United States Patent 9,328,346 (POLYCOMB-ASSOCIATED NON-CODING RNAS) - sequence listing, part 30

SEQ ID NO: 5075 - RNA, 211463 nt, Mus musculus
ccggcggcgcgggagccccgccucccggagugacgucugucggcaaccccccucuuucggcccccccgcgcccccucccccccggccggcuccccgcggccccggagguuucacugcacaacaagauggcggcggcggcggcgagcggagcuggcgggguugccguggccggagcagggggagccgggccggccggccgccugcugccuccgcccgccgcggggcccccggcagcccccgccgcagugcccccggccgccgucccggcgcgucccacagccccggccucccgcgggucgauggccgcucgcaucggcuacuacgagaucgaccgcaccaucggcaagggcaacuucgcuguggucaagcgggccacgcaccucgucaccaaggccaagguaguggcgcuggggaccgcgcggcugcgggcugcgcugcccggggggcguugcagcagggcgguggggccaggggaguccgcgauuccccggggcucgggucagggucagcaguggggaccggugcuggcgggagaaggcagggaccucagagcggagggguuccggaagggggggcuccgggaacuuagcagcuggacaucggagagguccccagggcugugcgcagggucggggggggggggugacuggaaaggaggcguuggaacucucugggggccggcggacugcacgccaggaagacuccggaaccagcaauuaggaaaccaucagaacgagggcaggggcauaugaaauguggaccacaggaugggggagacgcgcaaacuggcugccucaggcuucccaggacggcuggggcauggggcugagggugugcgguggggugcaagacaccgggaagagaaggaccuggcaccuauaccagagaaaggaauccacguuugauuauuuaagacggggagauggugucaguuguaagccugaggaaguauacuugauuaugggaagagucagugaagaaagcagggaaauaagggggaaaaaaauggaauggacccaugaccagaugucccaaggcucaggguuccuggugacacuagcuaaccaaggguuaaacaauuuaggauaagaugguuugcugguuauuuuuaguugucagagggucugaaauggugggcuuuuuagaacucggggugggcuuuucaguagggaagggaaccgugggauuggcacgacagaauuccacucauuugggcccuuugguucccaagggauuugaggagcuguaguagugaaacuggccaaggucaguuaggaaaccauguauguauacgcauguaguauauuuuuuaaaggacucagaggguagcacuuuuaccuaucuuucuucauugagaguaucaaggaaaaucauucaguuuugauggaagccacaaaacccauuugaauucccaacucgucuuugcucaauaccucacuuaaauggauacuuuuaacguaguagucauuccuuauauuuaaaacaguagcuugaguuuuucuuccgccuggcuaaugaaaaaccuuuacuaccuaagcaugcuccuccgggagacccaggacuccccuccccuccucccccuggccgcuguuuaccuuagccuaccuuguuuuggcuuuuauagcagucccucccugccaggacuuaucugggccucguauccugcuuauuggcaaccugaaaguuccuuuccuugccucucucugucaaagacuacaaggggcccuucuuccgaggguggcggcgggcagagugauuggucaguuucacuuccucuggugggaccccuucaagccucaagucuucagagcccugugacagacucaagugcgcccuccuguugcagucccucccucagguccgcagcuggagccgaagccggcaucuccuuacccccuacaguguguuuacuguuggccuagucaaacuuguguuuacaaacagaaugccucugucccuuguuuucucuccccugucugcuucugugguuauuuugcucugaccucugggaaauggacuccacaaacauaauugguugucuggcuacguucucuaugauuuaaagaaauuugaauuuuuauaucaaaauauugauuaaaaaaaaucuaugacaagcugguuugagugucuuauaaacauaacugcaaacaguugauucuuggcuuuauauauaaaagggacauuucuguuuucaguagucagcaaagccagggccuaauuaugguugguuugguugcuuucuaguguguguguguguguguguguguguguguguguguguguguuucaguuuccccugagaccuugguauccuuuaggacugcagccuuuacagcacuggcauguuuauagacgggugucacuguuuauguugguuuuuaucuuugaucguuuguggugugcaguuaugcaguuccuauguauggaaauauucagacuugaaugaggcugaaauggcugggacaaugaguugcauguguggaggagaccacaccagcguuuguuugugcuucuguagcaaugugcaguuuccuggcuccagcuccaagggcccuaucuuucugcuacuuaaaugacucugcugcgagugaagcucgauucacaaggcgcugucacgugcucagagugcuccaugggcauauuuuggcuugugcccugcuuaucugaauacauuuuggaaggguccuucagcacugacagcugagcugugcccagcagcugcugacauggguugggauggccuaguaaggccauggcuugguuauauaauggcagggaaggugccucgguccuagaaguugcuggagcugcuguuccuuccucaggagcuaggcucuccugcaguguuuaucucccgcagucaggucgaauagaggcaaaggauugcuuuucuucccuagcucuuucuacacuaaguuagucguuugccccuuuaaagguguaugcuuuuuuuuuucuuucuguuuccuucuuuaugucacugaauggucugagauuuucuucuaauccuguacaaaaaucagacacagguaauaaugacgaugcccaugucagcagaaggagguuaggcaauaggcauuuucuauacauuggagaacuauuuauaaaccccucuuccuacaugacccauuccaaggacuaagaagcuaaagcaaacuucauuuauugacuaagcuacugcacucuguccaacaauaagagaagcuggccccgguccaaacucuguuaacucaaacuucccagagcgaauaggauaaugaaaagaaaaggaaccaacgggaccccccccccuuuuuuuuccuuuucguuguugggaccuuugcagcgaggcucccccgugcugagucuugacaucccaucucugcagugccgccagccagcgucucugcagaaggcucacaggaaccacaggcucuggucagcuagcucaccccggcuuuguccuaccuacuuugauuuucuuuuuaaaaauuucuuuugagacacauugcccaagguucucugucuuuuuggcagaacaugauaaaauauuaagauuuuuaaaaaauauauauuucuccccuucucugauuacuuauggucuguuuccugugccuaauuguaccuucaagcuagcuggaugaacagaacaaagaauagcuacauucuguguauauuaaaaaaaacuucagcuuugccaaaaacagccugguuugauuugucugcugcuuaagacuggggcacugcugggcccugaauacuagcuaaaccucucugugcuuggauuucgucaucuacaaugggaugagaguagcacucaccccacaagcuucaguguuggguagauuaacugcgaugugcaaugcugcccaggcagugcuggcaugcaaggaguagguaagaaaugucgucauuuucuucaggugcaguagucaguaaggugaguaagacuggcgaggccccaccccccaccuuuuuuuuuuccccacucugggaagagcuauugaccucaagugccauugauucuggauagugagacacaagcugcaugccacacuuucauucaaggaggguugggggggaaacuacuguuucaagugcuacuuugaaguuccuccacgugguacucuguagucccagcuggucuggaacucuuggugaccuucuugcccucagaucccuugguguugggauuauagacaggagcuaccacaucgggcuaugaaauuuaugcagaacuguuuuucauuuaacuggauuuuauuuuaucuuuaauuguuuuuuaacaagagaccgaucugauaaacacauuggcuuuugcuuugggccaucucaaaauauuuacuuauuagcagugcuggggauugaacucagugacaugaggauuuguaccacagaugcacauccucaguccuuguguuugucucccccacccaccaagauguucaauguagcucaggcuagcccagaacuccauguguaaccuauagaggccuugaguuaaaagccucucuuguaucuccauucuccaguucucagauggcuggauucuagguuuguuacaugcuaugcuacauggauuuuuccuuucuuacuuuaaaaauuaucuucaaauuaacuaauuaauuuaaguguacgguacuuuguuggcauggcugucucuguaccaccugcaacugaugccccuggaggcuaggcaacaacauuggauuggcuggaacuuuugugagccauccgccuuaugggaguuggggagccuugguccccuggaagagcaccuagugcccuuaaccacugagccguuuuuccagccccacaucauuuccaugcuuugcuauagggcccugugugguccagucuguucuccaucccaccgcccccacggcaccggugugcugagauuuuaugcgggucuucaccuggcucagauugucauuguuuuuuuguaacuuaauuuuugccauacugaugaacaauuuuuuuuuuuuuugcaugcaauaguuucuucagagauugauucacuuaaaauucuguggaaaauaugaaaaauguuaccacacauuugcagcugggcuuaguggcacaugccugcaauccuagcacuugggaggcugaggcagcucaaguucaaggccacuuugagauucauagugagaccuugucacagagaacaaacaaaaucauuaucugccacccccaaacaaaauaauuugcacuuugcuuugcauacaggguaagauacuuagaaggguuagcuucuagcuuccuugcuugcucccauccucgcucuccccccacaaugcauucuaccauugaggauguauccucagcucaggaguuuaaaauuuacaugugucacagagaaaacauuuugcccuaaauccucauuccaaagcuuaucagugacauauuuucgaaggguguguuuacugcagacucaguucaugaagacuccgagccugacuucugucugccuguaaagaagagugccgcgaagcagaugaacacacgcaugugcccuuuagaaagcaggcacagagucuucaggagagagaagugaggagaggaguccacagcagcguuugcacgucugugguagggaugacagucccagcccuagacuacauagaggugaucgguaaagggugacccuugugauggggucuccccuuugcuugcccugugaggugcuaaggccauuuaggaccagccuuugccaacucagagccccaauauuccauuuucagcaucgacgauguuuauuuuaacauucugacguuugugccaacucccuagaaagucauagaucuggcucaagcuggaggugcccggaccaguugucucagggccagaaaugcuguuucauuucccaagcaucagucuggcuaguguguuuugaugcaugccauaaaauagagcaaaauccaugcucuggaaauaaaaagaaauguucuuuauuuacaagaggcucggaaguugggaaagguaccuaagacauuucugcugugaguagaauuuuccccauacccauucauucauucauucauucacucauucaggaguguuguuugaugggcuccagcuuuggaauacacuauugaaaaagagacacaaacaaacaaacaaacaaagccaccuggaauauacuuucauuuauuuugaaauacauccuagaggucagcccauccccaggagggauuaaaggccuguuccaccacacacugagcuggaauuuauuuuuaaauagauaaaugagauaagagaucccuacaaaacaacaaacaaacaaaaaaacucagucccagcuuuagaucccagugcucuggagacaggcuagcagagcucccuugaguuggagucuagccugguugacacaggaguucuagggcagccagggcuacacagagaaacccugucucagaaagccaaaaccaaaucaaaccaccacaacaaaaaaaccacuccucuguaccauggagaaaacgaaugggcuggcgacugugggaaggauguaacuucagauaggccacggaaagcaagauggagcuguggcugagaccugaauggugaggaaaacacagcuuugaaagauggagaagacagaacauccuuagcagaaggaauggcaaguguguagcuccuggagucagaaaggaccuuccaaagcuuggacccaaggccaugcggcuaaugcuucagauccaugguagggaugaguucagacagggacggggcuggauucugcagccuucuaguaugcauugagaauugccugugaccagaagguugacaucagagagcagcagagcaggacgggauaaucucugcuugguguguuuucaaaagcugugcuaauuauuuuauggcuaggagggaaaaaaaaaaaaccaaccuaucuaucuacuuaucuauugaggcaggggaggcaaacguuuaacaguguagauucucgucacuguuugagaaugccauacauguugcauacuaauaugacccuuguugaauuuauugggcacaaaaaggacaacaccaucuuacacaguagaugcguccuuaccucagucauauaggcaaggaaaagagaacucuuuauuuggaguuuuuaaauuuggucuugauuucuggcgugaguaauaccuguucucuguaugacuguccaucccucuuauuucagaguaacucccuuauugguguauuggagagcuggaguguuucauggaugacuuaugaugguguccagaguguauauagucuccugggcuuuuguccuuucguaguaaaucaucucugaguagauagccaaggcagugucugcggagccucugcugccuggggugaaggagcuccaaagcuguguuuaaccuguucagagcagaaucucgucagcuacugaggcgcuguugcaugggccaucaggagguuauuucuagcaagugugugacccuugguacacaaggacucuacuacucagauuuaagccuuucaaagagguaggagucagcuggguguggcacacaccugucaucccagcaguuugcagguggagggagggagacgagaguucaagguucuccugugaguggauugcuggauaauccaaguuuaaaucuuuuuuuuuuuuuuuuaaaaaaaggaaucagauugugagcacacgucacuuacaucucucagagaaucaauaggaaggagaagagaccccauugccucuuuagauuggucuuugugggcagggcuuacucagauggggaauuuuggcuaaaguuaaauuuagguuuugauuaagcaguucugcccaguuucagcucuaacaccagcucgccagcaguguguccuuucuuacagcucccugcaaaugugcacgucuagguucccauguucccuuuaccuuuucucucuccccuccccuucccuccccuccccuccccuccccuccccuccccuccccuccccuccccuccccuccccucccuuccuuuuuuuuuuuuuugagcaguauguucucauuacguagcugugucccuacgaccagcucaggcagaaacacacccuggguacagguggugcugacaacucuuuauccagauuucuucgcaaucuggcucuaauuucugguuugagggccaucuauacacgcucugcaucucuguccucagcucucaggugacagcugcauacacacauucacuacaacgccaggcuggccuggacuugucgugauccucuugcucugccuccugcuuacagugauuauagauguggccaccauagcuaguuuaugggugguggggacugaaccaaaggcguuacauagagagaguaugugggucugacugucuuuaaccuacuguauagaccaggcuggccucacagagaucugccugccucugcuuccaggaugcugauaucaaaggcauuugcuaccaugccggucagccugccuuccuauagcacccaggaccagcagccuagcaaacauuugaaaauagguacagggccuggcugagauggcuuugugcaucaaguccucgccguguaagugugaggacugaaucuguaucuggagcucccggagcauggcgcugucgugccgggagcagagguggggcucaggaacuaggcagccuggacugaucgcuccagguucugugagaaacccugucuauaaagagugggcuggaggggcuggagagauggcucagugguuaagaaugcuuccugcucuucuagaggaccuggauuugguucccagcauucccaccagguggcuuccacaggcaccuucacacuugugcaguguguucacacggguacacaugcaugaguacaaacaaugaaagaaaauauuaaacauaaaaaugaaguuggggaaugauagaagacacccguuauugaugucuggucuccccucgugcauacaugggugcacacaucuguacacacacgcacccccacacacauacacacaacuugugggaguggacuccucccuaccgugggggcuggaaauggggucagcaggucuggcaucaggggccuucacuugcugagccaucuuguuggcuccucugcauuucuuagcuguguuucauaaacauuugugacaauuucuuggaucaguuuaagggcuguuuauuuccuggaaaaccauuguuuuuaaaauuaaaaaaaaaagacaacuggcuaucuuuuauuguuugauaggauggcacaguuuaagaauuuaauacgauuauguaccuaguauuuaguaugauuuaaauaugcacugagugguggcguuuguggaggacuguagccauggcuccaugguuagacaagcugaugcugcucuuacagaggaccugaguucaguucucagcacucagucagauaccuugcaaccaucuguaucucuggcuccaggggccucugucaucucuggccucugugggcaccugcacacuaugugcuccccaccccauucguauaaauaaaaauaauuuuaaaaaauggaucuuaaaaaauauguggaaaaagauaaaaauugggguuuguuauauuuucauuuugggggguuauaaauuacauuuauggugugugugugugugugugugugugugugugugugugugugccugcucaugucucacuguguaauggaagucagagaaugccuuccgggaggucucuccuacccugugauccugggccugggcugggcugggcuggggugcagguuggcgagcccaacaagcccucacuuguucagccaggucucuggcccucauguauucaugugccagacugcccuugaacuuaacagguccaugugauccccuccguccauccuccugauagcuggggcucuaacauguaucacccuuccaggaggaaccccuugucuagguuauauguagguuauauguagguuauauguaaugcuagguuagggcucagacccagggucuggcgaacacuuggcaagcacuaccacagggcaacauccccagcccccugaaccucuugcuuuaaauggggggacgcuccuucaaaccccagccuuucugggguuuacuuaccuuaguuuacaccccagauauggucagugcggucauccagcaccccagcuuuccucuucugcugugaggugcuucucucugucaagcuguggucucuuccugaaagaacuucagaaugcuuguucuuugcuuuguaacuuacgugauccaacugaaaagacaaaacaagacagaaccccucaguuuuccaucacuggcugugaucuucgguucuuuaauuggucuuaacuguuuaugaaugaauucaacuaguauuccuugugccauguauauggaaaaaguagcagcuauugguacaaggagugagguauuauuauucucaggguagacaaacggugaaguuaaaggagcauuugaauagguguccccucuguuuucaagacggacagaggaccagaggacggaugagcagccgaguucauugcaguaugcuccuugaccucagcacacagucuguuuucacugccucucuccuaccaccuuccccuuuucuucucacaaaaauaacauugugcuccugaaacaacucugggaaaaaccaggaaauuaugaagaagcagacgggaaaaugucauccauaauucugccacccagagucgguaguuauugauacuguaaaacccucuugccagccuaggcauugaaaacuaguuaggguccuguuacaagugcuguuucugccuccugccccucuuuguacugucagcgggagccauucauaagcgucagcuucagugcgcauguaccucaggggcaugacuacugcuguuuuguuuguuuguuuugaggauuuuccacaguuuuuuauuucauaauuuuaauuuuuuuuuaaauguggcaauugcguuggcaccugaaucuuuagaauauuuuuuuuucuuuagauagauuguuaaaagugaaauuacugagccagagggcacacauguuugagagacaccggauacuuauauugccacauugcuuuccagaacgauugcaccaggguuagccuuggcagcagugggugagcaggccuccagcagcgggcagcucuggcuggcuggcuggcuggcugaccgggucccgcugccugcguuggcaugggggacuccuguucggaagagggguugcucgcccuuuucuagcuuuucagaggccuuucccugagcuagauuuguggaucuaaccccccaugacugcuaucgguucacccucugccugggccucucaccucucccgcgggcaugaaggacaggagacuguugaaggagacagaguccccaucacagagguaggcucuuuguugaccaccugaaccucuuuuguucuucuuuguuacuuauuuauuuacuuuuuuuuaaagauuuauuuauuuauuauauguaaguacauuguagcugucuucagacacuccagaagagggagucagaucuccuuaaggaugguugugagccaccauguggcugcugggauuugaacucuggaccuuuggaagagcagucggguacucuuacccacugagccaucucaccagccccuauuuauuuacuuuugagacaaggucucauuauguagucuaaacugaccucagacccaagcuccugccuuuaucuacagaugugggccacaguggccagcuuugguuuauggauuauuuuuauuguuuuuauuacucacuuguuuugaauuuucggccugaacaaaauccauacauuaucauugaggugcuuccucuuccccaaugugugcguaguguuggggaccaaguccaaagccugaaagugcacgccaggcaagugcucuaccacugagcugcauucagcuccugggaucacuuaacuuaaaaaagagaggcuuaaaaauacuuauuuuagccgggcgugguggcgcaugcguuaaucccagcacucgggaggcagaggcaggcagauuucugaguucaaggccagccuggucuacagagugaguuccaggacagccagggcuacacagagaaacccugucucaaaacacacacacacacacacacgauuuguauaucuguggagaauacggugaggugucugacccccucacagguauuugugagccacuucaguguugggauccgaacucuuguccuaaucaccacugagacaucuucccagcccagguacucuuuaaacccugcuguggguuucccugccuccuuuuucccuugcaguagguuaaagaaggacauugacuaauauuuggauguagggccaggggcuuuuucuuugcccugguugguuuccuucauuuuucuuuaaguacacuauaguucauuaugaauuccaggguugccuuguuuuugaaacaaaacaggaacucaggcauugauaaagugguguaaguuaagcccaugacuuuuaugugcccgcccgcccucccuccuuccaauuucuugcucacaucucacccauauguaauuugacuuuacuuuaaaaacuuuacugaauuuguuucaaguugaaagcuuaguuuuuaccaaagcauucucauaccccccccuaauuuuuaucauuuuaccugguauuuaauuaaaucacaucacaauuaguacaaauaggcaugaaaacaaacaaaaaccuagggacaggugugugacucggugguagugugugugucugucaugugugagcccguggguuccaccccagcacuggaaaggugcagacggcagcagugucagcaaaguccccaaguguacguagcugaugauggggguggaggauggggaggcugagcggucgguggggggugcaugguggcagcugcauauugugcuuugccugagauggccuauaagcacaucugagguaggugaaguuguaaacuagugagcgccuuuagaggaugucuucacggaugugucuuuaugagauaauuacugaacuucaaaaaucaacucagcaugcaaaacaauggguuucauuauaacauuuuuauacauacaugugcuuuuacuugaauuaauuuaaaauuguaaguacucuaaagcugcuaaggagcuugaagacaaaauauuuuacagaaguuuuuaugauccuauauacuuuugggugauauuuuuguccauuuauguuagaauuugcaugaaucaaacugaauuugauaaugggccacgauguuaaaaaaaaaaaaaaaaaaaaaaacucggaaggaaagagcuccccucugucucuagaugaaaagguuuguauccguucaugccaguguaguguuccauggaacaaauugacauuuucguguagcaacuuguuuucugucucuggcaggcaguccucuucggaugccacaagaaacagaauuguuuguauuguggaaggaaggcagaacagagcuguguguuucuuagauugcuccggcaccugcaggauuccuuacuucugucucugccuccugccuccuguuguccuccccuucugucaaaauguucccauguugcauaagcaguguucugacaauacgugagguuuaguagcucuuuuuuuuuuaaacccgcaaaauaauguuuuuagugauuguauguucuuggcuuccuuucuaaguucugacucaacagcccuacuguuccucuggcccaguggggugguuguauuugggcaugaucuuugugugccagucagcugcaggaucggggcuuuugcauauuguaccuaaauagcuucugugaauguaguuguucugggaggcaguuaaauguugagaugguauuuucggaucucuuuaaagaauauuacaaugccgaggaagaaaauagcuuguuugaagcuuguuacucaugagccccugacauggagacaggagccagugguuugagcccacuggcucugccuucacugacuuccuuuugagucagcagcuacaggcccugauuguaccaucaggggaaggggaggggcagaccaagccaccaucucugccaugugucaaugcugcugcugcuucguccuccuccuccuccuccucuuccucuucuucuucuuucuucuaugauuuauuugauauaugugaguacagugucacugucuucagacacaccagaagaggacaucggaucccauugcagaugguugugagccaccaugugguugcugggauuugaacucaggaccuucagaagagcagucagugcucuaaaucgcugagccaucuucccagccccagucaaugcuucuuaaugcucaagaccacaaauccauuuuugaagacauacuauauucuuuuuuuuauauaaaaacauuuguguguguguguguguuugugugugugguguugcucauggccuuuggcauaagcauggaggucagagggcagcuauuaggaguugguucucuucuuccaccaugaggcucucaaacucagguccuuuggguuagcuucaagcccuuuuacccacugagucaucuugccaacccuagaaucaaucaaucucucccccuccccaucucccucuuucugagacagggucucuguguguguagcccuggcuguccuggaacucacucuguagccucuaacucauagagauccuccugucucugccucccagguggagguugugcauuccccuccacuccaauuugaaaacauacuuguuccaguuguauccucuaaauuuccuuucuuacccagugucauuguucuguuuucccagcuccuugagggucccccuuuagccugucagauggccuaacguccccugcagcaguaaacaaugcugguggaguugaggaugcuucagcuccacuuggcgcucugcucgcgggcagcgccuugacuuugggcagcagcaggcuuugauauccgcuccuuuucauauaguucaggcacaggauagcuccuccaguuuaaauguuaagcguauugacaguugugcagccgucaccacuacacauuuaggacacuguauucuucucagaggucacuguucaucuccucagcucuacccccagucucaaggagugaccugucaacuccauagauuugccucuucgguuuuuucauauaaauggaguuuauguuacuuagccuuuuuuaucuggccuuuuucagggaguaaaguuuuuucaagguugauccacccagccuuuucuggaauuucauuucuuuucauagcagaguaguaguccucuggauagauagacaugcugcauuuuguuuaucuguauggauugcguguugucguguuuuuacucuuaggagugaugcuauuauaaguauucacauacaguuuuuuggggaguuguauguucuuauuucccuuguauagauaccucacaguagaauugcuugcucacauggugacuccaugaagaacugccaagugcuuucuagaguggcugccccgauuuacguccccaccagcaguuuaugaggguuuuaguuccuuuccugcccugguuucgucaucugcuggguaugaggcagcgcugcuuggagcuuuguagacucgagcuuccugacuaacggaggagcaucuguucacaugcaaaugacggcuugggagaaaugucacuucccuuccuuuucccggcuuacaguucccuugucuuccuugcugagcuaaauuuuaauuuuuuacuuuuuuauuguuuugagaaagagucuugguagggagcgcagguugauuacaaacccaccuugcuccugcugggcugcagagguggaccaccuaccuacucugcugagcuuagcuuaugguuucuucaccuguucuccauacacauuuuguauggacugacugauuuacagaucuucucccugaucuguggcuugucuuugacuuuuagcaguuuuccugccgcacugggauuuuacauuuugucuguuuucuuauuuguacagcaaguucaauucugaaauuauauguaaaguggucuuuucuguauguucagugagcugguuccuguuuucuuuccuuucuuuuguuuuuuuuuuuuuuuuuuuuuguuuuuucuuuuuccagagcugaggaccgaacccagggccuugugcuugcuaggcaagcgcucuaccacugagcuaaaucuccaaccccuuuuucuuuucuuucuuuuuuuuuucuuuugguuuuuuuguuucuuguuuuuugaaauaagguauuucaguguagcccuggcuauccuggaacuugcuguguagaccagggaucuccaacuuagauauccgccugccucugccucccgaaugcugggauuaacggcgugcucagccaggucugacugauuucuuauucuuauucaauucuuucuccugggcauuuaaaaaaaauucucaaagaugucaacacuuuaucuuucuaccuuauauaucuuauaaaauaauuaaauuuuguaaaauauagcaaagaaagugauggcucccacuccagagaaaacauauuuauaaccagauccccccuuuugagacugggucuuuuauauuuauuaucuauuauuguaaguggugugugugugugguguacauauuugggugcauguguauagaagaggguuuuuaaaugggcaggugaugcauccauacaaugcacagauuuucucucuguguuuuuguuuuccuuguugaccuugaacuacugacccuccagacaccaccucccaaguucuggauuauaggcaugugcuaccacaucuggccuuauuuauuuuuauuucgagacaagguaucacucuguaaccuaggcugguuuggaacucauuguguaguccagugugacucugaaauuagaguaaucauguugccaugaggauaguguuucacaccacuccaugucucuuauauuuuucuuucucuuccacuauguucccugagccuuggagggcgugguauagacauuccaucuguggcugagcacucuacaaucucuuauucucaccacuugugagccuuugccgacuucaaagagaagauccucugacccaggcugagagcugcccuaaucuauggguauaaacauaaauauuuagaaggcaguaugacgucauguccauuuagcauuuacuaggaaggucccgccccagugcuaaugagcuuccugggcaugcacgucuguucagguuuguaguacugggagugaguuuucugguguaguggccucaacuccaguuagaaggucuugguuaccgccuuaauagucaugccacuguugggccagugggugugucucuacuggcaguuuuuaauuguauacaguuuguagaguucccagcugguuacggcaguuaaugucuuucucuuccagcagccuacauagcguuuuccagcucuaggaaagcuaacucucaggagggggcuuccagucuaguuccaccuuguuucugaagaacuucuuauaguauacguaguucuggcuugaucuuuacuuuguuuguuuguuugcuguuugagacaggauuucauguagaccaugcuggccuugaacucacccuauaccacaggaugaaccugaacuucuaaucuucccaccucuaccucuuaaguacugggguugcaggugugugccacacccaguuccuggggugcugaagauggaucugagccacugcucugccagcugugucacugcccuagcgucuggcucggacugucuuuaaaccucacuccaggcuugcgggaugacuggaaggcuaagaucacuuacuacugucugagaagucagcuuuuagcaggaugagguagcucaggccuuuauuaaucggagcacucagaagacaaaggcagguggagcucugggaguuggaggcuagcugcucuacagagugagcuccugaacagccagggcuacaggagugaaaccccgacuuacaaacuuuaaaagggggaaaagaaacaaaaugaaagaaaaaagaacugagcuucuugcacuggcauagaaugccucccaaccaccuguacugugaguuccuaacugacuuuuuccggcaaauggcaccuacgcucaauuacacccacuguguaugccacacaaacauaguauuaaaucaugucuaaauagaaauaaaaucagucuuuaaaaaagucucccucguuacuuugggaauguuuagaaaaaagaaaucuguuuuuuuucccccucaauuuucuuucucauuuagaaaaugauuucucuuuauuuauguauauugauguucugcuuauguguauguaugugugaaggugucugaucccuaagaacuggaguuacagauaauugugagcugccaugugugugcugggaauugaacccagaugcucuggaagagcagccagugcucuuaagcacugggccucucucucuccagcuuccucaguuuguaaugggaggggagcaggaagagcaucaggauaguugaguuggugcuggguuaccuacagagaagggaguggaaggccaucagccugacaguguuaaggagggagggggugacguggccgaugcuguagugccagcaggcagagcgcugcggauucaagaguuccaguuccuccuggcuauauagugagaccguugaaccuuuucacccuccuuaaagagguugcaggaguucaguuuagugaccuugauuucucaccuugggccuggcaugucaccuucgugugauaaguaguacugcaguuacauacuggguagcuucuuguggaguuuaggaaacugcugaaaaaaaaaaaucacaguuucuguaccguggccucuuuaucucuguaaaacauuagacauuccuaaacuaugaacuagagcauucucuuggacuccacuaaugucuuucuccugcacagccaacuucaggguucccuuagagaccuuuagugaagucuggagaagagagccauuggaagcgccaugcuuuuugugauuccauucuuguuuucguuuugauuggaaaguucuagagugcuuccaugaaguuccauuaauucuaaaaaacgaaaaacaaccaaccaaccccccccccaagcucuuauauuuacaaguauaguuuugcauuucuccuuuucuuuaaaacaacagagguucugaugaaccuucagacuugccuuaguaaaccuaaccuuggauuucagaauuacuaaaggagaaaaauaaaucaaguagguuuguuugggacccuuggucuccacccugcaguuaagugccacugaaaauaacccuggaauaaagaguuuuuuauguggcaagucuuccuucuugaguuuucucugggcagagaacgggcuccuuuucuugcagauguucguuuuucucaaugcucgucuuaacggagaggcuuugcaccucagugagcagugcgucaggagaaguuagcuggcuccuguugauuuguugccccgagauuuacugugcuugcaaagcaccuguccgcacuggaguuaugcugccuggccggccggccggccggcuuuuacacuugguuccaggagaggcagcuaccuguuggaacacaagagaaagagaaagaggagccagcaaaucucuaucugcuuucacagaagaggcuuuccaauuagaaagcuuucguaggcuuaaccuucuugcccuaaaguaacccaguguuucauuauggauucugcugagguuuuggggcucagugccaggagggagaggacuaagaaggaaugugaagggaacauucagaggauggagcccagcguccacaaagugcugcuucauagacuugcuccaaaaauaacgugcucaccguaggggagccagaagagaggugcggucgcugcacuuuugggcagugucaggggcugggguguugcuccagugugauuagagcuauguuucagaugaugucauuuaaaauuuuauguuuggagaacauugucuuuggaaauuaagggggagaaaaaggucuauuugguuuuauuuuauuuguauaaguguuuguaugucugugcauccacuugcauucuguugccuaucggagacgagaagagguugucugaugcucugaaucugcaguuagagguggcugugagccaucauguggaugcuaggaccugaacugugguccuccgaaagugcagcuggugcucuuaacuacuaagcagguuuuuuaaucccugccucuggaaauguuauuuacccccaugcaaaagcuauucagcaaaguuuagaggacuauccuuccagauuggaggaaguucaucucuccgaacaggggcagugcucugcaugguagucacuuaauccuugaaguucagguuaagagcuugcuucgaucuuguaggccuugagcgauuaggauuugauuuagaaaaguuagcauuggauguaaccgcuccaugcccugaagguaggaaguguuauaguucagaggccccuucuaaguaagcuuagaguuauaaauaacauugaguguggaaaugccuugcacacagacucauaauuagcaagucaggaaguuugacuagaaggaauaaauuaaccucaguugcugauggagugagaucauggagggagcauagcuguuaagugucauguucaagcuggcccaggaagugacuugucagacuugcuggccaccucaugcugccuuggccuaucggcauuuaguauguaguagaagaaaugauguugcuucaccauuuauagaaaauaaggguuccaaguggcaguggcugagagaagcccuccagguugccucccagaggcaguggaucucauaacugucuucaagaguguugauuuuuuuccuuuuucuuaaaaacaaaaacaaaaaaacaaaaaucgaaacaaaacaagccaaacagugguggcucaugucuuuaauccuagcuauugggaggcagggacaggugggucuuugugaguucgaggccagccuggucuacagauagaguuccagaacagccagggcuauacagagagaucccguuucaaaaaaccaaaaccaagcaaccaaagaccaacaacaaacuuuuuuuuuuuuaaauuucaaaacagggccucacuggacuggguaaucauggcuguucuagaacucacuauguagaccaggcuggucuuggacuaacagauccuccugucucugcccccugagagcuggugucaaggacauguaccaccacaccugcucgcucccuuccuuccuuccuuccuuccuuccuuccuuccuuccuuccuuucuuucuuucuuucuuucuuucuuucuuccuuucuccugacuguuagagauugaaccuagcuaaggaaggaagcacucggccgccaagcacacccccagccuccugagguauuuuggguauggccauuauucacucucuuaaaguaggcgauccacacagcuguguaguccuacccauaccuucuuuucugguaucuggaguguuucucugcuagccuugggaggagcucucuccuuccucuuuucucuuacaugaaagggccugguuuacuuuuaacuauugaguuacuuucaaucuauugcugauuaaaaaaaccagagggagguuuuuuuuuuuuaaauauuuuuuauuagguauuuuccucauuuacauuuccaaugcuaucccaaaagucccccauaugccccccacuccccuacccacccauucccacuuuuuuuuagauuuauuuauuauauguaaguacacuguagcugccuucagacacuccagaagagggaaucagaucucguuacggaugguuuugagccaccaugugguugcugggauuugaacuccagaccuuuggaagagcagucgggugcucuuacccacugagccaucucaccagcccccccauucccacuuuuuuggcccuggcguuccccuguacuggggcauauaaaguuugcaaguccaauggaccucucuuuccagugauggcugacuaggccaucuuuugauacauaugcagcuagagucaagaagagagugccgccuauagcccagguuggccuugaauuuuauacccaaggaugaccaaaacuuuugauccuuuuccucuacuucugagugcugggaaugcaggcuugcgccacaggcgguguuguuuguuuguuuguucugugccacacugaggaccagaucuugggccuugugcauguuaggcaaucaccaccuaagccacagcccuagcaccuaacugucucuguuacaguuuuguguauugauuaggaacuuuuaagucauaauagaaacuuguuauaauuaaauccauauaacauggucauacguuucuuauuuaagccugccugugucuaugagguaaaugcauuauuuuacauuaguuuguuuuacaguaauugggaaucacacccaggucccggcacacgugccaggaaaguacucuaaguuccucccacagccuagagcagcacucuaccccucagagguguagggggaaccaaagucagagaagucccaucucucugaauccccgugagcauagguccugcugcacaucuguaagagaggaguaggggaaggcaggaaccugucauccuagaaagcaggguccugcuugcuaagucggagaagacuagauaucagucugugacagaaaugguguguggggcuggaagaccuucaagaccuacugcugccucgaaguacagagugugguaaaccaaaacaugggggcucuugagaaaucugggauguucagcccucccuagaagacucuaagccaaacggcuuucaaauuugcucuaggaauguguuggccugaggccauaaaagaagaauucagcuaaccuuggaaacaggguuuucuuagcagccucgagguuagggaggggaugauacggugcuaaggacgaggccuggcgguggcuaguuuggaccucacagcagagccuucuuccuuuggagaccucuuggaauucuaggcaggagguaacucaucccacagcuggggugcagagaggaagaugcaagcugagcugacugacuaauacgguuccuacugucuacagcucacagucccucugccuuuacugccaucugcagagccccacuccauccucugugcuucauggaguuccuucuaggcccuccacagcagugcagggugagaguccccaguuccaucgagggcagcagguguuaagcuguaacuuguucagauccuuauguguuuuaaguagcggagcugagaggcauaggugggucuguauuauuguaaacucuugcugauagucaggcagcuguugccagagcugaauuccaguuucaacuguaccuagccagaaucucuacaguguucuccauaaaggugucacuguguagccugcuguggaugaaagacuagaagaaaccccaaggaacauaauuaauggaggcacugaauauguauauuacauagggguagggcuggugagacgguuuagugguuaagagacacaccaccagccgggcgugguggcgcacgccuuuaaucccagcacucgggaggcagaggaaggcggauuucugaguucgaggccagccuggucuacaaagugaguuccaggacagccagggcuauacagagaaacccugucucgaaaaaccaaaaaaaaaaaagagacacaccaccaagcgugacaaucccagacccaggagcuuacgugguagaaggagaaaaccaauuccugaaacuuguccucuuccacaugugugcugugacuuguacaugcacacaggugcgcaugcaacugcccguguacaaaauaauuacauauuuaauuuuuuuuuuuuuuugagacaggguuugucuguguaguuuuguaugucauggaacacacucacucuauagaucaggcuggucuugaacucagagaucuaccuguaucugccuccuaagugcugaaauuaaagguaugcauaaccauugccaaaaauugucuggcaauuuuuacuauuuuuaaagguguggcuuuaauauacauuuaguucugucucugaguccuucugcauagagguuaaagcuuuccugaggugcagugguagugugggcucucagcuuuugguuuuuuuuuuuguuuguuuuuuguuuuuugagacaggguuuuucuguauagcccuggcugucccggaacucacuuuguagaccaggcuggccucgaacucagaaaucugccugccucugccuccuaagugcugggaucaaaggcgugcgccaccgcgcccggcggcucucagcuuuugauuuaggagguguuauugcgugucaguaugcauggaaaccuguaaucauaaccauggauucucccaucccgaaguuugaggacggaaagguucaaacugucacgugcccaucggcuuuucugugcccaaugucagcauugaccugcaaucuugaguacuuuuuggguaacaccuuugauguacuuccagggaccauuguggggagcguuaauaugggagggugauguuucgaugagguaaucgcuuagaaacugauucagcauuagucaugggcuuuccugcuagguuccauucuccugucucuugccuuaauuguccuaauugagucuaagccauuuaauuacacaaccacugaggagacugacugaccuuuaguggucucccaguggcacuggcagguagcaaaagcauuccucuguaucaguuaguguugguucugucuggggaauguuaguacacuuucuggguugcgcucagcaaccuuacaaagacaaauaaccaugccaggaaagcgcguuuacaguuuuuuuuuuuuuuuuuuuucauauguuuuuuuuuuuaagauuuauuuauuuauuauauguaaguacacuguagcugucuucagacacuccagaagagggcgucagaucuuguuacagauggcugugagccaccaugugguugcugggauuugaacucuggaccuucggaagaacagucgggugcucuuacccacugagccaucucaccagcccgcguuuacaguuuuaaguaguggucuuuaacaaguggcaguguagaauagggacuggugagaggauuggaugcccuuucagaggaccugaguuccucuccuauauggaagcucacaaccagcuguuacuccaguuccaugggauccgauauccucuuucuggccccugcuagcaccaggcagacacagggggcacaagcaugcacacaaucaaaauaccuguauacauuaauuaaauaaauaaaucuuuuagaaaguggcagugugaaauuagugagggucucacguguuuugauggucacucuuacuuauccugaguccaaugucucggaaagaacaggacccauccuccuagcccuccuaauagcuuuuuaaaguuccuuuucacuuacguggcucuugucgacucucgcuuuucacggacugcacuacuuuuccugauuaagauguucagugcuuauuuguagaccgacucacacgacucgcuguggccugacugcuucuguguaguguuuuaccugcucaggucuaaaaagggcagaggugauacuugucucuagugcugagcccaaggaagugggcaauuagagaaggguuuucauuccguuugucuugaugaaauccauggucacuagcugcuggggcuuagaugcagugaugagauucuaucugucccccaaaagaauuucuucuggggacuggagacagacguaguucagcguaaacauugugcuuaguugugcaaggcccuagguucaguuccccaguacccagaagaaauucaccugugucuguuguuuauucugaaguugaagggaaaugacccuauagauaccuauagacuaucugcauucauguuacugucuagcgauaggguguaugugaggugauuauugccuagcuucugaacucguuccccugugacuacgaaaaaaauuaaacuagagugguggcacaugcccuguccuccgccuggaaggcagaggacaaggaucucucuugaguucaaggccagucuaagcuaaacagugagacccagucucaaaaaccaaaccaaaccaccagaauaaagaaaaacuacuguugaacucucagcaauuugcuccgauuucuuuuggcuuguguacauacuacuaugcauuaauuuaugaauuuuaaaaaagaaaguaacucacuuaaaaugggagacugacaaauguaguaacauagcguggaaaagugagcucugcgggagccuccuagugggccagcgugcuguccgugugcgaaggaagcguugaaguccccgguagcaccuguucguagcagcucaagccugaaggaagcacccaugugacugagcgcaugcuuuuuggaaugugccgaaagcucuuggggaauugcagacagcauugcugggaauuuggaggggcguuuucuugaauaggaaggcaggagaugccuuuggcccacaccuaggaaucucaccaagacacuguggagcaggaggaaagcucacggccauccugcaauaauccuaaacugugauucggaacaaacuaacuccuaaaaauauaugauagacauuuuugggagauuuacuauugacuggcugucugguuuccccccugggugggacaguacuguuaacgcucuuaccuuuagaagggugugguauacuggauugcaugggugacaggcugucuggaaucugcuaggaagaugaagcacaggccaugcacuuacugagauugggcuaaguuggcuguuggccauagaaggcucaugggauuuaauuuuaucugcuccccauauauaugguugaaaaguuccauaaacaccagaaaguccacgaagacgaaauauccaaaaccugguuccgucuccuucuccuccaucuuccugucccuagaugggacguugcugaauuucaccccuagaguuggccccuuugcccucuuggaauuguagaaccgguaacaagauggcacacugguugagcaaugaagaagacuucagccaauaggagaagcgggagauaaacucuaagucaaacuuuucggccuuuauucuguaaguagagcuguagauuaguaauaaagagaggaaugcucuucuuuuuuuuuuuuuuuuuuuaauuugugauuuuccaagaauuaacuaacuaucucucucucucaaaauaauguucuccaggugucagcaugguagcugucacuugccaugacuccagagugugugcuguugugcauauauauagcauuacaguggagacugagguugucugggggccacuuuggcagcuaucuuacauccuaccaguuugggccagccugcaucaagagggacuuaaagccugugaucauccuuucucacagacaaacaagauaaagaccagguagacauucagccaggucauguagaguaggccacagcuuuuuaaauuguggggaacaauccgggagucacugaauaacugaaugcaggaauugugagacuugggguacaagguuucugaacucacaguuacuuaaucuucagaauggaaacaaugaggaaucagcugaaccugccagcacucagcguuuaaucucaggacuugacuuuagcccucauuaagaaaacagcguaccaacaaacacucagaaacaccuaagcucggauuuggaaugauugcacacacagucggcugcucgcauagaaauguaauaguuugauuauagaaagcaaaggccugucgggcagugguggagcaccccuuuaaucccagcacuugggaggcagaggcaggcggauuucugaguuugaggccagccuggugguuuacagaguaaguuccaggacagcuaggacuacacagagaaacacugugacgaaaaaccgaaccaaccaaacaaacaaaaaaagcaaaggccaucuuuuccucuuagugugucuuuacauuguaucguguuguguuagaauguuuaccuuuaaaaauagucggcuguuguuguuuuguuuuucuagacaagguuuugcuguguagcccuggcugucuuggaacuuacucuguagaccaggcaggccuugaacucacagagaucugccuacuuaugcccacaccucccacauaauagaauuaaaggcauaacaaugucuacccaaaaauagcuuuuugaguugcuggucuguauuucauuuaaaaaaauaaaaacaaacaaaauacuggacaugugacacaggguguaguuguauacaccacuaaucucaguauuggaggcugaggcaggcagaucucugaguucaaggccagccuggucuacagagugaguuccaggaaauccagaacuacacagagaaacccugccuugaaaaaaaaaaaaaaagaaaagaaacaaaaacaaaaauuaaaaccugaaggugcuggagauggcuuacaggugaagaacauuauuauguuuuaguccucugacucugaacagcugguuuggcgacgagagccuuuacaagcugagccaccuugcugaccuaagagagaacauuugguuuagaaauaaguguuuuuauuggguuuguagguaguuuuagaaaucauuuuuaaaaauaaaaugugagaacuggacuuuggacacuaagauaacacuuauuacaaagccuggugacaugaguuuaacucugcagaccuacacgguguugggaaagaggagacgaccccagguucugaccaccacacugauguaauuuuagaaagggguggggaaauuagaugugugagcaguacaggcuguuuccugcagauggaauggggucagaugaugaaggcugaguggcugagguguucugacuucaucuugcaacuguagggagccauuuuugacacaugagaugugcuaauauucaguuuugaugucauuguguguucuugguggugugucuugguagagaugaugguauuggcuguguagucuuaaaguucuuuuaaacagauacuuccauagcaucugaaggauuucucuguuuugaaucaggaggugggaccgaggcauauagagguaugugaacuuaauuauguuaagggcaggcagaucccaguucagccucuuaaugauccuuaucuuccauagugcugaucucaaguauuucuugcuuuuuuaaaaaaguucugucugucugucugucugucugucugugccuuugcccuggaagucuuccuguuugaccucucaagugcugggauaauggguaugucccaccaugcuuggcuauguuaauauccuuaaucugauugguauaauuugcauaccauaaaaucgaaccauuguacccaaggagcuaaaggggucugcaacccuauagguggaauaacaguaugaacuaaccaguacccccagagcucaugucucuagcugcauauguagcagaagauggccuagucggccaucaguggaaagagaggcccaucggucuugcaaacuuuauaugccucaguacaggggaacgccagggccaagaagugggaguuggggugggggaggguuuggggggacuuuugggauagcauuagaaauguaaaugaagaaaauaccuaauaaaaauauucauuuuuuaaaaauugaaccauuuuuaguaugcaaguugauauuuuaacugguggcacacaccagcagaucucuugaguuugaagcagccuggucuacauggagaguucuaggacagccagggcuaaacagagaaaauucugucuuggaaaaaccaaaaaaauaaaaacaaauaaaauaaaaaaucauauuuuacaacuuauaagcccauuuaaugagcacaucucaagauauagacaaaucuuaccaaaaguuucuuagcguuguuugcauuuagucccgcugugcugcacugccagaaaaaauagucaucucggucagcacagaugggcugccucccugucuggugauucauccauuguucucaucuguaugaaggcucugcauguuucugcccaguaauccuaggguguguaggugccaccugcucugucuacuuccucacccacugaugagcaccuggguccuuucuggucugcagcuggcacagauaaagcucccagguguugccagguguuguugguaggcuuaugcuuaccuuuaaguuuauguuuaguuuaaagaacugccauucucaugacaggcucagguacacaaaaaucccuacccgucacuccaugaugaugauguuuuaauuuuuuaaaaaauuacauucauguguacacacaucugugcaugagcaugugccauagagaguauguguaugucagaggacaacuugaaagaguuaguuuuguuuuuucaagacacaaggggccugguggggguggggcucaaacucagguugucagucguggcaggaaagggcuuuaccuggugaguaagcuggcccaucaucuucuaacuuuuagugguaguuguacaugcuauuucacagugucacuuuguacuuuccuauugacaaaugauauugaauaccuuuuaauguacuuauuugccaacugaauaucgacauugguagguauucguacaauuuuuuuuggccuauuaaaaaaaaaaccuuugugguuauuuuuuuguggugcuagacauugagccuagggcuuagggccuugagcccgccaagcauaagcuuuggcccucggccacgcccuccgacuugaugcauuuuaaagguauauagacuuacugaguuuagcagacucuucuauuaugguaugucuuuuuuuuuuuaagauuuacuuauuuguuuuauguacaugaguacaccaccauugcucucuucagacacaccagaagaagagggcaucggaucccauuacagaugguugugagccaccaugugauugcugggaauugaacucaggaccucuggaagagcaguuggugcucuuaaccacugagccaucuuuccacaucuuuccagcccaugguauaagacuuuaucacucagugcuucacaaauauguguauuaucuuuuuguucucacaaaggugucuuuuuaugaguaaauauuuuucuagaauuuauacguacauaauauaaauuuauuuucuauuuauguguuuguaugggcaaauacaaugaguccaaguacucaagcagaccggaagcuccgccagagcuggaguucccagcggauguggaccaccugccaugggugcugggaacugaauucacuuucucugcaaaagcagcaugagcucauagccacugcccucucccaccgcccacccaccgcaggagcaagaguuuucauucugaauuccaguugcucuuuugcucuuuguuuccucuuuuaaagucccagcacucgggaggcagaggcagguggauuucugauuucgaggccagcauggucuacagagugaguuccaggacagccagggcuacacagagaaacccugucucgaaaaaccaaaaauaaauaaauaaauaaauaaauaaauaaauaaauaaauaaauguuguuuuaaccccucucccucucccuuucccucucucucccucucucucucucucucucucucucucucugugugugugugugugugugugugugugugugugugcagguuucuguggagggcagaaaaggggguuggguccccuggagcuggaguuacuggugggcaugaccugccagcuguggaugcugggagcaaaauuccccuugucuggaaaagaaacaaaugcuuugaccauugagccaucucuucugcccauucauuuuuucucuuaugaauuauguuaaucauaucuaagaaacuaucuuccgucuacuguuacuucugcaccucauugucugggacccaaaaaggcuuagcagagucuguaaauuuuccagacucucuacagaacacagugucugccagugugucagagacucucuagccaacaaaggugagaagcccaaggcacagaugcuggcaauguggcucugaggaaggagccuacaaagauaagggaugagcugagaauauaccgaauaugccagacuucuggccaaagagcacaagagcuuguaaguccugucagaaacaaaguucuugaagaauaacaaagccgguugggcagugaggccagccuggucuacagagugaguuccaggauggccaggggggaccacacagagaaaugcugccuagaaacaaacaaacacacacacacacacacacacacacacacacgcacacgcacacgcacacacacacacacacacacacacacacauauaaucagacuuugagaaaguguuggcucauaggacaggauaaaccugguuaaagccaauuuaugaagauugaacaaaagaaauauagaaaagaaaagccagguauagcaguguacaguuguaauuccagcaguuuggggcagaggggagaaaguccuugugaguucaaggcuagccugagcugcacagugaggcccuaucucaagcagugaacugugguuccagccugugccagugcauuuaucaggagcacagagugugacagguggugaaauacugaauugcugcaaaggugaaauggccguagagcagggaggacacagaccucaucucuguccccaagguggcugagucaguagucucaggaugacggaaaagggacggagaauggaaggaaggaggugugugugcugguaagguggcacacagaguaaggcucuggagugugugccacucuuacagaagccccgaggucaguucccagugaaggcucaccucaccgacuguguguaacuccugcuccggggcuucuaaugcccucuucugggcaccuucagucacaaguguauauucacccagacacauauacauagaguugaaaaaaauaugaaaugaaucuugagaaaaaagaauggaaacaugcaauaauuaaaaaaagaagaagaagaagaaaguguagaaaagaaagguuaaguguggggccgugaacguggccggucccugcugcaggccucaguugguauucagcacguccuuggcccucacugacaauuacauuuggggguaguuuggcucucagcauagcagcgaucccaaccucaaaaacauugaagaauuuugacuuaguuuuaauuguuuuucuccaaaucacucugaaguacucagugcuuuaaagaaaaugacaucauuauuaaucaguaugugggucuguaagucaaggcaguuugcagggguugauucuccuccucuacuauguggaucucaggaugaaacuuaggucaccaggccugcugcaaggccugcauccagcaagccacugugcugcccccuaagagcucacugugcagaguaggcuggccuugaacccacagagaucuccugaacucugcuucuacagugcugggcugaggauguggccagugcuuaccuagccugugcuagcuagugcucacuagccugugcuagcuagugcuugccuagcccuugcuagcuagugcuugcuagccugugcaagguccugguuucauuuucaguaucacaggcaaagaaaaaaccaaaaacaaacccuucauuaguuuguaauugggagugagugauaaggcacacacacgggcaauaacuaaauacacacauuuuugguuuugguuuuaugagauggggucccucaucccaguuguucuggaacucaccacguaguucugcugccucuaccugcaguaaagacgugugccaccuacacgugcuuaagaaaccugaaagccugcauaagucuuaggaugauuuuauuucuuuuaauuuuuuuuaaacacaugguuuucucagcaaacuaggcaaggguuuaccuuuugaaaaaggugggaguaggcgcugagagucaccuggcagcgagcgaacucuagcuuggucaggugagaaugggacucuguggcccugagcagggugcucugagggaguaaaaauggcugcuacauguguggagugcggcaagaaaucuuuuauuugggggaacuccaaacucacucauuuuggccucacuguggauaaggaucuucugaggcucggguacugaucguuagcuugaaccucuuucgagcucacucuaggagagggaaggguacuucagcaacuggaguuugucacuugccacuuuacugacaucacagugcacugacauucuagggauagcguugggcaggucgauguggaauacacuuguguggagaguaagggacaaaaccccucaguccugcuguucauuaggacagcugagcguuucaaagcgcacccuauagaaaacuugucauuguauauucugagucauccaggcggaacugauagcccaaccucaugaaaggagcagaaagccaaguuagagucacaguaugcgaucucaccauuagucuugccucacauggucuuagggacuugaguagguuccauguuucccacaguaguuuagggaguuaaacagguagcugagcugcagauagaagacuugccggcugcuuauaugaaccuuucgguuuuuuucuggacaaaucaucuucuugcagguguguguguguaucagagacacacagacagacggacacauacagagggagacuuucuuuagcccaagcugcccugaagcuguagcucaggcugccucacacccucagcagacgugaguguaggccaggucagagcugcccaugcuaagggauuugggauuagucagaagugacaaauggcucaaacauuuuuuuccagguuagugacugagaaaugauucagaauugaaacugaaaugaauuuuaaguugcuauauuuccuuuagugacuuuuaaacaguugcugucacugucaggcguauuuuggacauaugggcuucauuuugggccaauauuuuguauuauguuguuaaauaucuugacagguuuaguuaguuuacucuugaauugagacuggccauuggaaucugaauuugguggcccauuuggaaaggacagaguugacauguucuuauuuuaagaaucuuaggaaaaauaugauacugugagaguauauuuucuaaaugucauaauauuuggggucaaauaauugccuugggaauucaugaagcacauguuuucuacugaggauauuauucuaccgaaauauuagucuuucuguuucacugaaaauguauauaugcaaugcaucuguccaugcauauacuauagcacuaauuuuaaaguaaaaugaaaguagaacaauguggaaaguauuguuuguauccagucauuaacauguaagacauauaggucuuaauuguagcccagcuucauccuccacaguuaacaacuauuagcaguuugguuuguguucuuccauacuuuuuuuuuuuuuuuuuuuuuuuuuuuugguauacacaaaguauaaaguauuaacagguagauuuugggggaaucuaucuaucuaucucuacuuacaguuuuuuugagacaggguuucucuguguagccuuggcuguccuggucuguguagaccaggcuggccucaaacucauacaucucccuaccucuucugaaauuaaagguguaugccaccguugucccgcauuuggaguuuuguuuuaaauugucucuuggcauauguaucuaaaaucugcuuuguuuugcuauccccgcuuuucugauugcuuaaaaaauguaccuaacuuuuguguauggauauuuugcuugcaugugagguuaugcacuaauguguaugccuggggccuguggaggucagagacggucagaggagcccaugaaggucagaggagcccaugaaggucagaggagcccaugaaggucagaggagcccauagaggucagaagaggucagaggagcccauggaggucagagaagguccugaaguuaggauuaggaugguucugagcugccaagugagugcugggagucacacccugguucucugcaagaccaacaaguucuccccaggcgugguggcacaugccuuuaaucccagaggcaggcggauuuccgaguucaaggccagccuggucuacagagugaguuccagaucaggcagggcuacacagagaaacccugucucggaaaacaaacaaagaccaacaaguucuuuaaaccacugaaccacccuuccagcuuccuuucugcuagccuguugaagccaucccuuccuuccuuuguuccucucaugacagaucugcuguacugcucagguuggccauacacugugauccuccugccucacccauacauguacagauauuacagguacuacaccuucccugucugucuaucuaucuagcugucugucuauccaucuagcuaguccucucucucucucacucucucuuucucucucuacuguucaucuaaagagguaagaguuuugcugugcugccuggguaguucuuggacucaaacagucugcaugccucugccugccccauccuauaaguagcuggauuuacagccacacuccagcauacacugccgaauguuuaaguuuggaauuccugugaaaugguguuccauuuauaagagucagacuuacaaaggauugauuaacaguugcccuaauaacucaucauuuauucaccuacuggaaaugggcuugcuguauacggcauaugucacuuauucuuguguuuguccuucacuguuuuuuuuuguuuuguuuuuuuuuuaaaacaguuuuucuauguaguccuuacugucuuggaacucucuuuguagaccaggcugcucugcaaaggcaugcaccaccaggccuggccacauuucauguuuuaaugcuuuaccgaguauaguaaauucaugaccuuuauaggugacaaaguauguauucugaguagacugugacugucagcagauaguaacuugggucucugcaguagcuauaguguuaguguugaacaaaaguuaccccauaauaccaguuaaaguuacccgauaauauucaguuaagcccuucugaacguuaguauucauggaaaucacccaggaauguuacugaaguccagaugcguaggugugccuccagcaacgauugguagguucacagaccuuugaguaagggagggugacauccccugaacacuuaauuugucccagucacccuguuccaacacuuacauguuagagcucauuuugauguccuaacaguuccaugacguuaauccccaguugucagugaggaaguagaaagcuacaagacuuuauaccgugccccaaaggcacacgcaguuagcagaggggccucacugagcccaagagcuccuguacuccuagccucuacuacacuaucaggaggauugcagcuaguguuguggguuuuguuauuuggggauuucuguucccaaauaaaagacacaaacucuuuauauuuaagauaagccuuaaagcacuagagcuggaugcuuggugcuauuuugucuacuucugucaauaauccugagauaucccuugccauguccuuccugggccgcuccuccuccagcaggcuggcccucaugccuuuuuuuuuuuuuuuuucuccucaugaccucuaccucagauuccaagcucaggagccgaagcccugccuaucucucuucugcacagcuacaggcuguagccaucuuuauucuuccagcaguuuuaaauuuaggagcaagguuuguacaacaaaggcuaguguacaugagaauucacuuggcucuuggggcgacuagaccuugggauacagaguuuaguguuacaauacacagcaagaagagcgagccucagcaagccaguuuacucgucugugcucagagggcaaugacuuuaaugccucuguggacggcuuaauccucccgcacucacuugcuauugcagugccguacuauugcaguuugacuguugagcaaggcccuguguuuuacuuauuuauuucuucuuccuccucaucccaugcugcucuuaacuguuuccuugacuuugacuuugccagaaugucauacuggagccgucuagagcguagccuuuccagagaggcuuucuguuggugauaauugaaguuuccucguguuuucuguuggcuucacuggucgguccuuugugucauguguguugcagucuguagaagcucccacgguauucuccucugcucaugcagaugaaaggccuucauguugcugcugggcuuuaucaaugaugaauaaggcuggaaauacuuauauccauuuuuguguggauauagcuuuucaguuucuuuggaaagacacuuaggucacaguugcugacccugugauaaauggaugguuaguuguguguuucggguucugucaagaaagguuguggucccucauccccauaggcagggcccgccuuccuuccuuguaucuucaccagcauuuccuguugcccacggcucuucuccaguauguagugaucauuuaaucugcaguuaaaugacaagugcuguugcuuuuuguuguucuguuguuuuucgagacaggguuucucucuguagcccuggcuguccuagaacuugcucuguagaccaggcugucgucaaacucccagaaaucucccugccucugacuucugggauuaaaggcacgcaucaccacugccuggcgauguuaguaucuuuuauaaacuuauuugccauacuuauuuaguguuuguugauguagcuguuuaaaucuuuuguugcccauuuuuguuuguuuuugagacucaggcuggccucagucccgcucuuccucagccucugagagcugagagucuuccacccaugcuuucuuuaggccuuuucucgacuauccccucugcccccucucuccuucccuccccucuuucuccucuguguguggcacgaguggccauuggagugccaggguaacugaggaggucagagaacugugggagucagucucuccuuuaccauggggcuccaggaguugaauucagguuaccaaacccaugccuuuauuagcuaagcuauucuaugcucucauuuguaaauuaaguuuuuuguucuuauuguugcauuuaagaugucuuuauguaguuuugugaauacuagucugucauuaaauaaguaauauggaaagcuuuucuccuggccugggguauguugucuguccuuuaguuuuuaucauuauaugugguguuugcuuuuuaguugugguaaaugauccucaggugcgaugguuaguguuaauuguaaacuugacagaacguagacucauucgccugggaaaugggccucugggccugccccugggggguuaucuugguuguguuaauugacaugaaagauccaucuugguguggguaggaauauuuccuuggcaagggguccugggcuguggaagauggagacagugagcugaccaggaggaagcauccacuggaugcagugcugaccgcuucaagcuccugcugccuccacuucccugcucggaugggcuguggccugagccacgagccagaaacaacccuugcucccauucguugcucauaucaggguguuuuaucacgggggcaggaaaagacaccagguaaggacucuucucagcuggguaaggugacauagacccucuggaguuuagggacgguaguuccggaguugaagcccagagagggaaagugggaaaggccuuccccaaugggcuuuguaucugcuuuacuuaaaccugacugcggucggcaaguucuugaacauuauuugucagaaaaaaaaaaagaagaaaacuuucccccgccccaaacacaucuaguuuuauucuuugcacuuuuaaacacuccuaggugaauauaaugaagcuggguguagcggcauacaccuuuagucucagcacuugugaggcagaggcaggcacaucucugaguucaaagccuaccuggucugcauagagaguuccaggacagccagagguacauagugagauccugacucaaaaagaaagggguggugguggggagacuggaaugaaagugaacugccaaucuuagugaguauuuuucuccuccgcccuugaccucugagucucugguuuucaucaacaucguuuguccagcguccugagcucauucugcugugaucuuucauuuuccccuuuacuuuuuugagccagggucucuguagcucaauagcuccaacugcacuuggucccuuagucuuccucuagguuacgggguuauagguuucaggucaugcccauaugcugcuuccgugucuuccgacuucuucccaguaauuuacuccuagacuccaccccagaaagaaaagcacuuggggcacccaugugaugaugugcaaccaccuguaccuguagcuccaggggaucugacacccacccacuucugaacucagggcuucuggacucacaugugcacagaccucuacacacacauacacacacaauucuuuuuaagaaagacagaccugcacguuguacccaaugugguuuucuggcuuuuuaguuaugcgauuugcuaagacagucucauaguucacgggagccaccagucgcuugaauugugccugacuuccaguuggugacauucuuccuggcacuacucugcugcauauggacaccaugguuggucacucagugagucacugcucccgcaucuuuguuccucucucaugccaugcggaucuccagcugugggugaacaauguuguccuuuucuguggccccguucuaggcccaaagaaaugauuuaaucguauuaauuuguucuauuacuaauucaugagcucuugccacaucugugcuuguuguccucugugaaagucuucucauuugucuguagcuggcuucacuugucucuccuccaaugacuguuuuuuuuuuuuuuuuucugaaucuuucccggcuucccucaggcuugugucaucucccuuggucacagcuggcuccacauuuuagcagaaugaccuaaaaagaaagacagaaaaacaacucuuguucuguauuacuucuuguguaauaccugaagcacagguuuccuagacuguccugcgugccugcugugccauguuuaguuuuaguuuuuuuuuuuaauuuauauuuuuauuagguauuuuccucauuuacauuuccaaugcuaucccaaaagucccccauacccucccccccacuccccuacccaccuacucccacuuuuuggcccuggcauuccccuguacuggggcauauaaaguuugcaaguccaaugggccucuuuccagugauggccgacuaggccaucuuuugauacauaugcagcuagagucaagagcuccaggguacugguuaguucauaauguuguuccaccuauaggguugcaggucccuuuagcuccuuggguacuuucucuagcuccuccauugggggcccugugauccauccacuagcugacugugagcauccacuucuguguuugcuaggccccggcauagucucacaagagacagcucuauuuggguccuuucagcaaaaucuugcuaguguaugcaauggugucagcguuuggaagcugauuaugggauggauccccggauauggcagucucuagaugguccauccuuucgucacagcuccaaacuuugucucuguacaugcucaguuuuagcccaggacuuugcauacauucugucugcuggacacacuuccucuguaugccugccuuguauuugauuuuguguuuggaacguaggugucaguuucucagcuacuguuuuccugaccucccauuugcaucaagauagaguccguuccuuugaaagcauagcgaggugacccaccgaccuagaguccuagagugucgaagcagacauguggguguuacugcugccagggggcaauugggcugaguacuucuacagagcaacuuagcuacugaaugauuuagugucagugaagaaacagugagacuuacgaugcauucauuuuauagaugaggucauuggaaaaaagacugugaagucucuuguccugucacauagcuguuugguagcagaguugggauuugaacccagacaagccugugcucucuguacuguaauggugauugcugcugucaucugcuccugugguuccuacuguccacccuccuggggagacuuuaagcccuugaggucugaguauuuugacucuccagugccugggcagguuguugguucuuguuacugaauaaaucaugccccuccccccucuucuuccuuggggcuuucagugugacuuuccuguuggccuuucuucugcuuccaaguccccuggguggaaaucccuuguguauuuuaaaauauagccccucugccuauuaagugugcuguuuguacuguggaaguaagaacaauuaguauaugcacucugguuccuuucucucaucuuucacuuugcuggagguaucaacuuugggcagcuaaaugucaaaaaucuuaaguggacacuuaaaauacacaaaggggggugcacauaacauacauacccuucugaucucucugucccucugucucucugucccucugucucucucuguuuuucugucccucugucucucugucccucugucucucugucccucugucucucucucucucuguccccccccucguguguguguguauguguguguugccagguaucuaacaugacaucuugugcuuucuaggaaaauacugucugucacugaguugcucccaagccaaguuucuauuuuuaauuaaaaaauuaaggcaugauacuuugucauuuugcuagaugacacaucaagggaauugggaucaggacaaugaugguggugguaguggugguuugguuuugguuuuggcaagguagcccugauacaccuggaacuagauauagguaggccagacuggccuugaacuccagagaucagccugccuuguucuccuuaauguugggauuaaagacauggucacuaugccuggcuucauuaauuuuuuuuauuacacugaugaguugauugauugugcaugggauuuuugucuugugccugugggaucagagcacaacuuacagucuugguucccuccuuccgccuugggggucccagggauugaauaugggucaucaggcuccuuauuccauuuuaaaggccccaucucuuaucaggaugggaccugaauuuuugggugacauucagaguguugcauaugguagggauauggagauagccgaagugccauuuuacacaauguucauggaaagacagucacagugcucacagaguaacaggaacaagcuucacuggggccugauagacccggcaccuccuagugaggcgcggacacuaauguuggaaaguacgguuuuacucuggaaaggaaggucuaauucaagccacggcguuccuuguacaaguuccccacugggcaagccagcuguccucugcaguggaggucugugaugaaagaugggugucuggaugcuggaggacagggcagauguugaggguaaggcuuuugagauuagcugcaaggccaacagagaagcagccaaccagaguguagccugccuccgcaugugcucuaggccuggaggaagcagaguggcccgucauagccgaaggacucagccucguccgguacuucagguuaguaaguaugucgguguuguuccugggcuuagucuccggccauauuaccccaucuucaggacgacugcuuggccugccugcaaggaagaaacaagaaagaaaaggccaaucagggaaggaaugugauccccaaggcuaaggaaaaguuuacauagcccugccuuguaccucucuuagcugcuaccagacuuguagauuuuccauuucccuucccuaagguggcagacaguccauucgccccugaacugcaguccagccuaaccgggaagaccuugccaugccucaagccaagcccagcucccuaacagucucaccugcuuuucuccucuaacuuuaaauucucccuuuccuuccagacaguguccucccgaguggcacucccagcucccugcuggcucugcuccucacuccucucugcugcucccgaggggccugcaguuuaagagguuguagauauucuuauuuuaaauccaagaauucauuuaaaguauuccagauaaaacuuucugucuucccuuuuuggacgugacuguuauguuuggucaguccucuuccucuugggaagacacuugagaggugagugaugcugcagaggggugagugaugcugcagaggggugagugaugcugcagaggggugagugaugcugcagaggggugagugaugcugcagagaggugagugaugcugcagaggggugagugaugcugcagagaggugagugaugcugcagaggggugagugaugcugcagaggggugagugaugcugcagagaggugagugaugcugcagaggggugagugaugcugcagaggggugagugaugcugcagaggggugagugaugcugcagaggggugagugaugcugcagaggggugagugaugcugcagagaggugagugaugcugcagaggggugagugaugcugcagaggggugagugaugcugcagaggggugagugaugcugcaguugcuccuuuugaugcucagcaccaaugauccuagcuucucggugcacuuugacguuucucuuggagaagcagauuaaaauuggcauccauacuauuuguuguucuccuggguggguagagucaagggugaagaucagagcacccccuuuuguuucuccuccucuucacugcagucauuuugugaacaccaugggggcacugggaggcugaaaggucacuggacucugaccuggaauuccaucuucucucucacuuucuuuauucucuguccaaaccagaaacaccagcuuuugaaucagguugaaucaguuucuauuugaaagaugugggcugauuuaccucaucucugugguguuucucuguuccucuguaagaaugagaauagugguacccauuucaggauuguguggcuuggaugaacauugaacauagucucuuagagcaugcucucaauaaguucuacuagugauauugugguauguuauaacuuuguaucucugggacucucuacuguuccgaagaccacacagagcauuccgcgccugguagagcuaguuuggauggugccagcagaaaccuucacuucagcuuacuucauauguuuccuggccauaaccuugaauaauguauguuccuuaagccuuacuggucccacauuggaagugaugaugauggaacuuuucaguauggagcaacacgauuuuuauaaaagcacuuagcgucaugccagaacacacaguuucacaaaguuuaaacaucagcugcugcuaucgucacuguuccucuacagcuuuuguauuuauuggcuuaaauuuuucauacaauauacucugaucaugaacuucacugucuuucaacucucuuagguccuccccacuucccuacauccaaagucaugugcuuucauuuucuauccaaacaaaucaaccaaaagucaaacagaaguaaacacacacacacacacacacacacacacacacacagacaaaucaugggguccaguguguguuggccagcuguuccugagccuggggccuguuuggagagugcuugaaaauacccaaagucacuccauuagagcaaacugauccccaucucccagcacgguugcagguggcuucuugguuagggguggggcuuguguccacuuccccuucucaguguuuugauuuugcaugccuuacuugugugugugccauuuguacaucacccccuguugucucuugaagacuccauucaccaccucuggcucuuagagucuuccugccacguauuucacauagaucccugagccccgaggugaggagggguguuagagacaucacaguugggacugaaugcucagagggucucauugcacacuguccaguugugggucucuguuaauuaccauuggcuucaaagagaugcuuuucugaugaagguggggugauauacugguguagcaaucuuuuuuuuuuuuugguuuuucaagacaggguuucacuguguagcccuggcugucuuggagcucacuuuguagaccaggcuggccucgaacucagaaauccgccugccucugccucccgagugcugggauuaaaggugugcgccaccacacccgacugguguagcaaucuuauuaggaaucauuuuauugcuacauccauuuagcagaauagcaguaguaguuucccccguggccucucuagacucagcaccacuuuagcagugccagggauggauucuaucuaucucauggcaugggccuugaauccagucacaaagugguugguuacuucucuuacaugugugccgccauugugccaguguaucugugggcaggccacugcauuugcuugcaggcuuuguagcuggaugagcuugaugauuccuuuucuuuguaguguaaaccuuccagccaugagugcuggucagugccggugaagcuccuccuugggugcugucuucaucccuccauguuagaugguauaagguagugauguuuucagugauauggcuuuaccauucacauuguggagaguagccaauagccuuagcaauggccagugauguuugggggcaggugucugggagccuuuugaccaugacucaacaagauaacccauuccuggcauggggguuuuacuugguggcauauguugucuaguuggggggcauugucucccccauuauauggcuuuauuuaaauuccuuuccuauauuuugggaagcuucuggaguugcagacuucccuauggcguucaaaaggcccuaaguguuaguugucccaguugucccaccuccauuuuccauccuuuaaccugcccacucuucucccuccccauuuaauuuaaucuuccuauuauauaguuuauaacacuaugcacuauuuccucuuucuuggaagauacugccccuucccucugauccuuacuagcuaucuaacaucuggauauucugaauuaaacauauauaucuaaagcuucaaagcuaacauccacauaugagaggaaacauacaacgugugucuuucugggucuggguuaccucauucaguaggauuguuuuuuagcuucuuccacuaaaugaaaauuucauacuuuuauuuuucuuaguagucaaaucauauucauuuguaaauguaucacauuuucauuaucuauucauuaauugauggacauauaggcuguguccaguuucuggcuauuacaaauagaacaacaaugaacacagaugagcaaauauuucuauaguaagauguaaaguccuuuuaguauauuccaaagggagauagcuagauagcuagauagauugugguagcucuauuuuuaaacuuguauuuuauaucuacuguguuuugccuguaugaaugccugugcauuuguguauguaguaccuguggagguuagaggagggcaccagauucucuggaacuggagucagagauggcuugauccacuaugugggugcugggacucaaaucugcgucuucugggagagcaccuagguucuuaaccacugagcuaucucuccagaccucugugccuuuuagaguguggauacugagcccccccuggugauagugcugaaccuuccaccucaagggccuugccuauuugguuaauuccuggucaaccuucagugggggucuuaaaauauguuauucacucuccucucucuuuauugcuagcuguccgccaagacagcacuauucaguccuucacuaggagaccaucuaguaaauaauuagaccagguuuggagucuaguagcagugcagacacagccaccaaggaagacagaaaugcuuggcuuccuugccucaguauucaucuauacaagccaaucagcuggguuuggcggggccagauuugaaucccagcauuccacugguggcagcagcagcaccuggagcucagcugcaaaguaaguucaaagccaaccuccauguggacaucugaaaaagccaaaccaaacuaaaaccuggauaauccuccucugugaggauugaaauguguguuuaaagggcugaccccacugagcaccaaaacagccgccagucgucucagaacccuucguagacgccuuugugauagugcuugccucuucgaauuccaguggcucugucugaauguauuuuccccagaggcaucacuaaaggugggcuauuugaauaucuguuucuagugcacacagagaccaccacuuauaauaaagugcuggacuuuccuuuccuggguagcagcucuccaaaucuuacaucuuugggaaauaaaagcucugaaagggagacuugagacacagcaccauuugggaccaugccucagugggcuuuuuagugagaacuagguucuaguaucuguaguggguagguuccuauggacuauaugcaggcauugggaggaagccacuccgagccaaagcaguacccguguaauguguaccaaaggcacgcagucuguaaacgaaguacucuuuuuagagcuuuugcuuuguuuagagauaggguuucucuguguacuccuaacuggccuggaacucauagagauucccugccucugccuccugaguuguugggauuaaaggaauaugccaccaugccuggccuuuguuuguuuuauugauguaaguaaaguuguuuugcuuuuuaaagcuuauucaaagaagcaauguucuauuugcuuguguguguguguacaagcaugcuuuagacaccaccauucuuguagagcagcuuuuggaauugguucuuccccagcagacaggucuggguauugaacucaagcugucuugcuuggugaugagcuccuaucucgaguaagcuaacuugcagagcugucucacuggcccuucaacacuguucuaccaaacccaccaaagaugaucauuucaacccuucuucuuuuuauuuuuuaggaaauucagaaaagagauuucuuuuuaaguuuuuuguuuguuuguuugcuuguuuuuugguauuaguauguagccuagguuagccuugaaugcuaaaauucugagugucuccacauccaauaagaagauacgucuuuaucauaagcaugauacagagcuuggaauaaguaccaggcacaggcuuuuuguaaaggauugcagaguauuaaguaaucaagacccuguggucuaguuuugcugccaacacuuuacgccaggcccugcuuguccuauugcaguaauaacuggucuuuuugccuugaggccuugugcucugacugguuugucuccuguuccauauuaaucuauccugcuuugacuuuucucagagcacccugcugugcuggcugaguucugaguugcuuagcuugacauuucggggucugucaaguucucuggagaacagaaccaacacacacacacacacacacacacacacacacacacacacacacuccacccacgucaguuuauuuuggaauuggcucccauaguucugggccuucuuucuccuuuccucucugcucugcuguuuaggacgucuucuccagccuacugacgggagugcuaaccugaucuagaauaggugugcuggaagggcgaguuaccugcuaugucggcauuuuuagcucagucaagucacguguagcacugacucccuccagccucuugcagucugcuucccagugccuuuccuguuucauuucccaccacauccgugaguggacaguguggguugucugggcuacuuguaauuuuucucaugugaauugcauuuuccuuuuggaccuucuuaggauggugccuuucuaaaaugaucucuucuguucuccucuuuuauuuuuugaaagaugggucucacuaugcagcccuuggcuggccuggagaaacucacuguguugguugaccucaaaucugcagaaaccugucuugucugccuuugccuccucagucuugggguuaaaggugugugccaucaugccuaaccuaagccucauuuaagauuuauuaacuuuaacauaauuguggaaucacaggaaauuguagacuuuguuuauagaguucugcauagucuugucucacaucccccaguggugggucuuauauaauuguuguauacgauucaucuuaaagcuccauuuuuggugugcuugccuguaaucacagcacuauaaggaggcagagacagaaggaucaagaguuuaagaucaucuugggcuuuuauacucuaaagaaaccacaaaccaacuaaacaaucccccaccccaaaaucaaaugucauuugaaaaauauuuuuauggugagaaaucuauuccuuuccccuucgccucagccccuucaccuuccauugaauuggauuuguugacugcauggaugacacucauggacucauaucuguuaacugcuagaguaucaaucagucuggauaguauggugucugaucuuuaacgcuaagggcuauggcuaaaugcccucacaagucugcgguuaacuggucuugaacagaauuuuagaagagguguuugcaaggguggaaugaguguguaaugucaucuaguacugcaggggugcagcccucacacugggguguugcuugugagcaucucugugucauucuguugauguuuguguuccucccaguggguguguuuucaauuccgagccagacauggugguacaccccucuacuuccaggucuuaagaagcugaggcaauucagagcaagccugggcuaucgagggagacccuguuuuaaagccacaacagcaaaagaggggaaggaaggaaggaagaaaauauuccaaaacacacuuauggccuguggauguagcuuggugguagacuucucauucagcauguugaggucuuggauuugguccccagcaucccuaaaaacaagaaaaaggagaauauguacgggaggcugaaggaaaaggcaaaauguuuuuguuguuguuucagcgcuggagaucgagcuaggaccuguauccuagcagguacucucuacugacccaugugccuaucccuuugagguuggguuguuguuguuguuguuuuggaguuggagucaggucuuauaaggaggauauagaagauaaaauauauucuucuguauauugugcuggugguagauaauuagcagcuccuucaggaaaugcauaguuguuacugggucauaaauucuagugugcgugugaauguuagaggacaagccagagcggguccuugucuuuuagcuuguuugauacagucucuuuucuuucuuuucuuuuucuuuuuuuccaaauagacaagucuagucggccugagagcuuccaggaacccucuuucugccugcuaucucacugcaggagccuacuagggcugucaauacuuguaccuacccagcuuguucauggcuucugggguuugaacucagauuaucaugcaaacauucucuccugaccuccuacauaaauguuuauaacuguuauuuacaguaaccaaaggaugggaaaaaaaccucauguuucacagcuuaugaauaaggaaaaugugacaucuacagaauggaguauuguuuagccauaaaaaggagugggcuauuggcgcugccacaccaccugaaaacauuaguauuggaaucgagacacagacggcaacaguguaugguuccaucggaaugacaugccccaaacaggcaaaucuguagauagucacaaaccccagcaccuugcacagaagugggaaugggagcgaugggcagugggcauaggcaggaucgcucugcaauaggauggcggugaggguuguauaacucugagucgucuuuuaaggcaaauaacacaucuaaagaaccaguguauaguauguagauuccaccuaagcauauuuaggagcagagauauagcccagugguggagcacgugccaagcacgcacccuugaggccuuggguucuaacacagucagucaccuuguauuaaguggugacacauucacaccuguucucuuggcaugagggacugugagugacagcuuccagugcucugaguccaaguaagggaaggaguagccacggcagagagugacucagucugauuuaaggcuggugauaguccagggccuguaaccgcauugggcagaguuaagguagaggaugaauaaagauggaguaaaugugugugugucugccuugcgugugggguaaaccagcuuuggagaaggccuuuuuuacauaucacacaccuucuguacuuacucuucuuaagaagguaguagggcagccgguggaaucaacugucaguaaaucuuagugugaguuguugaaauuucuaagaaacauucccuauuccaggcaaaacucuggagagugaaugacaaaguauucuagaggaagcagguucugacacugcaagugaguaggccaaaggccccggccauaguucucagaggucuuuuuuaaaaaaguagacauuggacaaauauguuguccaaugauaucuuacagagacuuuuagcaggcuuuugauuuauagaguuaaauauuuuauugacuuuuaaguuuuugccuuucaaaaaauaagcaauuuaaaaaauauuguauuuuaugcccaugaguguuuugccuccauguguauauguacaugugugucugaaagucagaagauggugccaggucccuuggaacuagagauacagaugauguugaacuaugucggugcugggaaccgaaccccagaucucugcaagagugcuaggugcuccuaaggccugugucacccugcagcccaccuucacuugguagcucagucuggccugauuucauucuguagcggagaccgaccuuaauuucagguucuuggaacacaagccuccugagugcugggaucucaaguuuguaccaccacacccagacaaccuuuugaaggcaguucacuguguuuuuaauugucaaaauguguaauacauuuacauugaccuuuaaaaguguauaauguuaauagcagugacaguaauuaagauuaaaagaaauaguuuaaauaaaaaguuugguuucauuacauuaaaguugaaauuuauuuaaauuuuaaguacuuugcuuguucuugaggugcugggaagucagucaaccaagcuguaucacuaggcccuaaaacucaauacuuugaaauauauauaaugaaauaauacaauuucuaggaaaaagauagugauaaacaugcucaugguuuugacaacuugccauaaacccauacagacccgagaagaaagaggcucaacugaggcgcugcuuccuuccaguagauugcuggcugguaugggagggccuuucuccuggucaggugguccugggcugugagagauagacagagacagacagagagacagagauagcuggugcugguagaguccuugccuaguaugguucugaggcucuggguuugauaguugaguuaagccagagagcaagucaguaagcuuuccauuuucuccacggccuuuguuuuagugccugccuugagcucuggcucugucccucagugauggacuuuuaccuggaaguguaagaugaaugaaccauuuucuccccaggcugcuuuuggccauuguuuuuucauagcaagcaaacguuaacuuggaugagcucuaugguguuauaaagcguauggggagagggugacuaccagaggguuaugggugucaaauguccaaggguucggauuucauugaauuuuugcugauauuauuuaauuaaaauuagugauagcuuuguuuuagauuuauguuacuuuuaaauaaagaaaucuccuguauaauggaggaugguccacaauuccuccuccucacuccuccuuucccuccuccucccuccuucuuucccuccuccucccuccuuuuuguguaagucuuacccuucugucuuugcuccugaaugcugggauuacagaucaguauuacuacgcccagcuuauuuuguuuuugauuucugaagcauguuguuuaguagcucaggcuggcucuggacugaaugauccucuuuccucagcuucuccagugcugggauuaccacagugagugcuuccaugcugggguugauguuaauuuuaaauuguacacacuuugauauagaaaugaauguaugucuuuuguacuaauuuaaggucuuggagaauaacuauagauauuaaccccaaauauuaauggcaccaccacacuugauuuagggugaagaauuucugcccuaagguagcuccugcggccaguggggaagugagacacacaucauguggccccaauaaagccuuuauuuucucacacugucuugcugcuugcuucccaugggcauucugccgcaguguuguaucaugcuugguaaaugacccuucacuaugacuuagugccuguuaccacacagacuauugugaagaacagagaggagcuguguguucuaaaggauaggcagauggagggaaagugcuggugacuaguagggcgcucuccuugucuggggcugaacagagccugucacgaccccugcuucucagcucuugcuccuauccugcuguaugacccuucccagucacuuaccacuuuccaaucuaguuuccuuauauuagaaagaaagaauaagacaggaucucucucuaguccuggcuguccuggaacucauuauguagacuaguaggcuggccugaaacuucagugaggucugucuaccucugccuucugagugcuggcauuaaagguguacaccaguaugucaggcagguuuguuuuaaaccucugagauuuggaauccaguuugaucaguuugguguguguauguuuacacaggaugaccugaugucaacuuuaggaaucagauaccagagucaugggcacacugcuuaaggcagccuguauagauuaguuuaauacucagaauuucucaggaaaccuggaguggucaagcuacauagccagucucccacucuguagguaggcaguguagagggaaauuucauuuauuguuuggagaauuagacaacuuuuacaacaugcuuagugaccaagaauucugauuuuuaacuccacaccagagccuccagugaaagccgucuuugagguucuaguaggagauuauaauggcuucuggucagcuagcucccagcuguggucuuuauagggcagaggugggaacucucagcgguugccagccgcucuugccuugggcugggccuuggaggaacucaagggaaacucccagcccagguccccagccuggcuuuccuaggggcuuagcaggcucuagcccugaaagcgauacucuuguaguacaagaguaaccacaaacccauguggacuggaggccagaaaggguguugccacaugucacucuccucccaugccccuuggcugcugaacagacgguaaccccaccccaccccgcgccugaagcaaauguagauugacagucuuuuccaaacuguccuuagauagaagcucugcuucugcuccugaaccaucagaagagugaagugggccgaguccacaugaggccaacucacguagccagcugucaccuuuagagccagacuccucugcuaggcuuaacaaacacugucucaauuguuugagaacaagaaaagguagcugaguugacuccuguggcugauuugcaguuaacaguauuauuuauuacucuaacaggucuuucucucucccccucccucucccccucccucucccucuccccugucuccucccccccucuucucaauucuccccccucucccucuccguguguguguguguguguguguguguguguguguguguguguguguguguguuuguuucuguguuuggugacuacuguagcccuaguuggccuggaacucgcuagguagaauaagccuucaacucagagaggccuucaccugccucugcuugagugcaacaccgcaucucgcuacuugccuucuuuaaaacauuguuuuauuuaguguauaauagaagagguuuuauuauaacauuuaaaacguguuguuguaucauucauuuuuaccuucuuuagguauuaauauaagcauacauauuuguuuuguguauauguauaugcacauauguguggguguucaugugucauagugcauguguggagaucauaggacaaugucuaguagucuguucuuuccugccaucauaugggcuccaggacucaaagccaggucacuaggcuugguugcaagcacccuuucccacugagccaucuugcuggccccaaaacuuauauuggcaguaacauuuuuggggguguguauugggaguuggaccuagcuuugggccuugugcgccuggucuaccaagauccuaaguuuuuguuuguuugugcaguaugaagagugugaagagauuuaucuuuaaacugaucagcuuucuuuugaaaacaauuuuuuuucuauguagcccagauguccugggauucacgguuggcuggccucaaagucacaagagauccaccugccucugccucgugagugcugggaucaagcccacugucuggccaagccuuuccugguugacuucguuguguucugcaucacucccccuccagugagcacuuuccuuguuuaguagcaugucuuggcuugucugaaugaggcauaauuaagguuuagucacuggcacucaaaucuugccuaugcaggacuugacaauagagauaccguacuuugcugugaauagauagaaccagagugggcaggccuguugcucuuacugagaugaacuuuuauaaacacuaaguuugauaguuuucuccaucacauuccugcuccccagauuuauaaagcagagguacagcuuguucaaagacuuguucaaagucuuccuuagccgcauagaggccagcugagcuacaauagagcuugucucaaaacaaaacaaagcaaacaaauuagcaaagaaagcauccccaaacuacaauaguuucuuaggcauuuguugugguuguuguuuuaugguuguuugccuuugacgacaacauugcuaagaacuaccuucaggaccuguggcuucuugucccucccaguaauugacauuuccugagcuugcuuuccuucuuagacuuaaguauuuuacugagcuagaagucuuguacuaugaaaguaaccuucaagucaauuaaaugauaauuaaaacuugugugccaggcaggaaggggaagaaaacacuguuuguauuggcuuuuguuucacaugggauugcguuggcugauggaaagcaaagguaguaggauucuaggguaugcuugacuucaggagaauagacauuggaucuggagagcgucuucucugcaacuaacucccuguguuugacuagccagucuccugcuugugccucccaagugcugggauuaaaagcaagccccagcacaccgugcauuggauuucaguauuuuugaaaauucugcuuaaaauucccuaaguggagagacaguugaggacuaaccagccuuaacuuuauauggcauuggugccugauuuauccgacgacuggagacuaugaggaugagacggagaaggagagcugcugguuagaaaugggcaguugcccgucguuuuccucucagaacuggagcuucccaguccuuccucucuggaguggcauccuaacugguuagggagguggugagaaagaccugugcagaaucagaaacuauuucuccauagguugaagaaaccgaucaaguaaauaguuuauaauuugaauauggagaugguuuuaggaacucuucugggucugguguaguuuugaaagagggaaaagauuuauuguuguaaggggcaacaaacacagcucucugacaguagcuuuugauuuuauuggcucaacaaauauaauuauugcacaauacauaaucuuccacugugguagcuaaugagauccgaagcugcauaauuacagcagcacuuauuuuccuuauagaauuuggcggcuacuaaguaaacaauuuaaagaauuuaucuuaauuagcuuaguuauaugccgucauuucugagucuucuguuuuucuucuuggugcugcacuucacaucuuagcugagcagagagagauuaauuauuuuaagccagggcuucaucucucagcauucuagccaccuggcuuuccuuaauuagggccgucauucacaugaguugagguugagccuaaaaugcuuuuugaaagcauuuagacagucagaaaugaggagagaguccuggagguaaagcuuuuuaaaggugaugugaauuuuaaguccauuaacuucauucaugaguguuaaugcagccuggauucuugguacugagauugggcaaaggcuugugcuguguaucaacuucucguacacguacugacaguuaaagcuggacgcacuuagaugggcugugugugagacaccucucugcucucuuaacugcucccuuccuaaccugcuggaugagcugauugguguaugucaucuaucaaccgguagagucacaggagcacagaugggaacauccaggaccagucuguaaauggguguuagccuuaggaggugggaguggcuguugaguacuaggcuuagugggaaagggugcuugggugggcaccgugggcaggcuuugcacauggaggacucgaguguguaugccuguguuaucccugcagggcuguuugaaacucaggagggcaggucacaggcccaagauaauagcaaaaaaccucuaggagaauuaaagauucauaaauuaaagauacauagauguguaugcuccggacaaaagugggcccuuaaugagaggguggcucauggaaggagugauagagaaugggagacgguaaauuggaaggagaaagauggaaaaaaaaguagggugagaguaagcaaaggcgaauacuuugagaaccccuuggguuacuuucgacgagaaaaccagaacuuaauuaauuguaccuuuagagcauagccugagaagucagagcaugauccagggcucgcucuguaggacagguuggucuggcagccugugccugggcuccgaagugcugggauugcuggcaugugugagaagcaggcaaugccuguuugauguugucuuuucuuucugcugcucucauggugggggauuuucgguuuuucuaguuucuguguaguucacuuaggaacuguucauacuaaacuagauuuuaaaauauacauggagggaccugguauacaacaugaagauuauaauuaaugauguauuuuguuuagcgguuuccauggguguuuuugcugaaaggggagggugauugugagauggcagcuacuaucuacuguguaucaaagcaucauguugaugugcguuaaguagacuuuacagagaaaccauaagaaagaggaaaacagaguggacugggugugguagcacacaccuguaaucccagcacuuggcagguuuaggcaggaauccaaggucagcuugugaaguaggauuaugacauuaaaauccaaacuucugauuugaauauucagauuucuuaacauauggcuccaagccuacauuguuauuacuuuuaaucuauuuuuauuuguguauguguuccccugcuugucuugugugcaccauaugugugcauucucagggagaccaagagagagcacuggauccccaggaaauggagucgcagguggcugugagcugccauguaggugcugggagccacaccugaguucuccacagagcagcccaugcuccucggcgcccccugcaguguuuaggcucauucacugccagucguccaugcuagcucugcccucagcuaagguuacuacucuguacuuagcuccccaccucugugugaggucuagcucauucauguagaccuucccuaggaaaccugucuuggucucuucacccagaagucagcauuuccuuuuugacuaccuucugucaccuugucuguggacacugccguguuacggauggguuuaugguuauuuauacagucagugauucagaggagaggugggacccugcugugugauacccaacuccuagcuuaacuauugccucacacaguguaauguuacucgcuugcauuucugcuuacugagugcuaggcacagcuccaaacuacucuucuguaaaguaacagcagcuacucacuucuuuaguguccuugugaaccagguaaucaugaagaacauguagucgggugucuacaguauauuaagaguuccaggacagccagggcuacacagagaaacccugucucgaaaaaaacaaaaacaaaaaaaccaaacaaacaaaaaaaaaagaauucaacagauguuccuuauuacgauagaauguacuuaauguagaauuacucuuucaaaauacacccuuugaaauuugacauucaguuuuaguuagcuaauauauagcuauauucauaaaaaucauauaaaauaugauuuauuuuccuaaccuucuauuuaacaauauuuuaaaauguugauuuuuauuauuuuuaagugugcuuguauguuuguguguguaugugugugcacaauguguacuagauugucaucuuuuuuuuguuaguuguugccuuggaagaugucucuucaucuagggcacucaccccucuugcacaguagauguuuuguguaacuaggacuugcacuagacauucuguuuacugcuggcccuagcagcacugagggcuucucugccugguuuacaucuugaugcuucuuuuccuucuguuuggaaggguaggaacccaggauuucucuguaguuuucaucuuauucacauuuauugcuuaaugcugauggaaggagucagguucacauccuuuaccagcagccugugagcagagacaggcagggaggacaggacuguguguguggguggagugcugcacccccuucccuaacagccugcuuaaguugcugcccaucuuuagugaacuucuagacuuauucugguccuuggugaugacucucuguuucgaacucaaauauccuaauuuuccccaugagucauguggcccuuaauguuguuuugcuuugcuaucucugugguugguuuuuauuguuaaugucagcugcuugaaagcaaggccuacuguuaauguguuaaggcagacuuacucaguagguuuccuuggcagucguccuugccuguuaaauggcaugaggcuacuuucgagcauuuuauaagaacuuagaaucucuugaacuuuuucaaucaugcucuuuuugccuuuggcuuugaugaaaguacugugguccuauugucucucccuugguuacaaccaaaguuaugaccaggaaccuaggaaccaccucaauuagcaccuuaguaggcugacucuaguguguguguguguguguguguguguguguguguguguguagcagcguguagagugggaauaacaauguucuuuacuuagguuugauuuuuaccauuaacguuuuguuuuguuuuguuuuuuuggucagggucucacuauguagcccugacugacuuggaaacucaacuauguagaccaggcuggccuuggaacuuaccgagaucuugccucugccucccgagugcugggauuaaagguacaugccucaugcuccaccaaguuuuaaaaacuggaaacaugggcauguggagaugguugaauggcugagaaugcuuggugaucgagcaaagggcuagcuuucacuuccugacauacauaucagguaguuuacaacuaacugcccuucaggugagcuccggggaccccgcucauguguccguguucugucuggugggccgucuagugugcuuuuugcacugccuuggacuuggagacaaacacguucuagagaaacuagacauaugcuaagggcagauuaugugauggaauaauuguaaucaguaugcucauucuugugugagaaaggccuacacuacugcuaaauaaaauuauuuugaguucuugaagaggguauauuuagaucuuuuuccuuuuucuuuuucccuuuaacaaauuguagagaaaaaaauaaaccaugaguuauuuccuaaacuaucugccaugaagagugccauguaguagcucgauuuuugacaccugucucaagugguuugcuucuucucuaagucacagugaaggcggaucugggugcaggccugggagcccagcuucucagaaggcugagaccaagauggugaaaguucaaggccagccugagcuacuuagugagacccuguaggggaaaaaaggccuggggaagucacuugccuagaguucacaaggccccagcuucaguccucagcacagagacagcugugagagagagcgcagcccucugccucacacagggcugcuguggcccuguauuuccucggguccuucuuucuaaguauuucuuuccuugagauucuuuaagacuauuuccaugcuucaguaucuuaauuucaggaaaugaugcauauuguuuauguuaucaugagacucugaguauccauguuaaugguuuuuauuugcuuuuuccuuucauuuucuuuccuuuuaucuauauaaucuuaucuaucuaucuaucuaucuaucuaucuaucuaucuaucuaucuaucuaucuauccauccaaacacuucauguaucccaggcuggcuugaacuugcugaguuguaaggaauguccuugaauaucugaucuuaccuucaccucccaagugcuaggauuguaagaaugagcugcuagguuggcuuuuauggugcuaggcauaaaaccccagggcuuuuuacaaguacucuaucaagguaucuuuucauuuucucuuguuccaaaagaaugugucuuggguucuagcaaaguacauauguuacacacaugaguagugaagacugauuuaguuagacauggugaugugugccuguaaucacagcccuugggaggcugacgcaagacuacuugccucagcaauuuugggucaaccuaguuaacuuaaugagucucugucuuaaaaaaaaaaaaaaaaaagacaauuagucagguggaugccuugaaucccagcuagcauuuggggggccagucugggcuacauagugagaaccugucuuaaacaaacaaacaaacaaaagcucucagaugaacuuuuagaauugcaccuuguuucccauuccaggaaauaguguugugucguguacacugccacauuaucuguacucaguagugcuggccauggcuagacacugcuuccauuguucaugucaggagcuccuggguaaggaugcugaggccacagucugccagacacaucagccgcaaugcuguuggcacagaaccuccugguuaucuaguauagaaauuuaucuuuaguuuugaagauucaguauuuuguggaauuaaaaggugucuauuagguaaaagaugaugaguauucugggcaugguggugcaugcuuuuaaucccagcacucaggagacaaaggauagaccucugugaguuugaggccagccuugucuacagagugaguucuagaacagccagggcuucauguaugaauguauuaauauuggugauaagauauuucauaucaugaauacuucuuauaaacagauuuuaaucauaugaauacuucuuauaaacagauuuuaaucauauguuuuuuuauuguuugaaaaaaaaauugaguucaacccccaaacugaaaacaauaaaaugcugcuuagaaaaagaugaaucuaaaaacugcugauuacauagaaugaaagaagccugacgccauuagucuaugcugccugauuccauugugcuguagaagcggaaucagugguacccaucucuguaucaguggguggaacugaggggaagaagauaggagggagggaacugcaucguguuugaagaacugaucacauagguccacacaucgaccggaagucaccaagugauguccuaacuacacaucuuauuccauguaugccuacccacugauuccaugucagaaaacauccccaugaugaacuuuuauuaauuucauuuuacauggaagggagacugguucuuggggaaugucauaaaauuguccaaguucccagagccaguacauguuugaaguuaagggucuguggacuacagagcugaucagcuaacaaaagggcauuguauuuugugugaacauuaaacacauuaaguauugucuagggcaccacuguaaacaccacauguuauuuugauaugcaagggucuuuuuucuugaaugaguagauuaacauuuuaacgaauucugucuuguaacuuuuguguuuuguacuauucucucuacugaugcuugcuguaaaucguguuuuucuuuucuugugugauguauguuaugagauaagcacuuaaauuaccuauaugcacgaguguacacugcaugcaugccuggugccugaggaggucagaggucacuguguggguguuaagaaccagacccagauccucugcaagagcagcaagugcucugaaccucugagccguuucuccagccacaacaacgauucuaagauaaaaaguaagauuuuccuuuucuuuuucuuguuuuuguuuuuggagacuagcuuucucuaugcagcucugguuguccuagaacucucuguguagaucaggcuguccuuuaaacucacagagaacugccugucucugucucuugagugcugaaauuaaagguguguggcacuauaccauccuguuuuaaguaagauuugaauaaggaaaugagagaauuugaugcauggaccuuccgauauauuuugacugcucagagaugugaagcugaccuuuccucuuuccuucccccaccucuccuccuuuuuucuggggugugugugguuguauuccaugaugaaacuagagcagaaauaauuuuuuuggauggugguaugggggaguuaagaccaacaggguuagucaagauuaggcuuauuguuauuuaauaaaccaauauaggacaguaguaggcuuaagagaaauaaaaauauuuaugagugcgugcuuacuaaauuguaggucaaggauaagaaauuauaaccuauauuaugacaccagagaugacugaaguuuauugcuuucaguuaaauauaacauacgcucuuucaugugaggaaguauuauuucuaaguaucuucaaaauaaagucuuuaaaagugccuuaaucuguuaccuagcuuggccagaauaagcagagacgcuaaggauuucugcagggaagcccaguguugagagcaugcauucacuuucuuuccuaucucgccucugcagagacuagugugcaugugugcacugcagagaauagugugcaugugugcacugcagagaauagugugcaugugugcacugcagagaauagugugcaugugugcaccuccaaccuguauauguggcaucaugugagagauaauguuuuaagugcuccuaccagaucauugguagaaucuaguugugguacuuacugccaugguccaugccugccauccuggccacuucauugugagaugacauccucuucauaucucaaaauuuuaaaaagcaaacaaaagcccacuaauggaagaaaugcacaaaaggcagacgaaugauugcuauuaccguuacugggcuuccaucuuggaccacagauguuagaauuugaaagggauauuugcucauuuuuagcuacuuuucuacuacccaaaguaagaaacaaacaaaaauuccacuuuuuuuuuuguuuguuuguuuuucgagacaggguuucgaaacggcugcccauuguuuucugauucugaaauauuuuauuuaaauaaaaguggaguuuuggggccgggcgugguggcgcaugcuuuuaaucccagcacucgggaggcagaggcaggcagauuucugaguucgaggccagccuggucuacagagugaguuccaggacagccagggcuauacagagaaacucuuucuugacaaccccccccccccaaauaaaauaaaauauaaaagaaaacaaugggcauuucuuuauaagauguaccuaucacccuuaaauguaggggacucacacugaagggguggaaucuuuuugguguuucuuuuuaaacagaaaaacaaacaauagaauggugucuuaaaauugugacuuugauagguucuccuucuccuuugcuauauagccgaggcuggccuagaacucaggauuauuuauuuugucuacuuuaaccgccacaugagugagauuauagccaucugucacuaugccucgcaauuucccucucucccccucuuuuugucuuucugucugucucugccaucccuccaccccccauguacaagcaugcacacaugaccuuauacaugcuagguaagugaucuaccacugagcuauaucuacugucucuacugucccaguaaggcuuugcguuuuuuguuuuguuuguuuguuuguuuuuuaaguuuguauauguccuagcugcagugagcaguuuguggcauugucucugccauuaucuuauuuacuaacucaucugaccuaggcuugauuuccaguauccacaugguaacucaaaaccgucuacauggguuucaggugaucugaugcucucuucucaucuacacagggaagucaugcaugcagguaguaugcaugcauauauacauauauacauacacacacgcaagcaagcaaagccuagaaacuggauguguagaugacagcauacagugaguuacuuaacagggaggugcaugugcuccuggcugggcuacuagaacggccaugggauggaaguguguuagagagggaaaggaaaacagcaaacugccuuuucuuuugaaugguguggguguuuugccagcauguauguaugucuguguauuucauguguaccuggugucuggagaccagaagaagcuguuggauccccuagaagugaacuuacagagaugguuguaagccaccaugagggugugggaaacuggacuugggucucuguaagaaugaccuguguucuuaaccucugugccaucucuccccaccuggaacaguuuuuguuuuuagacuuacacuauguugcugggugccaugaacucacuguggagaccaggcuggucuuaaacucauacaggucugcuugucuccagcucccuagagccaggauuaaaggcauuauuaccgcgcccagcccuugaugacagacucuuuaauauagccucagagguguucagucagugugucugagggguacacauacauguaugagugugugugugucugagggaugcacauacauguugaaugaguaugugugugucugaggggugcacauacauguaugaguguguguaugugaggggugcacauacauguuguaugaguaugaguggaggccugaggucaauacuguaucuccuuuuuucuuguucuccaccuuauucucccagacaaggucuuuauggaaccuggaguuuaccaacuggguagauuaaucagcaaacccugggguccucauguauucuucaucucacagucaugguacugcccacaguaccaugccuggcuucuuaugugggugguuuguuuguuuguuuguuuguuuguuucugggacaaaguuucucuguuuaguccuggcacucgcuuuaaggaccaggcugcccuugaacucacguagaucugccugccccugccuccuaagugcugggauuagaaguggugugccacuauugccuugccuaacuaucuuuauagcuuacauuacuauuucuuaucucaaaagucaacucaaaaauggaucacagguuuaaauguaaacugaaaagcuaaacauuuucuggaaaaagaaaguagaaaaaauuuuuggaaacaggagcaagguaaagaauucucagauuugacuccaaaaaucaugaucuauaaaaggaaaaagugauaaagcuggcuucaaaagcuuucaucaaaagcugcuuucauaagcauggacagaggacgagguguuuaguuaaaauaaauaaauaaauaaauaaauaaauaaauaaauaaaugccuacagagugcuacagaguguagugcagucucaguaccugucaucuguuacuucuuuuugcucaucugaaaacuaugcuaaugugcuguaauccaagcccuugggaggcggagauagaagggucaggaggucacagccagccugagccacguuauagaauggccaaacuuacugcagagugggaaaaagaacucaccaaucagauguucaguaaaagagcagugcaggugggcccugugcccgugaguuccucaucugaggagccauccaauuguagguccagaagauuuuaagaucauuaauauuagaggcauauuaugguacauguaaauauaccauguuggacaagggucuugaauaucuuuggguuuuguuaggggauggaauagucucaaauuagugccccacaauuaaaaaauggcuuguugccucuggaauaaagaauuccagucuccagguaagaaagccccaguaaacuaguuagaaauuggcaagaggggaaagacauuuuaccaagaagauguacagguggcccauaagcauggacagaggacgagguguuuaguuaaacuuaauaaaucaaaaaaaaaaaaaaaagccuacagaguguagugcagucucaguaccugucagucaucuguuacauuuuauguuugccuaccugcuuuccugccuuuguguguaguauguaagugaauguucacggugugcagaugcgcuugugugagcaugugugcaggucacagggcagucaccuuccucuauugcucuccacguaucuuuugaagugaggucuuucgcugacccuagagcugacuguugugguugacuaacuggccagcaaguccccaggaccuuccugugcccagguccccaguacugguacuauacucgguuaugaggcugcuggggaucuagacucaagucuccaugccuggacacaaguacaugacccaugacaccaucucccgagccccugcaucuuuauuuauauauaaauauauauuauauauuuaaacacuuaacugaauaugcuggguuucauuucaacauauuaaguacuuuauaugucaguuaaaacuaccuaugaauacaaauuucaaacagcucauacucuuguuuuauggcuuuaccauaauuuauuugaguuucugcuguguguuuaagauuuuucuccuuuguaacuauuauaaauaauauucugaugaauaauuuugcauauaaggccacaguuggggcuccuggauguuuagaauagauuuugaggugugaagucacuguucaugggcccaguacacuguuaaguagucaucaacguaauguacagagaagcuuucgguuuucaugauuuuggguaggggauacacacacacaugcguacauacaugcacacacacacauguauuauaugcagaguggaaaagggaaggaaagccgccuguucucaccuccacucugggcuccuggccuuucauucaucucucuucugcuccuugacaucgcucuuccuuucucugugacuguuuggguuucuuauggcucuguccucaaccuggcauuuguguuuacauucugcuucuguuaaucagagccagcccuuccccuuccacuacaguuuacaguauauaauagcuuguuucuuuagaaguguagaacccaguuucauauugcccacuagaugccuuugccuuaagccaugcuucacaaacucaagugugugaaguuuaccaacucauccacuuucccugaggacuacaugaccuuuccgugcuggaagcagaaagucuggaagguagccuacauuucccuuugaauuuugcucaguacaucuugucaguuaccauguguuaagauucuauuuccaaaauagcacccuaauuuguuaccucccccuuuucacuguuuguaauugagggccucacauuucaugugcugcugcguuggagucuaacucugugccuauuucuggucucauaucccucuuuuaucucgcccacuaaagcgaguuuguauuuuuaaauccuggauuuuagcaucuuacucauguucacuguccaauauugccaguaaagcaaagccugcuguccuuagcccagcguuugugugccugggcucuagagcuuggcuccugcuguuacagccucaugucugcagugccuguggugacuauaggcugugccaaggcacuuccuuugauguuacgugucuuuuuuucuggcccgagggccauugaucauccauggucuccacuugccagaucucuaugacauucaagcuccgaugcuacuguaacuucccagggaggggcccccacagugagaccuccucacccuauucccacuccucagugccacaucagaguacuuaucucccuaccacaguuagagugucccugaccacuaagcuagacuguaacacaccuucucagaccaccuaaagcaggaacugugugcacuguuuauuaccuuagaguauuuaauaauuaauguauuuaauagacaugucuugaguagaugaaggaagacgggucucagggugaaaggcaaggaaggguuugauguugaggcagaguucagguguggaagccauaggaacggagcuucuugugugaccagcucuagacaggccacuuucuccuugcuagaaguagcaauggcagcaguacuaaaacagcaguugcuuuugaaauggcaaaugccugcacauuucagucucuauuacaaguacugguggauccuggacagcaagcugcucacuugaaaugugguuuucacuuauaaguggaaugacgugagacuuggaggagacaugcccguccguuacaggucagguuauacuuggcuuugugauagcuugggugcuuguggaccgguugcucuugccuugucucaucagauguucagacagugaagauaggucggcugagucacuuugagacaaguagcccagaauucuuauuuaaggucucugaugugaaauuuccagggugacgaagcaugcagaugugaacagaguuccacguuauuuccugauguggcuugacuuuucuaccucuuccugcugucaacccugugugccacuagcccgccuugcuuuccauacugucucuagagauguauaguuagcagcagugacuaauacauugucaagaaacgcuacuauaaccuuuuaagucugacgcguaagccagagcugaaagcuguagccucugcacugccucuggaugacugcauguucccaccaagugagucacaucaugaauaugcaugaacuuauaaaaacaagcuuuuauaagaaacucugaugugcggaaacaaaccucaucaguaguaguucccaaaagcucuccaccauugcugcccgggccuugacugugucccuccccucaucucuuguacugaauuuuaaugauuuuucccuauucuuuuuccacauggagguacuuaguuuuacuguuuggcuacucccuuuggaugagugaaacugccaagaugcagguuagguugacgaacggguagcagccugggccacaccggcacaucggacuucuugauacuuacaauaaaaagaaaguauuucuugucaguugauuucucuccuucuaucuugugguccugaggauggaguuuaggucagacucaguagcaagcccuuuuagcugcuggauguuuguaaauguuaaauaauguuccuggggacuagagauggcucggcaauuaagagcuuuuacuccucuugcagaggaccggagguggguuccuagcacccuuguugggugcucacgaccaccugugacuccaguuccagggaucugaugucuucuucuggacuccucuggcaccugcacucaggugcacaggcacacauaaaaguaaaaucaauucugauuagguagcgggagucucagcacucaggcggccgagggcugugcccaccuaaucgcuccaccagucagcuuuauggcagugaugucuuuucagugagaucauacacaagagcacuggagagauagcugaugcaaacuccugcuuagugcugugggacauuccagggcuacuuacaugaccuuugaaaaguaauacucacuugauuuucacaguagacugcauuuagaaaauauuacuguuguguuaguuagguuucgacaguuggaacccaaagcagcuugggaagaugagggaaguugaggaaguaggagggcaggggccucggaagaaucacucauuucuuguggcuguacuuguguguuacccccgcccccuuuucuucuucuucuuuuucuuuuucuuuuuuuuuuuuuuuguauugugagacagggucuuacuguguaguucuggauggccuggagaucacucuguagacaaggcccauuuuggacuuaagagauuaaccuacuucugccuccugggugcugggaauaaaggcauguggcuucugccugucaaccugucuucuuauagcacccaaaaacaguccaaggguggcacuuuccauagagagcuggguccucccacaucagucaucaaucgagaaaauguccuacaggcuuacccagccuaguggggacacuuucuccauugaggguuuucucuuccagugacacuagcuuguguuagguugauguaaaacuacuaagcacaaugaccuuaauuuugguuauuucaccagauggcuuuuuuucuuuuuucucucucucuuccuuccuuccuuucuuccuuucuuccuuucuuccuuccuuccuuccuuccuuccuuccuuccuuccuuccuuccuuucuuccagauuuauuuuauguauacgaguacacuguagcugucgucagacacaccacaagagggcaucagaucccauuacagaugguugugaccauuacacgugguugcugagaauugaacucaggaccucuggaagagcagucagugcucuuaacagcugagccaucucuccagcccaccagauggcuucuuacauguugucauuuaugcaagguguugugccauacccuugcaaucccaggacuggagaggcugaagcagagggcuugaugucugccagcuugggcucuagagugaguaccagaucagcuaaggcuacucaaccccauucuguuuccauuuaagauuuuugaaucacuauggaaauagaaagucucugggugcgcuuaugagcaaucauguauauuaguuauuuuguguggaagaccagcccuaaaaguggaagguaucauuauaugguuuggguuuuggcuugaauaaaaaggagaaagaugaguacuagccuuccucucugccuauucccuguggaugugaugugaccaguugcugcuaccgccuucuucuccccccccccccccccaccuccuguaaugcaccuucuaucugguuacuuuugccagguauuuugucccaguaucuagacaauuaacuaauccugcuaguuuguuuugcuggcuggauaaugcaugcaugcacacaggcagggcccgcgucuguacucccccagggcuuccuacuccacggaggcuguaauggcacauggccuuugauacuugaagaaagcuagugcacacaggguggacgugucgacugccagcaagagcaaaccuugcugugcuuaccucacaggucugccuauuaaaugucuuggacucaggggacuuuuuuagguagagaacuauauuccaggaaauguauacagugaagagcuuagacucgguacugcagcuacagcuuuaauaagauggugggaauuccucucauucacuagguuccuccgugcuuccuugcaaugaaaccucagacuccuuuacuuguguaauuaaauggucagaccuugugguauagcuaauacaaaaaucaagcuuauuuaaaguauuuguuguuguuguuguugauauaaaggucuucuagcaugaucagaaagugcuucaaagcagguucuuuaaccagugagugaaacuuugauccuguugguaaagacauugauaagcagagcaucccacuccucagaggucgcugcccucaauagugcucagcacugccacagaccgaggucgucuguuacuccugugagaaauugagaggcauccuguaaccaagcaaucaguugauguuauuuguuuaaaaauuuuuuauuuuauauauauggguuuuuugccugcagguauaucugugcaccacaagugugccugguaccuggagaggcagaagaagguaucaggucccuggaaauggagugugggggcugggaacugaaccacugagccaucuuuccauccugccagcaccuuguuguuguguuuugacuuuaguagcaaaauaacuaagcaguagguggaaggcauauagggcuagucaggugaacccuuaggcuacaucucccuguuuucaaagugucucuucuuaccccuccaggcugcgauggacuucagucaauguuuggagagcuguguaaagaguugugucccugugcucuggccauggcgacugaacaaaucuguacuaaguggcugaccuuuggucagugccucucuuucucuguggacuuguaauucuguuuuucguuuguacaaauaguucugacagcuuaaugcuuguuuuucuccuugcaucuuaagaguuuucucuuuugguauaaaaugacugagauuacacuggguggcugcaguucuuguaaaagugugugcucuguggggaccagcgauguuggcucuuaugagaccuuucucaacaaaccaaugcacacuuggcucuagcucccuagucgaaccccuaucgggagcuuguucuuucuucuccuguguguguuuuguuucagcuaguuacugaugugguugagguggcggcuuuccugggggacaguacagcuuugaacuaccuucccugucagguggaaaugaugcaccccaaugcccauggaucacucaucucaauaacggcuuuauuaguguuuuuccuccgagggaagguucaggagcaaaggcugaugguuucauagccccgguguuguuuggugaugggcagggacuuggaagaaguccuguaagugcugggcagcacuccccacugaguuguauuuucugccuaaccccugggccuuguuaguuaguuaguuuguuuguuuguguuuguacggacaaagaaucagguagccuggucuggccuugaacuuuguauggagcuaaggauaacccugacucugauucuccugucaucuccugagugacaggaucacagcuaugaaccgugcagcagacugacauacauaauacacccagcucugauuauuaagaugaugucuuaucacuucauaugauacaugugaugacuccuguaaucccugaagaauccagaggauugcuuggacuuugaagccagccugggcuaauggcaaugcuuugccuuaaaacaaaacaaaacauaagcaaauaauuuuaaaggaacucugcuucugugauauuaaagacaguauuuuaaaauauugcccauguauauuuuaaaaacaaacuuuaucagggagaagguuacuaguccuccaggugaagccuaacuaguaguauagcugcagguuagugggugucacugcuggcacuggagacauaugucuugagagaucagugucacaguaaaaugacacaaaugaauacagaagaguagaaaugcgauauaaaauccccacaggcuucaucuagucccuguguuguacuagaggcuggugcuuacaacaucucaccucaugugcucuauguaaugucucugcucaugugcucuauguaaugaugucccugccucaugugcucuauguaaugaugucccugcucaugugccguauguaaugaugucccugcuuuuggacuuagcuggugcuuuggaaguuucucugcagucgguugaaucuuuuggagaggugaacugcaguuacagagcaacacagcguccccuuccuuugauugugugacagggucucacuguguugcccacgaugcccuuguacgcaggacccuccucccucagcccccauugcugguguuacagacauggaccaccaccccuggucuuuucuuuauucuuugaaaggacuuucaaggggauagcaaaaugcaguuguagucuuuacagcccauuguuuagucuuucgucugcugauaucuugacuuuaccuuggaacccugacugguuuuuaguauucaugguuacuuaccguucagauuaauccagaccuaagccuggacugccaaaaucgaccucagauauuccugucucccuuugcuuaaaggggaguuacuauuugguuuuguaugaauuccuacguacauugguuccguccucacccuucagacacuccgucaaucucagugguuuaaagucccgccguucacuggacggugucauggccagugugucacugcggcauuugcuguugaccuccuggacaucaaaccuuacugauuacuuuuuaacaaaaugacaauuaaugcggagagagaccaaagccuuucuuuuacaaucugauaauuguaaugaaugaauugacuuuuaaguuugaguauuggcagaagaggagguguugguuucuaaugaguuuuguuaguugaucaagcucuguugaauuaugagaugcuuauuuuguauugacuuagcaauuauuuauuucucccuaccuccauaucuugagcgggucacuucuugaggcuuccuacgucuucauuugaacaauugcagcuugcacugugaugugugcucucuuacgucauccccgccaucugaccucaucucuggaacgcugagauggauuugucuucuuuaaaccaucacucacuccaguuuccauuuugcagacucccauucucugugccagauggccuuagcuuuucuuuuggcuucuucccuggcaacauuugcugacuugugguguagggguuguaccauuugcaccacccauaagagaucuuauaacaaugauucugauuaguuacugguaucaaaaaguaccaaccuaguucugccuuaaugcuggcuuugcacacaugggcacuggcugugaucccagcaugggacagaagaaguaaucaacuuagaaucaacuuaguguuuugagagcaucacggcaaggcuggaaggacguucaguggguaaaguacucagauagggaacauccaucuaaaaacuugguauagcagugucugucacccagagcugggaggagggaccuuugaacccuggagccuaaauaauaucuucuguccuuuaaguuguuuaucacuggcaguuugucacagcagaaggaagggaguaacacaagaguuauuucguaguuuugaauaaaaagcauauuuucacaucuauucucccuccuuuacccauacuaaaacagcaucgcauaguacuugcuuauuaaugcucuguguuuugucuuguuaacccacaaagugcuuuuacauacauauuguaauuuaaacaucauuaaacuauccagacaguuccacucuuugacaguugaagaaacagauuugggggcauaaacuuugcuccggcucaguagcuaagcacagaaaucucugcuucaaagacgcugcauaaccaguuuguuucccacuaguauggugauauacccccuuccucucccucucuccuuucuuuuguuugacacuugauccuggguuuuguuacauugcccagacuggucuaaagcucuucggagcagggaaucccccugucccagucuguggagcaggaccucgggcacaugcugcccccucccccuccagucuguguugcaggaccaugggugcaugcugccacacuuggccauacuuguuuucuuucuuucuuucuuucuuucuuucuuucuuucuuucuuucuuucuuucuuucuuucuuucuuccuucuuucucucucucucuuucucucucucucucucucucucucucucucucucucucucucucucucucucucucucucucuuuuucgguuuuugagacaggguuucucugcauagccuuggguguccuggaacucacucuguagaccaagcuggccuugaacucagaaaucugccugcuucugcuaggauuaaaggcgugugccaccacugccccuguuuuuguuuucaagacaggguuucucuguguagcccuggcuaucugggaauccacuguguagacuaggcuagccuugaacucagagaucugccucuaagugcugggcuuaaagugugcgccaccccuucuggguguacuuguuuucuagagaagcuaaccagucgggccugguguuggaugagaggcuggaguggagcuccacuuggcaaacaaacaaacucuacaaaccccuucuuaaauguauuuuuaaaaucgauuuauguaaucauuuuauuuuagagacagggucccucuuauucaagguuagcuucuuguagcugaggcuggccuugaacugauggccuuaguacauuaacuaacugucuuugucaggguuucuauuccugcacaaaacaucaugaccaagaagcaaguuggggaggaaaggguuuauucaacuuauacuuccucauugcuguucaucaccaaaggaagucaggacaggaacucacacaggggaggaacuuggagucaggagcugaugcagaggccguggaggggugcugcuuacuggcuugcuuccucuguuuugcucagcuugcuuucuuauagaacccaggacaagcagcccagggauagcacuacccacaaugggcccucccauccuugaucacuaauugagaaaaugcuuuacagcuggaucuaauggaggcauuuccucagggagguuucuuucucugugguaacuccagcuugugucaaguugacacacaaaaccagccaguacauuaacuuaccuaguuucucucucucucucucucucucucccucucccucucccucucccucucccucucccucucccucucccucucccucuccugucucccucccucccucucccucuccuuuccuuccuuucuucccccuuguuucacaauaacaaauugauagcuuuucagaguuauuacaguuuggaguuugggaucacaaagcccuaaguucuaauucuagcaggguauuuauuaacacuguucaaagccucuaugauggguugcuguuacccaucugauggucuuuguggaaaucaagguagggacacacauuagugugucccuggcgaucguggaggcugaaggacccauuucuuaguccugcuuguuuuggaauuaauccaaguuucaugguugucauuuaguaguuuucuucaaaguuagaguauuaaaaugguuacuucccucucuuuuuaacuaaugaaaccauuugauacuaauuaaauaauaauuuaaacuauuaauuaacacuuugauccuucuaaguacugagccgugggguguuaggccauuguuccaugccugaguuuuacccuucauaccccuagguuucagaacguaauuucacuuuccagagaucucuuuuaucucauacuuuacgaaaagaauguccugaugauugaaguauuaacgaauugaacacagugcaguuuuuagugauuaagauaaaacacuuugguuacauagaacucuuauugcaaauucaccuuguaacaaauuucuaggaaaaaacaauuacucacgucugaaagcuccuccgacccaccacaguguggugggagcacaguguggugggugagcaucugugaagggucacggugcugugucgagggucccuugcauacaccagcacuuuggauagaauguccuuuggagagggacuuuugguggagggagcugguugguacaucugagucuucaguuaccaaaauguuuugcuccuucuguguuaguggagagcuauggcuugcuugcacuagagagcgugugccaguggcacaccaugaguuagcugaggugguaguccaguucugaggcugacuucccauucuagacucuuucuggggauuaauaggaguacacugucauuugugucuugucuaugaugccuuaaaaccauucauuuuaaaaccuaagcauguguguaauauuccacaagauuaaucugugaaguuugcuguuuuccuuaaaacagagcagcucacgggccgugcuuuguuaucugacacauagagaaaagguucaagauugccuguguucaauguuccauuugcagagauaccaccaugcccucucacuuaguuaugucagccugugaagucugugaguucugcucugugcacaauguggacaugccacuuccugcuugcaauccucacccuccucacuugcuugcauaguagagagaaccugcauugaggcucuggcgaguuuuaggggcagccgucuaaguccuggcccauggcacccauuucagcuuaccuggauucuauuuugaaccugauaugcaaucugucccucuguggccauaagcuagugaccgcgucaggcacuucugucccugcacacaguaaagcuuaguuuguuucaggucugguggggguccugcugugguuuucaucuauguuagccauugcuaagacuccuuauuccaacuuguucacccucuacuuaaaaauccuauuugggggccgauggugugcacuuuuaccugaucacaguacucagagggcagagacuggcagaucucaagaguuugaggucagcccggucgcauacauagugaguugcagaacaaguagggccacacagugagacucugucucaaacaaaacaaaaaauauugauaguaguuaccucugacuguagacacagagcuaaguccccuggcuuuagcaggguccaaggaacacaguuacucacuagcaucugcucugugcccagucucaaccuugucacuucagugguucaucuugacccuccgugagagugaccuguuugcccacggcuauagucauaucuauuuuacuggggcagccuucauuguccuugucaugaagcguggaacaugccagauagcccugcuucuucucauuguuccuggacucaucucgacuugugguucauguaaauagcauauuucauaguacuuggcuguuaucaaaagcaacaacuaauaguaauauaacuaagauuacugguguaaaccaaacacgugaaguagauguuacuccauuuuagagaugagcaaguuaacauaaugguuaaaacccaaacuuaggucacuaaauggcauaaguagauucaacccaaguaggucagauuugaagcuuuaagucugaaacauacagaccuguuggacugaucacgauucuguuuaagaguuauucgggauuggcccuccuuacugucccauguaaccugcaguuccuuucagaaucauuugaugccugauuuuuauucauaacuuagaauuguuaccaugaauacaugaggauuagguccagaguugcaguagacauuccuacuuugaaaaugaauccccucccugauggagagucacaggaagagcaaagccagagcguugggaaauggcucagccuguaugguacuugcugugcaagcagggagccccggguuccagucuccagcucccuguaaaaagcugcaggugauccucaccuguaaccccauuguggggguggggagagaaguggggaagggagcagagacaggagggcccuugaggcuugcuggucagcugaucuaggugauccaugagcugcagauucagugagagacccaggcucaaaauauaagguagagagccauagaagaagauacucuggcucccacguauacauggcaugugcgccugaagauauauaacacaugcacaccacacacgaaggaaaauuaaaaagucaaaauuuaugcggcaccaaggagaaagcauuauaagccaugaucagaguauuauacgcacaugaaauucccuagaaauucucauuucuaagaaaugcugucaaagcagugcucacuggcauuaguuacagccuucucuaggagguuguagcuauucuuugaaaugguuuuggggugugacuguugguaaaaguaggacuagaugacccccagcaccccauugucuuugugguucaauacaccuaccagaaccucaucucauccacaccuacucugugauugugauuuccagguggggcagggguggaauggggugggagugauggugugccuguucaaguacuuuauucucuucguugcccugagaauccccucaguuucuuggacauagcucuuucaccuugcccggguggucuccucuuugcuugagcaaaggccacugaagugauaaggguaggaaacagguguuuuccccugguucguuugcucacuuguuuguuuguuuguuuguuuguuuguuuguuugagacgggaucucauguagcccaggcuggccuuguauuuacuguaaggaugaccuuaaccuccugacccuccugccuccaccucauaagcaccaggauuacgguucccuaggacacugguuccugagugugugugugggucauaugccuuaugcuuggugcggaaagguuugaguugacaaggccacuuucuggagugcauuagaauuuggaagagauccccgccccccccccccccccgcccccgugguaaucuaccagucauuauguuuguuggccauguuauucacaaaaggcaaauugaacagaagagaguaagaggaaauguguggagguguuuuuuguuagaaucuguugugugcuacuaugaagaaccauccuuggccuugguucuaugaacuauagauuuggagccacagcagagcaguggucgccuugcucacgcuggccaucacggcucuguugagacuggggagcagccagccugcugcuuggcagaagcacacuaaguuguauggaaaccuguccagacuugacugcugaagguccugagacuccagugcugucuuggcagaugaacauuuggaagauacuacuagaugggcuaauuuucuagugauuuuaaaacuuuacuauuuaauuuuuucuucauaggucugggaucagcuugaauucacagucuacacaugccauuuccuagcggugugaccugcuguucuggcuaguuuucugucagcuugacacauacugaaguuaucgggaggagggagccucaacugagaaaacuccuccauaagaucaggcuguagucaagccuguaggguguuuuucuugauuagugauugaugggggagggcccagcccauuguggauggugccaucccugggauaaugguucuggcuucuauaagauagcaggcugagcaagccaugaggaacaagcagcaccccuccgugggcucugcaucagcuccugccuccagguuccugccccauuugaguuccuggcccccagugcuuuagauggugaaguguuaaacggaacuuuuggucaugguguuucauuauagcaauaguaacccuaacuaaaacaccaacuuuauguaguuuagcaccuucauguguucaacuuuauuacuuagagaaggaugcuuacaagaauugcuacuuaucagugguggcgcacgccuuuaaucccggcacuugggaggcagaggcaggcagauuucugaguucaaggcuagccuggucuacagagugaguucccugauagcccggcuauacagagaaacccugucucaaaaaccaaaaaaaaaaaaaaaaaaaaaaaaaaaaaguugcuacuuacagggcauaaaacaucuacagauuugacagugcugggugcauaauuugccuucaguaaaacagagcugcuggaagucucagcugaacugugguucguuuucugagcacuuuguucaugucguuuuugcacucugcauguacaguaacaacagagcagagacagggaugcucgguguggagugcguccaucuagcaugcccaacaccuuggguuggucccugaagcauaugaacuagccuugaagcgcgcaugcuuguagcucuagcucugaggagguggaggcacaaggauuugaaguucaugguuauccugugcagcauugugaauuggaggccagccugggucacgaaagauccugugucagaaggaaaacaacaucaaaaugcagauuaaguucagagauuucguaggaaaaaaauuuugaauugacagauaagggcuugaacacagcuggcccaggugucuccaacaggcuuuccugggcacaaguccuguugcauugagcuuugucuagaaaacugcuuuaaauugguacggcuggguggcacauaccuuaauuccagcacucuggaggccgaggcugggagauuucuagcuucauugcuagccuggucuacagagcaagguugaggacugccguggcuacagaggaaaauaacucucagccacuuacccuuguuuucuuuccuguugcuuggcagaaauugaucuaaaguuugccaacagugggauccuugaggagaagaggugggagcuggggcaguuagccugaaucagcuuauccacaggcagggagaaguguucccacaccucugguagcucuccuaagaugaggugagaagcagaguuggacccugccuguguuagaacccaucccuuaaccguugucuuacaucagaugguccucgaaccuagaggcugcugcuguugcuccugcugcugcacgaugggagauggcucaguaggagggaaagggcuggccagagagaagcccaguccuucccacaucccagcacugccacacuucacagagaagauggaacagaccccaggaaguuuguacauggagcuguaacugugggaugaguuuccagagcacgaggagccuuuuuccgaggaggcuuccucuggcucaggguuucuggaugcuccauuucccgaagaaauguuaauucauuagcaucuauuuuugaaggguuccuguuacacuguugcaagaauacauugcaaaauauguuuuccucaguguuuuccaguguccagacaguuauucuucucaaugccuguuccucaggcagaucagugagcuaacuuaggguuaaagcuuaggguuagcuuccuucuuggagguuuuuaaugggucccuuaugguagcgacaugcugcugccgugcaauucuuuugcuguuucuucucuacaguuucuggcccuguggaggugguagcacagauaaucagagcuuacagcuuuuaacauuucccugaaauuaaaaaaaaaaaaugugugugugugugugugugugugugugugugugcgugcguguguguaugugugugcgugugugcaugugugugugugugcacgcauguguguguguacucugcuauauugaaguaagaagauaacuugcaggagucucuucucuccugccggcuggguccuagaauugaacucaggguuucggguugccuucaggggccuuuaccuucuaagccggcucauguccagccucuucuguuaaagcauacuuuucagccuuguuuggcauccaaagugagacccuucuguucgccucacuuacacuuacaagaggauacaucccuggcuuuaacgucuuaugaaagcuaucuacuuccguguggcauuuaaggcugguccugcauaaaguaaauagaauagcaacaaccaaaagugcagugaccaugugccgugugcccagcauuacauuaaauauuuuguuuauuuaaucccaagggaagcccacagaccuauuuuuagcucauuuuaugacccuccauuuuacauucaagagaacuguguuuacuaccgauuauauuauguaaaaucuguaagugguagaucuugaguuccaaaccccuguuugccccgagucaagacuugcuuuuuuguuccugcucacagggguuuggaacucaagaucuugaacagaagugaggaaauguugggcgcaugcagcuuggcagaugcuguauagaccugucagcuuccugauaaagccaguggggacgucucaucgugagacuccuuacacaguacggaggagcaguaggcaggaaaggagcuaucagugugauaggcagacaccucccuugcccagcgccuuuucuuguucuugguggugguuauugcgcuauuaacuacaaagggaguguuuauuugacaaccaugggcgguuaaagcagaugaacucuggcugcuggcaggcuggccacacgccaccaggcugggcuaccugcgaggugcgcacauuguuggaucucaggagacacagagcuucuguuucauuucacgacagaggucauguggggacacagaauucugcuaagucuucacguggaagauauugucaggugacacgcacuccuccuacaugcucuccauggaagaacugcucgguacucuuagcuugaaguauauuucccaugaagccaauauugggaaguaaguuuuccucuucuagaaugcugcuuuuaaaaaaggaacucugccaugacuggugugaaaugcagcucucaggagcaggugaugaucucggcagggaggaaggcacagcgggucguggacuucuguaaaucuguagcuuuuacuucuugguaaagugauuaaaaguggacuguaguacuuuauuucauuguuucaggugaagaucagucucuucuacaguauagacauuucccgaaaguuaugcuaauguuaagacagacagacagacagacuuaaaaaaacgggaacuuaggguagauacaaagacaguuucaugaaagcuuaaugacuuugaggaacuguaaacaaggccaaagcacugggacagugugaggaagcaucagaagagggcuggcuucccaggaggccagggagagaccgagcagugaugguggagacugcguccucuaauggguaugggaucucucccaauagacaguaggacagugccauauggaggccacauguugaugucagaugucuucccccguugcuucucauucuugguuuuguagauuagacuggccagucuuugaggucugucuccagcucuccagcaccauggucaugagugcacgccacuacacugguuuguaacugccucaccuggccuuucccuacaugggugcuggggaucugaacucaaucccccauguuaugcaaggacuuuaccuauggagccuugucucaggcuucaacuccucuuuagaaaggaaauaguuaaguuuguccucauugagcuuuuaaacuuuguccuaauaaauguuaccuuggagggguaggaauggagacuauuagcuccauuaggucuccauuguuuggagaccauugaaaucaccgagacagaucaucaccuagguugcagcuauggucagagaugagguccuugccuugcacugugucagccuggguucccccuaccccuggacuucaguaaugggcauugaacuuagguauuccgaaagaauacacucaauucacuaguuugaaaauuauuguagguuugucuuauucuugaggcucgucggaguuuaugccuugguuucacaggcucacaaaaauagucacuggcuucagaccuuacagacuugacaaaccaagguaguucccauuguaagugcauuuagacagcucaugggucuuaaguuuuuaggaaagaaagagagggagaagugacugcacacagguguauaggauggaggggugagacagcuguuucugagcauggcacaaggaggugaagggaaacccugcuguucuuguguggcuagauuguggaggaaaggacaggugagagagugggaccucgggcuaagcagaguuaccuuauaagcuuugcuaaggaguuugagagcaaagcguuuaaccugggggugggggagcauauuaggccguccaugagcccugucacccaacccagacugugggaaagagagaagacugggaaaggaguggauaauaaggaggcuccucaguggcaagagaagguuuugugggagcagcagaagaagauaguggucaggguaugccauuggguacugcuggagagcucucaggugggaguggacaagugcccguaggagucuguguuaugagccuugcagagaaagccagauucuagaggacaggggaccuuagguaaggcuguaacuaagccacucuuagagacuuggcucuuaggagauacagaaaaguuagaggaggagauggacuagacucgaguuguuagagauggcucagugguuaagagcacuuacugucuugcagaggacucagguuugguggccagcacccacgagguaguuuacagucaacuguaacuccagauccagggaaucuggcaucaucucuggccucugcaggcuccugcaugcaaauggcacacauaaacucauguaggcacauucacauacauguaaaaauaaugaaugaaauagugagaagaguguauggaagguucugguaaggaugaggaguauuuacugucuagaauuccuuucuagagaaaaauuagguggauggaagagcaaacauugaagaguuagagaauuaacauuguuuugaauacauauguuaguuguucaucauuacuuaaauuaacuauguguguauauucauguacgugcauguauguacauauacaugugaauguauaccagagcacauauguggagggcagaggaaaacuuucaggauucaguucuuucuuucuaccauggacugugggguuugaauucaagucgucagcuuugcuugcugacucauuggcucuggucuuuaucauuauguggagcaagaguuaccacuguugaacuaugacaacauaucugguuuaauucauacagagaaaagaguuaaagagauagggaagauggggcuugagaaaucaaagggauaugaaagauuagugaucagaauugaaguuuugauuaaucuaggaaucaucauuaauguaggaacaggaugggagcaacacauggaaaugaagguuaggucuuggcaaugagguaaguuaugcacuagaaauuuccuagagagaagggcauacuuaggaugggaagacauggucaguuacaaaucacucuuuagacauagaaugaugaucuggacauuguuaguuaggacacagaccagcauacuaguguaguggaaugucgugaacagucagaggggagaaagguucuaccuucccucugucuccagguagaacucgggaagagagacagcaguaaucccauacauaguguagagcuauauugaagucagugauauugggcacuguuuugugggcagaucucaccugcgauucucuggagaaggucgcucuggcucucuuuaugggcaugcuuuuggaaacuggugcuaagcaaccucuuguggguuccucauguuaccguuaccguaacuuggugccugaccagugaucucacugaguugguuaucugcccccagauauacuggcuagauagcauuagugagcacauuaaaaaaugcauucauuaaaaaccagacaaucaucuuggagcuggcuuuagcaauaucugaaugaguuggacaaguugggaagaaaaucuuaagccugaaagcuacucugucuuccaggccgguuguggggaaggaacaagagaugaaucaguuguaacuuaaugggaucggauauuacuuuuauauggcaugucacuuuaauacaaugcuucaucauuaaugucuuaguucucucacagcauuaaggaaagcugauagucuccuauuuuauuauuucuuggcuccacgacagagcugugcauuaaaaugcacuuacggaucuugaaagggaagucuaagaguaguuaaaaaacaaacaaaccccaaguggguugagccgacuuauaaacuaauaauacauagcuaauagcagacaggcuuucucagaaggugugguuggugugccuguauacuccuucuuuucuggagccugcucugccauacucuuacuuaacaccaauauuaaauuugggacaagauagcaaaauaugccauuucauuaugagcuuuuugggguuuuuuguguaagacuaaauauuuagugauuagguuauugagacaaaaguggccugauacaaaauucuagcaacagugaaaaaaauaacaucuaacauacaccuaauuagauauuauacauccuacuaacacaucuaauauuagauaguguaccugauuugcacgucauucacaaucaguaaaugucagguacagccacauuuuaccguuuuguuugccaaagggauggcguguacuuuucaaacgauaacauaaaugcacauggggucuuagcucuguagcucugcuugacuaacaucaugaaguagccacccaaggcugguccuucuuugugcuggguguguaauuguuagcuaccacaucuagcuuccuuuuuuuguuuucuuguuuuuuguuuucucuuuuguagagugcagguaaauuuccaguccucuccugugcuaggaaaccaccccuguggauaugcccaguaagguguauuuuuaauguaaaguaauuuaguagugauguuuuaaaaugugucaacaaccugagacuguaaucuuuauucuuaguuuuauuucugagaguuugucuaauugaaauagguuaaaacaagaauguagcuguaagacuauuuauugcaacaauuuuuagaaaagaggcacaggggaaagaaaagcagccaggcguggauaguuaauguuaaaccauggaaugcuuuuaugauguugcagggacguguuuaaagucuuuggcagcuaaacuacgugcucucagugguaaaaaccacacucuguaauggcacguguguacagcauagcuucagugugugcucagauacacacauagggaaagaacagauaucuucaagagggcagggcuaggugcugcacguguugccauggcgauguugggagagguugggaugguggggagaaaacucugagcugggcugcagaugaacugcugacucaagucugaucacacaguaugaauggcaaaauuagugcuuuuaaacggauguagauuucguaaauuuucuaucauauggauauauuacuuucuaguuuaaaaaaaugcaggucuugggacuggagaacugccagucaaggcuacucacugcucuugcugaggacccagguucaguucccagcacccacaugacaguucacaguuguuugcaacuccaucaucaggagaucugaaacccucuucugaccucaagggcaccagacacacacgugacacacacauguacccaucaaaaauaaauaaauaaauaaauaaauaaauaaccaaccuuaaaaagguaauacaggacucgagacauagcucaauuguuaaaagcucucagacuuuugcagaggacuuggguucaauucccagcaccuacauggugguucacagucaucuguuaguccaguuucagaggacccagcacuuucaucuggccuccacaagcaccaggcacccacaugguacacagacauacgugcaagcaaaacauucauacacauaagauaaauaaagcuuuauagaaauacuucagagccagguaugguucacuucugcaguccaagcacuuugcagccagcagagacaugaagagcaccauucugaggccacugggggcuguauagcaggacucugucccaaacauaaaaacaacaccaaacaauaccaacccccuaacugaugguuuggugcucagcuuucagugaacuguguaugagaagacugugcuguggaccuagcacgugggcuacuguaggaagggagggugaaaguguucuugaauugccuugguuuguacuguuagccacagccaguuuaugacuaacaguacaaguacaaacaguuggggaagccaccacuaaagcaaagaauggagggaugacuuuuauuaauauauuccuacagggcagcugaugguucaguugauuaaagacuuugagaaccagagcuggacccuggagcccauguuuuuuguuuguuuugcuuuuguuuuuuuguguuuuguuuuguuuugaggagcagggagugcaaugguguguacuugagauggagagauggagauggguggauuccuggggcuugauggcuagccaggcugcccuguuugcugaguucuaggccaaugagauacuuacuaucuuaaaaauaagguugaaagaugcccaaggaacgacacccaggcugugcucuguuuuccacacaugcacuugcaaccaugcuccauacaagaguagacacagguacacacaaaauagauugcuagauuguggauagcuggucuuuuuuuaucaaugguuucuucagcuuaaguguauuuuuuccaacugaaugcuugagagggcuaacuugccuuacagaauuaugcucuuucugaugugauaagacauacugauguguuaaaucucaaacucaugcaaaaccagcauucaucuggaucacuaugggccgguagagguagaaaccugucugaagcugggaggaagcacacauuacaguguguuuggaagaaugagaguuggagugcagcagagcugaaguuaagugugcguguguguaucuaccaguagagacagaagaugcuaaaaccugaauuggcacugcuugacucuaacuccacucuagcgugaaaugcaugauuggguauguuguagcccuguucuugagcuugcauguaguugucuccuccccuccccuccccccuccccucccccuccaggcccucucucuuuccuucccuucuccccccccuccccuccccuucccuccccuccucuccccucccuucuccucuucccuuucuccuggcucucucucuuuuuggacaaggucuagcuauguggcccugucugacuugguacuuguuauauaggauaaaauggccuuguggcaauccuccugccucaucuuccugugcuagggcugcaggcauguuccaccaucccugguugacuuguguacuugugccccuuuaagcccuggccuuucugcucugcucgcugggaugauguauuuguucuucuaaauccccucuaaauagccccccccccccgcccuauuucugaaaaaggaaacaguggaccaauaucuuacuuuuguccuuauguuauuaacuuccccuuuguuuuuauuuuacuuuagucauuuuagauuuuaucuaguugaauauaaauauguauguauauacaugagcuaacuuaaacuaauuuuuaaaaaagaacuauucauuuuauuucacaugcaugacuauuuugccugcauguauauccguguaccacuuucauaccuggugcuuauggaggucaaaagagggcaucagaccccuggaacuugaauuaggaugguucugagccaucaucuguguccugagaauugaacaccggccucauacaagaacaagaagaacucaaaacugcugagccucaucuccaaacgcuuaaacuuauucuaaaucaaaacaguaccaauuaguaaauaaaugguuccuuuuccguaggguauguccucccucuucucuguggugcgugugucacuauaaguaacgugaggcgcuugcuuuccaguucuguacauaaagugcuuggcugugaggaugcagucagagccuguggaguuuguugagugaauaauaaccauacagaaaucauucugguggcuagugucuucugcucgccuuugucugguuuguccagccagcaggcugcuuccccauuacagcccagaggaucugcugacgagcuaacccaugucuugcucagcgcaccuuugccugcugccggacuaucugccaacagucaaguacagagccagaggccgaggaucaagguauccugaagaggcagcuuccuaaccgugcccaccaaccgcuuccucagaaucgagucuucuuagcauggucacuugagauaguuauaaaguugcuugguggccaugguacuggccaggaagcggucauuuuguuugcaugcuucccuuaacugacugugucaggagcagcgcuggcaccuuguuuagucuccuucugauggggguggaguagcgccgugccuuuauguccuguuugacuuguuccuuuuuauaucacugguuuuggacaaauuugcagaaguuacuaauauuuucuugauuauaaaauuacauauguauuaaagagauuauuguauuuucuuuauguuuauuucauauaaucaagccuuaguagggaaucaaaauauuaucucugugcuuauuuaacaaaaugauguucuucauuuguuauuuuauuuuaauuuauuuuucugucuaucuauuuauuuuucaaggcaagugcugacauuguaucucaggguggcuuggaacucacucugugaccaagcuacauucuuccugcaucaguauuacaggcacaagccaccaggcuuggcuuauucucuaguuuuauuuuuauaaacaagcaaguauauaacauuaucaaaguauauugcauuuugacagaugcuggauaauuuauuuaggaaagauaauauucuuuucccuuaaggauauuauugauuugaugaucauauuauaaaaagaacgauuuuuauauuguuaaacauguuaucguuccuguuuaaauucuuagcaggcaaaggcugccuauagaaaauaauacacaaaacucaugugcagauucuguguuuaugcugucagagaucaagccuggauuugugauuugcccacagccacucugauuuccauguguguccugcaguuuagaaggagcaguuguuggcagucagugugcccuggguuccuuuguuggucgugacaauuggucuucuuguugugucuuccagguugagggaucgcagugugcuccucaaaagcauuucagguuuuccaacuaaugauuuuuccuccuauucugcacuguuugauuucuuaggcaacguggccucccccggcgucugcugacgucuguccagccccucucccacuccaucuccaccuuucuugaacauuguuccuccuucuacuauugcuuuagaauuaaccaaaggaacagacauguuuucuuaaaugccugcuucugucugccccauggaaguacaggacagaagagacaccacuuucagucuaagaaaccgucuuuauguaggucaguuuuaauagagcuuuaaucauaaagaguuuauauucucucccccugucucccucuuccccucuccccuucccucccuuucucaccaaauuucccucccuucucccuacuccucccucuucccugucuucagcuccuuucucuccucuauccccugcuucccuaccaccacgccgcagguuucucgugugaccuaugcuggccuuaagcucagaucuguagcugaacucugauccuccugcuucugccucucgggugcuaagauuacaggccugaaccacagcuggcuucuggguucuucccuuuuccaaguuaaaacguguagacaauguggaacaaagucaaucugaaauuauauuaaucuaucuaucuauucauucauccaccuacacacccauccauccauccauccauccauccauccauccauccauccauccgguuacucaagaauuauacugacauuucuuuuuaaaaauuaugucaagccagccugacacccagagucugauuccuggaacccacaugauggaaggagaggaccaauaugucuuccgaccuccauacuuucucuguggcacaagcuuacacacacacacacacacacacacacacacacacacaguaaauagacaaguguuuuugagauucauugugucuauggaagcauuucuaauaucaagggaaaggggugccaagcaaaacugugcucauuucuggaaggccccaccauaggcuccuucaguaaauuccccagcuggugggguauuugggaaaggugguuagaccaggagugccuuuggagagugaggucccugggccucuucuguucacaaugagaugaagagccuccucugucugcccugugcuacccaaacaccaugucaagcagcuggaagcuucuucccuuauagcauccucucagucauuuucgucacagccagacagaaauaauaauccagucccuauuggacuucuugucuccuuccgcaucacucuugucucggcuccuauccuagccugagauggccauuucugcuaccuaaugcauaaccuuuacauuuuuauuguuacuuagcauuagacauauaugucuguuauuuguauauuguugacaauugaaagagggucuagcuuuguuacccagaauggccucagacucauaauccuccugccuuggucccuugagugcuagcauuauagauguguaacaggaagccuagccuuuccucauuuuuauaauguucccuccuuccccgacuuuugaaaguuucuggcuauucugaguauuuucuuuuuaaaauuaccaucgccauauuaccaucuaaaugaaugguugaguguugagaucuuccugauguuuugugugagguggaucucaugguuuccucugagcuggguuuggcgugugccuuugcugcucucaucucgugguuuauaucauccuucaagcaauggugccugcauugagaaaguuauuuccaagaaacuuucugguuugaauauuuccuggcucuguguugaguuaauauuuuuaaugcauucucuagguuuagugagaauuguccccccuaagcuauagagaguucuaugaauguauuggaacaucuguugauacguugauccaucacuauauagcgauucuuugacaucuucaguuacagaauggauucuuaauuaacauuuuaauaauuuacucagaacuccagauucuugcuuggguugagaugguuacaggaucugcucccugcaguuuaguuuguugcuaugcuaguuugauugcauauuuucucuccuaaaaauagauggucucuauccagaccaaaguuuuuauaaauauuugcaugucuagcaagguuuuuccuacaacagugauuuuguuuggugagcaucguuuuuagaggcuccuugucaguguuuacucuccugcagaccucugcccuaguaaggaugcagugugcuggugucuuacuccaucugcaguguggugcuguuggaggagucucuuuuugucgacuucugcugggagcaucaggcagaugcucugcugguuaucuuugacaagcucaaucauaacccuaacuauaaccuccacaaugggcugcugcuuauaaagacauaggacacguacauaggagugugugugaacaaauccaacuggauaaguugggugccugggaagauggaagcuagcauaggaaaagggucugcuuguguagacggggacuuaagucagcugucuccuucccccauguggguuccagggaaugaacucuaguugcaagacucgguggcagacauuuuuccccguuugagcugucuuguuggcccuaucuuaaccauguuuaaguauaauauuucaaaauguaaugcacauuaacccugugcaaucaaugucuagaaguuuucucaucuuguaaaacaaacuguccucccaucuaauauucugcccuccccuccugccacugucaccugcuguuuuauuuguuucuguggauuuuaaguggcaaucaaaaauaauugucuugucaucuaucagucagguuuuuuuuuuuugagaaauuuuugucuuuauugaagguacauggauuuuugagcuugaugaggagagaaauccaguucaaaccaguaaccacaccaugugguugcaugucaccugcccaacacggaagcaacugucuuccucuguaaugaacuugggaaauugcuguuccauucgaggagcauagcaguagcuagugacaauagcuugugacuaauucuuacaggguacuuauuacacccacuucucagauuauaaagggacaagaugaaucuuaauaugugcaugcacgcuagugccgcgcacacauacaggcaggaaaguggacagaauucuugguguagaguuuucaguuuuagguacauagcugggucaucuuugaaaguuagaggccuaagguuggcuagauggcucagaggauguaaagagcuggcauuguagcagcugaggcaggagauugccaugaguuccaagccagucagagcuagucagaaagaccuuaucucaaauaaaucaaaaaagaaaacagaagugacaagccucggaauuuccaagaaacgguagggaucgaggcggggguguguguaauuaugauggugacguguuggcagugggagcaguagguucagcccugugacugugugacugugcgcuaaggcugaguugagcuccacagcagucuuagggaagaauuaaacagggaggaaacagcccucauaguugggauuccaguuucauuucucuuagcucaagucuuggucccuuuucucuuccugcccaaugagugccccugagacugccuagcucaccauuacagagggagaauuuacgauguauuuuuaaaaaugacaagaagaggggagaguggacagaugaaacuauauauaucuaaaauguuuuucuuuuaaaugaacucuucccucuggucgggaugacuggcggcuccaggagggggagguggcuguucccacuaguaaguucuucaguuucuguugagaggacuuguguuuugaccaggacuguguaauaaucuauguauauauaaacagugccugcaguuuacuacugaccuaaauaaaugugaacuugagaaaaacggguucuuaguaccaugaauuuaggcguaguuuugggauuuuguggcauaugugaagaaauguuuguguagcagauggaguuacagugagcacugaccaacauccuuauguccugauagacaucaggcaucuuguugauuuacaacuuaaccccaacugagaucuauuaguuucuaggcugugauuggcuugucugaaugccaguuuaccuaugagggagcuguguuacugcuuguggguuagggucagguuaucugaacuacacaguaggcuguggcugccucuucuggccuuaacccuuuaaaguuggcaguggccuacuaaguugaaugucccauagacuuuuugcuuuuucuuuucuuuuuuuccucccugucuacucucuuuucuccucuuuuauuauuguuuuuuguuuguuuguuuguuuuuuguuuuuaauuuuguuggcuugaaacagggucucacuaugcagcucuggcuuggacuggaauuuacuguguagucuaggaugaccccuaagugauuguauagcuaaggaugaccuugaacauaggacccucuugccuauacucccaggugcuggaauuagaguugugcaccaccuucucugaguugucuaucauuuuguuuuuaguauaaagaaaauaaacacagggcuggagggauggcuccaagguuaagagcucuggcuguuuuucagaggcagcucacaaccuucucuuuuguuacucuaguuccaggggaccugaugcucucuucugaccaugccuacaugugcaguacagacgugugcagacacaacacccauacacauaaaauaggaaaauaauuauuagguauaacuugaaauacaguacagaugagucucauuagcacaguaaauacaagcugucaugcgauggaaacuugaugcagacacacgcauguauacacgcuaccaaaagauacuuuugaaguuucuguaggcuccucuuucagagaguaguucccggaucuugggagucugugcacacagagguccaaggcuggagaguuugacaaacuagagcuuucuuaaguuuuauauccagagccaagaacuuuuaaaauccugagaggaaaccgcaggugacaucauggcccuggaauguuguugguauacagugaagaaugaucucagaagauuggacagccugcugugugauuugugcgacacguguccuuuguuugguuuuuuucccccuuugacagcacagcacacaguuuugaaacuuuacauagccuaagcucaugcauucaaaucagcacacccaaaaaccauuuccccagcaccaauugcgugcuuugcuguguucucugaucugggccccagaguuuuuacauagcaaauucuaacaucugccaaguucuguuugggugcagauagcaguggaauagacuggagaaucuggaagcgugugcuuucuguaggguaagugcaguugggacuuugcuuguaugugaaccacugugauguuuagcaggcugagcuggaaaggccaggcugcaugagaugaagaacacaguuccauugcuuccuucuggugccagugaguagccauggucuccauuucucuugugggauaugaguuuggcuguuguuccuuuaagaguagggugauuuauagccauaacuuuuagcauauggaaggucuaugcacauaaaacccuccaguaaaucugaauuuuuuuucuuuauauaucauccuuccuuaguagggaacaugccacgccacaaguuuaaguucaguggcuggagccuuagaaauuaggcaucuuuaucuuucucaucuugaaacaaacaagacuuuguuaguuucuugauugaauuuuaggucaggagcugagacacugucuuugccugucugcuguugguuaagacuucaugcagagacacccuuccuuuguaugguaaugugaaacaggguaauuacacacagacccaaccgacuuuggcagcaccagaggacaaagagaacccaagcuugcuucagccuuugguuaaaaagcagguuuaggaaucggagccccagaacuaacugcaucuucucuccuuccaagguuccaaacaguggucuguccuucuccacacaccagaacuuucccugaacguagacugauagguuugaugccgaugaagccauuucacguuggcugaucuggaacuauuuggcugguuuuccauagugcuaugaguuuuaaaagaugagggcgaaagaaacuuuuaaaauuguuuucauuguuaauuaucacuuuauuuuuuaaaaguucaauugcauaaauaaaucauucuguuuuuccuaagaagcaguugggauauaagcaugcaccauuccuuauacauauuaaugaaccaauuagaagaguagucaucccauuuaguuauugcuguggcugucuaggaauuauaauucugucuaccuuaguuugauuauuuaucuaauuugugauuuuacuaugaacaaguuuuuuugguuuuuuguuuguuuguuggguuguuuguuuguuuguuuuuguuuuuagaucagcucucacuguguagccaugguuguccagaaacuuacuauguaaccaggcuggccuugaacccaaagagaucacauugccucugccuuuugaauccugaaugagauuaaaggugugagccaccuuuucuggcuuugcuugcaguuuugaauagggucucugugugguccugucugcccuuagacuuacucaguucuccuguaucagccccgugagcaguaauguaaagaauguaucaucauacuugguuucuguaauagcuaacuaguugacuauauuucuagacauuagaaacaguagguuuccuagguaaugccuguguaccuuguuuauggcgggcauuugauccccuggaccuggaauuacagaugacugugaucaccuagauggaugcugggaacagggugaggguccucugcaaaacaagugcguccguccaucaaccauccgucuccccagccccucccaacuuguuuucaugauguuacgugugcucuguuccuuuugugcuacaauaccugcauaaaugcagguuguaguuuucuuuggcaauaaacuaauugguauuuucauaaaauauaaggaaggacuaauagaugauauaauuguuuuuuuucuuaaguuguugauguuuuaaauuuuuuaccucauuguuauuugcuauauucaauauuuuauucgaucaauauucauuuaugaucauucuuuuuaagugaaguguuuggugccacuguagcagcugucugaaauucuagauguuagugucacuuagcacugcugugcgccuuugggagacacgaggucugcugaggaaaagcuagcgauguuaguucccguacagucucccuaucccguguuucuggcugacucagagcaguggcaccacucagcaguuuucucuguggaagaguuucuaucuagguuuuccuucuuaucugcaaaauaaauauagaaaaauugaaaauuaauuaauguuuccugugcuuucuagggauugacuuaggcugcauaaauggcaccauuuacuacaugaaaugcuagcauuuguuaugggagcgaaauccaguuuacuugaaaaacuugauuacuaaguuucaggaggccuuuaaacuccuccggggagggaugcaaaaugcaucauagcauuacaguuuugguagaguuuuagaagugguaguaugcacccgugacaugaaaaccuaccuagaccguuggugggcucaaagaggcuagcuuuccuucuuccggcugcauaagaccagguggggcgugugugcuuugaccacaguggucagauuuaccaccuucagaaaugaggaggguaauuggaaaacacaaacaagacaaacaaacaaacaaacaaacaaacaaaggaguugaaaaggauuuuccaauuguuacugugcucccuugguccacugagacuccuguccuuguguguaggcugugcuaggcacaggugacccacggucugacucuccaagaacagcauugucauggcaugguuagcaggacaccuguccagugugacgaaucacccuagcguaagccuaugaaagucacacacgccaugacagucggguuaagcagcuuucugcuggacucugaguucuaggugcugaacagugcccaggcuucuugacaaacaccauucuugggaacagcaccguccuguccuuuggugagccucuguuauuuuuaccugagcuggcacuccaggaaagaguagauuugcuccauuaagaacauccaucuugaacuucauucagcucgcugccuccuccugaccucauuucagagagcacugcccagcucucuacacaucuaaucugucuucuuuguucuuugggcuaaaucguagucucucgaagcuuaucucccacugugacaguuaaaaucuuuuuuaggcugagagccucuucuuauuuuucuuuuuuuuuuugggagucuccuuaacagcagcccuuccuucccacaucccucucuuccacaccuugcuugggcugccacuugggacuguuaaaacuuccuggucaccucauuucuuuguggaguuuaccuucccucuacuuccccaucccuaacauuuccucucuuuucaaagaucuuggacugggggucagagucagugacagagccaucgccucacaggcaggaggccaugggcuccauccaaguaccuuuuguuugccuuccacucuuguuuagcuccccuuaccccccucucuguguuagggcugcaggauggacaagcucuaccaccaccccaugucggccaggacagcagcccuugcauugagccuuugcugccagccuagacgucucccuuuaaaacucccacugcucguuaaucuaaagucaacaccagggaauggaaaguuggagucugguacuucuuaccugaccuucauuuuuauugucagucccaucuuuucuuacacucagguuuuuuuuugaaguaucuuuuugugcaguccauuuaaguguuaagccugcagaacaaugguugcuagacauccgcacucuguaugccuaugguacauugcuggcacuuuguaaauagcgguguaaucacagcgguacucaugucugggccugagcgagucaccuguaauggcggagacacuuguguggcuccugccuucuaaaccaguaaaugguaaucagauagaaaugacuggaacugcgacaucauuuucuuuucaccuuugaaguuuucccuucaaugcuuugaguuuugagcagccaccaacagagcaauuuuuccauuguuucagauaccauuuauuaugcauaaacuaccaauguucuaacuuacaauugcuucaaaaaauguuuuauuguauauuugaccauuuugaguaaauucuucauuuuuuacccugcagaauuccuaaauguacaaacuaguuugcuuucgcugucccagacaggccagagaaguacaaaaaaaaaaaaaaaaagggaguugagcuguguagucauaaaauguugauguuuuagaugauagcuaacaucuuccuuuguaguccuuugaacgcugccugacccaucuguguuguccauguugaguccucuuggcucagacucgggcaucccagcuuaggcaugacacuguacaauuuccaggaagcagugcaacugguguguaaugacacuguacaauuuccaggaagcagugugacugguauguaaugacacuguacaauuucuaggaagcagugugacugguguguaaugacaauuuccaggaagcagugugacugguguguaaaagagacugucuccauucagauguccagcuucaccuuaccccuuacuacuaaaacuaaaggauggauuucuguuaagaaguugguucaaauacagagguuaagcuugucccaaguguggccggucuauauccugacuggccaugugacacaguuauuaaucauggccacuuacucccugacagguuuagcuuuaagaugucagcuugugaaguuugugguuucuuuacauuuguuuucccaauggccauucuguuugguaguuaggauuaggagaaaaagcuuuguuucuucuucaucagggcugguuugaaagguuuuacaauucccuuuuuaggcagcuauuuccuaaccuggaccuuuaagagacucaggggaguguggccagcuuucagguuuccccaaagguuuuccagguuuccuuggaucuguuuggagucuucagaggagggucaguucacuggcuaggauguugcuguaguugccauuucucagugaaucuggggaugccacagcuucuaagacucugcccugggucuccaggauaaaaugucuuuauaaaaaguuuuauuuuagccgggugugguggugcacgccuuugaucccagcacuugggaggcagaggcaggcggauuucugaguucaaggccagccugcucuacagagugaguucuaggacagcccgucuuguucccgcucccuccacgugcucauggucggccucuccgucucuacucuucucccccccacuucucucucugccuugugugcuucugcuacccucucaacuccccuccccaugcccugaauaagcucuagucuauacuuuaaaaaaaaaaaaaaaaaaaaaaagcucuuguuuugauuuuccugucuuauucuccacaauuagaaaauggagauugccugaaaguacuguccugugacaaacacuuuguucccaugguuaaggaagugugugcuucugguguuggcuuuaaucucugauuuuaauuugauuucuaagugaauggggacaauauauauauugaagcuucuuugaaguuugucuguaauuuuuuuuuucuuccauucuguagaccaggcuggucuuaaacucgcaaugauccuccugucucaguaguuuuuagugcucuggagcugagcugcugaggaacagaguagccuagcuugccggaugcucagcacacauguccucaguaguuacccugaauggaugucuccugcgauugcuuagcuguuagaucaccuagaccagugcuauccacuagaagaggauuauaugucauauugaaaucuucuccuccccuucuguuuugagagucccaccaauuauccauggaauugugauucuccugccucagcuucucaaaguaguuggaacuguaggcccauggcaccaagcuuggcaguauacacauuuuuaaaaaguuaaaggauauagaguuaauuuugaguaauauauucuauuuaacuuaauaucuaaacucuuauuuccacauguaaucaauagaaagguaggauggugagcuuacaguccuuugguaauacuaaugugauaaaugguauauauuugugugcacugucuacauucaaaugcuauguaaccauauguggcugguggcuacuguguacgauuagacauaucuagaccauucgguaauucuagaggugagcugagaacaaucuagaggagauaaaauuuguucuagaaacaggccaaaaaauugccuucauguaagagaacacucaccucccuaagguuuaaggacacaguggaacuagcagaagacauuucagugagaggggccgcuucuuuccuugaaggaugcccccuucucccgaggaaagaagacagacugugcuuuccucuguuggagguuuuuuuuuuuuuuuuuuuuuuuaaagcuguguauuugucauaguguuucacugaaacccccaccagggguuuuugcugggaaacugugguugguuugaucuuagaguugaauuuucuccuggugucuugguucuaccaccgugucuuuccucagaaugucgggucagaauaagcaggagaaugacucccuuugggggaagcagccacuaauucuucuuucaucuuccuucugugugugcaucccugugcugcagaauggaggcaaggguuaaagccacugugguuucagaagugagaacccccgagagcgaggagggaaguucuggcuuuggcaugagccgaacuuaauuucuuucuuaccagaugccaauuuaaaaagaauucguugaagggaagugucuugcggagggaaauuuuuaagaacguucacaaucugcaucuauuuagcagccuauuugaugugaugccauguuuaauuaauguuggagugucaguucacacagucauauucucugcaagggaagaggauucuguggagaacagaccaggcuacaggacucacaggauccugcgcuguguccacucccuucuuguuaauaguuuccaugugcuugggugagugugugacuuacagguuucccucucccaucucuaacaacuuacuggggaccuggggagauggcucacaaguuaagagcacugacugcucuuccugaggaccuagguucaguucccagcacccacagauuagcuuacaaccaucuguaacucucaucauggaggcuccaacucccucuucuggccucugagggcaucaggcaugcacaugguccacagacauacauccagacaaaacauccguaucccuaaaaauuaaaacaugcucuuuggaaguuugucuaguuaccugcagauuuacuucugcuauagcaugauuaauuuuuaaaggagccuauguguacuuuaagcuacagcuuuuaucauauagucugcagcugugaaaaaaacccaugcucaguaugcuguucucaaaauaauccugccgcgugccagccccugcucugugacuucaucauuucuucuguuguuccuccuccugcuguuuagaacccuccccuuuccugcuuacagcuagggcuugccauugucuagcgguacugcagugcucuuuaggacuggggcuccuuaguuggggggaggggcagggacacgcacagccucagcuugggccuugcugugguuuccgcccugugguucaggaugacuguccugaauggaauucauuuucccucagcucuguuccuuccauacucguuacacaucagcuggcagcaggccaggagcuucucugugcucccacaaauugucagcuacuuuacuucuggccccuggcuugcccuuugacaaaggaauugauguuuuugauucagaauuguguugcuuagugaagccagucuaauccaugccauagaaugcucaaaguuuaaggccacauucuagaaauauugaaagcaucaguaccuauauucaauagagccuccucccaccccugccccacuuaucuguaggugauaauuuucaagacccugauggggguuccuggagccauaaacaguggcacccccuucucccucacaaauaaaauagauuagccguggacugcaguaacaguuauguggauaugcucuuuaucuugacagccaaccaacuguagaucuuagcagcucuagcucaugauuucucuuccauuucuauuguugguuucuugaggcagagucuugccuuauagcccagcuggccucacacuuaggauuucuugcaugaaccucccuaguguacaggacuauaggcaugcaccgucaugccagcucccuucuaauaaaggcaagagggugaaggaaggaagccccucucaacuuccccaggacaccccgggacugcggaguuaccagcauggcugcucuuguacuuugggguacuuggaucaguaaaacacaggucaccugaacaugaucugagugauguugagcagcgagccugacuacugaguaauaggguagcgaauauggcaugggugugcuguguggagagaugauucaugccccagcaggacacaacugccuauagacaacuuccucaagcuugguagacugccaucaguuuaaaacuggcacccuuuauuucuguaauuuuccauuuaauacuuugagauugaaguuaguugcuaccugaagcuguauagagugugaaaauggagguuaggauggugccaaucucguguauguguaucacaggccagacacacuuaagcagguugugugcaugcccaugcccauguuuuacagagaaggagauacaggaguuaaaauaacuugcucuauauuauacauuaagagaccguucuaaacuuuuuaguuuaagcaacuggcuucuuuuuuguccuugcuuaugauccuguauccagaacugggccaagcuccccuuucaguguuuuguggagucuuugucuccuuuacccuaaggagcagcccagaauuugaugcuguggaggaauuccauagagagguacuguuugcuaugguacgguuuggggagcaggcccaggagaagcaggugcagugccaggccagcugguagagugauguuugcacaaugaccagcaaugccugugggccucacagaucagaguugcagaaggugugguggccccgcucuucagugucuuaaggccccucccgcugcucucuguccacuuccuucucugcucuaagccuccuguuccccgugugucucucuggguggaagugcucauccucugcucagccacugcaccucugucccagaggagauuccaaguccuggaagucauagcugugcccuuuaguccuggagcuggagacacacgcagggcgcacauuccuccagcaggcugaguccugggcacugcgcucaagccugccucuugguaccuuuccuccuugcagucuccacucugauaucugaaaaaacugcaaauaaagucaccuaugugccaagcauccauacggguggcuaacuuacagucaucaugcucugagcugaauguuuuauuaauauugauuuauguauugauuaagugauugaaacuaagauacagaaacauuuuugaagugaaacaaguauuuugaguauuucucugaggaugauaagaaaguugaagauuuaguaaauuaaacuggacccaguggcucacaugcaccuuuaaucccagcacucaggaggcagaggcaggacgaucucugugaguuugaggccagccuggucuacagagcuaguuccaggucagucaggguuauguagagagauccugucucaaaacaccgaguggggugguggggguaugacuuaguggauugaaacaaaguccaucaucuuucauucuguuuuaaaaugucugugcuguguuacauggugagucacucccauaaucucaguacucuggggucugaaauaaaaagguggcaguugagaccagccuuggcuacagagucugaagaaaaccaguguggccugcguggugucuuguucugagaccguguguugggguucauaggauuuuaauguugguuucuuucuaaaggccagaccaccuggaucugccgcauagucguuguuaaugacuaaguauuggguuugcugcuuacucuucugugccuuaguuuccauauuaauaaaaaagguucauaaucacacaggcguuaugaggcuuaggggaguugucgacauaaggcaguaggagcugagacugucacagggugaauguucuguauagcugcugucaccaacucugccaccccuguuuugcccccuccugcuggcaccuuagccacuucucagaccugucacacaugcuucgucuuugcaggaaguccugcccucugcucauggaagcaugguuugaccuagcuagcacuggccacauuuuuucgguaacgagauguuccguccugggcuuuuacuguguaggcagcguaagaauuacagagaacccaucugcucuuggagccuauccguugagacaaacuuccuuggaauccauauccugucuuuuaaaaagaguuacacuguuuuauuacgugacauccugaaaacacaaugcuagccauuuaaaguggguuuaauuuucuugaguaaacugcuuuuaauaaugcucccauacguuuccuuccucuguugccagguugcuauuaaaaucauagauaagagccagcuggaugaagaaaacuugaagaagauuuuccgggagguucagauaaugaagaugcuuugccauccacacaucaucagacucuaccagguaggagggccgggaguccugcacagccuacaggaaaggcugccucugggaagaugugggugcgcggagugaagggcugccauccgagcacugccccacccuucuucccugcucccugggaccuccacccauguccuuugauucucccaagcaacacacagaccgagucuaaggcuaaaaguuuccuucuguggaucagaguuccucagcauuguggaaaccgcaaaggaacagagacuguguuaucaccucaugugauuauuuagauaucacaugaguuuaaacuaugaauuacgggugucgcuggguagugguguugcacgccuuuaaucccagcacucuggaggcagagacagacggauuucugaguuugaggccagccuggucuacaguagagugaguuccaggacagccagggcuacacagagaagcuggagaaaaaaacagaagaagaaggaguucuugcccgagucagcccuuacccucuugucuuuucuagaugagccagggcuuaguucuccaguugcuaucucuaucagaauauagguuaaaccccguaucaugaaagcaauuucugugguaguuuuuuuaaccuuccuacgaagcaagccuugcuuugcaccaccagcaaaacgcuacggcacaaguagugcaucucuuggauggaauuucagacugaccagaaggaugaaccucgccuuagcaggcugguggaagagauauuuuggggagaggugggguuccucagauugcagggugcugaguguguucauccagccugcucccagcucugcagcaguaguccucuccagaguugagggaagugugcucacugcugugagucagcaggggacgucuccugacccagguaugugugaggcugaagaagcaggccgccacuauggcagacuugccgagccugcugaucccuauggaaaagcaaccauguauagaggcaugcguggauaagcccacagcuguagcuccccucuggagucagcuacuugcaaggugaaaugaguuuugucagucagaccugcugaaauguaucaugguaaacaauguuggcaaaagcuaccuucuauaaaaagcaaauuuagaauccucccugcugaugucugaaggcccugcacagugaggcaggugucuuaccuuuggcuccuugccugucuugguggagugaaugaaauuaaguauuuccuccuguguuuauuuugcuaauuuguucuuacucuguaucccaagcuggucucucacucauaacccuccuaccucagccucccagacugcuccggacuaaaggugugcauggccacaccagcagcugaauccacagggacucgcuguuauagugaagcacccuaaaguacaugugggacucaggcugaccugcuggacgccacugcguccugcagaauugaugaucaaguuuaugauccuagccucaggucagacaaucugccuuuuccagcucugacuuugacuccgccuucuuugacucuguuuuuauuuugccuucugggccuagaauuguuaucuugauucugagcuaccagaaugcaggacuagagcgugucucccugugggaucagggcuguguccucaggucugaaugagcaagugugccuaacuuaccagagacaauuuugaguccgagaaguugaguaguaaaagaacauaggcagcuaaugagaguuaaaaagggagggauacaaagaaaacaaacaauacaauauuuuuucugaauaccugcaguauauuuaauauagaacauuuuugucauaagugaauuauggagacaagccuuucacagcaaugguuugaugccacuggaagggcacagcuguauuacuugaagaugaacuuaaaauguauucauaacauggauuauucuaaagccauuaaaaagaaaggcaggcaugguagaacaggucuguagucacaguacuugggaggcuaagacaggauggcagguacagcccaggguggacuguguagugaguuucagauuagccugguauauaguaaguuccucugucaaaaaaacgacucuuccaaccaagcaauaaacacucacacacacacacccucacauguguuccuauucuacacauaugugguguugauguaaaaagauaaaaaagaaagggcuggagagaugguucaguuuuuaauagcacugacugcucuuccagagguccugaguuaaauugccaggaaccacaugguggcucacaaccaucugaaaugguaucccaaugcucucuucuggugugucugaagacagcgacaguauacucacauacauaagauaaauaaauaaauuagagagagaaaaaagggggagagagggagagggagagagagaaagagaacccagcaagcaggauaauuaaugaaccacguguaauaaaagugugggucucuucuuucagagguccugaguucaagucccagcaaccauacaauggcucacaaccaucuguaauggaaucugaugcccucuucugcugugugugaagacagcuacaguuacucauauauauaaaauaaauauucuuuuaaagaaaaagugugggucugaauugaauaagcuguagccagagccaggagugaccaaagugacugagaaguuaaauuuuuaaaagaauguuuuguuuuguuuuguuuuguuuuguuaaauauacuaucugcauugguguuuugccuggaugccugugcacacguggaugugauccuuuggaacuggaguuacauagacaguuacaagcugcucugugggugcugggaauucaaccuagguccuacggaagaacaaccagugcuuguaaccccugagccaucuugccaaccccaauguauuuuauuuuagcuuaaggucauuuuaagguaaaaauugaaacagucuaaaauguuuuuaugaucauugaaaggauaauguucugggaacauugagguaaauguugacuguuguuucugacuucuguuuuaaaucguggccuuauauaacaugggggcugcagcucaguugugucauccuagcauccucagggagcugcccagugcucagccugucucugugagaaugaagguagaugggggcagaagccuuuggccuucaguuucugcaccagugauccugacaaagucaugcaugacauacaggguuuggaaaaaagggaaacagcacugacuguggacuuuuaaaaaguuacaaaacagacugcagacuggacaaaguacagcuggauugcauuauugaaaggccuggcauuuuaugggauccacccuuuuaugaacaaaugguccaugagaacgaaauucacauuuccauuuagaaaucaaguccugugugguuucuagcuguuccuugaugacccaguuuucucccuaagacucucccucugggugggauaugugaggggcucucuugaguuguaagugauguugaaauugaacuuuuucuaauucuuagcagcgucuuugcuucucagcuuaucggauuacaggaccaugccucugaagcaguaaauguucccauuuccccuuucucacaguaauaucugucccuuccccaugccuugugcccuuuaagcagggcuguuaccgucagaaucacugguucugcuggaccagccugccgccugugucacaucgcucucuugcuuuugcgcaggucauggagacagagcgcaugauuuaccuggugacagaauacgcuagcggaggggagauauuugguaaguacuuucacugcauccuuuaaacaacccucgagcacacuaugccaacccagaauagcuguccugugucuuagccgcugucucagcugucgccugaugcugcaaucuaugccaucaugguaauuucagcauuuuuuuuuuuuuuuuuuuuuuuuuuuggcucggccaguuaaaucccuccacuguguuuauucuugagcaaagguguuuuguuugaucuaguuugauguuaacagcugagauaaaagaucucagaaccaaacauugcugccauucaugugccugaggggcuuuccuguuaccaggcugcagcugagguugccggggugauggagaucccacuugugugggagccccuggugugaggaagggcccuacauucuuaacccuuguuuaaauauaaccuugaaaccugucccuugcugugcgcacacagucccggaaggcucugauuacuugccuccaguagcugcuguuucuucugggcuugaccuuuguacaucaugagaucuugaccuuuguacgucaugagauuuuguuccaggcauaccugaccugguaaaaacuaaagaaagaauucucugugcugacagcaauuaacacggccaaauagaggugaaaggcagauuggcaaacuuaaacuccuguauucuaaaagaaccaguauuaauuuacaacacuuuagaaguauaauaucacuuuucucauuaauguauguauucauuuuauauccugaucacagccccccagcccccuucuaacccucauaaguuccucuuccuauuaucccuuccucuucuccuaaggggaagccccccuuguauacggcccugcccugggacaccaaguagaagcaggaauguguguguccucucccauugaggugcaaccuggcaguucagcuagaggaaggggaggguuccaauggcaggcagcucagucagagauagcccugacauaguuguuaggggagccacaugacgacaaagcugcacgucugcuauaaauguguagggcaccuaugcuggcccaugcauguucuuuguuagugguucagucucuguuagcuuccaugggcucagguuaguugacucuguaggucuucuugugguguccuugacugcucccgcacacucaauccuaucccgcacucuuccacagaacucccaaagcucugccugauguuuggcugugggucucugcguuugucucaaugcacugcuggaugaaaccucucaggagacaguuaugcuaggcuccugucugcaagcacagcagaggaucauuaauagcgucaggguuggcucucucccaugggaugggucucaucuuggaccagucauugguuggcuguucccucggucucugcuccaucuuuaucccugcacaucuuguaggcagacagauuuuggguggaagguuuuguggguggauugauguccuucuucuuccacuggauguccugucuggcuauaggagguggcuacuucagucuuuauaucuccaguugcuaggauucuuagcuggcauuacuccuauagacucucaggaggcuucccacuuuuaaagugaacauuauuuuuuaauuaauagcuaugugauguggugguggugggugaauuuguaggcuaggccagacauggugaugcauaccuuuaauucuaacacucugcauguagaggcagagaaaucuugugaauucugaaucagccugaugucaauagugaguuccagaucagcuauugcuaccuggagagauccugucucaaaaaaagaaaaaaaacaacaaaaaaaaaaaccaucaacuuuuuacaggaaaaguaucauugucacugcuauuuccccccuuuaauagaggaccaaguguuucuuccucuuaccuuuaaacggcgguguuuaugcuuauuuuacacuauacaguguuuaaagaaacacuucauuucaaagaaauuagugcauuaaaaucucagaauaauauuguauaucaagacaauaguguaggcuuuuaguacauaugauaauuacaagccaaucaguaacuuuggagguaaugguuccauaucaagacacugauuuuccuccaugaagaaaucuaauagaaggcaaucauggaaaucuauguguaucuuagacuaggagaaugcaggcugugaaguccguaccggaguauagcagugcuauagagagcacagacaucuuccugguuuaaugaguccacagaguggagaauagaagaaugccagagacugggagagagaaguugccugaugccacuggggaauacauggaggccugacacccaggcacacgguugguucacugauacugcuucacauugggucacaaaugcacacaaaaccagugggcaacuuuuguuaccuaacaccuuuuaugaacuuuguccugaaaggaagcacagcaucugauccacgaacugccuguuagcuaagucauaguaaggccuuuguucacagaggggcacugauauccuuagaauaacagaggcuggcucaucuuaauguuccugacacucuaagcaagcacagugcauguguccugcuuugggaacacugcccuuuucuaguugauuucuuuucaagacaggacuucucuguguagccuuggcugucugucuuggaacucacucuguagacuaggcugaccucaaauucauagcaguccaccugccuuugcuuccugagugcugggauuaaaggcaugugccaccaugccuggcaagaaaacagaucuuaaaaggaaagauaacaguccuuuuuggucauaaacccuuuguguauauguagcuuaaugcauauguagcaugaguacacagaacacaguuuugguauuuuuuaaaaagggaauaucacacaauuaucuauuacaaccuagcauauaauuauaugagugaauauauuguuaauugacaugauuaauauugcugugugcauguaggaguuugcaugccaggacacgugugugaagaucagaguacaacuuguaggaguugcuucuugccuuccaccuuguuuuguggccaaguguuucuuguuucuacgacuucacugucuauaccaggcuagcugucccauaaccuugugggugauucuccugucucccaucucaguguagagacacggagacuaucacaugggggaucugaacucugaccaucaggccaucagggcaagcucuuuuaccuacugagccaucuaucuccuuggcccauaguagacuuuuuaaugauccaguugaagagaagaaauuacauauuacccaaagaaauuacuaaaaccucacacagauuuguggaggagcucugugacagaauagcuuaccuaacuugugccaaggccuggguuugguuacuaucaaaucaaaccccaaaucagacggacaacgagacugcacaaggauaagcugucucguguggcacugauuuucuaaagugucuguguacacgauaagagaagaggcacuuagucaagaagggaggugcugagggguggaggcggaguucagugauaauaugcuugccuagcaugcaugagacccuggauuccauuucagcaaagguuaaugugggccuggggaggugguugugaggccuggcguagugcagggauggauagguucauccauagacccucugcuggaggcaaguaacccagucauucuuggacucagucccagggccucuagaauaaggucuacaguugugaagauggacuagggcucaugcuauggauauuucaaguccagcccccuguaagucccuagguuugaccuccaguuuugggugaagggugugaguguagugagucagcauagagagcuuuggcauaugcuucccuuugccuucauguuaaagaacaaacgggaguguucaaaacagccagggcugcgcagagaaacccuaucucaaaacaaacaaacaaacaaaacaaaaaccagaaaaccaaaccaaaaaaaaaaaaaucaaccaaccaaacaaagcccuaaaacaaacaaaaagaagaaaugguggacaauuuucggcaggagucacgcagacgucuuaucagcugccauguagaacugaugagaauugaucuacagacugauccugugagcaagcagcagugaaagaaagaaaacaguuauucaagaacaucuaugaaaauucaguaagcaaugagggucuagauucuugagccagcccuaugcauggcaccacagccucucugacucucccaugcccuccucaugugcacacaggcugggugagguagagacagauuccaaucuggacauacaucgaggucuucuuaguacuggcaucuggagagguggcugucuucccgggaagaguagauuaaugagauuugucaucucauuaauauuuaucaucuuuccuguuaccuguuggggaggcuguguccugaagaguguaguugaaguggagucucccuucuguuuggagaagcacaucacucuuggcuugggucauacauaagacugguuuucugccaguugggcugaggugaugucaggccaucuucccauuucuuuucauugcacuucugcucccagaguuugauuguugcucacaaguugccuucgacucuaucuagcuccagccauuagagagaaaaacagaccuuaaugcacacagguagaucccagugucuucucaaagggccugcguucauguacaaguggaaaagaaggucaaguagaggaugugcugagaggcaccuaaggaguuagauccacgaagccgucucugcccccagccugauggccuacagcagagucccucagacgacaccucuggaaagagcucuccugagucagaaguuauuaaaaaaaacuaacaaacaaauaaagcacugaucagaaagcauuccuucaaagggaccaacauuugcuauauuguuuguaaaacaacucgcauccacgaacaacacagugggcaaucagcuaagaauuaauggaguugaauggcuguguuuggcuaagaaaagagguguagagacuucaguucaaacuagggagaucccagaauuugccaggcuguuuugcccagaagagaggacccaaauccuaagaauauggauggagucaauccaaguguugaaaaggaacaaagcagacagaagcuuugaggugggagguauaucagaaaccucagguaccccagucugucaucuagaacacccaguguucagccaaagcaacaggacccccaaacaacaaaagcacucccaguuacuggaccacaagaugcagaccacaagaaaaugauaauaggcagguagaugaugccagauuuaccagaagaaaacauaaagaugaucacagacacagaggggcucaccagugaagcaacaacgguaaaggcaggaaucauaaugucacuucagauaaagaauaucaacaggagacauuguuuuaaaaaauuauugggcugggaaauaaguaaaucauuagaaagucuccgcaacagaguugaacugccugaaagaagaaacacaaacucaaggauagaucaguaagauugccacacucaaguacagagaugagaagaaggaacuaaaggcagcuuccagaguuggugucagucaggagauuccugugcacagugagaggagacaaucaggaacauccucugcacagugggaggagacuguaaggagcauccucugugcacagugagaggagacagucaggagcauccucugcacagugggaggagacagucaggagcauccugugcacagugggaggagacagucaggagcauccugugcacagugggaggagacagucaggagcauccucugugcacagugagaggagacagucaggagcauccucugcacagugggaggagacagucaggagcauccugugcacagugagaggagacagucaggagcauccucugcacagugggaggagacaaucaggaacauccucugcacagugggaggagacuguaaggagcauccucugcacagugggaggagacagucaggagcauccugugcacagugggaggagacagucaggagcauccugugcacagugggaggagacagucaggagcauccugugcacagugggaggagacagucaggagcauccugugcacagugggaggagacaaucaggagcauccagugcacagugggaggagacagacaggagcauccugugcacagugggaggagaaagucaggagcauccugugcacagugggaggagacagucaggagcauccugugcacagugggaggagacagucaggagcauccugugcacagugggaggagacuguaaggagcauccucugugcacagugggaggagacagucaggagcauccucugcacagugggaggagacagucaggagcauccucugcacagugggaggagacagucaggagcauccucugcacagugggaggagacagucaggagcauccucugcacagugggaggagacagucaggagcauccucugcacagugauaggagacagucaggagcauccucugcacagugggaggagacagucaggagcauccugugcacagugggaggagacagucaggagcauccugugcacagugggaggagacagacaggagcauccucugcacagugggaggagacagucaggagcauccugugcacagugggaggagacagucaggagcauccucugcacagugggaggagacagucaggagcauccucugcacagugggagaagacagucaggagcauccugugcacagugggaggagacaaucaggaguauccugugcacagugggaggagacagacaggagcauccugugcacagugggaggagacagacaggagcauccucugcacagugggaggagacagucaggagcauccugugcacagugggaggagacagucaggagcauccugugcacagugggaggagacagacaggagcauccucugcacagugggaggagacagucaggagcauccugugcacagugggaggagacagucaggagcauccucugcacagugggaggagacagucaggagcauccucugcacagugggagaagacagucaggagcauccugugcacagugggaggagacaaucaggaguauccugugcacagugggaggagacagacaggagcauccugugcacagugggaggagacagacaggagcauccucugcacagugggaggagacagucaggagcauccugugcacagugggaggagacagucaggagcauccugugcacagugggaggagacagucaggagcauccugugcacagugggaggagaaagucaggagcauccucugcacagugggaggagacagucaggagcauccugugcacagugggaggagacagucaggagcauccugugcacagugggaggagacagucaggagcauccugugcacagugggaggagacagucaggagcauccugugcacagugggaggagacagucaggagcauccugugcacagugggaggagacagucaggagcauccugugcacagugggaggagacagacaagagcauccugugcacagugggaggagacagucaggagcauccugugcacagugggaggagacagucaggagcauccugugcacagugggaggagacagucaggagcauccugugcacagugggaggagacagucaggagcauccugugcacagugggaggagacuguaaggagcauccucugugcacagugggaggagacagucaggagcauccugugcacagugggaggagacagucaggagcauccucugcacagugggaggaaacagucaggagcauccucugcacagugggaggagacagucaggagcauccucugcacagugggaggagacagucaggagcauccucugcacagugauaggagacagucaggagcauccucugcacagugggaggagacagucaggagcauccugugcacagugggaggagacagucaggagcauccugugcacagugggaggagacagacaggagcauccucugcacagugggaggagacagucaggagcauccucugcacagugggaggagacagucaggagcauccucugcacaguaggaggagacagucaggagcaucccgugcacagugggaggagacagucaggagcaucccgugcacagugggaggagacagucaggagcauccugugcacagugggaggagacagucaggagcauccugugcacagugggaggagacagucaggagcauccugugcacagugggaggagacagucaggagcauccugugcacagugggaggagacagucaggagcauccugugcacagugggaggagacagucaggagcauccugugcacagugggaggagacagucaggagcauccugugcacagugggaggagacagucaggagcauccugugcacagugggaggagacagucaggagcauccugugcacagugggaggagacagucaggagcauccucugcacagugggaggagacagucaggagcauccugugcacagugggaggagacagucaggagcauccugugcacagugggaggagacagucaggagcauccugugcacagugggaggagacagucaggagcauccugugcacagugggaggagacagucaggagcauccugugcacagugggaggagacagucaggagcauccugugcacagugggaggagacagucaggagcauccugugcacagugggaggagacagucaggagcauccugugcacagugggaggagacagacaggagcauccucugcacagugggaggagacagucaggagcauccucugcacagugggaggagacagucaggagcauccucugcacaguaggaggagacagucaggagcaucccgugcacagugggaggagacagucaggagcaucccgugcacagugggaggagacagucaggagcauccugugcacagugggaggagacagucaggagcauccugugcacagugggaggagacagucaggagcauccugugcacagugggaggagacagucaggagcauccugugcacagugggaggagacagucaggagcauccugugcacagugggaggagacagucaggagcauccugugcacagugggaggagacagucaggagcauccugugcacagugggaggagacagucaggagcauccugugcacagugggaggagacagucaggagcauccugugcacagugggaggagacagucaggagcauccugugcacagugggaggagacagucaggagcauccugugcacagugggaggagacagucaggagcauccugugcacagugggaggagacagucaggagcauccugugcacagugggaggagacagucaggagcauccugugcacagugggaggagacagucaggagcauccugugcacagugggaggagacagucaggagcauccugugcacagugggaggagacagucaggagcauccugugcacagugggaggagacagucaggagcauccugugcacagugggaggagacagucaggagcauccugugcacagugggaggagacagucaggagcauucugugcacagugggaggagacagucaggagcauccugugcacagugggaggagacagucaggagcauccugugcacagugggaggagacagucaggagcauccugugcacagugggaggagacaggcaggagcauccugugcacagugggaggagacagucaggagcauccugugcacagugggaggagacaaucaggagcauccugugcacagugggaggagacagauaggagcauccugugcacagugggaggagacagucaggagcauccugugcacagugggaggagacaguuaggagcauccugugcacagugggaggagacagucaggagcauccugugcacagugggaggagacagucaggagcauccugugcacagugggaggagacagucaggagcauccuaugcacagugggaggagacagucaggagcauccugugcacagugggaggagacagucaggagcauccugugcacagugggaggagacagucaggagcauccugugcacagugggaggagacaaucaggagcauccugugcacagugggaggagacagucaggagcauccugugcacagugggaggagacagucaggagcauccucugugcacagugggaggagacagucaggagcauccugugcacagugggaggagacagucaggagcauccucugugcacagugggaggagacuguaaggcgcauccucugugcacagugggaggagacagucaggagcauccucugcacagugggaggagacagucaggagcauccucugcacagugggaggagacagucaggagcauccucugcacaaugggaggagacagucaggagcauccucugcacagugggaggagacagucaggagcauccucugcacagugauaggagacagucaggagcauccucugcacagugggaggagacagacaggagcauccugugcacagugggaggagacagucaggagcauccugugcacagugggaggagacagucaggagcauccucugcacagugggaggagacagucaggagcauccucugcacaaugggaggagacagucaggagcauccucugcacagugggaggagacagucaggagcauccucugcacagugauaggagacagucaggagcauccucugcacagugggaggagacagacaggagcauccugugcacagugggaggagacagucaggagcauccugugcacagugggaggagacagucaggagcauccucugcacagugggaggagacagucaggagcauccucugcacagugggaggagacagucaggagcauccucugcacagugagaggagacagucaggagcauccucugcacagugggaggagacagucaggagcauccugugcacagugggaggagacagucaggagcauccugugcacagugggaggagacagucaggagcauccugugcacagugggaggagacagucaggagcauccugugcacagugggaggagacagucaggagcauccugugcacugugggaggagacagucaggagcauccucugcacagugggaggagacagucaggagcauccugugcacagugggaggagacagucaggagcauccugugcacagugggaggagacaggcagaguauccucugcacuguaggagacagagcauauuccgugcacagugacaguauuaggaggguguagagacagaggcagaaacuguaagaaaaaauggcuaugaaaauagcagacauuuugaaaaaauaguaacucacauguccaaaaaccucaaggacuuucaaauguagccuaaauacaaaggcccacaaauagguacaucacaaggagaaccgauggggucaaaggaggaauuuugugauuuuaaaagaagacauguauguuuuuuucuugugaugucugugcuucagcggcaguaguuauacaaguaugaccaguuuaaaugaucacgcauuagaauaggaaaggcuggaggucuacgugaaauugaaaaccaaguguguugggaaccagaaggccagauaaaguccaggaauauggcucccagcaugugagcugcuguucacacgcugcuguugcucuuuggaaauggagcaaggucagcuguggaacugaacugugaauuuagguuaguuuacaguggcauuugaauggcagccagagcauuguacaagagauuuuuuauuuugcuggggcaggggugagcugccauagagaaagcacuuucuccaagaucacucgcacucuggcaccaaguguaaguugagaaaucccccagagccauucgggugugauaaacugcuggaagacucucagaacucacugcugugcccucuuccagggagaggaugucggugaaaccagccaagggcgguguaaagccggcaggcccacaagugcugggugcagagucuucauuguccuuugccugggugugcuuugucuugggaugagugugugacaauaugcacagaauauuguuacagggaggcucagccuuugcauccacauuuuuauuuuaugugugccuuauugguugguugguugguugguugauugauugauugauuguccauacuguugaccucaauuuucaggacaauugacaugaugucccagagucccaagcuuaauuucauaugguuggucuuccuaguguuccuacauuauuauuagaccuucuaacacgacugaggcuccaggcuaauaaagaccccaccacaaagccaaggggagguuagaucuuuucuccgggcaaggccacauucugauuccauacuguacagugcuuucauauuuaauugcacccuauuuugaaagaacuaaaaguauuuuacuuuggccauagucagucaguucaguguuuaauugguagugugccauguguagacucuggacuucuaagacguagugugcuugaaaagcagagaagagcaagucucacugcugauuucucuaucguucccggugugaaaugugcuggauaaguugcugagaucaagcgcagagugagugguacugcuugcuuuccucuguaguugcuggcaguuaugcagaugugcuucuaugucgcugaucuagaagcggugaugagcccgugcuucacauggggaaugccugaccaggagccugcacugggaaaugcuuucaaaucagaagcuuuugaaugccaauaugauuugggguuuuguuuuguuuuguuuuuugaaacauuuuuuauucugggggguuuuagaugagaacuaucugguaaaauuuauaugaguguucaaaauaaaacuaaacccugaaauuggaaauacugaucccaagcauuuccgaugaaggacagucugucugcacuggaguucgguggcagaggcagccuagcaagagaagcugcuagcuucuagcagcacagcucuacagcauggccauaggaggggugcugagcucagaggaaagcuccgcagaugcugggauggaaggaagcugccugguaggucucaguagcuguguuuaugcugaccuugccuaggggaccggagacugaaccacucuggacaucgugcuagugcugccaucucacccagcucuugugccucgcucaccaagugucuuacgagggcuuaaaacacacaacccugucuccaacuguagcucccaaugcucuccugcuccuuccacauuuggcuguccucuguccuccacuguaaggucuagauauugucccauuucuuucugcaacucucgucccacaucuuuguuccacuuacuugagaaucuuuccugcauuuccucauuugagacaacuuuaacuaaacuuuauuuuuccuacuggcuuacuauucuguaucucauuuuuuucuuuacuuuucuuauuagucuuuauaaccaauugacauauacucagucacucauuaguguguagcauuuuuaugcucugugugcaugccaugcauccacauugaagucauuggacaacuuuauggaauuucuccuccccugucuucauauggguuccagggacugaacgcaggucaucauguuuccuaaccugcugagccaucuaacuggcccucacuuguuuacaucugaccuuaccaaaguacaucuugacaguaaagaguuugucuuguauuuuugguucuagagagucaacauugcccuuacacaugauaggcaagagauacugaaccauaucccaagccaggauuuuguaauuuuuggugcuugccaauucucagaauaguucccacagaaacugcauaggcacuaacuauuuauagaucagcugaaugaaagaaggagggaaugaaaauggacugauggacagauggcauuacagcugugaccugcucuuauuguuuaaugugguguccagcacagcacgcacauauuccaagucaagcagagaaugaauggccauuucuccugcucacuuauuuuaguugugugagguuuugacuuaggggagaaacauguuuaucuuugcuauuugaguguauagagaaaaggaagcagaugggaaguuugaccuggaagaaguggagugcaucacugcaugcguguuguuugcucuauuagcugacucggugaaaugaauauugcggcuuagcacugcguuguaaaagggcagccaugacaguguggcucugccuaauguuccaauagaauugagaagcuaguaaguuuggcaaaucacuaaauucauaauucaaaacucccccaauauaauuucuugagauauauucccucaaacuuccuaucaugugcucuuaaacccagcacuugaucaaaagcuuccuggaugccagcaaaacccauaggcauugaagacaaagugcuaauuuaagaggaagcugcugaagugugaaugacuuacuaggaaugcucucacuuacuuaagauaacauuucccaguuguuaguucaguuuuaaaagggauaauuuuuaucugucccagccaacuucuaaauaaaugagacagagacuauaagauuuauuuaaccaccgccggguggugucucgaaaaaccaaaaaccaaaaacaaaaaaaaaaaagagagagagagagauuuacuuaacccagcuuuacuuuaugguacaguaucugagcauuuauuagucuguuuuaauccugcgagcuaaccuggcuaccucucagguguauucucauggugucucugugacccuuuccuuauagacacccgaccccugcugggauuggaaguccagccuuauucucucccccaaucagucauuggaugaucagcuuuuauugacaaaucagaaaaugaauggggagcaauguuuacauagcauugaaauaagagauuauuagaauaagcauugcagugccaugucuggauugcaaccagauaugggggcagaaaaucagcauuggaauaacaaaggauaaucuuuacacagugcacaauaacauuaugcccacauccaauggugccaacaggcaugaaacccaggaauucccacaaaccaauuuauuuaugccauggagcauucaaggacugccaguagggcaggcaguggugagggcaaaauuguguaaccauugaaugcuacaccgugagguccauguuccauugagaacuuuuaucuuguuaaauucuagaucuucagggacauuaacauagcacauacugugugccagcuugcugucaccuuuaaaacauauguuauuuuaaccacauacauucuuuguauccuucuaaacaaaacuaguauucucccaucaaacugguucauuauuauuauuauuauuauuauuauuauuauuaauuauuguuauuauuagacuaugaagacuaguacucugcucagacuuuacauuggaggcagauaaccacaccacugugcuuaucugaucacugaucaaacaaauaggagccauuuccuccccaguuaauuccucauuuguuagucuguaguuuugcuuucuuaauaucauacauagcuaguuuauguuuguaaucuguacaggaugccugcagaagccacugugcauuucccucagagcgccauuggcucucuucucuucucuucucuucucuucucuucucuucucuucucuucucuucucuucucuucucuucucucuccuuuuaucuucuuuucuuuucuuuuuaauuagauauuuucuuuauuuacauuuaaaauguuauccccuuuccugguuuccccucugaaacccccacccccuccccugcuccccagcucaccaacccacucacucccacuuccuggcccuggcauuccccuauucaggggcauagaaccuucacaggaccaagggccuuuccucccauugaugcccaauaaggccauugucugcuacauaugcagcuggagccaugagucccaccauguguucucuuugguuggugguuuagucccagggagcucuggggauacugguuaguccauauuguuguuccuccuauggggcugcaaaccccuucagcuccuuggguccuuucucuagcuccuccaugggggauccugucauggacaguuuucugaucaagauguuauuuguaccaugugagcucagugcacgccgaggccagagaaugauguuggcugcuuuucuuucucucuaccauaguuuugaaauacagucucucauuggaccuguaacucacgauuucaguaggacucugguagugagcuucaggaauccuccagucuccaccuuccaaggggucagauuacuggcauguaccaaaagcaacauuuuacaugggugcuaaggauaugagcuuggauccucaugcuugcacagucucaucagucacuauuuguggguuuuuaaaauauuuauuuuuuucauggaagguuuuugagauaaggucucauuguguagccuauucuacauugaguucaccauccccuugucuucugagugcuggcaucauacccaagccaaacauuuuuugcugaauuuaguauauguauguucgaaaggaauuuuuuucuguuuuguguguguacauaaauauacauguguaugugucaauauaaaucuguauacauacacacuuuuccugagaguuuuuucaaacuauguuuuaacccuuuuaggaaaauguaguuuuccuuggucuaguaauaaagacaugaaaagauauuuaauuauaaccuuuauugauaucuacaguuuuuaauuucuuauuugaaauuaauaugucacauuucaguauaucuucaaaaugucuugaagauauuccagccagcauuccauuuuuuuaaaguuguaaaauauucaguacacagaauuauuuuaaccauuuucaguaacauuaauaaugacacugcaguccugucaucugaaacuuugcauucuguagaauggaaacucgagguguuaaucacuggccacuauucugccacccuacaguucccccaaagcaucacccuuccugauguuuugagcuuaacuacuuuagggacuuauauaaauggaaucaccccguauuuguccuugugggaccagcuuaugucacuuaugauguucaugugucagacucaucagugacacauuucauguguucaucuggugauggacccuugaguucccaugcuucgguccugaugcugauacuagugagcacugauguaccagugaaaaccccuuuuuacuguaagcauguucaacuagacguacaggagaagggucucgugguaaaccccgcucccccaacacccagggcugacaaucgccagcauuaugcuggugcuguuguuucuuuuccccaacuguucuauaguuucaguuuugaauauuucaaguuaaauucaaggaacauuuuuuuuuagucauaaauacuuacaguuuuucuuauguguaaaggauuuuaaacagcuuaaucacaacaccuuucuuaagggcacuaaugucuacagagugaguucuaggauauccagggcuauacagagaaauccugucuggaaaaacaaaacaaaacaaaaaaaagagcacuaauacuguuugcuuuuugcuuuuguuuuugagacagucucacuaguuguuagccccaacuaaccuggaacacuuaaucuucuuccucaggcucccaaaugcuguacuccccacccagcuucuaguagcuucuugguuuaagauauuuugcagcuuuagacgagguuuagugagugucuuaccuuaaaggcucuuuuuaucccuucgcucuccuuuucgugaguguucuuuagcaaagcaaucauagcuaagucuuuguucauccacgucucucagucuuuuugccccuguuuucacagacuauuugaaacacuuguuucauuuguugugugugugugugccagagcacacacggagaucagaggacagcuuguagguaccaguuccccccuccaccaugugaauaccagccuugacagcaagcaccucugccugccaaccauccuaccaguucugcuuuuuccguucugucauuuuuacuguguguugggcaggaggggcgaucacugcagugauugugguuguugccuucaguagcacuugguucugucaggugauuaaacugaaccugucgcagcuccaguuugugguuuccauuuuauccuuacucuuauguagcccuuacuccagagggauaguuuucuggaauauucaacaaagcugcucuuuuuaacuugaaggagaacuccaggaucuucuggguggaaccucugagugacuccuggcugcugcucucugcuaagcccaccuccgaguguuaacguugugugcauacagccaggggcuugaccauggcucugaguagaauugccauucugauuuuuaaauuuuaaauguauagcucaggauagccucaaacuugcaauccucuugccucucuaccccacacgauugcaauuacauguaugcauccgaauaccuucuugcuaauuuugaugcucuuuccaguuuucuuccccuuuguccuucuguguuacuacuuuucuuguuucuguaacaaaauccuggacaagaagcaacuugaugguuuauuccaauuuacauuugaucauggcagggagcauaguaagcacaggcacugucacagugucccagaguugguaggcaggcacuggggaaugcuggugugggucccucuguccuuaggcuggacuucccauuuuauguaacuuaaucuagaaaguuccuuacagauaugcccagaaauuugucuccaaggugaucccagagccuuucaacauagcacuuucaagccaucaccuuuuauuccuuagcuugguucguggcucucuacaaugugaauauucaguccaacuucugaagucuccugggcuuuuuaacgauauuggaaagcccaaaguccuagagucacagaagacucaagguggccuccuaacuguaaaucccuauaaaaucauaaacaaaucacccacgucaaauacacagcagcucugaguaaacauugauauuuugaaagaagaaaauggagcauagaacagagcaauugggucaaagcaagaccaaaaccuagcaguaaaaacaccaagucuucaagcucuguggccugcaucuggggauugugauggggccacccgaguaccacaaguuauggcuaacccccagcccuucaacaguucugucuaucacacggcuucucucccggccggcucugccaggugccugcagcuuuccucagugccugucccauggcccuggcauucccagugucucuucauugcuauucuggcuucacguucagagcuucacccagugccccuucaggacuuucuuacaggaaccucucccuugccacacauggccuggccucagcaacacucuucaacugugacuuaaaucuuuggacccccacagucccgugucucucaugccugagaacucaguauugugugacuaauuccaucaaugucugcuaccagcucaaaguggauggagcauggccucuggggaccacaguuguaucagucucuguguacuaauggcgaaacacaucccuagggaucuguuuuccaggaggaggagggguuccuucagugacuuacucuguugaggguuucuucuuucaaaugaauuuucaaguuuauacaguggagucuccagugucuaaggucuugcccuuagggcauaccuagcuccuguaguugcaguggagauugcuguaaucucuuuaaaaauccuguagcccugucuuuuaguaagguuaaacuccaacuccuuuccucucaaagugcacaauuucauaucuuucugcuuugccuuuugauacucccucacagaugaccuggaugagaacuguaagaagcagccaugucacagccugcaugcuauucuguauuuacguuucuucuaccagaugaauuaguccauugcucuuacguccagccucucucaguucucaacacauggagaaaauagccagauuccuugcuaggauaucauaaaauggccuuuagcccaguuucuaaucuaguucucauucuccucugaaacucgggagccaggccuucacuaucuucuguuugucgugguaauuuggucaucccaacucccaccagaacggcccaugaagccuguuuacagcaugcuugggcuugauacaugccugucuuacuaugucuuuauaaucuggaagcccuucuuuccccacuugccacaucauuuuuguuuguuccuuuuccuuuguagucucuugcuuaagaagcugggcuguugggcuagagagauggcucagugguuaagagcaccaacuacucuuucagagguucuaaguucaauucucagcaaccacauggugauggcucacaaccaugugcaaugggaucugaugcccucuucuggugugucugaagacagcuagaguguacuuauauaaauaaaauaaauaaauaaauguuaaagaaaaaagcuggacugucuuguaagauguguaaguacuaaauuuggcuguucaugucucucaucaugaaacauguccucuuagcucucgcacuuucucguaaagugccaguugugguuacaguuugcuuaaauguagguggaauucccugguggagaggcaggauucugcacaccucuuccauugguucacuucaaguuuuggauagugacugguuuccacuuuagugauguucagauaaccugcagguuuagcugugucccuguaaucccuuucugaccuuagccaguuuuugaagcugcuccucucacauggucaccuagagacaugguuccaugcuaaaauacaaagugacgccugguccaaauagcacguccuucuaguccugacacugccgaggcugggaugggaucaucagagucugugucuagacaagguuccauggcaagcuugauucaggucagcuuggguuacacaggaagaccaugucucagagcaaaguucaccccaaauguugcaaacugguaguuuucuaauucuuucaugcuuucuacauuuaucaguuuuaaagaacuuugcuuuaaaaaaacuagagauuguagcaaggucagauuucaagcaaguugguacccuaauaguguccagugggacccacuugaguuguuuguuucuuuucugugaguccauggacuggaauguggcuggugugcuuuaguccacugagguuuucuucuucuucuccaucaccaucuucucccuuucucucuccucucuaucacugagcugccucccuguccugugucauuauucucucacuacucaaauuauuccacuucggaaccacauccaguugacuucucaauaacuccuuugccuuugaacaagauucuagaccuuccuugaacauucucugucuuagauuuagaguuaaacagucccuaucuaaaggagagaacacuaggagagggauaaguccuaccucgguaagcagucauauuuauuuaauguuaaauuaacauuauucauuuaacauugcuuuucuguuccuccuacacaaacggaagcacaccgcaugauauuuuuuucuacguguaggaacucaagaauagaagcaucauucagacuagccaaccugugcugauacacugggacaguaugagaggcaucuguuucuacugcaggaaaccacaauuaacauuuuauuaaaagacuuuugggauaggaggaggugccuuaucacaagcaaacaggccuuuggauuuagagauacggagcccugugaaaaucagucaugcuucauguaaucauguaaaugggcuagguaucaaaaguauuuaaaaagaacagaaaaugcccuuaguuuacaaaaccugcuuaguggcaaagugaguuuaaaaaaauauauggucagaacucuguugguggguggguccugcauccacauuuguacugguugcauuucccaugccacuguucucugaacaacauacacaugucaaguacuucacaugugccagcuagugcacaaguacaagaagcagugaugaauacagaagacacaaaucccuguugacacuuguuaguaggagagacaaacaacacacaaacuacauagauguguaauuagucagaagaugauaaagugugaaaagucuggggccagaggagcaguggagaguuggcucaguuguuaacagccccugccgcucuugaagggggaccagaguucaauucuuagcauccacgugguuucucacuaccuucugugacucuaguucuagaggcucugacucccucuucuggcuucuguggucaccaggcacacacgugauacacagagaagcaugccaguauaacacccacacuaagauaaaaucaaagggcagucaagggaggacucggagaaggcuguaaugcgaucaaaguucacauguugcugggagaaagucaggagagaacagcgguccuaaggcaagagcacuguaucuguuagaacaugacagaguaguagggagaacuuugggguaguagaauaucucuguaucuuuuggagccaggaguuaaguaagacaggcuuacuugugugcacaugugcagacauucucaccaaggaguaacuccccaggaagaaaaacuggcaguaauucugcauccugauuacagugagaagguuguguaucugcaugugugcuaaaacgacacggauacauaucacacccauaucagauucugggccuugcuucucuucucuaauuguguaagacuuagccauugaggaagguacuggggaccuguuuguauucucuucccagugacuugugacuguuuagagaacagaugcagaaagccuugggcagaauuggagauaauacuuaggcauguuaucaagagaucuugaaaucugguggcuguucaccccaauuggugaugcuagacaggguggaaaccagcgugagaaguugcuggcuucugggaauuuugggggguggagcucauagauugcguugcuguguuggauugugagucugggagaagaaauguacaacacggaccacuggcaagcuagacagacuguaaaaagaaccccuagcacgcccagaagcccucuguguguuucugccaggaaacagagcaccaagccugcuuccucuacccugcggcacccugaccuucacgucugaggacaauaggagagcaaagugagcacucucauuaaccugcuugcgggcagcuugaguuauuuuggccucacccuggcucuuuuggaaagaagcauuugcuugauaaacaggaaguuguuuccagggcuguaggaagaacaaaugauagaaccaaguagcacucuaaaggguugcuggcucugguuaguuuggaagggcagacaugguuucaggccaccacacaagaccagcagaggugaggcugcgcucaccuuccaucucaggaaacaguuuugcccauugcuugaccugccgugguuuccaucagcucugaagaaggagacagucugcacagaguggaaaagugacuuauuuuaagaaauguuagcucccuuccucuguucuauuaguggcauaccucuaagacgccagugaggcugcuggucuaggcaagcaaaaacuggccuguguguuuuauucuuugaaagguucgaacuugaauauccacagcauaucccaccuccacuuggugccccaguagacugggacagagugagagugaauucugaggcaggucugugugcuagugcuguaguguuuuugaacugcagacuccauucauuauucugucacccucagaggguaugugagccucagagugccacugauguuugaaagacuucaugggcgagcaccugaggacccauggcaagugaccugccaugacugguaagugggaagagauccucugccccacuuuugauaagaccucaaaagggaaggaaaugcauuucuguuuuagcuggcuggagccauguuacaguaaagaacacuuaaaucagcaccacauuucaacaauaagcugccaguuagugcugggaaaggucggcauggcagacuuuacauagcaggugucuccuugaugucugcugagggaaggaagggcaagaaucagaagcugaucagaagccaaggucuggguacaguugagacucuaucagggcuggcauugguagccaagacacaggagagcuagcucaccaaauggccuggaggaaguuacuucuagcuggaauccugcugaaguccagacugcuuuucuuugacuguuucacugugugaaagugccccacuguagauucagauccucugacuguguaaguguaggcuggcuacuguucuggguuucucccucagagguuaaauaucccaucuggacuugaauauuugcuuccugcccacugagucuguaggaacauaaagcaaccauuugucagcagaccacugaaaggcagguuucuacagggaaugaaacugcaggccauugguuuccuggcacacccaccugauauuagacugagagcaaacuaauggguggggggagcccagugcaugaaaauaaaagcugaggcuaaggugugaaugcacaugagcccagaagacagagcuggaggagaggagcacagagcccagcgaggagcagcagagucaagugcuggacuuggggaagccugaugugccgcagcugcuuaagugacagccacagcuacacccacaguuacagcaguaguguguggauguuuguagucgcaguucuggguggugugcguauuccaggcuacccaguaugcugccacugaugccuuccgcccggaccccagagugaugaggguucugagcagcacaggcagcuguuggagagcuuggagcucuucacaaaauucuuaacucuuccccgccauggcgcugagugaacauguaauaaguguauuuuuaaauguugaaaauucaagauuuguuauauaugguaacucuuaagaguacaaguuuauccccaaaugcaggagcuuuuucauugguccuggcuugugacaguuggcuuccauuuaacagagcaaggggaggugaggcuguuggcaguauaaauguuuuauccaaggacaaccaaugugucauuguggagauaaaacagaacuaggcugcacuacacuagccugaacucuauaacaaguuugagaauuuuccaacuauuuuagaaaaauaagguacuuagacauuuguaaagaagguuuuuuuuuuuuuuuuuuuaaaugaaagaaaaucccuuauuuuggaaaucacaaaaugaaucauucugucuuguuugagaagcuuugauguguuuugguaauuaguguuuacugccagacgaaugucucuugggcauuuuaauuaguggguggcauggcccagugagcuucugagcuucugaugguagcccuucagaagaguuacucuuguguuucucaagaagagcggccuccucaaagcucuuuaauuaggucaaguuuagcaacuaaaacauauuauuagaauaauuaggccccucuuaagggaauggggggggucagggaacagguacuguuagagcgggaucgcuuaaaaucuaguguccugccucugaugaacguccaguuccugggcagcuguggaacacugcugucuucagucagggacuuucuauucagagauuucccccacccccaccauggaucucaccagcagccuaaguaugcuggguauaagcucuccguuccauucuggccucugugugaagcugucucuuaccuccagccuagagucuuauuguccucuccuuuuuuucccuauuaaguugcaaguaacugugcuggguuccuuguuuguuuguauuuguuuuuguuuuuaagggaaccacuuuaaagauuugcguauaggaaacaaaacauuauaacagaucuuuuaaggguuguuugcuuugucuauuuuuagugauuucaaagucucuuccuagguggcccaaagcuggccucaaacaagauguccccugccucagccucccagguacuaggaugauagcauuguugccacaccuggcuugacugaucuuucuuaguaguuauauacguauaauaauaauaaugugugugugugugugugugugugugugugugugucuucugugugucugugaguguacaucauuuuuacacucuagaaucauguaugucccuugcuuucaaaaugcacuuuauauaucuucuaaaauuugccauguaaguggauuccccucguugccaugcuuggcccuucucccugguucuuggcugucuuucucugugucuuugcaguuaucucuaaugauaacacuuuacccuagauucuguuuucuuacaaguuuaaagaaagauagcuaucacuaguccucugggugaggugucaccaaaauaauugagugauuucagugaaccacuauuaacagcaauauguacauucauauugcuuaauuuuucacuuccuuaucucaggaucauaugauaacauucugauggcaaaugaguccuucuucagcuagaucucuuaguuaaaggacuuuucacagguuauuggauauuuucaacagaacaugcuauggcauucucucucucucucucucucucuuucucucucugugugugugugugugucugucugucugucucuguguguguaucuguguguguuugugugugugugugugaguguguguguguguguguguguguguguuugguugguuuuucaagacaguuucucuguguagcccuggcuacccuggaacucacucucucuguagaccaggcuggccuuaaacucacagagacccaccugccucugccucccaaguacuaggauuaaaggcguacaccaccccacccagcuaguauacacucuucccugcugagccauuucuugucccaaggcugacauuuauaaucuguuaacugucaugauguagaguuggguuaaagguaucaaugacgcuggcucagguaaaccuaguaccuuacucuaagguacuaagaauauacuuuuaaaacuugcuauaauggcuauggaaccaccaaauuguuuuucagucuugaggauagccugaucucuaauauuauagagucuauuacaggugagggcuuuuugagaggggugugugugucggggggggggguuacccucuauucuagccacuucucuauugaucauuuuucuugguggaaacuucauauuaccuauaaaaauuaauauuuuaguucuaagaagagcagaugcagauauaaagauuuaugugccaugguaagugacucaaguaugcuuuuuuguguucgauuauaggacuuuaaaaaauaagagaagcuaggauggacagagcucuacaugaggccaaucuuccacaguguagugucugcuccagucuaaggauugguugcuaagacucugcuuuuugacacacucuucaaacacaggaaaugcuucugaugcuuaucuucauguguguuugcuaaugugcauguaaucuuaugcagggggaguugaaaaggaacguguuaaguguuauaauucuggaaaaguaccaucaagcccugagaacccuuuuccaauguguacuuucuguuugugugugguuuuguguggaggagggcagggguccaagacaggguuucucuguguagccauggcuauacuggaacuggaucuuuaugccagacuggccuugaacucagagauccaaaucccucugccucccaccgagggagugugccaccacugccaggcacauauguacucguugugugcacccucaucacagcaggcucaggcuuaaagugguuuaggcucaggugcuagugugcuucauugaugugcacaggagugugccuuauuccccuucagcucuguucaggcuuuguugguucauuuguuuuagauguacuuacauauguaaauaaauguuuugccugcaggucuacccgugcaccacaugcacacagauaccugauaccuguggaggucagaggaaguccucagaccuagaguuggauuaacaauggcucugagccaugugcacugcugagcuaucucucaagccccucuguuuacuuuuuaacuguuaacugaugcauacucgcuugcuuccuuaagcugccugaggggcucugccagcaucuuggguggguacugacucuacucuuguucaccacagaccacuugguagcccauggaagaauggcagagaaggaagcucgacggaaguucaaacagaucgucacagcgguguauuuuugucacugucggaauaucguucaucgugauuuaaaagccgaaaacuuacuucuggacgccaaucugaauaucaaaauagcaggugaggugugugugcacgugcgcauguguguguguguaugugcugaagacaggagucaugguuaaaguagggacaguuuaggcuuuuuuaaaaaugagagcuggggcuuguucaugcugagggcacuuuucucacugagcuacacccccacuccagacuucacuuuaauaaccugaaaauuaauaaacuuccaaaggacauuuuaaaauauaguauuagcaggaacucuuuaggaagaaagaaaaagguaguauuucaaauucuauuacuuugauaaauccuuugucaauaaugaggaguagacuauuuuuuuuaaagcaggaaggaaaacugcugaaaugaugugcucagcuucuccugccaaggcuguuugcacugccccagccccagccccagccccagccccaaaccccagccgcgcccauuccacaggcugugcuuuaccugcagacucuaaaguuuauuugaagcugucucaucuuuuuuaaaugagaaaagguggguuuaggauaugcagauugagccgggugugguggcgcacgccuuuaaucccagcacucgggaggcagaggcaggcagauuucugaguucgaggccagccuggucuacagagugaguuccaggacagccagggcuacacagagaaacccugucucggaaaacaaaacaaaacaaaacaaaacaaaaaaaggauauguagaucguccugaguauuuucuccuccuacauacauagauaccugcuuccagcucucauaagccagugcgugagcaacucaaucaguuuuaaccuguuuuuauuucagcucaucacucaucaugucccaccacucugccuagcuaacuuguacauuccuuccuuacugguuuuuacuuguugcucugaccugucagcauuugccugacagaugcaaguccaucuccuacugauuagcagacagagaguguauagcaacuauaaauagaaaauaggugguuuuuuuuguucuuugacaguuucuauuaauacauuguauguccagaggaaaauaaaguaguuugugcugaaacugaaguauuguuugaauguaaccgccuugcacagccaaggacucauaagcuguccucagauuucccuguaagcagggcaggaguugagaguucagauuuauaucuuguuccaggucaaagcaccugagcaaggcccugccagcuguggugcuucugucucuuagaggcagaccuauccuuuuaaguccuaggaauaguguguuuccaucccggucucagacugacggcugugcuuguguucugaagcucacauagucuuccacuguguugggccuuggcaugacacagcaggcaagagucaaaggcuuucuuuauggcuggagacuaagccaggcacugugacucguccugccuucgccugucaaaggacauuacugugcaggaaaccaugguuuuccuuugucuucaugucaguuguggcuauucccauagaauuagguaauguggaaagaccuggcaaugucaaaccuucuuuuguaauuaccuuuuuuuuuuguagcuucaaugaaaugaacuguaaacagcauauacugaagcucucagaacucagacaugugacaugggauuugaaggcagccuggaugcauugcaagacccugucuuauaaaaaaaaaaagugcauugcaacaggccucuuagcuccuuacuguuggugaaacaaauuagcacaaacuccaaggcugcaagcacggugguguucuaagucagcucuggaggucaguagaauaaaaaacauccgguuagcagcugugguuccuggaggaccuagggggaaagcccagauucuugccuuuuuuaccuuguagagcgaaccugccuuucuuggcgcaggccccgucuucacagcacuucccaaacuucaugguuccauuguggugacuguucuccugauuccugguacuaaaaggagcccugucauuacaucagguccuccuagauaauccaagacuaccuccacaguuuccugauauugacuuggucacuuccauagagagcuccuuugacauucacgaggauaggaugcuugccacauggguguguuggaggacacaagccauucccaugccauccccagagcccuucccaugccaucggauuauuaaguaguugaaagaaagcccuucuuuauauuuuauaauuguauucugcauaugugaccuaaguuuaaagugguuuuuuuuuuuuuuuuuugguuuuguauuguguuguguuguuuuaugcuugguucaugauuuuuacgucagggccauucugauuaaguuaaggaaaauuccugugucaauuaguuuuuucuggagaaaccaaaaauaaaagcaaaggucauugauaauugagacuaaaauuacugaaaaauuaguggaaggggauuuuuuuuuuuuuuuuuuuuuuuuuuuuuuaguuuuucgagagaggguuucucuauagcccuggcuguccuggaauucacuuuguagaccaggcuggccucgaacucagaaauccaccugccucugccucccgagcacugggauuaaaggcgugcgccaccaugcagaaggugauuuaaaaaaaaaaacuggagguggggacuggagagaugguucagugguuaagagcacugacuguucuuccagaggucccgaguuuaauucccagcaacaacaugguggcucacaaccaucugcaaugggaucugaugccuucuuauggugugucugaagacagcugcaauguauucauauaaauaaaaacauaaauaaaucuuuuaaaaaauuuuuuugguaagucauuaaaacaaauccaagcaguugcaguaagaauguacccacuggagugugagugaagcugcugggacgcuggcagccagcccugugcccucuguguucuaacacauaggcuuuggcacaguuuuaaaguucaguuuaaguguuuacauuaguauuuguuuucagagcaaaacaaagacuaaauugggacuguaguucaugguugccuacagugcuaaauguuuaucuuugggugacugcucaugcgcucuuuuuuuuuccaugcccccauuaugugguuucucagucauugcucgagcuugggguguuugcacaaguauuagaugggauucucauuuacacuugcccuaucuuccuugaaccuaauggaucacuaggagaaaugccuuuacugaaguccaaguagaacccgaguaacuucagaguggacugggugauaaguaaugaaaucaauuuuauuucuaagaguguaaagcaacuauuagagcccuguuccugucaguggucauuuuggauaccauauucgaagccuuaggaagaagcuacuguauaugaaagacauauauuuacaagagagaaaaugagcuuuuugguuguguguguguguguguguguguguguguaagaaucaucuuauauagcucaggcuggcuuccaacucaagagccuccuacuucagucucucgcuagguuauaauguggucauacaccaccaucucugccauucuggggguggggaggggaaaagaguguuaauaaaccaagccagagauguuaucaguccuggaacgccuaucuuagccacuagugaggcuaaaguagcagaauuuuaaguuugaggccagccuggacaacguuuggagacccuaucucaagaaaugaaagugcuaggcagaaugcuuaccuacuuucagguccugaguucaauacaaaaaaaaaaaaaaccccaaauccucagucuuuagucccucaucuuuaaauuauguguguuaaggaacaacuuauuuuggacuaauacagauuuuaauuaugaaauguaagcaguuaacauuuuuaugccaguuauuuauacaagugguuuuuguuuuaaaagcauucugguagcucagcuacuaaagguauuugcugccaaguucgaugaccuguguuccauucccagcacccauguacugggaggaggaaacugaugcugacaaguuagcuguccucugaucuccaugcacacacuauacauguguugcccuccccaauaaauaaauaguuauaaaagaaagaaauugggggcagggucucacuguaugguucuggcuggccuggaacuauauguagaccaguccugccugccucugccuacugggauccagcacacccaagcuguuccuguggguaacuguuaacacuugaaugcagaggcaggauaacugcugggaauucaaggcuacccuuagccacauaaugaauuugaggccagccaagacuacagaguaggauccuaucucaaauaaacuguguccacuguggaagaugaguaaguucugguuucauuuguauuauauuugcuuuuugagggacuuccuaucaauauguguuuaguaguugauacuacagauagcuuacuacauaagcugucuaugugucccugcuagucuagugcuagcccuggugaagaauauggucccuuggugugaggguaggcauguggauagcuaucagaagagucagcuguaauucuacacuucaugguuuuuuaugucuuuucauuuuucuuuaucuguuucuagagagaagaaaaauucacuauauaguuggguuuuucuuccugguuguggaauuuagaaauucaugcuaauggcaguaacaaagcugucuuccguagacucucuucagugaguguuuguugugagugaggcuccaguauuugcaggcaaaagcaacaucuggagcugaggaucugccgggucagcuggggucuuguccauugucuuuaaaggcuucuuguucagguggcucagcagcaacagagcgggaaagggaaacgugacuccugcccacagggauccgagguucucuggggccgcaaacauucagagugcuggcaguuagagaauaccagagucgugccacacagggccuuucccauguaucguuuaaugccuuuguauauguaaauacaguguguuccaaaaacaugagaacccuuucaucuuccagcgguuuuaacguccaaaauggauuuaugacccgcauccaugcaaaccucaucauguaccugaggcuggggaaaggaggggauuauucgcuuuuaacccuucaguuuccauguuucagaugugugcgauucuguaauaaagcagauagaggaaggaagcgcagccuaacuuucaguccacagcacauggcagaggaugaucccuggcugauaguguuuaaucucuucagcuacugaauuauauagaucauguaacaagagauacguuccaacccauuagugaagcaguguaaucaccauauacuuccauagaccgaagaacacacuguaguguguaaaauuccagcuuacugggaaugcacaggaucuguaaguacacgcugucugcugccucaccccacuuuguacguguacaagaaucucaguaaucaggccucugccugagguacccaugcuuccccauggucagacaccuggcuuuagacuuuaccuucucaucccuaccaggugggacugaugaaguuaggagggcuagagccaggcugggcaugcccugagacauagcugagcgccuuaggcccuccaagugggccuggaacuggaccagagguuggaccaaguuuggagguguuggggaucuuuccauugaguccuguggaaggauaacauauugugaaccccaaguuggccugggaccaauacccuaaguuggccuggagauugaagccugagugccaugcaggagcuagaauggggagcaccugagaggaucucuucccuggguccuguacuguccaccucagagcugugaaguuggagaagguggaauccagucccaaggagucccaggacgucaaaguccugcagaaagaacuagaacaacuugccaggccccucaagcagaagaggagcaccgugagguacccucagaccaauguagggcucacccugggcauucucuuugggaagguauucagcuaaaugagguccuucagcucagcaucaggaacauuugaccccaggccauugcuggagaaguggauggaaaagacaacccuuugggagauuugcacagcagagacccuagugcagugcaggcacagaaaagaaguagaagcauggagaagugcaugugggggagcaggggaacgugguucggcaggcaaauaaucaagcauugacuguucccaagagaggggucugagguacaggucuucuuucccuggggcggucuguguucuuuccucugccacaaggcccccauuuuggugccucaggcuguaggggcccucauuucaccauacucuacucuuaggcuccuuuuccugaggaugaagucuuccccucuagagauuucugucacugcucuaggcugucccaugcguuuuaaacuggggcacucucccugccaguggauguagggaacagagagagggaaagagcuagaccaagagaacuuggaggcugugccaccagggcuucgggaugaaguucuucauuugcugaggaggauaggagcacaaggugauggaugaagaugaaguugagugcucauguugauuaagcugucacuuaucaauuaaauaaagaagccugggacacuaaagaaaaaaaaacccucaauagcuuuccugauucagacuucaugcuagugcucacauagacauaaaugccuuacucaagauagaacauuugagguaaggcuugagggacauuguagaggagagacuugcagaggcucugucagcaaauauggauaaacugccuacuguguagucacugguugagguccuggggaugcagcagcagaagaaacugucccuuucaauaucauucugaugaggagagacacacaacucuuaauaaggaccuugaaagaugcaaucugugugaugugauaggcugauuuaagcagaguagacaaagccuucuaagccgaaggaagauaaugcaaggccagagagagaagaggcgagucaaaaggagaaggucagcauggccagggcuaagaagggagagagaacggagugacggugacaggaauggccagggccgguugcacaugccaggaugugggauuuuauuuugguucugcuaggaagcugaggcccaaguguaauagagugucauggcacauuugcagacaagcuaugggaccagucauacauuugacuucuauggugagaugggaggcagaaacacgagaaucacuggaaagcuauucggucaacuggccuggaguucacagcguaacagaaucaagacugucucggaaacuaggaagaaggaaagaacugacucccaaguucugagcucuacacaugugccacagcacauguggaugcauguggguagaugcaauauucuuuuuaaaugauauggaaaccauguguaagaaaugggagguuuuuuuuuuuuugucacuaaacugugaaauugcuugacuauuaagacauaauaaggaaccuucacuacagauagaaaaagauuuggggagaaagaagggcaagaagauaaaaggaccaguuaaaaacgcggaagucacagacacggggagguggcaagggcaaaaaaccaggaaaagccaaugauuuccaggacaugguagcaauagggugucugagccauggagaaggaacuucucaucaaauaauugucagcaauaaaaauuauguuuagccaucaacaguaaaugguauguucuuguuuaauggucaauacacugcaguuugaaagccauuuaaaucuuguucccaaagauuaaguagugagaugucuauguuuaaaaaaaaagaaugucuaaaaaaaaaagcuaaacauagcugacuuacucccuaaagaaaagagcuuucaaguuucagacauuaugagaauguuuugaaaauuguggaaacuuauuuucuuuaaccaaaggaaguuggaaacuuuccccuuuaaauguccacucccagaaugggcuccacaagacaguuuccacucccguguuaguguuuucguuggcagucaggagacagcaaggaccuucaggguaacuacagaaaagcuggcccuucggggaggguuuccagagugcauggguuuaagagacaguggaaaguucgggccucggcgcagugagauugaaagagugguguuuauuaaaaauccaaacacuuugugagucagugcacugaccuuuugcaauccagaagagaguucagaggguggaaucccugguugcugagaacggcugcucugugcugugauuuugggacugcccggcuguccccagagaguccuuccuuaucccugacccaacacuuuauuuggguuacccaucacaccuuucaggcugauaggccaggaaguugagagccagagaagaccguugugaccuccuaaauucaggucauaauugacccuaacuuuugcugugucccuggaauggcaugugacacucauguagacggugcuaagugauucugguacaugcuaagugguuggaaaguaaaaugugaaaaauuggaaacuggagaugguucagugguuaagagugccugccaugcaaccgugaggacuggagucggggucccagcagccauguaacaaaguuggcucacacuuguagcucuggcuuuggggagccacucuuuuggcuucccacaaguacauagcugcauguaccuacauguaugcccacaugaggcauaaauuaauuuuaauaaauaauacaaauaguaggaaaacacucugaaaaaugaucuuuucgaggaucagagagauggccuagaaguuaaagaugugcgugcacugcucuugcaaaugccccgugcuugguugucacacuugcauugagugacuuacaguuguuuacagcuccaucugcagagaaucugaaacacuccucuggccccugagggcaccacaguccucaagcacagagauacauacacauacauaaauaaauuuuuuaauuaaaaucauuucucuuaaaucuuguuccuaagaauagcacaauguaagugaauaucaauauucuuuuauucaaaauuauuugagagauauauauguauguauauaucuguauguauuuauaugaauauauauguuuuuauggaaagaguauagaguuaacauuggaacauuguuucuugucaguguaguuguguguugugaggugucaagaaugacuguguaaggccucuuccagugcagacagagcugcuugucauauuuuuccacugugguccccacacagcagagggaaaggacaacgggcuggggugagucgagagcaaugccauacccugaaaugaccagaaacacuuaauccuuugcuucaugaugucucaaaaaaagauaauaaaagacaguggauauagcucagagguagggugcugcguauaauacacucuaaagaagggaagauggggagaaaggaagaaguggucaggcauaggcugacaucauuugcugugcagcuaguucaagaccacccugggauaaaugagacccuguuucaacuacccucucucccaaaaugguaucgauuuucccuugccuuuucuuaggagcuaauuaauggaguaguucuguaggucuucccacccuccucugagagccucugagugguuuaagugugugcaccuucgggcaggggcugauggacaggcuccucacucagcacguuucguugcucgcuugugguagugauugccaugguaaucucaccaggagguagauuuuccuuguauuuuguuaaauuuauauguuaugaaccccuggacuauauaaggaauagggaacacuaauauugauguucaaaugaaugagaauaaaggauuaauuaugcagugcuucaagauucaccucaugagauucauuaguuacuuuuuuuuuuuuuuuuuuuuuuuuuuugguuuuucgagacaggguuucucuguauagccccggcuguccuggaacucacuuuguagaccaggcuggccucaaacucagaaauccaccugccucugccugugcugggauuaaaggcgugcgccaccacgcccggcuuaguuacacuuuuuaucacagcaucaagacaugcugguaaggcucaaaagccagacuuauuauuguuuuuaauuaauuuauuuauuuacuuauuauuuuuuuaaagccagacuuuuaaaaaacacuugaguauagacagaugaacauacacacaugauguagacagacauaaucaauucagacauuauauacuaguagccauauaucuauaaauguauacauacuguagugcauucuugguauaguauaauauuauuuauuuuguuuguuuauuauaaaucauggccccaugcuugcuaaugcauuuuaucauuugcaaaaacaaaacacaaaaauaauucagauaaacugacuuggugguuuagguucuaguauguccacucaaaaugccgagucauuaaaagcauuuaccuauuguaauuaauuaauuuccguguuuaugcagcuuuuauauccaacugaaaugaauccuuuucauaaauaaguuagugugggugcuguuaaugguaucaugacucugcuugaaauuuaugaaggacuuuuguuuuucuuuuaucaaauagaggcuagccucacacucaagauuccccugcuuggguuucuggaauuacauaugugccaccuuaccaagccccuuaacuagacuguuuguuucuuuguugaagaauggguaggagaauugagacugauuuccauguacuacaggccuaaaccauuugaucguaaaucaagcaaaaacaacagaacugggggggggggguguuauuauuguuuguuuuuuaaugucuuucuugggacguuuuaagacaauacuguuuuaaaaggaguuuguaccuggguaugguagcccacaucugaaauugaagcauuuggcaggcagaggaauaagauugcuucaagcucaaggccagccugguagcugguacccaugguaagcucugggguacuacagugugaguuggagcuugcaugagggagggagggagagagugacucccacaaguuguccuugggcauaccaagucaugcccccccaaccccaacuaacuaacuaaaugcuuuuaaauguuggaaaaggaaaagaacaaaagagaauuugugagucgaagaguugaagaagacuggcuuccuacauugugagacauaaggcaguuuuccuugccuucuaaucuaaguagaaccuuagcuuucuuggucacauuugaaauucucugaacucuuguuuugaucugaaguuuucuuccuuccuuccuuccuuccuuccuuccuuccuuccuuccuuccuuccucccucccucccucccucccucccucccucccucccucccucccuccuuccuuccuuccuuccuuccuuccuuccuuuuuucuucuuuaugagaauagggucuuauucuguacuguaguccagacuggccuugaacuugcuguguagauggugcaggggccuugaacuuguagcaguccuccuggcugugccucuacaugcuaagauuguaaguguacaccacugucucuagcuaagauuucuuggaaaucuugauagaauuguuauauaagccagcacucgggaggcagagaggcagacaaaucucuggguuuguggccagccuagccuggucuacagagugaguucuaggccaacaggaacaggauggccuauacagagaagccugucgaaggaagaaaggaaggaaggaagaggaaggaagggaagaaggaaggaagggggggggagaggggaaagggggagaaacugggcaaagggaagcaagucaccuucauuucuuacauaccaguugcaccuucaugcuuaaacagugaucaucauucucuucucaguguuuuucucauccacagacuaaucuccaggucauugaggacaugucugucuugucccuauuguucugagagcacuuugguggagcaucagacauuagaaguacuuuucuauuaccacauacaucucucaggguuacagcuguaaugucucuggucaggugaauuauguuaaucucuuagcuuugaccuaagaaggcauuuuuuucacuugcuuauaacuccgaggcuauaccuuugagcucucuaaaugccacucccaccuuccguauugggucaugucugaauuauauuuaucauuguguguguccacgaugaaugugugucacugugcaugccaacgggcaccuguagaggucagaggacaacucuguugagucgguuuuuuccuuccaccuucacaugguuucuagggaccaaacucaaguuaccaaacuugcuccaucacccacugagagccuucucccuggcuucauaguguuuguuuguuuguuugguugguugguugguugguugguugguugguugguugguugauugguuggcuggcugugguugcuguugugguggugguguuggugguggugauuuugagacaggaucucacugaguagcaguggcuguccuccaauauacagagagccaccugcuucuguauccugaaugcuaagauuaaaggcaugugccaucauaccuggcccuugauuuuuaauuugaaaaauacuguauuuaaauacuggguuuugggcuggugagauggcucaguggguaagaguacccgauugcucuuccaaagguccaguguucaagucccagcaaccacaugguggcucacaaccauccguaacaagaucugacgcccucuucuggugugucugaagacagcuacaguguacuuaaauauaauaaauaaauaaaucuuuaaaaaaaaauacuggguuuccauuugguaucauuagguucuguuuaaaaaugaaagaggucuuuauucauugugcucuauaaaagguguacuaaaacuucugaguaauaugcucaccugcaaguauugggaacacacugaguggaccuuuguggcucuaauuuguugugacuuagaauucugaugauggcaugcauguuacuauuccuaacaguuucgguggguauugucuacaugucuuauagaaacugucugaugacagcaccuuuuaaaauggacucauuuaaacaaggagacuucugguagggcuuuucaauuuugcuuucuuaugguaagagugggguugccaggcagugguggcacaugccuuuaaucccagcacuugagaggcagaggcaggccgauuucugaguucaaggccagccuggucuacagagugaguuccaggacagccagggcuacacagagaaauccugucucgaaaacaaaacaaacaaaaaaaaagaagaagaguuggguaguaguaucugcaguaguguugagauuggccaauuuggugaucccaccugcuagugcauguugggaaaaccccauaaguucuucaucauaaaugccauuuccccaugaagggauuuucccugaauguguguuucaggccgugagucucucauuacuucuuuguuagcuucuagucaguaaguucagccagggguugaugcaaaugcuaaacacuaaggauuccccuaacuuuucuucaccgugaacucauugauuccuggaagauuucaaaaucaccucaucagugcugugugugauccuacgauccacacugccuucuguuguuuuauucauuaaagaaguaauaauagcaaccaaugcuuagugaauagucuuguaggcgacuuaaagaacuaguucucuuucuuugcuguaugucauauuagcagccuggguaacaacccgauucuuauuuauauaacuuuuuccacucauuuuggucuuuauuauuuuugagucaucucuaacaagcccccuuucucuguaaguccauggagaucucagacaaggaccagaguuaacugugcguugggguguuugucucugguuguaaguuguccucagaagauuacagcuuugacagaaugagggaucuugucucagugcuuccuggugcagauggacacuuggaaauacggauauauuuccaauuuauuguccucccaagcuauacucuccauauauauauaucuuguugagucugguagaccucuuaaaucuuucccucugaguguguauauauacaugugugugcgugcacacacacacacacacacacacacacacacacacacacgcacgcaggaagggaagucuagcucuccagaaggcuuggcugucagcugcauugcuuugggagcaccgagaacacugacacuagcugaaggcucugccccgucugcucacaucugcuuuggauuguuccuuggucaaccaggaaagauguccuuguuauugcucugaagugguggacugaacaagaaaauuugcucuuggaauugucccgauuuuuaaauuagugccaccagcccuccucucuuuucccaccauguuucacauacccagcuaaugauacgcuuauuuuaggauacaguaucacuaccuuauauagccucaggcgccucaucucgccuagaacaaagaguuucaaggcucaaaaucaaucuuggccucugguauuuaaaccauccuaggcgaugaacauaggguucaaauuaggccucugcuuuguauuaagagaaaaggauguaaauugccuuuugagccugcagacaaaugcuaacuaaccgggguguuggggguuggaaaagacacuuaacaaauuaaguugaguugcuuaggaguggagaaauaaaugaccauaggcuccacccauauggcuucugcuguguuggguguaacugcuguauccaguguaaccaauuuccuuugugugugccaccacacguguguauguucauguguguacaagugggcauguaucuguguguauauguaagccaacggauuucacugggaauuguuuaaguguuauccuucuagcuaccuaugaacacagggucucuuacuggagccuguuacccccugauuaaucggggaugccuggccagcacacuuccacacccgccuccuucuccccagcaccggauuuagaaacauuugucauuacauuuagcuuuggggaaucuuaaacucagguccccuugcuugcaucgcaagcauuuccugaaugagccaucucucuagcccuuaguggucucuuucuguuaugacuuugauuucuuuuguuuguuuguuuuuaaagauuuauuaucuaucuauuuauuuuuauaugaguauacugcagccgucuucagacacacacuagaagagggcaucagaucccauuacagaugguugugagccaccaagugguugcuaggaauugaacucaguaccucuggaagagcagucaguguucuuaaccacugagccaucucugcagcccacgacuuugauuucuuagguaaaaaucuuuaugacauuuaucaccucugguugagucuguaggccauaaaucuuuuccuauccucugaaaagggacugcuggcugucuccaucuauuauucaaggcgaugcuuuaagcuggacauccagugcucaccuguaaucucaacauuugggagcccgaggcagaagaauugaaaauucuccaaccuggucucaaucucccaccccaaaaguaauauuuuaacaucuguauauuugaaagagcauagugaauuguagguucauguaugcuuacccuuggaaguguaaaugaaagauuucuaaacauugcagauauaaccuucccucuaagauacuggucauucugaaaucauuucuucccggggcuuguuuucuguauacagucagcauaucuacaauuaugcuuuucccuuuaugucaccucaaguauccgauccaggaugcucuguaaaaucaccgugugccauguugcaugcaaagcaauguacaaguacagguaggaagaaucuuugauccacccugaauuacugcaugaauauccaaauugcucuuccauauccaaagcccccuucaugacguuggcuucagcgcugcacaccucccgcuuucucgggcuuuuaggaugcccuguaacuccaaguauuuacuugcccuugugagcucaucagaucccauuugauccgagucuuuccucugcuuccguuuguaugugacuuguaugguuucacuguggugacauugcaccagaguuuagucuauggcauucuccauccugggccacauaugccuuucagccauaauagcagagauaagcuaaggucacugucuagugagcccagccgcagagcgacacguccuggcacuccagguuuuccaggugguacugguucuggggacgcagggaccuuuucuagcacagaacauguacuuuugcagaaguggcugggcuaugcuucugcuaacuccagggauaucaugcaugacuuaaaaaguauagucggaaaaauguuuuuaaaaguucugccaaaaucucauccacuuuuaguuaucuaauuuuuuaaaaacucuauccugaguuuucuuuuuucuucucgcuguccauuugacuugacccuuaagcuagacaugcugaaagaaggaugccaaguccauagugacagacaguggggaguggauggacgccuggugcugggauggugcuuaguacagggagggcuucuuucugugguaaaguacucuaaauccacccugguuacccaauucugaacguaccaaaagccacugucgaugccccuuaauuagaugaaauuauaaaguguauuauaaagaguggaucucugcugagcauguaucaagaagcacaggauggucucaucuugucuuauagaacuucucaaagccgggcagggaggggagggaagcagaggcccauagcacccagcauuuagagcugagcucauuucaccugaugcagcugugcauucuggguagugccacaagccccacgcaacacccagggcagucccuucauagucucuuguauucacuuagcaagcaaguucugagugcucugugcuugaucauguuccccuccacccccauucaguuuccaguccacuuuucucucuuuaccuucccagaucaccuaagugugaucuuggguuuguuuuagguuuuguguguaugggugugugguguauguaugauaucuacaugugcacauuugcaccugcacuaggaggccaucagauguccugcucuaucccucuccauucuuuuguuugauugguuuuucaagaaaggguuucucuguauagcccuggcuguccuggaacuaacucgaugugccacuacugccuggcucccucuccauacucuuucucuuucucucucucucucucaagauuuauuuauuuauauguauauuauuaagauuuauuuauuuuauguagcugucguagacacaccagaagagggcucuuaaccucugagccaucucuccagacacacacacacacacacacacacacacacacacccauucucuucagacaggguuucucacugacccugcagccgaccuggcaaccagcaaaccuuagauuucccccuccucagcaaaugccgguuggcuacacucagccuuuuagugagugcuucagauuugaacucaggcuugcacaggaagcaggcuucaugcugagucaucucucuagcccccugcuuccuuuuugagucaucccugagauggugucccuucuguagggauugucauacugcaguauccccugcaaguccuccagacacugauguugaaugagugugugaagagauggaggcauucauuuagaguccuguaugaggugcugggaguaugcagcaguaggcagugugaguagcagaaacagcagcuccugagcccaugugccuuuggaagagaaaucauaacuuuuuagguacaaaguaacugaucaaacccuggcucugugccuuguuguuguugcuguuguuguaaaucuuguugauauuucugacccaagccagugagaauccauccuuguuuuagucuuugcuuuauuuuuguuagaguuuuuccuccuguguugguugauauuuaguuuauuucaguugucuguccuauaaacaguaaaggcugcucacccacgucuucccgccccugcuucaaccacacaucccagggucccccugcuacuucacuaaacugccaacaguucugaaaaauagcccucugcuugaagugugcagaagcugcccacaacgguaagcagcuaagagaaaccagagcacauauuuccuccaacucauuuuuuuuccagccccucaaguauuuguuagagggagcugaguuuucaaaaugaguuccaauguucccguguguuaauaauuugagguuucuccugcauggauaauuuaaauguucaaaaccaacucaugcuaaaguuaaaugcacauugaacuagccguacuccuagcuuaccauauacauggcagugauggagagggaugugagguaaagagccacuggcagggaagauggccacacagugcuaaggaaaccucgcuuuacagugaugcauugucaggaaggaugcugggccugccccugcuaggcuuggaaacuuaaacugcguuuaaaucaucuuucacagcaccaccacaagugucccacugcagauucuuguuagugaugccagcgagcccuccgcacugagcugccugggcugaccucaaacuucgaguccuccugacuuagccucaccuagccgggguuacaggcuugugccaucaagucuagggucuguuaggauuuuuaacaaccuauccuacuugcuuaugaagaguuuggacaauuuugcucacugugugcagacugugagguguaauuggacauugaaaagauuggugguauauucuucuaguccuagcacucagaaagucaaggcaagaggauucugaguuagagaccagccugaacuacaagauuuccuucagcuuaggcugccuguguggccauagggagacucuccagcaagccaucaauugguauggcuuccagcugauccaugggcauggcuuccaauguguucuccuucagaagcagcaucugcuguuuguuuuugagacaugaucugacugugaaguccuggauggccuggaacccauaauggagaccaagcugaccucaaauccacagauaaccaaucuuccucugccuccagaaugcugggauuaaaggcaugaguuaccaugccgguccauaagcacuauuucuuacacacucacugugcucgaagaaaugcuaaguaucaugaaagccaggaaagaauaguagccuuuuuuaaacaugaaugcuacucucccacccucccaucucuucggccccuuucauguccccccacuccuucucaacuuaucuccucuuuguaccggugugugugugugugugugugugugugugugagagagagagagagagagagagagagagagagagagaguuacuucugaccacuugggauuggauaacccuuggggccucaccucugucgaagagaagacugacucucccucucuugguagcuuuaauuacaugcagcucuucaucuagagguggggccuugugagauucccuccauccaugcaugauggcgugucagcuguguguguugucauuggacaggucuccuucagcaacucuaauaaguaguucuacagaaacuacggagaaagaauagacuucucuaagagagguagaguguuuuuaaagcugaaagaauuacacacacaagauaaagagucacaggggaguacagagaaagggggagggggauugucuuagucaguacucuauuucugugaagacaccaugaccacagcaccucuuaugaaggaaaacaucuuguuggcuggcuucagagguuuaguccauuagccuuagggcaggaagcauggcagagcagaggcagacaugcugcuggagaaagagcugagaguuuuacaucuugauccacaggcagcaggaaguuacagugacuuugacuucugagaccucaaagucucacccccuaguaaugcacuuucuccagcaaaaccacacccaugccaacgaggccacaccuccuaauugcaucacucccuaugggccuaugcaggcaguuuuuacucaaaccaccacagugaucuaagagacuucacaacaggguguuuauuucuguugacaaauggcacuguuuuggcuguaucagacccugaacuaaaccccuggugaucaguaagcuacuagcuucagcagcuugggugagagagguuggagauagagguucugguagguggccauugacgcagcagugugagaaggcaccagucaguguucaggagcgacugacacaguaauuuaacuggcucauuuuugugaaccuuucuaucguauaucaaagauucugugaaaagaugagaacaaauaaaccucuuuccucuccacucaguagucaguagaaagcuugaacacaucauauagcuaagaacaauguaaggcagaguggagacugggaugucagagaauaaacaaaaggcucugacaaccaaaggaagcaacugauaugguauuuucugcuggaaaucaguuaaagcuucauacaggaaguaauauuugacugcaccuugaaaacggaugacauuuuaaaggugggagagacaggaacaggccuggcacagacaggaaguauauaaagaaaggcauauaaacacaggaugugggcccucuaguacugaagauuagccagggguacucaggagagcuggguaggguggggcuggcugugauggaacuuaaugacaaugcuaaaauagagagcugccucuuuuuuuuuuuuugagcaaagagauaacaggaucugauuuuguauggcagccauugagcucugagugaauagcuuaggagguguaaaagguaagauucuaagcaagaggggcuggagagauggcuuagcaguccagaacacuugcugcuucauugugaggaccagaguucaaaucccugcaccuaugugagacagcucucaaagaggcuguaaugccaagaaauccaguuuccuccgcuggccuuuaugggcacucauacaaacuugggcauacacccacauguaaaaguauuuuuuuauccccugauguaaauguugcuucggaggcuauugccucugucugcuaaccuaguccuggaagcuucuagccucaguacgaccuaaucuaggccuagaguguuuucagccccugagacuugcugcugaauaagcucacccuuucuaguucuuucugagcuguagcgcaaacacucuccaagcugacugauucaaucuggcucccccgcccccucccucccucuccugagaguuaggcauauccuguucugucaaaucauucucugauucaucacugugucacuuugccacucaauuugacaucacuuuccacaugggcacuuccuuccacaaacuaaacuuaaccuucauuguuugagauuaaagguguauacuaagggugugucuguguccauccagguagauuaaagguaugugaugagacugagccacaccacaacuagaaauaggauuuuccaguaaauaacacaaucgcagaguucacagugugaucagauauccugcaacacccauacccccacacacaugauuuuuguuuuaaguugacagauggaaacaacaugggaacaaagccaguguauuuucuuuuaagauuuuauuucuuuauuuuauauauaugauaaguacacugcagcugucuucccacacaccuaaagagggcaucagaucccauuacggaugguugcgagccaccauguaguugcugggaauugaacucaggaccucuggaagagcagucagugcucuuaaccucugagccauuucuccagcccccaaagccagugucuuuuguaacagagcaugcaaagauagucuuaaccagcagguccuccgugggagaauucucuggcuaguuagagaaaugcacagggcagaaggagaagggcaaaagaguuggagaagggaaaggggcuccagggagguagguaugucgccuuaagauugcugcagggaauggaaaaggcagggagagugccaggaguucagggccagccagggaggcugggguguccuugggguagaguccaucaauuaagaaguuuuccagcaugggucuccccuccuucaccuuuccucugucccuccucucccuuuuccaggugcacaugaacaaggcaggugacccagucccagcgagcucagaugguucacugccuacuuccuagauuugcucuuucagccuggugacacagcucuguguuccgcuaaccagagaccagugccugcugggaugcugacaugaguguuguucccuugcuucucuagacuuuggcuucagcaaccucuucacuccagggcagcugcugaagacgugguguggcagcccucccuaugccgccccagagcucuucgaagggaaggaauaugaugggcccaaaguggacauaugggugaguaugucccgucuuaucaccuguccccucugcagaugacagcuguccugucaugugggagugcagagcacguucaccugcacuugcaaccccagucucccccagcacccaagucacaugagccuuggcuuucaacuacucccuuugcaccugcagaggaccccugugagggccugagcagaagauggcuguggcaacaacagagauuaccuuuucuugagaggcugggucugagaaauguuuggaaucucacccuaaauucaugucuggaagcagaaauguuaccugcucugaagacaauugacuuugacacugacccauauuauauccuaaaaagaggacaaguuggucccaucaucugcacauacacuaauggucucuuuuguuuccuccaaugcuauuaaccguccguacucucuguuugggcuacagagccuuggaguuguccucuaugugcugguguguggcgcccugccguuugaugggagcacacugcagaaucugcgggcccgcgugcugaguggcaaguuccgcaucccguucuuuauguccacagguaagggacccgccagcauaaagccaugacugcauucacggagaggcaggcauguggaguaauuucacaagugcagugaugcugggucaguggccauuuggcugcucucuaagcugcagcugccucagcucguccaggaggcaagguuccuuaggagcgaaauaagccaccugcuuuggcuuggggaucgggcucugcucaguaucaauucaucugagcuguuguaccucagucuaagacggcuaaggcuuugcacggccccuggcauacagauuagauuaacugcugugugagucacuggugccaucauggugcuacaguggcaucagugcgugucaccuguccuccccacagccuccacuggagugccagagcuccgcgguuggcacugaugcccaggacaaagcaggcuuucgucuuugucuuccuauggucucauuuccuaguucucuaguucuccuucagauucuaacuauuuaggaaaauuuuuuaaguaagcagacaauaggauaauagcuuuuuggaaauuuuaacacugaaaacggauaccagaaacccagauguuauaguuagcagacaacucagaaccucuggguuuggcuucaguuugggauguguuuaguugguugguuugggauuucuuugucaccauuucugugcaugucugauccacuauagacaguguuaccuuuugucuagcuacuuuccucuuaaggagagcaugcacaccuuuagaauauguagguggaguguggguuccguuuaacugagucagcucagaacugaugacuuagaaggucaugugucaggugaugauaaugcuaaggaaaggggaagaagaaaccuuuagaauggugggugggagaucguucaaagaggaacaguuggaaaacgugacauuucagggacaacuggaaacgaaggauacuggaggauuacugcccgaaggccccagggagggagcaauuggggugugccugaaaggaguugagcauguagacucucugcuuuuacucugcuggaaucggaagaauuagaagcucucuuaaaaauagagaauaauaugguuagaccuguggggguuuucuaaauuuuuauuacgaaaacuuuuuaaaaauugaaaagauuuuuuucaucagcuuuuaaagacaaucccuguaguugcuacacugcuuguugaaaggagagugcagugcagugcuguguggugcagugcagagcuauguggaguagugcaguggcauguacuaucacgcaacacagugcagugcuguguggugcuguguucuaaggcacagcacaguguagugcaguguuguguuguggaaugcugggcagugcagcucaguguaauggaguguugugcagugcagcucagugaagaagccugguugguaggagacuuagagagcauguucccagacugaggaauagagugauuugggacggaucgcugcugcacacuaccugguugaugugucagaggaauuuuacagacauuagcucccuucaguauuaugagcuauaugagguuguuaccccacuuugcagguggugccacauccaggagaguguaagcaguguccccauguagaacagcuuauuaguggcuaaacuagaauuugagccaaggcaguaugucucaaauaauguuugauauugcauuuaagguaagaaagaauaguuacagguaaccccgagauuuguaccugagcaacagaaaggaugaauuugcuacuaaaucaaggauaacugaaucgucaacauuuuggagagauguuuuuagaaaugucaaguuuguggugccuauuagccgucuaaaagacuguucuggucagcaguuggaaaggagagaguuguaacugucaaaacuggccucuuugagugucauagaauauacucuaaugcuaccaggaaggcucgcucucugugccucucaggaugguuagagaugaggaaggugacaagggccagaagaaugguuagggaggaaagccagagucacuugaagacaagugaagcugccccaggaagcugagguagaggacagagaacugagugcuggauuuagaggaauggagcucccuggugggguuuggugccacugccacgggaagcugauccaugcacacaguaggaccgagugcaaggcacaggaaagggggaagccuugacucuucccaguuugacuguacagugauggagacagagaagugugcucuggggggcuccaacccuggucaucagauguccugccaguagcugcauuuccuguugucauggugacugcauuuuaccauucccuacuaaggaaaaaaaugaggacaguuuuagguucacugcagaauuaaagggacagaagauguucauaugcccccugccucacuuccccucccacacacauacacacacacauaugcacacgcacgcacgcacacacacacacacacacacacacacacaccccuucauucagagccugucauuuacaagaggguucacugucaggguuguaaauucgcugggcucugacaaguguauaaaggcauuuauccaccaugauccugucagacagagagccccaccucugggaugauccugugugcuccccccauuccucccaucuuucucuccccacuggugaucaucgucuccauacauuuuuacuuccgggaugugauaugguuggaagugccguuuuacguuggccuuccacuuaggaacaugcacaggcaugcaaugucucuugugucuugcuagcucauuucccuuuacuacugaguacucccuugccugaauguacuacaguuuauccuuuugcccacugaugagugucauggcugcucuccaguuuugacaguuuguaacugagauugcuuugauagccuugugcggauuuguguauggacacacguuuucggcucacuugaguaagugccacggagcaugccugugaggccauaugguaagagcuuguuuagauuuguaguagacugccaaacggccuucccuagagcugggcuguguuguuguaaauaagaguucuuacugcugcccgacuugcggcuuuugccugauuagccuguggggcgugguccccuuucacaugugugugguguuccuuucauguguaguucugaagucugugauccugaacauccuuguauaggugucucaucaggucuucauuuuuuauuccucuccaacaaaaucucauaguguuuuuccaagcugccuuugaacuccugggcuuacacaguccugccucagucuccugaggaucuggaauugcucguuuauuuauuaggguuuuucacugucuucuaaaccccauuguuucuuacugcuucugagauccauuccuucuguccccuaaguauacucuuagucaucucugccagauuuuucguucucucuuaagccuuacaucuccucuuacccaaaugagcugucugagccaucucguuuacugccauggcuucaccgaucccuuuuggggacugcucccaauuaacugucuccaaauucucuccugaggucuagggccacaaauauccauccauuugcuauuuagcaucuuuaaaaaaauuauuuuccuuguuuuguaguacugagacucgaacccagaaccuugaguauguuaggugggcacccugccccugaacuacaaccuguuacucagugucuuccuuuaacaucuugaaaucacauucacugaagcauuuuccaaaaugaacuuuauucccuauccacaguuuugcucuauuuggugucccugguguccccgucugaggcuuggcagaaacaagucuugauuguuucuucucuuaucaccaccagagccaacugguuaguaaaggcugugcagucagucugcuauuccaguaaccaugcugucaucuucucuugccuaaguuagacuuugucaaaucuguggaugcugaguuccauccuugucuucuccauguuucugcgugaccuuggcagacacgaauaauaaaaacuacaccucacaugcaaaccucacagguacacgcauacaaacgcacaaaucugaugauaucauuuuauaguuuaaaaauguuucagcaguuuaacauugcccuaaaguuuacugcuaaugugucuaaagcacugaaauucaagaauuuuuacuacagccaugauaaaaaaacauacuuuauacuauaacuuagaacacacacauauauguuuucaaaaaucaaaauauauuguuuugagacagagucucuuucuauaacccaggcugauuuuaaacuaaagaaccaucucgcccagucuccugagugcuggaguugcuggcagucuagccugaucgagugcuaagccgaugauccugagggugauggucaagauuguucucuggccuacacacgugcauauucaagaaaaggcaaauucagauauuuuccgggguuuuuaucuuucugaaccuugucuuacuacuaugacauuuaucaaaauauacuguaauuggaggcuagaguggcucagcagcucagagcauugucugcucuuccagagguccugaguucaacucccagcaaccacaugaugggagcugaugcccucuucugacaugcagguauauaugcaaagucauguacaugagaauaaauugguuuuucgagacaggguuucucuguguagcccuggcuguucuggaacucacuuuguagaccaggcuggccucaaacucagaaauccaccugccucugccucccgaaugcugagacacauauauuuuuuaaucuuaauuuauuucuuauuguaauugauucuuucauuauaagccuuccacaccagacucugaacuuaaagaauaugcagagaaagccuccagccuucccacaguuguuuauaaucuagcagugucugguacagcagcacuuccuacacacucuucugugucagagucaacugcaccgaccuuguguuccaggggcuuucauugacucuuaaaaucaggcugcugguggugcaggccuuuaaccccagcccugggaggcagguagaucuguucaaggccagccuggucugcauagugaauuaagaccuugucucagcccggcgguggugaugcaugccuuuaaucccagcacuugggcagaggcaggcagauuucugaguucgaggccagccuggucuacagagugaguuccaggacagccagggcuacacagagaaacccugucucaaccccccccccucccaaaaaaagaaaagaccaugucucgaaaaagaaaaaugagaaauguacacaauugugacuucuucuguagcaccucacccccgcccccucccccaguccuguuuucucuuguucugaccucaggcccugggcuuuagucaggauaguguuuguccuuucucagacauagcaagcacacucugcuguccccucaggugggcacucugaggccucuauugacaccgcccuccccacugccaccaacagcuuccauaauuguguuugucuuaacccuugucucagcuccacaugcucuaaauuguuuucccaccucccaugucaucauugucguuguugucgucaucauugucaucauuagcuggcagggaugagcgguuuuggauaaguuuuguucacugcuauauucccaggccaugggguagugucuggugucuaaacucauaaagauguauuaaaggagggaacucauacacagguuuguuaaaaauacagucuacggggguggggguggguacggcccaccaaagcccuuccacaggaaauacucucacucaaacaauaucaagaaauuacauugugcgugucuaaucucagcacuugggaggugaaagcaggaggcucaggaacugaaggucauuagcugcucagugaguuugagucuagccugggccacaugagauccuguuucaguccuugcuccacccuuaaauacacacaaaaauaacuacauuucucuaaggcuagaguuugugaaguauuuuccuguauuucgucugcuuuaaacccugcagcugugcucuggaauuguuacuauauacuauuuuccugcuugccgugacguguagagaagugaguugccuuguaaaagccacacaguucaccccagucagccacuccucggaugcuguauuguucugcucaaccucacuguuauaaaaaaggggggggcaggucaauaaaccacuuccucugcuuuuccaguguccacaguauuuccugugaggaguuuggauauccuccaucuuccaccccagccucucagaccaugcaaggcucuucaggccuccccaaagcaggcugcugagcauagcuccuggcaaauaaccuagcugcugaaaccacgcuccuagugaguuaucaugagugcugaaaggcucugagaauggcagcgugauugucccaaauagugauacuguauaaucccggagaggagauuccccaagugaaugaaacaaugcucuguaagaugaagcacagaaagcaagaaccaguggaggaaaagagcuggcggucaccaucuuacugcaugcucguucucauccucagcgaugugcaugugcuuagcuuuauccuguaccauagaccugaaucccaagacucaucagaggcugguacuauccauauggugaggcacagaggaaaaggaaaucauaggauauuccuucaagcaucauggaguucaguuucaagggaaguacacuugagagucucacccgggguccucuuucugucucugggcauagcugugacucacuagaccuggaauuagcucuuccuguggaggucgaagcugucaggucugcucucccucuuugugcuucugucucuuuccuauagagggcagugugggugaaaaacaagaccuguucucugcugucaccaccuuggccugagcuuacugauuucugugaaaagauguagaaacucagucagggcugagagagcuuuccacauuagccugugaaacacuagaagauccuuuccucuaucuuuuauggccaagucagacuccagagugucuccagcugggagaucagucucugaagauggacacuguuucuauaguaacugugggaugaaguugucuucucauaguaggucaaagcuuguuagacacgaguguucuuccauagcuguccugagaucaacuaaggucacauauuguuacauggcauuugucaugggcuaaugagugucaugaguggguuuuaacuaccuaguuuauuauggccuaaaacaaccagauguguuuuacacagcugcaucuucuggaaccuagaggcaccuggcaggaauuacaugucuuuucagugacaauuuugaaugaaauauggaaggaaucacaacguuggucuuauggugguggauaccacucaggagacaaaggcaagcagauccugugaggucaaagcuagccugcucuacauagcaaguuccaggacagccagggcuacauaauagaaacucugucucaaugucccaaccucccaccccaccaaaaaaaggaaaguugagaaaggacuuacuacuuaacuguagacucuccugucgcuucggcauuguacuauuaaagugagagguagcuccccaccgaugguuggacacacucaggaaaccaauuggcuuuauaaucucuuguuauuauuuuguagaugacuagaucaagugacuucugguuaguuugcaaagguauuuugagccagucaucccggcacucaggaggcugaagcaggaggaacauaagugaguuggacaccagcauugguuacauaggagguuggaggccagacgggguuacauaaugagaccaucucacagcgaaaaacaaaacaaaacaaaacaaacuauuugauuuacuguaauuuggcucuccuagucucugauaaaucauguuuguuacaaaccauguuuguuuuguuuuguuuuuaagguuuauuuauuuuuauuauguauaaagugcucugccuguauguauuccugcaggccagaagagggcaccagaucucauuauagauggcuauguuggaaauugaacucaggaccuccauagccaucucuccaggcccagaccaguguuuuugagugaagcuucuuggauugacccagagcucagagcugucauccagggagcauuucagccuuugccacaagaugauaaggggacucauuuccuugagcucauauaaaaugagaccuggucuagccagugucagcaguggccacaucugacuccacccacugauggaagccagcaauauacacauuugguuacuagauucacucccugauaauacauuuuuaaacccuuggauauguguuuugccuuauccucuuguuaaauaccaccuaugagcaaauauaguccaaccauuuacuuaacggaaggaaaauuaauuuaccaugaagaaacugcacugaugcugagugcauugagaucucuugugggcaauauuuuugaguccuuauugauuagacuucauugggacuuaauuagcuguaauauugcauaagcauuuuaucacugggaaugcagaucccacuuacauaaugcuucugauggagaauauggccuacagcuacugccagaaagcuuucacuuagaggaagguaacucugcccuauccgaguacccaucaagaaccacacagugucucccugggcgaaagcacuuuguggagaggagcaagagugggaaugggcgucacuugcccgagcuauaagugcagaggcacgucuuuggaggucugcucuccauccagggagaaaaaccuguggugcuuuggugucuauccaccugggaacacaucucaaaccagagagcuggguguggugccacaccuguaaucccagcacuuggaaggcagaggcaagagaaucacaagucacccucaacuauauguaaguuucaagggcaaccuggggucuaugagacccauuuuaagacaaaacaaagcuagaccucauccgagugaaucaggccucgcccuagucccaugaguuuaucuaaguuucuagaaagccagggaugaagguccuugauaguguuccaguuauaacuauaccuuucaagcaaacuguuuucugauuuauggaaagccuuuauagaagaauaaagaaaacuccaaguagaagaagcuugauuccagagguugggugauaacuaacuuuggguuccugugcacuaggcacaguugauuuaacuacuuaguucucagcaggcucuaacuaucccgugagauaugcugaaugcuggguuguuugauugguauaaaaaugaaggcauagcaaggauaagagaugcucacuuagaaaaugcuagaacuaaccuuugaaccuuagcccucugaccccagagaguuccuaaccauucucaguuacaguuaguucucguaaauagauaccugguaagguuuucagaguauuuggagaguccuggagaggauaucaaagaaagcauuaauaggaggccacgagauggcagugcagguaaaggcacuugccacaaggccugggggcuuaaguucacuuaccaagacugccccugccccaugcccaccuacacuagagcuuaaauacacauuuuuaaaacuucuuaauuaauagcacauacuuuagacucugggagauuucuagcuccagccaaccucuuaccaaagcugucuugguuaaaaaccaaaacacaaugcuauuuuaagaauagauuuaacuuuucauuaucuguauagagaugaugacaaacuuuauuuucuguuuauagagaaaaguggcagagccagguuugauggugcaugucuacagccccaucagcuggagggaugagagcaaacuagugccagccugggcuauauagugagaaguaguuucaaagacugggaggggaagagacugagagaccaagccaggagggaaucugagaggauaugagaauguuuuauuugcgguuuucuuucuggaaaaaguagucagcauuacugagacacugagucacaaacaucugaaggccuggagcgcaaagcaccagacuccuaaagccauguagcucucugugcagaggcuccucacagccccucuccaucugcgcagccagcucuccuguuuugaucccugaccuggucagagcuugcgaguaacagaagcugacagcagugugccagcuugcauccaauucugacaugcaguuuaacuguuugaaguucugaaaguuguucauuauccacagaaagggauguuuuagagauuggacugccgguuaauuuuuguucccauuuuggauuuugagauuuagaaaaauagagcugucuaaaauuuggauugcuauaaaagcaaucuauaacuaaggaguaaacauugaugggaagcaugcuaaaauuguccaaaauauagacuuuggugcugaacacuugagaaucccauauguauuuaaacauauguauugagcauaugccuuguugacuggaaagacuaagagaaacuagaccaaacaccuucuuguacacacuuagaggaagcauggguuucuggguaauuguuucuuacacucuuacaaugcccucuggcaaacagauggcuucucuuuccaccagcucaaagaagcugugcgcgugcagggaccuggcacgucguuucuuugagacuguuccucugcacagaccccggagcagagcuuuaugauggcacuacuugaaagguucagggauggcaggcuuuccuucauggggucagcccagagaugcuggcauccagucccacagagcucaguucuccuuguaugauuccuugauuugcaacgccugucucauccaucccccacaaucaccagagcucaggcuucaguaggacuguucaucuuagccacugaccucauuagcaggugaacacggguacacacacacacacuccucacacaugcgcgcgcacacacacacacacacacacacacacacacacacacacacacaccuuuccauguucucuugcucccagucucgcacacacucgcugucagcccaccucacaguccuugucaucucauuaguaguugugagcaugcccucuacugcuucguuuggaaccugcuuguaggugaauagugccgcaacagccuuuggagcucacacagcacgucaucagcuggaugcgagaauuguuuggauuuguuuuucuaaagcuaugcugggugcuaccucaaacacuaaaaauggucauuguuuguuuguuuguuuguuuguuuguugaggcaaggcuucuguguagcccaaacuguccuggaacucacucuguagaccagacuggccuugaccucagagaucuaccugccuuugccuuccgagugcugagauuaaaagggugugccaccacguccagcuucuaauaauguauuuuuaaagguaguguuuagauuaagaauucucuaggggggcuggugagguaguucaguggauaaaggcccuaacuacacaagccugcuaacccaaguuuguuuccuggaccacuaaccaguccauccucccuuaaagguggaagagaaugaauugaauucacaaaguuagccucugaccucuacacauaggccauguaugcaugcaugugugugugcacacacaauaauaauaaaauaaaccacccccagaaauccaaaugcuuagaagacugaggcaggaggaccaugaguuuaggauuaaccugagucuggcuuaucucaaaaaaacaaagaaaggacaacaauaaaaauaaacagacucuacuguuuaguaucugccuaaguuucuuaaugucucaguuuuaauuucuuaaaaaauguagauuauaauagguguccuguauagguugaggcuuuacaggacguaguacucugccuaccacaccauagccaaccaugauaauaugggcaggaaugucucugcaggaaucacucuacugacauuucauuuccgucucucugguuuugaccccauacagcagcacaccuaaaucuuuaguaaaauaaugguuuucuggcaacuccagcuugaagggugggaaugacuguucuguugugacuucuuagguauuuccaugguagucagccuccaagugaacaggcagaagccauuguucuccaggucuguugcuuuugguuugggaacaauauugagcacgcacuuggccuugaugaccuccugucugggccccuagguacugaggcucuaggaauacaccuccacagcuagccucugaggacggugcuacagcugucagcaagguuuaucagucacugaugcgccugccauuugggaggaccuggcucauguuuggacauugaugcuguucugaaaggugcaauugcugucuuggaagcuucccauucuucaaacaugagucugugagucugugagugacagcaggagacuaccaugugacgcauuucuagugaaaaugagauuacuacaucauacacagaccauuccuuuaucacugucacagaguuuugagaauuggggguaggugaccaaggaguuccuuauguccccuuguuaugcagaagagugaucuguaaaauaaguagcugugacccucugggaagggucagugaggagccacuuugcuggggcguccugaagagccgacagguucccucugcucugcuuccuucuccgucugcucacuugaguauccugugguuguagguuugaagacggucauugccuucauuuucacauccuuuccauauuuuguguagaauaacguguccagagcucgccugaauucaauuuuaugagcuauaugauacugagaaaacguggcuugaugcugaguucggccauguuucacccucugcagcagaugaaauguguuagcuucugaccgucggccaguuucugcuccaugugacagcuaggaucagugcuugcccuugugccaccgacacaaaacagagucccuaaucuggggaagcuaugaaaacucuuuggcuccuugaacaaucaaagauuaauacaaguuuguguacauaauuucauaauuccuugugguuuuuuuguuuuuuguuuuuuguuuuuuuuuuuuguagugagacuuucagggucucuuaggauaaaaucuguuaaggaugacugagaagaaguuucagaagccuggaguugagauuugcacugggacuuaugacagguuauuuuguuuguuuguuguuguuuaaagaaauugccuaggagaagaacucuuuguuuuaaagcaagccuguuacagacauuuuuuggccuuggcccccuaaugucuuacaugaaauuuugugcagaaagaccaaaggaaaagaguggacugccaucuagaggcuugaacaacaauguuacaacuucaaaagcuuaaccggccucuguguacucaacuuugugaauuaagaacaacuuuuuucuuucuucuucucuuuucuuuucuuuucuuuucuuuucuuuucuuuucuuuucuuuucuuuucuuuucuuuucuuuucuuuucuuuucuuuuccuuuccuuuccuuuuccuuuucuuuccuuccuuccuuccuuccuuccuuccuuccuuccuuccuuccuucuuucugucuuucugucuuuuugucuuucuuucugugaugacagacauguaugucauagaugcuucacugcugugucuacccuugcuacuguagacauaauuuuagaauggagaugccauggucuuugagauaggaacuguacuugaauauaccuuuacucacaaaguaaaaacaaaucaauguuuuuauuuagcaucuguuuuggauuuuacauuaaaaauuaagaguaauucuuuuaaaugacucugaguguauauuucaugauaaugaugcuacuauaagugguguagaaauugcagaguugaauuuguucuggaaaaaaauagaugacuagaauguauauccgccugaugaugcauuauaggacagucaauagcauauccuuaugguagcugaauguuuuaacauuucaaagucuuguuuguucauuuauaaaugugcaucuuuauaguaccugaucuaggauuguuaugaagacuaagugaaauaaaaagcaucuucacgauacagucuuacuugguuaagaugaauauucaauaaauauucauacauucaguucccauuagauauaaugaucauuuuugguauuggauauuccauauugcaguaaaaaggacacaugccuugcauugucgcagagauugugucagcaagcacaaauacgaacaagagaaguccuuaaauaauucauguaaagaaaagucacgugacacagugaagcguaaccgagccuguuuucaugucagaggucagagaugaguuucugaggaagugacaguuaaacucuuuuuuuuuuuuuuuuuuuuuuuuuuuuuuuuuuccauuuuuuauuagguauuuagcucauuuacauuuccaaugcuauaccaaaagucccccuuacccacccacccccagacaguuaaacucuuacccgcaugacaggcagcccuccaugagaaggccuguggaguuuccauuucaacuagaggacuaagcauggaggccagacagcuaagagaacuucacugugggaaaucagacaggaacuuuuuaggcccaggacuuaacauuuucauuuugagggucaugagaagaaacuguagaguuauuaaaguggugauguuagccuuagccuuagaaaaaugccaguggagacuaagacagacagaggcaggaagcccgcuugggaaccuuuucuggcugucucagccagcagcgacggcuugggauggacccuuuggcucuguaggauugugguuaacggcaccaggucagggguuagggguaaauucuugggguaaacugcuuacauugcuguguuuggaucccuagcacccaugcaaaaguagacauggugguacacacccgaaaucccaacacugagggucaggaugcgaagaucucggguucaccagccagcucauauaguggagcuucaggcuuaugugagucacugucucaaaaaguauauaguggaaacaauuaaggaagccaucguagcguuaccucugaccuccauccuuguucacauagacaaaugacccugacacacaugcacacacccauccuuguucacauagacaaaugguccugacacacacgcacacacccagguagacauccagacuauugguuuggaucugacuguggccucugggcugaaccugggccauuucuaaagugggaaggauguucacaaacugcucuuagguuugugguggggcugagguagcaguuguaaagcgcugugaauacgugcgcaacgcggccucaucacugucugccgccuucccuaugacuguugcuccagcauggucaucagagcucccaguuuacacaugagagcuuuuguaaaguggguggcuuugaaaucagaauauaggcuucuguuuuggaacucucucuccaggauaaccuggagugugaguugaaggcagaagagaaacagaacuaaaacagggagccgagacucuaccuacugcucuuacaucuagcccuaucagcucuaccagccccccagaccccccacuagacugaggacagcuguuugucuguugcagagugugagcacuugauccgccacaugcugguguuagauccaaauaagcgccucucaauggaacagaucugcaggcacaaguggaugaagcucggagaugcagaccccaacuuugacaggguaagccggacccuugccucagggaacuccugauuaacuccuucucuucuucagugguugugaucugccuaggaccuaaagagaugagcaguaggaaccagcugcuggcuaagaccaguggcaggugaauucacagggagccgcgggauccagcaaggcuguggagacagugauacugggcauuaccacagaaaucauaguuugcuuuugacuucugagacagcauacucccaguucugcaggucacugccaccagagugccuuucuugucuugagugcgcucccuucaacagcuucugucacauacugcugcaccccauuaugaucacucucguaccccaggagcucaggaagcagcccugaggguuuugucagcccauagcugauugccagaacugucuugcuuagacuucguaugacacccacagaaucugcagcaguggggcauagaacagcuuugucaauguguaucccaugccguguugauguaguuaacuggggucugacggcuugccucuauaacuguauuauauuacaguuaauagcggagugccagcaacugaaggaggaaaggcagucggacccccucaacgaugauguccucuuggcuauggaagacauggggcuggacaaggagcgcacacuucagguaccuaagaaggagugcagagcagugagauaagcggcccuuccucuugccugccuuuccugcaguguccccuuccugagcucguggguguuccugcuuuccucccuuucccucuuccuuugcccuuccuggaccugagagggaaggaaggagcugcuuugugcugugccgguugugucuggugugucagugaggcgccaccuccgagucucacucucccuuucucuauugguagucauuaaggucagaugccuaugaccacuauagugcaaucuacagccugcugugcgaucgacacaagaaacauaaaacucugcgucccggagcacuucccagcaugccccaagccaugacuuuccaggcaccagucaaucuccaggugggcaaugucucugagaccuaggugagaagagguuauaccagggcaagggcuagcuacugcucaucagcuuuuggucaggagagauucauauucauccaucuaucuguaucuccucccuugucagaagaccaucaaagucugggucuuucuuugagagaaagucgcauggcagaaacaguugucuucuucguuuuguuuaaagaaguagcaaaucauugugagauaccauucucccuaaagaaugcuuccuugcuguguugccugagagcagaagaaccaggcuuuggcaaucaagacugcuuugaauauaauccuagccauugggaaucugaggcagaggaaugaguucaaggcuagccuggguuacauagcaagagcaugucuuagaggaagaggugagggaagaaacuacuuugaaaagcugucauuauuucuucuagugucucaggucucugugugucuguaugugcugcuuucuaggcggagcagacaggcacugcuaugaaccuuagcgucccucaaguucagcugaucaacccagagaaccaaauuauagaggcaaguagccacaucugaucacugucaacugaaaccacgucucuucccauagcuacaauuccuuuccuuccuucugaguuacuucugaucaacuguguuucccuccaccuuagccugacggggcugugaacuuggacagugaugagggugaagagccuucuccagaagccuugguucgcuauuugucaaugaggaggcacacggugggaguggcugacccacgguaaguaccuggucagcauccugcucagcccuaagucaaaagguuccgccagggugagugccucuuguggcacguuuucugagaggccacacuaggccauggccaaucugacuaguuauucucccuauaugcagugccucuuagcagccaugugaggagaguguaauaacaucuuuguugauagauggaguucuucuagucuaagucaucagaaauauucuguaguauucagucaccuuuagaaaaguguaguagugcaagccuuucaucccagcacuuaggaggcagaggcaggaggagcucuugaguucaaggccagcaugaucuguauauugaguucaaggacauauagagaaacucugucucaaaaaauaaguaaauaaaucugccaacuuuagcagcuuuuagagaugcuaucuaccucguguucuauauuggaacucuucuagaaagaggagacaaggugguguggcaucauuuauauauguggacaguuagaggcacuugccugacacaagcaagaaucaggauucaguauccugcuuugucucaaaaugaacaggaaucccaaaacauauuucccaaaguguuccuugagguccucguguuggggaaguggauucaggaccagcucacuccauuucuacucugcagucgagaccugucagcaugagcgacagcccaucuuguuggugaauguuuuccucacugagcaggaaagagaggguuauauauagcuagccuuguccugagaguucagcucagggcggagcuggcuuucuuaugucugucuucugaguggauccccagaagaaacgcccaugccugcucguuugcuuguuuuccgugcuuguucucgaugugaugaaacaagcaagugagagaacauuuggguuccacacagaaugugucacugccaacgagggguggaguccugagucgugauuaguggaaaaaucucuuauuuaaagucugcugggcaugacagucccgaacauccaguucuuaucuguccugucagcauggacgguaguaaccgaauucuuucccuggugaaucaguugcuacuucaggcagucauugucuuagcggaugcccugugcucucuagaaacuugcuguuccccuccaagcuuugagagccugggcuagaguugugccagccugugugucuccuauuggcuuucgaaagggaucaaugaaguagacuccccaauaacucagagugaaauuccacauaggagacagacuccacuuugcuuuagugucuuagacagaaauagaaauuuaggaggaguaacguccggaagguggugcuucugccggcauagagaccucaguucagauccucaguguucauagagagccagcuguggcagccucuguuguaacuacagcucuguagaguggagacaggcagaugcaccaagcucacagacagccugacaacaagcgagaccgugagagacccgggagagcaugggagaggaaggcuuccuaccucuggccuccauacucaugcauagacauauguuggggcacucacaugcauuuacuaucguacacacauagacuacaucugcacacacauguauacacauaugaaaaaaauagaaaaagucagacaguggcacacaccuuuaauuccaguacucaauagacagaggcaggugggucucugaguuggaagccagucuggucuauagagcaaguaacaugacagccaaggaaggauacaaagggaaacccuaacccaaaagacccuccuacccaccuccaaaaaagauuugugugucuguauguguguguguguguguaaaauuuuuuuacuguacuaguuguagcgguaguauugacuacuguacuaguuguggugguaguauugacuacuguucuaguuguggugguaguauugacuacuguucuaguuguggugguaguauugacuacuguacuaguugugguaguauugacuacuguacuaguugugguagcauugacucagacuuaagcauucugaguaaccacacuucucucuuccuguuucccguuagcacggaaguuauggaagaucugcagaagcugcugccuggcuuuccuggaguaaacccacaggguccauuccuacaaguggccccuaacaugaacuucacgcacaaccuguugcccaugcagagucugcagccaacugggcagcuugaguacaagguaggaggccauggaaaggaccugcccacaagaaacaaacuugaucuucccuugguaggcucugacaguucuguuccaguacuggagaguuuccugagggaggggaguucccuucuguaaacugcuguggugaugggcgauaucuccagccccccucaccccagcagauccucucacuguaguagaugagggugggcuguuuacuccguguuuucccaucucaccacuguaucugccuacucuccuggcaggaacagucucuguuacagccgccuacacuacagcuacugaacggaauggggccccuuggccggagagccucagauggaggcgccaacauccaacugcaugcccagcagcugcucaagcgcccacggggaccguccccacuugucaccaugacaccagugaguagcagcccagccuggcuuucucaaagguuuuugauaagaagucuguaauaaaggggcuggacuuggcugaaauacccacaguccucucuaauacagcauccuguguuuucucugaccugccuccucuuccacagagacaccucggaggacuuuccccagcagaugcaguucacacgggcagugcucucuagaaugaacugcuuuuuaauuuucaucuuauaaagacaagcuggcagggggugcacacgugcuucagugcauucguggggcuuaaaggacagcuuuagggggucaguucuccccuucccccuucauguggguaguuccucaggcuugcaaagcaagcucuuaccgcugagcaccucaccagcucuccugucgucagcaccaccugacauuucuggcucagccucgggugaucgugugauuacauuguggcucuaacuucagucggugucucagucacaccauuuuguauaauggugauaugcaaagguuuaaucucacagauugguuucuguuuauuucugguguguuucugucaugguccugucagacugaauaguaucuccacagcccuucugagcuauuugggggaguauugcuugaaaucacauuacuuggugacuucuguucaccgauccaucguggaucaauacguuuuaaaacacucgguuaacagaagcucacucuggcucucucugcuuuacuucuccuggguuuggucacagagcggugugugagcccaugagucacguugucaguugcacugcaguucagaaaacaguugcaccagaucugguggugugcugguuaugauaucaaagccgaguuccccuguauggagaaaagcuuauggagccguguagucccagccccuacaagucaggccaggagggucagugcagccuugcagcuaaccuggucuacauuguaagucccagucuaaccacagcuacaaggcaagacacagccuuaaaaaaccagcaugccagauugaaugccaaagugaaugacauggcugauggguggcagaggcucuucaugggcaagguuggcauugguuggcaaggaucagcaucagcauuguggauaguggggugacuuccucuguccacuggacucguugcugccaaggucacuaacaagcucuuguugauaaauccaguaggcauuuuuaaucuuuaucuuuuuggauggcucaacucuauuagucauuguugaccuuccccuccugccccccuucuccguaguacuuuguuuuuguuuuuuguuuguuuguuuuuguuuuuguuuuuuggcuucuguaguuauccuagguuuuccuucggccagucaguccccucugagguuucugcucaggauugacuuagccaccaaggcccguccccuuccuucucuggaugagccuguccacuucccgucagcugccaucuggccuugcacccaggaugcucuucugagcucuacacaucugcaugugugaucaccucuaccauagguuuaauagcuaccucacaagugcucacagugugaaugcagcauguggcacuugucuuucuuucuuuucucucccagggauagggacagcacuguuuguuuugguuuuuuaucuuuauacaauuuuuguuauucccucugucagucaguugucugauguuugugaauaaacagauuucaucucuccaucucugcccccuuccgucagccguggucaccagucaccuugauuaacacagugacucccagcaggcaccuggcuugacuccugguuaccacuggcuuccccuugcacccugcaaguaaagagaccccacuuucccaaacacagauccuguaacaccaugcuucugcuuaaaauccuacagggauucaccacugcccaucccaaaaucagucugugugcucuucaaggccguugauaacagcgucuucccaugccucagccauagcuacuucuuguccaacuguuuacuacagccuuagagcuaaaguagaggaugugaaaaauuucagaaguuggaauuauuucaauaagguuuuguuuguuuuuguuuuguauuagccaguuuuaaagauaauauuuauuuuuauuuuugguuaaucuuuuuuuuucuucaguuuuucgagacagaguuucucuguauagcuguccuggaacucacucuguagaccaggcuggucuugaacucagaaaucugccugccucugccucccgggugcugggauuaaaggcgugcgccaccacacccggcuguuuauuuuuauuuuuaauuaaugagagaaguguaccagagggcaggugcuggcagaggucaaaggugcgggguccuuuggaguuugguuuacaaguuguugugaaccacccagcaugagcaaggggucaaacucuggaccucugcaaggucagugugugcucuuagcccugagccaucucuccagcccuggaauccagugcuuuagaccuguuggccaucaaguaugguuucuaaauagcaccugaggcaugggugaugcuuaucugggccacugggccaagaauauuuucugagggugcacaacauuucuaucuucacccagggaagagccaggaaccucagugugguacuucucauugcguuuaugucucagaguauagugaguauuuaaaaacauggaauuacaacuauuugauuauauguuaugcaccaaucaccaugaugcuuucccggaguucagacauccagacucuggagcugacauuaaugugaggccacggucaguuccuaggcacucuagguaggcaguucgaugcauuccagguccuuggacacuguaggccuucccucuucucucagcacaugacccuuugcucucugcuggauguucacuccugugcacaccucgggucacaggccagcugcugcuuccuccaaagugccuucuuuccuucccaagcucccauggaggaccugagagcucagucgugcacuuacgauugucugcucguuuuucucuaaacaaaggcaaagaccacagcuaugaaugcgcagcugguccuaaaggaggccucgaguauuagaugaacaagcacaugccugugaacaagggaagaaauccagauauagcaccugagcccgauggagcuggaaagcaagauggaagaaaguccucucuagccaccguucuagggaagccuuugaaauaagaacauuaacaagacccuuggccucaguccaguuaccagaguugagggcaucacagaauaagcugucacccugagccuuuccuuccugucucucugcaggcagugccagcaguuaccccuguggaugaggagagcucggauggggagccagaucaggaagcugugcagagguaauguggcaccuggcagugcuugcagaacguccuugggcaggcuccccugcaaccagcgaaaggucaccucugcccagggagguggugcagugcagcuucaacacuuguguggucucuuugcucaagccagauggcauguuccuccccacacggaaguaacagaagacugcccagaaaauuucauuucuauaagcgccauuggaagccccuuaagugacagcaauacccuuaagaacgcuuucucuccucccucccucuuccuuguccccgcguucauauugcaacuuugguaguguucaggccuaacgccugcuccucccugccacgaacuguuuacugaaaaggaguuggagauuggagaugacagugauccuagcuagucuggccauggaccucuggcauggacucauccgucccaggagaaugaaugaaugaauaucuccugcacuguuugcuguguguuuccuccacucccuuguaccaacacugagauauugggaagaaaaaacaaacauggggguuggggggaggggcagggacaguuguaaauauccauuguuugcagaaccuuguugagagaugccugauucacagagcgacagugaccaucaggugugcugugcaguccgauggccucaguuccaguagccauggucugcagcuccaugcaugcccccuuguggaguugucuuucuuauuuucugugaagggguuuucaccagaauccagcauguauuuucccagaaauacagguguucuucaagauuauauguuuucccuugagggaaguugaaauaaaaugguuuucaugggcucucggggaaacuguggguguuuuuaucaauggacauuaaccacagauggcuucuuuaagcaaguuugcauacuacaaauuacagucugaugacagcuuuuaacugacguaggcaauguagucaggaaugaacuaagagccuuaugguuguuguucaggaauuguucuucacccagaaggucuauaggaaagaccaaagaaggugcccuugugcagaaagaaagcccuagugaucagggguaaugcuggccuagucaacauaaggaaaacaaaaaacacaaaaacaaaaaccuggugacuuugccucagucugauacucuugcuucuaugguuugcugauaaaaaugaauuugcaaaugcguccuacuggugucuugaagaaacgagaaaguagggaauguucuggaucccccuccaccccuuggaaaggugcagcuggguuuuaccuucuugccuuagaguucacguccucugcccccaccuucuucagaccaacauuggaaggccagugagccugucaguuggaagggacagaaaggaguccugcuucucuuaucuguauucaagacaagugaagugcugcagggggccuggagcaaacgcaggcccccgggucuuguuauggugcugaccuguguagguucgcaagcuccguagagugaauggcuucauggagaccuuggccuccucuucuguuuccuuuccuuucuucuuuaccuccugaaaauagaucugaacauccugugugguuuuauuucuucauccucuaagucugggagccacaucaguuuuucuucuccagugauugaguuuuggucacaggacauaagggaagaacucaguuguccucaaacaagagucuguuuucuuuggcauguaguaaggacaccacaggccucugacuucaggggacguaaauugauucuuucugaauaccucacuugucccuuuaauaggccuuagguucuauuucuucuaacuuauaguuuagaaauuuggaaaaaaauuaauauguaggagagauaacuucuucuauugaauggaauaaaggaaauugguuccaccgccuuugcaagcuagaucucccuuucuucucuuaauggcgacucgcaagcucgaaagcagccaccucaguggugagccaacuguuggccgguuaggcaagcuucaccuccauccuguuggggguugcuuacuguggagcccuuuuggcaccccauacuguccuacccagugcuucagacuaacuucuguugcuucuugcgcgggaacauucuugucuuuuuuuacuaugaaauguccucccugcuuguugcagguacuuggcaaauagguccaaaaggcacacacuggccaugaccagcccgacagcugagaucccaccggaccugcaacggcagcuaggacaacagucuuuccguucccgggucuggccuccucaccugguaccugaccagcaucggugaguagccgcuuggcagugugagcaucccggaggcucauuggaucagcacccuucugacuagccuccagcuuagagugacuagcucugccuagcagccaccugccaucccgagcucacaccuccgcuccuagcccuaaccaaugcacagggcaaaagcuuucucuuggauucuggagcagccaaggcucuuccaucucauuucuuagaccaccuacucaucaccugcaucugcugcauguaggccuuugagagagugguacucucagaaggcagcucuagaaguaaggacuuuguagcaacauccccaaacaugaccgccaauaguucaucgccuucagaaaaugggcacuugauguggcauuagagcagcaggcuggcuguagacagaggcauacccuuguugugugguagaacaggaguguugcauccuuuugagugcuguguuugggaaguaauucuuugaguauucugacagcaagaucuuuugcuaggccucuguuauuuagaauucauuaccuugaagagagaaaccaaguuucccucuaacucuaacuagauaaauuugcugauuccaagguagccugccagcaagagagcugauuguccuccaugacuccuugaugacuggcagucuuagccauguccauucugaugcuguccccuagcucccaggucauguuucccaagucgucagccauugcuugaucuuguuucuuccagucuucuugggguagggugggauaguggaaugcagccuccuccagaaggcgaaagcagauggguucugaggaaauucaguacacaugugugccaaucggagggaacacuugcaacuagccacucagaucagcuccauacaggguucucauugugcuucuugugagcagcagguaaucagcugaggcaggugaacucugagcagacagggacauaauuagugccacgcuggaacucuggaagaaggaagauaagcuuucauaauugaccgugaacaauuuagaaagaaaaaguccuauuaggaacuaaaagaaacggugaagguucucaugcaagauugcgauggugcagcccccgugacggaaaccccuggguugcugcagucagucaccucagagagcgccucugugcuggcuggcuggcgagcugcccccaccccaaggcagcucgcaucgugcacugguccugaaggugcuuucguugcuucucaccucuuccucgucugauauuugacuugucagcccucccccagggccuuuuguuuaccuuuuguccauugaauaccuggcuguacuucuccgugcuccuugggaaaauggugaugagcacuguccagccagccuuccucacagacgcucuauucuaccaacauuuguuaaaagaagaccacagcagccugcggacaggguccauccgugggacaugcauugcgccugcagauauugccagggccuugcugccuagagcccugcugccuguucccaucugcacauguguuaccuggguuucuagggccaaggcaguuugaguuggaaacaaaugaaugcuugagugagaaaucauguacuguggggcgguggggucacuauacaacgcacaagagauuaaugcuaauucagaagaaaagagaaguguucuaaggccguaaaacacacgaugugacgcaggcagccugucugcgucaccggauuccuuucguuuucuggagcaugauuaaaagaacagaauauauaucuauucuuuguguuauaauaggugaaguccaccauggagaccgaagaggggcuggucaacauuuacaccccuggaaguguaugcuuuaaaaguuggcacaaaacagguucuauccaguugggggcuacaucacuguuggaagaguauaggggagauagcagccuaugcaaggcugcccugggugaccgugguugcuguugaaaacaaaguuguacacgcuugacacugcccauggcucugcaguggucaggucccucggaaccaauccccugaagugacugagccaggcugagcuggggccgacuucacagccugagaguccggaaaacggugccacaccuugaaccugggauauucuugcuauaaugagaaagaaaugguuucaugcagaaagacagcucgaagaacaucccugggugacggaaaccugucuauugccugaaaauacugaaaguguaggcguccgaugugaggggagauaauaccggugcuggguuuccauucagaggcugaagugcagagagaacaggugucugcaagcauccuuggugaacucagugucuggaccgugacauccuuuccccagcccugauuaaucugccuuguauguuacuaaaacaaguaggacuccaugggcauuucacuagcucaccacugcuugaagcuuugaugacgucugaguaagggcuuucaccccgacaucagcacucucuuggccucgcugccugguccucauuucuccucagcccuucccugucugcacuguauuugaacuugcuuguucgccugcuuccuugguuuuggcucugcuucaguccaaacuggcaagguuccccacccccucaccauuggcucagcgugaugucaucucugccuuagaccugcuacccugacccuuuccaucagcuguggggacgcucgcugccucugcagucuuuaaccugcuuaucucagcucauaaacaucucuuucuggcuaggcagcaaguguagguguuagccagcccggugcuaucuuagggcuccugaucaacgguucuucuuucuccccauaagacauggcuguguucugacugaacacuggggaccccucugucagcaggaaguugggcaggugcugcugugugaggagauagcauucacaguaggaaggaggccucauguguguucauaagguacgugcaggaucuugaggcccacccacauuccugaggaauacgcugucuccgugcugggaucagaggucccugucuucccccaccccagccuccacccucccuucucuagaacagaacugugaguuccaggccagaccuuugaccacagaacugacuuugguuucauccuagccacacauagauuacugcuagagguaacucagggucaaacggugaauucuaaguuucuaaagauaccaggcagggaucugguuuuaaaaaccauagcuugcacaacauuauccacacaccgccccccaaaugcaacuacaauagaaaauaaaugagugacuauaagaaccaagccugugugguucagccaguccuggccguacugcggaguugcacccugcucuaguauguuuauauaagaaccggauguaguugaccccaggaccucagcaggccugggaaguaggaccaaccugagguaaguggaggugggagaugagggccuguaguccacucagggggacagccaccucaggaagugacacggaguaccaugugcagggcuccucaugcauccacugucucuguauucauguagacccauggucccgugugauuggucauaaccccccgaguccuggcugcuaaccgucucuucccauauauucagcuccaccuacaaggacuccaacacccugcaucucccuacggagcguuucucccccgugcgccgguucucagacggggcugcaagcauccaggccuucaaagcucaccuggaaaaaaugggcaacagcagcagcaucaagcaguugcagcagguaaucucuggaggggcagggggagcaguacagugccaggacccgggcaguaacucuccauacccuucaugucaaccacacugagguguucuagcuuaaagcagaauagcuuucuucaauaucuacugcccucccuagggucaaaccugcuucccucauaaugagacuaaaaauuuuuucccaccaucuggaauucauugggaaggcauuucugguuugauuuuuuucuugggaacgguacuuguaagcaaucuuggcaggccccuuguaugcagggcacggggucguaguggaccccauugcuguacuuucucacccccggcauaauccccagcugguauugcucccagagguagcaaaccugcucccaggauacugugacgagccaagggcuucaaguagcacgugcucucucuggguuuauaguugauuccacacugggcauuccacaguguguccuuggcguuucccacugcuccccagagagcagggcgugaggaucacugugugcaugcccaacaaggauaccguucuuccauggcucauuccgcccaugagaccuugggggcagaucugccucuccugaggucauggcaugggguagacuuggccgugucccguuuguccccacugcuuucccuucaggagugugagcagcugcagaagauguacggggggcagguggaugagaggacccuggagaagacccagcagcagcauauguuguaccagcaggagcagcaccaucagauccuccagcagcaaauccaaguaggcccucacucccucuucgcucucucagaaugcguuuuugaguuugcuggcaggcacauuggccugugcauugucugaaagacucagggcagcguggagugugagccacguuugugggugacaugucugagucacagcgcuuucugccccuucccaggaauagcccuaaugccuuucguagcucacgaugcugccguuccccccuuuuguguuuuaggauucuauuuguccuccucagcccuccccaccucuucagguugccugugaaaaccaaccagcccuccucacccaccagcuccagagguaaugaacuacuuagccucuuccugcauuguuggcuggcuggacgguguggcucccuugucugacgcauggggacgcuugacugacuugagcauuugggauagucuucuagaagaacagggaagccgaguuagaguuugaagggcuuacuagaaugcugacuauuuccugagcuccaugaacacaguggccugacauccaucgaaggccaggccagugagugcugaguugguggcagggaaggacugguagacugaggugugggcaagcugugguggccugcuaccgcaguuguccgccccaaacuacaaacugucugucugcauggauugucuggcugaauguuaacugcagaugguucugucagcucaggaggcuuauguaccuguucuguccuuuucuaagguuaaggauucaaccuucaagcccaccccccaaccaucccagcaaccaucucuucagacagccaaguaacaguccucccccggucagcagugccaugaucacgucucacggugaguagaggccgagggaguggauacauauugugccgugcagggaaagccuggcuuuuaggcuuggauuuguugcugguggugguggugguggugguggugguggugguggugguggugguguggugggguguguguuaaacuuuguuucuugacugugaaaccuuggguaauaaguacuuggcuuucucaacaauaacuguaauaauagcaacacuuaagaaauauauauaaaucaccugggacaguacccaauauaauaguccuuaauacagguuagccacuauugauguagcuauuaaaaccucuccaguccucguacuaggugugaagacuaugggugcagauccucagacccagcacacagucagguccuugccagucuccuuggcauuguggagaaacauagaauugcucuuccuccuccaggugaccuugagucagaguuggcucuuggguucugucccagaaccaccgcacgagaaugugcagcuuaaccaacucucaggaucauuccugcauauccuugguuaagaaacacugcauacaaacuccgcuacccuaaauccagccauagagcagcucuugggggacuuaauuggaaauaaaauugcaggggagcccaccugaccgacugaguccuaguucuguggguaggacccagugaguuagaucuguuucugccaguuucuggucuugucuuguauagugagguugaagaaggcuguucuagaugcuaccugcuguggggucuccucuagcuggcagguaaccugggcacuuggucacccuguggucccuuucucugcaggugcuacgucucccucccaguuucaaggcuuacccucccauggugcaaucuuccagcagcaacccgagaacuguuccccgccucccaguguagcacuaaccugccugggccuacagcaggcuagccagucacagccagugacuauccagcuacaggagccaguugacaugcucagcaacauggccggaaccgcggcaggcucugcagggcggagcauccccaucagccccagcgccagucagauucagauacagcaccgagccagccuaauggcucccuucagcuaugggcaccggcccuuguccaagcagcugagcgcugacagugcagaggcccacaggugagugagaagggacaagucugcuugugcucucaugucacccauggucaaagcggcauggugggcuuguugaugagacagguuguuagugagagaagaggaaauggcagagggccuuccugauggccugaaggaaggaagaucuguuagaggaacaugucuguuccccugacuuauuauucuaggguucuuccuucucuguugucucuaagagacuauuauucuaaacagcucagauuauuauuauuuuuguuguuguuguuuuguuuuguuucguuuuguuuugagacaggguuucucuguguagcccuagcuguccuggaacucacucuauaguagaccaggcuggccucaaacucagaaauccaccuaccacugccuggcucagauuauuuuuuaagaacagcuagauuagacuguguguauagcucuggggguaggagggcaagccugaaucccugguuucagucccugccaccagagaagcuaggugugguagcacaugccuagaaccccagcguucuagaggcagaggcaggaguggcaggaguuagagguccucuucagcaacauagcgaguacggcuagccugggcugcauggagacccuauucaagaaacuauccaaggucagaauguugcuuucaggauaauuacaugcccagugccuuauggcucuucaaaaacuuggaugagcagauaaggggaugaauagugguggugugcacaguccucccugccacagcacaggucuguaccaugagagcuucgugcuaaggaaggcgagugacuguccccagggaagcugguguaguuacuggaaugccugguacucauaccauuuugugucugcagcuugaacaugaaucgguucuccccugccaacuacgaccaggcgcauuuacacccccaucuguuuucggaccagucccgagguucccccagcagcuacagcccuucaacaggagugggguuuccuccaacucaagcccugaaaguuccuccgcuugaccaguuccccacuuucccucccagugcccagcagcagccaccccacuauaccacgucagcacuacagcaggcccugcuaucuccuacaccgccagacuauccccgacaccagcagguuccccauauccuucaaggacugcucucuccccggcauucacucaccggccacucggacauucggcugccuccggcagaguuugcacagcucaucaaaaggcagcaacagcaucgacagcagcagcagcagcagcagcagcaacaagaauaccaugaauuguucaggcacaugaaccaaggggaugcuguuagccuagcucccagccucgggggacagaauaugacagagcaacaggcuuuaucuuaucaaaaugcugacucguaccaccgccaccacaccagcccccagcauaucuuacagaucagggcgcaagauuguaucucacagggucccucgcccacccccacccauggcuaugcccaucagccaccacuaaugcauucggagaguauggaggaagacugcuugugugaggggcucaaggagggcuucccagacaagagcucaagcacacugaccaaagguugccacaacagcccucugcucuuguguaccagugggccuggggacccugagccuuugcugggaacugugagucaggcccgggagcuggggauccaucccuacggacaccagccaacugccaccacguucaguagaaauaaggugcccagccgagguaagaguccccucagagaaagacucuugggagaguuugcuggaauuuaagugugcagggguguuagcuugguucugcuaguauucugugcgccuaagcaaaacaaaacaaaacaacccuaaacagacccuaggaccauuuggggggagaggugaagcauguggaaaggcgauuggugggugagaagucaccuacaaaauagacagcagucgacagguggcacccaggacacuccuggucacaccacgggguccuagaguccagauuugcccggcugucaucagaaagucgcaguggaaaccgucagcaguacuaaggaaauguguaaacuguggggcugagagucagagccuccagcccguccuccucuguccugacugcgagaucuagacucuauucucaucguccucuugugugauagaagggcaauggacacuggcccucugcagcaucuugugacgauccgagcauuuguguucguacagacugccucugugugugugugugugugugugugugugugugugugugugugugugugugugugugagagagagagagagacagagacagagacagagacagagacagagacaacuugauaacuaaguaugcuguauacuguacuggggcugccuccauuuucaucuaaagauuagaguuuaccugagugaguuuuguuugcauagcaaaaccagagcaucagacccccuguagccuuuugcuucacccuccucaccacaaccacagagggaguaaagcgacuuacccacagagucugggacucugggcguuucuuccucauucccccuggaguuacccauaucucuugccuuuaaaggcgaugcacacaacucggacccauggcuggccaagcccugcccagcagcaggugugugaagacuuggugcugucagauggacuuggcaugugcucagagaggagggaaaugugcuguauaaaaugacaguuuaaguccugaccacugcagccaauggugucaccagcccggagaucugcccuccacaugcauguugaacucugcugguuguauuuagaguggaacuuuauaaacagguuguguguagaaugagagacaccuagcagcauuggggguggggauggaacaacuuugaaggagcagaucugucagauggaaggacucaacuuuuauguguaugauaaggaagagacucuaaaguggguagaaaucacgguagauuauagcucuccagagaagacuguuacgagagacugccaucacaggcuaccugagcagcuuuuuguuggguguguucuggaagaggcggaugccuuugauggacacacuguagaagagcauccauguguggaaaguuucugaugacucagcucgcugaaacugcaucgugcaugcgugccuccagugugcacacaccgagugcugcuccauccuuucuucuuauugugaugcuagggcaaaacccagggccucacacacaugcuaggugagcaagcucuacacggagcugcacccagccuguuguccguuuuaccagugacgcagcuaagacuuaggagauuuauaauuugccucugggucagagcugacaaugacugccaaacccugcugccagucgaucaccaccccaacaauccaugaaugugucugauguucaggcuacugaagaaauaguggagcgggucccagaacagugaagccaugcacuggaggcagagaugcauuagugaagcccagugcaugcugcugucuuuaauucagaucuccuuggggccagaggucuguguguuaaaagugauucuuuguggaggugccccacuguccuuaggcuagcacagguugccuuggagccuacuagguaagcacacuuccguuuauucuggcagugaggggugccaagcuaaauaaacuccuacucuaugcuuggcgcucugacucaagacaucgguuccuuuucacacccacccucggaagugugugucaagguaccauuuugguaggagcugcccuggccugaccugacaugccugugaagccuucaguuguccuuuuccucucucccccucccucuccccucuuuuuaaggacagggucucacugcauaacccaggcuggccuuaaacucaugaucuccaagucagcugugcacgugccggucgggguuccaggcuaugcaccacaccaauguuuucaguucugggaagaaauuccagaaugggcuggggagagggcuccgugggugaggcucuggccacacaagccugacagcuuguaaugguggaggaagaaaagcagcucccaauucaccugaccuccacccucacaugcaucacacacacacucgauaaugagauagaaacuucacaggucauuugccauggguuuugugaagaaaugguucuaacagugugcugcacugcaggcgaccgcagaacccgcacccaugucucccuguuucgacagaggaccuugaugguucuuggugcccuuccaucaaacaggcuagucucuuggcguuuaaccuaucacuccaugggagggcagcugaguacaaguuagugagccagggucaugggugcugcgggaauguggaaagccaaagggccugucuucaggaagaagagcuguaucagaaguggcguggaauaugugcuacaguucacaagagcagaacucugcauuuauuggcauuucugaagggugaauggguaaggcuuaccaauguuagucuaggaaacuuagaugccccguuacccgaccgagucugugcuuuccuguucccuauaaagcuguuugccaccagccaguaggaagccagacugggcagagcacugagcaccuacugugccagaaauguccuccagacgcugcaagugucagagcuaaccugccuucuauugccuacggucucauugucuuccacuuaaggagugaagauaagguggguugcccuccugcaguauugcaggagcuuaaggcuuuugacucugcacguaaaugaauacaacugcacagucaguugagauuaccaccuuaaacucagauagaaaaccgcauccucuucuuugagcccagucagcuuccagccuuguaagggauaaagugcugacagccuugcugggguuaagacaguagcccuuagagccucuaagaggggugugcaaacaugccguuucucauuuacucuuaaaacccaguaaaugaauaaggaugagucaacauugacagauugcacaguuacgcaagcuggcccagagucccccagggugugggggugugccuuggauucucauugugcauuuugucccuuacuuguuuggguacucuccccucuguacccucuggguucuuggaagacauagucccuguauuauuuauagauccuucuguaagccuggcuguucucuuacuccuaaaauggccuaaagggugccaaagguucuaguucccuggucaguggguuagucuuuacagccagccacuggucagcagggcucagcuaaggacuuugagucccagacucagcacccuuccuugucugacucguuuaccuacggagcccucagugcuuaucgcagaccuuccacugguguuaggcuuuuggagcccuggaacagcccuuuccugucagauaagggacauuaaggguaaggggagacugccuggccgucaggcuuuguguacucuggugauaaccuggaaccugccuccugcgacccucauucuuggccccuguauguauucuuuccccauguuagcuuccugucacugggacaaaauacccaagaaaaucaacuuaugaggagggaagguuuguccuggcucauggugucagcagucucagcucauaauuuguccuuguugcuuuggagccuguggagagagacaugccauggcaaggggcauguuggacaaagcugcacuuuauucugacugggaaacagaaaggaagccauugaggacccagcucccaaaucccaguccagggcauaucccaguguccuaacuuauuuucuucuaaaauuuuucucauuuauauuuauuuuguguaguggggauaaguggguuguguucuguucucuccuucuacucuguuggucccagggaugaaacucaggcuuaggguaagcaccuuuacucgcugagccauccugucacucccaaaagggagaaggagggagggagugugugugugugugugugugugugugcgcgcgcgcgcucaggacaguugaggggagucaguucucuucucccaccuaugggcccuagggauugaacucaggucaucagacuugauggcagaugcguuuauggcugaaucaucucagcggccccacccuaacuucccuuuaucaagcuuugccuccuaaaaguuccauuauaucuucuuagcgccacauacugaugaccaagucucaacaugggagccuuuaggcaacagccaagauccucacagggcccucucuaacccuucccagguuccucucuagcccuucccagcacagcuucugagugggagacacuucauuuuccucuacugcggggggucuugugaugcuuaaggcucaaacaugguccuacacucucuaggcaaacauuccacugcagagcugugaccucagcccuggaucugguuuauaaucucauuugcuucuuucagaccaaaggcugcuacccugguaacuaaaaauuggguaacuuacuuguuuauuguccugcucugucuaucagcagccugugggguaggcuccagaggcacagguccagaaagauccgccaccucgcucaaguucccuuccaccuccucaggaagcaaugaagcuagaaucaagcugagucuucccaccccggcggugccuguggcaccuuugccaccuccaccugacagagaagugagcccucagcugggcacucaggagagcuggucaagugauagccucuugugaccugaggccugggaacaucacucaggaaagcagacaggagggcacagaagggaaguggagcccacaagaccuuugaaaagccugggugggagcuuagauuuggagaaaccucauuuucaggucuaaaaaaaaaaauccaaaaggggagaaagagaauuuaacagacaggaaaacacauggggggagagugcuggucuggaagagggagugggguggaaauaucaagauucuguuagugaagagaggcgcuugccaucugcuccugauugaucacaggccuuaaagucucggcccaaggucagagguggcagagaguaaacccccaugaccugaguuugagccuuagaaagggaagagaaagccaacuccugaaaguugucccucaccuccacauacaugccauaacuccacauacaugccauagcgcguguguacccauguacacagcuaacaauuguuuaaauguuuucaaucucuaaacaagggauggaaacagagcacuacauauauacaacacaugcaccacauauaccacauguguacacauguacucauuugcauguacugugacaugcacacauaugcauauauuuuaaaaguaggagcugggcgugguagugcacaccuuuaaucccagcacucgggaggcagaggcagguggauuucugaguucgaggccagccuggucuacaaagugagcuccaggacagccagggcuauacagagaaacccugucucgaaaaaaccaaaaaaaaaaaaaaaguaggaacgggauuuuuuuuaaaguguggccuuuauagggaaguaacuaggggugguuagaaaaugaucuaggcaagagauacugucccuugacuggaagcaggcagucugggggcugagguguccaccacugaacgagcggacucuuuagacuuagccgcuguggggccgggaagaaggaauuaagcaugacuccaggaacuuacaccucaaagauugggggaagggaggcggugccaaacaagggcucuuaaaggaguagcaggcuucuggggaaguuaaugaguuugaaauuuaacguaaguguuacauacuaguaagauaaccaagaaaaaaaguuggaucuauggaucuggaaccaaaaaaaaaaaaaaaggauuucaguaacuccguuuacauuuagugugugugugcgugugcaugugcguguguguguguguguguguguguacaugugugugcacauauguaugaguaugugugugugugugaucauuucucuuacuaggcggguucugaggauacaacucaggucaucaagccugaugacaagugccucucuucacugaacaucuggcucauuccauccacugcaguacaugagcaguguggcugaagccauggaccuagaugaugucaaaaugggcauggggagugaggucaggcacagcugugugcaagcacuuaugaaaggugaaggagccauaggcagcaccagcaguggccgugggacagugggagagaccugggauggcacuaaggcagaggccaaggccauggauacaggccagaagccccucaucucuagagcucuccaugagcucaaucaggagcugagcacaagcuaagccagcagagugauggggaaagaagaagauggguauggcccagcucacaccccauagguggauuuuuccuucuaggguaaggagugucuuaaaccccuauuugcuguaggauuugauguuguuaggcuggccccagcuccucuaacacccaugccagcugacugagcauuggcauuugggcaaauguggucccuccccucucacucauugugucuuacaaggggcuacaugggaguuggcgucaccugucaccuggagaagcucugggccugcucacccugcuacucuugcucugucuccuagagucuguccuagggaacugccuggaaagaaguucuccuggacaagcaauggagcugccggaucacaacggccuuggguacccaguacggcccuuagucagugagcaccucaggucccggacgcuccagagacaccacacgauccagaacagcgacgaugccuauguauguuggccccuccugcugcuuagaggugggauggugccaucucaaccugaaagcagaguguccccuucugccgccaucuccucaguccagcccucugcaagcuguggagaccuuuuuuuuuucuuugacuccccauaacagaccagcauuaacaggagagucuugcggccauauguuagacuuaggaaucaaaugaucugacauccagggucuugaccucucccagaaaucuaaauccaggcuucaauauaugaacccucaauuuuugguccauuccuggcaacuguuuugcuuucuuuggcuuucuuaagaguugaccugucagagcaagucuugucaacugggacacacccagccaugguagcaccuguaugccuucaggcaaccauuuguggcuguucaaauguaaauguguuuaaguuacacaaaauuagaaauuuaguucugcgguaguaaauaacaguuacacuucacacacacagcagucaccauguuacaugggcacuugagaacagaacuguuagaccucacugucuauagauggguuggggagggacagggguccccugagagugacacacugucugucacucauugcugcugguuccacucuacagguacagcuggauaccuugccaggaaugagccugguggcaggcaaggcgcugagcucugcccggaugucagaugcaguucuuagucagucuucacucaugggcagccaacaguuucaggaugaggaagaugaagguaaggccuugcccaugggcaccccggggcagucuucuguggaaauuguucacuggcugaggugcuacgcacaugugcacacguuaggggcucuggcuucugucagcacagggacaucacaguccaaguucagugcuggagcaggauguaccuucaacaauagcccucuuucagcuucuccuuagagggcuucauauccuuguagaacauuuauuucuaugucuuuguagagccagggugggagaccaugauagagccuggagacggacagguucacccuuucuaagguccacaggcaaagccuaggaagucuucaucccaagucuucaccugugaggacaucaagagagcagugcccauguccuggcuuggguccuaaggaugcuggccuccugagguuuauuaguguuuauuagugugaugcucaagagaaaguggccuggccuggcuccuauagcacucacuacaguuauccugcccccuaaccacaagaaaaggcucuugaaggguuuuucaucuucacccccauaugucaguugcucaugaggguggcgaaaggaaggggcagguggucaggaagggucccuaacaucugaagggccugcuguggccugagucagagcuggacucaggcuggguugcuagacaagaccuccccagccuccucucuccugucccacuugcucccccaccuccaccucacauguucuuuuuggucuugcagaauguggggugagccugggccacgagcauccaggccugggugauggcagccagcaucucaacuccucucgcuauccagcuacguguguuacagacaucaugcucagccacaagcacccagaggucuccuucagcauggagcaagccggcguguagcaagauauggaaagugagugccacccugcucaggcccaggcagcccuggggcccagugccagccccucauagccucaauguguucauuccuugugugguaccccacuaaacuugagcgacacucuuuuugugcaaccuuccccgucugccuguuucuucauuaaguacuguguuaguuuugaggugggcugaggacuuuaauuuagggaagagguacauggcccaccucauguuauagaugcuauggcuuuaaugagauccaagcuacaguugcagaggccagaggccaaugaccuuuggccagcucucuaaagcuagucuuuacacuccauccugaagagugaaacccaaccagaaaagggaaaaagagcagauccagucaggcuccuucacuggugguuuuuauuguuugguuuuggcauuuuggugcuaagcauagaacccagggccguguaagccccagccccagccucaaccccagccccagccccagcuggacuuuuuaggggguaaacccaugcugaaaagacagaaggcucaccggcccuguuggccuagcagaggucacauggauggugaguacuaguggcucuaucucuacagagacagaacaacuugaggaagguaaagccacaggcagaggcauggcagagccucaguguggcaagacucauacagugacaccaagaaaagacuucacugagagccugcaugccuguggcucacugacagagcagggcauggacacauagggcccugagucccagcccuaguaccauuagaaaggguggggagaaagggugaagucaugucccucuccuucaagguguucuugucugcuucguagguucgaguacagcuccaggaggaggcugagucuagaccaauagaccaacaguguccaacagcgccgcaccgcuccuccgucugugucuccaccacaacagugcagcuccuuccccuacacuaggcaccaguaggccggcgcuuggguugcgagggacauuugccauguuugcuuguaugaccaaggcaccaaggaaauaaacaggaaaucaguguccuccaucuuucaugagccagcaucuggugugcuugaguugaguucugcuguuaggagguuugcuuguguuuuguuuuggaaauuuuccuuuggagauaacuuauucucuuugccuugcccaccccuacccccuugagcauauuccccccccccucucguuuucaccuaccauuucugagguagaugaaccagagguuaguauucaggggcugaaccucaggacccucccuuccacagccugucucagaccagacucucucccucugccccggucuaccaggaacaaaugcuagaccggagcuugguggccaagaaaaggagaggagggggcaguggccccugccuuuggagauuggaacagaagaaaaaacugagccugggaucuggcagaaucuccugcuggccucuacuagaauccuaucuggcccagcagaauuccaucagaucccagcacaggccggauggccuggugcugaagguuugccauccagaauagcucaguguaggccccucuggugugugguccaguuccccuccagucaccaacugguucccccucaugagugaacacccaggaguggugcacugugcuguuugugugaucuccauucuuauucucuacugcguuguaaaaagggccguugguccauuugugugcacacguaugaguguguacaugcccuucccugcggccucuuugucacagacaagaauuggaggcuguacugggucucuuaaccuucuccucuccccagcauccucggccccuauauuuuaauucuugaucauguaggaauuguuuuugauaaauguugauauuauuguuauuauuguuauuauuaauaaagacaaaaaggauuuuguuuauuuguuuaaaagagaaauguuuaaccagauucugugcuguugaacuguggcuugcaacuucuguuugaaguguuuuccuuggcuuuggcaucgugagccacucuccugugccagcagcggaugcaguggccucccuuccccagccgaagcagcacauaggcaguggcuacuguccuugucacuuccuuucucucugcagucagaaaccaaagucuggggccaaacgaggccggcccggcuucucuucuggucuucaaaaccagagagggauggucccugcucugacucccagcccucauuucugagagccaggggccaccaaccucugaguaugcacagaagaaagccgcugccugccauggcaucuggacauuaccagcagggucccuagccauuuuauccuuccgcaccaacccugaaagcuugccucuuugaacaaauccauugucucuugaauggauuuguuuucaaugugagagcuuggcuggggaccuguuucguggucccauguccuccaauuuccccuccacuucaggugucacuaauuacuagccagaagaugucugacucccaagaaagcuugacaagccauugucagcuuccaagcucaguccagcucugauacuccagccccgcccugcugcuccccacgcucagccugaccuguuuacgugguacuggauugauggaagagcaggcaccacccuccagagccacccagacgaaagccagugagccuauuaaccgugccaucuugcgaacuauuuucaagaucaccauugcuuuauauuguaguaaccaauaugcgcaguauauguugaauguauaugaaucuacuuugcuauuucuguucuuugaaaauguaagaaguauuuuuccuuucucauuucuguugaucuaaaaaugauaauaauaauaauaaucuccagauucaaguugcuaagagcuuuuguccuuguuugugugggacaucuacaacuuagugacuugguuggacuguaggagguuguggaaauaaaaaccugauuauguacuaacgcugau

SEQ ID NO: 5076 - RNA, 9582 nt, Mus musculus
ucuuugucagagacugaccuaggaaacgcagggucugcggccucuuuaagaaggggcgggaacaggggcuggaggaagugaggucgcaggggccgcggaagccggaagccgccgcgggagcaacgcguggggagaugucugccagcggggcugugcagccgggacacccgggggccgccgucgggcccucgcccgcugcggcugcgucaccagccaccgggccuuuguuccggccccucagcgccgaggaugaggagcaacagcccaccgagaucgagucacugugcaugaacuguuaccggaacgugagucugagcccggggaaccacccagccgugcacccagaggcagcucuggcguacaggguguaaacaagcugaagucauucuccccaacgccgcuucugcuucccuagggcacgacgcgacuucugcucaccaagauccccuucuuuagagaaaucaucgugagcuccuuuuccugcgaacacuguggcuggaacaacacggagauccagucugcaggcaggauccaggaccagggagugcgcuacaccuugaccgugagaagccaagaggugagcgcagaccagagaagguacccccacgguuucagagagcgcacugggggucagagcccccaaucggaccaucagcccuucaccagaccugucccaagcccuuagugucguccuuugacaguggugucgguggugcuggccucgguucugcugcuuugaguggugaacgugcuuugcgaauuuugugggagugaugggauuuauguggaagagcugggcuuugugggugguguucuuaccuucuggguagucaggcugacaccauguguacuauccugaaguaguuuggacucuucugaauggaaggcgggaagaagaaagaucuggguuggcaucugauggagagauggucugguuauuucccaagcuuuauugcugaccucuuuagcuagaacgguuugcuuucuguccaggacaugaacagagaagugguaaagacagacucugccaccacaaggauccccgagcuggauuuugagauuccagccuucagccagaagggaggugaguuuuaagaucaggugugugaggugugugagcuguucacaagcugagauguuuccuauuuucuuucaaagccugguccaggucacgccuaguggcuuguguuuggucauuuaauuauaguggauuuucauguuuuaaugugaguaaaaaguuauaguuaaucucucucucucuuuuguuuuguuuuguuuuguuuuguugguuuuuaggguuucccuauguagcccuggcuguccuggaacucacucuguagacuaggcuggccucaaacucggaaaucugccugccucugccucccaagugcugggaucaaaggccugcaccaccacugcccgucuaauuaaaucucuuaagaguccaguagugagacagaccacggugugcuuaguuuagagcuuuauagaugaggagaaggaggccugcagaguucagggaaaguguugagggucacacagacaagugauagcacgucagcacucacuugucucauguuucauuuaccacaagcucugaccacuguugaaggacucaucagccgugcgaucucuggccuggaacaggaucagcccacacgacgggugaguagggaugagucaaacuguaucagaccaaauguuggggaacuuuuugauugagcacauaaaggagcuaguucuccauguugugcuguccccagcccacgucucggugugcccuccugcacuucagauaaugucacauuaucuugaagagucuucggcuucucuacagcuuccugaggauucuuuuauaucuguacuuguuauuauagaaauaaugucauugcacauugcugcugucugucucuaacuggcuagagaggcauaacagaauuuuggauuuuuaaaggaauuucuuuuuaauuauguguuaugugcccgugugauguaagauguaaaugugauggcagauaccuuugugagccagaagcaacaguuccccacuguuacaacaguuccccacugagacgaaguuacagugcaguggaauaauaaauaagaaaauaagcccgccuccuaacccccagcaucguuuauaaacuucagaugagcuucuugugucucacuauaaaauucaggucccugugcucccagucuaaguggauguuaaggaucugacuggagggauauggcuguuggaggguuggggugugggguguacugccaagucugcaguuuucauccuguuccugacaggcaguggaaggugccaucgcagagagaauugaugaguucauuggcaaacugaaggaccuaaagcaaauggcuuccccuuucacacugguaaguacugggcuacugcagccacuuucaguguaaggaggaggcgagcaucccuuggcacugacugaugcugguaaccauggagcuuggcaaguggaagagguaagaagaucaagaguuuggacucauccuugacuucauagcacgguauaggccaggcuaggcuaugcugaagcccaaccuaaagauaaaaaaguggagcaggauuuuucuaguguguucuggcgcuggauggaaguuauauaugguuuaucuuacucucuccucucuuauuugucaggucauugaugaucccucgggaaacagcuuuguagaaaacccacaugcuccccagaaagauaaugccuuggugaucacauacuaugaccgaaccccacagcaagcugagaugcuggggcuccaaguaaguggacugauuaagucagagggaugcucuggggcugcccuguguucuggguccugaagucacugaagucacuuugcuauugcugccaccaucauccaaugcauccugucucggccuuuuaucacgcucacaaagcaggugucagucacaggaacccagccuugagccccgucuuucucuugucuggggauuugcuuuggcuucucuauccaucuguccuuugagguguccuuugguaccuuacagggaacaaaggcauucucucccucuuuaaguagggcagggcucuacuguaggcugaggucuaucugccaacuugugguuugggccucuguucuuucaggcagaagcaccagaggagaaggcggaagaggaagaccuuagaaacgaagugaguggugcuggcucccuuugaagaccauaguggaguuguggguagagacugacgaauguccagugugucaccaucacagcucacaugggugaccaccugcgggaugucuucagcucgaagggguggggaugcucagucugugccccuauauuauguccuaggugcuccaguucaacacuaacugcccagagugcaacgcuccggcucagaccaacaugaagcuuguccguaucuuucagcaggcaauuggguugcucuucagcugacucgggcaugaacguuauauuacagacgggagccuucccuucagggaaagccagugcuuuauccucaguggugaggaugaaccuuuaaugaagcuacauacugcauaccuggcuucugaguguggccaggucuccguguuugugagcacaggcccguuuauuguacucuuggguccugcaucuguuugugugggacuuggcuuugcuuuuccuuggggguggggguggggguguuuuccuugaagcagauagacuucuuuaacuccaucuuccagaaaucccccacuuuaaagagguuaucaucauggccaccaacugugagaauugugggcaucggacuaaugaggugggugggagaagauuggcguaggggcaacgccuuuguagcagucugccagcuuccugaaucuacuugaggaugggcaucagcuguauuugggucuuuugggggcuuagugcuggggaggagccacugaaggagcugagaauuagccuagagagaaguuggaaauacaagauugcaagauggacggaaaacugaccuuguggaagggguugugguucucagaaggcuggagguuggacagagugugacucagugaagaacucaggggagcugucgggaauggauuugguggcugcuguggagguuguaagccuucauuccuaaguguaucgagcauaagcugauuaaacuuaaguuauggggacacagugaacagcaaaccuggggccucaugcagacaaggcaagagcgcuguuagugagccaugucccagcccugacuaaauuccuagauuaugacagcaaaugcagggauggacugaaaugcuuacaagccucuuucauccucugacagucucaggguuuuuucuuuucuuuucuuuuuuucuuuuuaagguauauucaggguuucuuggcaguugccuaaaguuggcaugccaccagggcggagcaguguucuguggacucuugaugguuucuauuucugucacugaugcccuugcuggauuaggagcuuccgucaugggaagcuggugaugggagccuacauaaagcccaagucuuuguggcagcaggugaggccugggcucuucucuggaccugcuccugaccguuguuuccacaggugaaguccggaggagcuguagaaccuuuggguaccaggaucacccuccacaucacagaucccucagacaugaccagagaccuccucaagguagccuacuuggaaaauagcuguugucguauagccgcuucagucuagaggaagugaucaucuuagugcuuaagaacacaaggaacccuguaacuccccugggcuugagugacccugaggaagcuuuuuccaugacugggacuacagacucagaagguggccccagucuuccugagcaaugacguggcugcuuuuuaguuucuauuggcuauaugggcucuucucugacccuaaugacaagguacaauagcuuguaggugugacucaguuucagguuguuauguuaacuucguguugguucagaugggggagugaggcccuggcuuuuagccagguauuaagaguaaacuaacauucuaacuuugucuucaaacugucacugguuuauuaauuugguuggcuuucuuuguuccuaguuuuaaaucaguuugucucucuguaugucuguccaucugucuagugcuauggauugaaccugggaccucuguuaauacuagacaagggcucuuggaugaagcuaugcugccauccugugauuuaauuguaaauuugaccuguugucuuauagucugagaccuguaguguggaaaucccagagcuugaguuugaacugggaauggcuguacuugggggcaaguucaccacucuagaaggacugcugaaagacauccgagaacuggugagugcagagugugcugcaucgcuucuguuagcaguuuggcagugggaagggguaacauuguuuguccggguaugauggcacuugagaagcuggggcaagaagacaggauuugaggacagccugagacccuaucccaaaugccuccuaccaaaaccaaauucuguuuugucacuuauaacuggggauuucuuugccuuaaagcugguuuaagccgggcgugguggcgcacgaguauaaucccagcacuagggaggcagaggcagguggauuucugaguucaaggccagccuggucuacaaaguaaguuccaggacagccagggcuacacagagaaacccugucuugaaaaacaaaaaaaaaaaaaaaaaaaaaagcucauucaagagauuugaguauuaauuaugaagagaaggaagagaaauuaguuauaggauuuuguuuguuuguuugguuugguuugguuuuucgagacaggguuucucuguguagcccugacuguccuggaacucacucuguagaccaagcuggccuugaacucagaaauccaccugccucugccucccaagugcugagauuaaaggugugcgccaccacuguccagcaguuauaggaauuuuuaauggaaauucucaaggcuagcagugggccaguguaguuauuuugugaucuuaagucauuuaccucauuacaaaauagaagggggucuuuuugacaucuguagugaauauguggagacuuuucuugucgguauuuccuaaacaguagugcaaaauuauauuagaucuuauaaauguguuuauuuuauuuauuugagagauggcuuugcgauauaauugaggcuagccuugaggucacuccacacacacacacacacacacacacacacacacaccugccaccucucggccucagccuuccaugugcuggcacugcaggccaaguaacugccuggcuuuucuuugugaauuguacauugcauuucuuuuccauauugggauuagauacuguaagaacgcuacuggauuccagucccuacugccaguuuccuucuuggcaaagcagucucauagacaucuucuccuguccuguucucgggccaccuuccuccccuccccuaagugagcaaggcguugugggauauggagagcaggcuucucccacugggaguccacugcuccccaccccugguuugugguucagcguaaugacccauacagucuguguuguaguaauccagcuguugugcuacagguaaccaagaacccauucacacugggcgacagcucuaauccugaccagucagagaaacugcaggaguuuagccagaaguugggccagguaagaggacccaggccauuucugcaauccuaauuucccuuucuuuaaacuuuugggaacugcacuuuguaaacuggauuggcucuugucucgcagccauagccucuuccuuccaggaucuuuguaagaguuaccugcuaaguccuccucucuccuguagaucaucgagggcaagaugaaggcccacuuuaucaugaaugauccagcaggaaacaguuaucugcagguaaguuaggccuuccuggugguucuauggagacauauuuucggaacuuuauagaauuugcaugauagcccuuaacaaggaaagccuuguuaagucuucaauuggggccuugggcaggacuuggaagguaaggaagaaaggggaagguggugauagugggacucccaaguguguguaacaaagaccuagugcagggcugcaaucuuagguccucagaaggccaugaaaauggaaaguuuaagaccagccugugcgauuuucaagacugucuuaagauacaauaaugugaagaaaaagccaagaguaacuguuuaccuggcuagcgugcucagggcccuagguacagagugaauauauaagaaaguaggaccuccucuuccugggucugcuugucuuguucuuauucucacccucagcauuggagcuuccauucugcaucugacugugaaguaaggagcaauaggaaccuggccagaggucaggacaggaaagccgagagguguuggcugaacgggcaagcaaacaucuggcaauugauccauaucaaacugcagcaaaauuguguugaaccuggggccuccuccuuacuuuaguauuaaugagcacugaugggccuggcaaaacuggccuaguuuuucacauaauuaagaucauuguggucccccucccucaaaaccuuuuuuuuuuuuuuugagacaagucuuuguuauguagccuggcuggcuuuaaauuuguaaucuuucugccucagucuccagagugcugagauuauaagcaaucaccaacuuuggcuacauuuuuuauaggaaggcccauauauaaaaguacuuagaacuggggguuaaacacuuguaugcauguacaggggcuuggguuugauacuagcauacacacacacacacacacacacacacacacacuuuugcagaauguagccgugggcucuagagacccugcaaauccugugcauuucuucggagguugagagucagccgugggaggggauggcgggcugcacaggcgcugaccgucgucugucugcucuuggcccugcagaauguguaugcaccugaagacgauccagagaugaaggucgagcgguacaaacgcaccuuugaccaaaaugaggagcucgggcucaaugacaugaagacagagggcuaugaggcgggccuggccccacagcgguagcaguggccagcucacuggccagcuacagugccacucacacugcaggguuaucuguuacuguggggaacugacgaggagugcucaagcccucguccauggugaagagguuaccacuugaguuagaaauguaagcacccaagauuagcagcugacggacgaggcagcugcagcccuacugugcuccuugaccuucuuuuggagguuuuaaagucggcgugagaagaaucccagaaacaccaggcggucugccaucaccguuugccugucagcucucugaccuccagugcuggaccuuugaagucuggggaagugaaauacaaguuucugcuggcucugggcaugugaaguacugacucagcagggaaggaugucggaggggccgagcaggcacaggugaagacgccacauuaaagugauggccuuuaaacgacacccgccucugcguucauguccuuacugauuaccaugugcuagacuaagcugggucacacugagucacacucagcuccgaggagacugaggacagcuugggccaugcagugagaguccgucuucaugaaaagaaaugaggaaggaaaaaccaguuuaguuuccuaagcaaaucuuucuugagguggcugcuguagaggcagcauuugauucacuccaauaggccauccugucugcucugagccagguacaccuguguggagucuagcuguucucaugcagcuuaaagcagucuggaaaagcaggguggcacacaccuuuaaucccagcagaggcaggugguucuaugaguuugaagccgauuuggucuacagaggaaguuccaggacagccugggcuacacagaaaaacccugauucaagacaaaacgaauucaaacuggauaaccagcaccauccuuguuuggccucugcuagcaaaaauuagagccaggcaguaugaagauguguggguuccuguacuuacccgaaaguucuuauuaucuauaaaggaggcuaauaaaacugaaggguaggucaugguguccagccacuugagaggcugaggaggaaggcuaacaaauucaggggcagcuuaggcaauuuagaucuucaacauucaaaagaguggggauguaguucuauagaacuccugcauaccaugugcaaaaggccuuggguuuaauccucggugcuggaugaaagaaaaaaaaauugugaggguuaagugagaagucauaaaacacuuaacccuuuauagaagaaacuccagaaucuuccugguuucuuugccacacugaccacgaauccauuucacugggaagaguuuauaucauuuuuuagaaagacauaucaaaggugagaaggucaguacagguuugauaaaaaccuaucaaacuuuuauagucacaaguuugacuuccccuaaaugguacccggaagccucuuccagcagacuucccaccaaaagguauuuauagcaauaaaagugauugaaauugaaac

SEQ ID NO: 5077 - RNA, 9582 nt, Mus musculus
guuucaauuucaaucacuuuuauugcuauaaauaccuuuuggugggaagucugcuggaagaggcuuccggguaccauuuaggggaagucaaacuugugacuauaaaaguuugauagguuuuuaucaaaccuguacugaccuucucaccuuugauaugucuuucuaaaaaaugauauaaacucuucccagugaaauggauucguggucaguguggcaaagaaaccaggaagauucuggaguuucuucuauaaaggguuaaguguuuuaugacuucucacuuaacccucacaauuuuuuuuucuuucauccagcaccgaggauuaaacccaaggccuuuugcacaugguaugcaggaguucuauagaacuacauccccacucuuuugaauguugaagaucuaaauugccuaagcugccccugaauuuguuagccuuccuccucagccucucaaguggcuggacaccaugaccuacccuucaguuuuauuagccuccuuuauagauaauaagaacuuucggguaaguacaggaacccacacaucuucauacugccuggcucuaauuuuugcuagcagaggccaaacaaggauggugcugguuauccaguuugaauucguuuugucuugaaucaggguuuuucuguguagcccaggcuguccuggaacuuccucuguagaccaaaucggcuucaaacucauagaaccaccugccucugcugggauuaaaggugugugccacccugcuuuuccagacugcuuuaagcugcaugagaacagcuagacuccacacagguguaccuggcucagagcagacaggauggccuauuggagugaaucaaaugcugccucuacagcagccaccucaagaaagauuugcuuaggaaacuaaacugguuuuuccuuccucauuucuuuucaugaagacggacucucacugcauggcccaagcuguccucagucuccucggagcugagugugacucagugugacccagcuuagucuagcacaugguaaucaguaaggacaugaacgcagaggcgggugucguuuaaaggccaucacuuuaauguggcgucuucaccugugccugcucggccccuccgacauccuucccugcugagucaguacuucacaugcccagagccagcagaaacuuguauuucacuuccccagacuucaaagguccagcacuggaggucagagagcugacaggcaaacggugauggcagaccgccugguguuucugggauucuucucacgccgacuuuaaaaccuccaaaagaaggucaaggagcacaguagggcugcagcugccucguccgucagcugcuaaucuugggugcuuacauuucuaacucaagugguaaccucuucaccauggacgagggcuugagcacuccucgucaguuccccacaguaacagauaacccugcagugugaguggcacuguagcuggccagugagcuggccacugcuaccgcuguggggccaggcccgccucauagcccucugucuucaugucauugagcccgagcuccucauuuuggucaaaggugcguuuguaccgcucgaccuucaucucuggaucgucuucaggugcauacacauucugcagggccaagagcagacagacgacggucagcgccugugcagcccgccauccccucccacggcugacucucaaccuccgaagaaaugcacaggauuugcagggucucuagagcccacggcuacauucugcaaaaguguguguguguguguguguguguguguguguaugcuaguaucaaacccaagccccuguacaugcauacaaguguuuaacccccaguucuaaguacuuuuauauaugggccuuccuauaaaaaauguagccaaaguuggugauugcuuauaaucucagcacucuggagacugaggcagaaagauuacaaauuuaaagccagccaggcuacauaacaaagacuugucucaaaaaaaaaaaaaaagguuuugagggagggggaccacaaugaucuuaauuaugugaaaaacuaggccaguuuugccaggcccaucagugcucauuaauacuaaaguaaggaggaggccccagguucaacacaauuuugcugcaguuugauauggaucaauugccagauguuugcuugcccguucagccaacaccucucggcuuuccuguccugaccucuggccagguuccuauugcuccuuacuucacagucagaugcagaauggaagcuccaaugcugagggugagaauaagaacaagacaagcagacccaggaagaggagguccuacuuucuuauauauucacucuguaccuagggcccugagcacgcuagccagguaaacaguuacucuuggcuuuuucuucacauuauuguaucuuaagacagucuugaaaaucgcacaggcuggucuuaaacuuuccauuuucauggccuucugaggaccuaagauugcagcccugcacuaggucuuuguuacacacacuugggagucccacuaucaccaccuuccccuuucuuccuuaccuuccaaguccugcccaaggccccaauugaagacuuaacaaggcuuuccuuguuaagggcuaucaugcaaauucuauaaaguuccgaaaauaugucuccauagaaccaccaggaaggccuaacuuaccugcagauaacuguuuccugcuggaucauucaugauaaagugggccuucaucuugcccucgaugaucuacaggagagaggaggacuuagcagguaacucuuacaaagauccuggaaggaagaggcuauggcugcgagacaagagccaauccaguuuacaaagugcaguucccaaaaguuuaaagaaagggaaauuaggauugcagaaauggccuggguccucuuaccuggcccaacuucuggcuaaacuccugcaguuucucugacuggucaggauuagagcugucgcccagugugaauggguucuugguuaccuguagcacaacagcuggauuacuacaacacagacuguaugggucauuacgcugaaccacaaaccagggguggggagcaguggacucccagugggagaagccugcucuccauaucccacaacgccuugcucacuuaggggaggggaggaagguggcccgagaacaggacaggagaagaugucuaugagacugcuuugccaagaaggaaacuggcaguagggacuggaauccaguagcguucuuacaguaucuaaucccaauauggaaaagaaaugcaauguacaauucacaaagaaaagccaggcaguuacuuggccugcagugccagcacauggaaggcugaggccgagagguggcagguguguguguguguguguguguguguguguguguggagugaccucaaggcuagccucaauuauaucgcaaagccaucucucaaauaaauaaaauaaacacauuuauaagaucuaauauaauuuugcacuacuguuuaggaaauaccgacaagaaaagucuccacauauucacuacagaugucaaaaagacccccuucuauuuuguaaugagguaaaugacuuaagaucacaaaauaacuacacuggcccacugcuagccuugagaauuuccauuaaaaauuccuauaacugcuggacagugguggcgcacaccuuuaaucucagcacuugggaggcagaggcagguggauuucugaguucaaggccagcuuggucuacagagugaguuccaggacagucagggcuacacagagaaacccugucucgaaaaaccaaaccaaaccaaacaaacaaacaaaauccuauaacuaauuucucuuccuucucuucauaauuaauacucaaaucucuugaaugagcuuuuuuuuuuuuuuuuuuuuuuguuuuucaagacaggguuucucuguguagcccuggcuguccuggaacuuacuuuguagaccaggcuggccuugaacucagaaauccaccugccucugccucccuagugcugggauuauacucgugcgccaccacgcccggcuuaaaccagcuuuaaggcaaagaaauccccaguuauaagugacaaaacagaauuugguuuugguaggaggcauuugggauagggucucaggcuguccucaaauccugucuucuugccccagcuucucaagugccaucauacccggacaaacaauguuaccccuucccacugccaaacugcuaacagaagcgaugcagcacacucugcacucaccaguucucggaugucuuucagcaguccuucuagaguggugaacuugcccccaaguacagccauucccaguucaaacucaagcucugggauuuccacacuacaggucucagacuauaagacaacaggucaaauuuacaauuaaaucacaggauggcagcauagcuucauccaagagcccuugucuaguauuaacagaggucccagguucaauccauagcacuagacagauggacagacauacagagagacaaacugauuuaaaacuaggaacaaagaaagccaaccaaauuaauaaaccagugacaguuugaagacaaaguuagaauguuaguuuacucuuaauaccuggcuaaaagccagggccucacucccccaucugaaccaacacgaaguuaacauaacaaccugaaacugagucacaccuacaagcuauuguaccuugucauuagggucagagaagagcccauauagccaauagaaacuaaaaagcagccacgucauugcucaggaagacuggggccaccuucugagucuguagucccagucauggaaaaagcuuccucagggucacucaagcccaggggaguuacaggguuccuuguguucuuaagcacuaagaugaucacuuccucuagacugaagcggcuauacgacaacagcuauuuuccaaguaggcuaccuugaggaggucucuggucaugucugagggaucugugauguggagggugauccugguacccaaagguucuacagcuccuccggacuucaccuguggaaacaacggucaggagcagguccagagaagagcccaggccucaccugcugccacaaagacuugggcuuuauguaggcucccaucaccagcuucccaugacggaagcuccuaauccagcaagggcaucagugacagaaauagaaaccaucaagaguccacagaacacugcuccgcccugguggcaugccaacuuuaggcaacugccaagaaacccugaauauaccuuaaaaagaaaaaaagaaaagaaaagaaaaaacccugagacugucagaggaugaaagaggcuuguaagcauuucaguccaucccugcauuugcugucauaaucuaggaauuuagucagggcugggacauggcucacuaacagcgcucuugccuugucugcaugaggccccagguuugcuguucacuguguccccauaacuuaaguuuaaucagcuuaugcucgauacacuuaggaaugaaggcuuacaaccuccacagcagccaccaaauccauucccgacagcuccccugaguucuucacugagucacacucuguccaaccuccagccuucugagaaccacaaccccuuccacaaggucaguuuuccguccaucuugcaaucuuguauuuccaacuucucucuaggcuaauucucagcuccuucaguggcuccuccccagcacuaagcccccaaaagacccaaauacagcugaugcccauccucaaguagauucaggaagcuggcagacugcuacaaaggcguugccccuacgccaaucuucucccacccaccucauuaguccgaugcccacaauucucacaguugguggccaugaugauaaccucuuuaaagugggggauuucuggaagauggaguuaaagaagucuaucugcuucaaggaaaacacccccacccccacccccaaggaaaagcaaagccaagucccacacaaacagaugcaggacccaagaguacaauaaacgggccugugcucacaaacacggagaccuggccacacucagaagccagguaugcaguauguagcuucauuaaagguucauccucaccacugaggauaaagcacuggcuuucccugaagggaaggcucccgucuguaauauaacguucaugcccgagucagcugaagagcaacccaauugccugcugaaagauacggacaagcuucauguuggucugagccggagcguugcacucugggcaguuaguguugaacuggagcaccuaggacauaauauaggggcacagacugagcauccccaccccuucgagcugaagacaucccgcagguggucacccaugugagcugugauggugacacacuggacauucgucagucucuacccacaacuccacuauggucuucaaagggagccagcaccacucacuucguuucuaaggucuuccucuuccgccuucuccucuggugcuucugccugaaagaacagaggcccaaaccacaaguuggcagauagaccucagccuacaguagagcccugcccuacuuaaagagggagagaaugccuuuguucccuguaagguaccaaaggacaccucaaaggacagauggauagagaagccaaagcaaauccccagacaagagaaagacggggcucaaggcuggguuccugugacugacaccugcuuugugagcgugauaaaaggccgagacaggaugcauuggaugaugguggcagcaauagcaaagugacuucagugacuucaggacccagaacacagggcagccccagagcaucccucugacuuaaucaguccacuuacuuggagccccagcaucucagcuugcugugggguucggucauaguaugugaucaccaaggcauuaucuuucuggggagcauguggguuuucuacaaagcuguuucccgagggaucaucaaugaccugacaaauaagagaggagagaguaagauaaaccauauauaacuuccauccagcgccagaacacacuagaaaaauccugcuccacuuuuuuaucuuuagguugggcuucagcauagccuagccuggccuauaccgugcuaugaagucaaggaugaguccaaacucuugaucuucuuaccucuuccacuugccaagcuccaugguuaccagcaucagucagugccaagggaugcucgccuccuccuuacacugaaaguggcugcaguagcccaguacuuaccagugugaaaggggaagccauuugcuuuagguccuucaguuugccaaugaacucaucaauucucucugcgauggcaccuuccacugccugucaggaacaggaugaaaacugcagacuuggcaguacaccccacaccccaacccuccaacagccauaucccuccagucagauccuuaacauccacuuagacugggagcacagggaccugaauuuuauagugagacacaagaagcucaucugaaguuuauaaacgaugcuggggguuaggaggcgggcuuauuuucuuauuuauuauuccacugcacuguaacuucgucucaguggggaacuguuguaacaguggggaacuguugcuucuggcucacaaagguaucugccaucacauuuacaucuuacaucacacgggcacauaacacauaauuaaaaagaaauuccuuuaaaaauccaaaauucuguuaugccucucuagccaguuagagacagacagcagcaaugugcaaugacauuauuucuauaauaacaaguacagauauaaaagaauccucaggaagcuguagagaagccgaagacucuucaagauaaugugacauuaucugaagugcaggagggcacaccgagacgugggcuggggacagcacaacauggagaacuagcuccuuuaugugcucaaucaaaaaguuccccaacauuuggucugauacaguuugacucaucccuacucacccgucgugugggcugauccuguuccaggccagagaucgcacggcugaugaguccuucaacaguggucagagcuugugguaaaugaaacaugagacaagugagugcugacgugcuaucacuugucugugugacccucaacacuuucccugaacucugcaggccuccuucuccucaucuauaaagcucuaaacuaagcacaccguggucugucucacuacuggacucuuaagagauuuaauuagacgggcagugguggugcaggccuuugaucccagcacuugggaggcagaggcaggcagauuuccgaguuugaggccagccuagucuacagagugaguuccaggacagccagggcuacauagggaaacccuaaaaaccaacaaaacaaaacaaaacaaaacaaaagagagagagagauuaacuauaacuuuuuacucacauuaaaacaugaaaauccacuauaauuaaaugaccaaacacaagccacuaggcgugaccuggaccaggcuuugaaagaaaauaggaaacaucucagcuugugaacagcucacacaccucacacaccugaucuuaaaacucaccucccuucuggcugaaggcuggaaucucaaaauccagcucggggauccuugugguggcagagucugucuuuaccacuucucuguucauguccuggacagaaagcaaaccguucuagcuaaagaggucagcaauaaagcuugggaaauaaccagaccaucucuccaucagaugccaacccagaucuuucuucuucccgccuuccauucagaagaguccaaacuacuucaggauaguacacauggugucagccugacuacccagaagguaagaacaccacccacaaagcccagcucuuccacauaaaucccaucacucccacaaaauucgcaaagcacguucaccacucaaagcagcagaaccgaggccagcaccaccgacaccacugucaaaggacgacacuaagggcuugggacaggucuggugaagggcugaugguccgauugggggcucugacccccagugcgcucucugaaaccguggggguaccuucucuggucugcgcucaccucuuggcuucucacggucaagguguagcgcacucccugguccuggauccugccugcagacuggaucuccguguuguuccagccacaguguucgcaggaaaaggagcucacgaugauuucucuaaagaaggggaucuuggugagcagaagucgcgucgugcccuagggaagcagaagcggcguuggggagaaugacuucagcuuguuuacacccuguacgccagagcugccucugggugcacggcugggugguuccccgggcucagacucacguuccgguaacaguucaugcacagugacucgaucucggugggcuguugcuccucauccucggcgcugaggggccggaacaaaggcccgguggcuggugacgcagccgcagcgggcgagggcccgacggcggcccccgggugucccggcugcacagccccgcuggcagacaucuccccacgcguugcucccgcggcggcuuccggcuuccgcggccccugcgaccucacuuccuccagccccuguucccgccccuucuuaaagaggccgcagacccugcguuuccuaggucagucucugacaaaga

SEQ ID NO: 5078 - RNA, 16191 nt, Mus musculus
cuguugccccgcccucgccgcugccauggcggcagcuccgccacucaccaaagcugaguaucugaagcguuacuugucugggacagaugcuggcuuggaaggaggucccgaggccggucgcaagcggcgcaaaaaacggccgaagccuggaggcgcuggcggcaaggggugaguggacuggugaggugucgcgcugcccgguggcgcccucggccgcagcucuuccucguccuggcccgcgcggugcugccgaccccggcccgagcucaggccccgcuccacugccccggggcgggauuguagcugccacuggcagcucagaccucauccucugagcagcgccuuccuuguguuaaaggcagcuagaacuuaacucacuuucuccccgcguuuguagcuuacgucguuccauguacagauugaaagucguguccaagaauagcaaagcugauucaaaccuuuuucuuucucacuuuauuucucucuuucucccuucccuucucuuucuuuccuucuucuuuuucucuucccucuucuuucuuucuuucuuucuuucuuucuuucuuucuagauccaaaaaucucuuucugaggguuccaaagugccaggaacugaucuggaaucaaagacccauauccuauuacucacaucuacuacuaacaguaacaacuaaaaugggaacaguucacauccugugccuggccucuuucuaaaauaguugaccauauagcuuucagaacauuguaauggagcagacauuuauauuaaacacuauacuuccagauugcaaagagaugugcugagacagaguucagaugaaauguccauuaguaacuuggccacuggaaucuggaaagguuggguuaggauauccaacaucaaccuacagaacaaaaggaaaugucuguauuuguaggcuuuagagcagcagcccuaaguuuagcagcuuacugaaggugcuauuuuggauagaaaguugaaacucugggggcuaauuccauucucacacuccacccccaggucuacuaaaugcuuaucagcuuaaagagaguacuagauaggauacaaaguguggcucacccucucuguggggcaguaucauggucuaacaguauuauuaccguaugguccauugaacugggucgaauuagucccucauuuccacacuucucuucauuagagcuugagcaugaccucauuuauagauggaaucuuugugguguuaccaguuaagaugagccuauauucaguuaaggugguguugaauucaguguggcugaugucccuggaagaaggggcaauggcaugcagggggaaaguuuaagcuuuggagcaauacugauuagaauuagaauccuagcugugcuacuuauagccugagugguccagggcaagagauguucaucucagccgggcgugguggcacacgccuuuaaucccagcacucgggaggcagaggcaggcggauuucugaguuugaggccagccuggucuacaaagugaguuccaggacagccagggcuacacagagaaacccugucucaaaaaaccaaaaaaaaaaaaaaaaaaaagagagagauguucaucucucugagccugaagucccagccccuuacuacuugucugaaaugguuguugugauuaaagcugugucauguguuccuggcauuucaaauaaccuccuccuugcagcacaguucaucuguguggcacacauuuauuuauuggcuugccaccaccuuacaguaauuggggcacugguuccugaagcucaaaaugauacacuauuuucaugucaacuauucacauccucuuuaaaucauccuuagauuaauuacuuaaaagcccacuacagcuuagguaguaugccaguaguuacguuauauaggccauuguaacuaaagaaagucuaucuguuuaauacauuggccauuccuuuuccccugguugaguuugcaguugugaaguccauggguguggagggcugaauaccuccugugacaguuguguugaagaagccuugaugaacaaaaaauguauuagucagcaggauauggugguaaaagucuauaaucccagcacaggggaggcugggcuggaggauagagagcuggaagcuagcuauagggaacaacaacaagaagaagggaauaaauaagagaaugccuuagcccuuggcuguuggaacuuagaauuuaaugagaauaugggcugauaaauacaaaugaaagcauucuaagaguguguagagguauuucuacucugggaguaggagacagugagcaagaaagauagguccaaggaaguuauuaaaaaccaggguguaguggcuauuccugguugucaacuugacaauauuuggaaugaacuacaauccggaauuggaaggcucaccagugacccuuaucuugaggcuuggagauccuuaucuggaucuugguuuggagaucuugagccauaguggcuauggauuccagaagauugaaucucccaguuuaaggaaaacaccuuuaaucugggcuacaccuuucaucugggauuaaaggugugguggaacacaccuuuaaucugggcuacaccuucugcuggagacaauauaaggacauuggaagaagggagucuagcucuagcucuugcuccuucgccugcuugcugcgugagacugaguagcugcuagauccuuggacuuccauucauagcugcgacugaaccauuguugggaauugggcugccgacuguaaaucaucaauaaauuccuuuacuaucuagagacuauccauaaguucugugacucuagagaacccugacuaauacacagggcccaaagaaaauaagauucgugauuaacagugagaagaguaggucuggcagaaggaagggggugccuuuguaaaaacugauauuaccaaagguggacagugauggagugaauugacagcacacaaacauugagccauaccuuuaaguuuaaaagccaguagggggcagugacauggcucugcacuugacaagccugacaaccugaauuccauccccugaacccacauagcggagggagagaacugacuccugcagguuguccucuggccuccauaugcaugccauaucacauauauacaccaucacugucacacacacacacacacacucuaaaugucaaagaacaacagguaaggggcuggagagauggcucagaguauagacuacucuuccagagguccugaguucaauccccagcaacuacaugguggcucacaaccaucuguaaagaacaacagguagguaggcccguguuacagcaugacuuccguuuugaguuuuuauuguucucaucuagaaugcggauuguugaugaugaugugggcugggcggcuaucucuacugcuaagccggaaaaggaggaggaagaggauggagauuugccugugguauguaucucguggagacuuuugucaggacuuugaaaugauccaggcuucucagacuugacacugagcaaggggagaggugacccucaagagagcuguguggcacuguuuccuucauggugcuuauacagacagacagucccaacuuaauguuuuuuuuuuuuuuuugguuugguuugguuugguuugguuuuucgagauaggguuucucuguguagcccuggcuauccugaaacucacucuguagaccaggcuggccuugaauucagaaauccaccugccucugccucccaagugcugggauuaaaggcgugcgccaccacacccugcuccaacuuaauguuuugacugugcagugguguggacaugauacauuuucagcagaaaaugguuuugaauuuuugaucuucggcuagcacuguuugguaugauagucucaugaugggcaguagaagucagucaugcgaucacaaggagaagcaggcaguucucugccuguaagcuauggcucuggguucuugagacaagugauccuuggcuggguccuguggguuuccucacuguagugccccuacuccugcagguggcugaguuuguggaugagcguccagaagagguaaagcagauggaggccuuccgcuccagugccaaguggaagcuucugggaggugagugucagcagcaacacaacugcacaucucauuuccaggauggguuccuucugcuucccugccuuaggggaaugccugguuuguuuuaugucagugaugaugaaaaacaugaugggacaaagaugucaggacuuuagaagaagggcauggaacauuagaggcugacuugucagagccuggagaccagccuuuccacgguucuagaaugaaacagcuccuguggucagagccagaguuuugucuuucacuuugugacuauuucucuguucuccugacuuuccauaaacaaggcucucccaucuucuccuccauccccugugucuuccuuuccuuccuuucuuuuuuuuaaaccuuugagacggucucagucuauagucuaggucacugugauucaaucuuacuucuugagaucuauuuaacuauagaauauuccuggugcuugcucuuuucuuauacauaggugacaaaagaauugucuccuaagugggguuuguuacccucugugccauuaggccagagcacauugugggacucuuacuguuugcucuuguguuuaggccacggugaagauggacauuuucaucacgaugaccaagauucaucuccuccuaggaggguccgucaugacaccccagacacaucuccucccagaaaggcccgucaugacaccccagacccaucuccucccaggaaggcccgucaugacaccccagacacaucuccucccagaaaggcccgucaugacaccccagacccaucuccucccaggaaggcccgucaugacaccccagacccaucuccucccaggagaguucgucaugacaccccggaucuaucucccccaaggagaguucgucaugacaccccggaucuaucuccucccaggagaguccgccaugacaccccggauccaucuccucccaggagaguccgccaugacuuagaugcuucuccccccaggaagucucaucguaauucuucagccguaucuccuaggagaggccaucaugguuccuuagguaccucuucuccgagacagacccauaaccacuccccuacugcagcccagcauagaaggacucuugacucuucagguacacagcaucucaggagggcccaucaugaguccccugauuuggaacugcacaaagccaaaaguaguaaagcugcagaaagagccccuagcaaggcugcaucccagagugggcuaggacccucucacccaucacucuccaccaacagcaaguacgagcacgacucugaccucucuccuccacggaaacggcaagcaaaggcucauuuugaagcuaagaaacagcuugauucuaaaggugagcauaaggcuaugcauaagaggaccuuccuccuggggaguguaagaaugaguuucuuuuggaaaguuuugaaaaaagagagacuagacuuaggggaguugaaaaauaaaaggguggggggaaaguuucauguccuuuugcucacucacccuccccauaaaaaggcaaagauggggugggcucagaggcucagaggguaaagcauugucuucaccacugcaguaaaaggagaaaaccgaccccugaaaguuguccucugaccuccgcauguguaugucugcgaucauguacacacaugcacacauacaguaauaauaaauacacugacguacaggaauguauagacacagcagugucacaaaauuguaucauuuagacaacgucauugcuaguguuguagccgguguccuuaggugguuugggcacgcauguugggcguaguugggccugaguguacagagcauacuuguugccuguggauucuugccugcucgcuccacuuaccagucuucccugaguuugcccugaggauauuugacaaucaucauguacauacacugauagcacaacugggauugcugcuuuuuucuuuuucuuuuuuuuuuaagaguuauuuauuuauuuaaauauauuagugcacuauugcccucuucagacacaccagaagagggcaucagaucccauuacagaugauugugagccaccaugugguugcugggaauugaacucaggagcucuggaagagcagucagugcucuuaacugcugagcugucucucuagcccuguauuauuucuuuuuuuuuuuuuuuaaaagauuuauuuauuauauguaaguacacuguagcugucuucagacauuccagaagagggagucacuuguuacagaugguugugagccaccaugugguugcugggauuugaacuccggaccuucggaagagcagucgggugcucuuacccacugagccaucucaccagcccccuguauuauuucuuaucuuagaucuccuggggauuuaacugauagguuccuagaaaacuauggaguuauuuacuaggucagaauguguggcuguugcuacuaccuaguaccugcuauauaguggcuuuucaggaggugacuggugacacugucaucuagaacaggccccugcagaaaggguuuuguuuuacuucaucauuuguuuuagcuauaguuuuaaucuuaaaaugaaauuacuuuguuuucuugagucuggggagaucagcauauaguccaggucuuccugacucugccacaccgcacgggccaacucauuucugaugccaguucugaagaggguggcagugagagacugugucugagaucucauacgcuuuucaaagucaccagacacugguagccaggaaaccaagcccccgccuuuguucuucucugugucacuugugccuguguuuugguuagucauguuauuucauaggauggcuaaaaagacaccgugcccagcaugguaaguucuuuuaagcaaucuccuaaggagauuaaugguccuccccuucucuccugugcugaggaccaaacccaggucugacguacuaggcaggcauuuuacugcugaaccauccccauccuuaauucauucuuuaaucccuagauucucuuagacacaggagauuucauagacgcuuuuguucuuuucuacuuaggugucuaccaaaaagccucugauucagaucuuucuccuccacggaaaaaaaaaaauucggggcaccaggauucugauucagaucugucaccaccacggaacagaccaaggcggcagagcucugacuccgaccucucuccaccccggagaagacagaggaccaaauccucugauucugaccucucuccaccucgaaggaguccccguccuggcaagaagguagguuuccaggaguugugucuuucuuuaucagggugacuccuccagcagagaaugagaaagugguacaggaaguuggaguuagaagcauuucuggaacuuucucugacggugacauggguggaacucgucuuagcugggccucagugaagcuugggaaccagaguguuggaguuugaaggcugugcuucugcacccaaauggugcucagaauguuguagauuuuggacuauugugcauuucugguuuuggaucaggagugcccagcugccucucagagccuuguaaugccaccagucucaucucagugucuugucuuuguuguuuugaguguacuccaaggcuggccuugaacuucugacccaucugccucuucccaccuguugauagauauacaggcuggcaccaccuguuuuccuaacaguaaauugaggcuuacagauuauaaagugcaguuagaagugcagaacccugugaaaccaauaauagcuguaaauucuacuucugcuacuuaguaucugugggauuggacgagaaauuauauuccucuaaaugucagcuuuuugcuuuuuaaaaugugcauaagugaguucaaagccagccugugcuguaggggacucuaucuuuuuuuuuuaaaaaaaaaaaaaaaaaagagaagucaugcaaauucuuacucccuucuaugugccccauguuuguguuucuguuuacuuuaaaauuugauaccauaaaguguucuaugagauuagauauuucccauucuauguugugagcccuguuuguggucaauacugagaauauaaaacuagagguuuugguuugguuauagcuaacagucaggcacuggagcagcuaucugccuccuggaaaaaugguguugcuguugccucuucucuugcacagacugcacacguguauuccccuugcauaggcuguacacauguauuccuuuucucuugcacagacugcacacauguauuccggagcaaaaacuggguuggucacugauguucagcgggagcaccaggaacucaagaaacaagaccaggacaccacagaccucggagguacaauugugagcuugcaggggccacugaagguccuauagcucucuuuucuguuguuaauguggcuuguauuugcuaucggaaacuuccuugcuuuuauguaccuuaccucaguaguacaagcacuccuuuccuucccaguaugugaaagagugcugguaggauggucugucugcagaguucuuucagcaaaagaucccaagcaguugguuucuagugcuagaaugugauuucugacugugaugccugguguguaucuuuaaaauguguuuuuuccuucauagcacaguuugaauucacugaaacuguauuucgagacaagucuggucggaagaggaauuugaagcuagagcgcuuggaacagaggagaaaagcagagaaagacucagagcgagaugagcuauaugcccagugggggaaaggguaagggcgccccugagcacaaagcuagacugcaagaccugagccagccucugccuugcauuucugggagcugauacggggcgagccucaggugcacagucuccugagaugguugguucaagcuacccguccggauucuggggcugcuacaaagagggaguccuccagggcagcgcugugggcucucaguauaggagagaauucucaagcaggaugcuucuuuuuugcccaggcuugcccagagccggcagcagcaacagaauguagaagaugcaaugaaggagaugcagaagccucuggcccgcuacauagaugaugaagaucuggaucggaugcugagagaacaagaaagagaaggggacccgauggccaacuuuauuaagaagaauaaagcuaaggagaacaagaauaagaaaggugagacuugggguugcuggagcuggaggugacugagaguugucagagggcugccccacacuacuguaaugcccuuguguuuggaaguuugaaucaaaauaauaggaacuuccaugaagaauuuucucccauagccaucuagcucugaauuaaauugugucaguagcuaauuucuuuuuucucauuccugucuuuagugaagccccgcuacagugguccugcuccuccucccaauagauucaacauuuggccuggguaucgcugggauggaguggacaggugagucuauuuccuauauuuuuguuuucucuucugccugaccuugacccuuucugguuuucguuuccuuuuuuuuuuucuuuuucuuuuuuauauuuauuuuuuccuacuuuuugagacagagucucacuuccuagcuaggcugacuccaacucgugcacuaccuccuaggucauggggauagagccugggggccacaguaggcuuuguccagagucuaaggucccuccacccuugcucucacucugcagucacagggaguagcaagcaacucgugcuucagcuccugagcucgguauuucaaggcuuggguuucucccaacuccuucccauaaacuuggaaaagcucaggaugagugacggacaagccccacuuuguuugccacauugcucaugcucaguauucuaaggguuagaggguggacaagggcuguggucuugagccuuuucuguguuguagguguuuuuguauguuuugggggagggggguuguuuguuuguuuuuuugagacaggguuucucuguauagcccuggcuguccuggaacucauucuguagaccaggcuggccucaaacucagaaaucugccugccucugccucugccaguacuugggauuaaaggcaugcgccacaacugccccgauuuugugguuuuuuuuaaaaaagauguauuuauuauuauaaauaaguaagcgccagaagagggcaucagaucucauuaagggugguugugagccaccaugugguuucugggauuugaacucaggacuuuugguagagcagucagugcucuuaccugcugagccaucucuguguuaugucuuuaacauguuguguuugaacauuuaauucucuguaauucugggagggagccccggguaauguuccagucuugcccccucaucugguuacuggccagcgucucagaguguacucgggcuuccugacugaugggauggcuucugccaguugucgcagaucccaucucccuuuguccacauggaacaugagcguguagugugaggguucuccgaguuuucaaucucaagaccccuugauacucuguguuacugagauugcucugugggcaaaggcgcuugcugcuaagacuaaugaugugaguucaagucuugauacccauauagcaggagagaacugccucuugcaaauuguucucugaccuccacacacucauuugaaugugugcgugcgugcgugugugugugugugugugugugugugcgugugugugcgugugugugugugugugugcgugugugcgugcgugcgugcgugcgugugugugugcgugugugugcgugcgugugugugcgugcgugugugcgugcgugcgugugcgugugcgugugcgugugcgugugugugugugccucuguaaacaaauagaauuuuuaaagaagcuuuuggagaccccaagaagcuuuuguuuauguuuauuauacauuuauaguuacuauauuaaaaauuaaaagagcauuuauucacuauauagaauaaaccauuauauacuaauauaauuaccacuauuuuuaacgaaaacuaauuauuaaaaaaacaaaaauaauuuuaauugcaaauaacauuaaugacuagacuaauaguagacagcuggguucugaauuugucuauugugaaguguugagcugaaaugcaggaggagaacccagccugccaugucaccagcagaagaggaagguguggcacacagaagagcugucuccuucaaggcuguuguguggucuguagccauggagagaacuauugauccuuuugcauuacaauuuauaaucuuuguggguuuuuuuccuuugagacaggucucucuaguaguccuggcucaccuggaacucccuauauagacaggcuggccuuggacucagaucuaccuaccaaguucugggauuaaagacaugugccgccaugccugcacaauucaugaucauuuucuuccucuuuauuuuuuaugucuggguguuuugccuacauggaagucuguucaggaaguaaucuuggcagccagaagggguugucagauuccucaagacgggaauuacagauaggugcuaggaauugaacccagguccucuggaagagcagcuccugagccaucuuuccagucauggucuuuauuauucuuuacaucuuuuaccagugcacacuugaaucauauguuggucauuuguaacuuacagguuggcugaguuuuacacaccuuccaaaugcugacguuuuuauuauacaccaucagaaaauuacuugagugguagauugagaaaguucucuaaauacauguagaauauuuucccauucuuuugauucucccuagugacugaugcccuuaauauacauucagcaauuacuugggaugauggugcuuuauaaaacucuguuaggcuaagguggcuugagaguuuacagaacuguccugauaccuuaguuguuuucucucaguugcuguuaugucucagcugcguuggguccagaauucccaucugauggcuugcaugucugcacugagauuucccaucugcucacccauuuagagacuguuuucucauuuuggaaaauauuuauaaaugguguuuugaaguuuugucugcugauuacaacauucugcucaccacagacuugcuuuuuguuaauaaccuguccccugccuccccucucuuugggggacggacagggucucacucuguaggccagucugauuuagagcuggcuauguagcccaaacugaucucaaacucagaccuuccuaccauagcuuccugacuguugagauuaugugugacugacacuguaacuggcuaacuuuuuuugaguacauguuauuuuccguuuccaguuggcuuauuuguuaggucuuuuauuuaugaggaauacauaguggagcuuuggcuccugcugcguuucucugcugauuuuugucuggaguuuuacucuacacugaacccgucucccuugcagugggcagcagcuaacaucucggcucaggucuugccucuggcugcugcacucugacagggcugcuacagguccucugcauauacauagugagucaccaaagcuuggugugaccuuugcuguacauaaccagugucucucucccaggacuucuccuuaauuuuguagccacucuucccacugccacuaauaccucaagccagucagccugugguucugccuguggccuacuugagcuguguggaccgagaacguacccucuggcuaacccccuccuauugggauguuucuuucugcuuuagcgcucacacaugccuuaaaccacuacuuauuuugcucagguuuuauaauugcuauuugagugucagaauccacuuugcacuugcgccagccuaaggcguugucuucuguccuucaggcugcuucuggaaucugacucuaguucuuccugaggucaaggagggacugcaguugcaggcuggcuggcugcugugcuugcuggucacccugcagaaucuuuggcaggagaauuucccugaacucgcacuugcuccauagccgcagguggaucuugucauagccgugccugcugcaccgugccuguugcacugugccugcugcgcucuucauuucuuuggcugucuuuggagcccuaaauacgcgcacacacacacacacacacacacacacacacaugcgcgcgcgcgcgcaguguuuugucucaaaggaaaauaaauauaaaauaauaaauaguaaaaaaggaagggguggcuuuuuggagagagaaaaggguugggguaaggggaaggaauuugaaguuugugguccacucaccauguacuugaaccucauccagaauuggcuuccauaaugaccuguuccuguucucgguccugucuuggccccugugaguguccuuucucuguuaaccuucaguggucuucaguucuccuucuggaaccccucccugcucucacuccugcuccuuccgguugccucuuuucugagccaggccuucagccacugucuguguguggguccagauaugucauaguccgauccucugcccuugugcacuugaggugccucaggcgcagucacacaugcaaagcauacccgccugcagguggcaucuucacucaucugcucucucagguuacugacccaggcugugacuagucagucacccaguccuacugcucuuuccucucgacggccccuguugccaucccuaccuggcaucacugccuucaucuguugucaggccgcugugcuagcuuucuuacugcacaucucuagagaugucugaaaugcaguuuuaaguccaucuuucugggaugaaauuuguauuuguuuguuuuuacaguuugucuaagcucacagggauuuggccucuaccugucuuuccaguguugacuuguggcuacaccauuugucacacucuaggcucugcccaugccagugaccccccgaccccacacacacacccgucaccccuuucgaagaccagggcucuuuuuucugugccugcggguuugcugcugcuuucaggcauagcuuggggcuacucccacaaaggcccuugcuuaguccuucaucugauauuuccccacccccacuucuguuucuuugauaucccacacauguuucuaacaguuuuuccuuuuauuuauuuauuuauuuuuuuaauuuaauucuuccauuuuguuugucuuuauggguguuuuagcuugcuuaguccuucaucugauauuuccccacccccacuucuguuucuuugauaucccacacauguuucuaacaguuuuuccuuuuauuugguuuuuuuuuuuuuuuuuuuaauuuaacucuuccauuuuguuuguuuuuauggguguuuuagcuuugugucugugcaccacccucagggcagcaguagcuuuggauucccugggacuagaguuacagaugguagugagcugacauacgggcuuuccagaggaaccccaguguucuuaacugcugagccaucucuucagucgcaguugugugucugugugucaguagugucuauaauccagaagagggucuuggguccccuggcgcuagaguuaaaggugauugugagccuauccaaugguaccagggguucacauuuuggguuugcaagagcaacaaaugcuuuuaacacccgagccacguuuucagcccuggcuuuugcuuuuuaguuaaaugucugugucgcuugucugaguucaucagcacagguauugugcaguucauuuuccugcccugauucuuccguagcacccggauguccagugagaacucaguacuuauguaaccaacgguuaaauugagccuguggguaucggccacaagugaguugugcuuugguuuugcaccguguguugagcucauagccugguaggggcucugccauugccacugaguuaggucccuucaguuuacuacuuauuuugaggcaaaacuucgugaaguuguccagcuuaaccaugaacuuaacuccgcagcccaugcaggccaggccgagcuguguugaaucuuuguagagaauaauaaagguuugaaauaguugucuaagcgucugauaguuguccguaagucugaaccgggacugagaagaggguuaauuuguguguuuuguugcuuugacuuuuuagcauaugguuuaaauauuuuccuauaaauagcuuuccuuuuuguuuguuuguuugagacaggguuucucuguguagcucuggcaguucuggaacucucuauaguccagacuggccucugccugccucugccucuugauugcuggagucaaagauaugugccaccaccaccuggcuuccuuccuuuuaaaguaaacguugagaguuuuggcugacuagaauuucucuuuugauugcagauccaauggcuuugaacagaagcgcuuugccaggcucgccagcaagaaggcuguggaggagcuugccuacaaguggaguguggaggauaugugacaccaccccccccccaggccaugugaccccugaggccaugugaugcuguggugcuguuagcaccagcucacauccagcucuaaaggaguccugcuaagagacgcagaccagcaaguugcugucagccugaccuuuggacaggcaccuaaccuggcugugcccucacugucuguggcuggcuugggcaggacacggugacuucuuuaucccaggguuuguucuuggccaguguuuuccuuuuucuuaaaaauaaacacauauuuauuuuuuuauaaucauuuccuaacuggguauucugcuugggaagaauuccagcuguaugaaauuucugggugucucgggaguauugagugauugcaguuuucauuaauuuaccuguguggguaaaaguguucugugaaaaucagaauuugguguuaaaccaaguucaggaauauuggacuguaugugugauaagguaguguuacauguuagugggaaagguggccgcugaggcucagaaaauuagguuauauggacaaaaaugaagaaggccccugucucauaccacaucagcaguccugaagcaauuaaggacccaggugaacuguacagcgaagcuagaguguggcucagaugggcucugggcuucugagcucaaacagguaguaaagcccggugggagcaaugacggcuguacagugugagg

SEQ ID NO: 5079 - RNA, 3235 nt, Mus musculus
gaugggugucgugcugugucucacaggcuuccgaccccgccaggguacggcaagagaaugaccuuuuugccauucaaaucucucuugcauuucagcccugacuuuucagcuccugaccgggccuaucagcagccuccuaauucgaucacugcucacuccaggaaacagucaccaggaaggagguccggcgcaggcgggaagcagcggccgcgcagugcccuggugcugugaacuuccccuggcucgccagagcccugcaaaaauaaaucuccggagaaauagauuuugaagaggaauucggcacauagaucuucugucagcggagcagacucugccucagccguuuuucaggcucgcugaguauccagaaauacaucuauuuuuacauggcucucuagcgagaguuccucuugccuggagggguaagaggccguggaaggagucagaggaugggagaggagaggggugcgggcacugacuggagaaggacagggaggugaccgugcagugcuggucuucccgguuuuccugcauccugcaggaccuuggguuugccaaccaaguuuggguuugccucgucgcuaugaaggcucugugugucccuuggcccaccggacccaucuuaguaacaggccugauguccccggagaagacaauacacuacggcaguuuggcgcgcgcgcgcacaaagagcugcagcaccgcccggggcucacuguuuuguucucggccuagcugucgcggugaacagcaggagccauggaccagauggcuggagggaggugcgagcggaucgcacuggcaggcaauuaggccucaaacaauggcccgugaaaugucagaaguggcaaggaagggucgugguggaacagcgggaugacaacguaaggauggcgccaggaaccccggagacaguuccugcuugcucccacaggccccucuggcagagggaacacucaaugacccuucuccccaaugcccacgcagacuccucugaagauaaagaaaaggcugaggggaagcuauagugcagauggugagccccagguguagaucgggucaguagaugcuggcaccaaauaaaaccugucaugacgauacacacaugcgaucccagcacuuaaagaggcgggaggaggaucaggaguucaagaucauccauggccacauguauagugaguucgaaggcagccuuagauauaggugacuucaaaagggggcgugggagagagcgaaagaaccgggggggggggggauugaaagagaaacaggagaaggaaacagugcuggagaaggagcaaugagagaagacagggaagggaggugaggagagagaguguggagaggagaggaguaggaaccgccccucccgguggcugccagcaaccacgagaaccccacacccacuagaugcugggguuaaagugaggcuaagagauggcgacacccacccccuuggccaccacaacuaagaauuauguagaguaauuaaucaagagcuaaugagaaauguguuuucucucgcagccuagccccacaucauauucuuauuagcggagguuauuacaauaguaaucagcgugcuccaggcgcaaauuggguuuuuugcuccacugccaccaauuuagaaaaccauuaauggcaagauaaggcccccguggcucacaccgggccaagccugggaaccugcagccaacucucugcucaugaaccuacacgcccaugcuccagggggcgcucgagcaagcauccuggcucuucugggacgacagagaagaaaaagccaaccgcuuucuaggaggugcuguaccugcgggaccauagaacuuucucaaaugugaauccuauacaacagucacuuggaugagacaaccucauggaacaaaacauuaaagccaaguuugccacuagagccagagcgccauauacugugcccuugaguccugcuucaagccagucugcuagaaacgcuuaggugaaucuauagcucuuaggcaggagguugcgaucagacacaagcccuggaacaaguuucuaucagugaaaagaguggagaguuaagaguuugggguuuuucuuauaauaauaauaauaauaauaauaauaauaauaauagccgggcgugguagugcacaccuuuaaucccagcacuugggaggcagaggcaggcgaauuucugaguucgaggccagccuggucuacagagugaguuccaggacagccaggacuauacagagaaacccugucucgaaaaaccaaaaccaaaacaaauaauaauaauaauaaaaaaacuuguuauuuacuuauuuguguguauaccacagcacucgcaugaagaucagaggacuucucuccuuccaccaugaggggccaagagauugaacucacguugucaggguuuggaggcaagaaccgucauguuuggcagcaaagaccucuaccuacugagccgucaccauagcccugcugagauaguuucauaacgauaaaugcacucuacuuuuugaugauguucucaguuccaaaauugucucccugugugcgugugugugcgcaugugugugcgcaugugugugcguauguguguguguguguguguauguguacuuacucauaugucuuuuuauguacaaaagauagguuccuucauguauaguuggagaagggcugggugaucugacugggaggaaaagaaagaaaaccaggagucacgucucuucugcccccuugugggauccuggaucaaacucagguugucaggacugcauggcagggucuacuugcugagcugccucaccaguccccuuuccuuuuucaacauguagaggccaaguaugucccugguucuacacagcagacaaagaguuaagaagcaacagcuauacugcaguuaaguccugccuuuuguuuguuugguugguugguuugguuuugguuugagacagccuuucucucuguagcccuggcuauccugaaacucacucuguagaccaggcuggcuuugaacucacagagauccagcugccacugccuccugagugcugggauuaaagaugugcaccaucaucacccagcuuagucauuucuaccggucacuauuauuuaguuaguguuacuuaguuccuugaauauguuguccacaaaaauucucucaaauaauuaacuacuucauccuguggaauaaaagauuugagugaggcagaccuaaguuugaagucugucuacuuaucacugg

SEQ ID NO: 5080 - RNA, 323221 nt, Mus musculus
uggcgcgggcgcgcggccgaacgcuagcgccagggggcggggugggggagggggcuaguucucggagagccggguugggcucgaggugccacgauuggucgcuccugacuccgccuccagcgcaucucauuagcaucucauuagcuguccgcucgggcucgggaggcagccaccgccgccagucugaggcaggugcccgacauggcgagugcugugcugccgagcggaucccagugugcggcggcagcggcuguggcggcggcggcggcgccuccagggcuccggcuccggcuccugcuguugcuccuuucggccgcggcacugauccccacagguagguugugggcacccgcggauuggucccgaaaacccccccgggcacccccaggagccguagcuauggaaggggggacguuuccaugacaaccuucccccacuuccuaaauccaaagcggcgggagcguggcaaggaaagucggggcugcgauggaaggggccgaggggucggcgccccuucucuccuauccgccggcugcggaugggcgcccucagggauggcugcacccacaccucuucuuccuggcguagcgcggggugcugaguggagugggcucggggccgggggcuagcgcguggggggaaggggagcccucggaggcgccccgaaccuuccggacccuccgaaacucgcucucgucccuggaacuugcagguccuccugugucccugggcuaagcuuucgcccccuccguuccagcucgcccccccgaucgauucuccauuccccgaagcuuucuccuucgcggguccccaggacauccccaccgucguguccucuucccggcuugcccgcgcucugcagccaggucccccgcccgagagcucugcacgccucucguguuucccuccagccgaacgcugccccucggcccccuccgcuaggcugcgggucggcuuggcuggaauccaggcagggaaaguucccggcucgggggcggccgcucgucgccgccgcugcaggagggcucuuggagcccgcagguuguccgcgccaccgaggccucugccgcgaguggggauccgggauuucccggcugcgcguccuucgggcaagcggcccgcaggugguggcgggggcguucgcggccucugcggcccggcgugcgcccugcgggccucggggcgcuccccgcguggccggccgucuugagaaucugcccggguggcggcggcucggcgagcgccgcgccuucccugaagacgccgagcgcuuggcaggagccccgcguguggcugccccggugcggggcgcguuggcgcggucgcgaaagaagagggcaguguuugcauuugcuaacaaaagggagccggagcucuuccccaccggagaggccggccgcgcugcgaccgccuucccgccaccucgccgcucuugcccgccgcacgguguccccgugcugcuguaccgccugccgcugccuccuggcgaccggcgggaccgagcugcaccgggcgguggcgagagggcuucugcgcgaggggaugcgcuagggcucugugccugcaaaaccccucgcagcuccgagcugcaggaccugggagcaacaagugguggaggaugcugcgagcucaucccccaccugcggagcccccagcccgggaggaugcagcgcugggccagccagccugcgguuccgggggcgccuuucugcuuggguugugucuuuuguuuacacgcuagaggacacauaguuauguaaacaccgcaggagacgugcuguuggggggugggugggggugcuugggagugcuagcuucggauuuuaggggaugccagguugguugauuugacacccccacccccauuauaaaauaggcuugcggaggaacucggcuugaagaaccaauugagguucuaagggugggauccuggcagcaccuuccauuccagcuugagaauuuugucuuccaugcuacguucugucuccggauguuuauauguuuuucuucugugaauucuuaauuuaugaguuacaagauaauuagguuuaaccgaagccggugugguuacaacuuaauuucuggugaugccacugacuggaaggguucgauagaguguucccgaaagagaucccucgugcugcauuguaaaaagcgccagugucaguuaaacgugagcgugaguaaaggcuggguaacuggcgcauuacagaggcaacaauagacuuguauuggcugcagaaccaagggugggggagggaagcgcuggcccgggauauugcuuuucgacuaaaaaugggagccaugcaaugccacuaaaccagcagaguaggauuagauucugccucccuugucaagccugcucauugaaggcucuggguaguaacaacacuacuauauuuguacuaucucuggaugagaaguugccuucccgacgagggaugugugcugacuuaggaacggucuggaacucaaccgugcaugucaaagcuacaagaaaauucuguugccaguuaccauggaagcagcuucuugcucuuguguacaucccuguuuguucgccgcuuaucagauuguguucaaauuagaaaguaauugggcuugauuuguagcgagggaaugagaugacuuucuuuaaugucgugagugugguguguguguauguauguuuauauguguguguauauguauguaugcacgcauggauguauguauguauacaguuugagagagagucuuagcaaagcccuagauuccaaaccacagggaucaauuucagguggacuccuuaggacuucuuucccucagauguuaaguuaaagcuuucucagggaaagcuuucucugcuucucauuccuugccuuuaaagaaaccuguuggugcuaccuucuaacuucauuacguuuguuucauucgaauccuugcugagcgagccaagucccgcuauuguguauuggguuccugguucuguuugccuuuguaacugaauucuuucucccuguuccccaucccucacccccaucucagagaaaaucuacucccaucucuccugugguguuuggaugaaacagaccuguaugaagugcauccaaaauaggauugccugcacguuguuaaucacuccugucagguuuagagugcaggcaugcugcuguuugggauccugaagggaccuguaguaguccaacccgcucuuacucuuuuuaggauuagagaagauggcugaugggugggggguuugugaagguggcaguuaguccuggcuugcuguagucgacuggggcuugcauaccggggacagggacuuugcaaaagugacgcccugcuauuguugccauuccugcauaaaauugaauagucacaguagggacuugcacuugccugugauagcuucgauaaaauaucccucauuaaugccacuuuauauuuacagugugucacuggagacgcacaaggcuucauuuagugacuugugugacgagacaagcuugcauuauuugccccggacauuuuggaggaacaagagacccauugagcaaucuuuugaaaugaacaaauacgaaaaaggggggaauaaaagagcaggcaguucucuggaacaaagagcuuuauucauauggauguuguacaugcuuuauccaguuuuccccaguggcuuuccuggugaagggguaucgggcagggaagaugauaacuuacagggcacuggggcuuccucucuuacuuccugacuuccuauucuuaccggaguuggucccuuacucacuaccugcaucucugucucuccacucccuccaaagccccaacggcucucucucagguuucaaaggagauuuuugaaaucuuugccgccauuguuggcucucaucugaagacacugcgugguagcuaccuguugagacugaucaacauuggacagugcacugggugaagggagagagaucucauuuuucuaggauaugugucaagauaaugaaugucagaacaauagguaaagauaucuugcaauuaugucagccuaacuguuuauuuuuaaggguguuuuaaaaaugaaaaucuagauuuaaaaaaaaaucaucauuaauggugcucuaggauuuuauuuuuaaacuuuaucccauaccugguacauuucagcuuuauacauaagagauuaauauuauuauugcaauucuucagccucuauuauugcuaagugauuuuuuuuucuuuaaaauuuauaguacuacuaugacaaucaguucuaugagacuuauugggccuguuuuuugugacauuuuaaagcuagccauauagaguuugcauugcauuuaaaauuuuuugagugugugugugugugugcgugcgugugugcgagcgugaacauuuaacaaaagggucauuuuuaugugaggguauuucuuagaaggggccaaacuaauugauacuguaguuugaauagaaauuggccacauaggaagaaaauuuaaaagaaagaaauccaaaggauuaaaaugcugcauaucuucuuuggaagacugcuacugaccauuaugcugggcauuuuuuaacacaaaauccagcacagaaaggagaaaucacacagcgacaucuguugcagaacugaaaauuugccgcuucgagauggaagcaauuagccccauguaagcaccuccuaguaucagagugugugugcguacugacacaaauaugaaccuguguacauucacauuccaacauacauguuauacagaagcuuacauauuuaaaguaaugcacuagaaaaugcaacauuagagugccgacaugcuuuaaaaaaugauagagauuuucaugaauauagaacuuuugacaaaagauaaccacgcucuuuuuaggcaauuccauugucuucaggugaagcuacugaagcccagcugaacggaggcugaguuagcuguagaucuugguuggagacaggucccuugauauccagccaguggaccuucuguucuuccuccuggcagggaugcccagagauauggaucaugggacaauacuuggcucaaacuauuuuguauucugaaggcagcgagauuaauuguuugcucuagguaauaagcccauggaucagaaggagugaccucugggaagaaaggaccagcucuugguaccuuugccuuugguguugacaaaugauucugcaaccucuggacuuuaucuggcagccacugcgcggaugucauccaaagggccuucauaugggagacugcaggucuguguugcuguagucagucacagaggcgaaagcuaaguuucaggaagcucaugcuuuguuuuuuaagauuucauuugucuuuucuuaagucuagaacaagagccuucuucgguuuucuuugcagguucuccuuugucauuugcagagaaaaagcuaaagggaaaaucuucuuuuucuuaaagggaaacauuuuuuuuuuuccaggauggcuuuuacauuggccuuauuuucucuccuuuccccugauuguggggaauuucaaguauucacaaaagcagaaagaacguccuauuaacucuacgugcagaccauccagugccaacacuuacccacccugccuucaucguuugccccucugugcuuccuauuucuccuggauuauuuuaacuaaaucuugggcauccuauaauuuuuccacaguuccuucagaaugaauuuccucacuuauaauuacaguaucauuaucugaauuauacagauucucagcuggauaugcagaaucuugccugcuccucuugccuuucugaggagcggaaugaaggguuggcucaguggguaaugaccaagcaggaacuagagaggcaaagugcaugccugcuugugccgaggagaccucuccugcgguuuaguuuauuuugagcaagguuuuguuuggaucggauaagaugaguuuauuguuguguagauaugguuguauaaauaugcaguaauuguggcuagucuucacuguggucugcacccuuggugaaauaguccauuuccaguccuucccauaaugauuacccuuuacccacagacuuuuguagggaaagcuuauuuuaguuugauggcuaugaggcaccccauauagaugugugugugugugugugcgcgcgcgcaugugcgugcccuccagugcuccaugguauaaaugauauugcauuuugugcauauauuccuuaacagaaaaaaugucuuuuuuccauuucuaacuggcuaaguguugauuugagucuguaacugaagugaugaaagucccuucuguggcaugagacacccaugcuguucacugugaguacucugggauuauucuuguggguuggggcugagggggaguaggggagagggagagaaaagguucuaacuuuacucucaauguuugcucccauucauuuaaaaaugauauuuaauauuucagcuggaaaugcuugauagccauauaguucauuucugaauuuuuuuuucuccaugaaaauaagcugguuugguuucccaacguuugugacaugugagguugcccauucuuccuccuucccuccccacaccccuuucuuauugauucauuuucauuaccaaaaaaagauuuacuuuauguauaugaauuuuugcuuacaugugugcuacgugcagcaagccugugcuuggugccuaccgaaguccgaagcgggcaucacuggaccuuagaacugguguuagugauggcugggcguugcuguguggaugcugggaacugaacccaggcugugugcaagagcaacaagugcucugaaccucugagccagcucuucagcuccuuucuuuugauuuuaacaaagcuccaucuugaagguuucauuucaugcagauacaaaucugaagcuuuuucuucguguucaagaagaacacgauucuucuuguuucugaacaagaaaugaugaacgacgagaugauauuaaggggucugugugucccuggcuaggggaaacccuggcuccugauuugaccauuggucaagaaauacaugaaggaguuuuucucuccagggcuuggggugucacacacacacacacacacacacacacacacacacacacauauacauauauaaucccuuugucugucuggaagccaucaaugaaggaaggaacccacuggaauguuuguaaucauaagugauaccuccuuguuggaauuuucagacgccgcaguuucuuuuucagauauuuaaauugcaggcucuaggcagcagcugcuguugggguuaaugcacacuuuuucuuucucucuuugaaggucuuccagugcucguccuccaaagccuugggucaguuguccauggaccaagggauagacaaaagggagauguagguauuuguguggccaaaaugaugcgcagcauugaagguuaugcauaagggaaacucgguguuaaagguugauaagagcagaugccaaaagagccuguguaugacucccggggaccuugaacaaagagguuaccucaaggaagagcugugguuggggauuuaaaaaaaaaucucuuuguagcugcugcacuggagucuaguucuugaacccaacauuuugcuguggguauuuccgaguguuaaguaagcuugcagugaaagugcuaugguacauacuuaaacacuccuugggguuugagguuccagugagcacugugggcuucugucagugcggagaguaagugccuugaucuuggcagaguucuuugggaagguagacuguuuaauucccucucagcucucuagcaccaccaaguuagaauuaaguuuugccaucccuggagagguggagaugcaucuuccggaaaacaaagggcucaccagcucucucugucccguugucugugccauguucuuacagggcugggauggcuuuuccgaaauggaccuuucuuuguugugugcugguuacagcuucccucgaagucuucuucauuauugggcacaguagcacuaucacccuagccccuguucauuguuauuauuguuugagacagugcuggcuaagagcuggcuguguagucagagaugauuuuuacccgcugagcacaagguuacagguguccgucagccguaccuugcuuauguggcucuggagacugagcugugcucagcaccaaaccuagggcuucaggcauuucaggcagguaccuuccuaaccaagcuccuuucccaacauugaaauuaaauacaccacaauuuacuuuuccuccgugacgcuuuagaaacuuagugcccagcaugugcuguguuuuuucaguagaaggugccuagccacuccccucccucuccucagagcuagcuugagucugucuguccgcugcaguuggaauuccucucaggacagcaucauggagcuucccuuucagaagccuacucucaaauucuuguuuucuugcuucaaauucagucucugagcugcuugucuuucggcgguuccuuccuccguugcucucucguuuccucucuaauugccuucauuucuuauuacuuuucagcccaacccugaugggacuggaagacugaugacucugcaaugaacccgaggaagagagugguucugcccaucagcuuccgcuggucgccauggcauagaacgggccugcuuuuccuuuaacugucugucuuggcucauaggugaaggauggcugucucuccucagcuccuuggagaguagauaccuuucccuuuugacuuucauuuuacccagccugcacuucucuaaagaaggcuucccugagggccuuucuuucucuguuuuacagguguguggggggccguguuucuuuaugccaauuagagauugugacauaaguugucaguaucgcggucauaaauucucauggaauguuugagcuucagaacguugagaacacauuguggccuuuugguggaaccuguuugaaugcugugcuuuauucuagccuaaagacaaacgguguaagugacuuaaauuacagucugucaaaguaacacuuugagcccccaagugaaguuuucaaaggaggaccgucucucaagggugagaaagcaaaaucaaaggacuguuguguagaucuccuggcuugguaugagaucagccgcugugaaggugauccgggaaaugccaccuugcagauggcaucuugaugcuuacaucuggugcacguagcuaccaggaaaaacccaccuaagaggcggcagaagagugcucccuggccucugucaguuaguguucaaacuuagucaguuugggaguagggcuguugaacucaacacagucgugccagcuuuuuuuuuuuuuuuuuuuuuuuuuuugguagauaauaauagaggacaaguuaucauuggcucaauaaacaaaaccauggaguucuuguuucucggucucacuguugaacuugcugucugagggguccuuuuggaggaucugguauugccaucugccgcccuccgugccuuugguuuuccuugucugguacaguucuugcugguacagaaaggcuagcacugcagugauacaguggugcgaccuuucauugucuuccggcgcuugaggagucuugagggucagacgguguuuguguauuuggcucuuugccgccucugccuguguuaagucaagccgcccaguccuugcacaucaucagcuccauucuucugaauaaaacaggagcaucgccucauuucucuugcagaaacccuuauuuaaacaaugaaaacuuuaacgauagggagaaaaaaaaccccaaguuaauuuagaacuaaauuacugcucaaaugguuuuaucucuuaaaagguucaaguagagauuagcuuaaauggcacccacuuucacucuugcuuaugccuaucuugugagcgagcauccuugucaagagcccccuggccccugucuccagcuuuguuagcgaucaugagaguguuagcugcuggugugcuguuugcuccuggagccgaucucuccauccaugggccagguuggcaaguggaagccuugcuuccacuuccacagagggagcaugaagaagagcaaagcagcagaccacgcacagagggauguguacgccggaaggauccaugucuguccaucucuuuauuaaaauaucuaccuaguggcguugggugaugucuccuaaugcauacucaccuguaaaucccuuacaugugaggccguauugaaaaaguauguugaaaggauuaauucaagauguucucagucugcuuugagaagugaaggaaacaagugaguggaaucgcguaacaucagagaaacagcgugaucauaaucuaauugucgggccuuuaaacacagacguuauuauuuuaaucaaccucuuauauuguauuugcuauauugaauaaagacaugguauugcuagcccauaaggcagcugguagagaagaacaaacauuugauuuaugaagugauuauucauuugaguaucuguuauaugccagagacuguugggcauauuucucucuuucaagaagguaguuagaugugcuuuuugauauauuuuuuuuuucucucaccagguuugguuuuguuuuguuuguuuguuuuuuuuuuuugaaaauuuaaaaaucucagguaacuugaaaucagaguacaaugacgaugcauauuuguuucuacuuuagagcucucaacuguuaacuuuugaccauuuguauuauugccauaucccuaaauaauauguaaacauauauucccaguuuuucucuuucugaaccucaggaaaaugaauaacagguaugauaugugacucuugaauauucgucauuucugagaauaagguuauuucauguucagucuccaaaaugauacuaugcaauugacauacaucuacuauuaucuaguaucuaggucauagucuuuguuccaucagcccauuaacguugcuuuauccugcccaguauagaucuugaagucaccaacacacacacacacuggauuuaguuuucacaucucugggaucuuucaguguaaaaccauuucccuacuguccacccuuuucuuuuuucuaucaucaugauccucauuauuuugugguucuagguauuaaccagagagcuuccugcaugguggacuagugcuuuauuacugggaugcuccucccauuccauugaaaggauuuuuuuuuuuucacaauagaggugucuuucauggcccugccauuuugagucuagauaugccguuuucuagcauguucugugguggcaccuuuccuccugguuuggcucagauuaagcgucuuuggugauaauacuagauagcugaacugauguugucaucuuguagcuccuuaucagguuuccccuugauccugggugaagauaccaaguuaaccacuuaguuuagcuagaucacacguuucuccauugcugcccuuuuguaauuaaugaagaaguaagucugagggauaaucuugagaaugcugguccuuuucucuuacugcacuuacggaguuaacggggcgacagcacagauugugucaaaugccuaccagagcuaccgaccuggccuucuccaguucugggauucgaauauuagguggaggcauugcuguguugacaagagcuuguuucucaccacuccuuuuuugauggauuuuaaaaaauagaaauucagugugauuugacaguagcucauucgcaucaaagguggcccauugagagcaucuuuaaacucugcugucucacuuccauguagccuugcuaguuaagauucuuuguuacauguauuuauuuuggguaugugaguccacaugugccuguguguccgugugcgugcaugcucuaguguguguguguuggucagaggacaguguggaggaaaugguucucucuugccggaggaucuuggggacugaacucagguuauaggcaccuuuacucacugagccaucuugucgcccguucuuccaaguacuuucucacuacaccaucagcucuaggcuaaccuuaaguggauucuaccccggaacugcaucuaguuauuucuccaaggaaucccguuuccuguuuguggaggaaugcucaguaaauagagaguuguacuaaucagauuuguguugucccugggcagagguaggacuuuuguaaccuccuccacccccccccccccacagugcauacaugccugcuaccuggccugucugucuaaggucuguucagcucagucauggcauguaacauggaugcuuucugcucuagccuggcauccaaguugucuuucuccaucucccauuccuuccuuacauccuccaucccaggggagaacccugggucucagcuccauccuuaucuuauaacuaauauggaaggauuuuuacauuacuucaccaagaccacuguggaccaugaucuuagcaaguaaaucgcaguucuccccucccucccucccucccuguucuuguuaucuuuaaaaagauccuacuuguccuggcaguggugagaggcagagguagguggaucucugaguucgaggccaccugcucuacaguuccaggacagccaggguuacauacucccuucauccauccccccaaaagccaaaacagcucucuugucugucugucugucucucucucugucugugugagggggaggguugauuuuguagauauauuuuuuggguacauaaaucagccaucuagcuaaaaaaaucccccacuuuuucugcuucuuuaaaaauaaaaccaucuuccaauuuuauuuuuauugugcuuccuauuuuuuuaaagggguacuauuacucuuuuaagauuguguuagagaucuccguauuuucuuuauucgacccacccuggcugcuucccauuuauuuaaaugaccuccugucauucagcuuuguucuaguaaccaagaaagcuuuuucuuggguggaauucuguauauauauuuuaauuuuccaauuuauuucaacaaggaccaccuuuccauacugauacaaugugugucugguauuuaucguuuucuggaauauacagucuuugacugcguuuuacuuagcuuuugacaaucauuugagaaaugcuucuccccucugauaaguuggauaauuacagcacaagcuccaacucuucuuucuuuuuauuauuauuauuuuuuaaggagggucuugaaauuccgcccagccuggccuugagcuggaggugguccucugcuucuguuuccuggaauuacaggaguauaccaccacauccaaaucuacuuaaaacaaacccaaaaccaaccaaaaaacauauuauagccuacucuaaagugugcaguguauaaccaagguaacccuuguauuuaagucucagaccauguuuuaaagaaacaaggacagaagccugccuguuggaaaucuccauugccgugucugcaccaucccaaaggauaugaagcgagaacagccagucuucguugcuaucugcugcaagcucacuuguucucacugucacucugaaaguacuuacuccuguugauuucuuuuacagguaggaacugagagcaggaggagagaagaagcacaaacagcagauagcagaccaggacacaaacuaaaucaaccuuccagcucuauaauuuuaaacauauaauuaugugguuuucaaaccguaaugucuacagccaagccucccgcuuaucccuuccucuacccuggaugucccugugaagaaucuugcucucauccacccuggaguuugacuggguguggccucagagugucacugucuccuucaccaucuucuucccucuaaugguuucuaagucccucccagcuucauuuugcagccgaagaaaguagauuuaaguugguauuacggugccuuaauugguccauuugcuuguagccuccuccccugcaacgcaucuuugauucuguuucuagguggauugcaucuuugauucuguuucuaggcugauugucacuuucuagcuuaacccuaccagaccugagccccugacuggccuccugagcaaaaugugaagcagcauugauccauucccuagcacugaguacacagcacucagacauccacguccuucccgcacucggucugguaggguuaagauccuuaaauguguucucaauacuuuuaagacagggcuugcucauucccggaggccugcagugucuuuugucaccucccgucugucuucugcucucaccuccucccagcccgcccuccgcacauggaccacagaaguaagggcauuccuauugcuccaggaccgcucuugcuuggugugcauuaucagucucugcugacuccugugaccugagacuucagcucagcacuggcuguugaaggaaccuucccugacggcucggcuugguuagguuguaguuuguaguucuccuuuguacuucuuguacuucgcuuggggauuacuuuacuuuccuaacuuggcuugcucccgccccccccccccccccaucaucagacauccuucuuggaagccagccuccuguacguacuugcugcguguuugguuuuucuccggcuucuuuccuuuuccugccucaggguuagcaaauuuaaaugacaaccagaauggcccaagucugcuguuuucuuuuucaggucuuaccuaauuuccuaggcagauuauaguauuguccuugccaccucucucuacugaagccucucugguuuuuccaugcugguugguguuuuacuuucucaugugucagcguguguccacguguagugggugggcgugucugugucuugagucgcaggaugauuucuuauuugcauugauaacaacacuggacacacaggcuugugcguaacacacagucagugaggaugaauuggauauuaggugccuguuacaacuuuucuaaauccuuuaagaaugcacaugaacaggggacacaaugacacuaguucagaguagaagaccaacuugaaagugaaccaguccgaagugugcuuuuauucgccaguuuccuguuacacaauugaauuuccaauagguguguguccuauccuuuuuccuucgugaauucuccuaguugggauagaagauguguaccaggcuuccucugugaguuuaccguaaaggcugucagaucacagcuucuagggcuguaagucucgaaaguuugauuuuucucuccucguggaugaagaacugaagaaugccuggccauucugaagcucaaaggagcagcuucugguguuuguuuguacuuggugggcaaucacuggagagauuuagacucccagcccagauaagagacucuauucccauuuauuuagucacuccacaguccugggauagcuggacuuugagucauugcuagguuguaacggcaaaaccaagaaacuuaucucagaggucaucuccuccuacuccugucggcuuucagaagaaucuugucuuaaaacugagauauagccucgaaagagguggcgaacauagggaaauuuaaaccucaggguaacaauuuucccuguacgguaauaaagauguauguggagucaguggcugcagaaucaaaaaauagaucacaguaaucggaucacacaugagaaauggcuuguugcugugcuuaaaaacaugggcaaggcagcacguucgucuggagcccuuuccacugugugacugcaucguugguaggaauuaagaccgagacaaagugaagcuuauaaaguuaauugccuacaacuggucucgguuuaagcagagagauuuccuuucagucgccguggaagacgggagucugcacaggaagagagcagagggcuuuccguguuaccuugugauucagggguuguuuggaguuuggucuuugccuugaauguagagguggaaccacacuaacuggaguuuauugcuguaauauuuuuaaaaguauauuuguaacgcugauguacugugaccuugugcggguguuggagaggaggggguggccagcccucuuccucacugucagaagugaugcgcuugcuggcuccccgucccggcaggcuggggaaggggaggauuuguuuuuuaugacuucuuucuccagcacugucuucauaguuacagccauccauccagguuccucuccccugccugaggcuugcauccagccuagucuggaucuggugcuuuaaguacguugagugauggggaucguagcauuuuuacggaugcuucuccuguagcucuguggguuacacggcuuguguugccuaggcauugugaguggauuacacaaugagcuguggcuuggagcggagugacacuuucccuuuaguucucucucuaccacgugccaggcucuccuccguagauguuuuuuucaguauugcccuuuugagaaaucuuuuaaguugaaggcauuaaaccuucuuuuucuuaccauaauucuucaaagacauauccuuaucaauaugaccuacugucaaguuaauaacgauuugauggcaauauccaagagaaaugacaccuuuguaauacaaauuuggccaguguauuaaugcaugguauauggcugguauuauccaagaagaaaagccgaguucaucaguuugaguuucuccuggaauuagguggugaaugcuucaaguauccuauuuuaaaacaauugcaucuagauucugccugcaggauugcuuauuucauuauucuggucauuugcaugaaaacaaguugaugauuccuuaaauaaccugucgguucgguuuucuuuucacccaggauuguuauuccucaagugcccucauccagucaugcaggagcaggaacucaaucaaaaaacuuugaaauuuagaguaagguaguaacagacuuuuucuucauuuauuuuuuggccaaaaaaugaucucccauuuucauauuaauuuaccuaugauuuacaccucuguccucccuucagcagcugggagcauacagagauauauuuuaauagaacauuucccaaaguuuuaggcaucuaaaaaaugaggucaucaucuucaagauuuuggccugaacaucucaugaaggaagggagcgugaaaggagacguaggaagggguccuaguauguaauauccucauaauggaauaacgaucaaagcgaaauuccuuuuucaacauuugucuggagcaaaguaauuugauuuccgaaggagaagcccucuguuucuguaugugucagguacuuccuggagaaagugugcuuugcuuuuuacuuguuugucuuguuuuauuuuaguuuaaaguuucuuaccaguggcuuaaacaaaaggaugcuuuuacauucaaaacagcaggccagagagcggagcugugugcuggcaaucaugcugucuaggcuguccccuauagguagugaugaggagugugugucugucuggcauuuucuuucuuccuauuugcuuugggcucccacgagauguugcuguggcugcagcagagagcuggaggaguugagcuuuuccuucacuuggcauaugggacuucccaucaggaggaaacuaguugggaguaggguugucucaaaggcuuugcauugaaaugaaguucugaaagugcaagagacacuuagaaagagagacgcuuaaggaagacuaugugacuaaaggcuuauggguagaaaagugaaaauggcuagugagaaaugggauuagcaaaagauaagguaggguguggaaaaccuuggagucugaguuuagauuaaacuucggcagccauuuggagcuaaugaaagcuuuuugaauagugaaguaaaaacaaguuucauuuaggauguggaucugagagugauuagaaacccagagauuugauuagaaacugagcacuagguugggggauaauaguuuaauccuaaugaaggcuugaaguggggcagugcucagagaggcagagcugacuggauucggggccugagugggaaguagggauagagaaaacauaaagagcagaagugaagguggacugugggucugcaucugcgugacugggaaaauggcuguuccgauuaagacagaaaaaugugagauguugagguuaguaaguuuggcuugaagacauuagcuaagcuguuacggacuccaggagaaauguuuagagagcaguuugaaaauaagguucuuauuggaguuggagagaauuugagaguagaguuggagauguggauuugaaaaacuaaacugcaaagaaauuuauuaacuauuccaaugugcauaaaauaauguuagauguuauagauagggcaggaguguucaagugagccugaaggaggaugguguguugaggacaagaagaaggaggagggggaggaggcuugguugacaacagaaaggaccuguugcggaagggaggacugaggggagguggguggggcucgcugagauggaagugucuuugcuaaagugccgggaguuaugcagguuagugccauggaagagaaggcgucaccggagagaaauguguugucuggaauguaaaggaccacuggagaaggcuguauaaaggaauaaaaugagaccugagugccuuagcauacaguucagguauggcaaagccagaaaaaaaccaacaaccgaccaaagcaaacagaaagccugccccgccuaucugugccaccgaagugccguaagguuccuuagguuguggcguugagugaagaccgaauugugacgcucacaacugcauguuguguggugaaugauagcuuuggcaggaauagcauggagggcggguggcuggaaacuuuguagaaacgugcugcuuuaacaaccucaaccagagaacagaacauaucgcacuguagcuuggaagugccuuucaccguggcaggggguuuugucauuagccacagcucccauucuuuagguagauuagugucugcaacucuaguuuucggcuccugcagaagugggaaagauggcucccaucucagugcguuuuguugcggugacaguacccaaagcuggguaauuuguaaagaaaagagauuuauuuugacucaugguucugaaaggccaaaaacacggugcuggcaacuguccagcuucuggugcacacuucauugcuggcaaggcccacagucacacuagaaggagguaaacacaugagguaagaaugcuuuaaaauagcuaauucuccugagaugugauccauucaugagagaaccaaucuggcuggugaggaaagacaucagugucuguggaagauucugacucccaagaccauuaugucgaccagccauuuuaaauauaaacuuugguggugagaaucauuuccaagccauagcagguccuuaguacaugcauugaauuggcacuuuggagcaguuuaaucuacaguugaguagggagauguagcaacaugccaacuuguagacugaacuuccuaauucgucuucguacauuauacagcagcagggcuggagacauagccuagcaguucagagcacuuaguguucuuccagaggacccaaguucgguucccagcacccacuucaaagaagcucaaaacagccuggagcucugguuccagaucagucacugcuggccuccgagggcaccuugcccccacauacacacaguuaaauaguacaacuaaaccugacucccuuuagggugugucuggucgacaaguggcuucauucagcagcagaacuccagaaccugcaggcuaaucuugccuuuuuuggcuaugccucuccagugcuguucuauggagcauucuaugaugguggacacaucccccugucugugcaguguagugagccacugcuagugccccauaacuguaaaguacugaaaacgggcuuauuugcauuuaauuuuaauauagaccugaauaaccacaucaugucaccauacuugacaaaacuuccccuccccucaaauaaaaagcaacaacaauacaaaaaacaaaacaaaacaaaacagacgggaaggguuugguaaaggcuguguuguaccgaggucacuccaaauuuagugggucucauugaaggguggguucagccacugugggcauaugaaacugaauuuucucguucuguugcuuuuuagaucaaaaagccucuggaauaucuucauuguccuuucuucauuugaaaaauuauccuuuuuagccuuaagagggguguaggucauccgguuccuggauuaacagcgucagcugugucauuaggaagcuuggcuuggaaggucacuguuacgugacugugugaccaugugucaguucacaguguggguuucccccuuuccuguccuuuuuuuuuuuuuuuuuauggugcugaaagugagugaaauguggaagaaacauuauucauuuuaaauaguuuugacugccagguuaaugcgacucuuaagcggagcuucaugaggucuggccguaguaacugcuuuuaacuugauuuaaaguucuuaaacauucugaauugccucaccuaaucuuuuuauacugaacguacaauuuucaggcucuuuuuuauuuucaaauccauaacugacagcugcucaacaccucauucaaauaguuuuaagaguuuuagagaaaaguugggaccgucuggauuuacugacaucaguuggauugagauaucauggauuuaaagaugauagagagggagagagagagagaaaaguaggaaauaauuauugcguguucacugcuugcccaaugacagggauuuggaaucuaauaacugagagacccaagaagagcagaaggacauuugagcaaacuuucaaaucuuaaccucaaaagggaaaauuccauggaagaacauaauuugccugaaguacugcuuguuuuauuacguucaaaccuugaauauuaagggagguauggauuccaaaucucgggagcgcccucucauuuccccccuggcauguagcucacagacucccaguuaauucuuugggggauucugugggauccagugcauagcguguauuucccagaugaaauuaagcauuggagaggaugacaucagagcagggucuucuaccuuuguucccgcucaccaagggacuugcagcucaacccagugaacuuggaggagcucuggagugugcuguuugucuaagauuuaaaacaaacaugacacuuaauuuuguccuuuucuaauuugcuuuaagugcuaugugugugugcugugugugugcucugugugugugugugauuuacuguguacuguauauaauguugaggacuagcugugcaaagauuaauuguauggaaucuauuccaugcagaggcucacacuuuggacucuuguguacuaauagcccugugugcucagaagcacaaggcugaagagcacaguggagguauacauagggcagggcuaucuaccugaggauggagauuuagccagggaagacuuucagaaagacucagauaggguaguauagcuuggaguuuucuagguuagagguguuauguggaaaaccuuggaaacauaaaaggcccggggaugcuggaagcuguguggacuuuguuguuuuuaaaugauuagauuaagagucuggggagcagugacuagggagcaacagaaugaggcugcugagggagccacacaagggcacauagucgucagaauggcaaacucaacaggcacggguuuguuuuaaucaccaacuacaaacucgauaggcgugguuuugcuuugggguguuuauuccaugcgauaccuguaugggagcuagagguauagacuagauagcgagauuagugaccagaaauagguuaacaguugcaagaggccagggaagaucaggugaaauucugagagccuuggccaaggcacuggcugugcagguuagaaggaaguuggugugugugugggaaaguuggcuuggcuggugaagucagucuaggaaaaugaagcagaaucaaggacugauggaggaugaaggggagcuucgugcguuuuucaaaccagggagaccccaucacauuggagguaccacagcaggagaugggaaguaagaagaagggaguugguuaaucagacucacaagcgcccagaugagacucggaaaggacaucugcuuaagggaccugagccucauuuauugauugguugauugaaaugaggguaauggggaagacccagaauuguggauggagguaagauuguccagugcuaaugauucaggggaaagaggaccugucagguaauguagggguuugucucaccggagaugugacaggguguagaguucagcugcgguacccuuggagggaacucagaagauugcaugggcaccuagcugagguugaaacuuuaugcuguagugucuccagucuucuugguuacuggcuguccaugccuguguagcaaaccagucccuuguugccagguuagaucguugacaguaggcugcuacugaaccuucucuucuaaccaggcgugguggcacacgccuuuuaaccccaacacuugggaggcagaggcaggcaaauuucugaguucaaggccagccuggucuacagagugaguuccaggacagcaagggauacacagagaaacccugucuccaaaaaaaagaagaagaagaagaagaagaaagaaaaaagaaaaacagaaugcuugcugaaccuucucuucuuuagaagagagaaguuaguugcauuagcucuuuucuuccuuuuuaacuuaacaguuguuccgugcuugaguauuugccugcauguaugugugucccauuugguugccuugcgucuguggagggcagaugagggcaucagauuccauagagcuaagucacaaacaguugugaggcaccauguagguucugggaacugaaccuggauaccucugcaaaagcaacacgugcucuuaaccacugacucaucccuccagccccacauuaguuucuuucuuuugauuuucauaguuaaguuugucaugguugggaaggccuggugauggcuagcaggaacaacccuaggcuacgacgacaggggugugaggaugcuuguucauaucugugccacucaagaaggagagagcgagcuggaagugggugcugguuauaaaaccguaagcuccuccccuagugagucacuuccuaggcuccacuuucuacaguccgugagccugggggugcgcuuuccacggucuccucaugacagcuggccaggguaacaggacagguagagcagagagacgggagagaucaccagggcaaccuucucugcuuguggaugagcagcuuucucagaaaaaugaggcauuuaucaaguaaauucaaaccagggcaaagauccaacugugccuuguagcugaguucucucugucccucuccugcugucucaucgauaggaauuacgacaucuuguuacuauaaauccucuuuaacuuguauuuuggacucaaugaugucuacaacauuuucuuccuuucauuuccaguuuucuuuucaauuuaauuuuuugggggggccagguucaagcaggaauaacuauaguauucuaaaaauaaauaaaccuauauuuuucccaagaggaaaugacauuugauuugaugagaguauuauugagacuuaaaauaaaccagauuacauacuaaaguguuugagguuucucuuguuauaaacugcuuaauuucaaagucauguggauuuauuuauaauuuauuacuucugacuuucauuuauucuguaucuuucaagagcaucuaguauguagcaggggucaugaugauguaagcauagaguauucccucaucugucccguugucuguugagaaaugcuacacagagauauacuccuacuaccugggaucaaguuugauaugggcaaccugugaacuuucugggcucugccuuccaugcccuuagccuagacaagaaccaagaaacaaauaauagcuugucugcuggauaaauagagauuuuucuuucaggagcgauuuaguggagcaggggacccucaauuaauuaucauuguuuauaauacauuuucuccuuuguuucuaagagugagaauaaugcagcaauaugauugauaaauaaaacauaaaaggucaguuaugguugcccugguaacucuauuucucagcaaguauuuuguuugccaugaaauguguccggagugauuuacuggaucucaaacucugaaugucaugacuuuuuguauuuaaauuuuauaugcacucauucgcggagggaaugacaguuuuguagguuauuuuugaguagaguucuaaagcuguauguguagugugagugugugugugcucuuuuuuauuuuuuuuuggaacacaaucagcaaucugugacuaaggugaaucuguuugagauuagagagaagauccaggucuacaguagcccugaagagcucagccaugagacauggaacuacauuuuggucugugaugaacugcauaucugauggugguccuguaagauuacaguggagaccagagguuccuguugccuagcaacacugcuaagcacauacaauuauguacaggucaucacauuugaauaaacaaauguuucagguuuacaugcuuaauguaauacaccuuuuauuguuauuuuaggcuauacuauuuauuugaaacauucggaacaauuucucuuugacuugauuuagucuccuaguuuucuucaucacagcccuaggaugaauaagguuguauuuuuuacacacacacacacacacacacacacacacacacacacacacacacacacacucucacaccucauaaacuauaauauaauucagaugucuaauagaccccaccauauagguuguuguacauuuuggcuaugaaguagaaggauaauauuagcuaauguauuaguuaccauuucuguugcugugauaaaacaccaagauaauuuaccaaagaaagaguuuauuugggguuacagaugagggagauaaagucuguccuuaaagagaaaugugguagugagcaggauggcagcaggagcaggaaacugagaccucccauuuucaaacugaagcuaguaccaggcuuuuaguaucaaagcacaccaugcagugacguacuuccuccagugagguuacacugccucagccucccuaaauagcaucaccacccgggggacauuucucauucaaaucaucacaccugaauaucacauuucuugaaaacauauuucucuuguacaugucuguauuugaauauuuuucugaugacaugaaauuucuucaaacaggauuuuuuucuuuuaaauguaguauucaggcaaaggacacuuucuaauaaguacucagaaauacauuaacugauaccuuuugacuuaauuucuaugcaauuacuuuugaguagcauacguuaucaaaaaaguguuaacacugaaaaucaaaauaauuaagcaauuagugcaauugccaucuucuugaagauuuauaguaguaugaauuaaacagaaaugaaugauuaaaaaaguuuaguacauucuuugaucccugcaacagccuacuguaauagcuuuacaagugcacagauauaaaccuagaaacuguguuguucuuaauaauaaaaauuggaaauaaucuaaugcccaucaggagaaggcugguuaaagaaauuauguucugccaacauaauggaauauuuuguagccauuuaaaaaaugauguuuuccuaugcccauugacagaucucugggcugugucaguaagugaaagcuggggagauggcugaauggucaaaguguuugcugcuccauugugagggccugaguucagaucuccauggaaauccuggaugagcggggcaguccgccugugauuccagcuuuggaagguggugacagggaucccuagagcaagccaacuuacaagagcagcuaucuuggugagagcuugggguuuaauugagguacucugccucaaacaaugagaaaucagggaggauccugacaucauccuuggguuuucacauguauccauauauauagauguccauguguucccauacauaaagccaugcauacauacaugcacauaccauguacacacauuagaaaauggaaagaaagaacauguuacagaggauaugguagauauagauggccuguguuauuguaauuaaucuagaaugucuauuuaauuggaauauuuggaauauucuuuuaacaucaggagaaugaacagucucuuagcauugguuaucucuggaggacuucuguucucagaaguucuauuugcauauaguugaauuucuguaaugaauauggguuagagaggguuaaugaauauggcaauuagagagaaagaaaagauacaaagagccugcugcuuaaguaggcuacaauccagcugacuaggugcugcccggaggcccguagcacccuuucuauaacugcuucugucugcaugccuggaugguugaagauguguuuucuuuaccucucuugaaccauuguacugaaccauuuaaaaucacacguguuuauaugucuuggguguguauauauggguguguguggaggccagaggacaacuugggaguuuaguccuuucuguuuaacaugugggucuugguggcacacgucuuuaccugcucucucuuuggcuccauuauacugauuuuaaauucccuggugagcugcuguuuguuucuuuccuugacauuugcuuucuaagcauauccuuuucuuuagguuuuuuucuuuacugacuaaccugcuuuauugccauugcuuagcugcuacccaguauucucugguagguugcuuuugguuuaaagcuuuauugucugacuacuaguuuuauuuuaaaacguuauaaccucuauacaggaacgauccaggaagggaacuugugacucaggguuccaucuggauuugauguuucuggauccugacucuugggcugaaugucuaggcuuucuuuuuuuuuggcugugugucuagacaggagcugaaagcagagcaggcuggaggagaagcagcaggcuggaggagaagcagcaagcuuaggagcaggaccucucuguuguagccaguuucucuuugcagagcagucauuggcacaggcaggaucagagaagaggugugcauggauggugauuauugccaucuucagcgucugagcuugguuuguuggcacaagggauggaacagaagcagugauucuagacccuuacugugagcuuuccucuccacuguugugacaaucuggauuaggacagagcugcagccugauguagacccuggguugcaguguugacacccuggguauauuuuauggaucugcagaugcaauacacauuuagacaauggcuuuacauuuacaaauuuucaccccuccuauucugucuacuaaacugaguagguuauucuuuuucuuagaauuagcuguuggaaucuuguucuugggagguaggugauaaaugcucuuaaaggaagucucaguaggggcccacuauacccuauauaagauucaaaacagugguuuuuauguuuucuugacaucacaauacaaugcuaggcauaauaaauuuauaugacguauuuaucuuuuaugugcucauugcaccgugaguuuuuuccuucaguguguucucauauuuccaucuccuuuccugucacccaaaccaguccaucuucuuuuauuggccaucaucucuucuguccugccuuuccuguccugugccagccacccuacucuguucugcuguauccauuucuauuccaguuuauuagaaaguacucauugggaacuauucacauuauuucaggaugcagcauuuaaaaaucauggcuuugaaggaugacagauguuaaaauuaaaacuaccaaaaagucuuugauucuguauucgagagcuuuccuguuuccugcagaggugagcaugccuuuagcuugaguucuagcucaugccccguggcuuguuccuaggcuugguaggcuucagggacuuacagagcaccucauugugagacauguggcaugcuugaaagccaucuuucuuuccggacaguuuuuaaguaggaagucuuuagcaggcucucucgcaacugugucaaauagucugccagaguagggacaggagcagguuaaauuuguagucuccccaguauagcuuagcacuacugaagguucaacuccggguuacuuucuucagcuaucccugcaggcuccugucucccuucugcaaccauccacugauguaccuguagagaacguaugcccauugugauauagcccuuaagguaugguaaaccuguaagaaaaaaacaaaaugcaaguaagucacaaauuagccaaguucauuuacaaacacgauggaaauuaucuugaauauuuagccuuggccauuuuuuuuaaaguuuugauaaauuaguguugguuuguucuuaauaugucuauaauugaauuucaacuuucguuuuuggauucauauaaccacacauaaguuauauuuuuaagacucuugagaguacagcuaguaaaaaugucuugaauuuacuguggaagccugcucugcaaccaggacauaauuaguucuugauaaaaguauugauuugauuugaaugugaauugcguauuaaagaccgaggccacaguaaugccucauuaauucacauuauuauucuuuuaguuuaaugaauuggaauagcaaaguuaaaggaacagcacagaagacagacaacaugaaaaacauguacuugcaggagaccugugcacguguugcuaauggcuggcgucucuuguauuaaggcaugcuuagaacaucgugguagguacacuucugguuguuauggagcugaaccugcuggaacuuguucacucacauuaauagucugugcccucaaguuuguguuaaagaucacacagagacaaaaaaaaaaucgccaauaccgaguuucugucugccauucuucuaccugcagugugcagaaccacccacaacaggaggagggggaaagaggaagcuuuuguuuguuugucuugaggauggaaauauuuccagccaugguggauucuuagcacucaaaugccgaaugcuagcugacaucuuugggaguaaugguuugggucggcauugcuaacacacgggcuccugccuccaaaaaguucaaucagauaagccugucuugcuccuaggaagcauaauagcugcugucugaagugaaaaucuggagaauuccagagaaauugcuggcaacagacacuugaaggggagcucggaguuaccaaguucagcagacuucuggugcuuuuauuugcgagugaugcaauauacuagguagacccuugagaaauuucucuaucccuucagcggagggcacucuccuggucgugggcuguuguagccaguuacuuucuggucagucuguccuggaguguguucuuaccuuggagccaaagcucugcaggcugcauguguguuagcgugggggacaggggcacacuggauaacuuaacucuagcgaaugcuuacuggaggcagguuacuggcuucacccacugaguccgcacugcuguuccaggagaauaaacuuggucgggaaguuuuuguccaguugcuauuuugaagaauuuguuuguagaucuuccugagcaaaguuuaacuuuuugggggguggggugggggugguggaguuuugugaguuuugguaguagauuuaugagcuaucucaugguaacaugacugcaccacaguucuucauuaccagaucucuucccgccguccuuggaggcaggccucccucacagccuuucccuauuguagccaucacucugguucugcauucuuaccauuccuaauuuuucugaaaugucgcagaaauagacugaugcuggauguagauguugucuuuugaaucuggcuuuauucacuuaaaaucuuacgucuaaaauuucucaugguuauuuuuaugcacgaguagaauucuguaguagauguaccauggugucgaccgagggagacugauguaguuuucagcuuuuggcauuucagauaacguagcuguaaauauugaugugcaaguuuauauggguguaaguucuccccucccccacccaaauaccuaggagcaggcugcugagucauauguaaguauaguaagugcguauuuaauuuuaaagaaaccacuagauuguucuucagaggggcugugccauuuuauauucauuuuggaauugaacccuggucuccuuauaucuucauaagcauuaaauauugucgggcguggcuguuuaaucuuguccauucuaauagauguauugagaugucuuuauggguuuaagcuguguuuucuucuggcuugcugaugagcaucaaauguaccuauuugcuaucugagugucguggugaagugccuauucaaagguuuggcccauuuuuuuuuaaaaaaaaagaaaagguuauuuucuuacugucaaguacugaaaauggugggcauaaacccuuggucagguacauaauuuguguuugcucaguccguggcuugucuuuucauucuccuacuagugauaucuuuuggugagaacagcuuuuagcuuuaugaagcccaguuuuucacuuugugguuuauggauugcaccuuccaugagguaacuucgaauaucuugccuagcccaaccaugaagaauuuguccuauuuuuuucuuggaauuuccaagugugucuagccuuuuugacaaaguaacucacuguugucaucaauaaaauucaugcuugaaaacuguguuguucagugacauacacaaagaaacuucaaaaccaaaccaaaccaaacccucaguguuucaaauaagcuuaugauuuuguguugggugccguucauagccauccugagacacuggucaccuuuggacugcuuugggcauguuaccucauuuuguuuuugacucuguuaaccauugaguuaauuuuuauauauuugucaggaagagauugaggcuuauauuuugguauacagauggccaguugcuucaaaaauaucgguugaaaggacuguccccuuuggcuuucaacugacuccgcaccuuugugaaagaucaauaucugugugguucuauuuuuggacuguuucuuuuuaaucaaugugucuaucuuuuugucaauugaaguaguuacuuuucaagccucagauuacugaugagggagccuagucuuagccaaauuaagcaucuugucuaagguaauucagcaacagaugauugagcagggccacgcuaggggagggcuguccaguucccaaagcugugcuggucagggaaguggcuuuggcaccugaaauaauuuuaguuauuuuguuucuguuuaaaaugguugccuuuaaggaaugucugauaucugugcuuucggcaccauagaugugaugagccgaucucagugagucaucugauaagucuguuggaaguucuuuucugcuugcaaggccauuaguuaguagaucuaauuacuguccagcauuuuuaacacggcauaauaugcuuuuuaaaaauauaggcuccauacaccauuuuucucccucccucccucucucccucccucccucccucccucccucccucccucccucccucccucccucucucucucucucuuucuuucuuuuuucuuuuuucuuuaacgagagugguagaaauauauguuccuguguagcaaggaaaagauguuuaggauuugugaauuugagaacacagaugggccaagagugacuuccauccagauggcuuaugcgaggaacuugguaagaggugagagagcgaugcuagcgugacagugaauaauaaauuaguguuucaauauuggcaaacuggaggauuuugaagaaugccauauuuaguuagcuuuugaugauuauaaccuaagcucauguauuuaaucucuuaaaaacuaggccugugugccugccuuccuacuccuuccuauaccuuuacauauacccacacacaugucaugugugagagacagcuccagugaguucagguuagacaguauugcugcuuuuuaaaugaaacguaacguaaaaauccagucuuaccgugcaacccaggcuguccaugagaguguauuguccugucuucaccucccaaauccuggaauaacaggcuuagacuaccacgccuggcccuauguuagucauuuauuuaauaucuucuuucuuuaaggugcuggggacugaacccaggaacuucaaaucauuuuuaggaagcugcacccucaucucuauguaauucucaugcauacuuucuaaaacuuaaaagcauuuugucuuuuucaacguguguggguguuuucccugcauacuucugugcuccacaugugugcaguuccugcagagacccaaagagggugguggauucuuggagcuggaauuacagcugguugugagucaacuuaugggugcugggaaucgaaccagggucuucuagaagggcagccagugugucuaacuauguaacugucccccuccacccucauauguauauuuuuuugagaccgggacuggcuuguguaguuuuagcuggccuggaacucccauguagcucaggcucguacagaaugcuccaucucugccucgucagugcuaggauucaauggcucccucaguaaguacuuuaguugaaggaacacauuuauugauguuguucaacucucuucaagagacaaauuccagucccauaucccugcccccccugugcuguuuccugaggcuuuauuagaugcaacucuuggaauuacuuuuugcugcuaggaacuuagacacaaaauugagcuguuuccucuucuuuuuaauaacaaagcaaacauuuccaacuucccucuuuauuucuauggugggcucuuaaucaccucacaguuuuuggccccccauccccacccccuuuuggugaccaaauccguaggugacuuggcaacaugugauuguuaguuuauguggcuccacuuccagugcuuucuuccucucccuucaguuuguguccaccccuaguucaaugcuucccuugacuguugcaggcuagacugcgucugucuuguuucaugggcauugugcuuuccuccugcucugcccagaaccugucucuugcccgcuaguaguugaaaaauagggcaucggcugcaucccuucuuugaaucccucaaugcacugcaaagagcaagcucccuauugccuuugaugucugaaacaaccugcauggggucugggcuagcagcaucagcauccccugggaacuuguuagaaaucccccaccccagaccugcugaagcaugagcuuuagggauggauccagcaaccuguguuuaaaagaguucuucagacuguuuuuagcaugccaacacccccgugaaaaccaccucuuucugucagauguguagaccagcuuaucuuuuaccaucucuagguuugguuuggguuuucauucucaacagccauccauuucucagccauuucuaauucuuuguuuaaaauaggcuccaaauucacucccuggaggaagaccuucaauuuauuuuuccuaagcaacaggcauuugcuuuagacuguucuuauuucuuguagauguuauuaaggguggagguugauggcaggguguucuguauuuucagcugguagagugauagaaugugucuuucaacccaguacuggggauguauuucauacaaauuuuugucaguuuuaguagcaaauuggaggaaaaauauuaaaugucaagcaguaaguuuauacuuaauugagguaugucaugagcccagccauucaguaguagagaugccuauguucaacaacuuugguuguucugggggugaccccagguuuccuaaucucucucuugaggcaucagaggacaucuugcuuaagaggccuacaauacucucucgaugguaaggaugggaguagagugggcaggcauuuugacuucugguccuucauuucuuacagucguuaauucauacuguugggccuugugcuaucauuugaaaaauuaggaaccuauggucuguuuccugcaguucuuacugugcacggauuaaaugagauuucaggggagguccuuauacaaccccuguccuauauucaguguucuauaaauguccccuuuaaguacuaacaccacuaaaacagcacauuuaaagcaaaaucuccauggaccgaguccugucugcucauagaaugccuuuauugaauguauugcuuguagauaagaaauuucauggcucuguucuguacagacauccucuuuuuucagaacuucaaguuuuagugcuuuauaauuguuaaugaaugcuaagaaauauuacuugacuuuuugacaaaucugugcauuucuuaaaauuuauccauucaacuuuaguuuuaauggaugauagcuuacuuucuaauaguauuugaaagguuuuuauggguuuuuuuuuuccuuaguagaauaaauuaggcuagcuaaauggucuccuugauacaaugcccuaccaagacuguuguuucauugucaguggcugguuuaaucaguauuauuugaagguaauuucagacuauucuggcauuugguuccuuauuuaguuuguguucuuucccuaacacaucuaauuaauggaacuguccaguggucuaacauggagaaggagagaugacauggugaaaacucuaaccauugugauagcagcugacgcuugucuggcuugcuacagucugcagaguucuuucacuugcaucacacugaagugcagagaucaugaggagcuggcacugcuauuuuuguuguuguuuuuuauuuggaaaauugaugauuauauuauugacucuucacaaaaccaaggcgguaaaauaaggcacccugaaguugaggauaguacagugauaaaaagagcugcaauucuuggcugaugauggagcucaguugguacaaugcuugcauagccuggccgaagcccuggguuggcuccugacuaccacgcacacugggaguguuugacagaggcaggaggaucagaggaccaaggucaucuucacuacauuguaaaucugagacaagucuggauccauuagaccauguccaaaacaaaagagaauuuguaauucuuccugggcuaauacacagagaaagggguacaaauucacaugauucaaaagugcugccucccacaguccaucaugugggacaagagauaauccgcuuagguucagaguuuggcuuggcuuccuuucuugugacagaccucagauaaucauuucaucuuccugagcagagcucuaucuccucguuggggaauggggaagcugagagcaucagcccaguggauaaguaaggcagcgccugcacuacacugaguacucuguaagcacuagcugucacugucgugggggaguggaugaagugccuccuauaaaauguuagugauuguacuuagacguaauuauaauuacagaagugcaaaccagagugucuagaagaguucacucugacacagcuguuuacuucuuaggcggggcucuaaugcuacgguaaagugucuaugucuuucuuaguuugaguguccgcauugucuuagggacaugugaggacucuacuuuaaaugaaaaaaaaaaaaaaagacccaaaacaaacaaacaaacccccugcagccuggguaugauuucuauuucuaaaaacucaaaaccaacaucaggacuacagcagcguuccaugugccagaaagauucauccacacagaggcaggcauucugguggggucaaagguacaguagccauuaggagaagggaguuuuguuaauuuccuucuuuagaaauuauaguuuuccugauaggauuuucacgagugagacaaacguucuguuggugaaguucagugguuuucuuguggguuuggcaaaucaccuguaccaggaacccuuuccugauugcauggagaugagacucugguuggcuucaagccuuuuccuugccaacaguccugccucaucucacacaauggagaacugagaacacaagauugacccugugcuguuuauagucuuuauuuauaauuuucucugcagcuugauuuuuuuuucagugagaaaagcauuuuuuuuaaauguggaaaaccuacuaaaauguugguaaauacuagaaaugggauuaaauuuuccagcauuuugaauuaacauuaagauauggauguggcucuucgauagauaccauguauagaauguucuuguaguccuuggggcucuaccucacaaaauaugggguugcauuaugaaauuugcauagcaucccauguuuucuuugcucauguuucccccaggcauuuuucucucuguccucugauucucuuuccuccuuugcauuuuuuuccuucgauuucaaguguguuacaggcaggaggaaaaagucccuuucucuauuaaagccacaggcuguguaugacacuguaaugaaauuagauacucagaggaaucuauucacuuuuaauuucugauggcuauaaucaacaugaaaagcuuuucuuaauaauuaauguuggggacuaugaacuuuagacauauuuaugacuucuuuccagaggauacuugggugugacuagacuuagaaucuugaguucuuuaggccccuuugauuucuucccaguacaccuauaaacucuucaagugaaaaggugugagacuuuuucauuucuguuucaaaaaagaaaaaaaaaucuaaaugugacuugucucaguucaaaugguauggaucuucucuuuucuaugcccaguaugugugcacgcaauugcuugcuugccuggauaugcaggugaggauaugaauguggaggccuugauugucauccucagaaauggccuccuuugagauagggcaccuaucuuugaguguguuuauuucucugugccuuuguuauuaucagcacaugucaaaauggaaaugccuuagaaagcuagcucccucuuagguggccccacacgaguuuaggaaacacuguagaacucuuuguggucaccuuaaacaaacaaacaaacaaacaaaacaaaauacuccaauaccaaaaaacugggucugguguuugcuccagcucgugaggaucauugggucauggcuuuucuaagcaaagaacaaccuuacgcucagaagccuuuccaccuucaaucaguugggcuugugccugcuagccguuuccacucugugauugauagcucuguguuagguacccagucugaagcguucuguacugugugaaaguucagaguagugaguaguuauuagugacugaaaccuaauuuagauucccagaucgaaaucguucuugaagaacgcuggcccuccacugcagaugucuugugccgaugacgagugugcucaucagagaacaagcucucacccugccuuucauaauauaaaagcguuuuuaauccuuccaaacaggugcugucgcaguuuauuuauaacugaugcauuaaaaugaaaaauauugaaagggcccuaaguggaaggcggcuuuugaaauauugccauauuuaaaugauaggauuuugucaggcugauuuguggaaaggaccagucagugcuggcugguaagucuuguacuccaggcuccucguaaguucaggugcuguucucugcagugcgacaguccuguguaggcugcuggcccuugcaguccaaaugauuccacucuccuauauucauaaucauuuggucagcucccuuggucuuugccauuucugaccuuugugaagcacgccaucugguaggcuuucuuggccuuccacauucccugcagcauaaagaugugaacucuucuuugagauaaucggcagguggucagcccguuucuucucaguccgacuuucaucucacacauggggcagguaaauauguuccuucacacuggccuaggccugcugaucugaaaaugucacagguuuuacauucccuccucauuguguuuuccugggaaagccggccagagacuaacguguaguuggguuguauggauggguguuaauaucgucccgugccagcugcucucacuaauuuguuuuuacagggcagcuuauaguaaaugaauggcaugcugaauauuuuacugagauuucagauuauccgaagaauauuuuccgguuuacuaauugguagauaaugcugaguacauugguguugacaugagcaaauggauuuaaaaugauuugaagugagccucauuaaaagaugcuguaaucacaggcagcaggaaaugucaagccucucucaccgucacucgcuauaguggaccaggagcuguugcaggcuuuggggagggggaugucagcuuugcuguucuaguguugggaugucaaagguuugggcaagagauugagguuuuguucauuucuuaguaucuuuaccagaaaguaaacagcauacauuucuaauuaccugaguggaugaacgaacauuucucugagaauuagagugaauucuacugugggagucucaccauccacuaaagacuggauacauggaaaucauauuuuuuugcccgcucuguacuggaagcuaauaaauuauguaguacccauuccagcagaagccugcucuagaauuaaagcuaaugugcuccuugaaacaccaaagaaaacauaggcaaaugcaucacagguuccccggcugacgcuuagaccacugcguuaguuaccuuuugcuuuuaauuccuuugaaaugguaugcaagcuauuugaucaaaauugacccccugacacaaucuuagggugaauuaugcagcaguaacuauagcagugaggagggaagccucugguacaagacuucucaggcuuccaaugccacucuugcccaggccaaguguguggcucuuauacagcucagccagucugagcucaagguuuguuuguuuguuuguuuguuuguuuucuuucaguuucuucagucuuggagauaacaagccaggaccuuacaggggcuaggcaaguucuuugccagugagcuguaucaccagaccuuuuucuuuuucuuuuccuuuuuucucuuucuuucuuuucuuucuuucuuucuuucuuucuuucuuucuuucuuucuuucuuucuuucuuucuuucuuucuuucuuucuuucuuucuuucuuucuuuucuuucuuucuuucuuucuuucuuucuuucuuucuuucuuucuuucuuucuuuuuuucuuucuuuuuuucuuuuuuuuuuguacaaaguauauagaaucagagauaacacugccuuucucgugagguuguaagaguauuuauacacaggaugauuuucaaggacaaagccgcuggcgagggcuucaucagagcugguucuugaccuaagugaguuuaucuccuucuuucaggaacuaaagaaacacagugggucuuaauugcuaacucauuaaccaaauaccuuauucuucauacuccagcuuugugaagacuugucaucucggccagaauauaguuaucuagaacaugaagggcucugugaagcagugugaagaacuugggacaugacgagacuacccugaauuccugcugucggagucuggugguacuuacugcaguauucuugccuuucucucugacagcuaucaacucaguuucucuuccagccccgaugugcugugcuaagaagcuagcccuuccaggcccugaucaagggcucguaaugauuucacaggaagaauaccaugauccaggaguuuauauaaugcuaaugaaauccacuaccuggcaagcaacauguucauuucaggcugcucauuagcaucgcauucaccuagaugcccuguaagcauuuguacaguuuguguaucuuuuaaauaguaccagcaugggucagcuugacauaccaacaaucuagcuggaugugcaguagauucaaaugccucacggaagucacuagagcaugcacugccugaguagagauaauagaaauggauucuauugaaauggagggagaagguucuggacuacccaaauaacaauuaaguaaccacaguucucgauucagagcuucuggcucuauugccagaacagaaaguggccuccacaucucuugcaagacagcugugaguuaauuuuuuuuucuuuaauuuucccuuaaugccuugauguauauuguagggaggagagaaaacaaaacauaacuaaaaaucuucccacucaaaugacccucuuagcuuuucuuuguacccuguauaccgugcuggaaauguaaugcucuucaguggcccugggugggauccagccucuguugacaaauguaaaaaauggcccagcagacugcagauguggucugugggugaguguggacuucccucaucaauggggaaauggggcuuaagucaggcuuagaaaaugagaaaaauccuuaaggggcgugacuaaugucuccagugugcacuacgcuacauaaacccauuaugugcuuuaauuuaauguucuccauaaagauucaggaccugucaguggaaggaaagaaacaagcaauccaucuucagcgaauugugaauagaguuuuagauuuuaaaaaacacacauucaccuccacauacuuugccuucauucaguuuucuccacagcucgcccccuuccccucccuguccuaucuuguagccccacuacuuuggcugcugcagaauuguuuuguucaguggaaguggacuaauguguuaauaucuaauauugcugacugagucaagguaaaggauaaaggaacagaugcagagcgcccgaccccucccuggcagcggacuugagcagaccauaggagguuugcucuccucugucccccaagccuuuucuuuucaggcgucuggaguagauuugagaugaccagauggaugugguauuuuagugauuuuacgucuuucgcaugcuaggaguguuagcacacuuacccguacuucacuaaagcaagccagaauuugucgugauuuuaauugaugagagaggaaauggaaacugcaccgggucaguguagaauuuuccauuaugaaaacauaaccuuucacagggcacccauuggcagugaaaugucagauauucacauuccccugcucccccucucagaggaaagaaacguggaucugcauuagaccuccuauaauucaguucuagaauguacuuacauaauaaucccauucucuuuaacuuguuuuguuggcugauguauauagaugauagguacuucugacaucauuuuuucccuuucuguuucuuuuuucuuuuuccuuuuuuuucuuuuggcuucaaauuguuuuaaaaauaggagaaggcuagugguggguuaggaaauaggagaaaauauaaauuucauuuuagcaauuguagacagguaagaauuagucuuaccuguucuuuuuucuuggggagacacauuaguaaaaugaggcagagacagaauuguuuaaaggauuaaugagauguguaugaugcucuaaugaaguuugaugagcuagagcugagagauccgaagggucuggguggacaucaggguguuuguguaucucuggggauugccccaauguuugccauuuccugggaggggccguguauuuauugguucugaaagagacucccaguaaagccacucccacuggcugccucuaagcaccuccccuuccugcaucauugcuguacucuuucccugucuguccgguucaucuccuuaucuugaaucccucuucccuucucuuuauccgcuuuaucuucuccuccacugccucuuguaggcgagacacgguuuggaguggaugaucuaggugcuagccauuuugacugccuauacaaaccaaacucugauuggcucagccggggcagaaccuguaagucuugugacgcuaacccucuccuuguugauaacauaaugaugguuuacuaacuucccuugcuuucuucccuccuucuccucuacaucagaaauaaauuacuuguggaauauuuaauagguucgcagggcucugcucugguguuaucuguuuuaauuccgucgagaugagaugcagcgcuugucagcagaggcggcugaugaugucgguacaccuugcugagcacaggucacgguggccugcaaaccuaaauugggugguucagcagaggcagccuccugcugcugagugggacgacuggaugcagagccucagagcucccauguagcugcuggguguuaugcaguuguucugccgggguucaugcucccucccuggcuaccuagugcaguguccugggcugcucuugggucauucugugguccaacagaagcagucagcuuucugagagccgucuugcaaaaugauauuucugaaggucaccaagcauugguagccugcaguuaagcauuaucugccuugcccgcccugugguauuuggcaccauuaacuucuguuuccuuuuacaaauuccuccauuuguucugcggcacugccuguuuuugggcagcuuuauuugguggcacuugggcuggcuuuuuuccccuucuccuaccagcuguuuuucuacauuuuguccuuggccauuuucuucucuuuagccuggauguucugucuacuagaucuuauucacuuccccggggcugucuugcauucugucaaccuggacccugucccccuuuaaaaauuucuaaaaugcauugucaacugccuucugucccuaguuccacugccuccacaaaauccuguuguuuaaaacagaauuuagggcugggugauagcugucuauaaagugcuugccuugcaagcaagagcucccuacuaccucuccccaggcauuggucaagauuauaacccaagugcuggagagguggagacagggagaucucgaggacuuacuaacuggcuacuuuggugaguuauaagcaguugugagaucuugucucuaaaaaaccaagguggacggcuccugaagaacagguugaccucugccccccugcccccgccccgcccaacagacaaauaaagagcacagcuccacuuuacuguucuaccccaguuuccacacaaauacacaugcacaccaaaaggcugaaaugacaacuaagauauugccuccauagccaccgcccacagcaguccccugaagcagaugucccaugguucguccucuuuuuuuggggggggggguccugauccugggagccuccagaccugaaucucucagagucuucuuucuauguuaugugcacguggcacaaggucuuccccuugaugacagaguuuucuccaucaggacuucccauuaccauccuuaggucagcuggcgauguguuccucuagagcauggcucauccacauaguaaagacggauuugucuuucucagucucuguuaucaccacugucuggggccaucaggauuccucggcugccuucucuccagugcagaugcgaucucccaaugcagucaaccgcuuuccacuucucacucuuaggaaguuuuucagcauccaucuuuucucaugucuaugcugugcggcuuauaauccuauuggaagaucaaguccuucuugaccgccuuuacuuuauauuggaacuuugauccauacucuuuuugguggggaagggaggcaggaucucauguagcuggggcucacuuugaacucguuuguugcaaaggaugaccuugaaccuuugaucuccugccuucaccuuccaaguacuuugguuacugccuucauggucugucauacuggggacuguaccaaaggcuaaggguguggcagccaggcacgcuuccaauugcacuacauccucaccccucgauguuuuauuccaucugagguuuguaacuuucauuuuguggagcauuucuuccauugcaucgcucagccgggcuacaaauacuaacggaguagaagcuuucuuugcacacacuuuucuguaugccacccagcacaguaccauguaaauguuaggagcccaauaaauauuuauugaauggauuaaugaacaccuacacugaaaugcuacuuagguuagcaggcuaacuugaaggaacuuaaagaucucuucccacuaaugaucuuuugucuaauuguuuugcuaccuuucugcuuagccaugcaaauuagcauagguucaugagcccaaggccugaaguaaucuguaacagaaagaaaccagguuguagguguacaugguuuuaguccaagaaaaauuggaaacauagugccugcgaccaguuaucaauguaagcugggcguguccccuccccucuuaaaaagaaaucuuuuuucccccuagcccucggcaguacugaguuuuucuuacucccuacauaggccggaagaagcauggcaacaacagcacaaggguggauaggaagaggaacuggagacaggcagaaaauaugguguuggaccguguuuauuaccuaacauacaaugucguuguuauuauuauuauuaugacuguuauuaucacuuccacuuucaccauuuaucaucuagaaaacacaggugacguuguauuuuuauaaaggucccuagggaauuauguacaccccauagugaaagguuacuacauggcaucuuagccuacggggcuuggucaccugugggagacgauuuuugucaaaccagcaaagccguguguaguugcgauguauuguuccgggcuauuuguaaauacuguauugugugacacacuuccagcacaggggaaaagccuggccucugggacugaucugaagagcuguuuacagcuguggcaagccaauaccauggccgaagggaaaaggucugcuuugagaguggaccccaacugaagggggacugugugccucccuuaacccccuccguggagccuggcugagcacagcagaggcugcugggagggaacccgggaagcuucagagagccugaacaugggaagggaggcugcucuggauacagucuucucucuaaacccaccugcuaacuggagggaaaagaugccaggcuuucaggucugcucgcaggcgcauccaaaauuuaaauccuuucugugggaaaucaguagaggguuuaauagaagguuaaacaaauuacacauaaacacauagaaguagucuggcccaaguguggaaaggccagagagcuggaguguuauggugaaguccuaggagguaauuuauuuuuaaaauuuauugaacccacugaagcauaagugugaggauaagagaaaccauaugcgcaugugguccagaaugaaauucuucagaugccugagaugguuacaacuagugacuaagcccuucugagucuaguuuagcccuuuccagugcugccaaaggggacugaguggugacagcuggucagggcuacccuuccgccacacugcaaggaggaaacaggaccuuuagcucucaugccugcuuggagcaugaucucccucucuuaucuagucuggcuccuuccccucugagaugggagugggguuaggggagggugggucugaacaaauuuuauucacuauggaguuucuucccagaaaaaggguaaccaugcuguuguauagcucacauuuaggaaguacaaaacuaagccaggugugguggcaugugaggacugaagaugcugaagcaggaggaugggcacauguucaagaguauguagagacaaccaagcuuguaagggcuauaaagcuaggcccugauuuuggggcagggagaguauaaaaauauaucagagggauagauuucuuuuuuuuuggugggggaugugucuuaaaaguuauuugugaaauuuggaccuuauugauuaaguggguccaugagaguaaucugcagugacaucucaucagagggagaaucugaaggaaucaaaccggagacaaaccaugggcuugaaugcagaagugcacuguguagcaguagcgcuccuuuccauucauuguugcaguuauaauuauggaacccaacguauuuaauuggcacgguguacuccucgcuacugaauggguugcauuguuuguguuuuuuaaaaaacaaaacccuugugcacaugaauuccugcucguguugcucuuuggcucucgagagguuucuuuguuuacgugaugacugauuaacugagccguggagccucgaagcuugucauaugcaaaaccgaagaggaaacucugcuguaacugagaaaggcuuuagguaauuuaagaaaaauuuguucgaucuuugggaaaauauauguucuaacuuagaaagucauagauggaaauaucaguugaguccaguaugugggcuggccucuuccugauugcagagcaccugauguguggcguuggagagguuauuggcaugcauguuugagucugaaccuccgaaggggaaucucugaagaagcuucugccuccugaacccccagaaaugagagcaguccugagugugguggaaaauaaggggcucauuuauauaggacuuucuaguuagcaccagagacucguagcuuuugagaugagaugcacaggcuaucucacaaggauagcaaccaucacagcuaacuucaagaaugccugcugccucccaagcccuguacuaaguacgcaucuucccgucauuguuucagguuuucucaacucucucugcguuccucuuauccucagccuguggcucaguggugcaguuuucuuguuuguugacuucucagcuaacagagccggaagaugaucccaguggccuuucaccugcuucugcugucugcuguagaaugugguagaaagacaaggcucauuaucucaaagccuuccucgucuuuccuggguaauuccucacuacauguagcaucuacaugcauuggaaaagcagucauagcucugucauuggagauugucuccagaggcaaagauccccagaacauaggcuguguuuauuggugccacagguaggccugcucuuggaugcagaaggccucuaguucaauuucuugcuggaauggauucuucacaaauaaggaugcuccuucauuugcuguuuacucucacugauuucuucuguauucuguccuguccacaacagacugugcaauuuuuuauauauucuugccagaaugcacuuauucauuagcuguuuuuuauuaguguuccgguugagaugccauuuuuccauucaaaacuccaauuuucaguggcuuuuaauuuuacaaaacaauuaccuacugggcugaaacuccguaggcugcugcuucuccaggggaggaggucuggugggggguacgggggggggggagacaguuccaguuucccuggcagcuuuagcauuuauauucaugcaagugcucuuuaaauaaaguugcaauugcuuaauuauuuaagcaaacgggaacugaaugguuuagggaauuuuucuagcaggaccaaaggcucuggacucccuucguauuccucacucagacagugugauuuugugcuggccaacuaaaagcgagugucucacuugugcuuugguauauuuagaaaucugagacuauuuaauuuggaguccucuuuuuuccuccauucauucauucauucauucauucauuucuucuucuuuuucccuucuggaauguucucuguagcccagacuggccucaaacucagagaugccugauuuugaauacugagugcugggauuaaaggcauccacaaccaggcuuggucaauuuggaguucuuaaucagguuacauccauggauuuuauaucuacuaccaaauccagggccuugaacaugcuagacaagggcucuaccacuaaauccauggauuuuagaagucauguuugaauuuuuaguuuauaucuaaaugcuuauguugacuaucaugauuaauauuuaaauauuugucagcuccuugaacacuuacugugugagagggacacacacuguuuaagacugaaaguccugacccuugguacugaccuugccuucuagguggcugcguagggauuucccugccugucauuguucucuuggguagcccaccuuauuagggagaugugugcagaauccauccacagagcuuagugucccuaaggagcuguggugaccgugcagccuggaguucucaaccgagugagaccggggcccuguucuuaaagggccaaugauccgcuaagggcaaagcauuuccagaagagggaacagcccagagaggggucugugaaaccaugcaagucccauggcuguuuuggaaaccuuugacucuccagggucuaaucuaaacaggaauacgagugcagcugcuaaguggagggguccuuuggagguuuguagcauacauggcagccgcuauuucauuugaucuuugcaaaccccuguguggccaauagggaucaccaccucgauuucauaagggguuugagggauucaccuggaaucacauagcugcugcaagagcugguacugaaguccaggcuuugcgcuuccuguccggugcucugcuccgggaucauucagagccauuggccuuaucuacauauacaagugcuaagccuuuaaugguaauuuaaugagacuuuauaauguucuuuuuacuuaaacauuuuuacuuaaacucaucugaugagauaaaauuauauaaaaugaaauugagguuauacguuagcuucucuauguaugucacugguggcuguaauuaaaaaaaaauuuaaaguguagcuauuuuuuuuuuccugaguguggagacucuaaaugucacuuccuuguugcauuguguggucuuucuucucucuuuucuuucuuuuggcuucacugucuuuuuuuucucuuucucucuuucuccuucuuucuuuuuuuuugggggggggguuugagagacagaguuucucuguguagcccuggcuguccuggaacucacucuguagaccaggcuggccucgaacucagaaaucugccugccucugccucccgagugcugggauuaaaggcgugcgccaccacugcccggcucacugucuuucuugucuuagggaauggagaaaucacacccacuugaguaucuugauucucuuaaguaugcaguugaaagccucaucucaggccuuacuucauuaaugacaaagauacauauuggggacagauguucucuuucagggucuguauuuauuuuacuguauuugauuuaaacacauugccuuggcaaaauuaucaaagauuauagcuuuuugcugucauuuauguauugaugagugugucucuauccgugcuuagaggaaaccuugcagaaguccuucuaccuucaggguuucaguggaucuaacucaggcaaucacacaugguggcaagcagcuucuacauccugagccguugaccugacaggucacacauguguguauguguguucacguguaugugcacaugugccuuccauggugugaauauuugaaggucagaggugacacugggugccuuccucaaccacucuccaucuuaguuuuaauacagagucuuaaauacuggguucaugccuuuuuggccacacugguuggcccgugagacccuguauccuggaaucucuguaucugcagcaguggguuuacacauggugauggcaugcguggcuuuuaugugaacucagguccuugugcacacaaaucaagcaucaucuccccagccuaccuccugccccauuuuaaaguuacugcuugaacaagaagccaccaccuccauucucuagugcuuccggacgcacgccauugugcuguuccuaagguauucaacaggaagggcagaggcccaguuccacuucucagggaguacucacugaacccaggaguuguuggauccugccaguuaccaacauuuccaaauaaguaugcagggcaugccugggcuuucgacuugauuucugaauacuaaguuguugggcaaggagagaaaugcuaauguccccgagaucugugagaugcuucuccauguuaggugcuccacagacccacagguuuauuuuauuuuauuuuguuuuauuuuauuuuauuuuguuuuuguuuuuguuuuuuuguuuuuuuguuuuuuuuugcucccaaggaagaguacuuggaagguccauccaccaucuuuguuuucugcaggaacagucuuuuaaaguuucuuuuagaugcacagaugugauucuugagcccucuggccucauguguggcuuuucuggaauauucagagaguuuccugaggugcuugguucuugggcauaugcccauaguugagcguaucagugaagauuccagggccccuuucacacuuggauucuaaguacauuauuauuuaaagcugcagauggggauuuucuacuagggacuguguuuaucuguuuguucuguuuauguuuuugucuuugaagucuuucuaagagauacuccugcuccucaaugcuauuuauuuauuuauuuuuccuuuuauucuuuuuccaaagaacauugaagaauuguaaagaauuguauguuuaacuuuucagucagaguuaccuguaauguuuggagcuuucuguuugagaccuuuugaguucucacuuuaauuuugcaauugauugcaaaaagggggaaagaaaucucaggcuggaugcugagguccaagaagcacuuguuaauaagaaucugaagaagagaguccaguaacuugaccauuguuccucagagguuuucccuugccuuacuggugaagguauguccauggacugcaagggcaguaugggacuuccucucuaacucgucaagaaaggggacuucuccucauccuccucuuccucuuccuccucuucuucaaaauuuauucauuuauuuuauguauaugaguacaccauugcucucuucagacacaccagaagagggcaucagaucccauuacagaugguugugagccaccguguaguuguugggaauugaacucaggaccucuggaagaacaguuggcgcucuuaaccgcugagccaacucuccagccugaaagggagauucuuaugcucugaccugggaggaaagcuggcagagacacaaaugcuugcuguguccagugccagaaggagaagguagggaccagguugucacuaaaagauggacaggcagacaacagacagacugguacucaauucaagaaccaguucuuagacaagucuuugagcaugaaauguaaaggaguggucuuugacucuugugcauaacuacagaggcacuugugaggaugccaccauuggcuuccccugagagaacaggacccugauuguggacaggggaagagcuggcucaagccugauaaccgaguucagucucugggacagaccacaggguguaagagaacugagagaugaacguuggccugacuuccacauacaugcugugguauccauacgccccuucuccccccacguaaauaaagggauaauugauguuaagucccaucuccugugggaaucugccauuuuccauggagauuucgggggauuucggagguaagcgguaugaucuuuuuauaaggcuacagugaagcugucccuugaccccauggagaaacuaguuccugaaggguugaauguauuuaaguagcacacggcugaacuggagacacugccagagaaaugucugccuggcaaauugugguucugccccaagaggagcccucuaccaccuugauuuaccuggcaggagaggaucuucugcugacuccacugcaguuuuccuuaaauuccucugcuuuguguugugucucugggagccauucaucuuugucacccgcucuacuucugcuauuuuuagcccggugccaaagaccuuacagcuuccucaagcuaaggcuaaagaauuaagaucuguuguaaacaaagccucacccagccccccuuccucuuucuuccuucagguguucuuuggaaucaaguuuacucucuuagaaccuggaguacucucuaggagagagggagggucuuagucaguuuugacuccagagacuuuccuccuucguaagaacauccuagaagaaaggaacacuugguuguuuuuuguuuauuuguuuggauuuuuuguuuuuguuuuggaaccuauuuucacauguuaaagcauaaaacaguaaaaaaaauuuuuuuuuggcuugugagucauaucugugaguucauuuaggcauguucuaguguuuguuuagcucagucaguuacuguagcauuuaacuucggauuucauugccauaggcucucguguggguuaaguaccuuaugacuggugucacuguuggccaccucugggaaaacacuguuccaggcacauacucucugaguccuuauccuuuuaugaugccuguguuuauaaaaccagacuaaccagacaagccacagcguaacuuaacuguucaguuuugcagggcuaagccuuacuagcaggcuaucaggcaaaguaguggaugcccaugguuguuuuuaccccuugaagagaauaggggugcucacucagccauuucuuccaccccucaagucccuugugaggcagaggcagaggcaggaagaucucugugaucucugaguugggagccaagccuggucuauauagugaguucugggccagccaaaggucacauugugagacuuuaucucugcaguuuaaaaaaaaaaaaggcuuggagacugaaaugggguagauauuuuccgugauggcagaauucacaaguguaaacuuuguaccuauuuuuuuuuaaagaugaagaaaacguauuguaaauuaucauuuuuuuuauuccacucuuccaaguugaguuuugccucauuuuauuuuuaucucuccaucgauguuugcagggcugccuguuucccccaaguguuaauguaaacacauuuucuuuugagacagaucagcucacuucccucuggaaauccuugccuaugaugugguaacccucaauauaacucuccggcccgaaugacauuucauaacuguguacaaaucaaacagacuguugauauuaaaugacaacauuuaaugccuaugucaacaauucacuuaagucucauuucauuaaaauacucuugaucugggagcagccgcucgucugaguagauaaagcccuugacuuucaccucucguuuccaggugaaaguguagcuagcuggugagcuguuagcuguuagucagguggauuuuauagguucuggccugggggauuggaacagaaaucuaauucuuaugaucaggggaaaccccagguugccuggucaagaaccagcgauucccuuacccccacuuuauuuccugugucauuugauucccacauccaaauuuuaauuuuaagcaaggaacuaacauaguuaagaaaguuaaugucguuugcuugaauuauauguccuuucuuuuuuguuuuuuuguuuguuuuuuaaacagcagccacaguuaguuucaagucuuuuacucuuaauugacuaaucaauaaaucaauuuggggacagggauuuuguagcucugacuggccucucgaccuucuuaucugagguugaccuugaacuuaugacccuccugucucuaccucccauguaaugaugggaucgcaggcaugaguagcacaccuguaguguuggauuggcuuccuggcuuucuucagguuuucuucuuggaaguuugagagcauuuuaguugguggaugccuccugcagacucuugacucucuggggagagcugguucucccgcaaaaaaaaaaaaaaauauauauauauauauauauacacacauauauauauauauauauauauauauauauauauauauauauauauauauugauuaguuaguugguugauaguguuugugugugugucuggguguacacauguguaccacaugccugcaggaaccuuuggagguuaaaaggguauuggguccuuuggcacgagguuauaagugguugaguccuccuguggcugccaggagcugaaccuggaucuccugcaagagcagugaguacucuuaacugcugagccaucucuccagccugggggauucucucuuccccguuuccugacuacaauccuaauuuaugugacagucuuuuauacacauugaguccucugacucccuguaguuuaggaaagaagggcagccuugcuaggaaccuucuccuaggcugaaaugaucaaggguggaguuuccugcauuuccacgucaggaguucuccugucuuagaugaaggcaguaaguagucucugccuguaaguggccagcuuggauauuugaauaaaaagaguauuaucuaucacaaacacaguugcugcugcuccuuugaaggucucauccugcuucaggcccugguccuggccacccaguaaaucuuucugccuuguaccuccuguauugugaucccucaucaaguucaggguaauagagagggaggauuaaucuguuguccaagagauuggcaucuccgaaaggccacagcgagaaaacacuggcauuuugcuagauauuuauauacuuugauaaacagggcaaaacucugaaauaaaugacauccuuugccucaguuaagcagugucauucgaaauaagugaccguguguguggcuucuuucagggccuaauaacauagggaaggcagguaauuaauacaaccaagaugacagugggcuguaauugucagcacacuauggaagucagguaccucuuuuccuucucagucuggagaauugcuccaguaugggaguggagaagacaaaggguacgauagcaguaguuucauuucuagacgauucugaaagcuauuuaaaagucagugcagggugugcuucacagaagcaauuucauggcuccuuuagguuuuuuuguguaaacccagauaaccaaaauguuagcccugauugauuauugaaaaggaaggaguuacaucaaagguguguugaagccuggguguaggauaaaggcucuggggcuggggucaggagcccacacuagucuguguucuuucauagagucucaguugugauugggaauguaaggggcaucagaaagaugcucguuauuugaggacuguuucugaacucgaacugugcuagccuuggaucccauucacacucacuggcucugaugccguuuuccaguccacgugaucaguuuggagcuucagcauaauuuuauuucugcuucacaguucuuaaaauccuguuuggaaaugucauuaggaggauaagggauguaaugaaaacuacaucuccucauguaccaaaucaaagugcauaguuauggagcgggcuaucuauacugcacaacaguuaacaaaaugaauuggccgcuuccugcauuugaaguugcauaguggaaaauucaaugaaacauucaauaacuggaaagaucacaucagaaccgaaggcucauuuagcuggaguccccccaccauauuauaagggugaauguucgguuuagaaccaggcagaaaagcugugaaugaaguuaaggauugugggaggccuggagguggaaagauaaguuagaggcacugugccuggaaacccaaguugggaugccagcagaaggaaacugacagaaagacgggccucuggggaccaguauuuuauaagaauggcgcuccugucaguaccuuccauuggaggcugaaaguuauuuuucgaaacugucaucugucaggcucuucccuagggcaaaagaccucagguuagugguugaacuugcuuggacaaauccagugagucugcccaauccucacguuguguagaaagacacagaauguggugaaaggggacuuuuuuccuccauaguugguaauaguggggauuuauucuguaaguaaacgaauugaauaugugaaugaaaauauaaaugacaaagcuugcuguuuuucuggaggaguuucacuugccgugaagagauuugucaugaacuugcaugaacaaugaaaaauaaaauccagcaaaacuuauacuuucaggcacaugugguugugcgcauguacgugauugcgguugccuauaacauaaugaggcuguuaaacucacuagaaugggcaaaaccguaaaguuaagcugcuuuaaaauauugcugucacacacuggcuuagcagaauccauguuuucuuauaaaacacggagaacacugugagauggcauuguaaggaaaugcaccuugcuacccuaagcaguaggcacaccuuuucagaaugcaaaugugcaggacccagcggggcagcguacacauuccugaguuuucuuccucugaguuuuaaguagguuggugguauagaaaggggcugcgucugauuaugacucuuucagggggaaaacuguuucaccagacugaccuuaaguccaaaauggagaguaauucaaagccccaagggggcuuaagaaaugaagguagcuuauugguuuuggcagccaaaggguuggcuggaaagaccauugagccccuuaguugacagacaaugcugacaagcugagccgaaagccugugugccauagcaagcgcagucauuauuuucauuggcagaguguauugcucacaguuuuggguagucuguccauuuugucaguaauuuaaucuaggucggaaaaggcaugugguaugaacugcuauugucacacauccccgcaggcauaccuggcagguuccauuccagcuuuuaaugaggagccuugcuuuaugcugggguccugcuggugccuugcaauaucuuuucugggguguuuuaaaauggaaguuaggucuuaaaucgaacaaggugucugcaggaaaguuaauaagaccccccuccaccccuaccuuguuuucugcuccuuguaaauuugauaauuagggaagauuuugagacagacuaaaguauagacgacacaggaucaugucuaagggaguggcucuuuuuccggggguagaauacccugauuuacaaucaggauguugaagauggaaacuuuacacauucaaaaugagcuguauauuugcuguaguuugauuccaugguuggcgcgucauaagguaagacaugacacugcgcaucauggcguuuuauacuccugccccaggaauuaagcuggcacgcuuacaguaggggcauguugauucugugcucuugggacgaaucccauucuuguccuuucuucucuugagucuuccuuacgccucacuuucuugcaccagcuguucuugucugggauuucugugauuucaucuuagaauugcaaaaugaaaaugguugcuugaauguaauccuuuuguauauguuaacaguuuuuaggauacucuuggaaauauucuuggaaagaaaaugcaggcauuuucauguuuuggcguucuuuuauuuucaugcauuuuuagaucaacugaggaaugugcaggaauuuuuuagucugcaugcugaauuagugaacaauuaauugggaggcacucccccugccccagucagauuuuuggcagcaacuguuagggugccuuuuucuuuauucauucuccguuuauagaggguuuuuuuguguaggaauuguuuguucuuguggucaacauaaggaugagaaagggguugcuuuuaagaguaaagaagacaggaacucagucacuuacaauuauucuaacgaugugcuguucauugagcauuaaccauauuccaggugauaaccuaggaauuauuaaucuaugucucuuccaaagggagaaaucagacugaaacagaacagggacacugaacauggaaaacauaagagcuuguuaacugcaacaagguauuauuggacuaaugagauuggccaguauaaaaaagagacuagcacucuaaagaauagcaaacacaagaggccaccgcugcccaggugcugaacuagauaaagcacagagagaagccauggccgacugcaguccagaccacugugggagcggcugcagcugcgcucccagagaagccgcugugcugaugaaccugcugcaaggcagccuguccgggauuuaggggaacuuuccuaaaguuaggauuguggagacuugguagaauauuuucuguagcgaguaaaagggaaguuugccuggugacccaggcuguggggacccugucccugcaguugcuggauccuaggagagucauagucugcagugccucucuggcacccucuauugaaaagccuuaaccuggugcuagaggauaaaggaaaaacagcuaaaaggacccagagccauugucacagaaugggcaaaguaaagguggauuggcaaugagaggcagcagugugacagcuggcacaggagugacuacugcuuauuuuuggaucucaaagagaccagaaauagugaaaagggaauauuuccccuauuuccacuuuacuggugaaaaauauuuaaccugagguagauaagugauuuguuuaaugccaauauaaaugacuagguucuuuuacacccccccccccuuuuucucuuucucucucucucccucuccagagaagggaaagguuuguuuuugcuccugguuugaguguacagucuaccaugaugaagugaugagggagacaugguggcaaggguagcuagcuggucacacuguguccacagucaggaaacacaggagaaacugucuuccucagcuuccuuucuucuuuauucagucaguagcuccacccuacaggauggugcugcccacucaggucucugcucgguuaacccuuuccgaaaaggcccucagauuuucagaaauuuguuucgggugguucuaaauucugugacacuggcaggaaagaugaacagggcuauguaacuaacgaauggagauucacuucuccaauucagauuugucaguuucuaaggcucugaauuuucuccagaacgucuugcauuagagauaacagcaaacccuagaaacuggccaaacauuuguuuaggucccuucugccugguccuacagccgaggggaucucuggagagacugagugcuguguuuuuaccacaggcuaucagaguuggaggcauucacgaaugugcagugcucauuuuaguugggucccuaccgccuccuuuuacccaaaucuugguugcccuuguaucagucaagguuuagguuccauaccugauguccucuuggcagcucucaggggccuccagcuggauucauuggguuguagggacaggagaugguggaucuuggauuauguacggaugaaccuucucucucaggcugccccuuuagugugcaccccacucucagcugcccccuuguugacacuggguguucaggauugcucuaucagaacuuuuuugguccuguguuuaguuugccuuucuuuuacugugauaaauaccacggucaaaaccaauuuaggagaggaaagaguuuauuucauccuagagucccagguuuccucaucacuggggaaagucagggcagggacuaaaguagaaacaaugaaagcugaggcucacagacucauguguucucuuacuugcucuguggcucaggcucagcuuguuuuucuacaacccagggcuaucuguguaagggauggugcugcccuuagugggcuagguccucccauaucagucaagacagucuuccacagacgugaccaaaggcuaaucagauugaagcaauucucaaaagagguuucccuuuccaagaggacucuagguugugucaccuugaggauaaaacuaaccaucaaaucccguuagccacauauguuuaccucauguugaguaacagacuuauucuucauauuuguguagcaugucucacuuucaugcugauugacacuaugcuuuucagaacuacuuuaucauuugaccuugggugaguuacuuaaccucuuucauccauucuuuaaucuauaaaggggauggccuuucuaaagcucugcucaucuuaaaaacacucaguagcuauucccaguuuaacaucguuggcagcaguuccacacaagggcacucacuugccggauccugucccuggcaaguagcugaugaaucacaaauaaauggagggcagcaugaugcccucaugagaaugugacuucugagucagacagaggaggguuugaagcucaguguuguaacuuaguaguuaaagggccuugggcgagagaauuguuuucccuugucccggccguuuacuuggugauugguagucuccuguauucugauaagcaggaagggaaaugacucaagcauagcuggcauguagccagugcucuguaagugguagggagugucccugcccaucaaggucuagcuucuuugauggcagauuccuucuuucuaaucgugcuugaauugccuguaguguuugauacccaacccauacucagugcuguugccagcuuaaacugagaugcccccguccacuagaggaggcuucccaaaccuaguuucuucacaaaguaaauacuuggcacaugaguaaucacccuggaguuugucuuaugguuugauugugcauauucuucugucuugaaguggcgcauccauuguuauagcuuuauuagauuucuuguaguuuucugacugcgugguucuuugcugucuuuuaaaaucaugaagacaugguauaauaguaguuguaacaggauuaaggauuugguaucuaguugccauuauuccaggugauauacaccaaccauuucuuuaacauucacagugcucuuaguaucuccauuuuguaggugagaaacuaaaacucuagcaggucauugcagcuggcccuagggcaugagccaugguuggggagcaacggcagaucucaaaggccacugcucuccgcugcgcucuguuacugcuugcuucaacucuaguuuuagaauacuuuauccgaggucagugauggaagucaaucaaaguucaaauuaucccaagucuaaaauuauagggaagacauaugcuucaaggcggauugacccauauccuucccccacccccacgagacaggguuucucugugucgcccuggcuguccuggaacucacucuguagaccaggcuggcuucaaacucagaaauccaucugccucugccucccaagugcugggauuaaaggcaugugccaccacugccgggugacccauaucuuuuuaagcuuucuaauacaucugggggugggguggggaggacaguuucuccugcucauagaacuaaagaaauaaagaggaguaagaaccaaacagcacauuuguaauguaagauucgaacagguucugacauaugagugcucuuuuguagucauucguccucaggccccuucccugccuugcucucagccucuucugacaccuucucacacgcugucccuucagauucagcagcaacaugaaucuuagcaucacgcacccccucuuccucacaugggagcuaaggcacggcucucccuuuagugucuguccuuacucuaauuauugacuuuaccuuggccgacuuucgaacaugagugagcgagcacugauuuucuacuaauaauacauaguccuagugacuugauuuuaagguauuuguaagcgagacagugggcccaaugaugaauuuucagauugcauuuaaugaaucccagagguugucaucuggcauccaccucuacugcaugggaacagacagagucacaaacuguggaaccggaaugaaguguguguucagaugccaagagcuuauuucauuucuccuuuuauuucaguaacaacauuauuuucacuguuaggaaaaagauuggcuugguagacuuuaggaaccacuuuagucagugcggauaaaugaaaaaacacaagugaucagcuuucauugugacaaauggaaacugucauuuaauuuuuauccccaauuauacagcuccgggaccaauuuuucagguggaauguuggagccauuaaaaagaaauaaguaaacuauacuauauuccaucauuuuucuggcagcuaaccaaugaucuguagccuuauuacauauacgcuuuuauagagauauuucucuuaaguuugugaaggguuuuauuaacucuuugcugauuccuucugcaaagcauuuuuucccuacuugaauuucauuuguuuuccucuuuuugucaccaagcguuggcugggauuuacccuuguucuggaccaagugauccagcguucaacucagcuucgcuuuuuaaauacucuucgguuauugcaaguaggccuaaugguuagugucuuuuuaauuccaaccaaagauacagugauggugcuaaugcugaguauaguaaggguuuauguggauuucagaguuaaauuucuuaaaaugcuuuguauaugcaaagcccagcugcuaucucuccugccuuacugugugauacuggacagugggcaccuccagaaaagaguguuacuguaguauugugugcguuguccuagagagugaacaaaaugcuuucauuucugauuugccaacuauccucaguaagcugguauuguaggcaugaccgucuccuucucuugucuuuacuucugguggugacaguugaacguagagccuugggcaugcugggugagugcacugaguuacacccugagacuauuaacgugcauguuucaaucucuuucauuuaccauugcacccacaaacuuagcgaagggcuuggcauaugaaacaugcagcaauaucuaauggcuugucuauuaauuucuauaauaucuaauggcuugucuauuaauuucuauuucuaaagggaauuaaguuaguaauaauaauaaauaauaaugacaguauugaaauucagggucuucugagagcaaaauacaauuccuuuagcuguguguauguguaguauuauauagaaaauuuguauguuagugguuuguauuguagaggccaaagaaauucaaaucaaaggcuguuauuaauauuaagaauuucagagagagcaucauuauuacuacuggaaccacugccuucugauuuccaagccuucccauacuaccccgcuuuggggcucuguaggcauauugcucauucuaccaguucuucaucacugaaagcaucagucuugucuuuuggaugcacaauuucuauauaacgugauaguggggaccaugauggggcggggcccauuagugguggacgucuacuugugggaaguuguugcuugguguuugcaucuuuuccuuuucaccuaauuagauauucuugggaguccuuggcucaaagacaggggauguuugccucuuccuggcuuuagcaucagaaugguuaaacccgguuuucauuaaagagguaccaguguguguguauuaugaccaauaaggcacuguuuuccuccgaugugugccuuggcaucugcucagaggaggaaugauacccuguuguaucuacuuaggaaacugucaucugguacuaucacuauucgaauaugcaaguaagcgucuaaaccugcugaugagaggauuccuguuggcugggaaccuuguuaaguaagagauguuaaaucauguaucgaguccucaggggugauggacuaaacagcugcacuuauccuuauuaaugccugcagacuccugcuucaggagcagcaaauggccuuugcuaagagucacuacacuguggagaguuacucugaggcaaguucugcauggggaauaugcauauauuaguuuggccuuguagauguggguggaggguaaagaaaaacccuagcaaauugcaaauguuuucccuagucuuauucucuaauaguuauaaaaggaguaaacucuaugaaacugaugcuguuggcaaucugucauaacuaauugcacauggaagguaucucuuuuuaaggcuacauuaggucuugcaaugggaggaagaguguuccuaguuggcuaauguaccugcacugauagagaguuguuggcucuccuuucuuggacucauggguuauaaaugagaauguuuucugugucccuguuuuuucaguuguggcugauauguuaggauuggaauuggugaacgagcauuucagggguagaagggaccauagauaauaauauagaccuuagguucaguguagaacacccugacuccuugguagcugugauaauagaauguuuuguuuuguuuuuuguuuuccuaucauccuuguauuugcuacucuuuguaaugucauuuccccagagucuaauccucuagucaccaaccaugagugacauucccggcuaugucaucguauuuuuaguucuuuuguuuaucaaauacucuuuucucugucuuuguaaauucugagccuucaaucuuccuugguauccaacuuacugaacacugauuauacaguauguacacauaucccuccaggugggccucugaccucuccacuuugguaguagcccacucucuucuguccuuugacucagucugcuucccaccauugcuugcacauacaucuugugcaccacaauccuuugugcaugcuggccgugaaggcaaucucugaucuuaaugcguuguggaguuuugggugccucagacagugcucaguccuuaagagcuauacaagaccagaugccuaauguucuaacugucuuauggcuggcuaccgguauauuuucuguauauauguagcuuuuagguugucugcccauacacucuucauugaacucaagauaaucgaaacgaaacacucugggcugucagggaugucugauuuaggguuuggggaacugugaaauaaugagagagguacugaacgugccacagaacaacuugucauugauuuuggaguccauauuucucucuggaaacauucgccugaggcauccaggugauuggugugaguguaagucagcaccuugcucauuucuauaaauuuugauuguguucacaaauuuaauagcauaaauaguuuccccccacucagagcuuuugcaccugaucuuuaugucauggcagaagcuuacuuaccauucccaagugauagauuaaucguaaucuccuccuuuugcaguucugugcaggagucaaauuagcguuauuaaguaucuugguagaaauaaaacagcauuacagguuuuuaacaugugucugucuuacaauacuguauuaguuagcuuuuuguuacuauaaugaagugccugaggcaauuaacuuccaaagagaaaaggacugcuuugucuuaugguuguggagguuucaguccagucuugggcgucugaacugcuuuggggcuuuaucugcauguuuugccugagggcaugggagagaaaacacaugaggugggaaggucaccgaugaccuaagcaccccucagagguuccacuacuucccaagagucccauuguggguggugugugacucuuguguaccuuucccugaugggacacugacuacagauccaagaaauguucccacuuaaguggagccuagugaacaaugaauuuccugggguuacuuacaggaacaugggugauucaaagguggcugccucaccgaaaugcccacugcagccugagggaaagcugugucccuggagauggcugggaaauuugcgggcuuugaaggcauugccacuggucugagucgucuucccccaguuuuuauaaucucugggguuccuguuuuuuaaaaacuucauaaauaucuuuuacuucuuccuuguuuugaacuucccucuuuccuccaggagggggugauucaguuuagaggaaaucacuauacaacacuggggaccaaaccuuaacacucgggcauuugggggucauuuuguccaaacuaccauacuauucaauauuucugcagguuuucuccauuuuguauuugaauggucaaaccugcaaggcuauugagaccgaagucaucauuuucauugaaaguauucaauucuuccuguaaguuauagcucaccuuaccccuucuccgugauugcaguagcacucagccacaucugugcacaugauuucugagcccacagggugcucugagaggccaggcuucaccucacuggauguagccauuuguuuuacuguuucuguuuauguccccccaccccccaaggagacaggaauaaaauagacaccauauuuaugcugcuaagaacagagcuuacuaaaaucuugaaccaaauuuggcuuagauuacuguauuugaagaaugaagagcauccuaaggauccaguuugcucagcagcugugaaggagaacauggaaaagcaggauuauuugcaucauuauucugaugauggccuuuggguccuguugaagcuaaugccucguccauggauucacugguguguucuccagccuucccucugaauucuuuacauaacgaauacucagauacuuaccuguauacaagagcagcauuuauuuauuuugagaguuuacuggugauagugucucuuuuuguacuugauuguguguguguguguguguguguguguguguguacacacuuguauauaggaguaucucuccaggaauauucgugcugaggccagaggaagacucucuucuagcucucuccaccuuacucccuuaagacaggaucugucccugaaucuacaacucacugaaucuagaggguuuacuuuuuggacuaggcugucagucagcaagcccuagugguccucuggucucuacucaucuccagccauuccuggcuguuuuacauggaugcuggugacacaaacucagucccuucaugauugcccaguaagcacucuuacccauugagccaucuccucacccuuggugugcuuuuucacagucaggguuucagcaaguguuuauugagcaucugucauaggccaagcacaguguuggcuauugggaguaugguugagaugauggauagaagucuugccuaagggcuuagagucuauggggagcacaggcaaugaaacuauuacagagucucauguguaggaagcauaagggaugaaaggcuugcuguucagcaucugguacagcgauuauguaucuaaaaacuaaagaaguaugccaaagaaauaagguuguggcuuuaaaaaaaaacaaaaccuaaauaugaauagaaauauuaaagauaucauuugggcauucaaguauaugcauaucugagaccuugcaguaauuuaagaguacagagagcuagaauguuuggaaucaggucugucauggagaaccugacauguuugcugugcuucauggucccugccacuuguagaacugaauuuaugacacuauuaauauagggaauggguuuaaauaauuguuagcauauaguaaaggcauaccaagauuuauuaagacugauuuucuuuacacauucugagccucaugccaguguuuugauggggaaaaauaaagcagagggaaggagugauuguucauggucucacugcagagauuacugaaaggccuucugugcgacuggaguguuauggauuccuucucucaagccaccacuuggcugugcuuugucacucgaggugaucugacagcuuccuauagauaacucugaaaugagcuuccacuccugacuuugcauaauaauuguauaguuuuaauauugcugaggucagcacguggacaucucugcaaaaacauuaguuaaauaauugguccuuuuaaguugcagucugucaacagacugcauccgcugaggccaugaauagaaauaggcaaugcaucaguguguuagucuaugcaaaucagaguuucacaggccgacaaggaccgcaaggaggaguggaagucagagaugucugcagugaucaagcaguuccuacaagagugggcuuccugauggacaugccccucuucagccacgacccuggugaagauugguucaggaucuuuguacagcucuguaccucucccucaaccaagccugucuucuccuguuguaaccaguaccugguuaguugucaaguauauauaaucauucacuaaaagccuuugucuacugauagacgcgagggcuuguagauuacauguauggaguguccaugugguucaggcaguugugcagugucgugauugugagcggcaggucgaagacccucugaugacucauggcaacccccucccucccagagccgagucucugcugguaaugcuucaccuuuaagaccgcuugacaggcguuaaccacacaugcaacaaaucaauguggucuagagcacagaugcacuugaucuauaauguuugucuucuuuugacugaugcgggcaaaagaaaccaucagauagcugcuugguuaauacagcuucguucugggggaaaaaaaggagaagggauacaguuggauguaaaugacccagcccuggagugacuggagacuuaccugccggggguggggaggguggucagugcuuagcugaaccaugcuaccaaaagaacucgcuccccugggguaaaugacauuauguaaacguucccugaugcuuuauuaguaucguugaaaaauacagucuacuaaaaauucuaaccgaucauuuuaaugaaagccgugucauuugugaguggcacuugccuauaaauuuuuccagagcaaugaaaauaaauuagaaacaaggccuaugguuguuccuucuuuccuuccuuuucuuucaccccuccccaacccugugaacaguugugacugauuuguuccguugcuucuuucuacugccuguagaacaucuguuggaaaauaaugcuugcccugucaguuuccagacucagcagcaaaagcaacgugugugcacaagguacgugucagcguuauccugcugcugcugccacgggcuucugggauacagaaggcagaaucaauccgaucauggggauagucguuaaaaaaaacaaaggucugggcaccccuuucaggaccgggaagcuuauuccaaaaugcucggagcagaacaccagccgagaugagauuuugaacgaaaggcacaaauucaggaugauuauugccuguuauuuaguggacgaugcuuuguucugagacuggguuguacucuuuugcuggaagcucacaacagaucaauaguaauuuuguuaugggccagaugucaaaacagaaaugugcucucaaaucccacugacuugcuaugacaacugguaugcuaaagucagcucuccggcaucucacgagggucuccaaagcuccgcaggccugucugcgucuaucacuaguggggauucuguuuuguguuucccuuuuuuaucacauucuucuuuugauugagaagagaggcaccucggacaaaccucccccuuucuccaccuuggccauggaguuaggugaaaucuacacuguagcuucuaguuacagauguuauuuugauggugaugcauaaaucaagucuauaguagaaaaauagcucuaaagaaaggcaaaccaccaaguaacuuuuuaaaaagugucauuguaauucagcuuuggcgguucaguuuggacccgugugggguuucggaguuaagucuauccugagggaaggcaagugugaggggcguuugcuuaccuguugacuuacugucuuccuagagcucuuuuccugggaaacggcaguugccuaccgagacaagcaguucccaggaagcugaugucucccuguauugauuugucuguguagaaggaucuagaauaaauuugauggaaacaaccaguaaucuggggcaguugcaacuugaaacuguacuuugagauggagagaauuuggucuugggcccauguuugucugggccuagccuucuuuuggcacuuccgccuaaaagcaagaaaagaaaaaaaugagagcagcuccaauccuucagcccuggaaaggaccgaccuacugugcgcagacugguacaguguuaugccauugcccuuucaacgguugggugggccugcugcuucuccccauuaccccucgugugaaguggacacacugucuaccugggaagaaccauuccugucaagggugccuguucucauaggaccugcuacucugccagguuuugucuuagucuuugcaguucucuacuugguuugaggccggaggcugagauguuauugggccauguggcuuuugaagcuacucagcugacucccauagacaucccacucacaggaagaauugcuuggaugcugcucuucucaugacuacugcagugcuauucagagcaucuaagauaauaggugcagagcaaaggggacagggcucaaaucugaccgggacccucgugaagccacucuugcauuuauccaugacuacugaaaggccaguugauacucuacuguagcaugauaggcuccauguuagaagcaagagguagagccacgauuaauaagccagaucgagcucucuuagaagcuuuguugugcauacaagcauugcuucuagaucccagcagugagcugcaagggaagaugaauuugcaagcacuguccucaguucuuuaauugagucuccugauaacuaagcacauaaaauugccgcaucaucagucagagaagcuaagcccuccgaggauuaagucuaagacuugggcucaugggauggaacuaaccaauuauaugccucgccaucauuacuaccucaguuguauuucaguucagagagugaacgagcaugacaaaagaacuaagaagaugcuaggugggucucccuccccaaacaaaagcaagaaccccaaauccaguaggggauguauaggaaagacagaauuacuguuugagaacagaccagcaaagacaaugaagaaggcaaaggguguguccaggguuuuaggaaugcauuugggaccccugccucucuaacaauguuaaucuaaauuaaacaugaucaugugagaaaaccacacacacacaugugcacacacacacagacacacacagacacaauaggaaugaguuagugagaacucaugggagaauauggggaaauggguaggcagugaaggucugaccacugggcugguuacagagccuggugccucucaugggauuggcagcucuccuagauccggauagugaucgcuuuguagcuaagggaagggugaggugaagugauaggacuacauuggggacuaaggagcaggaugccucuguuagagguucaguugaaccuugcagucaacucugucugaucaagacagaugcuuuucaagcuaaaaugcaguaaugaagacugaaaguucaaagaaaaugcggucuuuaaaacuaaggcaaaucaugggccuggagaaccccgugugaagguccuuccuuccaagcuugugaacucccauuugauggcgacguguccuguccuagaaagccagaggagaugcuucuugacucauugccaguccuuuacuuaaacuuaaaagaucuuugcauuaaaauugcguauuugaagugcuggcaagcuaauaaauucagggggcuaucuuaagcauugucagucuacaauguaauccuguuaaaauaauugaguauuuucugaguggagaauucccucuccuccuguccacggcucacaagagaacaacauaaaagggauccuaggauguccucugaacaucauugaagccaccgacgugcuggcacaagguaauucucuucaguaaaggauuuccuuggcucuaucucuuuaaaaggcaaaacccgacauaauggcugguuuauccuaauaaugggacguggggauuauauugggagggguacuucaucgguccuaggaaugcauggucuguuaauuugugcucauuucagagugugacugaggcucccgcguaacuugaaacguuugcguuuucuuccuucuguucauuucuugggcuccuuuucauccagcggcuuggguuaccuugaauuaaauugguuuauagcauggcguuuucgggaaaacucugcaaaagaaaugguugcauaacucagaaagguuugcccuuggagugauuuagucaugcuggaugauaacuggggagccuuauugacucugagcucccucuggaaccacauuccgaaagcugugcacuuccgugguaccugcgaggcacucacuugagcagagccacggagcagaggguugcaguuacuggcauuuuuccuaaugcauuuuguaugugucuauaccacagggagacaugugugguuauuguugaaauauuaucuacaugccuuugccggagaagaagaaaagccauuguucagcagucaacagaaagaugucuuguaguguauggggucuguaugucuguccccccuaaaacacccacauagauuuauggcuacacuacuuggauaacucuauuugacuaaccuugaguuccacaaugugcgguuggcaauggcguucaggagugucauuuaaaugccagcuugcuuucuguucaccugguuuugacugggaagcaaggcuuugauccacugcauacgugcgcugugugaauccaagcucagaaaucaaagucucagaaaugugcagggcuuaauuugcuuuuccuucuaaacagguaggcuccugucuaaauaaaacuuuguguggacagaugcucauuuuugucauguauguaagugggacguguugcguuuguguaaagggagcagguuuaagcggcuggaugugaauacccgcuggcuaucagagccaccuauccaucucagcaaauccccucucaucuaacaacauugcaggaaguuaagguaauugauucucuugagcaacacaaauaguggaauucuuaaucaugcuaagguccaggcagagaaacugcuuuuaugcuuuaagaaauuugguuuauuagucuggugugcucauuaaacaauuauugaugggcaguucaaccugugccaggcucugggcuagaugcugaggugccaggaggaaaaaagguagaagcuaugaccuucucauccacugaagaagacagaacccaaauggguaauaauuaugcaugcauucauuaauucaagacauuuugguaagcauguaccaggguaggggaacuuuugauaggaaggagagggggagagauaagcagagacagacuuagcccucaugguuuccacagccaaggcuaaauagccuucauaguauuuaggacuaacuguaaagugauccauuugucaugaaggagaaaccauguaaagcaaucacaccaggagaacuggaccugccugcgaagucaagggaggguaucuuccaggaagucgagaagagacugucucgugaccuccagaguuagccagguuaggcuggacuggaagaucuuucuagagggagccaugugacuuaaaaaaaauuucugggucauacauaggcugcagucaguaacuugagagagagaagggacaagaagcacuggcugcuuuagggacauuuugagggcaggagaaggagcaucaaggaaggagguuaaauuucauuguguagggauugauugagauuucuauaaggaaggcagaucccagugagacauccuagaacagugguucucaacuuuccuagugcugugacccuguaauauagcuccucaucuugugaccccccaagcuaggaccucauaaguuuauuuuuauugcuguaaguuugcuguucuuaugacucauaauguaaauaucugauauggaggcuaucugauguucaaccuguuggggucacaguccccagguugagaaccacuguucuagaguacuguuaaugcugacauuaaguaugaugaaauaauccucaucuugcuucuucaagacuaaauucaucuauuguuauuauagcugucaauuuauuuucuaauuuucugagaccccuuuuuuucugccaucugagaaauuguaguucuuauccauccugcucccuuuaauauaaugaagacaguagacguucucaguuaugacuccauaaaggaaugucacagaacaggcucaaguagaggacagcgucagggugaaggacuuccagcugcacgcaucuuccagccacgugcgugcgcagagagcaccugaagacggcaucaggaauggagcuugcugccucuugcccucccugcccauuugaauucagaaaauuuaagugauuacuuuucauaucaaaagugagcggaaauacuaaggagccuuucauuuauaaacucaauucaguguaauuuauuuuauauggaggagagccuuaaauuagcugucagcugggcuccacagguggaugggaacuccugagugaaaugaccaaauguccaguccuaaggcauucauuuucaucuccgcuuccuguugaaaacugggagacgugaaauggcgagauaauagcucuaaacuuccaaguaauugcuuuuguuagcuccauucauguuuacuccuauuaauuacuggaauuugauaaccccuuuguuuucuacuuagcaugacucugaauggagaggacagagccauaaaucaggugggugguuuucacuaaaggcaggccuccuuugcuuugauguugacagcuuaaggcuaauucuccaagcuugauagguuuauaauucaaaaaggugugauuuaauguugguggaauuuauuuucaaaagucuuuaaaggagaaaggcguucuaaguagaaaaugaaguuuugagcuaaaccuuaagcagacaaagacugucaggguuucuagacaccuggcauuggagggcucuguaggacacuugucuucaaccuuucgcuggaagaaaacacuagacaaaaaaggacaaagcagacagaaagugagggagcuguggcacccaaggaaugcuccuaggauaaaggaugucugcuuauuuuuuuuuucuucuguuucuuugucauugccugcagacaguaagagcauuacauuuguggcauaccuuagacgcuuuugauauuuaaccuggacuauacugucguugggcuugggaaaaaaccuggaaucuaucccuaccccuaaucugggugguucauaaguuucuacaaacgccugaguccucaucucauuuacacugcuaauguuaaggauagacugaguuuucaugcagugagcaugcccacagcugcacuagacacuuggaaagauggggagagcaagucucguuuaggcccuuccucauagcucacagacacacuacauuguuuaggcccugccucauaccuugcagacacacuauccucccaccugaaaucacuugaucuucaugcguuuuguuuuggucucuucaugacacuugguuguguucagcagacaaauuucuugcaugaugucugagaaaaaauuguucuaaaauauaauacacuuuucugccuuucaaagacauagcauuuugaauugagucuuacuuaaauaaaugacuuugggguccuuuagaauacuaaaucguuuucuuuagaaacugaagugggguugguuguuugcuucauucugcacucaaagaaugcugugcguuucucgaauucuccacggcauuuuaaaaauaguuauucuuccuuugcuuucagcuuuuuauucugcuugaaauucugguuugauucuuggacagggugggaauaaagguagcuagaauuaucaguccuuacaaguaugcacaguggcacaugaucgcagucacuguccucccaugguuuuaugagagacuuuggacugaggcaucugggugacuuagacacugucgagagcugggcuuacuggauacuuggugacguagacaaggagguuuagaaacggucuggucugagguguguuccugugagauccuuugcgguaggaaccugugguguaagucagugcagcauuuugcgaguuugucccuugcagauuucauguguacgugcaugcacaugcaaggcacuagcuccucccacagcuauacaccagggauugaagucuuuaaaauaaucugucucuaaucugucaguuguauauuaagaauuauaacaacgugaggaguugugaaaguaagaauugagagcucacagacaauugcaaggcuucuagaccagauacuagauuacaugaacacacaacauauugauuuggugaagaaaggcuauauauaguacagagucgggcuaugacagaugggguucacuagcaacacaucuaugacuucuaggcgucauuccaaacucugagacaaauucaccagaugcacggccucuugccauuuuuaaugaauucacuuuuauauaaaugagaagcauuuauauauauuucuccuauggccaaauaccccgaaggcuuuauaaaaacuuuuacuuuauuauuauuauuauuauuauucacuuaauggauguagugccauauaguaguagguaauuacauugguaauaacaguuuuuuuccccuaguggaacucagagaugucuagauauuuaaucuuuauauaagaucacacacacauccaauaaauaucuguaguuuuaucuuagaauuauguucaagaugaacccuuucagaggugguagaaaaacucaucucuuagcuccuggggagaauuuuggaagcucagaucuguguccuuuaauuuuugauauuauuucuuuggauugaaacucagcucauuauaaauauacuucauucuuaauuucuaauuaggaaacuacuacaugaauauaauuuuuuucuaaaaaaugcuuuagauuggggguggagcccagugguacagugcuugccaagcaugcgugagguucaguguucagugcugcaaacaaagaacaaacauacauggauacauacacguacaugcauacaugcauacauacagaccuuccuuucagaaaaucauggaguccccauugaugacucucgguccaucccaguugacaucuuuuccuuccauuuccuuccccuucucugccuacucauucugcugucugucuguugucaucuaugcaucucuucaucaugucagucacuguucucuccugagguggguagaaacacagcaucuguggaaaccuugagguuccuacgugaauguucuauucgugguggcauacuguccucaucaccccaugagguucugcuuuugacguucagugucccagaagcuccgccauguugcacucagaccuccauuuaaaggcuggauucuauccuauagcuauagcacacacuccuguuuauuuagcccucccuauauguuccacauaauggauuuuggguacuuucucuauuuugcuuauuuuuuuuuucucuaaacaguguuuggaugggguuucuugcccaugcguccacacuugcauguaugaggauuucuuuaggauguauaacaagaaaugguauuacugggccagaguaugcaugcuucagguuuaauugauagaaucugugcccagggccgaucauuuuaaacuuucuuuuagaaacuuuucccccuaaucuauuuauucacauuacacccacaucacagcccccuccucccacugucccacucauguggucccuccccauacaccuuucucuuuaccucucugagaagggaagguccccccagaauaccagccuacuaggccuggccccucaagucacuguaggacuagguaauccucucccagggaggccagacaagacagcucaguuaggggaacagauccacaggcaggcaacagagucaggauaaaccccugccccaguuguugaagacccacaugaagaccaaacuacaaaucugcuaaguaugugcaagggggccuagguacagcccauuucuacuuuugcuuggugguucagucucugggagccccauggguucagguuaguuaaccugacuaaccuguuguucuuguuguggguuccuuaaucuaucuccccacacccccaacuccaauacaagaggagcucuguuuaauguuuagcuguggucgcuaucuguuuccaucagcuucuggguggagccucucagaggacaguuaugcugcuaggcuucugucuacaagcuuaacagaguaucauuaauaguguuagggauugguucuugcucuugaggugggucugaaguuggucuagucauugguuagucauucccucggguugaaagguuuguugguguauugguguccuuaguccuccacuuggagcccugccuggcugcaggagguggccacuuuaggcuccauauuuccccacugcuacucauagacucauagacucccugaauccucccccaucccaggucucuggcacaucgagagaugcacucccccccccccccgcccgauuuccccuccuucuccuggcccgcucucccuacacugacuuccuccccaucauuggaagcuuuuuuuuaagugaacaaaguugagccaaguggucucagauggagcagaaguaaagaugcucuccuuucauccuccuguguuccuguaguauuccugucugccauggaggguuguuuuuaaaaaacauauaaauauuuuuauuacauguuuguuuauuuucucccucucucauacuccacucucuccugucccccauguacugcaugcauccugccuaugggguccacccaucuugcugugccauggagggacaaugacacaguguuuaugaugcucuggcucuuaccccgucaucccgucucaucucagucugucccugugagcaguagacaugcaguccugauaguucaacuaaaaguauccagauuuugagaagaaaaguaaguuaaauuuauccaggccguggaagaacugagagagggcacaggaaggaggguggagaaaggagaacgcauccugguugaaacccaacugguguagcagagaccacucgcuucugucucagcuaacuacguacggcuagagcaaguauaucuaagaaaagaccuggaagcauagccuuuaaccugcuucugcuggagcuacagucugggccccacccacuucaagccagccauagagucgacuagucgacuguuugcuauacucuuggugcauugaaacuugaguagaaggacagacaggugagucagagggucagaaucugauccugcgucucaguacuauuuuuuuuucuuccuggaguuaguuucuucaguuuuauaucauuggugagagagacuauuuuauuuagcuacauugcaagucaggagacagaacacuuuucuagcauccacuaaucauguaggguggaauauuugaaaacuucacagaaaauucauguuugggagcugcuuggugcugcuugcuaagauugauuuugguuugaaaaugucagugucugugcuggucccgcaggucccccccccccccccccccgccuccuuguugccagagucccucaguagcucagguuggggcugcaucugucccugcagagcuuuccuuucugcccgcagaaagcugguuuguuuggcugacagaugggguucccgcauuggccaggaugugccuaguuaaaggguuucuguucgaagccugcaggggaagcccagcuccauauagaccccugcuuaccacauucccuucauggucccguaaagcagugaggaagguuuuaauugacauugucuacuguuaagaggacauaguaugggcaucuuugcagagauuuacuuugucuuucuuugaaaugucaagcuaguaagucauuggauaaugcagugggcccacuuuugggcaggagagauaucuacuauuguaguuuaucuuuuucaaucugggcacauuaaaaucuuaaaagcaacaaucccagaaacuuaugucacaaucuaaaccaaagcuaaagcugcuugagugauagguaugguuaaaauaacaguauuuaaugcccaaagcacaucgaauuugggugaagaggcugcauucugcauaaugccuggagaugucuccuauggugugguuaccuagcaacaaguggaaacuguaugaaaaugaggcgcuuaucuguuuuugaagugggugcaaugaaacuuauuacgccagccugcuuugcuuggcauguuauuaaaaucacagcuaauguggaaagaacuggagccuguucccauucgauacagaggcacuguuaaauacagcuacuguaaaaugucaaugcuuugaucagggaaaugaaacccacagccuccuuaaacacucagcauugagauguuagaaacugauuuguauuauggaagauuuauuaauaaugaaggagcugacaggaucuguaguggugacuuuagaagcugcuuguuauucagauuaaaaaaaaaugcagggagccauuuauaguuuuguccauaaggguagcuuaguagauagaguuccggaucucacggccagauuguauuuaacugucugcugaacguaucgauggauucuaaccacagccuucuuaaguuuguugaauuugcugaacuccgauguauugccuggauccauagaaauucuauuuuuauuuugccuccuagaaacaagcuucuaaucuuuaauucuagcaacugccacacacuuugagggacacagaaagcucuuccuggcccucagcguugcucuugucugugcuuuagaaaagugaguucuacccuaggccugcccugccuuuucuuugucugaaguucaugcaacuucacauugaaguccuacuucacacuuuauaaaaacagaaagucacaccuagaacucuaccaaaauauccucucugguggcuggauauucuaacgugcgcuagcaccagcucucccacagaggaaaaaaaguucccgugcuuucucugcucaucaaacaccugugaugacacgcagaaaucuggcacacaggacccaacuccguuagucguauccugacauuacuuuggggguuuggaauguguuucuguguagcagauggagcuauuaguuagccgagcuaucuugaagaauugcuuucccagguaaucagcucugcucauuuaggaugucgucucccuaccucgauaugucagcucaagaagcaggaaugauuaaucgcugcgaguggacagggagcuggaauaacucuguaaggggaaccagcccuggugucccccaguacauuugggacuucagagggcuaugaggcagcaaacaagauggaaaugaugaccagggagcuuccugaagcuuaccugucacuguauagaguugcuguggcaaccugacgauuugcaauucagaggcagaguagagcgagacaaaaccuuaagucauggcugucauuacaguggaaggggugccaccaacaccuggcagucucuauuacuucaaguugucucuuuucacgcucggaggaauaaaaugcauaaaagauuaauaugcacaguaaaccuuucgguaaaauauguauguguucugcauuucagaugaguggaaacuuuuaagaguucuacuguacucaggucaacauuaguuaauaaugugcaaaauuuuggucauaguguuaagagagugagaacuggaaacccagaauaaacauaccaagaugucuccucaaguuaaaaaauuuaaagaaugaauugcuguguguuuuuguugucccuuauggaagugcucauaguuuguuaguguguuucuuuugugauccacaaggagaguucugaggcuggucagaucuauaagaaaggugggguuuuguuguuguuguuguuguuguuuuauuuacuuauuuauuuucccuugcuaaguagugacuaguuuaagcuuguccaugugcaagucuuaucuauggagaugacuguuaaaaugauggugaaggauucucuuuuuagggggaagucaacaaaacaacugucauuugugugagcucuuuaauuucacgauuuaauggaaaccagggaucuaacagcaaacucaugucacagccuccauccuuuggucuucuucggaaagcuggaggcuagugcuugcauauggcagggcccacgugagcaggguccacgugaguuuuagcuucuuguugcuacugaagguuagggcuaucuuugcuauuugcuguauuaaaaugcacauuuuuuuuuaaaauaagcaagccuagcuuuuaacauuuucaagacuugguaugaucaguaacuaguuuccuucucuuuucucuucucuucucuucuuucuuucuuuuuuuuucuuuuucuccuuuacacaguguuuugcaaguguguuuuaaaagcacuuccaaccaacuuuggaguuuucuuuugaagaucuguuucugagugucaggaauaaacacaguggcuaaaaacauggcaguccguuucucgacaagucuggaauuaaaucuagagggcugcuguuacaaagauuaaauauuuaauauuaagaauuggcuucuaauuuuucucucaucauuuuggaggucagaacgagcugaggauucacuuguaaaauguugcccuuguacaaggacccuuuaaaccaguaucccgaaaucuggguuaugguuaagagcaugagaaaacaaauagaugugcugcucugccucggcugccugacagcauagcugccgugggcuugcacagcuccgggcugcugcaacuggccuccuccccaccauggugguauaauuggagucagccuucuugaagauggagccuuuuauuuuuguggcuuucuggggaguuguaaugccuaccugcuuuuccuuuuaaucagaugucugagagcugcagcuucgggucaaacgagcauauucacaccuguuuuuuuuacaggguuuucagaaacuggagaauuagguuuaaacggaaaccuauccugaauagucccauuucuguaaauggccugccggaguacagcucucuccagcacuagcugggcuuagagaagguacugacaccuauaauuuguaacacaguuaaaauuguuuaucugaccugcacacaccuguagucaaggggaaaacagcugauuuuuaaguugagcuguggaauuuugcuuguaugcccagaugucccuuacuucauuugguagaaacuaauagcaguagcaagaucucaaaguuaauuggcagcugcuaguggagaguccugugaauggucuggaggaacccccucaggguacgaggcugcacgaagaugugugacagagcacuaauucagaguucacauaaucaccguacagaaauauuuaagauggggcucuaucaggucucaucuguggagacaugauccuuuugugucuggcaggccucaugcaacaaauuuucuuucuuucaagugauccccgaagccgucaaguucauuugagcaaagcaaacuugagggagacauguacagugucugcgauggcaagcugcugaugacauauuuuuagaauuugaauuuuuuuuuucucuucccccacccuuggagaaacugaacuuuuauucaagcucccugcuguuaacauuggaaagaaaaguuuccugugccaauguuugcccaaacggaggaaaauguuugcauuucguaugcaguguucauagacuugaugaguggagcaguuuggcaccgcuggugaacgcgccugcucgggguucugcagggcaggcagagaugguguuguggaguucugcugcgacucuuuaaggugugccugcacaccucugucuacucgagucgggcuuguacucagaacugacuugcagggacuuugaaggucauuucuuaggacagagguuggcuaaacauuggugaccaaaaagacaucacguucuccauuuccucaggauaagggaguucaaacccuggaccaaucuccuuuuucuuggcaagguuguguguauaaaggaccuugaguguuucucugauuuuggcugcaguaguaccaacuuagccaagaugcauuguggccuuuuauuccuucacucuggaaguuugugccaucaaaucaguccaugacauguuguagacuaucuuauuaaaaaaaaaaaaucauccugggccuagggagguagaucaguugguaaagugcuugccuaccacgcaugaagccuagggcuugucucccagcauuacugugccucaugcccagagucccagcccuugucaaguggaagcagggugaucccaaguuucaggucaucuguagugacauauugaauugagggcuagccaguaauacaugaaaccuuaucucaaaauaaaaagaaaaacagacgugugcaacuaagguguauguguguguguguguugguggcggcgauguagccagaugugguuguauacaccuagaauccuaacauuuggaaauggaagcaagaacuccaugagugagaggccacccucagcuacacagggaguaucugucucaaaaacaagcaaacuagcacuacucaauugcacuuucacuggacaaaaucauaauauuucuauaugcaagauagaggucaaggaauaaaucauguccuguccaaguacgugugccauugagagagguuaugacagcaguggcgaauucucugauaaguguauaacaaaugaccuagacaagaaucugagugauaauaauuuguuccaagagccaguguaaggugauguaggaagauacacuuuucuuuggccucuauccugcagcaucauugaaucagguaagugauucugcuuuggcuucguucauccuggguaagccaagaagaacauggcacgggucauuaagauuuacagcucaaauguaaauaauucaggacccacaaacaauaauuaaaaaccaacuguggcauggugugguaucagguccucugggucccuuugagcaggaacucuuccauuuuggcuggagaccuguccaucuggguacagaugguuguaagagcuuuuuaaugcccuuuuuuaaugccagugaacgugucuuuggauaccaucagaaccaauggaugagggggauacaaacggcaggguaguggcagcugagggaguaaauguccugaauuuguuagacaucuguagaaacaugcaauuuguugggcaggaaauuguaaacaaaacagacugcaucaacugucaacacaccugugacacccugggaugccagcuccgggaguguaauggcaacuuucagaguccauaccuggaacagccuguugaaacacggcacaagugccagugcccuuggaugcuuccuuuguucguggggccagagcuuggcuggcagcaucaagcagucgggcgugaggaaguucagccaucagguggaagccaggucuaaguuuucugcuguggcuugacucugugucaugaucuccugugcggcccugucuuugugacaguaauguguugcugaggggcucaaggagccagagagcucgagaaacauaccauaguuguaguguaggaccuggccaugcuccuuuaaaguucuccgggcaauucucaagcacacaucuguugagaaauauccuccugaguauuucaaggugaccuugaagaggccaugggaagacauuaacuggauucagcauucaaaagagcagugcaucuuguagauaaauaucguucaggacaugggcaccguggagauucaagugcuaaggacaaaacuguguuuccuugaugacucucuguagaggagccagcugagugacguuggguuuggauguaagccacuucuugagucuagcaucuguuccuagcccuggaucuucccaguaaagguccauucugucaccaugcucgcccaguuuaacuaaucagauuacugcgucucggaggcucauuuucagguucauggucaaagauuucuuaacucucuagaggauuccauuaauuuccuacuuuaaaagaccagaugggguauuggcuuuaugaaccugaacacauagcuuucauuaacagggagauuuuugcaaacuggaaaucucuggugaucacaauuuauaauaauuaucauaugaaguaagaauuuaaaagggauauugucuguuuauggcucguauucuuuaaggcaagaggggcaaggcagugggauccccaggagacauuucuuggaugcucuccugggguugcagaaggcugggaaagaugucuguugcccagaguucucugaguuuuccagagugugagagauuaagcaugaugaugaggaagccgggcaacaggggacauggaacccagggcccggaaauaauuuaggaaccugagugcuagggcugacucggaggaagagagucucucaagauaagaucuucccgaggcaugucugagguaggaugugccgccagcagcaaaguuagaugcugcuucgacuuuuuguuaauacauucauauuuucacccauuauuuaucuugucucuuaccuucagaaaaaaaaaucuucauugggcauucagugauaggccccaguucacugugcccucuccuucucuccuccuguaauauuuguauucuaaauuaugauugaguggguuccugaauauuuuaucuuuaguagauuaugauguuguauaguuuauguaaauauuugucuggaggugccuuaaguacuggcuccuguaaaggcucacaucugaauuguuuuauugcagccacucugucuaaauuaagcccuaaucucuucaauccuauugucaaggccucacucuuggcuuggguuuaauggagguaaaauuugguuaguuccuucaugugguauauuuaauuugauuuuucagguagugauaaacauugggguuugggcuauugguucauuggcauuaauauguaaaagccuugaucucaaggauggaacaguuuaaugcacucugcagcagaaaugcuuucagauguauaauaccguguguguguguguguuugugugugugugugugugucugugugaugauucugauucugcuguggcacucagcugaagcaaacacccaaaugacucaugcugucuagaggguaguaguugauuuuggaguccuggaagguagcaguuugauuuguagcuuucaguucucagguucuguaggaguuuucuaaauauagcagucuggaacagacauagaccacaugaugcagcagacacucgacuguccauucuuguuuaggcuaauaguccuacccacuugggcaugucguuccucuuauaccucagggcuacgauguuggaggaauuuuguuuucuucuaauggaaaagaaaagcauacaagcucagccacuacagugcaaaugacuggcguaucccaggacuggcaagacgaguguuccccuaagaucuuacuuuaaugcugcaguaaaaccuucccagcgcuuggaagguaggagagcagggggaaaaccuuucuucacaucaaauucaguggguuuuuaagucauuagugcaguuucuugcccacuucuggaccagauauugaaagagucagauccauaucaugguauacgguaagaauaccuacagcaucuuuuuuaauacagguguucucugcuuuaagacuugauauauugacaucugagccaugccugucaggggauacuccaguugcuuuagcacaguaaugaaugacuuugcaaagauucaccacaaauuuccuauauagagagagcucccuuagucaugaaaugcaugauucaauuaaaauguuuugauuugcauuuaacuuugcaggaauugacugucaaggugauauaacaguuuaaugagcugcuggggggagauugugcagucuccagccagccgcuuaucaagugaguugagaucuguuuucucccgaugguuaaagaaagauagguacugggccauauucuucuugggcacuuccuuuucuccaguguuucuguaaacacacugacgucugcagcuuggaugaguuuuacaugucucuuuacgcauaauaaacggccaccgcagcgcuucucaauccaccacaaaugcuuuugaguauauuguucuaggaacuccaccccuaucucaucucugcucucuuauuaaaucgcauuucucauggcugacaugauugggucuaaaugguaacuauuuuaguucucaaaaauauuaaaaaauugcccagaucauuuucugauuuuauuacuucuccacuuugauacucaggguggagcccagggccuugagcauuggaaauaugugcuguaccacaaagcuacccuucagccugauagcauuucuucuauuagcuuuucuuacuuauuuuuugucugagcuuuugagcugugaguccugaaucugcccccagcccuggcucccccagcccacgugucuguaauccuugcaguuaagcagcaggaaauuggucuguggcucuccacugucuuggagcagaggcuacugcagcuucuuaggacuagaguuauguacugaaucugaaaauaagacauuuagugcuagugcggaacggaacauagugcugggguccuggagcacaggaugaauuuaaauaguguggugugcuuuaucugugguuguugcuccuaacugucuuugcugcuuaaauacugauaaggaacagcuacaagaauacuagaugugauuugugcuccuccagccgacugcuccccggcagauuuaugcaauccauguuuaccgugggagcaguucgcuucauaucagcuuuacugauucugaugggcagaaauagaaguaucauuguuucauauuuccucacucuggagauuucauacaagaaagcagaggacaauuggccaaagaugcacagcuuugaaugugauacccgcuuuucacagaaaugugucuuugauuaucucuucauaaauacaugacccagagcuaaaauuuucugucagggucuucaguggaguuguguauuaguggcgugacuuggcauuaucgucugagguacugugccauggcacuccuuauaauacucagagacaugcagcuggcauggcagauaacaguggacugaagggcuccacaaucugccaguggcuggcucuccagucuucguguugggggcuccauuuuauaaguagaaauggggccggggugaggcaaacagggaugcccggcuacauccuucaaccuuaagaucgcgcuggcuuuuucuuacgugcaguuuuuuuuuuuaccccccacaaaaacuauccuguuuaucucacuuggaucagaaucagaguuugagcauuguuuaauuguuuuucuuuuccuuuuuuuaaaaaagcaaaucucuuaugaccuguuugccuccuacacuuauuucuuuugcauauuccucugcucauaacuuuugaaagcucauaagcggacucucuaaugccacacacuaaggguugagaaagagugcaggggacaugagcauaagcaacaauuggcugucugcagacuaaaauugcucuuccgggugucaccuuguaagcucuccugggaguuaucuccuaauagcacugugagguggagggaacagcccacuucucaggugugaaaaaacggucugaaagagguuaagagauguuucccgagucagugcagccacugugugauucagcugggauuugaaaccauuuuucagacucaaaauguuuccuucguuuucacuguguuagaagagguguaauaugucccucaugcaauucugaaguugaaguucccuuuaauauguagaucuuguaagagaauccucuuuaucagaagauaauugauguguaaagaaaggucacauaagugaacccacuuaaagcagguaucagaaacuucguaguaaauagagauagcgagaagcgaauuaaacuuuacugugcugagugaaacccgaaauuaaaaauguuauuuuaucuuauguuuagcaacacugaaauuuuauuuccaccucuguguuaguucuuacaccuagucaagaggugacuguucucaggacagcuuuccugacccaguugagugguggaaagccagcccagccccugacuuaguccccuuuccugcugcugugauaaggugaccugacaaaagcgauucaagggacaaggaggcugcuuuggaucaggauugcaggugucaccagcacauggggugggaagggagcagcuugcauuuacaguggagaaagagcgcagcaagcgcgugcaggccagagcuuuccaguuuaacaguucaggucccugcccggggaauauccgcauucccaaugcaugugucugcccacaucagugaacacagucaagacaugcuuccacaggccauggcuuacccagagccccgugucucugcugauuucagauucugucacguagacaaugggcacuaacugucagagucucccuuugcacaguccagcuuaggggucucccauccuuucugcaugguuuuauuuauuuauuuauuuauuuauuuauuuauucaucuauuuauuuacuuauuuuggcucaguuuugcaggguacucauuggcuuuuuuauucuauuuguuauucaggaaguuuuuuuuuuuaaucauauucauugauuucaucaaauucuacauuuuuaccuuaaugcugcagucugguuuauuggacuguuauacaauauagaaucuucuaggaaccuacaaagacuauacauaaaaacagauuauguuauuuuacuaauugaguggagauuaaauuuauaaguguuugauauauuuuguuauggcuuuuauuuaguaauuaaugacgggaucaaauauuaaaauaacuaauagaaccauuguguaauuaaauauuguuagguuguccuuucacguggaagcauuggaaguuuauguguucuagugcccagguacucauuuuauggaaguagaagucuaucugguaaagcauaauggaagucacaaaaaauaagccacgauuguaaaagaggacuuuguuuuaaugucgcauuugcauuauuuagcagauuaacaauugcaugguuguguauguguaguaaguauggaggugacguuugcauaaaggaucacgucuccugagugugagugauaucaccagaaggaugguagguauuaguuuuauccuuauagauaauaagccauauugcuaagguccuguguuaucucuuccauuuacuagcuauuugaacacuuugaaguuacaucaucucucaaugccacaauuacccuguuuguguaagggagaugugauaucugugauagauugauuuugagaauugaguuaggauauacauguagagugucuagaaacacagccugacacuuagaaagcucugagugaaugguaggagaguguguggcuucugaagaagaaaaccuguugaaaacugcugaaggcugggaccagcacaucacagccuucugccgcuagcauaaauaaauaaauagcaaaaaugaauuaaaguaaguaaaagagaaaaccagaaagagcuacuucucuaagaaguuuauuguugaacagaauguaaacaauuauuacaaugcauuggcacacauaguuucagaccuuauaaaaagacaaguaguauuuuucugcuuauguaaaauauuucuucccuuucaugugcuucuuuugaaucuuccuccauaaguauacuacguucucucucucucucucucucucucucucucucucucucucucucucucucucucucucucacucuuucccucucucucucucucccucccucucucucucucucucaaugcagaagccuuccagcucuccuugaguggcugagauggucguuuuaaaccugcuuccucauguguaagcacagggcuguccagugaggauuuauccugcugcugccuacuugcuuagaguuguaggagugacggugacggaugaacaguaauugaggugugaauagaauuuuggaaaagauaaaugauacuguuugcuauggaacgugcggcauucucccauuguggggcauggcugguuauuaacucucuuaaugggcaagggcucugaugguugcaggcuaacugugguuuugagugaacucagaaucuguuggugguaagugauguuguuuaaauagagaccuuauuggaucgacccucggguggcguuugcaacugcagugcgguaguuaacccccugugagucacaggaagaagcgcgggcuuguugcucaaauuuuucucuuccuacauucuguaguucagaacagaaccugcuagaaggcuguguuguucuuccuccuauggaaaugugauuguaaaucacuguaagaaagcaaccucaguguaauaacaauuaaaaagauucaagcucgcuuauaaaagcagguucaguauguguuuuuuaaauugcuagucugcuucauaaacuuguuuacaggcuuccucauuucaacuuccuuuagccucagaaucccgccccccucaaaaacaaaacaaaacaaacaaacaaaaacccugauuggauuaaacuagaguauuuucaggcuaugcucaaaccuuguggccuguuguugaaaguuuuaugguuuuccuuaaaccuuauaaaaauacuuaauaaaaaaaaucagauaaauaaaggggccucaguuucuuccuuuaguuacuggguaggagcccuuguuguauuuuaauugacuuuggguuuuaucaaauucuggcccuguuugcagaaaugugccuucagguauucccacuugcuugugaaggucugugauaccauaagcaucaaugacuucuuacagcaaugaguucuguccccaggauuuuuccaaaauagaauucuuucuugggaaaaaaaaaagaauaacacccuuucuugauuucuuaagggggaaauuaagucagacuguugggagucaccaaugagugagacuucucuauugugauaaugugacaugacagauccuguaauggccaucccagguauuagcauauucuacuguuuauuaagcugaaaaacauaaaccuuuccuaucauuccauaacuaaauauagcagugaaauuuuaucucaagucaggaacauuguccaaaucagauuugauguguguaggacacugaacagucauugagugguacagauuguguuaaaugggccugaaauaauguucaggaaagagaaucacuuucuauucuucuugacacaaacaguuugucaccaacaggcaucccucuccccaucuuguuaguguagucguuacacuuuccauuacaaguuuuauucaaaucgccuaguuuuccuugauuggguuuacgugaauacauugcaauuacagacaagguguuauuaauauaugcaauuaaacauguaauuaauauguguaauuacacagugagaggcgugccagagcugggcucuaugcuaauuuauugccuagguauugcacacacagugucaggguuuuaugugcgcgacacuuacucccacuguaaguccgcaguggucuauaucaucagagugcgagccuuuucaugcgaguucagaaaaucauuuuuauggucaugcaagcaacuggauuaugguuguccuuugcgguagcuauaugaaauaucccaccuagagaauuuacagaaguuggauguaaaaaugcauggcuuaauuguuuguguauuuaauguuuuaauuuccuuguuauguuugucuguucaguggcuuuuccucuucuaacccuuaagccuuuagguaacuuuuaaaaaacaagugaaagaaaauuuucuacauuuuuuuaaaugaugcuaucuguagccacuggauuuuuaccuaucucaucuuuuaucaccuauagcuuuguaaguaggcuugaucuacucugcuucccagaaauucuaugacuuccuugcucuguucccaggucuaccucuugccuguguuucuuuuucuuagaagagaguccugaauugaaacuauggcaaucaaagaaagacagccaggaucuauaccauugaacagugcugggggugggggugggggcuaggagcuaccugagagaguugauaucugagaaguaagaggggcaaucaagguugacauugugguugaauauaggugcugucuaaugagcuuuguguaugaugggagaaccucacacgguaauaggagccauacuuaugcauggcacuauuaaugcacaaacaauuccugguuguagucgccuccagugugcucagaacaugugcagcgugccguuuucaguggcugguuaugguguugaggcugguggguccaagggcuggcucaggcgcuauauaauuuugauauaaaggauuaaguugauauacuucccuccagagcacaagcacugaaguugacugcuaucuggauaggcguguuuccaagggggaccugggaacagauguguugucucuucugaguacucugggauccguccaugcuuugcuuacagacccccgucugucugcugcacucugcccucuaaaagcuuccugaauugcuuuguaaacaaggcagcuacuacagcugcaacuguuggaguuggacuuuugccagcuugaaauuuaucccugccccagugcuauauaucugggagcuggaaaaaaggggggagauuaaaaaaaaaaaaaaaaaaaagcucacggaugcauucccugaaaaacaagauugugcugaagguaaggccgugcaggucucuggaagcuguaggcacuuucuggacuauuuggacuuuucauucugugccuccggaucagguuucaacacuuuucauguguuuucgugugcccacuuacucaauugggccauugcuucauuaaaaacccaucauuccaguguccuuuuuaucuuugggcuucccuuggcucaagaguacuagagucagcccuuaagugaaugaauggagauuguuuuuucagaauuucucccuucagcaugccaguguuuaacaauugaagaaagaaagaaaggaaaaagacauaaaguagggaaugggauuucuuaagaaaucuuguuuucggauuguccuuccuggcaguugcuucagugccuguguguuguguggauuucacguccccuuuguauguuauagagagguguugagugccuucucugaaugucaaaauaccaguguuuuugcaaaaauugaaguuggauuuugcuuuauuauauucuuggcuuguugaugagguuggcgcuucgccgcugucuuccuaucucacuauuggagucuccugcauaggugcguuccuguauggcucccacuggcugaggauucaaagcucauuguucaucucuauguguacuuuaagcuguucagccugcugcauugaccucuuuggacuguugauguacgacauugugcaauuaggguuggcguuaccgauuuugugugcuuuuaguuuguuucucauugccggauuagagcuaaaaucauuucguuuuaguagccgcagaaagcacaaaauguugaauuuccugccaauauucuuuuuuuggaaccacaucaaauguaacuuuucuguuggaauaaguguuuucuggccaacaucauuuccuucccucaguuuccauuggccuccuuuaucacaggguuucaaccguucaggagcccguccacaggagaaggaugacuuaaguaucguccuggaguagaguugguuaugaauaagcgcuugcaguagggaggugugggugcuguggcuugugguacuccauaguaaaaggaggauuaagucacauucccugggagcaucauuggaugcccccucccuauguccugagacuuuagaucgcccaccaacacaguugugaacuuccccacagcuuuuggccgccccacaugagugcuggccugcacagcagcauagagaaccaggcccucauugauuuaugccuuuugguuucagucccagaucuuggaucgugcagggauuucaacugauggguucagccaacuagcuguaggcuaaagaagugagcuauugugucagaaggaaaaauuguuguuugaagaauuagaaugacacuuuuuggggguagucagaguugccaaucuaauaugggaguguuuuguuuguuuguuuuaaaggaagacaucuuuuauuuccauucucauguaaaaguaagaaacagcuggcuuccgucugugcuguugccagugucaacauugcuaccucuuuuaagguuucacuuaaaaaaaauggguccuguuuuuaaauuuguuugaguuuggaacuuguuguucaguuuuggagcccacagggaaggagaacacuucuuuagaaauucgaugauuaaggggcuuauucaucauucacauuggcuuaccacacuacucuucagugcuccaagacuaaaaugcugugauggaguucaguuugaaagagcucgcucacaugauuacgugggggagccuugaaaccuuccugauguggaaagccagauugguggagacuuguugggcuaugucacgagguuucacaaaaucaaccuaaccuuuccauguugaugauaugcugccaugcuaccccauggccccuuccacagucagugugucugcccuucagcuugaaagguggucugaaugaaaaugucucgcauaggcccauagagugacauuauuugaaaggauuaggacauguggccuuguuggaggaaaugagucacuaggggugaguuuugagguuucagaagcucaagccaggcgcaguggcucacucuggaucugcugccugccgcuccagagauggaagucucagccacccuuccagcaccauaucugccucucugccaccaugcuucccaccauggugacagugaacuaauuuuuaaaacucugaacuguaagcuaggcccagugaaauguuuuucuuuguaagaguugcuguacucauggugucucuuugcagcaauaaaaacccuaacuaagagcuagagaacuaauuuuuucagccuuauggaauuaaugcaugagcagaaguacucugagaucacuggugccauuggagcaacuguugaucacuaacacuuuguugggagaagggcagggaauagggucuuuguggucuggacugaggaguguggacccugugcuaugucuauggcuacuguugaccuuucagaugggaggucauagcacuuguucacugugaaagccagcagucagcuacggcuguuuuuaauucugucuaauagaggagaaugcucgcuuuacauauauacccaagauauucaauuuugauuauauuauuauuuuuaucacagcuccucaacuaugggggaugcuucauauuagauaccaccaaacacacagcccucacagugaugucuauacuuaaauucgucucaggaacugugacuuuauuugguuauauuuaggcuuuguuaaauuuauugccaauuaucuggguuuuguuacuguguuuuguuuuuaaaagcaaacaucuuuaaaauuuaacauuaccagcguacucaggucuguagcucacucaaagaggauuugaguaaauuucuucucaaauagaaauucuuauugacgugacugaauauaugaauaaggaagugucugaauauucuuaaagaaagaggaagugcuauuuuuagaguauggggucuaaagauacacuuacuuuauguuuauauauaaaugugauuuaagggggaaaucuugauaggaaaacugaaugaaaaaaaagaaagaaagaaagaaagaaagaaagaaagaaagaaagaaagaaagaaagaaagaaagaaagaagcccuaccagguuaaaccacagcggcugaggagaccuucagagaccuucagagaaggccgucucugaugcgguugucacugaacccuuuccuauguguagagaggccuaucuaucuacagcaguagaaggcaccaucgcacuuagcuuugccauauuguaauguguuucugucuucccuggccuugcuccucauccucuuuccuaggguuaagcuguguguuauguuauugggcauugaacuugggccucaaauauuugagcaaagcucacggagaucacugggggucuauuccuagcccuguaaucuucaauguagcguucaucaacccugccucuauuuuagucaucuucuuaaaaaauuaauuuuaguugugugugucuguguguaggucugugcacaugaauguggaugccugcagaggucagcaggcuuuggaaccccuguaguggaguuacagguaguuaugaacugccugaaguugguucugggagcugaacuuggaucuucuguaagaacagcaagcacucuaaaccucugagccgucuuuuccagucccuaguuauuuucuuuuaagcauuugcaugucuauacaggugguaucauucugcauauuuuaaauaaguauuaaacaauguuauauaugcgucugggcuaggagcauagcgaaauauggagugcacacacuccugugcacuaaugcacuacccuacugcuguauuuuuaaauuuguucuucacucucauuugugugacuuacucaucuugguucauuauuuuuaauuuucauugcuguaugggaaaggaaauacagaaaaaaauaauuugggcuguccaguuccagauucugaguccaucuccaaugcaaggauaacauggaaggugagguucggagucuccucuccuuugaagcauggaggaauuucugcugagcaaucccuagguguguguggauugcuuugggcuccuuuggcuuucuuggauaccaugguuaggcguggcaugcuccuggcugguuuccuagguacugugugcuuccuccuucccccauuacugcuguuuccuggguguucauaugauagaagaggaaacuuuaucccuguguuuugguauguauuucucugaauugugaaacccaguuucaaugcacauuuuugggccauuuggguuucucuccugacgguugccuuaucagaucugcuuuuuccgccacucuguguuuccuccuggugugcaggcguucuccauggucugcacacgaaucuuuccuuacucauaugcgucucacguuugcggcuuguuucuuuacccuguuuauacuaucuucuguugaacaaaagucuuuaauuugaaugcaggcaaucuugcucuuuucuuucaugguuuguauuuuugugccuccuuauaaaaauucucccuuccuccaaggucauagaaauguccucucugugccuuuuuuccucagaacauuucagaguuuuugccuuuugcuuugaguuaacuuguuaggcauucuuaugucauauaggaagaaucucccucuugcucccuccuccuccuuccucuuucuuaugguuucuguugucucagugcuacacuaagaaaagcuucccucuauccccgccuuccucccuuucucccuuuucugccuuaaacauuuuugaaaauauggcagagagaugagguggcucuggccuggaaucccagccuaccugauauauccugaguuccagaauagccagggcuauguaaugagacccggucucagaaagaaacagaguugaagaaaagagagaaagaaaagaaaagaaaaacuaauuuaacucuaaaaaccugauuuuagacuuaagugagagaagguuguaacaucauaccaaaccugccuguagauugaucaucuagguuggccagauguuagauugauuguucagguuggccagauguuacuaucauuuauaacuacagccagagugugaacagcagagauuaacagugguacagcacuguuaccuacucucuaggcuguauucaaagcucaccaggucucccugauugccuucugcuccucugggcuagaaggacacauugcaccugauuccugucacuucccacucaccagucugugacccauucucaguuuguucucuacuagucagauguuuugaagacuguccacauuuuuuuuuuuucugaugucauguaguuagauuuuaacuaaacauggucugugucccucuuggugcauuauaugaagaauuuggucuuuaguacccauugguccuaugcuuaaugaugagccuuucagucuuuugguguggugauuugaauaugcuugacccagggaguggcacuuaggcgguggcacuuaggcgauguggccuuguuugauuaggugugucacuuugggugugggcuuuaaaacccucuuccuagcugccuggaagccagucuucuagcagccuucaaaagaagagguugaacucucagcucugccugcaccaugccugcgugaguacugccaugcucagccuugaugauaauagacugaaccucugaaccuguaagccagucccaguuaaauguuguccuuuguaagaguugccuuggucauggugucuguucacagcaguaaaacccuaacuaagacaauuggcuucaguaguauauuaaucaggguuaucucaagaaauagaauugauuguguguauaugugugcacauguguucgugugugucuguuaaaaggggauuuauuacugugguuuacaggcugugguccaggcaguccaacaguggucaucuccugauggaagccauaguuguugagucugugaaccugaaugacucagcacugaucugcugcuagaguccucucaggauuccuugcgagggcuuggcuguaaggcuacacuggaauguugaaguaggagagaugagcuagacugagggcaggcugcaaaggcagcaacuucauuuccccguguccuuucagguggacgaugugacccagauguagggugggcuuucccauuucaaaugauguaagaaagaaauuccuuacaagaaugcccagcuuguuggguuucaguugauuccagaugaagucaauuugacaaaccaauacuggcucucacaaguguguaccacgucucuuuccccucugcuguguuagcaucuauucucgaccgugguauuugccaaauagcuugccauuuuccccuucuuuuauacuuauuagcuggaggucuaucaguguuauugagaugugcauacuuauuuuuauguugauuuuauacaucugucuuuacaucucugcuacgaucuaccuuuagggcuuugcauucucaugccuacuugggagcacugggcagaggcauccucaccccaggcucacaaauggacugugcucucaaaugucauuuuacaaauuugcuuuaugaaaaaaugugaguggaugcucuuuugagucuguguugaccaugcuuuagacuuuuuauuuuuucuacauauuccuucucgaugaccauuauuucccuguaggagugcuuuuccuauuagauuuuuaaggagcacuuuguauguuagguauguuaucccuuuuauaagaugggaacauuuauuuuuguaacuacaacauuuuucuuuagcugauggcauauuuugugaguuuucauguagaugaaguuauuaaucuuuccuuuuggugcuagaccagugcuuucucauuuucaguuuguaguagaaucacccauuugcuuucaagaguuuuauagauaguggggagguguuauggguuuuauuuguaaaggacuauguaaaauuaagagaaaaguagagauuuugugucgcgacgcaagaacagccucccccuuugucagcguccccuacagggcugaauguuugauaaaaaggguaagcccacacugacaccuaauuaucacccaguuuuuauuguuuaccuuuagguucggacuuggcccuuguaugguuugcacagguuuacagugauacauuucauuauuauaacaccacagaguguuuccacugcccuggaagcccucaguugaugaagcuccuucauccuuccuguuauccguccaucccagaugaagcuccuucauccuucauguuaucuguccaucccaggacaacacagaucucuucauuaucugcucaggguuacauuuuacacaaugagaagacacugccauuuuggauuuucuucacucauuuacagauguuccaguguuuuuccuucauggcuugagagcuccuuugcuuucagaguaaagcugugguaaacaucuguguguggguuucugugugggugcaguucccagcuccuuuggguauaccugagugugacuacugggugaaaguauguucaguuuuauaagaagccgucacaguuguggcuuuuugaccuccucgcugacaauggcugcguucuugcugcuucacauccucagcaauguauggugcuuucugucagugucuuggauguggaccguuuuuaaaguugggcauugucaauuuauuguugcaguuggcauuugcuuagugacauaugaugcagagcgucucugcaaauguguguguguguguguguguguguuuguaucuccguauccaucucaugcuguguuccauggcagucugaauaguuuugguacauaaugugagcugugagagcaacuuuacuuuggagcuuuuccaaucauuuguucaggucuuucccuuacugaucggagauaaugcccauccuguaccaaguguccaugucgguuuugcguagccugugagccuuccuguugugccacagugcaucauuuaacucaugcaacugagcuacacuguuaugcuuguaguaacuccauacugugguuuaauuaaaaaaaaaaaguguuuuguuuuguuuuuuaaaaaaagaauuacuggagagcuggcucagugguuaagagcacucaccgcucuugcagaggaccuggguucuguucccagcuuauaagcacccacaacacuaguuccaggugcuccagugcugacuucugaccuccuagggcacuaggcacauaugugacacacuuauuuaugugaagaugaacacucauccaccuaaaauaaaaacaaauaaaaaaauacuuguuauccuguguaucucuuauaugugugcaccagaacuugggagugggagucaagagacucucccaccauccuggguuccggacuuugucagguuucauguuuguuuagcaagugcuuuuacccucuaaggcaccuaucucacugaccuguuaaggcuugccacaguuccacuguagucagucagucagccagccagccaaucucucucucucucucucucucucucucuuucucucuuucucucucucuguuccacuguagucagccagccagccagccaaucucucucucucucucaguuccacuguagucagccagccagccaaucucucucucucucucaauuccacuguagucaaccagccagccagccaaucucucucucucucucucucucucucucucucucucucucucucucucucucucucucucucucacacacacacacacacacacacacacacacacacacacacacacacaacacacucacacucacucaacuuuucuugcuuagguuuuccuaauaauucuuuuugaaugcuaaaacuaauagauuuaguuagugaccaaauccuuggcuuccucccuccaauuucuagggccuuuuaaaaucccauuuaguacugaucccuuuuuguauuuauguuauaucugcuuaaaaauguguacauuuuuuuuucuuugcaagguacaagauuuuacauacacaccauaggcucuuuaggaauuuaaaggugugucugcguuugugugugugugugugucugugucucuguguguguguguguguuugugcaugcaugugcagguaucugcaugcaugugcauguguguacacgugagugcauacccguuuaugcagaggcccacaguggauguccuggguuucuccucaguuguucuccauguuuauuuuugagacagaguuucucauugagccugaagauccugcauucugauauucuggcugccccacgugccucagggauccuccuuucuccugccucuccaaggcuggguuacacuccugcucugccaugcugagcucuuucuguagguucugggguuugaacuuugcuccuccugauuaugcaguagguacuuugcuggugguguagccaucucccaggcccaggaauuuaagguuuaugugggguucugaaguaaauuugaauuguauuguacauucagagacgcgccucuccugucaggcagguguucaucauaaggucaauggguagacuguggaggacagugaaccauagaacuuacauggagagaggugucuguguaauuuucuggacagaggauucaucaauuuuuaaaaaauguucuuucaucucagaaagauaaaggcuguuccagguuaaagcgagaaaaagaauggaauuuaaacaccuagcaaccaagaaugcaaaauugcgagauaggaaaacccagcuuuuccuuggccacugggaucaggguguacugauuaggaaaugaaggugucuuuuaauguuuccaggagcucuaaagccuuccaggagucacugucuacauuuaccauaaugguguuuucucuccucuuucuuuuagguaagugacagucuaaagcuugguuacugcucuaucaagaauggaugcaugcuuaagacuccaucccuguuucugcugccaugguaguaaguucuagccuccugugggcugugcugcugugggcaaggggcuaacuugcagaaagaaacagguaauuuccugcaagccauuugcuucuuuccaugacuuguuuuugcauggcuuuguuuucucuuuuguuuuaagugggcucuuugaagccucucugcugaguuucugcauaaaaguagagucagggcaguuggguccuaagggagguguagaagguuugggagcugggugauuuggagcucugcuccccaguguuaauuucaugguagggcaacuguagcuuuuuucuuucuguuuuuccuguuuuugaguagguacagugauauaagcauuaucccaggaagauuaacucagggaccauuaugcuugucaagguguuccaggucacaggucuaguuccuucuuccuuuucagcuccgacuuuucaucaagaugccaauaacagugagucuaccaugugggcaaaggaagccugacuguguaccugauagcucaagugucuuugagacuuagaaaucuuggagaccaggcgccgaaggauuuguaaaggaaucuaaacuggguuuaaggaggcagcaaacaucucuuugagcuuacuagccacaguagaaaagcccacuugagguaggccuaggugugguuucuuagguggccuccgaagaaacucuggacaucuuugaacugcauguugggaaaagaauucccuuguuucuucaaggaugagauucgcucaaauaaguaaagaauguuaaagccaagacuguuuuaucuccugcaggucuuuaaauacuugucagguuguugaguucagaauuaucuagcaaucuggcuuuguaaacagaugggcacuuuucaccaggaagcagaagcgcacucagucugauuuugaaagugaaaguuaguugugcccaguuggaagacaugugagucuguaaaagguuggggaauuacaugccccaguguuuuagcuugugggguuuaacccaauggcaaggucccgaggagaggcuggggccaaaggaaaccacaguucauugcacauuuagagauuaaaauaucuccaaauuaguuccagugauucauuucaaauuauuuuaaaagcccuuuauauuuuaaucagagucuauucagggccaguuaauuuggauaggacauucuaaaauuacuucccccagugauguuuugugccauugcuguagaaugcagaaagcccaugagagaggggaccugggacauaaguaccauggagcuguugaucuuuguggaauguuuucugguuuaacaguggcagugauuuuguacaugcugccugacuuagcuaggauaaugaagaauguucuuuguagagagaguggcugcuuucacaggcagcccagagcccaccacauauucagggaagccugggcgauguggccuggcucuuauguaucugaaucuaaucucuaacagccuggguaccucagggucuuuauccaccacuuuguccaucuucccugcaguuaguaaugaagucccuacauaguaaaugcauagugcuuuuccuccacuacucaugcaaacaacagaguacagugacuucuuguuacguuagaggagaaaagacccuggacuaaguggauccuuucaugauucaaauugaacuuucauauucuucagucccccuucaaagauggugaaacucggugucuguaaagaaaagucugaaugaggcuccagauggaucuggugcugaguucaagcccugguuuuccugauggcuggcuuuugucuuccgccccacuugcuugggaagaggccuguguguuggcauucugugcguucacgucuagacccuccauuguggaaaauggcuucuccuuagaagcuauuccaagcuagagggaccaggagugggcacuaauuaauauguuguuggaagauagcagcauccauuuugggauguuguauuaccuaccaguuaccagcuuuuugcaggaacugacuugggaaaggauggcaggaugggcuuucucguugugcaacugaggaacaacugguagucaaggacuuuuuggcaguuggcuagaaucucauuuuaaggcaauaacacacucagaguuguauucaaacacugagauaaaugcagcaaccuaaauucauggguuuuguuuuuuuccaucauguagcuaauuauugaacauaacgaggcuuauucauaauuucuuuucucuugcuugauagccguaauccuguauuugugcuacugucauucccaugguaacagacgaaugucugaagcccaagauuauuaaauacagagcaguacauuaaaauaaugugaagguucugacuuacagagagacuuucacacuggggcaaacuucaaaaagagaauacuuacacaaaaagcaauuuacuuggccaguaaugguugguauucacaucgcuauuauggaagagauuuguuugaauuauagccucucucuucccagaccaucaucuccucaggcuuugcagccaagucuuaaucugguguuuaugaugucagccaguugccaggggaguuuuucugccacaaauguauugugacuucacugcaugauagaggcagaagagacuggaggguggaagcgaacugccaaggugaucuuggguggaucuguucugcaggguaaugcuuucuuucccuugcauccucuuuagaaaauguguagccaagugcugcuuccaaagcuuggcccuucauaaaugcuguugaaaugacccaaagugacaaaagccaacacugaggaagacgugaccccagccggaccauaauacuucaaaagugcucauaauuuguuuaguucuaugcuccaguaacgaagcacaugcauuuccgaggcauauaaauugguaaaccauaccacccccccccucugcuuuuccugugaagggaucugaguuuuaauugaauccuauuacaaauccaaggccugugcuuaaccacacccucaccggucggucacccaugaaugugaaagccuggccaaaccuagaggugucuuugaagccaaauuuugugauguucaucagcgcauuuccauuauggucucaggggcuccuucaucaucugguaucugggacauccucccauuuggauggcauaaaaauaaucuuacucuuccaaaagauaaaaagaucucuguagauuuaagcuaagugcacagguggugcugugcacacuaggaacacguugacugccauacucucauauaaaugggaugcauacaccagaagugguuuucaaaaccauguaaguguaagaagaacuugagcaagaaaaugcugucuggugaggaagauaugcaggcuguguuuaaauaguaccuguaauuagaaaacuaacugcaccaagccuuuauauuaauaaaguugaaguugcagagucuaggacgguaucuuccagcucccucuuuuuccaucgcugaacgcaauacaagguuuuaaugaccuuugccuuauuugcuuuucaagauuuaaggucuggcaugggacauguuuuccucaguguuggcuuuggccacuuugguucauucacacauuuacgaagggccagucuuuggagaaguaucacucagcuaaacauuuucuagagaagauacucgguaaaggaaacacugcucugcaguguggugguaguguagccuaagcaaauugacauucuucaaacaucucuuucuaguugcugccaauuugucaccuuggagccugcauaagcuuguuuuggguuugucauaagacgcccuuucucuucuguucucuuucccaaaucagcguccuucuuaaagaggugcaugccagcacauggugcuauuauacuguacacugaagacagcacacuguaccuuuauaaugaucgucuccgcguuuuguugaggaagcuucagagugcguggagcggguguggaaaugacuuucuguacagagagcagagacguugcauucggcugcugauuaucuacuucgcuccugcucccugucagucucugagcucacucacauuuaugcgaagauaccaacaugaggaaaaucugggugugagggagggagauucaaaaaaaugguacugaguccugauuuuuuuuuuccggaaauuguuaucgaauaguuugcgggugcuuugucugggcuuugggauuuaaaaauaaucuccaggugauucuaguguacagauuagcuuguccaguugcagguuucuguguugcuauggcugccaauugaacucagggcaagggaacccaucacaggugcccuggacuuugugcuuuggcucugacccuugcuacuucagggagacuucccagaagccccguuuccuuucuugugcucacaccauggaaacagucaucagaugauucugacacuuuguuuccuugcucccggacgauuaaaagaaaugaucauuaauucugacuuccccuacguuugucuuuuuaaaaagagccuuuaaauuuuuagaagacuuuuuuauuaaggcugugaaacagaacagaaaucaauagacgugcaacaacaacagaccccacaggcugggaagggaaagcaagcgugggaucucgugcuggucccugggcuaacacuggagacugaacguucacuuucugacacuggcuuccacaccacugaagagcucuguagugugcucagccugcaugcaaauuguuuuccuuaagcucuuuaucaaugauaugaugacauuaaaagaagaguuuaaucauguuuuguuuuucaauguguaacgcuagaggagacaagaaaaaaguagauuucuucaucucauaaaaccaaguccauugcaauaaaguucugacuaaaacuuagccuagcgguuuuucauuuaucuugguuauugcuuuucacgugucucgugguucuuguaagcacaauuuucccucuggagcuagauacaaagcagagguuauaaagagaaggguugggaucgcgagugucuugcuucugauguuuagccuuaagaaauauauuugagcuuaauagaaaaguaauaaauagguuugcuugaauuuucuuauguugguuucauacucucuuuugccaaaucuauggcuagcccugaaagcuugaauuagacagagaucugagguaauuccaaguagcagcagugucagaugacagcagcagaccuucuuacuucuguucccugccuugcacccucaaagaacaugugcaaauguuaaguccagaucgguaugggagagcccuacugguccucucuagugcuugcucagagcccucugcaguucugcugccugaagaagagccucgcugagcuugcuggggucuucuuuucucuccacaguguuguuuuccugccucccugcuccucuccucuccucccccucccuccccggcaguucaggcuuuuccucauggaaaauuucucucugugauuggugacucuugcuagcugauuuguugauaaguucauuaauuaacgcugauuucugguucauauucaaggcagagaugguguuaaugccauaagugcuuuggaucuucgguuuucuuugugugguuaugccuuugcagguguggguguggagaggacgggaacagaaucugguguccuucccuaggaaugcuaccauaguuuugagacaggguauuuauuggccuggcaagcuaggcugacuggcccagugaggccccuaggaucuguucuucucugucucccuagcucugggauuacaaaacugggugcacaccaccuugccccccuccucucucucucauguugguucugaggauugaacuuaggaucuugugcucgcuacaggcaguuucugcaccaagccaguuccccagugcacgcucugcuuuucaguuuuguuccugcuucauggauguguuggucaggaacuaaaacuaauaagauucccugucugcacauuuccugucagauuuuauauugaauuugaaaaggaaauuuuaauaauuugauucugguugaaaagaaucccaggaagcuguuccgagcugugucuuacuuucuguuaguuuuaauuuaaagagaaugaagcuuuguguuucuuagaacaugucuauuuuuucuuucagauacugcuaacauuugcacuuccccaagauuuuauuuucuagaccucuucuugcuaauaauggcaacauugagaguauauuuuauccuaaguauucuauaucuuugguuuuucucauuauaaaaauaaacuuguuacuuuaauuuuaaaauuguauaaaaguagagcuuagaguacaaaauuuaccuguaauccuauuuacuuggggauauacaaauaaauauauauauauauauauauauauaauuuguguguguguguguguguuugugugugugggcauauauguauuuugagacaaucucacauagccacagcuuuccuuuaauucuuuauguaggcaagaauuuuucuccucuuuaaaaaaaggaaaaaacaaacaacaacaacaaaaacaaaagcaaaccaaaaaauggauaacccugguuguauuggaauuugauaugaagacugguuggccuugaacucccagaugcccgccuuccucugccucccagucccagugcuugaacugaaaggcaugccugcacauuuggagaauuugaguucuugaccgcccucugccucccccuuccaggcuuucacugcccuguucuauggacagggauagcuccgcucucuguauaucuacagagagcacguuucacuuuugauuaguuaacauuguguugcuuggaaccauccaucucugcaguaaugcuccaggccugugucccaaugugcauauaauuaauuuccugguguauacuaauugauuguacuacuucuuuauuuuuaaagccauagaucuauccccugaauuuuguuucuguaaacaaugcuaugguggacaucuuugucuuugaucuuugucuaugauucaaguauuuuguuagaguaaguuuccacuauguagccuccucauuucuucccuugccuguuucacuguacaagucgauaaugccaguggcugacguuucgucuccgguauaacugugcgguugguauaugguaccguguuccaaggucauucacguuucagaauggagccgaguugcuuugccauucaucacucaagucugaaagaccauuguaacuacuuugcugauaaagaaugugaaggcacagaggaaccgcaguaaacuacacagccccagaguuguguugccuucaaaagaagcacugguucauagagaugcucuuuauuucauucauccccauugaugaauccucuaaguuguaugucuaauugugcucacuuuuguuucauagcauagugcagacagguuguaagauuuuuagacacuaaugcacagugguuuccuuuacaaguuuggagacaauuguugauucauaaaaccugacaggaacuuuggguaauugucaauuguaugacucuucuaugcauuccuuuugcuuugcuaucggcagucauuaaagggauucaauuugaaaacugaaugagaaauuaguauauucuuacgaaugugccucacauaaauuuuaaaugaagcauuugacuuuuguguccaaaucaaguuggcaaaagaauuuuaauuauuucauuggcugaguuuaugaguuucaguugaaguuggagauuacucaaaccagaguacauuaagaaauaaauauaauuaagugcuugcagagguaugugucuucaacaggaacugaauuguaaucauuauuuaaucuagaaacuucuuuuguuuugucacaugagucgccugguccuuuccucagugacaguggguggcucugugucaguuuuccuuucuguuaaccaaacauuuccaucuggccacugcuaccuacuuuaauaaaugauuccugccgucauucucucucucucucccucccucccucccucccuccuccaguuucuuauuucuuucucuuuuuguccucuugccuccuucucucaauggaugucacagugaauacuugguggggacaggugcucugggcuucugugugugugacagggcugcaccgguccaccugaggagcaccagggcucccagcuggggcugauugaagaguuuuagucugaaugcauacuuuccagccucugagcaggagcaggcagaacaggaagucaucagggaugccaccauucauucuuggaagcaucuugcuguucuuucccccuuccugugaggcagagacagacaggugaggaucauauuguccucagcccagauuucaggagccccaggacugggguggcugacaagugauagugccuucuggccaggacagggauguggcacucaugaacucuuaacagcguggucagaaccgcagaggccucaccagcugacaugccaacaugggcugagaaaaauuucauaaggucccaccuguaggugaaguuaugaacacucuuugugguugcugaagugggagagaaccaguuugguuauuuguuuguuugcuugguugguuuuguuuuaggaaagcaccccaguccuaagugguuagcgccaaacacaugcaaaacaugagaaugcuaguuggacucugaaggugugagugucugugugugugugucuguguguguguguguguguguguuggaggacaugagagguguuggagcagcgagagaaagggucaauguaaaugcaguguauuuucuggaaacccuucagcaacucagaacauaaaggacaaaagugaggaggaagccuaugaagguggagucugcaucuugaaugaccgugacgucagguuccuagugugaccucucuagcugccuuguuuccuguggacugcaguagcucagagcagacagcuggccagccacagugcagcuguuuauugagcaaagaggauugucuuccuauuuacuuugacucgcuauuuuuggaaggaaguugauguuuuuuaaaaauuguaacauuauaugguuagaauagagaaagaaggggaaagugcucacaaacuauguccugagggggcuguccauucuuuucauuuacuaaguuguguuucuaagugugaucggauucuguaaacauaucuaaacacugcuuguuguuuuguugaaucuacacaguacaaucaaguuaaugggucagucaguuuaaaacaagaguacuuucagacguguugugcucaucaacagcacugugucagacaucguugggucucuuuucuguauacaccugugggauggucacaggaacaagguugagauuagcaaugcaguggaugguauuccaaagucucuagaccacaugggaggggagcuuaagcacaaaaacaaaacuuguguuugaagcagccgcuuuugaccuaggggaacuuguagcaguagggagagccccugaaccauauaagaauaaguugcacuccucaagccccuuugccuacaaauacuucaaaguguauuuccaaagagcgccauuuccuccucuauaguaccguuauuagcuuugggcacuuuaacauaaaacugaugaguuuuuuuuuuuucuucuaaucuucuauccauacaucagcguggccacuacacugaaugauguccuguagagccuaagaucuagccuggaauaacaacgcugaaggugacugcuugccuuggcaguuuccuuuacgggagaacaguuguuugaguugguucaucguuuaugacuuugccauaagaaauagucuaccccucacaccuuugugcuggaaguccuccuuuggguuuauuugauguuccagucugaagagaccaagucuggauucccagucacacugauccuuacaugggggguaucuuucugaaaguauugugccaagagguacggguauccuugugcguugugauggugauuugagcuuuguguaucuugccgggcaccgucugaucucucacuguguauugaauacacauucuugcagcugcugaggaagugcauguaagcauguuguuccauuaaaucuuccuccuuagacucauugacagucuugcuugaauuuuucuuuccugcagucauuuuccaaccauagcacccaccagcauuuacuggucaaaagugacuagcauugacagacaggggacaugcacgugcacacacacacacacacacacacacacaccgcaccuuuuuacuuugagacagugucuaacuauguacucuccaaaauggugggauuccaagcaugugccaccauauguaccacuacuacuaauaauuaauaguaauauaguuuuaauaauuuauauuucauguugcuaaaguuacuuggguagucagauuccucuagacugaaggagcaggagccccuucagcuugguuuuuguuccuuuuuugacaccggcuuuugccuuuuuuggaaguuuaacuuuuuuuuuuuugucaagaaauguucuaggcucacaucuugugcccugucuacucugguuuugcaaugaaacauuaucugaggaauuuugguucccuuuaaaggaaaauugcauuagaaaccgucguuaagguacuagguguguuacuuaaggucacaccuaagagucaguaaaaaguaauauauucacacacacacacacacacacacacacacacacacacacacacacgagcacauuuaggagucaaaaaucacacuagugcuucuuccuagucuaaucuaucucuacagggguucuuuguagguguuuaagguuuauuguuauuauuuuuaauuauugugucuguguggauauaugcaugugaaugcaggugcugucaaaauucagaagaggguguuggaucuccuggagcuggaguuacaggcauugggagcugccagaugugguugcugggaccugaacuuggauccucugcaauagcaggaucugcacuuuacugcugagccaccucuccagcccucuaugaggucuuccucagugaaauccccagcuccuuauacauuuauucaguccuguaucacaggcacuaguaggcucggagcagcuuugcccagagcacagcagaaaggcagcauuuuaaagcuugggguauaucugccacacucccuccuugccugagaauauagagcacacugcugaaaccuaacuugaguuccuucgcuucucccuugugguuagugauucauuuaaagcacauuuguguucauuuaccuccucuugcuuucaauuuuagguuguuauucuuucccaauucugauuuauuaguuuuggguuuuuugacuauggagaugagucacaugcuuugcaaggcccguauuuauaugaugaaaaugcauagggccauuuuacaugaaaaaauccugaacacauaucacugcugagauugaucaucuguuaaagggcauggcucagucucagagcuaagaucauagccuuccucucuucuacuagaucuuucucucucacuccuuucuuuccucccacucccuucuuccccccucuucucucuuuuuuucuucucucaguguacuucuuagaaccugaaaggcagcacuugauuauugcagcuagccuuagauuuuugucucuggcuuucauuauuuccuaucccuaucauuuaacaucucugaaugguagacauaguaggcaugugcucuuuccaggaaucaagcucuugauugcaucuuuuaaaauacuaagacauagaacaguuucaccuagaaggccacgauauacucuccuuucacaugacuugacuuugaaucaugauggguucucucucuuuguuacauuuggaguuggugaccauugcccaugugauaugguugugucugcuucuuguucaaaguuacaggcagggcuuauggaaugauggccucacagaaguuagucuggaaugccugagugaucugccaaacggcucaccugcaggggcuacaggaaagaccuagauuugcagaauccgaggcaguaacaauugccuuuugcauccuagcaggugauuuccuuagaggcaaugcauguagucccaauaacugagugugcccaguuuuaucuuuucuuaugaacagucucaguacagaaacagaagcugggcuuuauauacugaaaaguauaucaaacuuauaaagaggggucugcuagucaguuuugcuagugauuguauuguuugucugugaugccucuuagaauccaaauaaaucaagcaugcauauuaaaggaggccaucuuggaguagcuaauuagauggucaggacuauauagauguaaaaucaaugcuuuaucuauguguauuugggaauuuucuggacaguuguauaauuuuuggugcaguuacccacuagcuguaugugugcccagagugucuauuuuugcuuuauguuuuuacguuuuccugcucauaagcaacuacaaauuacucagguuuauaucaaaucaacuuugucugcauuccaaggcaaacauucaauguagaacacaguucugaaaguguauaagagaauaauugagaugaccuuuagcaggacuucccauaggagggucaugcuggugacauuggcuggccagcacacuucccuacugcccaggugggugauauuggcuggccagcacacuucccuacugcccaggugggugacauuggcuagccaguacacgccugggcugccccugucaucugugagagacauuaacagacagaucccugaacuaagcagccucacacacaaggaaagcucugagacaaaucuuccauguuugauucaggagcagcaaauccuuuucccacaaggcaguauuuccagccugucauguugugauucgcuuuuccccaccugaauguaaugugccauuaguuucuccccuguucuuuuguuuaaaaaaauuuuuuuguuguuguuguugaaauuccuuuucuuuccaagcacauuuaaagaaaugaguaucugccucucaguuaggugggagagagggaaaugaguaugaauguguguuuuccgugaggguucugagcgcaguaauaggaccuuuuaaagcuuuacaguagagggaggugagugauccaucaaaggcauagucuuggauuugggucuucuauuuagauuaggaauguuaagaaagauggaugguaaaugucuuuuagcugcguuguccccaaaacaugaaaugaaaucuaaagacucucaaagaagguuucaauuacacuagcaaaugacuugaacagggauuggggaaggggaggucaugggccaguggaaugccaguuguggauuuauauuguuccaaaugaaaacauuauuuccauuaaccccuuuccacuagugccuccaccggaguuauucucagauuguacguucguagguguucgucacacuugacggaaauaccucaucaccaagguggauuucacagccuuuccguggcuguaggcuuucucccuguccaacacacaguccccgcuugcauuagcugaucuucuagaggugcucuggaacguguguucuccaggcucgauuuuaaagcacaguagucagcuacccagugguagagagcauuucuaaguuguguaauuaacaccaucauaaauggguucugauugggcuuuucucccaugagcuaauggagggggccugauuaacugggaacuggaguucaaggcagggggaggagugauuucagguuuacgaauggcucugcacaaauuugcccuuaacugucaguguggguuccagugugguuuucugcccuuucauagcaaauagaggaaggaguugguaagcagaggaugaaaccuccuugucaggagccggcuggagugcgcacucagggcaggcacuuuaaaagaaugccauuaauuugaauaaaacaggagaagguagguacuuuguacauccauaaagcacugaaggggauaaauccaauuaucuguucaauauuuaauggccauaaaguuaaaaauuuuaaaggcaguaccuuggagacugcuuagucaauucuguccauauuauuuuugacauucaaaagucaagguagaauagccauaucgacggcugcgugcaucgcgcuggucuacuggcuuaguggcagugacccuggguuugugauucuccaugcagaucuguugcaggguuugugggccccugccccccaguccacuuagggaguguagggucuccugagcuuuuggcacgcuccuuuucuuucaggcuuuugcuguugucucuugguaugaauauagcuaaagacagugggcaaacaaguaaaauacuugaagucagggcgcaagcccacagccuagauacaacuacagccuuuaaagaagguaggaaauuuuguuuuuaaguauuucaaacauucccaucugagaaacgcuuggaagugccacuaaaccccaguucuuucuuuaucgauguuucauauauccugugcauuuucuaagcuaauggugggguaaauaguuaaugucuuaguuccuccuuauacaggugggcuuugcucuaagcguggucuagagguagcucugcaaagcaaagcuucuaaggaaaucaaugcaguagccaucguugggauguuucucaauaugacagagagaucuuaggauauggucuccuuucuccuugccaauuagcuaacguaggaacccaguuagccauuaauaggcucuugccuguagaagcauggcucacuauagugcaaggaacacauugcauucuccuuuuuaaaaauucugauuugugcuuuuucuuuugaaucaucgauucuucaaccccucucuccaccauuugcuugcugggcauuggguccuuuccauguggcuuugguuauuuuuuccccauagcuuuuugcuguuuacuuuuaaacucauacuauguauagaugaauguugacacgagacagguguacugcuaaaaugugcugagggaaucccacagcaggccacacugagggagauuaaagaagcaaguuaguauacugcauggauucugagacauaagaggccuguucugucuuaagaugugucaggcugugaagaagggcgugccucugugggcuccuuaagccaccuguguuuuucccagggaauacacauaaaaucuuucccuuucuuuucuauuuugcuacccauuucccuugaaagggaguguugcuuugcucugcucuauuuucaaaugcaaauucagcuuauuccugucacaugcgaggucucucaggaugauacucccugaaaucuaaagccauuuagcuguccuggaucuuagaguuuuaaguagauuguuccaugucuugcuccaagagucuugagugauuuggcuguuaaagcagcagaaaccuuuguuuucucagguuccuggaaagaaaaugaaggugagaaaauaaugauuuccgggauaauucaaagaaaagauuuaauguacaaaucccucacaugcuacugcacagggacuuccagaucagcuuaugucacacucagcacgacaauuguuaaacucauuuauuuuuaaagagcuuuuaucagugauacccugaaagcgucaagaggaguggggcucagcaccugccucuggacugugacacagaccuuugugagcuugaacugauucccuugucuuuuuauucuugacccacacagcucuuggguggccaacuuugugagggcaggaccccuuccuucugcucuucauacucccagagcacagugcuucucccgaguuuccuuccugucuuucuaaugccacuaucauuuacauaauauuucucuuuuagguugguugauugauugauugauugauugauugauuuuguuuuuuucuacucaaucacaucuuaauugguauaggccgugaaaucacagauuugucgggcuguauuuuuuauguguauugaaauuaaaaucccaauuauuaaaacuuaugaagcuuauuuaugugccgcuucagauccucucucauguaucacacuggagaaacaccauccuagcgugcuuuugcaguuucaaguuugaugcacauuggugcgguuaugggaagaacagagauaaaauucauuauggacucgauguaccaagcccugcuuucaguagcuuauaugucuuuuucuuuaauccuuauaacucuagugaggaaaaugccccugauuucacauaagaaaauguaguugugcuugcuuaucacugcccuggggaaccugaggcagggagacuuuugagguuagcuugggcuacaugagauguuccaggccaaccuggacuauaaccggagaaacucugugugaagacaacaccaagggaaagaaaaaacugaaacacuaaauaguugagugaccuucucaaggucaaacagacugcauagggacaaacagagcuaaagcaagagccagguccucagaguuccgucuguguugucuuugguaugugcugcugguuuccaguaauuagcgaauuaaccaugugcauuccugcagcagccugcucugccugucuuaguucuccgugaugggaggagcaccaccgccacugguauuuauagucugugcuuugccucuggaaucgcauuucucaccgugcugaguuguuuccaucucggaggguuuggaugagagaaagccucuuagcaccucugcgagcugcaaauucaguuuugauuuuuuuuuaaauuucaaaagaguuucgcacaaguauugugucugugucugugucuguguguguguguguguguguguguguguguguccaugcacaucuguauguagacuuuuguucccaugagugcuuggagagcagaggaagauguuggugucuugcucuaucgucuuugccuuguucucuugaggcaaugucucucugaugagggagguagucaucaacccucauuaacuccccauccuugucccuuaagcgcugguauuacagcuacaagaggccagagaggagguuuucuauaaagugacugcuaaguacuugaacucagguccccuugcuugcacagcauggagccacugaguguggcuuagaucaucuuaaaccuugaacauaguauuuucaaggaguguggaugucauucaggucgccaucuuacgccuaguggacucggagacccucauuaguccuuuauuuaauuaccucuaacuaaggagucucacuacacccuuuuauaucaguuacccaaacucucgucuuuuacucccccgcccccuucuccucuuccucuuccuucuuaagacagucuugugagcccaggcugggcuugaacucuaugcagccaagguugaucuugaacucgugguccuccugacucuaccuccagugcuuggacuguagguggcaugccaccaugcccaacugucauguucucaggggacucaauauuccgucaacuuaaguuuauacaaauauuguuugccuuaagauaaauuuagaaaacucuuuugcccuuaaaucauuugguucccauuucauauagucauuaggcuuguguuuucacucggccggauggcguacccggagacguuuaaugggcccacuuaugcugauggaugguguaauauuuugaggaucgcaaacaguagcacuuuuaagagaaucaucggaacuggcgcgugaggggugugacuugcuggagcugcacacugaagcaugggagcucaguuuugaguugacuucucuuuagcugcccgaggaucccgcuacacuucccuuucccuugauuauguuccuccugguuuccugucugacuucauugccaaauuuacucuacaucuuccaauucaugggaaauggggaacuaggcaagcugccugucuuucuuuuuuaguuuuaaggcugcuuggccuucaguuuugaauaggaaggagcgacagacccccucccaaaagucauugcuggaacccaacauugucacaggcgacuuuuuguagauagaucccucccagcccgccuacacaucaguuggauuuugauauauggccuauacugcaaggggaggaaguauaauuuuuaaauucuaaaaaauuuuuaaucacaaaaguaauuggugcuucaaguaaauauuauuaaggauacuguauuuuaugacauaccaaaaugacagauaguagagcugauaucuuguguguuuauguccaucaccucauaaaacccggagaaugaaaugagccaugaucucauuuuuagucucaaaaggugaaacugauuagagguggugagcaccuagcccccccaucccccagcgcugcucagaaguagauagugagugacuucacccacacagcucuucuuuccuacuccaggcagggaguucagcuauauuggagccaaaacucuagugcagcauuuugucaguuacagaauauuuggagcaucuuuauuuugcccguuauuuccucccucccccaaaugcgugagauguugcuaucacagaaaaaccgggcuauuuuggguccuguaaagcauagcagcacuguccccauguggggcuggcagcacugucccuauguggggcuggcuuucuguuugcucggcugcuuuccucaaccuaaccuuucuguaagaaggaauaauagguuaauugucacuauugugagcauuuuaauugaagauaaacacauuuucuuuuuagaugucuucaguauuacauaucuuugguuuuauuauccuaauuucagcagauugccaaagccagauaggcuguacagcccuaaccugauucagcauucauuacuucugcuaaaucaaauaagaucuggcuaaucgaaacauggcuuguggaguccuucuccaauugaauuagaauauugcauguugaguugcgcuuacauguguauaccagggacagaacuucgccgucaauuuggaaaugcugacucuguacccuccaguaaaagauauuuaucauuuauugcaaaaaaucuccucuuuguggggagucugugaauuaucaaguaauagcauugcuugaaggaagggagauggagcuagcucauugaaugugccauugaagguuaggaaauuaggugucaucucgcagauuggcauacuuuuucuauaaagggcaagauaguaaauauguuaggcuuugugggccauacggucucuuucacagcucuucaacucugcuguuguggugugaaagccgcuguagacaauauguaaacgaaugagcauggcugugugccaauaaaacuuuauuuauagacagugagauuugaauggcauaggauuuucauguguugugaucuauuauucuuaaaauuauuucucaacuguucagaaaugggaaacuauucuuagcucacagacuguccaaaagcacaugguuuggacugugagucuuauucugcuggucucuguuuuagagagucccccuuuuuacugugcccgaggguucugaacugcauguaugcucuuagacuuacaucuuugggguaauuugccuuuucuccuugcuuguucaguuccucauaauguaggaagcuuggacgcgaauaaauacuuuccaucucuuuauuaucuacccaucucugcuugaugugacaaaggagaguuaguaguucagaguccagcgagaguaauuucugcuaacaguugguaguugcuguuuaauucucaagaugugacaaggcaguggaguagacuuaccucauuuucccaugcugggagaugaucuguuagucccaaggauguugucagcuuuccagugugagccuuccugcagggucauuaauaauaauagauuccauaaauugacccuggguuugaaucaggacuuguuggcccugaacacucggugcacagacuugcugucaguguuugcacugaaagaaguagucuaaggucagcuucauuaucccaccuaaccaccuagcauguguguccgccaauguucagcuugugcugugagaggcuucuugugucagacauauaccagacauggcaccucaauuguuaaugacacgaugaaucauucauccuccagguuggcagugucuuucugcaaggauguucaccaagaacuggauuaauucaucagcucuagauucagagagauuuguuaguagugaaaguucagcuuguaauccaucagugggagcucuguccucugacauuauggaggcuugcuguuuucucauuuagguuugucacuggccacuuuuuugcaaaguggauauacuucauaagacaguuucucaauucauuugaaaacugugaggaugcugguuaauguuaucucaggaggagugaacucuuggguagauuaggagcguggguuuuucgacugacugugcugaugccugcuauccagcuucugugauucugaccagcuuauugcuagaaucauuuacucacuaaauagaggacuuaucaguuauguaaccuuagcugaguuccgaucagauggcacggaguuuucuugcaguuuuagacucuguuuucaucaucauggaaguggacguuuucguccuggguaauuuuguuugaaccuauuuuacuuguuuucugguuuugcacucggagaaccagaccaccucucugaaaauguucuuucuuuuucuuccucccugugagcagcuucuuugcaaaugacuuggaaauccuuccaagcacugcugaagcuucuucaaggagcaguguuuucggugguacacaaaguucuguaggucagcuugaaaccauaaugcuugcaaggaaaaaaagauugaaauugacuucaaaggacaacucugacacggucaauuaauaauuaaaacaguuuuuuaaugagcuaugcaauuaccugugugucccuggagaugaugguuuaugguauuauucuagugcccuuucuuuagucauggcgcaugacauuuguaauuuaaagccggcuagacauuaaagugacagaacuuucauuaaccuugucuaaaguuugcuggugacaaaugacuuauaaaacaugcuguugucaaaauauaccacauaccuuaaaagucucuugggcucugaaaaacuggauucucaggggaggacugggccaccugacugucuucaggaacucacuguuaggauccgcaguggccgcguggucucuuccuacuucaggaagugaugucuguccagccagagcugcugaguguuucguggcugucuggcucagguggccuucccguggguuuuauaccaugugaguugguuuuuaacuagugguugaugaccacugaauauuuuccuccaaauuugccuugguguguaaauuuucacuuuuagaaacauacuuaaaacaaaaacuugaaauuacagcauuuuuguuguuguuguuugacuuguuauuacuuguuuuucaaauucucaaccacccaguugugcuauggcuaaaugcuugcuugcuugcuuauuuauuuauuuauuuauuuauuuauuuauuuauuuagugucccucuucauuaaaauucucauuuuuuugagacccccccauauuuuauauucuuaauuuuuaagaauccuccaauuuugcuauuuucuguuuccuuuagaagaauauuuagaaauguuauuaaggaagauauuguacuagaaugcccuuuuguaguauugcuuuguaguacuucuaguuguauuacuauugguaauacuauuaucauuccaugugaaagacuuacaacuaagagacaaaagauggcauucuugccuucugucuucuaacuucugggugaacuuggauucaguuucaagauugacugguaccaaaaucuuguuucacaauucugagagauacacucuuuuaguucacuuuacuuuuuucaacauaacuugaauuauuuuuauuacauuuuuauuuacuuuauuaaaaauccaaguaauuucaucuucacgcuauauaucaauaccuacaagaacaaaugagugcaauacuuuaaaagucauaaaagaaaaacgaggcaggguaugauggcuuaugcuuuuauucucagcccucaggaugcagaggcagugcucuuacucucagccguaaggaugcagaggcaggaggagcucucuaaguucaaacuaaccaagguuaauuagugagcucuuggcccucuaccaaaacauaaugaaacuuacugucaaaauugagagagagagagagagagagagagagacagagagacagagacagagagacagcgagacagcgagacagcgacagggaaacagagagggggaagagggaaguggggggagagaaagagguuaaaagacuaguuaaaggaauuuguaacuaucgcaugauagauacucccuaaguauuuaugaauguuauuacaauuccccggccucuaacuuaauaucauggaucuuuuggggcucuuucccaguuaccucccauaagguuaaugauuauaauuuucauaacauuuuuuguucaaaguccauucauuucuaaugugaacauuaaacauuaugaaauguuaaagacuccugucuugaugaauaaauucucaucuuugcauugccaaguuguaguugagauuucugcauacccagggagggcuuugauugaagcauaacacuagaaagcaugugauauauaaacacacaccucacuaagaaaaacgucacaagguaaacacacaagugaccauuauucaaaucaagaaguagaacuuuaccagcaccccagaauucucccucauggcuucuuaaaauuacugcuuuucuucucuuuccaaagauaacccagacuugaacuuuaaugcuacaguuguguguuuuuguuuuugacauuuuaaauuuccuuauuguggaaaaugucaaacauacaaaaacagaaggacuuguauauugagcccucauguucccuucagucaacgucaacaauuauuaacuugugcccaguguuauuucaucuauaauaucaccuguucacccaccacaggucacuuuacaaaacucuagaccuuauaacaucucaucuauaaguauuucaguauauaccucugaaagggaggcucuguauagaaggugaccauaguucuauauucauacguaaauagacauaaucucuguucaugccaacaacauuuagccaacaucuaaaauuuuuauaguuauaucauaauuauugaucugaaaacauauuuucguuugguugaaccaaaagccaaaaaaaguccauaauuuaacuacuguuaaguaugucaagugucuuuuaacuuauaguuucuaacuccaccuuccuuuuccuguauuauguauuuguuuaggaaacuggaccuguccugcaguguugcaugcagucugauuguguccuccugaagcuguucugcauauuucuuuguuuugauuuccugcaagucagaugucuauuaaauucagauuuaauuuucacuuuaguuuuugggaaagggauacaugaaggauaagaauauuucacacagaacauaacacuacuuuuuuguuuguuuguuuuuguuuuucgagacaggguuucucaguauagcccuggcuguccuggaacucacucuguagaccaggcuagccuugagcucagaaaucugccugccucugccuccugagugcugggauuaaaggcguguaccaccacugcccggcaauuuguuguuuuaaucagggcuguaaacggugauaacugugccaucacuucagcauaaagggcacuggcccuggcugugugacuuaagguaugguuggauacaaaagguuauagaagugauucuacccauugagcuacugguuugcaggauuaguuggaucucuaaaccaucagaagugaucauggagucuguguuuugcucuguuuuaauagaauguauucuuucccuuagugggccacuuacaauugguaccagcauccaaagauaaauacucaaggucccuaaaucccuuauauuagaaugagugcauauaccuauguacacuuuaaacuauuaucauacacaauacaguauaaguguucuguaaauaauugccauauuuggcuuauggggcaaugacaagaaaaaugucuaugcauguucuauauacauauauuuuuuccguccaaauauuuuuaaccuguggguucuuacaaacugacagagaaacccccauaaucuaaaugcagaguuuaaauggucuuaugcuucaacucauugcaacuuuuauucguauugauguucaaauuauccuaauuuugacugugguuguuuccuuacauuaauaucuaagaccuuuuaacaugacugcagagacaauguuuacagcuuuugcugacaugccugucuuaugaauggcuuuugucuuacucuuguuuuagaccugaaaucggcucuuucuccuaggaucucauuuuuuuuuccaaugggaaguguguuuagaagccauagucuggucauagaggaugccuguugcuauuaggggguggggaguauuauuauacaucuuuuuacuauggagagcuaggaaguauuccacuuuuguguugaaguuuaaaugcauaggacuugccuugacucuuuaguucaaauucaaaaccacaugaguuucacuuaaagcccuacauugguauuuucauuuguucauauagaauucugaaacuaacacuaaccaauuuucacacaugcacaacugugcguauacacacacucacacaugaaugugcacaugagugugcacacacauaauuuauguaguuucuuggagaugaaguuuggaccuugaauuuuuaagaaguugcauggauaauucugaugccccacaauagauggaaaucacuugcaugccuaucuacccccccuucuuucuaucuuacuacuuuuuguuacugaaccuugaaccuucuauuucccuguaagaauugucccccuugauugacuguacccuuaaccauucaugucccaccugaauuguauuucuuguuuagcugcuagcugucuauauaccuaacagagaacacuguacgucauuucagccccauggaaaacagucugcaguuaccuuuggccacuugagugcuaaaauacaggugauccccacagcuaaagcucugccugaggccagagaauccuccuugcuuugagcagaaugccugguacugcaauagauuugcucaagggcaacucugcauuugauuaaauaucagagcaauuuauguccuuguacccuuguucccuuucuuuccuccuaugcagaaauguuaauugacaaucaaaggaauaacaagugcauaccugaauucacaagccuuuggggcccaucuuuaauagcucagcggugccaggccugguuggggucaugcuuucucuuauccccacucaucugagagugccuuguucucucuuccgcagcuggaguuggaauaucugaugccagcuuguccuuuauggcuuuuuccucagaacagacuacacaucuaccuuguuccaccaaccucuuuugacuuaguguuguucaugggguaaaggggagccugggaugagcauaucagacaaucaaguguuaguucaagaauauaguaacgcugcuucugauaauuauuuaccuucguuuacuuagcuuggcuguguggcucacagauugcccucauucuugagagugggguugggugaucgcuguuacuuugaauguacgguguaaaauaggacuagagagcaauuauguaacuuuggugauguaggucacacaucuuguaagcagugaagcaaguacucaugucugauucuuucuguuauauggcccuacucuuuggggaaaaaauagcguccaauauuacaguacaaguaaaauaauuuuagaaaaggucaaaaaccaauuaaagaagagaaugagaauucugcucagugccugguuggauuuauucuuagauuuuuggcacugaauuuagcuuugaguuuucuguugguuagccaagacauaaaaggaaaacuuuggcuuggguaaugcuuaucugauuaaggaaagcacaugaauucacauggaauacagacauuuucuuggcacggaauucugugaagaauacauuauaugguucuacuaaggaauguuuguaacaaugaauuauaccuucaaugguaauuuuauaggauauaaacuucaaaaggacauuuucagguucuuuuuaaucaguaguaugggaauucauuggcaguguuuuccaugugggagaggauugguacaagacagcaugcuugagggagucauuuguccuagauuguaguguggaugcaucaagcccauguuuuuacuuuuaaccuuugugcuuuuuguaguuaauguaacuuccucauaauaaguguuccauuuggucuugcuuuuuacguuuccaauauggcaaucucuguauuuuuaaggguauuuagaccauuuacauuuaauguaugauuaggacagucacaucaucuuuguuuuuucacuuuacucagguacugcucucuuuucaaccuuuccccgucuccuuugcugaguacaguucaggauacuagcuuaucucuucuaaagguucacuugcaguaauuuucuuaaaauauauuguacauaucuuuagccuacuaagucugucagcaaaugaauguguacuugucuguauauuguuuuccccagccuuuaugcuacuuuuguucuauauauuuauuuuuauauauguuagaaacuuuauaauuauuauuauuauuguuguuguugcauguucaaugaguuauuaaauaagcauauaaaagagguaacaguuauucuguguuugcuauuugaaucccauuuuugguuuauuuuaguccuuucuagagucugguauguguuuccucuuuacugaaggcauguuuuaauuuuucuaugguagguuucuugguuagguucuacgcuucauuugcuuugucuuuuaaaauugcuuuugauggcagccuguauuuggcccauguauuuauuauccaaaugggaagugaagucuuuauuaauuuuauauaaaaguuuaaguguugguaguucaugcugaauuguuuaauagccaaguucugaugacauuagcguucacuguuggugcuucuggccuucccuuucuguagaggaguccagaugaauacugauguaccucaaguuguugguccaacugccuugcugugcuggaaaugcuguaccccaauaugacaggcaggauagguuaaacagcugaagcuuacugcuuacaguccagacugaggaacauaagcucagaauggugggaagcucagcugcauucugggacccauuuccuuagcuggugggucgcugccaucuccauucuaucaucugaccucguuauugggcacacacacacauggguggggaaaugaagcuaccagcugucugauaccucuuauuagggcacaaaucccccauaaaugcucuacccccagggccuuaccuuaccuacuuucuucccaaaggucccauuccaaguaccaucacauugcuaaggucuucaguuuaagaauauggggguagacaacauacacaguagcugccuuaagcucuggcaauguguaucacucuaaaaacccaaacaauuccuccuuaggagauguagguugagaacuggaagaaacacuuuacuggaucgguagaccagaaccuuaccuguacuugucuccacagagaaucuuuauuccuaucauucuguuugacgugccaagaaguuacuuaguuccacuguauuaacaacagccaaauaucuguuugagucaggagcaucuggaaggaggaagggagggccaggaagauauguauguguucagcaucuccucacaucuaagucuuaagugacagguuuguugccuggaaaguggaagugggugaagcaagugcuguggccgcccuguggaauuacgccguggagcuugggcgugaccacgccucugcagucacuucaaauuagaaucagaaccuugaucagaugcacugcugccuuucuuacacaaugagguggacguucgucccuagaauguucaugaggaagugucccaugagugaugcagguugguuugugguuuuuguuuagagaguauacuuaaaauguauacuucuuugguuucaggguuguagggucacaggaugucccaagguuuuugcacauuucaugugagaucagaauuuuauauuuuaauuuacucuguugcuuguuacacagcuaagagguauuuuccccggugauaaaaugcgaugauaaaucaaauugugacaauguuuguuaaguuaaacaagguaucucugcuaggauucuugcagcaaauguaaaauaagaugauaaaauucugcauugucagcuuauaugauuguuuacuuccaaugacugaccacuugcauaaacucuuaggauaguuuucaaacaucagccucauggaugggccucauguucacacaaagauuucaccaggaggucuugggagagguugguucaguuuucaagaguuuucucuuacaguagcaguugucuaaaaagagauauaaaaaaugcauuuuuacuuuauauauauauauauauguguguguguaugugugauuugcugcauguauauaugugcaccacauacaugccuagugcuuggaggccaaagagugccaaaccccgaagaacugaacuacagagaguugggagcuccuguguggcugcugggagccaaaccccuucuuuaagagcauccagugugcuuuacccugagccagcuccccagcccagacagucacaguugggcagcgaguuaggguuuugaugucauuuugauuuucuuguguaccaaacugcuacuucccgagcccccugcuaccuucauuaaggaacaguuccccccaccaccaccaccaccccgccuuguuuggaaucuugaacaaaauuuuaucacguaauuuuuauuuuaaaaaaaaaaagaggauucucauuacucacaggcacugggguuuugcaaagacucaagaucucauucccucucaaucuguugcuaaaugggauugcugcugaccacuugggaccauuucaauguagcacuagcugagacuuuaguucucugggggcguuggccaccucauaagcgcucuguuggcuguaggugauugguggcugccauguuagacagcagaagacagcagauuuuuuuuuugacauugcagaacauuucuugugugugauaguaaauagaaauuauucagauuuauguacucuguaauguguuuggugugguagcuuucagucauguuaacccaaagaugaaaugggagacaaaacuauaaacaaaaacaugauccgaggaacauuccuguuggguacugaugcgcucuucuuuacaucgucuccucuauuauuaguggguuccucccugggauauuacucuucaaaaaagaagccauuguauauagaauugagauuuuacaaaggcucuaauauuauggguaaucuuucaauuacuucauuuugaacaucaaaauggccuccaugaaugauugcuuaugaugcuuaaagaaguuacucggaaaaaucugaaaaagagggagacaaaucuaacacaaauuuagucauuuugacauucucucaaaucuacauauguugggcauuaucauaaacaagccuuugaaaggauauauaaaacaacaacacagagucuaugcugugaagaauagagaucccaauuaugugucggcaggaugcgcaauaaaccggccugcuauuuaagugaauuggugcuuaugguaaaugugucauucaugaauuuuaaaaaaguguuauaccgcagacaaccuggaugagaaaaugauuugcucaggaaaguaucagaaggaaaaguggcugcagcgacaauaaaggcacuuuugugccuggagaguucugaguggaagaaacagaguguuucucuaaauuaaauaugcucuauaauggugcgugugaauuugaucaugccuuggaaguaaauggaagaaacacagcaccuaucccuucacucugucucugucuuaagagucaauauaaagaggucauaaggaaggccauacugugggcagaagugaguaaaagcuggcugcugacagccaagugguaggcggagagaacccaccccgguagcuuguccucugaccuccacaugugcccugcggcauggauguuagccaccccagcccacucaagaaaaaaaaaguaaguggacauuuugaaaauaaaaaggaaauauuuugaggggguuauuucauauggaauauuauagaguuuucuaauaaucagaauuaccuuaaauuuggauacauguacuguuugcuucugguaaugucuuaacccucacucccuggagaauuugcuuaaaguuuguagaguuagggcagauaauuuuuuuuuaauccauaggaaaugaaauauggagacagcuuugaguuacccauuaaaacgaagaucauauacaauauguacaauuguacgacuguaaaugcuagcugugucaaggacaauacaguggaagauggacccgaguaacagcagugguuagcagcagcugacugggcugugggacagguguggcuccccccauccuuuauucuuuucuguuccauuuuucuaaugaauaugcauuauuuuuauaauuagaauagaaggaaaagugaucacuuaaaaagaacauguucaagagaauccuugauaugauuuauaggucugcacuuacagguuaacuccaguaaauggaaaugaacuccucugcacagacgccggcuucugugggcacuggauaagggaacccauugucucucugcacaucuuguuucacccaucuuuagcaaugcuagaaugucacacccaagauaagccucaggaaugcuuccauacauuauuaaguaagaccuguccucuucagcaugcaugcguaaugugugguucauccuaggccugaaguauucugacuuccauccaucagcuguagagaucuuggacacuggcauuuagcaugguggaaaaccccuaaaagugcucagccuauuuuuaggccaauuauuuuuaauucccagugaaauaauggagacagauuguuuuagaagguaaucuaggucuguuuuuaucuuuuggcauugauuuauaauaaccuugaaauauaugaauauauguaauaauaguaaucaaagaaaaagagguuaucaguuagcagggaagagagaggacuuggagggaaggggacaggcauggggcuacaagcgaggagagggaaagaggaauugauaaaauuauuuuaauuaaaaugcaaaaauaacauuugguaccuuaaaaacugcuuauuuucaguuuuugaaaauuauuuauuucuccugguaaaugcuggacauuuggaagaaguaaugugcugagaaauuugaaugccagacugucacuggcauguucuuuauuucuuuucuccaaugcagcuucuuguagcacagcccgagcaaaucauggguuuauuucuucaccugaguugcugaaaagggaaaaccauagggaccuccuucauugacaggcuucuugagacacaggggugggguagggucugaacgccccagcgugggacgaucugcccccacugccaccuuacaaaguccuggacuagugaacugccuggagacggcacuguuugcugcucuggacaucugacacuaaaaagccauguauuuuguauuuuugcaugucugaaucuuagccagaggaauuaaaaauaaauauuuaaguagguucuugacuuuuucuaucaaggaggccccgacacaggcaauuugcucaguccuuucuguuggccuguguuugugccgcacugcgauacgauguuugcuucugaugacuccagcgugccugcauugugugaucagcacacagaaaaugccaguguugucuguggaagacuguaugauaacaugugaccccagugacagaaauaaauggaucccaggaacaaggagccauuaaucuggaugaaaauauucccacacacugggcagauuaauccuggcggcagccuucauucguaaaaccuacucugcucucccaaaugccagagagacaggcagacagaccaguguucacugugacuccugggggacacuuggguaacauuuucccauauuagggaaacugaacuccgagcugcucccguccugaaguauucuugccugaaaauugauuauuguuucaagcaagguuagcaucaucagcuugcuuuguuuguuuguuuguuugauuguuugcauuuuauugcuugauguuuuggaaagcuucacaaauuuagccacaguuggugaaccccaaagaaaagaaaaagcagauuuuccuuugcuguccugaguucucuuuagcugacauaugggauaauuaaaaauuguuguaauguugaagcaguuacuuacaccuguaaucccagcauuugggaggcuggcccaggaaaaucuuaaguuugaaacuugucugacccauguguuaaauugcagcuuugccugggcuagacagaaacuccuacaacaaaaauauuguaaaaguuuuagccaguuugauugaugucaguauuuucuuuacgaaacauguuaaagcaaauuauaaauaaauacuuucuccucuugguuucaacgucuaugccaauauuugucuauauagaacaaacuuuguuauuugcuaauguuuaauuuuagaacaaggcccaauaagaguauuuaaccaugguuuuuuuuuuuccauuuuuuauuagguauuuaacucauuuacauuuccaaugcuauaccaaaagucccccauauccacccacccccacuccccugcccacccacucccccuuuuuggcccugguguuccccuguacuggggcauauaaaguuugcaaguccaaugggccucucuuuccagugauggccgaauaggccaucuuuugauauauaugcagcuagagucaagagcuccgggguacugguuagcucauaauguuguuccaccuauaggguugcagaucccuuuagcuccuuggcuacuuucucuagcuccuccauugggagcccuaugauccauccauuagcugacucuaaccaugguuuuuguguaaaccauacucacaacaaaucuuuuauuaucuucaucuauuuauacauguaugaacauacauauauacacacagucauauauugugugugugcaaacgugugguauguauguguauaucugugugugugugugugugugugugugugugugugugugugugugugugugugugugugugcgcguguggugaugcugggaauagaauauaguaccugguaaguuaagcaagaaguuuaccaaugaauuaaagacacugaaauagucuaagagcagaauccuacuagaccuuuaccaacuuucugccagcccuuuucaguuagcucacuguauuugauucaauacuauuuuuauaauucaucuuuaugaaguccuaugaguauucugcuuaauuuugacagacacaaguaacauuuuaauaaaguuuuaccaacuuauuuagaguugacugugcaugagcuggugagagggaucagcagguagagcccuugcugcccaaagugaugaucuaaguucaguuccgagcguaugugcaugagcccccccccauacacacgcacacacacacacaugcacacacgcacacacaaauaaaauauaauaccuguuaaaaacuguauuccagcuuaacugaaagccuagaagaaauggguggauuucuaggcacaucugaccuacauauauuaaaccaagauuauaucaauaauuuacaaauugaccuguaacaaguaaggagauuaaugugguaauaaaaaaaauugaaaguucaucaauaagcucaaauggcauaaacaauuuugaggauaaacccaagaaacuugucagccugugauucagcuggugggcuucauaugccccuccacaugauaauccucuagacggagauucauuuagagcaccccaaacaucacuuagcagagaaugaaaagcauuguugagccaauauuguuaccuuucccuguaagcauauauaaauagcuacagcugaaaacugauaaaaauuuaauuuucacgauuguucucuguuuucuucuucuaaugaaaagccagagauaguugaguaaauucuaaugaaacuauuauuuacuuugguacaugcuagcauugaucuauuauacuacucuguuuauuauguaugugcuguggugauugauuauaaugcuguuuuaaaauuuccagagcagagagcacuuguucuccaaugugaggugaagucgggaagacagacagccacugagauuugcgccacuugaguccagugcugacugugacaggcaucuaagacuguggaguuaccuggauggguuuggcccuauuaaagacauuaaauaaacagaagcccauucuguauuuuuuggucagguucugauguguggagcccgugcuggucucagucaccaggcaguccucucuccguagccucucccaugcuggggcugcagccucugcuccccacuccccucccucacuuaguuuuuaaaacuuucugagcuuuaauugggucuuagguagccgaggaugaccuggaauccuugcuuauaaaugcugcgauuguuggaucuuguaguucucguuacaggauacuguaguguagcucaggcuagucucaaacuuucaguccuccuggcuccagcaucuaagugcuacaguuacagguauguacguuucacuugcuccguuuuucucuauucuaggaaaugugugggagcuuuaaaaaaaauggugccgacaauguuaauugggaggguuuuaggauugaguacugaugaaauguuaggaccacauuugaaaggauaaguuggcuuagaaaugaguuuacaaaguaaacaauuggagaacaggagguuuuugagacugaggugaacguguaagaauaaggggcacaucuuaaaguugacuaagcaggcagggucacagauguauuuaaaaugcugacaugccgacccagggucauuugguuuuggucucagugagagguguagauccccaagaacggcagccuuucccucuguggggugagcacagccuucagccuuccuaguugaacugaugcaaugaucaguggagcuugaauggaaggaaacaaauuucuguuuaucuuaaagccuccucuauugugcuuucgcaugcauucaucuuguucuuuucauuauucuuaacuuagucauccagauugcugcuuaagaaggaaaauuacccucaaacacacuuggcaaacaaacaaaucuaucauuguccagaguuucuggauccuucuuaguagauuucucgugagaaggagcuggguuccuucauguugacaagacauuacuuagagcaccccuaagcaaccuuggucccuaaguugagugacucaguagaauugauaggcuccugacauucagagaacagcagccaagugucacaaaaacaguaggagaugggaauaaugaccuccauuuaaggucaccggugcuugaaugcuugcgguauguuggcaccagcuaugccacguccugcugauccuggaaguggugccagccuacucuuacagggucaaaagaauuuugagcacagugacaagagguuaaagagucugagccccuugguuuguacaauugauccuuaauggaagauuuauguagacugggugaggcucugugauuuuucuguugguagggacuggaaaucaaugaauuagaugaacccaauauucugauacucacaacagcuguccucaugcuccuguuaccugucucauaguagguguuuguuugagaaaagacucacugugcacauuucuggcuagauacuuucuagaauuauuacucgaaguagacguguaugggcugcugcugcugcugcugcugcugcugcugcugcugcugcugcugcugcugcugcugcugcugcugcugcugcuacacugguuaguguggaucaccuuccuugagguuaaauaggugacauagucagugaccucacaacuuuaugguacuuacucuugaaaaaagguuuaaguagcaucuugccucuuuuccuucaccuucuauccuuccuugcuacauagagguuuaugccaucuguuuuugucaaaacuugccaaaauagaagaugccauauaauucagauucucucuauauuauaaagagaaaagucaacucuuuaauaaucuauuuauguuuugaauucuccaagcuucuuccuaaaaacagauuuaaguaaaugcccugccaacaaaagcacuauucauuaaaacuauuuuuguugacuaggucucaauacucuagaggcuuuggaaugacaccuaccugucauuucauugggagauaggacaggaaacaggaaauccugccaaguuuaaaagguaaaauaugaagguguagguuuucuuauaucaagguacauucuuuggagaaugagcauuccuaauggcuaaucuaauuaauucuuaguggcacaacacagggcaaaggggauugaaggugcgugguacuuggcuuccuuauguuuuguacgagguccuucuuaggcaguuaugucucaucaguaguccagaggcauaggcaucguuaaccuuagugaagaguuuauuagaagccauuguuagaacuuguuuuugaauaauaugacucuaguauuucaaugagaggcauuagcugcacucaggcuucauaggcagcagauaaggagagccugcaaggagaguguuugagugugugauuuaggggcaggaauuuuaugcacucaugucauuuggggugcgcauguguuccccuccaccauauacagugggaagacaugagaccaagccucccacccacaauuaaauuugcaucuuggaguugcuucuuuuccaaccagaugcagauguuguaaggaaccuuacagucauacauaauggcugguagagaucauucagggaccauguaaacaaaacucagaucaguccguauauucacacugcaaauguguauucgcagguacaaugugaguuaaccauuuugacugacugugugacugguaggucagcuguggucugggcacagcuucaagccuacuuaucucaggcaggagaguacccauccuuacauguccccaaaucugucaguagcuccaguuuaaaaguccuauuuuguuaaugaccucucucagacaagcacagcuacucuggcugagugagcgugguauggaggaugaaugcuucccuucguaggugcuggcguuucuauuuucuuacccuggccuuugaugccccuuaccccagccccauugcugaggcugcuacuguuguugcugcugcuuccucuuccucuuccucuuccucuuccucuuccucuuccuccuccuccuccucuucuuccucuuuuuuguuguuguuguucuuauuuguugcaggaagaaguggaacacucucaauuauaguuuaauuauacuuuaaagccaaagcuggauauagaaugacugcuaccuuuguacucaauaaauaauggcaguaauugccaugggaacuguaaauauaucagguuacaaucauuugcuguucaauuaaaauaccucaccccaaccccuuccccccucccccccaaaaaaaucucuuguugggucuuuugagcaggcugcgggaucccuguaagauucuagagcaggacaaccuuuuuuaaaaggcucaaggucacaguugucagucuucuuugaaagugugugugaauugccucgcugauucuuugauuuugccucgagacugcgacugaggucugucuagggguugugcugacagcuggcccaaaugaguacaguucccauucugugcgaucagcacgaucggagauugcagaggaugccugugcccuugaggaguuagucauggaauguaaggaacugucaacaggaaacguauccagcuuugaaagauuuucauguguugcaguugcuuaaccugcaugccuuuugggugucagcauuucaucccugcuccacccgggauguaugugugucgcuuucucccucacuggaaucacccaucggaugccguccauguacagagcucucacuccuguucauaauggcguuagcaguguuauauugaaguuuuggcaaaugcuucauuucauugaacacccaagaucuugagacucaucagcagcauaaucugcuuucgugcgauucugguucuggggcagccuuaaagucagcagaaaguccgaguugcuuucagauuguucauuuguacuguacuuacacuuagaugaguugacuccuuuuagacucuuuaauaacaacuguaauaucaaugucagcuuugaguaugugacuuaagcaaaugucagaguagcagguguauuauuuuauuuccagagaaaggcucacuuacacucucuucuaugugauuaacgcuucuggcccgcugacugcagaguuugacccagcagugccuggcagauaauaagcguacagugaauggauacaaccgucauugugacuguuauucaaggcucucaaaaauauauuugagcaaaggacacuuagaagcugaaaugucagguuauugugagguaaguaaagaacagugggcggagccugugggcugugaccugugggcugugacauucuguuauuuccaugaagcucaaacuuaaccuucauaggcaaugcuuggcaugagcuuuuuuugugacuucugucauauuuaaacucaauaaacuuagaccauucagcaaagauggggcuaacaucccuguaucuuacucauguucucagaagucgugguccuauggugaacacaaugagugcuguguuuccacugauuaggacuaaugcuuaggacucguggcuuguuaauggcugcuugaaacugcaggauauaguguaauuaagggagggauuuguuucuguggugaacguuguguuuuguuuuguuuugaacauucuuaccccucccugccucuuuuguagggcuagaccacauccaggacauugcacaggcuagaccacauccaguacauugcacaggcuagaccacaagaccucugccauugagcuacuuccuugaccuuuucuaaugaagcuuucagugcgauuccaucaugucgagucuuggucuugggcuaauugucuauaacucuuguucuauucuuauugaagucccuacuaugugccaacuguuauacuugguguuuaauguaauuggauuaguuagaaacguaagaaguuuaacaugaaaaugaaagaaguugauuuguuuuuaauuauguauauaugugugugcuuacgguguaggcgcauguguauacauggauacagguucuuucagaagccagacaaggcuguuagagccccuggagcuacagucacagggagguagggcuagcuacccuguaugaguuuuguguccucuggaagagcacuaccugcucuuaacuggugagccaucucuccagcccccccccccccccagaaguauuuuuauacaacuuuuauauccugacauugccuaguagucuaguaaagggaguagcgcucccugccaucugcagcgcaugucuaccagaagcucaugccucgaagccgucuacuuggucacucagcuggaaaucucugucuccauaggcgcagcagcuaggcccuacaacaucugcagaacaguuucucagacacuucugccaucuccugacaagccacacagaugugccucgcagcuuguaguauauuuaaggagugcuguacacauacauaugcauacacacauaugcauuuaucugaagggagggagggaggagaggggaaggauggaaagcacacucaugcgcauuaucccaaagagucugcuuugaugauugauugaagauugcucaucuugguuuguuugcuugauaugggcagcacaaagcaucuaucuuuaugucccgacaguaaacacagugcuuggugugaagcacucaguggggaucagaggccgugacugaugcggaaauggugcuuagcaugauguguuugugaagcugacucuuggaaccauggcuaacuuccuaucaauucaccccccugggaugcauagggauaaguuggacuggagagauggcgucugagggaaaggccuggacccgguauacggucagauggaucuggugauuguuucuguucuuuguguucaaaaauuauugauggucguuauuaaguagaguaaaaugaaccagauggaagaugcugugcuauauacagcuccuuucugucaaauucccucaaguggcgauuugacuuccagggaggccaggugugucuggugagaugggguguauguggggaagaggggcuccagguaaagccuggacugccuugaggugcuacugauuuuuagcaucuugauugugauucuguauggauauuagaaccugcuaucuuaguauuguacacacuuggaauguauacaccaguaaugcugcuaaagugaaaucuuguggggcuggaaagagauggcucaacaguguuugcuguuacuguacagggccagagucugggucccgauacccauaauugguggcucacaaccaucuguaacuccuacuccagugaaucugaccccuuuucuggccucugugggugcaaaauacauaaccauuugccccacauaaauauuuuuaagaacauaauuuugcauagcauugaguaguuaaaaucaacugguuacucuuuaucucaguaccagacuagauacuccaagaagaccggccccucuguucucaguggucagccagugagagguacuuaccgaggauucagcaguagguugaauggagagacagacauauaguugaacagguauagacagcugcugugcacuuaccacagaccacagauuaaacuaaaaauauguuaugaaucaucacauuucugagagacauuuuuauuacuuccauuugguagacaaggaaaacaaagcgcagugcaguaaaugccaugcccugaaccaccagccaaucaguggagggagccguggcaucgagcccgucggacugaaaguccaugguauuaaccucugcacucagacccauuggcauuucuuuauggucugcgugacagggacuuuuaugaagcugugacaggaaaaucuacaaggauauaagacucaguugccagcaccccucuuucaacccgaggaauuaaggaaagggggaacagaugugagcgagcugagcaucuuuagggaaaccccuguccuuuuauuuccauucccaggaguuuuagugcaaaguugccuugucuuguauggcuccccuuaugcacacuggaaccugaaugugaagcagguuagguuagagccuugcauagcauggcuuucugccaagaaaucuagcagaaccuucuggaagcccugaaggacauucuuucuccuccccauugucacuuuucauguuccugugccaggagggggaugaaaagaacacacauuucaguugucugugcaguuguaggguguuuggggucccccaaaugagugguuuauuuuaauaggccgauauuaaacuuucaaacagggauuaugaaauauuugcauuguaacaguguaacacaguuggaauguacuccagacuccuucugcuuucaacgcugucuuucaagaaugauggaagagaaagaauguuuacauuucugaaaauaauacuugagguuuucagcaggcaauuguguuuuuccuuagaagcuguaaaacauugcuuuaucucgucuguggauaguuauagaaccccagacuucaaaucacaaauacgaguuauaaauuuaacaguccuggcuccccauuauuuuuuauguaugauuauaugggugucacacuggguuucguacagacugcuguuuuuccuauaaguguuccuuuugaaaaauaacuuggaauauuucacaucuuucuuuuuaaaauuuguuuguaggggaaauagaauauuucauuuauuuuauuggauucaucacccauugauacugcucuauuuguuuauucaaaaaacuuaagucugcacugugugcugugugugauaggugcuggcggccuaggaggaauauuuguggaggguaccuaaccaaugcugggaauugggucucuccuguggcuuugcuugcgggacuauuagguagaccagaauugcuaaugcuugguaguucuguccaaaucucagguacuucgaucaggccgccuuguccugaucacaccccugugugugugauguguauguauguucucccauauacgggcucacaggaguguggauucacaugcauauggguauggaggcauggaggccagaggaggacagugguuguucuucaucacccuaugccugauugacugaggcaacgucuuugcuaacccagagcucaccaguuuggcuagucucacuagccagauucuucugggggauccucugucucugccaccccugccgucuuagauugcucauacccacucagcgaucugaacugggguucucauccuugcacaacagacucacagcacugcccucauuccuuauuuuacaaaaugugguaguaguuucuuaucuuuuguuuuuuugucuuugguuuuuuuuucgagacaggguuucucuguguagcccuggcuguucuagaacucauucuguagaccaggcuggccucgaacucagaaaucucccugccucugcgucccaagugcugggauuaaaggcaugugccaccacugccguguuugcuugcuugcuuccuuucuugcuuccuuucuuccuuccuuucuuucuuucuuucuuucuuucuuucuuucuuucuuucuuucuuucuuucuuucuuucuuucuuucuuucuuucuuucuuucuuucuuucuuucuuucucccuuucuuucuuucuuucuuucuuucuuucuuucuuucuuucuuucuuucuuucuuucuuucuuucuuucuuucucccuuucuuucucucuuucuuucuuucuuucuuucuuucuuucuuucuuucuuucuuucuuucuuucuuucuuucuuucuuucuuucucucucucucuuucucucuuccuuccuuccuuccuuccuuccuuccuuccuuccuuccuuccuuccuuccuuccuuccauucauucagaauuauuuauuuauuuuauguguaugaguacacuucuucagacacaccagaagagggcaucggaucccauuacagaugguugugagccuucaugugguugcugggaauuaaacucaggaccucugaaagagcagucagugcucuuaaccuccgagccaucuccccagcccaguaguuccuugucucgugugagucauauaaacaguguuucagguaagaaggagcuaaaugugugaaggaagaagacaguccagugaucggccucucagugugcgugcgugugugucuguguguaugucuguguguuauacagaggagggaagcauuaaaagugugacugaauuuaggacuggcuuagguuuuugauuuguagguaguuugccuguuccuagauuucucuugagaugacuuuuggauuaauuauuuucuuaucuuuguguucugacuugaaaauugggaagauucugaguuuggaaauuugauaauuuuuauuaaugucauucuaacaaauuaaacuucucuaagauacgaagguacguuuuguucaaguaacaggaaaauggucuuggacagaacuuuuaacaggcauaggcaggugcauugauguuuagggaaauucugcacagugcauucgcaaugaauaaaaugaacaccgaccaucuuauaauuaagauaauuuauugacgguccuuuucuacugauauagaggaauacucuggagccugaguugguuuuccuuaauuucaggaugguugauaacuucucguuauuauccuuccauaauuuuuggacagguuuugcuuuuuguuuuuguuuuuuguuuuuuggcacaggaacuuuuuuuucacagcauuugcucugcuguugaaggcucucaucuccuugggcuguaauuccccgacuaccugcgaagcccuucaagucaggggucuuuuccugaacuuccaucuccagugcuuuggucagcacuuccagaaacugccugauagugggaccacgucagccuccuaccuuucggagauccgucucccucacucugcuuuuguguacuugauugccaaguugugacgcuuagugccccagacuggcagagaccccuguguccacauggucccaaauagagaccacuaugucuacuggucgcuguuuagcagugugaccuugaaaaacucacauuucauuuguccuucggugucugaauuuuguuuuguuuugucuuauuuuauuuuauuuuuuuugguagugcuagggugugaaaucagugccccaugaaugcuaaacacauguucagccaugaagcuacaucaccaacccuagugucuuaguuagaaaugagaauguaaugcagaacuucaugagaacuaauuaaaagaauagcuagcgugaugauucagauauaguaggugcacaauaaauuguucuuuuccuauacucuuaaucaauggcuuucauauuuuuuaaaauccucuuuacuucauacuagauuauuauaauggcuacacuaucuuuccugacauuuuaaagucucucgugccucuaggauaacuuuagauauugcaaccagauuaaauauuuauauaaucuucacuguguguuaaauacuaggccuuuucugucccaugguuuaaaauaauccagcaagcaaagaaacucaccgugacuaugaaccuagaaaguaaaugcacacuuuaguugacagcuuugcuauaaccuguuuugugugccccacaggccgccacccaccucaauacuuuucacuccuuuuuccauaaagaaaaaucagaagagccagacauggugccucacaccuuucaucccaguauucaggaggcaggcaggucaaucuuugugaguuaaggccagccuggucuacagaaugaauuccaggacagccaagauuauacagagagaaacccugccugaaagaaggaggagaaagaaagagaaagagaaggugaaggaggaggaggaagagaaggaggaagaggaggaagaggaggaggaggaggagaacaacaagaagagagacccuugguuccuaagcagguucugauaaaggcuguacucugccagggguuccagcccuaauucaggaggugcuuucccuucucucuauucuaaaccugguguagagucuucuuuuugcucaauuucaguaaauauugaagcuuggaagagugaaggagcagcacaccuaauaccagccucucagcuucauggaagucccagagagagagaugggcaauuuauccugggucaggcuuugccuaguccuggugcucuggcuaaggcgugaugccuuccccaggauucucuuuuauccccacagcagcagcagcagaguugcaugcuccugaagaaagggagcaaauagugagggcuccuguccacaggugaggaagaaaaagaagagcauuagcacgccucccagguagggaagauggaggguguagucagucagaggcagucucuuuccuggaguagacaggauucuauuuccugggaauuuuuuuuagaagccaucuucuuuacuuacaacucagucugcugcggcuaaaugcaaggauguguauaaaggugcaagcacucauguagcugacacauuuauuggagggaagggcaacagguacccugcagaugcucuuugcuggagguucuugaaacaggcgagagccugcugaaaccugcuccauuguuuugcagaggugucugucccuuuggccaucaugguucacucauguccagccacaugucccucaucugccuuccuagguguucuugguauggccauuuaaaacucuucccauuguaacugaggguugauuccaccauaacccugguaggugaggcugcugagaagcaagggauuuaagaaagaacuaaagcauggguuuaccuuugacuccagaaugucucaccggaacuuucaggaccuggagucuguucuagaaagauggccuuaaaaguucuuucuuggcugggcaguggcgacacacaccuuuagucacaguacagagaaggcagguggaucucugaguucaaauggagccuacuuuacagagcaaguuccaggccagccagggcuaugcagagaaacccugucuggagguggggugugcgucauuuccuagaguggagcuagccaguaucuaggaaagccugagacaaaguugaauggcuuugaacaaaugagaugcaaguuccauuuuccauacccuagguagucauugguaauaguagcuggguaaucuucauuuaaauuucuccuuuuccauuuuaaaacugcauuaaccuacuuuuuaaaacuagaguuuaaaacauuguuauuauucuauguguaugcagagcacgugggacuuguggaggccagagaguaaucauguggagcuggcgcccuccuucuacugagaggccagcuauucaguucaggucaucagacuugcaggccaaguggucuauccacugagccauccuaccagucuaaacuaugaguccuucugccuccuagaaucgcuuccuacuucacccuuuauuuccuuccccagucauuuugaagaguucauaugcaauuugccuccauuucagcaaauggagcuguuauuucucuugaucacacugcuuaaauuucaguugagcugguguuuggucacugcuugcugacugugggguacugugcuuaguguuggagaacucucgcccaaguccucgcuccuaccccaugggaaaucuaagguuuguagacauagaaacugugaggagcucuuuacuuccaaaagacagacuguaacaauaaggccacaaagagugucccuagacuagucacugcugccuggcugugacacagcaagggacuugagugugugucuuauagaaguagcagcaugcucagguacaggccauguuugcuugauaucccugagaaacaugcucuuuucugaagggaaauguagaaggagcggaucuggaggagaugggaguggggcugggaggaguggaaggcaugggaacuguguuaggauuuaacaugugaacgaagaauaaauaaauaauaauaaaaguaugaguuaaaauacuucaugccgucaccauccagcauacuuucaccucagggacauguagaugggaugaguucuuaacucacaaagcaguccuggcauggcguuauuugaagggguguggcuuuauccacccacauaaguugagguaaacuauuaagcauuucuugaacuuugacuugucaacccuuagauagaaaauuuuucaaaggggugacauguggaacacaucuugcauccuauuugccaaacaaauggcauguguucuagaacuaauguuaauuuaaguaguaccacacggcuacuuaaguguaaaacuuugggggucugaagugugguggaaugucuugcauaaaggcauggguucaauuucacaccacagucaaucaaacaaacacaccccaagccuuccuuucccuguugcacuggccauacuccaaauacucagcuacauguggucuaccucagacauugcagauccaaagugcccacccucacagaaaggucuagcagacccugccauucucaacauauuaaaagcagacuuuggccucaugcugcuccagucucaucucagcugugacuuggggaugaugccaagcaucucuuucauaccuagguugccaugguuaugucugguaaacaauagcccacaguggucagugcugcaaaauucuauggauccgcucucaucaccacuacugucccuuccauuuucuuagaaacacacauuccuugaguagggaagagaaagaaaucuacuuuguucauucucauuuuuuuuccauuccuggagauuagauggauucugggaaaagaagacguuucugucuuuaucccguacccuguguaaucuggccaauugaauaaaaaugucauuguaguuguguuauggcuuguuuccgaaggcugguccauguaagugguucauccggaaaugcaugcuucugcauugagagcacugcauugagacaggguugcuucuuaggggagagcacugcguuuguaugagacggggguccccaagaacccuuugcugagacagucaggugagcuggccacucaauuccuuuuuuguagauuuacacgauuuuuggacauuuugguuguggcgacuugggagcguuuaaucuguuuuuauuaggucauuuucuagacucuuacgacaguggccuuuucagcaggacacacacacgauuuguuauuguaguuauggggaauugcugauguaaagcauucugugacuucagggaauauuaauaagccucuuaaaauacuuguucaauuagauccccugaccuccuguccagagguugagcugucauuaaccgagagaaaucuuuccccaguugaagugguaguggaggaaaccauugucuuucuccucauuuuucgcuagcuuguuuuccacacuuuuucuggaccagugggggaacauggugcccuauguuagaccgccaaaggcccaucucgacucuggacaguaacuagaguugcuuagguuuuguauuacuauugugccuacuuuuuauuaaaacaaacaaacaaaaaaaaccaaacaaccauuugcuguauccacagguuggaaagauaauuuguuucacuuguguggagaauugcuucuuucugccucaagcagcagggucaggggugcauaguuuguuugcauaaaguaggaaguguuuuccuaaacucgcagagagagggaucuggggacuguaauugcccacuggccugucaccaaggcugggcccuaagaucagcuugucuuggacugaaaggcuagguuuugaaaaugacaccacaucuguacugggggggggggggccaaguggccacggcagucucggguuuaugucggcuccucaugccaaucuguugugaaauucucuugcugucagauuuguaguuucucucuccgagaguaggucaucugauuuggagcaugaagguacugagccuccuaagucucugugacagaaagauaccgauggagaaggagcgaagccagagaccagagaccagaggagcuggcaggaaauugcaaacaugguggaauuuccagagcuuuccauuuugugaagucauggauaauuuaaaaaguacuggcuuuuacuuuuguuuguuucugugcugcagccacgucuaucugccaaccuuucuaaaaugucaugauguaauuauuuuaacaggcacuguaugcuccuuuauuugggggauauuaaccuuucuaaacaaaaggaauguuaauauacacuggagacacaacuaaugggauuucauuuuucuuguuaggcaagaagcuugauuuuuuuuuuuuuuaacuucuuguaaaagaauucggcgagugaaauaauugccuuaagcuaauccaugguagcgauuuuuaaacgugacuuuccagaucacuuuuauauggcuuagaaagaauaaugugauuuucuuguuuuuguuugcuuuagcuaaacacuauugaaaaaugauauaaauucaaugacuugaaaacaaaggaaaugcuaauuucuaaugugcugaguucuuuuaaggcaugaaauauaguguuuaauucauuguuuacuuuuauauagauuuaguuaauuuuuugaaaguaugggacacagaauaaauuagcuagcucacucuuuucugaaucacggugccuuucuguuugaugguugcaugcauuugaccugaaugugcuguuguauauaaagcccaacagccauagccucuugacaggguggccagaugcaugcagaauucucggggcuccucuguccccauggcugucuucugcccucuuucucuacccuucuccuccccccgccccaucucuuaugauacauagccacugaagcacuuuaucuggacuucaugacucuuggucaguaacacucauuugccaugguauauauauaaggcaacaaaauccucuaaaauuaaucaucaggcuugcagcuuugaccuuauuaccaugaguggccugcacguaguucuguagacaccugcaaacugaacacacacagaaucuguagucccaggcugauggcccuacccaaaacagugaagucaggaggagagggaggaggaggccgugccaucgaaccuccaucauccucuaugucaggcacuugaacugcguucccuuuaagcaagccagaugacacaagguuuugcgauuuuggauuagugugagaguaugaaauggcuccccuuuccuuccaggcaaaaauaccaacagaaucuuaaagugcuaauuucauuucauggcuuucgggcuugaaauaugggcucaaaccggaacugugcauuagucagcugaggcacacacgguucuuuugacaaugcuaguuauuauuucacgacaggcauuuacuuuauguugucugcugucuccaucccaaaacuagccauuguuuggggaaagaaucgguuggagugucaugauccuguccccagacaagucuugcuauuuuaugaguauagacacugugcaauaaagagagcuuuauugagaacagucuugcacaugaaauguaaucuggaugaauauuuaaaaaaugaauagguuuauauuuuaguuuugauuuuuaaaguauauauauauauauguauauguauauguauauauauauauauauauagacaucccaauuaccuugucuuaucuccauuaaauuuaaucuguucuuauugggauacaacuaaauuuuuguuacucacauggacuuaggaaggagugacauauacaguuaacaaauaaauacaaaaugaaauugaauauaaccgucuugaugugcaaaggaagaugaguggaagagagaguugauugcaugucuggaagcauaucuggcugauuuauguccuaauuuuaguacugaguuuccuuuguaauaguaaaaugucacauuagcaugucccuuuuaauaaucuaauaugcuaccagugacaauaaauacaugcaccaagucuagcucaagguaucucuaacuucacaggcccgugacccuuccccguguaguuaaaucacccagaugacccugcugucauauauuuuuaauuguaaagcacuugaaauuaaucauguuuuauuucuuuuuaaauaagcgccucaagugcagcggugcacaguuuugcucacggcacuuauccacucuuaaagaaaauuaaagaucggaaagggucugugucucagaggcagcaaagccauccacacagggaaaacacagcagaaggaaacgaugcaugcaugcuaggccuacacccagucucgugcccgugcacugaguaaaaauugaggucggugcaugaaacaaaguagaaacauuuuaaaguauuaccgcaagucaucaguggucauaacccaaggucuugaggaccucagugagggcggagguuucuuccacucugggaggcaacagagugccuuucauuuaaacuacgcacagcuaaucuuuaggagaauuggacucuggcuccgaacuaauuaugauuuacagaaauugauaauuugucuucggcaugugucugcaggaagaaauuacuauuaaauuugauuaacaaaugacagauuucagcccaguaauuuaccaucuuuauuagcaaacuuagaaaacuucucagugccauccugguaguucauccuggaauaccauggauaccuacacccucggcacggagcuaccuuccugugaacaaacacaucucugugugguuugucuucuccauccucaggcacgguccauguguucaagcugauuucccaugagagguggaacuuaauaauauguaauuaacuucccaaaaugaaggaucuggccuuccaaguacacucuccacgggcucccucggaauauugaggcguaugcaagaggaggcugugcuucugcagccaccucaguuucucacacuccacucugucaaacaaauguuuuuccuucucucugaaacagauugcagaccauccauuuguuuaaagcugagucuuaauauccaguugacacugcgcgugacuuaggagccucuuuugcaggcucauaauugagacgugaaacuguuguaacauggcagcaaagugggguauuaaaacguuucucaugcgaguaacaugauuauuucuaaguacacuaacauccauguuuuuauauaguugagaacauauuccauuggacuaagcagucuauuggaaucaucacugugguaaaaaaaaacaaaaugcccuuuuauguucuccuaucaggagaaccuucuuguaugugaaaaggggaaguugagaggcuggagagaaggcuccucagggguuaagaucauugcuacuccugcacccauauccacaguuugcaaugguuuguaaccccaguuccaagaaaucugacacccucuuuuggcuuguaugggcaccugcacauacaugguacacaucuguauucuggagcagugcacauguauguaaaauaauucauaaauaaauauuuuaaaagauaaauucaauagcugguuucuaauuuuauuucauaucuaucaauguuuugccugcauguguaucuguguaccaugugugugcaugguaaccuaggaagucagaagaaggugguggauccccuaggagcuaaagauaguuguaagucccucuguaaguggugggaauugaaccuguguccucaagaagagcagguagugcucuuaaaugcugggccaucuuuccagcccccaauuagccuuuuaaggaacuagaagcaacgcuuaauuuuauaaugaugugaaauaaauguucuguuaucuaauaguucaccagcaaagucugcaguagccuccuuucucaaggaugcagcuugugugugaugcuaauauucaaaugaaccugccacagugagugaugggaggugcuaauaacuccgaguggggagaugaaaacaacauauugcacacaccugcucuccgccucaugucagccucaucauaucacugaaugagugagcugaaugaggggagucagaggccagacagcagcaagacacauguccuuggaucuggaagccucacugucacugugguccacucuugaccuuugacccagggaugcaaaagaaggcagagcccuuacagcaguguuuccuguggggguauuggcaaugcugaguguucuaucaaccccugauuucaaucuuucuuaguacugcguugggcauggguguuuauguacuaauuuuguuuaauagucuccaucuuguuuugucucuuuguauuucuaguguucuuauuaaaguaggauggucaguaaucuaaucaggcagaagggaaugcuuuaagcagguaacugaccguuguugcugaaaauggucaggauucuagagagaaacaaguuagcaacaagcuagacaaaacccugggauggaccaugaggcaaacccuuauaaaggaugauagauuuuagagaacugcagauagcucgugcaguucacccaacagaaaccuucuccuagcaacuuauguucauuuaaaagcuaaggacacauugauguccagcccaggaaugcacugaaugaggcuccugaaaugucugucaucugugggcuccugaagcccuccagacuuguuugcuuauucucgcccugucauucuuugucauuuccuaaacaucguccuuugaguacaagccaaaccauguaaagguagcaaagugagucacuugaggaccagaaggauguguaaccaaaguggacauuugaaagaugacugcauccgcugucuucccuguucugaaagcaaacugaagaagaucuccgagaagaggaacuuugagagagaaugagauuuauacagaaggguccacaggguuugggauuacuguggaaccacagcgacccuuaggcauugcauaagcuaaaaagaauggacacucccaaaacccaaugaacaaaguaucuucagcuuaauguaguuccagggaaucacuuggaugcaucuaugauuuuucuuuucaauucagagucucagaagucaaguugaaccaccaacaaaaauggagugaagaaauguuugaacaccuuggggggcgggggagagcaagaaaguccuugauaggggaaagagcacugaagucuugcucugacaagugggaccccugccacuaggcucugucagcccagagugcuucugggaagaccacuaacagaacgagcagccuguaaacaugagcaaguuaaggacucgccagccccgugguuaggaguggaagucaagcuaaagauuaaagacagcuugacaaaauccuacaugcaauccagcugggcuuuacacauuaugagauguggucggacagaaugaggguguuuaaaaaaaugauugcuauuaugcagcuggagggcagcgggcugagcugggcgugugccaggggaacuugugcugcuuguguagauaaacuugcagggcuucggcuuucaaccccguccacugcuuucugucagccucucuuaaccuuguccugucccuugcugagcccugacauuuucagugcaggagaaaaucguguuaaauuuauguaugaggagggguacgccuguguguguugcuagacucggauuuuaaguguuugggcucuuuugauuaguucugcccuugguuuauuuuguagucacagaggaacuuauaaaccaguguugaguaagagucuuggugcagcuucccguguucuuggucagcacgggagcaggccuucgugggggcucugcggaagaaccucggcccucugagaaagccaggugagcucaugcuguuugccuaagccugcuggagcccacacucguguuuuuggucagugacuuaacagggauuuuguccaagacuuuguuugaugaaagaauuacaaaauggaugauguuaaguucugauggagacuugugagcacuggacuugggaaggaggauuuggaccagacuguacaacaucuggggcagcuaucagaggacaguauauucuccuuuucccuuuagacagguagugggaugucgcugaggaugacugagagguccagaagccaugugaaagagggauaccugugucagaguugucaggcagagggcuguugcaguggacuaggagugugagcaaugguuucuguuagccagucaguaguagucuugggagaaccauagguguugccucacaucccaacucccaaauacaugucucaggcucauugaagugguaugauaggaaggaucauaaagucgugucuguguuccuuucagacgggagguaaagaagaugcucuguaauccauuagugaugucugcgauggguggggaugguggcuccucucuauggagauguuaccccugauagacauaccucagcaacacuuaagagaaguuuuaaggauuaguggcugacuaaauaugguggggaaucgggaaguuuggagggauauuaugauggcuaguacugaaaucuugacugaccugacuuagcaaaaugacaauuaaaagcuaauuacucaguaaacauuguugauugaggcuagagccugagauuugggcuggaagcggccaacaugguucugaucguuguacucuuguaacgggggcugaagagcuagagaggacugcugguagauaagaagagauagccugaaaccacgugacccuccuagucuccaagccuggauguaugggcuucucacaucuugaaucagauugcagaaaggagacuacccagugaacuuggcaggugaauuuggaaccaguguguauuaggaggucucucugggcuugucaagauuccauugguaccuuuuauuuuauaucuauggguguuuuccugcaugcauguauauauacacuguguaugugccuggugcuaccagaggccaaaggagaauaucagauccuuuggaacuggacuuuuucagaugguuguuagcugcaauguggaugucaggaauugaacucggauccccuucaaccaccccaagugcuccuaaccacugaucuaacacuagcucuuguuauuaaauucucauuaagcacaaauaugguaauuaccaugauuuagugucugaaauaaauggaagauuaguagcaagaagcuaguucuuuguuagggagaagacggacuugaaggaguuaagaguucacucugagucucacagguaauaaaugucaggauugggucuuagacuuaggucuggugguugucuucuugugugcuuucccuguuaucauaugcuaucugcuagaauauauaugauacagagcugaacuuuauauauagaaauaaaggauaaaugaugugcauaaucugacagaaucauuuggagaaguggagaugcugacaguacccagcuuuugcccuuuacauuuugccucugcguucauacauucauaaauauauuuaaaccugucucugaauauuuaggucauuucuagucauuugcucuuauaaauaggagagagaugguauaaauuagccagacugccuacguuuaaauccaagcuccaccacuucuuaccaaugagaucuuugguaaguuucuuaaccuuugugucccaguuucccuauuugcaaaaugggaugauaauggcuugccucauacagcuauuguggcagaugcaugcggaugcuauguaaaguacuuagcauaacaauuuggcacauggcaagcucauauagguaagagcauaauuugggggucagacuucuuuggguuuaaguuccagcuccaucuuuuucuaguuguaugaccuuggccauaaccuuagcucccccgggcuuugcuuguaagcccuuuuauggcuguuggaagguggaguuaaaugagauaaugcagaaaaguugcuuucaugguacuuaaacagaggacacaauacaagaucauuguuuucauuauuacugccauaaucguuauaauuaggacuaaugccauaaugaacaucguguacaucaauuuuugugugucuuugugacuguuaccucaggguaaauucuuaaagcauaauuccuguguuucuuuugacuuucaaaaaaauaucgaaacuaugcuauuuuguauguugaaaaugauacguuuuuacugaguacauaguugguagcccuuaccaacuuggauauagugagguucccuaaggaugcauauuuucuaguguaagaguuaagaguggaaacuaaccaugauaaagugugaugguaauuuucagugucagccugaguugguguggauucaaaauaagagacaucugggugugguuuugaggauuuuacaaagacaccugccagaggaaggaagauucugauagugguaacacaccaugcuaugaauugggaacccaagccgaauaaaaagggagaguaagaaggaggaagcugggugaagcgcaucguuccucucucucugccucugacuguggguagagugucagccacgccuucuucuguagugcuggacucagugcccucaagcugugcgaugaaauaagccacuccuccuucgguggcuucuguccuguauuucaucagagaaugagagaaucaaguaugcauaaagguauguagugugagugaugcuuucagaaagggacccaucaauuggagaaaaauaagugggguucagggaaaucagguuucccgagagugguggcaguaguggcuccugguggugugugugguucugguaaguggagcuggggaaggugucucagcacugugagccggcaccauggcuguuucuggaaggcugaagugcauggagcaggccuuggcucuggagaccuugagacuagcaggaugcuuaucuuguccucgaggcucaagcuguccacccagaaucuaucuuccuuccaucucuuucaggccacagucaauuuugggacuuccugguuucuaucagcagcguaaugcucuguuguguguuacuuagcaugaauccaggcuacuguacacauguagcucuugaguuuuuuuuuuuuuguuuuguuuuuuguuuuuguuuuguuuuuuguuuuuuguuuuuuugagacaggguuucucuguauagcucuggcuguucuggaacucacuuuguagaccaggcuggccucgaacucagaaauccgccugccucugccucccgagugcugguauuaaaggugugacuaccacgcccggcucuugaguuucuaagaauggaauuucuucccagguucucugauuacuuucaucuaauuucuuuaaaaacaaccccccaccccccccaaaaaaacccaguuaaucucuugucacagucugauggcagagcagugcccacauagcuauuuuaauguagucacaauucuuaagguaaguuaaaaccuuuucaguugugccuuauucuucagugacaguuaugacaaauagcuagcauaauucauuuuuucuuuguagaugguauaaccgggaaucauauauagugguuacgcauuuuuuuaaaaggaauuuaugaaguuucaacuuagaauaccggauuagacauuaaagcauuucuguugacaagacugaaguaaauugucuucugauccaguuuguauaauaacgugcaacccaauucacuaaguucauauuggaaacucagcauugcugugagacaaaaauuacauauaugagaguugacauucauucaccauggcuuagacuugaacuccagaaugcaaaggagcuguuguacuccuucuuugcaguuuuuaaaaaaaaaaguggggacaggaucuuuucaauuuuuucucccacaugccauuuuuaaaugaacaguuacgccaguuugcuguuagcaagcgcugugagucucucaggcuccuuguucccaucaggguuccuugugacaaauuuauaauuuugugucuuauaucugggucaacaguucgauuaauguuuuaucuccugagcaaaagcacagcccuucuuuguaaacuuuaucucacucaaccugaagauugcaaaacaaaggguguucugguucucugcgcccucgugcgcgcgugcacgcagagccgagccugcaguuccuccugugaagcagagccacagagcuuugccugugccuugacuucgaguccacugagcucuaauuugcugcagguggaagagucuccucuuuaaagcuuucaaaccguauuaauuaaagcgaguuagucgucauuacugaucauuuacuaacuuuuauuuauuuuugcuucauuauagcacaguaggaggccauuuaauuuaaucagaaaauuguauaccuaguucuggccacagaaaagcauguagugauaucugcugagugaagaaauugaucauguaucuuaccuaagagauaguuaaucuuuaauauuuaguaucuuuaguguuuauuuuauuuauuuaacucaauuuccuuaaagcuaaaacucgcuuauguguuggggcagagauugaaugcagggccuugugcauauccucaaauccucaacuacugacugaacuacccucaccaccuucagcacaaagucaauaugaaaaaguuauucaaaauaugcauaucacgcugucugagagcuggcaguugugggcauuaccuuuucuaauugaaguaguagcgcucucccucccccucccuuuugcccucccccuccccucugucucccucucucucucucucucucucucucccccucccccucccucucccccuccuucuuucuccccagccuugcuauguuaccaguccuugaguaagcguggagacucauuaguaauuuuuuugaaauaugcuacuuauaauagggcauauaucaauauuuucuuccauuugugcgggcagauuuauauguuuggugacuugaaucacagacuggggaaauuuuauuuuaaauagaucucauuauccagcaugcauugcaguauaacuuuuuucugcaacuccccuaaaaaaaaaaaaacauuucaagccuuaucauuaaaaauucucuuuaauauugccaaucccagcuauuuccuagaauguuccuaaaaacaucgugaaaggaauggacauaaaagguuuugaguccucauaggaacaauggccuggauacaaacagaaacuaaccagcucugugagccugcucggccuccugucucuguucucauuaagugagcauguuaguuauacaugugcaaauucgauuauuacuaauuuugucaggaacauuuuuucagucaucaaggaacaaagacuuuacuggaauggcuugagaggaaccagagauuccaccauccaguguuccagaagcaggcuguaauccuagcucuuagguggcuccauacuuuggaagccugacuuaacaaccgagaggugcuggccugggauggaagagcagacuuggugaagagacugauuuuaaaugugauccaggcacuucagcaucuuauuggaaacaagaauacaauuuggaguacgcagaaggaucaauacuuuaucuacuaccucuuuguaacuaaaauauuaugaaucucacuugggcuugcuggguagcggauugaagagggcucaugucugagcucugguaaguuagacuuuggaguugauagccuucccuuuauuguuuaugcuuugcuauuagauagcuguguguauggccauacaucauugacuaauggggcauaugcuaaaaugaagauuugaauucucugguaagguuggugaaaaggcagagggcuagaguggccucucuggagcgagcaugagaaaggcacuuugaaaacugguccgguuugcuugcauuuuaacauuacagcaucuuuagauacuuagaagcuggaacaaagcuccccuaaaguagaggggaucauauggcgucuugcgacccaugaagcaugcgcagucuucugcucucuuacacuccuuaccaggagcagugccuagauauguggagaggaagcagugcaugacacagucaccuguaccucaggggacuugagucauggcguguacuagacuaggacacugagcuccacucuaugagcaagcacagccagucgcuuuuccacagccuggauucuacauugguccagggagccaucacagguuuaagugaguauaguacuugaacacauguugggcucaaagaaacuagaaucuucuuuagagaaacaguacauuuagggacacuggugugauuuagauaacaguggcucuuucuguucccccugcccccccaaacuuggagacaugagcaugaaguuagguagagugugggagugccucagucacauuguaacucagcucuguggcuuccuauaugugugaguuaucuugggcccauuucuuguaccuuucugccauuuaauuuucccaucuauaaaauacaguugauaauggucccuacuuggucaccuuuuguguuuacucaaggaacuaauauauacaaaaugauuaugauagugucuagugagccauucuguuguacaugcuagcauugauggugcuggucucauugccccccccccccccccgaaaauuuguagaagugugagccuugccccaguucauucauucauucauucauucauucauucauucauucacuuccugaggaaagccugaacugcagacugguauuuuauaacccaagccauuacacuguacuccaggccaacuggaugccacagccuugugcuuagcuucccaaucucuuagaacagaacugaaaucccacuucagugcagagcugguaauuguuuuuuuuuccuggucaucucgggugauuuaugaccagaggcagcagugugacccucucauaacauuucuaucuaaguuccccgagaaguggauuuuuaauaaaccauuaucaaacuggcaucauuaucaccacucggugguguguuaauucaacaacauuugugggucucuaguuuauuuaaaggacagugguaggaacugugagaacuccaaagagggugaaaagugaagaaaggauacuuuugcuugggaugauacaggacaggaagaagaguggaggggcuuugggaaggaagguuagcgaagagcccagguaugugaaucucggauggagccucaguagaucuggaaaaggcacauuuuacucaaaaagaggaguguggcugcaugguagaagagaaacaagugacguguucaaaagagauacagcagucugggugugcuggaaaagaucugugcucagauagucagacagcacauugguaagcuaggcacuuagcagcuguagaggcaaauuuguauuuccaaggggcagcguccacagcaauuuugcaaagacaggcaccaagugcggauuauacagccucuaauucaugggaugcuaagaaacuagggaacaucuaagagauaccuucaggcacaaagcagaacugcuggccccaggagccacuugacagaggaaggaauuaggaaauuauaucuggagucagugagaguuaagcacucuugguuuuauagaauccaucugguuguauuagugaacaaaaugauguuccaacccucaaucucccccucuguaaaauggugcuagcguuacuaugagacaguucguucaaugugugaggaugaaagaaaugcagcggagggugugcgugaagcuuuuaaacacucaaacgucucuagaguauuuaaugaaugguuacuaggaauaacugugacagagcacgcgucaaggagagagaguaucuucaauucacuggugcugcuuccaugagaugcuguguaaaugcucacugaugcuguacuucucucagaaguuggaagagcacucccagacuuauuuuuagcuucacaacugaaaugacagagcugcucaguccgucggugagaucuacuaaucuuuguaaaggauuaaauuguaaauauauacaucaagccagaacagaaaucuaguauuucccaacuucuuguuuuguuucaugugcauguuucaugugugugugucugugucugugucuguguguguguguguguguguguguguguguguguguguguguguuugugggcacacauguguaucacauccauagugucucucucucucucucucucucucucucucucucucucucucucucucucucucucucucucucucucucucguguguguguguguguguguguuugguugguuguuugguugguuuuccgagacaggguuucucuguauagcccugccuguccuggaacucccucuguagaccaggcuggccuugaacucagaaaucugccugcaucugccucccaagugcugggauuaaaggcgugcaccacccggccuuuuuuuuuuuuuuuuuuuuuccuuuuuucuuuuggacauccauauucucacuuuuauuuuuuuauuuaauagaauguuuuguuaauuauuugagaacuuaauauaguauaucuuuauauccacccccacuccuuccaaauguacccuauccuuucgauccccccacuucgugccccccucuucuaauauacacaacaauuuuacaaaggguagaauccaagaguaggcauggagagucaaugaggaaacugaacagggacucccauuaaccagauguuuggaaacaaaggccugacuacuaaggcucacacuuguucuccccccacuguggcacuguuuuuguuucaaauaauggcauauuuuauuuuaauuuuuauacagagcaaugaaaagaauacagauugaccaaaaauccuuucacuuuucccuccagccauuuucccaccuaagguuccuugauaaguaauccugaguuugugaaacaggcccagucaagucacuaucuauguaacuccaaaguaucugaggcuaggugaggcacaccuguccaagugugauccaacccuggagcacccaugcuccuuucagagaauccaugaacucaaccugauccugagacuccuagugugucaguguccguacagaagcagcggugcaguuuacacgucacuaacccgagucaucucaguggcaccagacugucccaagauuccugugcuuuucacacacaguacaaaugaaugucccgaugaaccagaagagagugauuacuucuaucagcucuuggccuguguguuucuagaaguuuaugaagucgaggggcacaaaggcuucccuggucaucugggaaggagcgcugauguguuugcguuguaaauggaacuaacucggaaauccauggaacaucauucacuguuucucaauagugauaaccacccuggcuauuaaggcauggguguuaggcagauguuuuuggaaaauaaaaugagccugucguuucuagggaauaaugggcgauguguauugucagcaacaacauucaagcuuugaauggaaaauaagaauuauuaaaaagcuucacccaccacuucgcacuugauagauuuucuaagacguagagacaacucuccugagagagguggccauagugaugccaugaugcugaguuauggaacaugccagaagaacugugcagcccagugaauggcugauuucuaaaugacuauaguaugaugcuaaaauucacagguggguaaaaaauucauggacagaggugcaacaguggccagcugacugacuucccugugaccgcauggaaaguucccugucauggcuucagguacuacacccugacuauccauuauaaagccaacaauugcggauuucagucuagcaucaguacccaucaccaucaccaggaacuacuaagcccucuucccgguuccaaccacauagcugugugaggcuggugcuuuuuauauugcugaacacaaacagcucauggcaacaggcuaaaacggcaaacaugggaagccaggugucuucuaguaaaccaaacacuaagagacuugccaagacuuccuuucccuaaucucaucccuuggaaaauguagcuguuugugcuaaaaugucuuugauagcauguaauggauuuguuauaucuuaauuggauuaguaagaaucaauuucuuguuuugauuucuaaugugaugacagucuauaugcauagcccaaguaaacaaauuucuuugaggcccucaauuaacuuuaaauuuaaaaaugacucugacccccaagaugugcaagccacaccucuaauguaguccuguuagauuuaugauuguucuggccugccagugcgugagagugccaucugcugacagaauagggaaguacaggugcuuuuugaaaagcacagcuggaagucuuggaugauuucugaaacuucuuguuggaaauuuaucaagggaaaaagacaucaacucagauguccaaaggaaucugucuuagaauauuacguaccgaaauauuaaucuucagaaugcaaguaaaaacaguuaaugaaaugcuuauuuuaaaagguucacacuuacaggccaguguuccuuucuuauguccguuuaguaguacagaguuccuagucuguguugguacucugacucucugacacaccgagaagugugguguucugucaccugugauuggcauggucagucauugguauugcuccaaccuuuccugacagucagugcuuuuggauguggguuuuagggccagucucuagggaaagagccuccaauguauugcccuuagagcccaugccugugcaaguucugucacacuaucaccuggcuccccuccuucuuccuugagaacugacacacgcggugugggagcacagaccuguagaaggacauacagacaaacacggcuaagccaagcugugaggaauaggaugcagcugcacggagcaggcucaugaguaaugagcuccaaugcuguggaccagcuucugcaugucuguguuugcaucacugagcuacgugaagaggaaggaaccucacugcauuuccauucaguuagaaugaaggccuacuggccaguuugguuuuguuuuuuuuuuuuuuuuuuuuuuuuguuuuuuuuuuuuuuguuuuuugacucaauucagcugauuguuuucaaaauaaccuguucuuuucaaacaguugugcgucgggacagcugcacucagaugaaaugacugugagccuguaugcuaacuacuguacucauugucuguccaucuccacugugugcccagugacccugcugaugaauauuuuagacaucugcaugaauaaucagacugcccacaggagagcugauggcuuguuuguggggcuggaaugcuguugggaugauacugcaauucuguguacccaugcgaaaguaauacguaccgcagugagggggucuuacucuggauugucuuugagcauccauagaugcccuaaaauuuggcugucagaguuuacuuguaggcaaaggcaaaggcauguguucaugcuuuugauuaagcaccggagcuuuuaucagacuguccaaaaagacuguaacccccuaaaggcuaagaaccauuggcuaaugguugagagcuuugcaaacaccucuuggcuuucaaucauugggauccucccagggguuuugugaggcuuuuaacacgucaugacuuggagcuuauggaacucccaguaggccucgagagccauggacaguuuucagugaguauguaaguugguguggcuggauguuuuguuuuguuuuuuuuuuaggacagauggagcuggggugguguggagagcauguuagaggucuauagaaccagguaggaacucauggggaauugggugaauaaagaugccaggcccugaggguggagucagaauggaagagaaggaaugguuugcaauguaguuguaagccuugggguuuguucaucaguugggaauggggaaagagagaaaguagagaccaagcagguuuuacaagauggcuuucuggugugagugaccagacagcagaggagaagggagacagcaaauucuguuuccgugguguugguuuggaagagcugaugggggaauaggccagcaagcccuugggaugggaggugaggaucuggugagguggggcugacguggcuccgugugugcaggggaaauagagaaugcuggggaaagacauuaagacaucgggugggguuugguggcaguggugaucugaggggagaauaggcuuccaaguggcuagggaaugccacucccucuucuacuccucagcugaaaagggggguaucuaucuuucaugacucuccuuauuuccucucagcucauuuccucucacuucaccuuuauuucucaguugcgaugacuuaauuacucuuaaagaaauaaccagagucugccagcaagcugcugugaacggcagacaaaggguggcuucaauguccccuccuuuggucucuaaaacccucguucuaacuuugaaaacugacaacuaagcuugcacguuugcacuguugugacgcaauggcugagagaaguuuaagggggaaaaguuuauuuggcuuccaguucaaaggugucaauucacugugaguugaccauguuccuuugcauggagggucaggcugggagagauaacagaagaagucugccuugagagaagaguuggaguacuaaugcccucuuccguggcaugcccccaauauccuaacuuccucccccaaggcuccguuucugaagguuccaucuuccaacagagcuacauguuaaggacagacuuuuaaugcagaaaucagaagaccuuugcgggccagacuagcacaguacagaagcaccaggcccguugagcuucgaguucccacugcccaggccuccucccuagcaguaaccauggagccagaguugcuuccaaguggucucucccuguucuccaggagucacacagaacccugaggaggugucacaucccuuuaauggcauuucuaguacuuacaucccaguucucugacucccucaucucaaaugaccuucaucuuuauucgacuucagcugugcacacacaugccacaccugauagaucugcuccacucucggaguuucaaacucuauuagcuucucuuugaagcagccuuccaauguacaccgcccguguuacacuucccccaugcuucucuagaaacguccugucugcccccuuucauuccuuggucuccccuuguuuuccauugugggaagaugagagugaggaggcuggacagccccuucugugauacccagugucccucgguggcuaugcuuggcccguacaucucuuuugcacagccuucuuugagaauuuccaaacuagguccuuccuuugccaucuguuuuccuccugcaacuuugaagucacugagcauuguuagaaaacuucacaaaaacuggggcaauuggaucaauaaauguguugaauaagggaauuugucagcuucauccccguucaccugggagagaggagccugggaaaacuaaaggcccaugcuucgucuuuguuacaucucuaucccaguagcucugccugggugaguauuugugaaugucaucugguaggccucagaaauuuggggccaucucaauuuagcaugcuuuuauuagaaagccauccuuggggcccauuuuuaccucuuuagaguuacagucuugguaaaaaucuugacaaaaccuuucccuagacagccacucacccuuugcgguuggggccuaggcugugugaaugccuuucucucgaagcagugagugauauuuauuuauuuuauuuuugucaguuguuuccaugguucaugaauucuuuauuacaguaggagucaucaguuggauggagaaucauugaaauuguagguuuaggacauuaguuggaauaaccugaacaaugcacuuaccuuuugggcccuuaauuuaauuuaaaauuaaaugggucuuaugauggcaagcuucacagaucugccugagggcuuucugaaugggaacguguggcucuguguaggaggcuccuuuguucaguuggagaggcuagaaagucuuugccuaaaaacacguauuguuuggagagcacaaauaacugaacauaauguuagugagaaguuccacuggagauugaacugcugacuuccaagaauagagcagagugagaggaagcgcagugaacagugucuucucuguuuuccuuaaaauacccgugaaauuaucugaaagggcaacaaacccccagaaguaaccacagugagccccaggcguggagccccugcuggguucugggaggaauugucucauucuucucuguugaaaucagaucucaccuuccugacucagcaucccacccuccucccucccccauggacucccacucugccucuaaucauggaaaccuggucuccuuguccuaaccugcucuugcgccaucuccaccacugcugaugguuuccguugauuugggaaaugacugcugacccgcucgcucgcucauuggcugauguccucagcucgcccgcucgcucauuggcugauguccucagucucuuggugguaugauugguggaaaugacugcugacccgcucgcucgcucgcucauuggcugaugcccucagucucuugguaguaugcagcagaaagcaccugugauuccgcccaucccuugcccucaggcaggucuuggcuuggucugugacuuuauuuguucagaaggaauguggcugcuggccaggcuuugacucugcuuuaggaaugaggaugucugcaagggcuuccuuaucagucacccaugccggguaauugcccugacucccugaugguagggaaggaagagugggcucuggagguacauuccugccaauuggucuccccuguacgaagaacaguagcugucucccaaguaaucagggaucaucaaauugcauugcggggggaaguagucuucaaguguagcacacacugaagaccaaggucaacaaacugaacucaagccuguaaaaucaggaagcuaagucugguguugaggaagaagaauuaaaacagaauccuacagcuucagaaccagguugaggaaauguagcccaucuuuguuaacaggcucgccuuaagacauggcagaacagcccaggcuugugaacgcauaaaaugucuaaaacagguuguuucuaccaacugacgacugacaaggggcauccuaagacaccaaugacaguaacuaaaugacuguccuuguaaacaaaagaccacgaagaguaaacccagagaagagaugccggggacacagguaagagacuggggagacacagagccaacccagaagugaucaggacucuuagggaacacagaccaagacagaugaaccaacugggauucaguuuucagagguguggggccuggaccucagguguugagagaugaaacucugcuaggcaagguuucgaauuagaaauuaacacugaaaaauauuggaugauuucuuuaaacuggacccugguaggaacagucagggaaaguacauggacuggauugugggucacccauugugaucuuuuggggguuuuaauuguaaguagauagagugcuugaaaguuauugaaagucuguguaauugauguaaguaauaaacugaugaauauagagcucgguagagcucuccuacccagccacagggaagcagcgccuccaagcuccucccccuucacugccugcagacacacccacugccugcaguaccucauuagcauaucccgaaauguauggagcccuuucacagggcccuuauuaguguacuaaguauuaaguguacucacuuaggaaucaggagagugaauuugaagguaugacccauauguguccaaauaauaucuaaaaauugacccuuaaaauuacagcauuuccuuucaaacacuacugauaggaaucagaguuuagaacauaaaguguguuugugaucauaugaugucuauuuacuguggcacaugguagauauuaaaauagcgauggaauuaaugauaaccuaggaaacuuaacuaaaauuguaaaccagggggaaugucauuccauccaccaauaaggaguugcaccauuucuuccuaguugucugucagacugacagacagacagacagaguugugcuuauucugaaaucuggacagaacaucugcugugauguagcacacugaagagaugcugagauagagauaggcuauggcggagaacuuggugcugaugcagggaaggcauaaaguagaacggauuucaaugaguccuaauuuuuagacuuuuaagagguuaauuccaauuguuauucuugcugucuuccuaucagagagcuuuggccaaucugguaagaagcagaggucaauagaaaugauuaagcagcuggaaaaaucagcuuagggauagaggggagggguuaguacagcauuuauaaaaaagaaucugaaucucucaaagucuacggaaacaggaggauaauuuagcaugauuuggagagcuguggagccaauggcagaaaauugaguaccaaaaaaaaaaguacuuacugaguuuaagacagaucuuaauagacaaauuaaagaacugcagagcaguccagaggaaagugucaugauguuuuaauaaaacaugcuaucccaaagaaugauaacaagcagcguuuaugagcacacugugcccagcacccugcaagcauccuuuuguuugauauccucagugaucugugaaaugggacuaucacuuucugcuucauuuuucaaagacagcgggauggggcagucuuaugaggcugguaggccgugcacacuucauuuugaacuuaaguccugagcucaaucccagccauacacucgugcuuucugugccaggcaguugaugugcuuuccaggguaacccacuugguuucccacgugcuuaaagaaacacgacuugcucuaggaaguuacuccucacgcacguggaaagcaaacgugugccagggucccuguucccuguuggagggaguauccagcaggggucagaaugguggcagcaucauagcaugcaucagagagggggacagugggacucucgcuuucuaaaaguuuacucguuagcucaaauaaauuagucaccugaccuccguagggauaacacccccaaaaagcagagaaucugauuccauaguguauauaugaagauaacuauguguguguaguacgugcauaaaguacuguaaggguggcgugcaaauaagaacauguguauaaaaccugcgugugugcguaucguguguguguguguguaaaguacuuaaucuuaguacauacucagugagcaguagcugacauuguuguucugaucaagucuucaaggaaaugaagacaaauagccaagggcauuacaugguagugaguuuuuaaaaagacuuuaauuuuguguguguaugugugugugugcaauccucccagauugucuauuuaacaguaaaacuucuguccccuuugcacaauuggggaauucacaaaaggcuuuggucuuguagaugcaguaguuuguccgcugcaaacccggcuucugacaaacugaaggcuugcugugcucugauauguuagcaggcaaugcgugguuuuaauauucauggucucuaagugcuaccgacugacauucgguacuaaaugugcagauacgggugcugagcgaaacacaggcggaggacuugcuaauuuguauucuagauggaaaucuuaaauuaguuuccaagauuuuuaaauggauuuuuaaaugccgggcacauaggagauugaguucauauuaauauuuauaagguuugagaagauauuuagugaaauauuuguauaauuuaauuuuggucauaaucaagaagaaaaccauaacaagaaggacauugcacuuuaguuuggugacucuuuguagcucagaguuagaauuauuuuuuucuggaaaaacucaugcugaccccugcauguuuaaagagaacuuuuuuuuaaauuuauacccagaaguuagauguuauguguguauaaauuccuugaguuggauuguuuuaugguaauuuuauauaagcuaauuaggaaaucaguauugauaaugauuuuuuuuuaagccuucauugauaguccugcaaaacuccauauuguagcugcuuuuauauucuguaguacagggaagagcacccuggguucacaggaaaccugcuuccugugguuuugcuuagggcuaauugagcuuaauguaguuuugugugcagaagguauugacuugugcauaguauuuaauuuguguaaauauguguguauguaauguuuggccccuccgaguuuuauuuuaaauguaacccuugaaacugggauaauagaaauucguagcuuaggccugcuagcaauugcaggugccaacgguuuaaacugcuguagaaauacaauuaugagcagccaagagcaaaucuuguuuuaagguccauguguaaugaaugccuguuaguauuauagaauacaauuaaaaagagguuuaccucuccuaagcugugauugguucuuucugauggaaauguugaguccccugaguagaauguguauucagcucucggugauuuagacaccagugagccuggcauacugcaggcuuggauaaauucagggcaguuauagucaagcagagaugggaaaagacugaaagauuaaugagcgagcuuaaaacaaagcuucaaaaaugagagcagugcucugcucggucuuauauaauugugcagaauagaagucgguuuuggcggcuguuguuaaaaaaaauuuuaggaucuuggcagaaaauguuuauuuguuauaaaaaucggaccuagagaaugcaagugaaaaccuggguugaaauauccaguuccugcuuggcuguguaguccucagagacacacccugcccauagccucuuuuauucuugcuugaccaagccucuucaguucuccccacuacaccccccacggaacuucccacugcuucaugauggugagggccaaagucccagcucuggcuacucuccaggaagugcacaucugggugguguuccuggaggccucacuggcacucuugcguguugaccaaggccuaacagaucaggaccguucagaagcaugagagcccucugccacgguagcccaacuuacugcugauuaccuguggaucccaguuucuggcugguggcuuucaauaguagccucguggcauuucuuuacuaagacuuaaugcaagggauccuaauggcuuuaaaaugcgcuuuuaccuuugccaauccuuuuaauagccccuguaacuaaccuuccauuugcccaacacuguggagcucugcugcggagcuggucaucccguaaugcgaggcugggcacucagggaaagggcagcucguaauuaacgcagugcaggugagccauuucuuugauccagggcuugccagcgcagugaagaagagcagccuuggaagagagacugccaacucagaagaggguucuccagucuguguagacacagcagcagccuuucacucugccugucccuuucuucaaggaguuuggcgccaccuacaggaggcaggaagcgcgguaaccucagcuucucauggaagcacuggacuucuccccguggucauuccucauauuuaggguuuuuuucccccccuaucaaguugaucacuuguucagcauguaguauuuaucaagccucucuuuggccacgggaugaugcuaagcucuaugggaagaaagguuacgucuguacuaacuguuuuggcagaagauuccucaccgguaauugcuugguaaggucucuguuucugcugcccugagccuuuuccuuggacacuccagcaagagagagcaguuacagaugggcguuggaggggacagccuacaagggcugcagacuucacuuuugaguuuccuuuguuuuuuuuuuuuuuuuuuuuuuuuguggacagaguggcagccaauccauuauuuucuuguuuguuucuauuuguuuucuuuggaaagaaauguugaguuuaacaaagggguggggggaacuacagucaaggaaguucaagaugcaugauccaguucagagacuucagggggaaagacaggugaucgcuguugcuggugcauuaaaggugcugaagagauaaugaggaucaauuauuuucauucaucagccuuucauaacuguaucacugaauuaagcucuccauuguuccacgcuggagggauuuggcuugaaaggaguuaagaagguagguuucugccugcgagugaaugagcucagcucucccuuccccaccagcaccccuaacccagaccuguucuugaacucucugccugcacccugcuggguuuuuugugucaucuugcaccacaccccgacccccacuccaccacucugccucccagacccacuguggcucacaucagcuugagcacguguccucaucuguccacuacaaaagacacagucauguaaccugcccuucuuuguaguauuucuagcuuuucuuuccccccuccuccaacuucugggcaaaugacaucaucauucauucaggguucugggaaauaacuccugguuaucuuccacacguuccccaagaaacucaaguagguucugagccugucucuuuaccucuauagcuuuucguaaauguccuuguuuaaaacugaauuucuguuuugcuuuucugucauuucauccucucgaauuucccguaacuuuguauuuucuaagucauuugucuucuuuagaaauccuuacuaguuggcuucuaguagauuuguauaauggccuguuggcuagagagagcugucuagucaaaugaaaaauuucccaccaagccccauguuaaaauagacuguggaauuuggauauuuuucuggguuuagacacuuagguuucuauuuaaacaucaaaaggaauuuacagauaagaaaaacauguuaguuauuugauggggaaggccacacauuggagcugaaacgauuuuaaauacaguauuucauauguuuauaccaaacaacugacuaaugguuucuaaaaauaaauauuuagagcaucaccuaagccgaugcacaggcagaguacacagaaaguguauuugcugucauagucaccaggguaaugcaaaucaaaaccgccucacuacccaccaggauggcuaaaguuuaacaaaagauaauaauugcagacaaagguguggaaaaccuggcaacuuuauacauucgugguagagauguaacaugaugcaguaaauuuggaaccagcuuggugguuccucaaaguauuaaaaauagugaucaaaggauccagcaguuccaugccuagcaauguacccugggaucaaaaugugucuccauagaaacaugcuagacaauguucagcagaaguauucauaaucacaaaacccagaaacaacccaaaugcacacugcuuaacaaaucgauaaggaacacguggcgcauccacucaguggaauauuaugcagucuuuaacagcagcacacagcauagcauggaugagcuuaaaacaccaugccaagugggagaagugccauuuaucugaaauuuccaggaaaggcaaggcuauagccacagaaaauaaauuacuggcugccgaauugggcaaaagaugugagaaugagugcucguggaugugagaugguuuggggaugaagucaggguuuguaacuuagguacuagugacagguacugggcccugugaaccuccuagagauuucuagcaccuucuagagaccacugaacuguauaucccaaaugcaugaauuaucaucuccuaugugcaguaaagcuguagaugguaaagucauuugcaagugugcuugugucugaugcaucuucauaucacccccaaaugcuuacacaacacuugauaaguaacugaacaauggaggaaugaaugaaugaggucauaagaauucuuauaauauacgagcaguuucuuggcaagugcucugggggagacucgaagaaugauggccagacaucgagccucuguccuucuagucacucauuuugaugaggcagcugccuuguccauugaucugaugucagccggauggaaucaugcucugcucugacgucagugggauaggggcuuuccuuuuucucuguugaaugauguuggcggcacacacuugagcaacucuacacugugugaaugguucgugauaccagugcucuguugugaccuuuauuuuuaugagcugugagaauuaagaaccuaccaguuuuaguuuaauuaagcagcaaggcacagcagauggugcauuuguggguaaugauugccuuccucgaguucccuuaagcagcgcucuaacccugugguaagcugugccuagaguguugcaccacggugacaaaacugccagaaagaggguccccauggcaaugguaucaucagaaaaucauggaggaccuggacacuaccacaaacugaacuauaguguuaggaggaagaagcgcuaacugugugguuauagcauauuaccauccauccauuccaauauuugcaaauaaagucuaugaagguuuucauuacccugguguuguuuuguguaaucuggggcaggcauuaagaaugcauuggaauaugauuugcauguuuuaaagugcugggagaagauuggugagauagagaagcagugauuuuuuuaugucagguuguuuuauuauguuugcuuguagucacuacagagggccgagcgaguguccuaugguagacauuucucccagguacugugugcuuacuguuagaguguuuacuccagaggauguuaaaagcaucccuaagugaacagaauauggaaugaaucuagugcuucccccugauugugcagccuuccaggagggaaaucuaauuguugaggagaaguacuuuucauuguuaagggagacgcuaucugucuagcucaaacucuucccuuuacuaucuuugaaaaacugaauuacuugaaagcuggcauaaaacuuauaauugcacaauauuuuagauccuaagauaauaugccucgauuuuuucucauuaaugcaauauaugaaaucaucaaaaugaaauacauucccuuacuggcuguaauguuguuaaaagcaugaacuauguggaucuuguagaauauagccauaguuacuuucaauagaauaauccauuugucucaucucuguguuacagagacuagauuggaauccugguuaacucaugaacuucaaaacuaauauuuuaaucagaguguguaauuucucuuuggcuaaagcccacauuuuauguugggaggagaccuucugaaauuguauaaagagacucuuuucuguuuuucuucuguaaggguguuguagcccacaaggcacgugacucugucguccuugcagaggugguccuuggcaacucagcuuucauauuagcugagugaagcuuuuuucuucccucuucuguuccuaccaaccacaggauacgugagcacuuaggauaaagcggaagguguaaacaguaauuuugccuuuuuuuuuuuucauaauaaaagauaguuagccuuuuacuuacuguucaccagcauguaauaaagagagaugugcgcgugcauaccucucugcagaggaaaugcaaaacaauaacggaguucaaccuacaaauuauuaaaaacucgggcgagagaaguuagaauuauuuuuauaugggaacagacuuuauugcaaaaucauuggcauuucauuuccuuacagaacuggguuuccuucuaauuaaaauagacgagaggaacuagacuacuucccacuuacucaauauauggauggcuugccgcuccuguggcucuguucaacaugggcggacggaggugucggcaacuaacuuaaacuuaugccugauaauuuuagggugauaaggaguguuuauucuaaaacugguauuauguuaauccuccauagucaccuuucccauuuauauuuaucuacuucauauuaauuuugucguagaggagaauuguuauuuaaccaguaguaucaaucuaggcucuagccuuggucuguccuaagcagcugaacucuuguacaggaagaacaaaggauuucgaugaaucaacaguuugucuucagaucccaacaugcuagauacuuccugugugacccugucauuuaggaaucccucaugccucuaaagaacucuccgagagugguuugguuuuuuccuguguauguguguacauguucgugcauguauguacacaugugagugcucacagagacaacacccagaugucaagaaggugggaauuucuaucuuuacugggggcaggguaaagagugggguucuguuuccaaggaugcaaggaggaguagauaagugcuaggcaucuaccauucucugacacacugaccuuaggcaguugaaucucauuguaccucagcuuuucaugucucucaacauggucauacaaguaaguucuaaaucaggaugcuguuguuugugguuaucguuggaguuauugcaucaaaugcauuuaucccagugcuaggcauguaagaaguaaguaauaaauguuaauuauucucacgucuuuccaugucgcuuuccaguagcuuuagguuaacguuuuguagacccuuaaagcauacagcguucaucugcguuacagacccuuauuuauuuccugcuccuauaggggaggaaccucaguacagucuguacgugcuuaugacaucucugauccuggcgaucgcugaauacaacuguacucacaggauggcccguggcguccucugcccugugccccuguguguguucacuauuuaagcaaaagcugccuccaucucuugcuuccacgagucuucauuaucuaccagcuaauacccaaacuuccuacagcaguauucuugccuugcuaucaucuugccauaguauuaaacacuuuaucuuaacuaagccacguuucuagccccacagaucccacauuucuguguacuuuuaaccucaucuaaaacucccucuucuccaagagaggucuuauggcucuaguuuuauccuuaggguaaacuuuuaugaauuuucaacuugaagcaggaacaauggagggcagaugguuuuucugccuacaauauauaauguuugguugugauucucugaacacuucuuaugauuuuguuucugagaccuauagcguaggucaaccagcacucucucauagcuaaguacauguguaaauauaugaaggaaugaagggacaaaggacuguuaaguauaagaaacuggugaaggggacucagccuucugauggaucgguugguuuguucagcaguucucagagaauagguugagagccagaaauucauuauuuuuacugugcaagacaauagcauugguuuggguacuuuaaugugaaugucucgaaugcauuuugcuuucauauaaagaaaagaaaagguuggcuucauuuuaucaacuguguguguguguguguguguguguguguguguguguguguguguguguguguguguguguuguauaaugggcuguguaauauaauuuuagagcccucugaugcaauauuuugaaacuaaguuggucauacaauuaaaacauaucuuuggucauagauugcuuggccuuaugccaucuucauaggcaauguccuacuuacauagccuggauuggcugagaaaaauaauugcugcuaugaaauaauuuugcaauuaccacuguaauuaagggcaguuuguuaaugaaagugcuuggugaauaaugacugcagggcacuccaucuugcagcuucaugccagaugauugguucauguggcagaggcaguuagggaaucagcgacacagcugucaugguuacaggauggauguaaauauccuuugcaguugaugaugaagaacagucauuagccuccugccccuugggaaccggucagaagaacaaaaauaaacuuaacacaggauggugaaagccauucuucugucuccuuuucuucgguaugaacaauuaacauucuaauagaaagcgccaggagcacagagaugagcccucuccacuuuuuaagcauguuaaggugauagaugcuucuccugguagggcagugguuguucacaguuuauaaccacucuuauuagcuuauaggcuaguuuaaaccgcucuugagagacccaugggccccacugaaauuuuucuuguucauccccagguauuguguguuuauuucagccacuugaagagugcccacggagggauuuuugcaugccaucuucauggcugcaggggcaauugaagaucaauguucuguguuugggcuuaccuaccuguauaaacacuauacugacugaagaagugcuggcuggcugcugaucccacuuuacucuagacugugggggaaaaaaaucacugcugcagggugaggguuccucacacccucccucucccugaaagucagguguuuaagugcacuuuguauuuauauucauuccaccucugugguguuuugauguuguuuuucauuguaaauuugcuuaagcaaucuuuuguggaguaauuucauaacaugcacacacugugguuuuacacugaguuguucgugagcugcaacucauuaacuuuugcugacuaguaagucagcagagcaugcuguauuucuucaacuuugucuugucacgcaguccuuuuuacucucuauuaggaggcuggaagguugccuggcuggauaagaacccuugcuuagucaggaggaacugaguucaagucaguagaacauguaaaagucuguaaucauaggauugugggggaccaagggaggaucccugcagccugcuagacaccaaccuagcucagguucagcgagagaccuugucccaagggaauauauccaagaaugauauagcaggacacccuaacuccugcucugccuuccucgaugcucacacgggcacaagcaggugugugcaucccauguguaccacccaccuccagaaaguaaacuggaccuaacaaagaaaagaugcuagcagcucccugcagaggaauggaaacacagcuucucauuauguccugauggagaaagcucugcugcuucgguaggaggcaggaguaggguacccucauaaagaaccaucacugaagugcuagcacacguuaugggugggcuuguuacucucugcuucugccggccaugaguccuugugugguaggagaugcuuagugucucuggauccucaugacuuuagcaagaaccgaugcuaagcaacggauggggauugugccccagaguuuuauaaauccugugucccagaccugacucuuaaguagucacagaaggauuagaaagcaccugcugcucacaggagucuuccccccccccacacacacacccagucacucacucucucaaaaugaacucucuauuucauugaccauagaugagucacugugucaucugacacuguaggacacaaaucaacucacuuguccuuaaaagccacacaauguagcaaaccuuccauacuaagcguuaaaacuaguaucuuauucaugcucaugucugaugaauuaauauggguuuugagagaacauaauuuuccagggacuucugagagugccuggguuuaaggaaaaaaaaaaaucaacaacaacaacaacaaaaaaacugggucccuacaguggcuucauaguaaagcuacaaggguaauuguguuugugugugguguguguguguguuuuccgaaguaugggcuuuuguggugggucaaaacucccaauagaaaauaucguuguauuuuuaguugguguugcucaggcagaggacacaggaacuauauccccccuucaggggggaugggacaacugcaguauuuacauagucuguucucauuccuguuugguuugguggcauuuugauucacuuauuuauuuuuuaacuagugugagauuuguguuugauguuccauggcaucuguacaggcgccauaacacgacagaggugguaagugcucucagacaccgggcgggcgggcgggcgggcgggcgggcgauggagauucuuaagugaagcagacuucucacgcacuguccucaggauguguguggaccugagcuggcacauagcuucuacccagcaccgcccucgucuggcuucccucauuuucucagaacaaaucaaggacuuuugguaguucuccaggacauaaaugcaucgugucccauucgguccuauugugguccuaucugucacagcaacacuaauuauaaaaauugaacguaaauuugugcuguuuaauagguuuggguuuaauuuugccucagugggaagacauuugauuaaaagagucuuuuuuccccuccuccuuccuccuuuuuucuuuucguagaacaguuaguaaaggcguaggaaauugauuucagugucacaaaggacauuucugacaggaauguacuuugaaaugauucaaggcaucuguuucucucaaaugugcccaacacugcugagagcuguaccuaaauuaaacuguuuaacgugucagcucagaauccgaucacaauuuacaucccaguggcuuggcuggagucuccaccauuucaugaacucccuccccuaauuuacuaaacaaguucucgcucaaagugaccauuuguucuagaugccaauaugucacggucggaauugauuuagcuuuggaagcuauuugcuuggguauggucacuuugccuaugagauggaaucaucucucuggcauugcuucuggcguggcuugugagggacguccuggugggcauuuuggugcugucugucuuucacugcugcgaugucugucaggcuagcuggcuccgggaguuccuguugaaaguguuucugagcccaggaaugaugugcgcuguuuauggcugugucuggcacccagcauagacccugggaggcacuuaacguaaauucuucauaaaugagcagagaaggaacacuuccacacgcccaugcguguaacccugguguagacagcacugggagggcucauuugucugccuugcuguguuucuuagaaaucagcgcuguucacuccuauuaauuacaccgaggcauguccuuugaaguuggagggcuggggcaauuauuuugugugugagagaacuuuuuauauucauaguagaaauaauucccuggggauaagaagaaaaagugucuauguugagguauaauaggaaccugagcucauuaagguaauuauuuagugguucuuuccccuucuucuccccuccaguguccacccacgucauccucagacacaguuuaccaggcaauggagaugaagaacccagggaaaggcuccuucuauugcccugccuguguuuauaagucugccaccuacugaaacagggcgggaguuuguauggggcuacccuggaaggcucuuguccuagaggggccaugugguugaccccacugacgagcagcagagaagacugucuguggcacuguggucucucucuguagaucuggacuucacuagugaagauagaaagcauggcauuuguaguggcuuaaguuagugauuuaccucuuguacauaugcuagcuuagccuggaugucgcacauauccagcuaccucagauucacccagccauuaauagucaaagcuuaccagggggcgggggguggggguggggagaggcugugccaucuugugugcuagcuucuggaaccacccuggccaaaccauuucagcuuccuggaagggggaaaggaaagguagaagggaaacagccuucuucaccaccaugcucaggaaggaaucuggcccuccuguucacacagggaggagcuuagucacuugacuagccuuaagcaaggaaggccaggaaaggagaaaggaacuugacagaucaucccugcagcugggcuugcauggaagcagagauggaguugcuggagugucuugaaccuuaggcuuuccugaccaauuugcugccugccaucuuuguuuuaugagucucccaguuguugugagacguauacaacagccaaugcugcccuugcugagcagucccgcuuuagcuuuucguacugaaacuguuugcagagaugauuguagaaauuggcaguucagcucaccuucgucaaguucucugcaaggacuaggaacuuugcauacacgaaauugcccuguaggucugccaggcaaaugcuugcugucguccauuugaauguuucaacuccuucugcuuuuguauugggaagcaugauagaauagggaagaugguagauuugugauuucuuuggguuguuuuuguuuuauuuguauuuuuugguuuguugcuguuuguugggguuuucuugggguguugguugguuuuccauuugagaagauauuacauguacuguuacugugcuagucacuguacaggaaaacucagaaggcuuaauuacuauggccuacaaauaaauccucccgcauagcauauacagauggccacugacgaaugcaaaaaucagguuuccauucgugaucuuucuucacaaacaguucgagcgguaacaugaaagaugguuaccaguauuaccgccuucugcuuuucuccugucuuuccucuaaggagcucaagaaucuccaacagcauauuuuccucugccuugauuagauuuuugaagcugugccugauauuuugaaugcagugcauaguggaauuccacccgccaccccacuucuagacgcuggaggaugaaauauggccaagucucagggaccuguaagccugcaccuagauugacuuuaaucucuucagcugcucucucccaaacaaaggauuaucagaguucuugcugggcaauaaaugucauuuuuaagguaggauuuagacaguaucaucacccgacucucucaauaugagcaaacguucaacuuuaguuuuguauggacaaaaaucgccuugaguuuucucacauuuuuggcaggggagggacaggaagugaaagccaaguuuguaccaagcaaagcucaaugcaugcugccugcguucuagauaaucuuaccccucacacagcuuuaguguugauaccgcauaagauaggagugguucuaaaguauuuccugagacugaguugucuuaugcucguaagcuagcuguaugaagccuacucaauaaagacuguaaaucucagccauauguuuauagaaugcccugcccucccgcagucaacacguggggugccuuggugucaaacaucuugcuaaaggugauaggagagagcacaccuuguagugauauuaauccauuuucaaugucuggcaaauaagcacaaugucuagggcacauuaaauugagucauccaaaaauagaaauucaaaguggcuuugaggcaggaagcagaacauugcuucucugaugguggaccugcccacaucucacuuugcucgcuuaccuccagcaucucauauggcggucacuacagugcccaggugcuuuacaacuuguuucucuuucugcuucccacaccucacugggagcuucuugcaggaagaaaauacguucuauucaugcugggacauucaaucaacgugugguugguaaacaauaaguagaugcugaauaaauaccuuaagagagcaaaaucuuguccuucccucgagguuaaagcuaaagauacucugauuugggacaagcugguaguuuuguuuucuuugugcagagaaucuuuucauuauucuucgcugccauuuuauuaugugaucuggauuuuaaaauggaauaaaaagaaguaugcauuauguauauuggucuaacaugcuaaaauuguuucacuuaccuaguuguaacacacuauaaccagcauauaauccagcuguuccauuccuggguuuauuuccaaaggaaauuuaauacguguuucguacauauguguauaccuguguuuucaguaacucuucucaguggccaggaugcagcaagacacccaugccuggaugaguggauaaagaaagugugauguauuuauucaacuauaaaaaagauugaaacccuuucaucuguagugcaauggauggggcuggaggacauuguauuaagugaaguaugccaggcuacagaguccaacucaucuuaaagcugaaaucuagaggcuagaagaguaagagcuugaaugccauagguccugagagauggguaccagaauacagauggcuaggagugaguucuugcaucccccugcaagguagagugcuuuacagcagcucuuauguagcauauaaggaaguggaagagaaagaguucugggguuuuugacacaaagaaugauuugaucaucauucauuuacauauucaguguuccacaaugcagcaccaugccaauuaagggugucccccccacccauuaaguaaagggaauucucuuaugugagguucuugggcgccaaggcgagguccuagaccacuauaagcuagugcaaccaccugugaaugugguugaccagugggacuuagccuggggccucuugugagcuccaaaugagauccuugguaugaagaauuugacccagccaaggucagccaugaagguaacaguggucucuguggguuguuccucucccuggggaugagccauguucauucaaucuuguugaacucuuaagaacuaagguccuuuggcacugugaugagagccgaagugcaggcacaguugugcauagucacagaaagugggagagugugcgauggaugguccuucucccuacuuucuagggacguuagauuguggauuagucgacccaugcauguucgguggcagugguuuguuuuuccaguauacaguguguguaacuaauagacuccucugcugucagaugguucugaaagccacucacagcauagugaagugauaaggcucugcagauguguguguccccugaaauauuucucuccuccauuuaaaaauguguuucuaggucagaagcugaaauguauccaagaccaucucucuguccucagacuuuuauuaaaugacuauuuccuauucuugcuaggaucuagugauguggaguucagcacugccucgcuuaccugggggugggggugggggcuauguaucggauaaccucagcaaucuggaccacaacacacacacacacacacacacaagccacauaugcauacacguauauagucacauucauuuuaaaagggcugauccuauaagcuuugggguuauuucaucaauauaauuuuauuaagauuuguuuuucuauacugucugauuccauauaaguggagaauuccuuuuuuuuuuaaguuaugaaacuucuugggccaugcaccuucuugucuuuguaguuuuuaauaaguuaucuuuauuuuugugccuguuccuaguacaaacaugacucaccucuaccuuauuuuuaccuuugagggaacuucaacuuguguuuuagagaauagagaaaauuugaugguaccaaauauagaaguuaucaaagcuugugucuuuaauuuucagcauguuaccucaaauuaacucuuuucccacauaauaauauugaucaccaccaccaacagcaaacagcucaacauggacaagucuuuucucacagguagauccaccagcuuacagugggcaaggagcuugccuggagucccaagcuucucacacaagagaauacccucuucuuaugaaaaaaaaaauguauuugacauugugcuccugugcugaugcauuuuugaaacaaaguaauccguagauugaccagagagugguuuggcagccaugucacaccaugugauuuugacccaagaguggguugaggagccacaccaccccaugucacuaacagugcucccucacugcccccuuaccaucuccaggagaaaugcucuucucguccccauuuauauucaaggucguggaaggucagacaguuugagugauggcucaaguuacucugccagagcauggaucaagaaugggugucuugccucacugagccauuagaugcugcucaguuuguucuggucacauggcucacagcucagcuuccuggacaguuuacugucacuggucuagcucucuaugguggacaguccucagaagagccgagagcuggcugguaacagugguacauaugcagaaggggccgugaagagaccugugugcagagaucuuuucgccagacaaccgcccagccaaccuacugccgauuuguguuucauaauugauaaaaagacaaauaauuaaaaaaaaaaggacugguugaaaaacgacuucucccaacaggagcagcccauccaucuugcuaagaacccaacgcuuaaagaacaaacuuucuccaagcacugaaauuucaccaugccuuucccccuucaucgucucuuuuauuuuccuuuucacuuugacagaauucuugguuguguugaauugaaaaggcccacuggguugaggccaaucuguauguuuaaaauuaugcacugccaaguccuccucuggugcuccuuuuuuaaaaacuucguuuuuuagaagguugacaacuuuaaaagaaaugguguguuccuuuaaccccuagaacauuuuauuuaaauuuagucacugguuuggagaacgaauaaacagaaccuugacuuaaauguucccgugucugagaaugaaugggaagugauaugauuuauagcuaguuggaaggaaaaaaauaaagaagauaaaagagaauugaaaccccaaauuauugguuucugcagugcguuucugaucuaacucucaaucgugaguacaguuuaugccuugcuuaaaugcuacuugccaggccacggaagcaaaucucugccuuuuauauaacgucagcuuaauuggauguuugucagcucuguagcagucugaaguggaaagaggagaucaucuguauucauagccagcagggucuugauaaauauuucuuaauugacuaaauagaggaaugaaugaaugaauuguauucagaaauuuacaggauagcacaguaguauuugucaucuguguaauacaaaugguguguauaugagugaugaaguugcugguaccauuaucaacuguguuucuagcuacaagaaacagaccacugugggagacacagcagaagaccuugugggagaauucaugcucgucccacuguuguccaugagugcucauugaaucagcuugcuucuuaaugcuuaguaguauauuuagcgagucaaaacgccauucuagaaugagcuugugguucuaguuucugaauguauaaagcguuaucuguuacuucaccucucaugucagccacagguuuuuuucuaaagguacuucgagaacacagaaguggauuucuucaacuggcaugagaaugcuucauaccagcauauuaauauuaaaccuuugguuguggcauuuaucuaguugaccauauuccauaaagaagacaauaaacacauaaaaccuuugucuuuuacaguaaucacuuuuaaaaggccagguagguaggcuuguuucacugacgguguauuuagccaaaccuguucuuaugacuugcauguggguagccuuuguacagacucgcuggcagcaggucuuuguucucuaugguaauuuauuuaggacugagccauuggaaauugguaugaagguggacacugcacuugaggauuucaaacaaaagaauccuggaaguaacucuaaagcggaagcgccaaggaagaugugccaggcccgcugccaugcaagggaagguuaugaggaauaauugaggguguguggaaccuuugacagaacauagcugugcauugcagcuagcgcaaggcauaauaccacuuuaaaccuuugucuuucauuuccgugacaguuuuaaccuuauuaguuuaaagucuuacuauauacagacuuaaaaacugacaaacaaucuuaagacaagaaacucuuggauacuugggaccuaguuaguucuguaugguauagauccacaccagccucagcaugagacagucuuaggaacuggaccccaguguuuucuccuuggcuuaaguauggggacuggauuuaaaauguucccauagccuuuugcuguugguuauagguuuguuuguuuuuuuuuuuuucucacuuuggaaacaauguaacugcuuuggaggggaagacauggggucuucucuacuaauagaagguaaaucuuuuaaggaauaugguuuuauuuuuuuggaucuagcuaucuggggcauuuuaucuuugcaguuaacuuuuuccaaaggaaaauaaugucaaagaauauuuaggcucuaguuaucuuaaauacuucuaauugaaguucuuaccaacuuucccccaccaacaaaaaaaaaaaaaacuuuuagaagguuggagguuuaucuauagcaaauauucuugccaugugggcaaugcaaucugcucucaaguuugaagaucuggaucaguagaugagcguauuuaaaucacuaucauaacuauuacauucauauguuugauuagccagagauacuuucaauaccaaugaacugcaacuggaagaugcaagucucucuuauuuuugacugcaucacucacuccauccauccugcuguuuccuuccaugagacauugauggacaguuuaaaugcaucucguuuuggagagugaagcauaggcaauucaacaaugcauccauaaguugguuaccagguuucaaccgaggcccaauaaugaaugagaagugcauuaaacaaauuaaaacucugaccuggccauacguuuggcucucagcauauguuuguggaucccccuacagcacagcauagucauguccaugaaaggacuucccagcaguguccccgcuccuugaggguuaguuaacaucuauagaggucgauggauuuaucucaugacauuuaaucuugcucacuaaugaucccaguuuacaguuauucaagaaaguggaauauacauagcaguucccuuggguucaguaccuaaguguuuccucauauucugcuuuauauaagagacuguaagguucuuuaauacuacaucuccauguggguggauggcuauucgucuuaguagauauugugugugaagucuguucccugauggauaaaccuuaauuaaagauuugacaguaagugauguugccuggacaaaaggggguugauguauagaaaagcacauaagcauucuauaucaaaaucacacuuuaugcuucauaaaaguuugugucucaaggcucuugugcauuuagaagaaucuggugagaauggaaugucuuggaacaagugacuggccagucugauuccaacccuuucucaagccacucauaaauuaacagggguacagugugcuguaccucuuugaauacuucagaacugggcuguugccuaucuucccacacccuacaaaagaaaccugaagccaagaugucaguuuccuauuagccacagaaaacacaaaagggggaggaagcuugcgguggcagaaggaacuugguuuuaauagaacuuuaaagaaacucuccuccauugugaccaacugauucucuauuuauccuuucuccauugugcugcaagccucuaagcuggagaggagagaauagauugauacucaaaggcauauaaguagcagagaccaaaaggacugagcugcagaaccugacuagaggaagcaggggcuggaaacagggaaaaugagaggaauuucaaagucagcguuggacaguugcauguggagacaagcgaaagaagaguucuuugacaauguaaacuggguugaggucugugugcaucaucagagacuugcaugagcuggaaggugccccgaagcaguauauagagaaucuuaugaucuggggguugggggcuuaucuggcaccuaaggcuagaagcuugcuugcuuuuauuuauuuauuuauuuauuuauuuauuuauuuauuuauuuauuuauuuauccuauccauccuaucuaucuaucuauccuaucuaucuaucaucuaucuauccauuaauccaucuaucuauccaucuauguaucuaucuaucaucucuacaguagcuccauuaagcacuccucaagcaagggcucgagguucugggugauuugguuuccugugugucucccaaaagucaguuucuugucuugcuugaaugaauucuuucagcaucugagcuucccauaccucuucucugugugucuguuccuaccaugguugagacagucuaagcauucuuggcuugcuggucuuuccuccucaucccugcccaggauggaggaugaggggcucugcauuuugucuguaauuaucacguguggcuagaaacagaggcagucauguugcugccacuagcuaccauggccacuccaaaaacaaugacaaaaacuacaaaaugaaagugaagcuugucacaguuccuuuuccuugagucugaauuuggaucuaucugcucgacugucacccacuuuauuaguauugcuguguguacaacgggauugaucacaggcaguuuuaauucuuuguauaucuguguaccuguuugauguaugagauccaaucagauuaauucuuugauaacucuagguugaaauagauaggcaguggaugugucgcuuuuagcacaaugucucuauuuaaguuuucuuugaagccaggaaguuuggguguaagauguuuauuaugccacacuucuguguccccccaaagaaaaccaccauugaauuaacuuuugcauaguguauuucuaucaaagcauuugauccuuguuucugcaagcuaauccuaagaacuuuuuauuuugagaauagaagaccaugauggauuuaauucauaaagggaagccgcugcaaggaauguaaauguaagcgcuugauaagguaggauuuccuaguugcuauggcaaccuuugggucaugagccugagaaaauauaaaguaaguccuggagcuguaaagaugauuauaaaauuuaacugucauucuucauuuagaguugauggcaaacauuauuuacuuaaguuuaucucaaggcaggcaaggaucugguuuuggaaaucugagacucggaucacaacugaauccauguuguaccugucuaacauuauaaagcacaggcggcauuuauuauucuaagcagacuguuuguauauaaugucccuguagauuuagucaccuuccuauggaagccaacagugcucaucucgugaauucuuaauaaaaacagcggaaugcagcuguauauguugaguaaauuugcaaaaacguguguacuuuccaugccaaaagagaaggccuaggggaucguguaggaaggauggcuuugugccuucuuuucagguucacauauaaauaguacacuguuuggaguggacaggagccaagauguucauauaauuguguguuuccaauauauaccauaucccuuucauaauugcacccacuuuccucuggggcccaggggugaguguauggguggggagacccaguuuacuacaguggaggaagggauugggagaugucaaguuccuaacuaaaauaugauguggagcugugcauuuugacggagcaccaguuuuucuugcuuuaucguuuacaggccgcucuuagucugugcuaaugaccuaugagacccacugcaaauuacccaaucuugcaaauuagagaguaugugagcaaacacuauaaaacuaucagauaccacaucaaacaaauguaguuuauugcaggaagaaaaauagacuugcauaucgagaggggaugucuuuucacaaccagauaagugcuuuccugcuugcacaucagggagcuucaacacauuauauggucugugucagccaauggcucgcuggcucuugagcaaaaaacaucagucuuuaaaaugcaggcacagaacagcucaugagugcaugcaugcuggaaucuugcagcacugaauuguuuucccuaucgguugccuuuauuaaaaaaaaaauccuuucgaacuguauaugcuggaucuuugcacuaggaaagggaacagaauuuaggguuauuaagaacagaacaucuacuuugcugguguucucauucugcacccaguugagucugcaccaguaggauucuucccccccccucccuugccaaggacgaggagggauccagcccacacacccggcagcacacacucugcucaucaaagcacucuucucaguugcuuuguuuucgucucuagcagcagaaauagcugcucuuuuucuuuuccuuuuuuuuccccccuccuaacaucuuguaauugcagcugguaauguguuuucuucuaaccugagacuggccaagggauagcaauaucuggacccacacaugguagaccucguggcaggaccccagugaccuguugauggcacaguacacuuaucucccauauauucagaaccuuaccugggcuagucagugcccccauuauuucaugucacccugauuagguuauuuuacccagccuccuaauaacagcuguaucaguaaugcauagucugauacuucgcuuaugcugaccacugugguggggggaucuguguguguuuauucaauauuuguuuucuuuauagguauguauauauuuuuauaucuuuuaaaaaauaucaugcgguacauuuuuguuuauuuuucauguuugguucucuguaagccuugcuuuaauggaugcauauaauaugcucaagugagagccacccauuccccccaaaccugccuucauguggugcggugagccuuuguaagacacuugcuacccaguccucauaaagauaugagacuuagacuguuagaucucucuuguccaucuuuauuuauuuuuacaauguauucacuguaauacacauacacagugcacaccuaugcaggugcccacaggcauggaagagggcgucaagucuucuggagcuguaaucacaggccaucgugagccaccggaugugagugcuaagaacggaauccugguccucucugagagcagcaggagcucagaacuccugaggcaucucuccagcauuccauuuuuccuuuugcuuguuuuuaaggaaaaugaggacuucagagaacuuaaucacuuugucauggugacacaccugguaacuagggaagccgcaguggcagucaucagagcucaagcugucccaagucacuuccuuugguugcuccguuucaguguugguuucucaggugaugcagacaugauagugugccuugucuaggauuccaggauacauuucugauaugugcuuuagagagauaguaaaaguccgggggauguggggguccuuuguuguuguugcuguugaauguucuguuugggcuucagguaagacuggcaauagguuucagcugaacaccacugggggucaccuggauacccuuagugcuuuaggagccaaacucccuguggucaaucagacacacagccagugaugcuggccuucgcuguuagcuguggucagcucccacuagucuaucucuguuuugaaaacucaggcuccuuucaggagcugugggcgggcccucugugugcaugagucaaccuuugggauaauaaccagacucuuucauccuggcuccccucuaaugugcugacgcgcacaccaucuuaaauaucaauaugcaauugugcuuuagaccaggauucugcugccgacucucuggauagaucccccugacgagcaaaagaagcuaugaacaaugaugaaagugcuauaguucucaugaggagggggugggguggguacagaggugcaaaucaccuccuucaagggaaggcccuguuucagaaauacauugggaagcucccaucaccaacagugugcagcccuaucuuaaacuggaugugaccaggaucagauagacuguaggcccagggcucacacgcacauuugaaugauggccuccaugauagccuccucucuucagaggucccaggaucagcagggagcugccuuggcaggaaggccgugaguagaccgcccucugugaaggcugcccucugaguucaugucugacuguccucgguggcuucuucguugaaauaagaacagguccaggcuguuauguacugugcuacugagguuagcacuccaggcugauuugguuucaaggguucuucaguaaagaaucuggaaagcacugguuuugugugacaaacugauugauagcugucugcgcuauaaaacccaccugguaucggucugaagcgggaaggaaccagauguuaacauggggcuguugcuuuacaguuuaauuuuaguuccuuaguugaauccuucaggagggagcauuguggggccuccuucccauucagaaagguaucuguguuuaaagacagaugauggaauuuacugggggaaaaaaaaguuuuggcggugugcagugguagaugggucagaggguaagaaugugugcugcucuugcagaagacccagguuuaguaccuaguacccaugcugagugaucgcaaucacauguaacucuagguuccgugggaucugacaucuccagccuugguaggcacgugcacugcgcgugcacacauaaacacacacacacacacauuuacacacauaauuaaaauaaaaguuuaaaaaauuagguagccuacaaaaugaugaaauucauuaugaaauuucagacauauauauuaucccuugcucuuauccaccucccccccacaacucuccccuccccugcuucucccucaugcaaguccucuucucccccgacuaccagauaaucccucuucuacagucuugccaucuucacguauaggcuauuuauacguguguguguguguguguguguguguguguguguguguguguauguguguguguguguguguguguguguguguguguaugugugugugugugugugugugugugugugugugugugugugugugugugugagaugggagagcagauuuaccucauucucacccuccacucuaccuuucagcacccuuccccaaguugagaucguuuuaaagagcacaugccugauacagaaagacaagcauagcauauuucucaaauauguaaaacacacacagagagaaugaaaguagaaggaguaugcuuuugaacugaagaugugugaaauauauaaguugggacuggagaugacacaguuaagaacacguacugcucuccgugaggaccaaaguuagguucccagccccucaguaggcagcucacaagugccuacaacuucagcucuagggagucucaugcccucuucuaggaucuguagauaaucuguugucaugugcauuuagauacacggguauacauagaacugaaaguaaaaucuguagaagcaugaugcugggaaauuauuucuuucuaguacucacagcacuacuugugguaaaggaggaggagaaauuauugccauaauuuaccugacaaagacccucaaauuguuuucucuugaaaugcacagcuagaaguuuucccagucaguauuggccacaugcuaguacugaguuuguuccagcuauuuagguaauauuuuucuucucuuccuuuuaauguuuuacuuuccuguuuguugucaggauuguugccuaauuuaguuuggaucaacgagaagaguccguugcgguugcuuguuauaacacauuuagagucgugaaucuaaagucagcuuucaaucaggaaggacuaguggaugcuuuaauggaaagauuaccacaaaguccccaccccuuugugauuuagauuccuugaauucaccucauuaauggcugagcauugaaucgaauaagguauuucuccgaguuuuaaacauugaaaauucaaggcaaaggccucuccuucuaucuucaaaugaaugagaaagccauccuaaaggaagauggcggccgaggugucauugcucugugucaccucuaucaaagagacugauuacacuguugauggugguucuccgggccaucacugucuugccucugcuucuuaagaauguauaaugcaguccaaccuuaagacaaauaggucaagcugcaaaacucugcgggaauaugagaaugagucucaaaauaauaaagcaguccaacuuggagaugcgauauacuuuauaaauaucuccugagagggaacacuguccaaggccuuuccauagcagccugccuugccaguccuauguauuucuagcugcuauuucuagaauguauuaggagccacugaugguugaucuuuuacugugguugacaggggaacauaugcauacacuguguucaucaauuuuuuuuuuuaaccucugguguacucugaaaaaaaauuguucuccuauggguuagaaaaauaauauuuuugaggauaucccaucugcagauaaagucauuggccauuucuggucuugucaaagauaaaaauaaaccauuuucaacuguauuaaauaccauacucgggcauaagggagaacacauuugucguguuucauuugucggcucagucugcacauuuagcacggcaauagcagugaacuucacggacagucaggcccacucuuucauguuuccuuccaguucuaaauugaaaauauuuuuuuugaaaagaacuaugacaaaagcaauuugaguuagugauaucuugaaagagaagccaauuucagaucaccuuuauggcuggucauuguuaccuacagcaggcagaugucauggugaucuucucgauauuaguauucugagagagucugaccugacaguguucaggugacaucacaaauggaacucuaauauugagauuucaaguuguagagcaaaagggccgcucguggaaauccagggcagacagaacuacuauuggcgagaaguguagccauuccccucaucuggcucuuguucuguauggugcacaagugugguuagcaaugaccacaugaugcuagaugacuaauuaaagcacgugcugagaauaaacuccccgguaacagagaauguaugaaaguguugcaaccacuguggcgacuuggcugauuuccaaccuguagcugccaguguugucuccaucucuucaucagagacccaccacccugguccuuccgagcugugcugugcauuuguaacaagguuggugauucaugggcacgcaacaccgaaagcucucacgagcccaagagaugacccugaaaggagaaauugugguucaaaaggaucaucugucuccgaaagugugauuuacugagacacccaccccuaccccgagccuuaaaaauaggaucuaaugacuagaucucuuccucuuucucucucugccuucugcucuuucucuucccccucagccuaacccuggagccagaaucaguccacggguucuguaagaaaccaugccacugugagucauacugcuucuuacagcaucauagcuguucuuucucucaaaacccuucuagacagauaacaaguguuggguuguuuucaugucucagaugaggaaccaaggcaaggggugcacugacacgcccaccuacuacagaagggugucggcgacacugcugagacuugugcucaagccuuuuguuuguggcuuauucccaacaaaccccuaaucagcgccucuggccuugucgguugguguguggcacccacaucugccauugcuggugcaucuguaacgguccgugaacuguacauucugccugugugugaucugagaagccaaucucauuuucaacucuacagaaaugaagugagaggccaaugugacuucuaagggaccaugcagugcauuucagagucaaaugugaauggcguuuaggucugccaugcuagcuccuccauauuagcguggcuuucucuucuucuaaauaacuaagagauaauuauucuuaagucccaguguccugccuacugccuucacaguacaccugcauuuucugaguauaccaucuugcgcuguguuaggcauuuaaauccaucuuggcacucuacucacugucauguuaguaguugcccuggggaauguucuggaucacauaggauacacuauugaacagaaauuaguuucuugaucccaguagaguaacagauccugaaacauuucagcaagauguauucuguaacuauugggaacuguacaccccgccugugucagaagcacaccacguaugauuuuauuuguggcuuaaucaacaggaagaaaugccaagcagcuuugacuagcuggcaguggaucuguuuguguuugcgguauuuucucucuaagacaccugcuggagaugagagccgccacaaacaccgaguggguauccagggcuucauuauagaggcuucucuaaugaucaaagaagccuuuuuauacaaucuuguuccugaucaugcagcugaacaucugucuaccugucuguccaccuuuuaauugcaucauccaggccucucugauccuagacagcucugucgaugcugcucugccucccaccauuucugaucauggcaaacacaaaauuucucacaaagcaaaaaaccaguaaaacagagugcuuucuaauaaauucgaacggagccauuuuauaagaaguuaauuuucgaucacauacccagugaaguccuugugcuaauuuauucuucaaagccaaacucuugcacagugaggaauguagcgcgcugugggaauacucaagguauuaggcacucaauucaggagaacuugguacuacuggcuuuucacaaucugcucaaaguugauuuguauuuucaacaggagggguguaauaauucaggaauuuaacucaaauuuuauucauuaauucauuugauaaauacuuagucacaucaaucuguuauguuuagggccaucugugugacuuaaaagugagauaccauacccaauguaaaaugaucuuuaauagaaaugaauugauugcgagaaucggacagauaguccuccaguagauagaaaacccaccuccacuuagggauaucaacaguggcucaaggauuagagcuuuauggcuauaaaaaacacaaaagcugaagggcuccucugcagugccgugagauaaagcauagaagcagaaaaucccacaucaugcccagaacaugguagcuguaaguuaguuugauuaaacuugaguagaggcagcgugagggaucgugcugcagauguggacugugguaugucuguggguaaagauguggcuucagcuuuagaggauauugagguuaauguggcuaugaugcaauaugaaaagcagugugggcuacagaaaagagagccuucaggcuauagaguggccacauagggaauauuccagcuauggcagggugaauacccugggaaguagggcaaagcgugacacucaaaaagagucauuucgaugguagagggaccaggaaaaaaggaagucacugauggagguagcuuuuguuauugacuugccuagcagucauugauguacauggaauuaggcaggacuuccuuuucaguauggauaggagagugggugaaguacaucagauguguaccccauuaauaguuaaauugauaccaucuggcgaaaugucucuaaacacaguguauuuauuagguaacaagccuugcugucuccuugagaugucaugugucuggagugagcagccucaucacuaguacacucuguuuaaucagucagaaauguuuacacccgucugagagucuucucucugcucucuuuauggggacagaaagaguaggaaacauaaaaccuaaauuaacuggagaugggaaaagggcugggaaagauaggagcucccauggcuccauggagggagcaugccuaggugggagugcucagccacuuguggaugcucugugaguuagagguagaugaggacagacugugaauguauccaaaugacagacacuuaauuacacuucgcaggauccaauccugaggccuccuuucucaaaugucgucccuggagagucccccaguuccuugugaggaagcuuuggugggugucccagagaucugagguaucuguuucuagagucuagaugccguguuucacaguggccugguuauuagucagagucuggggguguuuuuucccugcuucucugaguggagccaugguggauaccagaagccauuguaaauucccaauaugcugugcuucuaaaauaacucaaacuaucuuguuuucauuuucuuacauagcuauuuaaaugaauacuuuuacaggccuguuaaucuaaaggcugaguucuguuacagagcuuaaaacugggacuucaauaaauggaccgacuguauguuacaaacucaaaugugugaaaaauccugaaucuucucuuagguaaagcaguguuguacuaaaaucacagccaauaauauuauuaaguaaaggugcauuaaaaacugcuauaguaaucuccuaggcacaugacuccagcauauuguaacacuuuuuaugaugcuucaaaugaauaguucagcauuuggucagauaguaggauagaaaccaaagugccaguuggguuugguuguuuacagggugaagggcucuguagggcagaggagucaucuuuaaucuucuagcuguaaagaagucacuggaaauguugguuucuauucucccucuuuaauguuguuuucucacaguagcuuaagugaaggcuaauugcugcagcauuugguaaaugucauauauccuacuuuucuaaaggcagugaagcaguguaaacauguggcuucuuucuucaaaagauccaucccauaauuaucuugaaggcuauuacaauaugcaaauagcaagggccguccuugucuccuaaauuagaauaucaauauugauucaacaugugcaaaaagaaaacaacauuucugacaaauguuaauuccguuucaagauaggagagaaagcuccaguugucaagggguugguaagucccagguccaggccauugagugcacccaaauagcaccugccccugugguucccuccuuggcguggcaaugcacuugguucacaauacacaccacauaaggguagauuauuauuauuuuagaagaaacguuuucaucccugaauuauuaaucaucacuaauguaaaauauaguaagcgucugauuuggcccagccuccaaagaauguuaguugggagcuuguaaggaugugucgcucccgcuuugugacaggggaacugaggcacacagaauugacucccucagguuuguuuuguuuuguuuuguuuuuuuaaaucacuuccccuuguauauaagugaggagccugagacccuuaguguacauuaacuagauugcuugauguaagguaucagaaaugaacuuccucugcacgugaaccaauaaucuugcauguguuuguaugguaauauaaaauuaauguaaauauggcggccuuggaucugaucugcuaaucuccccaucugggugugccuguguguaucuggaaucucuuugacuuuacacuugaacaagguugucaguggcugcucagaaaccagugucucugcugccacacuaggucuuugaccccuccagcuguuguuucaguggggggcaagcaaacagaagacaggccuuguagucuucauuacuccuagaugagaaguuuuucaguugggucuguuugcccuagcuuucccauauacagcucacucucuaaugccacccaggccccucugaucucagaaaugccacggaagggcugcucugcugucucucagaauucuguuuccagcugaauuugucaggccaaauuuaaaagcgccaacaugcaauuaaauauucauuuuuaacuuuuuuuuuucuguucaccgcugcaagucgcaggcuuuccaagcauucucuggccguggaguacugcauaagcucuguuuuaguggagucauuucauacuccuuccuaagcccaaguaacaguaagggagauuuaguugggcauuuuggcaaagucacacuaauuuauaggcccuaucaggggaguauuauggaaguguguaaugauacuaucagagcugcauuuaauuccugaagaggaaggaaggccugcacaggagccccaaaucugcuguucucuuugugagugaaaggucacacugcugagcgcugcgggguggauuggugagaaaugagcucccguuugcuaggaauuagaaugagucuaucugauuuuccuucacucaugaccuuuaaagaugcagcuuuuagauugauaagcagguggaugcuuugaggaacccaaugcagaauuuguuucauaugaaaagacuaucuuugagacaccgaagauauugcuuccacaaagggcuuuuuuuuuccccuuuuccuuuuuuacaaagccucggaaggaagaaauucaaugauuuuaucuuaucacacaaaaagaaaauucagaauuacuguauguucauuuagaaugcccccucccagcguuaaucauugugugggacacacauccuccagugaaggaucuccaggacggcuugagagugggcacuccugcucuggguuuccugccacacgacacccagccuccuccgugcugauaaaaagagcuucccgcucguugcuauaguaauccuuucauguugggcacugcacuaucuugaaggcaaucagaggagaacaaggggugggggcaggauggaguuaaugucaggcagccgaaggugaucugugcuuuauauuuagagauguuuugguaugcugaagagagcaugccagucaacacaaaccagugcccacucugggcccaauuugaugcuuggcuguuuaaauauagcugcuucuuccuuuuuccuuuuuuuuuuuuuuuuuuuaacaguauguaugcauuucaacucagccuuacuuuggagauacguuugaaaucgcucacuucccguggccaugaagcccuggucccucucccucaucccuugauuucagauccuaauuacaucaucugucuuauuuguuccaguccccuccuuuucucuccuuaucucucagccaucaacuguacaagcccaucagcacagcccuuauuuugucaaguucuggugguuuacuggggcuucucuggggcuucuuuuucuuguuugauauucgucccugaucaaguacagcaggcccucaugccuuuccuguguacagcuuuuaauuuccuacucaaaaucacaaaugagguuaaaaaauucauuccucccacacagugcgccugauuuuuuuucuuuucuuuuuuuucuuuuuuuucuuuucuuuuuuuucuuuuuuuuuuuuuuuuuuuuuggagauguuuaggaaaagcagacauaaguagaguugcuuucgcucugucaggcuuccugcaguggucuauaacaagaaugcucagcucugcagaagccgcucccaugggccagaaagucuccucuaauuugaaaauauucuguuuucuguuguuauuguugcugcugcugcuguauuguuguuuguuuguugcuggguuauuuuaaagcccaccacaguagcuugcuguacagacuacagacaaacacuccagucugagguacccuggggccagcaaaaugacucagcagguucaagggcuugcuuccuucccauccuguucacccugaguucaauccccaggacaccauuuagugaaaggaaaaaaaaaaaacaacuccugaaggauguucucugacuuccauguguagcacacaaacgcacacacucucucugucacacacacacaaauuucagaggcagaacuucccaccauucggguagagggcugguagggcacacuaguaucccauucugacugggauguaacagaguccauugcaaacccauucagggcuggaagugauggggcacauguucucccagcacuccagagguagaggcaggccugccagcuccugaccaaucugggcuacuuaccauguagccaaacguugucucaagacaaaaaugucagcuucucauugucuccagcuacaugugacucaggugcugaguugcugcauguucuguagccacuguuuuggacaguacaggugcgugguagagaauaucuucccuaccccaggaggcucucuuacacaguuguguuccugcacauccacagaagaacaggagacucccucuccaucccuagacauguagaagcuuccucagcauccucaguucuucagcacgcaguaugaagaucuucugggaugguuguuuugaaagaaggucucaauauacaguacagucuugccugaaauuagcagcaauccuccugccucaaccuccaaggaauuauagccacuuuucccagcuuaagaaaagcugcuuuaaacaaguagcuuguugucaccuaggccuacccagaucagggaauaggccgacaccugugacugaggugaccucugggcuaucugggucgucugucucuuuuguagaaaagaaggccaagcugggaaaagugagccauuuccuauuguucauucacucuuuccgccuauuaggcccugcgaggcuauugcagugacgguaacuaaaauuuuauagcuaguguaagagacaaaggucagacagugacagcaaagccuuguaagugccaagcuguaggcaugcaugagcucuacaggagucaggaagaaacggaaccugacucccgagagaugacgaugaaguagagaaacaaaggaaacucaccagaggacucuaagcuccgcuaguccagugguuuugucuucucugucuuccaugugccuucuucauuguaaacuaguuuaaacacaauggcuuuuauacaaacagauugguggcuguggauuacauaaaauaugcagucauaaaauucuugacauagaagagacuuacaguaguuuauuugaaagcuuaccauaaaacaugguuguuuuucucucccgccuccuaguguucuagaggggagacuuauuucaucucacuccaccugugaguuccuagaugcuaagccauccucucucuggcagcaucucuugcccuggcuguagcuggcuuccuugcuguuccuggcacacaccaaagucauucuuccucuuaggcccuuguucgaaugcucauuugccuagaacgaagcauacuugcucccagcuguccaccugacugucucauuccagucuuccagcucuaucuaccaggaugcuguguccuuacacaugcuugccaacugcucugugugaacuaccagccugcucacacucccccccaucuccacucuaccugcagugcuuuucaaagcuaccauggucuguguugucacaguugcgguugauucccauuucuggaaugcaagcucucugaaccagaacuuggacuuguuuauggucuuauauccaugaccuugaagaauacccagugugguaggucucaggucauugguaaggauugggucuguucugucucuaugcagaggaaugauuagauuugccauucuagugauguaguucacuguuccucuugaaaagauaauugggauuuggaucuuagagcauugugucauucucuguggccuaaccuuagagagcacccucaccuuuacagagccaccuuaccauucuuccagccgcugguuugcugcccacuggaugcccgagaugucuacacugcacuggguuugccauuucucccugguuggauacagcauacucugucucugggaccaaugucauggcagucucauaggacuguccugguuuucugaacuuugccccuuuguuauuuguuuuucuaaauuuaaacuaggucccuuccaucacuucucggccauuuaccuaugaucaaguauaaauaagccagucccacgugagcuugcuuuucuucuuucccucucauccuuucuucuguccuuucuucuucccccuuuccuuccucucuuccuucugucugucguaacuuucauuagaauaggaagaacuaguaaugggaucaucccuguagauccaguaucuccagccuccugccuccuuguuuucugagcuggaagaucaacauaaaaucccaagaagaaaagccuuguuucaagauuccagcuccucccuuuguggagugccauucguuaacuuagccagcacacugucacugccucucuuuggcauuuuggucuucagucuaacuaagagccaaaaggcaagacaauauuucagagaggcaacgauuaggagaaggggucugggagagaacuacuucucuuuuauugaucuugugaaaauuguuugaagaaugauucagcauuuuggggucuaaaaauaacagcuuggaguggcuuuucaauuagggggauauacuuucucugaaagguucuguugauccuuaaauggacucucccuccuuccuuccaaggcucuuuaaugaguggugaugugacaggagggacagcaaccucccugacacccuuacuuuccuucccucucugucuaggaggcugaggcuccaacagagcugaugggcaaaauuguugcuuaguugggaaaagguaguuuuauuaagacuggcaccaucagagcauaaugaguuggauuccaccagaaugcauguuuuaucccacuuagcuuuugucucaaccaggaauuccacauggccaccacuggcuuugaaucgacauuugcagguacauggacauaggaccaaaguccagacugccaucuuuaauaauaagagucuugcuucaagauucucuuaguagucgggucacuguguuuaaauuacuuuuaaaaugcauauaauguugaguauugcauauaagcugaacacuccugaccuuggcaaaauggcuauagguguuuagugaccuaaggaaaguaggauuugguuuguuacuuggcuguggagguguuggucugcaggaaaggguuauaauauaacccuguguuagcucuuggugacuauauaguauaucgaaugagcaaacuugucuaguugcaaaauaaacuuuucaguagucuaguaacagauuuuaaguuuacucacaaagaaaagcuuuuuauacauaucucaaaugucagaaggccagcuggagauguggggacagcuaguggagccauggggacagcuaguggaggcauggggacagcuaguggagcugugggguggaucauggguuuugguuguuguucugcuuuugguuuugguuuuuccugaugcucuugacccgaaucugugacguuagagaucacaugugcugcucucuuguaaauugccucuuuucuccuuacuagaauguuuucuauaauaaccauauaaaugaaagauacagaggccaugagacaugaaccagcaccuaugcagucacuacaucggagcagauguugggugucaaggcugguacugaguucugggcagcucugaugaguaacagggacucagcacugcagagugcuggugacuagagacuugcagaggcccagagggaggggcuucucuaacugcugaguccugagggcacuuccccaacaaccuacaugcugugcucuuguauaaauuuuugcucuuguauuuuauuuuucuuugcucauuugucaguuaaaaggugagacuauuaaccccauuucauauuuuugauccuuccguuccagauaaaauauguggaaacaugcaagucacuuagugagugaagcucuuccucauauguccauccaaaguuauguauucuacccaccugccaucaccaaugcuaugcuuguagcucccuaccagugaccucauaugucaccccucacccucuaggugacauuaagccagcugggaaacucauugcuucaguuuccuccccuguaaaaagaagcuaggaauacugccaccuuguugggcuauccaugaggacauagcaacuaagcaucccacguguaucagacagucccuaagagucaggugguacaacacguguuacgauauaugaaugaagcugcuuucucaccuuuaacauuauaaauugcauucacaauagucuuugcuguuaauuacagugaguucuaugguguuugaucugaugguaaacccgcaagguaagaugauccucuccugagccucuggacugcauaaaucaggggguugccaguuugguuucugaugccuuggcauugacugaucaacauuugguucauuggugagcauuuaagaaccaccagugagagcacaagaaauuagcaauccuucauacugucaggaagcauugagauugagcugucaggggccgagggugaaugcuucauuggacugagccacccaauugcuuggguucuuugucuuucuuggcguucuuggacagaguccauugaacuaggaagcaaggacuuuggucauuccauuuaauagaaaugaacuuaaaaaauccagggcuaaccacuuagacauauuaaaaauaggagaacauuaguuauugauuaaacgccuuuaaauauaaaucagaacaguacugaggcacaaaguaguauagaccgucaacuuucauguacaacguuaaccaugcuuuuugagaguuagaaaaaaaauucuuuuuuuuuuuuuuuuuuuuuuuuuaauucaucaccauggcuguauuuaugagguacaggggcagaagugacagaagaaaaugagaaauggaacauuuggagugcacuuaguaacaaaaaccuaaacuuuugugacuguguuuuauuguuguguugguucuuuuuuuuuuuuucuuucuuucuuucuuauuuuuuacucuguuuuccuuuauguuuaaacaagccuuguuugacugacucuaaccuuuaaguaauugggaagcgggaggagggagauugacauuaacaucuguugaaagauggagagaaggagcaguauucagccaguuggucagacaauuguccccucuuuugcugcguagaaauuacuuuuguguagaaacgacuucuccuuaacuggcagcauugucaguuagugguauuaaaugacucacaucgcuuccuauuguuaauaaugagucaacucuuggcccugacacaguugacccauuucuaggaguagaaagucgucuaacuacaaauacucugaccauccauguccacucuacugcugcuuccugcucuaagacaugcauggggcauucugugcuuggcacccuccaggcaguuuggcagcuucgcaugguggaacagcuuuucugucucagcaacuuucugaccuuucaaaacuuaaccaagaugcagccccuucauucuccuauugcauucgguccaggucgguaaaugugcauuggguucuggguccuaagacaauggacugaaggauaauaggcauggcuugugcccucauaagacucugggaacuuggggauauaagcacugugauguuacucagcccucaguggauaguaaauacucuagagaugcaaucuaaguugaucucagugcauccccccauccccacccccaguuucuucucuugccuuugcagauggaugguuucaucucucuacuucuuugaugucauccauaaagcuggccuguuacccuggcuuaugggucaugaacucuagcuacuguuaggugcuauccucuggcucuccacuccugaacagucagccaccugucuuccuccacccuguccuuguuucucuaggcccccaucaguucccccaguuauccucagauucuccaggcucagaccuaccaucuucuccuccucaugggucuauacugcuuucagcuuucuggucucuuuuccuaaugagggcggaguauaauuuagaggcuuaauuuuagagaacuauaugaagcagcagacccauaaaacguuaugauucaugaccacuuguuuuguucucguaaugcaaccuaaacuaaaacgccauucaucaaagcuauaaaagccguucguggcugucuuuaguauaucguguagaauguaauucaguccacagagaggcaagagauggauucauggggucauuugccuuggugugcauuaaagggcaguaauuucuaagcuaggcagaagacccuuuuuuacuacaaguccugcacucuuccuuaaccccucuugguucgucuugccaucuuaauaucaacauggucauucuuauauacaaacuuucuuuauugauagauaauuucaaaguaccugcuucucuucucccucaugaccuuucugaucuugguggucuucaucugugcaggacauuggcauaugaagggguguuagcuaaaagcccaggcauagauugcauaaguaauaucuuggucaucugucacuuagaauaauacuuuaggagaggcacugcuucucccuucucugcuccccagagggaaaauuaccaacauuuuucuuggagugaaggaacacagccuugggcagccucagcuguuuuccuauagcauuauaauuagaaaucgguagugguaguuaaccuacgugguuaacaaugcuauccucaaagggugaggugucucugguauuguaauuuguguuugaauacugaggucugcgcuuuugcauuuucucauacuugugucuguaggucaucaugcauuaggaaucacauaggagauccuauuucagaagugaagccuaaagccauaguauagaucaaccauuguuugagcccugcauaagacagcuugccagcuuugcacuucccucauuuggaacauaaguuagucaauguccuguaaggcuccugggaagauaauaugagaaaaaucuauguaaucuaucacuucacuaguuagcuccugcuaauuggaaauaauuccuugaaaauuaggacuuguuauuaagagucuauaaugaugacaaugaugcggcugaugaugaagagcgcuugcagaguccagauaaacugaagggucucaguuagagcugcagggugggugacucggacgaaugagucacucuguaaaacuagcccaggcgcuuuuguaaauagacguacaccuuaaaaacgaaccagguauuuaaccccaugauuaagcauuagcuaccuggcauuuugucuuuuugguuugcuguuaaauacagcaucaugacuuugaacuuaccuucugcgcauugguuguucagcugagaagucgauucuuuccuguaugaagaaauaaacuuuguuucaccauaaacugcugcaguuggagaucagcucacauauucccacuuagggcgccccuuguacugcuuauuucccuggaucccaacauccaucuuuuuuagcagacuuguuguuuuguuuuguuuugaaaccccugugaaacuaaaugauuuccuugaagaacaagcuucguuguuuggcagaugaaaccagcagugcccauuaggaaucuuaagcugaauaaguuuucaaaugcuuaacaacuuugagcauaauuuacgcuaggaaauagguuaaaaugguuugagaauuguuuugaaaauaucaucgccguccuuuuaaaaaaaaagucuucccauucaagauauaaaaauagcauuuaugaggauauucucuucaagugcagagccugagagcagacuaucuucuagaauuaagcuuuugcuuuuggcugaauuaauguucccauuauauuuucucuugagaguucuuaggccuuuucuauaacuacaaaaggccugucuccagugcuccacaaauauaaaacauaaauauauauuuucuuccauauguauuugugugaauguugguggucaugguuuaugugugugcauguuugugcggaggggugugcaugggugucccagaaguuaaggccaggcauuaguccucaguagcuaucugucuugugcuugagauagggucuagguggccuggggcucucuaaucagggaugcacguuggccagugacuugcccugagguuauuagugacaccaugcccauacauucuucuguguauauucuagggauugaacucagguccuccugcuugcagagcaaauacuuuacaacugaaucauccuccaguccccaaagaagugccuuacuucucuucagaauagccuaucacagcucugaucgaaggucuucuaugacacguggcuauagaaaggcgaaggcaguagaucuagccuauuauuuuguuuauuuguuguuuguuugucgcuucuguugcccuuuuccauaaagagagaaacacauugugucuugaacuugcauggguuuccccaauccucugggaauccaagccauuuauagcuaacaucaggucaaggccaaagaggccauggccuccugcaguugucauuagugagcucuuauuucucuuccauagagaagcugaaauugacaaacugucuagggagaugcgcugcucucugcugccuguuuuuaagcaggacgcauuaaggauaaguuacuugucaaggcagaauucuucaucauuaaucaccgagagaccacauuccuagguaaauaagcuccuugauaaagccacaucuugcuagaaaauaucccuucuugacaccuuccugccugccagccuggucacagugugcuacccacucagaacaggcugccucuucuaguugagauagggguggugcggugcagaucugugaggaucugagccuuggaggcuaugagaggccugcuuugauaaguaugaaugaguguccguguauuaagcaugguaugcuuuuuuuuuuuuuccccaucucugugccgacagggacuauauucccuaucagaguaaaguuuguucugugaggcugaugauucacccccuguuucguuucuuuuccugccuucucauccagugguugcauuauguacgaauucuagcaguuuucuucguuucaaguaaagcucuucugagaugcgaacaauaaaaaucauauuuuuauaagccuucuuggaagaagaccgugcgaauuccauuuuaguggaaaaggacauuccauuuuuugaucauguuaaugucuacucccaagcagugcugggagggugggugaccaccugcacagaaucucagaaaaaguggccuauauguucccauagucuugauaugcaugacuccugugcccacuaccccaucucaguugcuucucuuguuuuguaaccuugaaggcagaagcaaccuaggcaugaauguagcucacccaccauugacuagauagcaacuguguuacuaaccccagccuacaguuaacuggauuggauccaguggcuucauugcaguguggucaaguccccugucccuuuaugaaaaggagguuaguuuugugcagccauucaguaugcaagucacaugcucauucuaggguauauugcugcaugagagcuugguaggaacuaaauauuuuagauguagaaagggauauuguucuaauuaaacugagugugaugcccauggcaaaauaugugcuuaauauauuggaguacaugugggaaaauuacauguguuuucaccaguuggcuccuccccacuuauauccuugcugggggcuauuuggauauugguuaccauaggagaauuauuuucuuacuaaucugggcugcacaguaaaugcgggggaaccauaaguuccacugauccuuaagggcauaaaguuggauagguagggaagugaggaccuggagagaguuaggagugggagaaaccaugaucaaaauauaguucaugauuuuucuuucuuuuugucuuagucgcuguucuauugcugugagaggaugccaugaccagggcaacucuuauaagagaaggcauuuaauuggaacuuucuuacaguuuccgaguuuaguccauugucaugguggggagcauggcagcacacaggcagacguggugcuggcaaaguagcugagaguucuacaucuggaucaucaggcagaaagaagaagaaagauacuaggccugaauugggcuuuuaaaaccucaaagccuaccccaguacuucucuaccaaagccacaccuacaccaacaaggccacaccuauaccagcaagguuacaccuauacaaacaaggccacaccuauaccaacaaggccauaccuccuaauccuucuccuuggugauggaaacauucaaauauaaagggggggggcauucuuuuucaaaccauuacacaauuaaaggaaaucuuucucuuagaaagaauggaaaaagcuaguauuugacucuuguaauccagaauuccugguacaaaccccugcauucuuagcugguuaucauuuuaggaagaaaagcaaucgcugccucuucaccucuuagcucagguacgacugcacuguuacacacucuuugagucgacuguacuguuacccacuauuugaguccuuguauggaucaaccauccuagcccacuuccuucaucggcagagccugccccuccagacucggucuucauuccacugccucucaccauuuggcuuucccccaggcugucucagcugccuuuguauucaugucuaccagguccagacagcauugcccucuuacccaugcuccaguagccucccauccuggguaaugcaguccuugguuuauaguuggguugcacaugaucucucucuaccuuguucuuccaugcucauucuucagcaucuacagaaugaagucuuuuucucagcccaccauucagagccucucucaucuuagcaucuucuaccccauucauagguauucauguaaucuguaucauaucuguccuacaucuuaguuuacugaagaccuugcucauuugcccuaugaaauccaagauagcuagugcacaugcuugccuuuuuaaaaccuguuuaugucuacuucauauaauuacaauaaauuaugaccacuauuaauuucagcuaacaucuacugaaucuguauuauaugaccauuacuauuuaaauccuuuacauaguuccccugucacauuuuagcucaugugacacccauccuuccuuuuguuaucguuuccauuuauaacagugcacauagaauucaaaggguagaagagagcaugccuaugcaacauaaucagacacagcuucauggccacccacagggucuaggagagagggaauucauuauagagaugggcggcugucuauagggguuugagaauguggcugggagggaaugagagucacugagcagauagagagauaugggggcacuauaagcauggggacagcggcagcagacacuggugacaggagcacauccucugagucauggaaggagagaaacauggcuuaguuuggguuuucagcauucaguguaguaaccugugaucaaaguguaguauaaagaauaguugagccucuguacuucucugcaauagagauuccugugagccaggcuuaagcaugauagcuuacaggacauagaggggggccgugggguauaggggggacucucagucacucucuuucccagcucgaccuugguaaccacacuguuuuacucucuggcuagaaacaguauaaacugaagcgguccuggcucguccaggauccacaucugcuuaaguccucggucugcucuuagcagacuguagcacuacugugagcagucucaguaguagaguuuucugaagauucuuuucuuaucaaauuaagggagaaagcaugccuugcucuuuagcacgugcucuaagcccaguguauuuugucaggcccugguuuucgucaagucucgguagcagcauuagagccccauggcugauugcaagcuuuggggugucagucauuucuacauaaugaucccaacaggugaaucaaaacagaaaccuaacagggcaaaagaugucucugcagcagaucuuccggugggacauuguauugcuagucagcaguaugucccugucuacucaagcuggcuauuggcuaccaacugugagauguucccuugcugacaagccccccccaauucuguacuuugcccucaggcuggcaauuuacugcaugcaaucucguugagaaaauguggucuuuauuaguguucggcacagaucgacuuugcuuugucuggaucugcagagcuaguuggaugcuuggugcugggaaagagggaaaaaaaugaaaccaaaacaaaacgggacagaugacaguaugaggacaggaggagagguguuuucagauauuaagaaucagagugcuggccuuguguagagaaagacgcaagcuggaugaguagaaauagcuagaaacaggucauuaaacccacagacugggcacauucugaucgacaacuaaucuucaaagaaaugcucuugacaauagaagugcgguaugcugguuucuacauacggaaaaaaaaagaaauaaauaaacacccuuaaauggaaaaggcaguucuugcccuccagacgucgauaccuccccuaucacgacaggugugugcaacuuucuguacauuuccugugucacugugagcagauaugcacauauucuugugucuauuuuccccucugucucuucuuagcuuugucuguugacuuggcuccaucuuccuggucuaauguauucuaccgagggauuugggaguggcaaagccccagcuccuccuucuccaucucccauaugcugucucuguaacaagugcccacauguguggcuucuucgccuccugauccugcuggugccuauuguucuaagcaguucuuaaguucauagaugcccccgagucgcuuuuuaagcacaaacacaaaugccuugccaguagaaauuaaaugccagaguguagguaacaaauauaaaucauagucauuuaaaguagucauuuuguaaagaacucgagaaagcuagccugggcauuaaauauucacugcccaccuccucugaaauggugaaacagcuucauuuuuuaacgauggguaauaauaagacacaucaaguuuaaauaaccuuccuucuucucucccuccuuccaaagcuaugacuuggcaagcuugaaauuaaacacaaguaagggugauaacuagacugccacuaacuggucgugggcuagacucuccucugcuguuuucuggaugcucuguggcuauuugaagagacuguucaauuggaaauugcugcuaaugggaucagcuugaauuuaaagaaaaaauagaucucuguuagugaaaacaaguaauguggacccuuaaguagcaagugugugauuauccucuaaugcauucugauuugucucccuauuaagucucacugcguccucuuggaauaguuaaaacaaaccuuuaagugaauguauacccacucccuccucccugcacaacacccuagauucaacugcacuuucccuguccucaaacaaguuacaugcaaauacaagggugggaucaaagagaaaauuauauauguugaauucauaucgcccuuugcuaucaaagagcuguauacaccuuuuaucuucagucuuacaugcaguaugcauuuacuugacagugaguuuucucuuuacaccauacauggaacauacugaggcaguguuuccuauggucacauccuaaagcguauguaucuguccucugaugggaagaagcuugcugugucugggacucucuagagaguguggagucagguaagaccugcucagaaaacagaagcuaagcuaggaucuggaaaaugaguuggaauugggcaggcagcaagagguaagcaggaagugugugaggggugauuugcaaugcacauggagaugagaguacgcuagccaucagggaacugaaggcacagcgaggugccacaggugcugcugguucugggcagugaugccacauggaagugacuggugggacugaccaaccagguuucccucccuguuugcuuuguaguucucucuugagcugguuaagaaaaugacagaccauuuauagugguugaaauguaaccuuagcugaaggguaaacuuacuucagcuggaaagguuuauggggacagagggucuggagucaaauuucugggaaaggguuuuagagaggagcugggauucaagggacagucaagacagagaccaaggaagagggcuauuuguaguggaaccaggucagaucuggagguaagcaccagcucugcgcuucccugggcagcguccccaccuagugcugguguuuauagaugccucaagcauccagagaaagguauaggaauugcacaaaaugaaacuggcucuggugaccccgcccucgcagcccuucaggagaugguugcuagacuuccagauuuuccagguacuguuuuugucuuuuaacucuuacaauuuuuaggugcuacaaaggacaggagagacuccgacgacagacacaggccaauggcauuauugcccuggaccauugucaaaauuuuguauuaacaaguugugugagguagaaauggggacgagggaagacagagacuuuuuaagcccagccauuuuguuuuucaagggacaaaucucccugggcgauaacuaccagauugauguggguagugaaacggcacucagagaggagagcuguuaacacagugugcuggcagagccucgugcucgugcuuaagcaccugcgcuguucugugacucagagcaagaaauacgaaacaaacccccgucgucaaacgggaaccuggcaggaauagucccuggguuuccauuugaacagaacuccauuaagagauuaccaagaagcaccaaggcuguggcugaauaagcaauugaaacccaacccuaaagcucaucuagaugaauucacacggcccucgcucugcagaggguggcugggauuaugcgcaccuuauguugguguuuaaaagcaugggguuggagguauggggaagaaaauaggccuugaagccccaccaaaauguucuguagcuggguccuuuccuagaagagagaaugccuucuaccacguggggaugagaccccagaccaccccuuuaccacgccaguguguuuaugguggcguuccuuuucauucauuucaaagaugcuauugaauuugucacaagccacagccaucucauucuuucuccaggcgauguuuuuuugauaaauguugaugaguuuauaacuguaaaaccaaaugacauuucuagugugauacacgauuuacuucuugcauaauuauaucuaauggcuuugcguguagaaaggcauuuaccauuuacuuuuguguaaaaugacaaucuaaacccccaggccugaguuuuuaaauuuuuuuuuuuacacaaagauaaagacuuaauuaaaaaccaaacacaauuuauuuuuguaaccagcauuuaagguaccuaguccuuugguuaaauaugugauaaaaaucacaaugcuuucaguagcaaagaucagugaguuucauuuucccucugucuuugaaacacugucgaacccauuuaauuaucaaacugauauccaggauggcuucuuguuucucauuucuaguuaaaagagcuuuuuugaaauuuagcagagaauugaauaauguguucaguuaaugaggaacauuuaagagauguuucugaauucagugugauagcccgaugauaaaccaccaccacagugcaggcagacugucuaagcagcaacgacauuguaguccauugacugugggcaagcuuagcuuaguuuuauuuuccuuuuuuuuuuuuuuccuguuuugguuuuauauccuggcuauucuaguaugugguguagaaauguccuuuauauauuuugagguguuuauugucauaaaguagauggcuuccuagagaaaaacaguucuguucuuuagccuuccuugugggagauagagccuuauagucugguaaggccgacgcaugcucagacagacagacagacagacagcugggugacuuuccagacagaagccugcuguggcuccaggucuacuacuggcuaguaucagugagaaguucaaguucucucuuuccacaggaaaagguccugaugcuguuucuuuauugaggaaauagacuaggcaguuggagagacagguccacguguaagagcacuggcugcucuugcagaggaccuggguuugaguccuaguacccacagagcaguucaaaacugccuguaacuccagucccaggagacccuacauacuuuucuggccuccaaggucacuguaaacacauggugcaugaacacacauguacacaaaacgcccauaaaugaaagaaugaacaaauuccuuaagaaagaaaggagagagaacuaaaucuaauuagucucuucuaugggacuuaaaagaauguucuuauuuucugcuucaauauuucucagaaacucuuauugaauacuugucagcaucauggggucucuccuuuucacauugauacuaggaagcagcauuugcugaauuuuuuggaguuaaugguuugguuugguuuggggguuuguauuuaaggcuaagcuauggcauuauacguucacacaaguacuauuaaguggcuuuuuuugagacauggucucacuguguaguucaggcuagccuccaagccuucugcucuuggccuccuacuccuagccacagccuuacaccaucacagcagacuccugguuuuguucgucugguuuuaaggggugugugggcauugcuagugaucaaacuaagggucccagacuugauagauaaauucucgacgacucugcuaccucugccucuuacuccuaaguggauggaauuguggccaccugaccaaaucccaaagccaaggaagcuauugguaaggaagaaaaaauuagggaagaggagcagggaaacuguuuaucauaguaagcacacaaacagggguagguaguuaucugacaccugagcugggcuucaaaauuuggagaaacgcugcagccaaaucuaauucguggguuuugagguaugagagaugugaggagugcacagacuuauaauuaaaaugcuagggggagccuccagcuuguaucucaggucgggguuuuaauaaugcaucugugaacugccuucuauugccuuuaacaaaaucaugcagccauagucacugcaaguuucuuuuuaaaaaucuauaacgaaccaguguguaugugugugugugugugggggggugauguuaaacuaacauuuaagaccuuucagaaggccuucagaauuuauuggaggaaggcacagagucacuuucuauggaagaguggcuaggaagaagcauuuucaugcucuuaggcugcgacaggugguauagauuaauguugaauacauacagaaucuauugagacuaauuaaagaugcauauccacauggaauaccacaucucagugguucuuuggcagccagucuaaccagcacauggaauguuuauaccaagcauuuuucaaaauuagccaagaaugguagcagugaaacuccucaaaacugcccuaaaagaauucuuaguuucuucguguuauagagaauccccugagagucucugccucugaacaguacuccucggacuagaaaagguuauaaagucugcucaccucugauaauacagugauaugcagcagcccuuaaaauacuacauggcgguacaaaaccauggcugacuguauccagaucuuauaugcagaacucaguuuagcaacuuagcauugacuuguaagaagguauccaggaccuuuccuuccuaggagggcauccaucucucacccaaggaggugagauggaagggccugucacuggagcuucacucaggagaccgaauuagcacauuggcuccuagcccuccaucccuuccccagguugacugaauacccuuuggugaguagaauguuucucaccaaugcuaaugagcaguucacuuugacacuguacacaaacacaaucuggugguugcguucagauguuuuuccuuccugcuaaugaauaaacucccaguggcucacaguuagcugagguaagcagugacucgagguguaccccccaaaaugauuuauuaacugccauaaauggaaugagcuggauuuuagagaaaguacaggguugucuugaccucaaaaauccaggguaaaaagauaauuuuaaauaaaugagcuuaauacuuuuagagcauaucccauaccaaaguuuuuauuuaagaccaaggaugucacucagugguacagcaugugugaugaacauuguguagcccuggcuucaauccccaccaccauaauaaauaaauauguguguguauguguguguguguguguguguguguguguguguguguguguguguguguauguauaacuuugaaguggggauuguaaaguugagagucaggagaacauacgacauguaagaguuccugauucucaacuggcugaagaggugucaucuggcaguuuucuuuuuuaguaagcucugacuugagcuucacugggccgccagcuaccugcucuguaauaagaaagaggcaguuucuccauuccuuuuaagauuuuaaccaaaaaaagcaaauccuauagacuucaggaagaguguguauguagggugugggguguguucuggaagacgcgagaaggggcuucgagaacuuacaccaaagagauuaauauuuauagacaucagcauuggucucucaccagcauuuauaacccuagcaguggcagauugagggcugaaucaacguuuuccgccccucuguaaaauaauaaaugccguagaguagcucucagaacugccuuucucauagggauaaaucaggacaguuuguguugcaggagagacuuaaaacuuauaaauauguugcccuuuaggcuacuauucaucaaauugucugauaugaaaucuagacuaaaggcuuuuguuauugugugucugcguauucucuuuuagaaguauaaauuggaaagagcgcugucauuuuggucaugcuggccugcugugcuacuuaaaugcaugucccuuuugggaugaauuugaagagaaggaaauagugggaguugacgacugcacacuuuucuacagauccuuuuggucgccugaacuucccuagcagaaggcauaauuuccagcaggaaaaauacaguaaauaacugcuugacaaaugaccuauuuuacugcagccgacuuucuaagacacuggaguggaggcauuguuccuuacaggucccaucuggguucagagagaccccugcuuuucuccucaguccccagugcgagugggcccagccacagcucugcacagggccaguugagccaaggcuugugacagaugcugcaggucacguggcucuguaggucucagagcaucucaaaucucacucgacuuugcaguucugcagcugaaguuccuggcuucugugguuuggagucagaguugaagcucgagcgcuacccugugcuccccucggugccuuuagcuguugaauggcauaugguguguggaaucaccugcuguuaggaggcccccacagaguauguacuaagcaguuuuccuuucuaaagugugguacagcuccuaguuuuccagaauaacuaauugggagcauaaaccucacuuugcccuugaaugguuugcaauuuaggagaccugaauaaugaaaacggaggaccuaugaaagcagccaacaggcccugccgcagcucgaguguuuguuugcccaguuggucagggagagcuguugggggaucgcuacccugggaagaaauggcagcucuuaggagcuugcgugcuggugacuugggagcaucuugagagucguuaccacuugaggucuguaucuugccaugucaaguuauacaggaacaagacucaacccccugguugauucucuuuagaauuggccugaaugccauuauguggccagaaaugcacuguuuguguucgggccgaggaaugauccuugggaguccagucucaggggccuggcaagguagagcacagccuugaaccagacagugcaaggaaacucaugcccagauauuuucaccucugguuggucagcacagccagcaggaacaagcugugucccaaauccuaccugcauguggcuucacagacugcggcccuggagcugugcuuguccugagccccacuuguccguuugagaugguggcaguuugacuugccaagucagauuucuuguacuugguacaagucagaaugcacaaccuuaucacugguaacugacucgaaagaggggcucagggacaggagagcacaggcuuucucuuuaucagaugccuuucaagccgcuccgcaugcgugugauggcuagcaccaugaugaagacugacaguuucaucaagaaagcaaggaagaaaaucugcagacaauaagugggggcugugguuggcccugcucuguuuacccuccauggugccuccuggacaucgagcggggagcuggggggacccuuccucaggacucccggcacuugguccuuucuuuugcugcccuuugugagccacaaggguaacuugaagacuuacugagugaaaagcucaggagaguuuauggacagaccuacugaguggugcugguagcaaccagguguggggguugggugggggguggcuggccuugccuugcaugaacaaacugccagcuuugcucagccucucguccuccucugcagcugaaauccaucucaaacugcaaauaucuuagcaaagugcgcagaccagagaagcucaaguguagaaaucaagccugaauuuauagacacagaacuucucaguacuguuacccaucacuuauagcuacugacuuagcccccagucucuuuccugccccuaagauagcagcaagcaaggccaguggucugugagaucccauaccaugcuaaccgucccaggccacucaaaaaucccuucuuuccuugacuuagcagggaucaguagacgucauugguggcggcggaagggagcagcauggucuccagaagggaauccuguugcugacagucaucuucccuugagguuucagcucagcccaaugacccugucauaaugagauggugacguucaugaagccguuccuaaagcuccuuuuggaaaguguccuccaacguuaggcuccccacccagccucaccaucuccuaagcaucacauucuuuuauagaaacaaaggggagaauuggaugccucaggaaggagccuuugccaaagaaagcaauucuggguuaguuugugugguagccaaggaaauguaucgagcaggguagaacaugucuguuguucacagaaccuacauaaugcuucagaaaugugugauuuccaguguguguuaaaauaagaagugguuguuugauuuaucucccacaaugguaugguauucuucuucuaagaggcauuucauuugcaagccaggcacuguaaauuugaacugaauauguaaguaaauacuccguaaggagauggagugauggcuguccuuggcagagaagauguuauaagaaugaagcauuugguuuuggggaaagauucagcauuggaaguacauuagaauccagaggggucaagacaguuacugugccagccaagcaagcucaaaguuguccugagccauaauuauagauguccgccuacaaacagaguaguuuagguguuauagcucccauauuugcccucaagcacucagaaauacauuggagccauuaguugacuuugaacuucauuuuuggggacauugccuggcugcacggcagcuugguguguuacaguuuuuacuguggcaucucugcauggcagugacaaaggcagugacaguguuuuaucaaguccuaacaagauugccuccgugcauaauuguuaaacuaaagagcugucgauccacugauguggaacaggcgagaaacuuaaagaauagagaaaacccauaaucgcagaguaacuuguaucucugauuuauucugauuuauuauuuaucacaucacgguuaaaacaauuuccuacgguuuuguguauuuuuaauauuauuuugacauugaauuuucaccuaaugcaaaggaagguuucagcaacuuuuugagcauuuauauaugcagguaguuaggggggcggaaaucccuuuuuuauuaagauacaggaugcauguuuaucaaaauucaucucagauuccauuuagaaauagagauaucuugguuuugaaagagcuuacugagcugcgaagaaugacagauauuacugacagaacaaaguuacgaaugauaaaagagcccagcaaaugcguauccccgaguggcuauaaauuaaccagcagaagcaagagugcuguugguuggugggcauagagcaagcauuaaguugcugugcguaggagggaaugucuagugagcaucccuguagcuucuugccaaaguaucuagccacucaguagcccaauccugaaugguggcuggugugagagcccaccacucugcgggacuccugccaccagacagaauguagagccagagcccuaaaggagaccacaggcacagcagcugcacaguggguccugcagagaguccagcugagaaagucauacuuccuugaaaaaugaggggauguaaauguuagccuaggguuuggaaauguuaaauuuugccgcucugagcagagccugucaaaaccucucugaagaacaguuaccaaauaggaagacagagcuggcuaaugucaccuuuauuuuaagcacagcaacucuccccagaacaauggguacaguguagccauuugacagaucuugcuggugauaccuacugcauacuggauggagguggguaaggcccacccuuuccacaccuccagcucccagacuccaggaggccucagaaucaccuggaagacuuauucaaacagauugcagucuccacuucugugguaaccauaucagcagcgcgggaagggagccugugcauuuguguuugauauguuucuuuguggugggagccaggggugaucacuuggggacuuaguugagugacacgcauaccgaguuaguuuuauuggugcacaaacuauucuaagagaagauuuggacuuuacaucaaaagauaaggguuuuucuccuccugauucuuccuuuccaucuuccucuggaagaagccugugauccuccagcuauaaacacaucauccuagacagccugugcaugcagcacuuggggcacagagagggccaggagcaggugagaauauuagacacugacgcuggaagugcucuucuugaggguagagacagaacugaaaggccaagugaugaaaaucaagagagcaagcauucacuggcuauggcccugggguugagccagcccucagcauaagaaccuaaccucuccuccaccccuugcugccccugaacccaguuaaacaccuagauuacuucccucucugagguuuagguggagaguccccucccccaacuccuaagaaacgcaaauuuucagaaaccguauugaauuccuaaaaauagagugguagacuucugugguuuagcaaauaggcagagcagcucucugaggugugaucgggaagguguguggaagguggcaggccaucgagucuccucaguuucacaagcaagugucagcuaaugaauguucuuaauuuuucuuaacgcucacugacuuccccacacucuccuauguuuuccauguguacuguccuccaaagagauggagaaaucacuacuugccucuauggaauuccuuuucuggccaacaguagacuuucagccauauucccaccuagucaggcuaccucuuguuuuuaaaugugaaagcuggguaagaaaggcaaucauuagcauaacauuucuggaaccuucagaagcucagcacagucauugucucuuuuaacccccaaaucagccaucuggagccauucuuaaagucucauagaugacaagaugggggugaaguuagagaauugacucaaggucauagagccaugcaagucgaaccaggguuuaagcuuaccuccuucaacaccccguuaggguuccauuguuacugggaacagccuugccuaggagcccucaguaccucuagauaaaacugagggccugaaaaccuugguuuuacaaagccuguuugucugaugucucaagauaggguacaccuguccuuggucacuacaaugaaagacagagauggaagugacuguuuuagacuugaauaugcuaucccuuugucauagaaaggaaacauuuuuuuuugaauguuuguuuuuccuaauuguguguguuaaguaaagugauuggacaaacagcccucuccuccagccuggugaucugucauaaaucaaccuucagauguuaauaaaacaagucagggcugacaaaggaagcuccauuuguauuuucaacucccaauucaucaggguccccuccuucagaucuucugcgagaguguccuuggucuuaauguagcugcaagauaaaacgcagauaaaagagccauugucucagaagagcauuaauaaaaaaugaguguugauccuaauugaggaguauuuaaacauacggauggaagccggagucuguggggagcaucugagccuguuagaauuugacugucucgucuuccuccucuuacuacacugcccucacugugcagauaacuugugagacuguaagugucacagugaaaccagaaagugugugcaugugcgcgcgcgcgcgcguguguguguguguguguguguguguguguguguguacacuaucacaaauggccagcuugacagcucuuguucuuaugucuaaaaaugugcuauuuuccucuguccuuuccugaaguauucaacugccucaucgucuguuucccuucacaccguucgucuguuuauauuugucgcuaugaauuugguuuugaguuuccuuacaucuguuuggcuagauggaacagagcaagcuccuaggagccaaggguaggccagucugaauaauaaauaacaucaauagugaacuauaagccaaagaauaaaauaaacguccaggagucuacauuaguauaaauaaauuauugaauaaauaaauaaacgggagaaaagccucaucuucagaagaauuucaauuaaagacguaaaaggacuuuuuuuuccaagaauacgacuuggauuccauuguaauaauugcuaucugccagguccaucagugagugcuauauuauugagugcaaguguaaggagaugcaugguagguacacugcccaaguaucucccccuaaauguauauuaauuaauuacccagagguucugagguaugcauauagccacauucuuugaugcuacccccucugggagauggagcauaauuucuuucccgggaugugggcuuuaguaugugccauucuagccaggagauucaggcuaauaucaccaauaagaagacauuaguaucacacaggcuguuacgugacacagugccucuucacuccucuccagcuaagucugccaucccagucuaagcuggaaagaacacagaacaaacccaagcugacggugggugugcuaggccagacucaucagacugucagggucagucacguucauugcuuuguuugcucuguaaguaaauaaugucagccuugcggagggggccagggagagggucaggggaacuugcugcuugcaaguuuucacauccacaucuuaaaaaucuuaaaaauaaacugaaaaguaugacccgucaaaggcauaaaauagcuuaggcagaggagaaaaguggguccuaucuguccacucacuuccuuauuaguugguucauucagucguucauuuauugaaguaguuccugcaagacaccaccggccuccgcaacaguggccaagagaacaagcacgugaccuuccucagcacacccuccacagggccugcuuuggagaacacaucugauccaugccguaggcuucuccacgugcugaaauggggugggucaaggagugcuuccggaggcacccaggagacaaguucgccugguugguuaaagaccagguggcacugcagcaauuugccucuguggugugagccagucuugcucaaucccucguuucagguggucaguguugucugugagaaugcuauauucauuacuuauauucucaaguucauuucacucuaauaacuuccaaauacuuuaagaauaccauugaaauacuuccuguguacuucagguacugaagcugcugcaauguuagggguauuauuuuguuguuguuguuguuguuguuuguuuguuuguuuguuuguuuuguuuuccagaggaaucauuugggauuagaaucaugguuauuuagaauuuuguauggcaacagcaacgucuuaauguagauaacaacuaguuuuuaaaacaaguugacuaccaaauguaaauuauucuuguuagaguacaugaaaauuugaugcuaauucucuagcagaaaccaguacaaauauuuacauacaaagucuuuucacagucagccauugguggcucaugccuucagucccaguacuugggaggcagaaacaggauugucugugaguucaaggccagccuagucuacagagagaguuccaggccagccaaggcuauaaagagaaacugucucaaacaaacaaaaacaaaacagaaaacaaaaagaagccuuucacuacagcaauuugaggggggaaacuuaguaauuaucuaaacaugacaaaaaauggucucagaaaugucaauaugguaacacaggcauuaagauuaugagccaaauauguauacaaauacacagccauaugugaaaacaaggcuccacuaaaguaauuacaugagcagagguguugugagauauauuuguuuauuuuugagauagggucucauuagcgggccuuaaacuugagaccuuucugccucggccuucugaguacuaaaaugucagcuaugugccaccaugaaccaggaaacugaauguggaaccacauacaggcuaggcgagaucccugccacugagcaacacugcuagacuucccaaaacccuuugccuuuugagacagggucuuacaaaguuggccuugaagcaucuguauguguggcccaugcaaaccuggaacuaggcauucuccugccucacucuucugaguagcuguacuaaacgucuuugucaccagcccuggcugaaagguguccuuaaaagcaguguuagagaauuucuaguauauggcuugaaugauggcuaauacuguaauuaaaacaagaauccuucuagagcucugaaauucuagcuucagucaccuggugucauggaugauauuuccagacuaacugauuuuacaugcuguuucuugguacauuucuaaauauaucucugauggucuuccaggcuaaaguaugguaucccugagaaauguaauaacuucauggcaaggcauuuagcccgccaaauagcuccucucuccuugcuugcaaguuguacacuuugcaaagaacuuggcuuauguagcaaggaaguacacgguucucaaagguacugagaguuucauuaaaaauaccuggaaauccuuugcuugaaauuuguuucaaauugguaaauaccaagacucuguguauuccauucucauguaaccaucugaucuaacgugagcgacgcacacguaaugauucugaaugcuggagcuggccuaggccaucaggcacauggggaccaccugauaccaagcauuuaagagacaagucagugacagaccagacaguuccaggcucugccugccacacauuuuggacguacauggagcucuggagguuaaccugagacagggacaaagaggucagaacauggcaaaaagcaagaggguggagauggucaccagagaagagaugcuggggaaaaagucagacgcuggagcccuggcacaagacuagacccaugauaaaauaagguggagagaccuggggucaggauggcgagagggaguugccaugcacaggaguucuagggcuggucuugggggacauaauucuguacucuuagcagacaccccuccuuuuucacuuccuuuaggcuguauucagccauagcaagguguacuccugauguguucuguuuucuugaaagaaaaucaaaaaguugucuugcauggucuuuuaaaaauaguaacucacuauaucagucacaccugauggcgccauucccugggccgagcauagacaaaccaucacacuccccagaucggaacucuuccuaauugaaaucuggcugaaauaaaugaauagcauaaaugcaguuaccuguucuucuuagauugguuuugauacuugccuccaaaaaacucaaauaugagcuugauccugagaaaauagauaauacagauagagcuuuagccacaugacauuaccuccugguguccucaauaagggucaccagaaguaauguugcuccccaggccuucuucucagcaucucuauaucauaugaccucaaacugagaccacugagagucuggcaagccuggguucuggaguaggucaggaagcagagcaaguaccaccaagcaccguggaguucugucugaccugcucacggccucucauugagccuuguuuaccaugcuuuucuugugguuugugacagauaagagccauauugauucucagcaucugcuggcaguaaccuuugaaagggcaggcaaugcaucaccaccgaauuuuaucuaucaauaucggagucauagaaagacaggaauggcaucucaucacaacggcacuggcacaucauaaaucugagcugagacggggcuaguacuaggcaauagggaaaggggggacaugguuuaauauccagauaaugucaggaggacaggauagggcauucagaugaaaaggacaagacuuggcugcaggagaaguacuaaauggugauggucauggcacaggacccaaagauguucagcuuuacagccagugagugguagguccuccuuccagccuuagucuucucaucuauacaauuggcuugaccaugcucuacagaauugugaagguuugggggaaguuuguuugcucuaagagcauaggcccuucagcagcugccaucccccucacuuggaaacucuuuucucuuguauuucaauccuuuuacugggcugagacccagaagacaaauuacgagguaacccuaagacaaacacaagcucagguauacagucagucgguuccuggaacagagguagacuucaaaaagguagcauacaauugaugcuuugguauuucuguacuuuauuccaccaguaaugccaauaaucgauucuguggacaauccccucauuccucaagcauuuguauucacaaggaaucauaaaaggaauggagaaacuagugagaaaagcaaacaauuuugacauguaaacaaugucauaaaauuaaauacauugauuccuggaauagaaagaugguucagcaggcagagauguuugcugccgugucuagugcuuaauccauaggaccuccaugauggauggggaggacagauucccacuagauaucuucugacuacuacuugcaugcuguggcgugcuugcacacacgcccacgucuacacauguauguauucucuguauagauacuauauggauggauggauccauuaauuaaggaaaauguagcaaaauaaugugccugccaauucuuauacucgucugcacucucccggguggugaggcugaaggcuguguucucugugugcuugggacuucuuucgugcuuucgacaugccaggaagcuuccagccuggacagugaguagugcuacaauuucauaacuuaaguggagucugucugauucugcaaagaaacagccuuccuuuggggcccagaauacacagucccuucugcagcuacacucaugguauuuuuaaucauuccauguuuuuauuauaucuugaguacaaggugcuacaaagagucccuggugcuggcagucacucagaaaaaauugacaaaucuaaaaagugagcagaacagcaagucgcacauuagggauuuccuuuuucucuuuuucccccuuuucuuuuucuuuauuuaaaaaaaaagacuuuuuaaaaaagaaaaauuaccuuauaacauuggaaggguugaauuuggcaucuuauccaugaaaaguaguuguaauaaacuuccccaauuguuggugccuucucugcaaaaauuauggcugugcgcaagugugagguuuuaacuguuuccgugaagcucguaauucaggcucuaaaugugccgagccugacugcccagaaaccuaacgacuuuuuuaagagacuggaauucggaacauuauucucucugaaacugcacucugguaacccagcagaaaacugcucagagauccgcuccugcucuaguaaaggcaucugggcaugccaguggcuuacaaagaaaaugcugaaaucucuuguaugagagccaauuuguuagaggaaugaugugugagccgauugcaacugccccuuguaaggggaggggacauggacauggcaguggcgaugugcugcucccucaguaccaaguuaaacguauuaguaaacuaacauggaaccgacagagugacaggacagacguucccaaccugugcuucuuacuuuggguaacaucuuugcuuucaugggaaaugacauuuucuccggaaacaguaagaaugcuauuagccugcuugcaaggcacaguugcuccagcaguugagagcgggccagagguccaggacagucuguggauguucauuaagagguggugaaaaaaagugaagccauuguuuaucuuucuuuccccugagcauucuuccaccaggcucucugcagaccugauucuuugcugccuccagccgaacacucuuauuauuuuccuuaaacuucuguuuaugccguuaccuguauuuuugcagcaaauuuuaucugcuagguagagugaaaaggccugcuguaauagauacugucgcuuuuguuuuuguccucccuccaaaucauagaguuggauuucaucacuuguaacaaaccucagcagccucuucggguuuuguuuggggcugcuugcuuuguuuccugauuuacuggguuuugucuucacuggcuuaaugcucacaagcacagaacagacaggcaaaccaaauaagcaaaaauuuaacuaggguacugcagccugugaacugacaaacccacucugugugacagcgcugacuagaaguggguguuuuugcagcuaagugcacaauaaucuauuugcacuggucacaggcgguugcugggcaagggaaguuugcauaucuccaguguuagauaugugcagcuggaggacggaugguggauucugguaccuccugacuuggugaaugguccauaccaauuucucuucuuucauaucugcuuugcuuuuaaacaugucucuuccuggaaacugaccucacucgaucguggggauucccgacucucuguccagugaccuacuugagauauauuugguccuugaaacagggugucuaugugccuccuccugggaucugccuugccuuaagccaguggucucacguugccugugacaucuauuuaaggaaggaaugacagugacagcuguagcacuuuagccagagguucucaaacccacauggcccuagucucuuguuaaaaugcagguccugacugauacuacugguaugaguuuggauuuauguauguuuugcagucauggagacauuauuaauauugcuggugggccacaccgaagacauaagacaccagaagggaaggaagcuggacugucucacugcauuuagauauaaauggauacuacagaaagcaaaucgcaucucguggcuccucaccccauauccaugaauaucuacaagggcagcacaaaccaggcuuagcggguuauuuaaagaagagggggacaugaaauugacaagguggguucagggagagucaaguguauauacuuguaugaaauucucaauaaaaaguauuauauuuaaagacaucugagucauuacugcaaguguugagaagugugugucauuugucuucugacuuccuuucuaucaguguagccuggcuggccuagaacucccuuguagaacaggcuagucucaaacucagagauccacccgccucuggccccaagugcugggagugaacgaugcgccaccacacccagcucucggaccacuguagaguuagcuccuugcugaucuuuccuuaaggugguaacuggcauugagcugugugauuaaugagaaccaagcaaagggccacugagcccuuuugcugaguugcccucaugccuguccucuauagaccugucagucugcccuguuucucagagcccaucucuacuuucuguuccucauuccuguccuaggucuuaccagccuuccauagccgguaucucauacaacucugccuucuugcaaucccccuuccucuccuuagaaaacaucuuccaguccaggugugaucguaucacucccuggauccaaaucacucccuggcucuguauuaauuacaaggugaaauauaaacugccuagccuaccagaugauagccuuccuuaaucagccuaugaccucuguggaaaacauccccugugcucucucuucuggacacuagagccgucacagaguuucaaauaagccagggucuucucaaacauucccucuccacucaugcgagcugggccugcagcucucugaucacuuuggggggugggggggugggaaacgucagucagucugucuuccuugaagcauugcugugcugaauaaauacaccaaaaagaccugcuugcuuucuaaccuuguaaacauccuugauuuauuuuuauuuuagaauauucuauuguaaaucauuucaaaaacaaaacuuauauaggaauccuuuucaaaguuuuaauucaaaaccuauguggcacuuaaauauauuugaaaauguuugaacacuacauggacuaauuucuaaaauugagaguguccagaccaugugaaauccuaagacucucagucaauaaccuaccucagcguuggccaauuccugagcaccugccauauauggugacacugugcuggauuuuagggauucaaagaaaaauaagaugacaguaaaaauacuuaaaguaacaacacagguaaauaauuaaaguuuuuauuugaagauacacaggaauaaagagcuuaacauaauuaaaauaacaguaaguaauuuugggucuguacaacucacauuaaguucgcugcucuaucaauccauugauuuggcucaaauccacugauucucaacauaaccugguaaaggagacauuuucauguccugucugcuuguggggaauugugagacuucgagacugaagccauuggcccaaggucaagcugauaagggcagagauaggauugaccccuuggaagacaaauucgggacagcacccuguaacaagugggacagugugcaugcauaaugaagaacgagccguaugugcaugcacauaaucaaugcaugcagcaagucaagaagcacaggucaauccacagaaccgauauaaaaagcugcucuuggugucaauauuuuuguacucccagcacgacggaggcugagacaugcagcuuucuggugcugacuggcuagggcgccuagccaacuuagugaacucacacuagugaauggcagucucaaaacccaaggaauaacacucagguuugaccucuagacggcaugcacacuccacgaacaugcccugcacaaacaccuacagcaguaaccuuacaaccauacaaaacaaagucgcguaguugcacucaaaccuguaggaucggugugggguuccuccagguccgcuuuucugcuuuuaugaauagauugguggugggggacauggguugauccagugauuaaaauaagaauuuaaugccaauaaucaccaacuauugucagacaucaauuauguauugauuugcuacuucauucgaccgguguauuuuuaccuaagaauaucuacuggugucaggguauaacugucaagcuaaaucauauauuauuauuaaacuuugucuaugaucuuuucuuuccuccagugucauauggaaggggggugauuacacccccacaugcaugcuacaggagagcagcacuuagugaagguugcauuucuagagaccucagacaucgcaggcacacccaggaacucauuagugagcaggacaggucucaaugcuugguagcuuuaucccaagcucuugcacuuaguaagaaaggaggaaauuaugugugaggaguggcggccuacagugggcgaagaacaggggacguagaggagccuaucaggcuaaggugagcuagacaggggucagccaucccugcuuaugucaauauuucaugggcccuuccuguguugaaaacuaggacaaagggaguggccaguuugcaaguguugagacuuuuuuuuuuguuuguuucuuuccauuuagccuuaguuuuggcauuuagaaagaaaugcccucucuaaggcuuguacaucaugccugauuagucugccagguaucugagauguugacugugaaguuugccaaggaagaugcugugugguguugccagcuugaugcugucuaccccuucucuccugggaagauggacguuguucucgggacuuacuaugauggagagagcccguagaguaaacccuuuuugaaagcuguacauugugucuaauuccaguguaggcccucugcccacaucugcugugugccuugcguuuuuccuauacacagccgugaguaggugguuuaaccuaaauguuucucaacaaacauguuuacuuuuucucucuucuuuuccguuaauuuuauaauagcaugaggugaugguugacaggaccuggaaucauuuccgggaauaucuaugggggauuuccuugguuauggucauugauguuaacuauaggcaggacuguuuccuggguaggagauccugaacuguauaaauuaaaaacacagccucugacuugugcucauccgucucugauuccugacuagacgcaacaugaugggcugcuucaagccccagugccuugacuuucuugcugugauggauugugccuuggaccgugaggcacaaugggcucuuccuccuuuaaguugcuuucgucagaguguucuaacaugauaacaagaauagaaauuaagagaggugaauaacaucuaaaauucuaagcuuaaaaaaauccaacagauuuugaagauguuaaaaaggucuuggugaugaugacuguaugauuguagagagauuugaaggauaauauaauccuuuauguagaauuuucagaguugucuuuucuacagcagagagagagagagagagagagagagaaagagagagaacauuucuucacucaagucuccuuauaacccuguuagagagauacccuuuucccaauuuaaauauguaagaaaauucagaauuauagauuugcaucaccaggaagcguugaaccauagcaaagacuccuguuuuccaagucuaaugcucuucuccuuucuccucugcugcccccuuacuccugaaaaacaagucaugaguaaugaaugcccuuaucacuuaucucuaauuucagugaugauuaaucagcagcccacacuuggaugauacuaaucaaguuauuuguauaauggcaccaauuuggaucguuacugugcaucucugccugacaugggcuuggcaccgggcaaucagcaagugugagcauggaaucuggaaggaaagcuccuugcgcugcugccucucuccuuacgagauccuaucaucaaacucuggcugagcacagcucccugguccagcguguuuccuucagacuuagcugagaacggccgcucaagcacccagagguuuaaauccuaagccacccaccaccugcuugcugacuggcagaugauauagugaauaacucaccaauaagggccaauuuuccagcuaagaaauuguuguuucguguaauaguccaaagcugcuuggguuccugguaggagguguaagcugaguggugagcauucuaugcauggugauuaucguggauuuacagcugugucucgagcaaaccacaguacaugcucuagaauaagaauacgaaacaucucucgccuugcgucuccccguuuccugugucuggaguuaugucauuugaagcugacauucacuuggaguccagaucugaugugcuccaacugauagccauacuugcuuguccugacuucucuaagcuuuaaauuuggaagguuuucaguagcucuuguuggcaggggaaaaaaugaccagaagagauacgaggagagacugcuauuacagugauauuuuggucacauaggcugucgauacuaaugaaugcccuugaagcagguacuguaaaugccugaagcuggggcugagccgcugagccuggaucagucugcagaauggcugucuccuccuuaaauacuaaagaccugauuaguggccucuggcuguggcacugguuuuaucaguaucgcauauuggagccuggauugccaauggauggacagcauggcuccacauuccugucugugcugggcauguuguuugguuuuauuccugagucauaaaugagauguugcagaguguuccauuaguucccgccauucuucuagcaucauaaaaugcaauguccuuuuagcuacuucccugauacacuggaaugguuaguaccagcagaucaaggguuaaacagacuagaucagguccaaacacuucuuaguuuccuugugguuaugugggguacagucagaagacagcaaaccacaugggaguauagugggguuuaaaugagaucacagagaauuuuaaauacaucauaccuaguacguugaaaaagaagaaccuuaaaaauaaauuagcuuugguuuucaugcagaggacuugaauuauggccccucuagauaauagugggaguuguccugaugcuaaaaaauuaauaguaacaagcacuuuagaaaaucauuuggcauuuuugccucuagacauaaagaauagcugcuacuucccuuuucuucuguauauuuguagaaugacaguuccuugcaauaaccuugugguuuuaaauaucuuacacuaauuguuaaucuuuuaacccccuagaggcaaacauaaagaggaaaagaaaacucagcuuuuagugaguugaagcgaaaagcgacaaaaguucaaucaugguaccuuuuaucaaagggaaagugauacugagucggggguuggaaagcagggcauaugcaugggcuaucuccauugagacuggaggcuggaguucuacagaaauucaauuuagagaauuuuguugaggcguaacugguaggagcaagugcugaacggugucuaucucugcugugccuacugcuuagggggacuggaaaggcauauuucaguaccacugacugcagcgggagccauguccaugcuccuaaagucugugcuuuugauuuaguuaggaaguuuuaacauagaaucuguguagcccaguccuggcuguuguugugcauauacuaaauaguuggccacagaguucuggguaagagaaaauucuguauaguaacaacaaaaccuaauguuugugcuuuggggugacugucaagugugguaacaagugauuuggaucucagucuuacaaacccuuugucucccuuguggauagcuguagcuucagaaguggagcuaguucuguuaccucaauugaagcagccauuuccugucaucucagacuuuagcuaaucugggggcccaagucacaaccccauaggaugcacuccauccacucucagcugcuugauacaccacucaucccuuuugugugauuccccuccccccaacccccuugugcauccgugcuuuuggacagcagggcuugcucggcccccugucacucugcagaaccgucacuuaagagucccagggaacggcauauaucuuauuaucaguucauuagcaaaguggcugacacagacgaucaacaguuggccuucagcacagcuccacuuugucugggagaagcauaaugcauuucgaaaugcuggcauagcagccagccuugaguuggacugaggcagcuccaucuaacacuguccuuucuucuuucgccauaaacgcgcaucgcagaaucgagcccauugaggggaaagcauuugcucugccaacacaauuaguuuuauaaaaagccucugucuucagauuguucuuccccaaaguccaaguuggauggcugugguuauuuuuuaauuaauauuuuuaagagccucccuccuucucccaagagccucuaagcagauuuaacaggcuuaaaagggacucuuucacaagguaacuucaaugccaucucccaagcaaauaaaauuccauuugaggguucuguuuuuccccaucucuuuuuaaaauuuuccauaaagccuacccagugggggcaguuuuucuucaggguuagguaguauucgcuccaaacaacaacaacaacaaaauacguuaucuuguugcugaaggauggagccaugcaagcuguccagcaggagcaggaguggagggaaucugugcuccuucccauccagcgugaacagcagcaggauucagcaaucacuaguaaucuuucugguuuauuuuuauauucucauuucguuuguugcugucaguuucuuugauucuugcauuuuaauugaaaagcuaauucagaccuuugguuuucacgacuggcaccacuccauagauacauuccgugugguggcucacaccuccuccuuuugggagaucagacgagcuuagaccuuaagcgucauaauuggcuuggccuuuuuaguggugaaggccuugauuaggaaguuauugaaccuggagucuuucaaagggaagaaagcuaaugugaugguuggaauugaaacagcacagacacgcaugcucugucacuacuuccuuugucacucacuuccuugaaaagaguuuucaugugucuuugcacaaaagagaugcccauccauguaaauucagcuuguacuguacuugaucccaguucuucagccuccaugcugaaaaccaauaaaggaaacgguaaaaauagcgaaguguguguucauuuuuaaaguugagacucuggucaccuuuaguuuggcaugguauaaggaucaguccccugggagggaaaagcagaaauagcucuucuuguagcugagauuaaagaguuucauggggccaagaaaaacuuuacauaauuccuuacaguaacuuuucuccuauuuuaaaaccagacuacuuugcagucuguaaggucaggguagaauuaucaaaaaucucuucacucuggaagauguguuggccuuagaucuguggaaaccccgggugcuagggcugugaaggagacaucuugcugugcuguuucauagcucucuccaccccaagggacuucaaaauacaagggagacaggagaggcgagauuuacagaaucgggccuuugugucccuugguguggcugaugcucacggagaccugagcugcauccacuguggcaagccaccugcaugagcaucuguauucucuccugugcuuccuucccuugcauuguggagucaaaggugaaauuccaucuuuaacccccguaugguugucugagcugugauuaaugaaguagaugugacucccggcacagcuuucagagggugggugggagaaagaugaaauuucagccuuaaagaaaacaaaaacaaaagcaaaauaaacauaaaccaggccuuuugcuuaauacagcuuuuaaaauuaauauccauuuucgaaugccaagaaaacaaaggggauuucucagaaguguaugcagcuugccacaauaggccuuaauuggugucaaggagauguugggaugaacgaggaaaugcccauuuagcugauaaagacugaaaaguggaaccuuguuaugagcugucaucucagcauguauuuaaacuauagcaaaacugaaacauauuugccauauagaucauaaugacuccaaaggagccauuauacucuauuauguaauuacauaaucaaagcaugcauaguaaucagcuuuuggaauucaaugcuaaucaaacauaccuauacuauguguuuaagcuaaaauagagagcguuaauuugccauuagucaacuaaacaagaguguguauacagaauauucaugaauagcuuaauguugugucagauacuuuuuguuuuguacgcggggggaaaucaacaauuauacucgaagaaaaaccaguaccaaggaugaauacucuuuagcucgccguucagaaaucugccucaccuuuuacugauugucaaaggagauuagcguaaauucaauauuuuuuccuucuauaagcucaaaugaugcaauaguaauuauagaacaguagaugcuuaggagggucugggcaccugcgugcauaggacacaacuuagaacuacuagcugaaaacauagcaaagccuucagaaccaaauucgagccuauauugcuuuuauaauuagaaacacaucaauacauguuauuucgaaagaggugagcagagucacuccuugagggcuccgugacagguuaucuggccuguccucuuggagacauuggugcuugcccuggagucucugcccagggucuagcucugucaagaagaauugcucuuggaaguuucuuuggcuucuuugaauaaagaaggugguaccgagugcuuggaccagcaucagaaaucuuugucauuucaguuacuguuggucuguaagcucacggucacaguuguuuugaccguuaugaagccaggacugguccuuggaacagacagucucaacacucccauuucacuuugggagacagaaaaacauggauaaggaucaaaaagguuaacagaagcuuuguaaaccauagauggguugauugcuuuugacuuugaauaaauauucaaguauucauguaccuuccuuaaaaauaaaaaauuguauuuguuuugaagcggucaucuccuuaaccuuuaacccccagugauggaacucucuuuuaggacucggcuuuugcugucucucaucaguauguggccgacucagaauguuacugucauguuuaaaugggacugaauucuuucaucaaaagcuuucguggcuugaacuucaaauaauuuauuuucaaauuacuuuuacuguaauucuuauuaauucaaauagguuucugauuugauauaaaacucuguaaauguagggaacaguuuaaugaauugaaagauaggauugagucuuuuaaaggaaauguacaaaauaugcugacaauaauugcuuagauagaaaucaaaucuuaauggcuuuguuaaugauuuguagcgcacacuguguuuacguugacuugagggaacguauguaguuagauuucucccucuggguuucaacagaaucuuaauuuuuuuuccuuucauuucuuuuccuggaacauacucaucucuguuccggcuccugaaaacuuuagcugaaacugcagugccuuugccuuuaauaauaguuucacuuggucaggauggacugucuucuucugaguuagguacaucuuuaacaggguaguaaaaauaggauccaauagaagggaacauggccgacaaaccagggcaagcuucaggugacauggggcacccauaauagucaaaaauaagguuuccaaagucaugcagguguuuuguuucuuugauaguuucaaacuuugaugccucuuggagaauaagaauguauaacccugagucuuugacugcuacaaagcuuccagaauugggccugaggagauggugggaaagaguucgugcuggucaagccagaggaccugagucugaaccuucauggugggcaucaaagcuggguguggcuacuccugucuauagccuaguguggggugacuagagagacaggcuguccugcgggcucacugaccacgaggcuagcaaaaauaccaugaguucccaaguccaauaggaaccccaguauucaggaagugggguagaggggcagagcagggcacccccccccauccugcguuggccucuacaccugcuugcacuggcuccuguucccgcacacagaauuccagaaggacacuuucaaggacuguaguacagguuuuuaaguguucacugaguuugucaucauuagcauggguuuucuguuagcccucugcauuugggacuugagugccuccuguuuggacaguaacccugccaaguuaauguuggggguucagcuuuuuccuagagcagggauguggacagaguuucucuaauaugauuuagcugaugggggagcagcccaggggcuuuauguguugcuccauugggcaagccgcccgcccaguuaagugucacaguaccuggucccccucuguguguguggguagguggcaguugccauagcugccaccacauaagcuaaaaucuguuuuaacucugacuuauccuuuuauuaugggcuggacuggggagccucccccaguaugaaugaagaguuuuauuuguuaacagccaggcagcaagggcgagagcuuugggcacuggcaaaugcccaccgugccguaguaauaaaggcuuucucugggggcagagagugcugagugcagaaggaggaggaggagacagcaguaaacagguauuuuacauucaggacggccucucucucaucuugaaguguguaauuguguucaggauaaauuauggaaauaaaaaaaaucacaaguugcucauaaggaaauaacccucucuaaaaacaaguaaauuuuucaagacagagcccaaagggccuuagcaaccaguucugaaauauuggcugguaagcagggugugugugugggagggggggaguguuccagaaccagguucuaacaccaguucagcucacccacuuaguggaacuggaccaggcaacuuccuucccuaagucagacucugcaguccaaucguuacggcagaggcagugaaacaggaaaagucuggagauggggaagcagcccagcacugggcacaccuuaguucuccaucauguuucucacugccaauucuggcuuugagauccugucacuugugacuuccauaaggacauacuguugauugaauagacucgauugaguucagcauuuuauacaauaccaucuaaagggagaguauaaaaauaugggguuugagcaaaguaucucgaacaauuauauuaacugaaaagagcuaauaaggaauuaaugucccuauaccacuccuaacaaggggcuauuauggccacugguagucaucagaguaaguuucaccuuuuguagacaauaagcuuucuugucauugucugucuaagaaaugucugguuuaauggaaggugcuugcucauggaugaagggcucucuuugauucucagauuuguuuuggggaauuauggagcaacucugaaaguuagucaauguggugggcgugucuguaauccuagugcacuucacagugaagaaaggcuagccugugcuacauagcuaggagcagaccagccagaggcacagagcaagacugaguuggaaaaacaaacuacagggcuaucgugauggaacagugagcaaaggcugggagcccacaugguagaaggaaauaacugacuccagaaagccacccucugaccuccacacgugcacaugugcacaugcgcacacgaauagauacagagaacuauguuaaggaaaauagaaaacaaaaagucugaaauuuauaggaaacagcccuauaucacaauaaguucuuguauaaauuaaaauucagcuugauucugucucccaaacuucauccaaauauaccaauuaguggucaaaaaugucuacacacgccagccacugcucuacccuuaaaguaaauuaccuggcuguuaacagccucauuuaaucgcuagauauucuaccuguuugauuucuguuccccagaacguguacuguuccuuccuugacagucugucagcuaauugaguuuuagaaaacucggaaggauuuuuuaaugcagucuuuaaaaacgauacggaaggugcuuguuucucuccugcuacacaugagauugcauuuugugacaaccuaauugucucaacauccauuucaagggggaaauuuaucaaguccuaguauguacccuuucuuuuggaagacauacuugaggaugugagcagaaauuauuuuuacauaaaggcuucaggcaguagaguacugacauauauacuguauuuuccuugcugucacucaaguccuuugccucaaauaaauaggucauuauuaucccacugcagccaucuaugguaccucaaaguauagggcucuguuuaauauaacugucauccagcugacccggauaauuuauuggugguuuuuaaagaauggcauccuugggccaccaccaucaaccaaagcacuuugauucuuucagccagauauuucauuaucacauaauguuuuuguauugauaguacaaccauauuagcauagcuagaaguugacaugucucugagacacugggcuucugguuggucuuaauuaaaaaaaauaauaaguccgugauguuaacaucacauaacaacaucaccguguaucuucagagcagcccagcaaaggcagaaguuuacacauggccaaaguuuaccugagugacuuguucuguagugacaugguaaacgggcuagacauguaauacccccacuuucaggcauguguaguguguguuauaaacaacuuugacuugauguugucacuauuuuuguuuuuaaaaugcaaaaccaugcuccacucuuugacuuccaucccccgugcauacaggcuacuaugaauauaauaaaggcgccuccucucagaauauacuggccuuagggcuuccaugaaaggcuaaaauuaaagccaaguuauuuccacagaaacugucuuauuagaacaggauuaaauuagaggcagcuuuaagucucggaagcuucagagaaguaguugguauccaaagggguugaugccugucggcucacagccucugcacguggaccuucuguggauugaagaaucuuguuuguguugcuaauaaacucuccgaagauagaagaaaucccugccugcccccaaaaggucuuguuugguguccucaucuccuaaaggcaagcccaugguuuaacacugcuucauccucacacuauacagugucauuuuccuuaauuuccucgguuaggucucccagcaaacacccagugucugguguccugcuuucuagucacuuuugugcaguacuaucagauccaccuggcagagcuggcucgguuggcaggaauuucugucaccuuguucuuagcuugugccuuggaauaacccaucccuucaugcuggcuucuguauucuguguuuaccacaggaaucucaggacaaacaauaaacccccaguugcuuuuucugaucaccuuucacuuugcuguuggucuguaacagccuucagccccuagaagcuuccgcaggacagucugccucccuccugcuacacaggccaguguccucaccacggggucauucucuggggucacagagcucagggucaagauucauugggguuuucucugcaagcauucuguuuaucugugucccuaaucaugucuccuuauucuucugguuuccucucuucuaauccucugucaggcagcuggucuauuucuagguggauuuggcuuugagccaucuuagacacccaucacacuucccccacuguguccugccaagaaaggauccuucagagggaaugugaucgcagguggaaauccuccauuuauucuaauuguaccucuguuuaugcugccucgauauuuuuuuaaaaguagcauuuaucuuugaccuuugcuucuugaugugacaacauuucuucaagaagugaagaagccacccuaagcugauacaucccagcuacacagagagcuccuacagagcaggaauccuuagccugcguucuuguauuuacuacccccacacaugacaguggcuuaguaccuguggggauuuggaggucuagagaaaugaggagggugauguggugauggaagugguggugauggugauggugauggugauggugaugguguugauagugcuagcaguuaccaucuguuugguuugacaagaagcuagacacaguguuaacugcuuuguguguaugacaacucugugggauagcuguuaauuacugcccccauuuuguagaugggaaacugucucggggacuuuacauaaauuuccugauauaagagcagucuguuuuucccccuucgugacugacuguuacaucugcugccuguaaauacaccuuuugcuugggaaguagagauuuggugucuguuuuacccgcaucucggcuucuuaaaggcuaggagagugucccacacuucccuguccccugcuaugccaaccacagaaucaaacacaucacaauuccuuaucuucugcuucuaaauugaacuucugccuugugcuguggaucuuuuucacacauuuaggagaugcucuggcugcuggaacaaaucuugaugcugcaaacuagagcagauacggagauaagccuuguaucaguggagcugaaagcucucacauuuuggcauguucuggaaauuuuuucacagcugaaggggugaucugcagggagggcagugagcucggggcugucuucagcuuugggugaguuaugaagguauauuuuugagagcugaaucagacucucaaccguaagccuucuggaucuuacugaagucccaaagaguuauagguaguuugguccucacucucauacaggacaaaauggacugccugugcauugggaaugucagcaucugcuaacuagacaaggccauuaaaugagucuuccuguuucugcuucaguaauugacccaugaguuuagcucggaucaaggacauguggucuaagcuuggccauaccuucuguguuuuagaugggagagcuuccauguucauagcagcuaguacucugaucuuucugguuccaccucagcauacuguggggcaguucaaaauacuggagguugggacaccagcacuacuuccuuucuuagagccacgucaguuccaagcuucauuguaucucggccuagaucucccuuaguuugacucauuuugugaacgggagaaaaguacuuagggccauaucagauguuaguuuuguaaugcguuucucacuucauuugugcuuuaauggagcucuuggaccaaaauguaacugaugggacuuccaucugaccuuucucuuucuuuucuuaaaggugauggacagaaucuguuuacuaaagacgugacagugauugaaggagaaguggcaaccaucagcugccaggucaauaagagugacgacucagugauccagcuccugaaccccaacaggcagaccauuuacuucagggacuucaggcguaagugucugcccaccggauuagacagcaacuuuuguuuaccuauguguugucuugauaaagagauugccaaggccaccucuuucuaauuuaauguuagaugcuuaaaguuuagucaauucuugagagagaagaagagacgggcaaucauaaucuuucuacuuaauagaaaccuugaaugguccccuuuaaaagucuuacuuugcaauaggaauugauuguaguaauucaaggugaauugcaaucgagucccaaauacuuagcugacacaaacaacucaaauaggguucggcaaggaaaauauagcauucugauagggaaucuguuugguuuaaagagugguguuucuaaggcaaucuauaccuguaaugacaggaccagagcuuucaccauaaccucugcuguacagagauagccauaagcugaauuccauuuaaaugcaauuuaacaaaagccagccuuugaaacugaauuguauaugacaccaaaggcucacgccguugccauggcuuggcaagacaccucacugaagcaaguaucaucaugccuguuuugggcuacuuggccuccuguccuuccuaguauuuugggccauccugugggaaaaguugauaaauaagguggaacauuuaaaggacucaagaagggcccaugacaugucugaagugcuugucccaagccugaccuccugagucccaguccaaaacccaccugguggaagaagagugccucuccacaggguggucccauuucacaugcaugugcugcuaacagcuuuugcuaaaugaagaagacuuugaaaaacccuucucauauuaaacaagaagccugcauacaguacuuugugaugguucuaauuuccuuuugugggguuugaucaguuuuccacugggagguggacaugccuaaaaaucuauguaaccagcuacagccucuaaaagcccugccugagucaggcucucccacccaauucauguccccuaaauucauucagauguggccaaguuaaacggucuucuaaagcauguuuaaaauugauauuuuacauugaaauuacuuuuuuuuuuuuuuuuuaguuuucuuucaugauuuggaccaccuuguuuuuguuguuuguuucauuguuguuauugguuuuguuccuuuguuuuuggcuuugcauuugcauucuaaaaguacuuuuguuucugaaccucugcuuuccaccugaccuguccucccagccugcuccuuccuucccacuucacuuugccuaucucuaauaggaaacuguaaacaguaguguugaagaggcacagugccuggaauugccccaaguaggguggcgauggugcuguguguguguguauguguguguuuguguauguguaugccuaaguuuccuuaggucaucaggguugugugucugcaugcagcuacuacagaagccuaacauaguaccauacagauacagaaagacagaaauuguuuccauucuguggcugucuuucuagcaucugacguuuuuccuuugccuaguuaaggaaaguagauugucggucaucuuuugcacaaucacugacuguguucuguuucacagcuuugaaggacagcagguuucagcugcugaauuuuucuagcagugaacucaaagugucacugacgaaugucucaaucucggaugaagggagauacuucugccagcucuacacggaccccccacaggagaguuacaccaccaucacaguccuggguaagacaugcuuguuagucccagagccagugggguggcucgggcuaccaaauggcuuccaguagcaaggaagggguuaagagugggucucgcugcugcaacuuguuggagggagaaucaccgcccaucuugcugaauuuuaaaaauagccuauuuucccaaaugcucucagggauagcaaucagcugucuguauagacuccaccugcucuuggguuucagcccugaagcuucggaagcaaagaucaacaaaguuagagcccucaaaagagucacucaccacaugaaauggcaucagcuuuaacuaccccgaauuuuuuuuuucuucugagcauaagaggagaagaugggcucccaaaucuacagccacgacaaagcugagcuguccuguaaugaugcuccgucuaacgggcauccucgugugaauguggaccaucuuauuuucuuuggcucuauuauucugucacccuauuuauuacugauagcccagaucgucgugcuacagagcagaaagucacacccagggacaccagguuucuuguaaccaggugcagacgucaacaugaagcaacugagagcagggagcagcagagaaccauuggcaggcugagaggucgcugccacugauugaccauugucauuagugguccccagauugggcuuuucacugaaaucccgguggccagcgugauagguuugugcuuugauacggucaacagguauuucuccgcuaaagggucugagucugucacaguuuacacaaacauauacucugguucguaacagcagcuggucccaggguuuuggaacugaauguucaagggcauaacacugcagagugagaccagagcucugguuuacacccucaggaagaugaugaaucaaucuauuugaggcagaaggcugugacuuuuugguguaaugaugugaagauuaaagaagaaagauagauauaaaggacacuuucacugggugugugcacacacauguauuuaugaacaugcauauugagcugcuuccucguuacuucaguuaaacacagcuguaacgggaaaaauaguuuuaauucacuaagccaacgugugugcccaaagccuguguauauuuuugauaugaccaauuaugcuuuuagaaagucggcccuaaugucuggccacacaguuccuagcguggucugcguauagcuuucauuuguacgucacuuccugaugcaaucuguaggagaucuucauggaaaguucugggaagaguauuuugcuauugugcagaugaacuaaacuuaccaagaggcccuuaagguuuuccacuucugcuugucugcaagugugugaauagaccuuugugaauucaagggugcgcagugaccaucuaaauuugagcugccaucacuugcaccaucucugcaggagugacggcagggaaacacgacauacacgugacaguuugaauuuucagagugauuuuuacugccugggcuuuagguuucgaucuuuuaauuucauagaaacucugccaagguuacaaagcacacaauaagaauuagaaaucugaggaccuggggagauagcucaguucgugaaagaaccugacuucaguccuuaggauugagacgugauagugugcuuuuauaguucacacauuaaauaggcagggggauggucccuggggugggucugccucccuaaucuauuuagagaauccugagccacugagagacuugucugcguaaacaggguagcuaguaccagaggaacaauaucugaggucucggcuccacauagaugcacaugugcacauggauguguugaacauggacaugggaacacacacacccagcaauuccauguuucaggacauuucuggaguuuaacauuuagcuuucaggaacacaacuuugggaccauugucaagacauugcuaucugucagcugucagugucucagucacugggcugaccaguucaacugugcaaguacccugugcuuggagucagcuacccacauguaggcuucugagugguaucgugccuguaauccauuugaggucucauuauucuagaaguaauaggugccugcuuguauuucauugaagcauuaacuuaaguguacuugaaaggaauacuagucaauguucuuuuugaggauauuaugcauucuuuuaauauucuucccacugaaguuacuuuaggauuccuugacagaguaaaauuguugucaucagugugagagucuuucauauucuaagaucugacaauuuccacugauacacauucaagccuuccuccuaagguuuagaguuuuagauuuuguaaugaauggagaaugauggauuagcaucccuagugcucugaauaggauuccauauggacuuacacagcugucaaacuccuccauagguugaagaugcacauuuuagugcauaugacuguuagcuauuugacgcauucaacaaaaacuuuagcauaauuauaagauacaaaaaugacuguuaauguuuucuaugcuauugcauuguguuuaggucucauccauguguaaaucaaaaacccuccugugaugguuucuguaugcguugugggccuuucauucaguccuuccacuugugacaaguuccuguccuuauccacacacaugauauaggauucuuucuauuccuuauauuccuuucuuaagaggagaugaacaggagagagaagccacugugccgagaugaaugcacuuacuguaaucguggcuaacauuacuacagccccauccuccuaagaucagugcucacucuuaaggcuccgggaacaggagaaccuaauuauuuuaaagggucuuagagugagguuucacauacugaucagcuuuaagucuccucuuuugugguaauuaaugugacucaucuugauauugcuuauuuuuuuucucaauguuguaggcguaauguuuauaauuagcacucuuauaggcuugagguuagcuaacagguaccuugacauucggggcuguauuccccgugugugauuuuacucaggguuuccucugcgugcuccuucucagacaggucugugcuuguucccacugauggcugcaggcaguucugacuggcuguuuguaucuguauaguggaucguguauauguguucucuggcuagcgacaguuugaauucauuuuucuagaauggauuccauacuuuaccucuuuuguauuagaauagacauugugaagucaggauggaguuaaggagaaaagugggauagaauuaauaggccaaaauacauuuuccuucuccaaccuucuguuuucgggagggcaaguuuaaaucaccugaucuauauuguccaauucuucauugcucuuuaaaaguccaagaaauauagaacucugugaguggaucuaguucaaaggaaguaggggggaaaguccgagagaugugucuuuuuagcaccaaaagagauacaaauaaucaaaccuuacccuuguaacuagacagccccacucccacuugcucuuucuuccucugaucucagccaagaggagcaacacugcucauaacucugagaaaacuaauucugggcuuggggacaucacugggcuacugcuucucaaaaugaugaccucagcgacacgcaagcccauuguguguguacacagggugugcuuucuagcuuuuggaguuuuccacacgauucccuuggcuuaagguaaagaagaugccagcugcacaggaggguaacccugggaaccagaauuacgcaauuacuugaaggucauagggacagacaguggaccauuuacagcagaggugaagggcacacagcuaagaccagcaguggagaaagccagagaugaacuuuaaccaccugucaagcuuucagcccucaaaccaaaguugaaagauguuagucaucuugucuguccuguacaccugccuguuuuuaucaccuuacuuugauccugaacuccuccauuccccuccccaucuucucuccuacccaguucccccuccaugugccucuuacgacaauuuuauucccccuucaaagugagauucaagcaucuuugcuugugccuucuucuugcuuagauucuuuggaucuguagaguguagcauggauaucauauuuuauggcuaauacccacuuauaagugaguacauaccauguauguccuuuggguacuggguuaccucacucaggaugauauucucaagaugcauccauuuugccugcaaaauucaggaugccuuuguuuuuaauaguugaauaauauuccauuguguagauggaacacauuuucuuuauccauucuucaguugagggauaucuagguuguuucuaguuucuggcuauuacgaguaaaacauaauugcucaauuauaaacauaauugaacaaguguccuugugagauggugaagcaucuuuuggguauaauuccaucuuacauuggucagaguagcuaagaucaaaaacuaagaugauaguacgugcuggugaguauguggaacagagagacacuccuccuuugcuagugagaauacaaacuuggacaaccacuuuggaaauuaaguugacgguuucucagaaaacugggaauaguucuaccucaagauccagcuacaccacuucugaacguauacccaaaagauguuccaccaucccacaaagacucuugcuaccaaaagauauucuaccaucucacaaagacacuugcucaacucuuuccuuacuuugaauuagcagacauuuuuggugaugugaaaggaacagacacaaucuuuaagaccacauagaggcaguaaaaguuuucccccacgaguugccacuggcgaugguuacaguuugaacgugaauugucuguuaaggcuuuauguguucugggcuuuuucacgagcugccaugcuuugggaaagugguuaggucccgaggucucccaccugaucagcaucugugauaauaugauaauaugauaauaugauagcaucugugagagaguggcuggggccucccugaaagcaauguccaugggacacacguccuuggagcuacaucuuccugcucuggcccuucuagguccguucuccuugcuuccuuucugccaugacgugagcagccucauccucuacuuggcuucaucacugugcagcuaugggccccaagacagagcacaggacuucugcaaugaugugcugaaaggaacagucacccuuaggaaaaguaacucggaaagaaaugagugggcagggaaggccaugagaggcauccggggaggaguuuugaugugucaucagaccuaccaucugaugaaagugagagaauaagcauaauauacccaaaacacagagcacagccgacagacagcguccauaccacaugccucuacgacuuaguaucuggguggcaucucagcuaccccuggaucuguucccauuaagagagugccugcauucugagugcccaugaccguguuucucaggaagugggagaaauccuccauucagaggaauuccagcauuguccguguggcuuuagcugucugcccucucuuggguccuuaguaccauacuuggacaaugacauuagugauuauugcucucaucaggaaaugcccagugugccaacuucaaggaccuuuucauccaguuguuaguuccccuggggaccucaaggccaccucuucucuucugggcccuaauuugucugugagaaugcucuauggccuuugacacccuagucuucuuucucccucucuggugcugucacuucccaugaucuuugucccuuaggcuuagugagugguuuccaggacaucuggauccacaggagcaugucucccuucuucguugcuagcccggugcccagaguucaagggcugcuuauucccaguaccuacuguccauggcagucuguggcccgccuggccaucauuugcacaaauaaaccauguaaaggacacagccaaaucagcccaauuucucugucacccccuuuuugggucuuuaaaaauugcaucagauguacccaucuaaacugcauguuaaauugucuccuacuuaguuuuuaaaauguaagccagggguacuucuuugccacaaguaaguaaguacucauuugggccagaccaugucagcaagccaccugauugaacaagcguggacuuuuuuuuuuuccucaugcaaggggaccagagagcagagugccugcuccagcagcugcccccucccugcugccacagugugccgucuugcugagaaacacaugcaacaaaccguuuuguuuucccccuuuucaucagccccuagaagacuuuucaaucgcucuaauucaguaugaaagucuuccuguggacagaauuuucacauuggacuggaacaguuggaaaucccaaauaacaugguuuaaucccauaauuuauugaagccguaucagagauguauuauucaacuugauggucaggauggcauguuuauacauauuuaauuucuuguuucucuucugaguugagaaacuuauuaaucauaagucucagcccugucuuugcuuauucaugguggccagggcucguauucuuagacucacacuacugaauucuguauucuuacugauuuuuauuucaggaggcucagucuugagguaggacgacacauuguaugaaguuucaccuucaacuuaguuucauuuuuuuuuuaaauaaaaaagguagcuuuagucaucaacuucacuacugucacacacagaaccucgauuguugucagugugucagcccccaagccuuuuguuuuaacuacuuuauuacagagauauuuaauaugcucauagacaaauguuuuaauucugauaucugagggccuuucaagcgccugggagucucuuucuccuuugguuccugagaucugagcuuugggacucugaguaugguaaaugccugcacacaccuggcauuuccuguauugucgagcauucuuuucagugaugcucugcccacuagaggacaggccugugccucgacuucuuucaguccugguucaguggagccggcuccgaggcguacuuuuuccaucaguguuuguggugagugguucuucuaagggaccccgagcuuuuuauccuuguuaguagacuuugaagucuuuuuuuaugaagauugaaauccaaggguugaauucaaggagaauuauugcuuucaggggcuuccagguaagggcguugauuucaauacugucugcuacucuugauuuuauaucuguucccuuacccauuuucuuaugaugaaugucuagacuguuaauccucagucagugauaauucaggaaucggagaggucacuggugacuaacuaggagacauuuaggaaagacauucugaguuaacugaugaugccugauccaccuuacaugacauugucuauccaguuccuccccuccucuggcaguuugucaucuggaagugaucccaucagcagugucccuugucugccucuuuauugguaacaaugacacuggucccuaaggaagaggagaaucuguccuuaaacaggcccugugcuuauaaagcauauguguuuaauuuguaguuccuccacguaacuugaugaucgauauccagaaagacacggcaguugaaggggaggagauugaagucaacuguacugccauggccagcaagccagcgacgaccaucaggugguucaaagggaacaaggaacucaaagguaugauggagaccgcccaggcaugaggcauuuagcuggcccucaacucuaucuagcaaggggcccuuugcggaaauuacaaacaguugcuucugagccaaaacuauccauucagaucugguuucuaaucaauuagcaaaaacauccgaggcggaacggaauggguuucuuugccuucucucaucuccaacccuguguaguucgagagcugguggugaaccaaauaugaaugcuucagacaaggaagagccugugucagagauauccugaagucugaggcuguuucugucugugccucaaaauucuaucauguuuuguggugacuugauggcucagaaccccacauuuucaugcugugcauuuuuguaaaguuccaggccauucauucuaacaugcaucgcaccguccuucagcuguagguaugugcucuccugcaagaccguugcauuacaaaguaagagcuuauguuaauuaugaauuuacagagaugacuuugauggugaacauguaauucugaugcccgauuugccauccuagucuucugcaaagucucugacuuuggagugacccuacaggcagcuuuuauggcccugggcauuuuauauugcuuauccugucucucacgguuggcagccuuuggcucuguuucuuuucuagguugcccugaaaguaaugccugaacaaaggacucuggaacucaccucuauuuaacagaaauacuuagccaugugcuucaguucccucuaaaaaggaaacaguaauacuaggguauuguuaggaggaucaaaugagugaauauuuacaaagcaucgaggaagugccugaagcacaguaagugcugaacgugcacucauuaaauaaauaaauaaauaaauaaauaaauaaauaaauaaauaaauaaauaaguaaacagugcgaguggaguggaugucuauauccagaaaaggagaccagcaaaccuccaaaagcucacuccgccuuaaaccccuccuuccuagguaugccuuuagaagggaggaguuuuuuauuuccccucugcuucugucuaagugaauugagccauuaaauguagacugcuauguacaaagcauucacagaaaguuaauggugugccgugcuuugggagugcugggugcaggaagggacggccuaggccuauucacucccuccggaagccuucucccuccuuuucugggcguucuuggacuugucucccaucuggcccaaagcccuaugucuuucuuugcucuaacccacugccacugcauuucuuguggucuuccagaagucuccaaguuuaaacauuucaauuacaauuucaauuagauaaauccauuuaguuacuuuuccucuuaaucaugggugauagggguaggcagugaggcuuguuuuugucuccacugcugacggaauuacuuaggggauuuggacuucacccuggguuuucaguggcaugacagccuuguagauauuugaaguucucaugguuguaggagagaaaagcuuauuuuccuuccuccuccuaaugccacaggcagccaagugucaaaaugguugaacuuuggacugacuuggcaggaagguucaagauagaagaaauauacauaauauauuugaauuaaacuaguguguauugccuagcuuuggaauauaucuggaccacuguuacacaaggaugaaagaaggaaacuaagggaaauaaccauuguaugaggucucgggucccagaucgcccugaccuaugacguugccaucuuguuaccuaagguaacacuguuagggguggggagaaagggaaaggaugaugaucugcuuugucucccgcaggcaaaucagagguggaggaguggucggacauguacacugugaccagucagcugaugcugaaggugcacaaggaggacgacggggucccggugaucugccagguggagcacccugcggucacuggaaaccugcagacccagcgcuaucuagaagugcagugugaguagccgagcaccuuguuuugaggccugugcuuggaagcuccuucccuugaaguccguaugcaaucuguaugguguacgaggguuguuccucuguuguucugguagaagagugaucaaaagaucauccugcugaagggcuacuguaauaccaagugccaaugagaacgugaagauacugcggccaacucaaacaugaagcuaaagcagugccagucugcuuuaauguggcuuaaaaucggcuucuuuccguguucacugucaucauuccugggccaacaaagucuucagugauucccccucccucucuaauccaccguaaaccggauguuuacaauuuuauucccauuucuuacuaacauuuuguucuaagguuuauguucuauguagcuuuaguuagaaaaagguguugaaaguuaaagucgauccguaauucugcacgguagcgagacugucccuagccauccccuguaaaccagagaagagggucuccuugucuucuccuccaggcccuucugcuucagaggcagaggguggagggaucuuuccguccaaagccgugcuccauccaagacugugaccacaugacccucugcucucacuuuucuccagaagauuccuccuguaggcuggccuguggcgguccgaggauacaguggaaugggucuagugggugguggugugaggauuugggugggugagcagugauuagggaucugauuggggaaaggcauugccaacugugggaguucuuauguuagugccuuagggcugccaugucaauuggcagugucacagaccugucccaaaaccacagagauccacucacaauucuaaauaccaaaggagcaaauugggggcuuauuugggccaccuucccuccaagaccuuagagaguccuuucugcuucuuagauggcaagugcucugcgaauuuccccaaggaguuagggcagugcuucucacccuuccuagugcuaugacccauuauguuccucauguuguggugacccaccaacccuaaaauuauuuucauugcuacuuuauaacuguaguuuuugcuacuguuaugaauuguaauaugaguaucuguauuuucugacggucuugggugacgcuucagagccuguugccagccaucauucaggaggcuugggugucacauaagacacagugucgcugaguuuagagcccacccaaaugauccagaguuuucucaucuuaagaucuucaagacugcacgugcaaagugucuuuuccaaacuaggccauaugcauggguucuuggggcuugaauuugccuuuggaagccauuuuucagcugcuacccuuuuuauuguguauuuaaauuguccaaguagaacaaguuauaaacuugcuuauaagagaccaucuugucccaaccucuucuugcccuucgagcauggcucaauuuacauuacagaguguagguuuuucuuguuaauucauuuccucuacuucauuauauagcuucauuaggagcaucaugcuuauaauuuucauaucacuaaaacuauugugguguaaugucccuauaaugggaaaacagaaaugaucagauauuaucuaaauuggcagauacuagauuucuugugacuuuguuaauauguaauucauuuaagcaaacuuaauauccauuaacguuccuuguaggggcccauuagcuuuaauaauacauuagcuccuuugugaguccugaguggauauccacccaguuuccaccccuaaacccuuuaaguaguuucccggaguaucuuuuaaauagagaauagccccucccaccuacaaaauugcauucacugccaaauacagaauauuucaagccgucugccuccuacccuggaaaaugugguaaugauuccuagccuuguuuucauuuucuguagacucaaaagggauuuguccuucaaggaaaaugaauacaggucuguaucugaauccauuuggcuccaaucuaacaaaaugcugugggcuccucucuucaggagaggcacuggaacaccuuccaaagaugagacugcagcuacugaucauuucaucacgacagccuuucccucaacuaaaauuauauaaacauuacguucuugaugcuuuuaauagauagagagagagagagagaugaaaaacaucuuguauaaaggaagguuauacauugcagcacuuuauauaauucagaaagggaauuggggggggggucuaguuuucuaucuuaauuaagacucuuggaacuuaagaaagucaccuggcccuucagucuaugaauaucauucuauucccagaucuguguugugcuuguggaaucagccagcaagucuucguucccaaccaacaugagucuccuugaacacuauuagcccuucccuaucagaggccuccugcccccaaggcuccggugccuuaggccccaaguccgcucucagugaguggugggagcuuagcuccagucccucacagcgguucuuucucuacagccaggcaucgcugucuaagggaaaggauaggauccuucaucuguguagacacugaguuacugagauacccagaaggaauaacagugcacuucuccccuccuccccuuuaaguugacucaagucccugaaguuaucaccuuuauagggucacuaaucccuaaaaccuccuuuaauaucaguacacugugggguggagaggggugaauuaaaucaaucaccacauuuugcuugcaauauaaggauuucaucugcccaauagaguucugcuaauuucuucaaucacugauaagaccuauuuuccuuaggccacguuauuguuugaaccugacuaugaucuguauguuaaaagccauaaaauuauguauuuuauuaugugauuuaaucuaaaaaaaauuaaauauaccauuguucuuuuuaaugucaucuccuuuguaagcuaagauuucuucaggauaucaucggggaucaacagaaucaccaggaaauagugaccccacagcccucacacuguccccaguuaggaggcuggaggggacauuggucugaguacucuuuaguagccucaguuguucucauccuggccaauuuuggacaaagaagguuuaugggaugagcucucugccccaucuaagauaaaugcaugucaccaggccaugagcagagcuaugugacugguggugaaaucccauacaagcuagggucuccuuuacaaaugguguucagagggaaacgaaauuucccucacugugcccguugacuguccuacuugaaaggagacagagggagaagccguaaaaagaaagggaggcauguacgucuucccuuaagcuggaauccuccauguugcauaguagacaagauuugagcugugacugggccuggcuucuuuugugucuuguggauucaaguccuaauuaauugaacuaguauuuguaguguuuguuuguuagcaccucuuauuugugguaccaggagaaauuguugugcccaauuaugugaaaaaucagccagaugugugugcugucauacuuuuaauaacccuuaaauuuuggugaguacagauauuaauuguguaguaugcauugaagugauuaacaucaauguaauuuaucaucuggagauuucugaacauaaauaaaugaguuguuuuguugagcaagguguugaccccuccagaaucagugaauuaaaaguucccccuccucuuuuuuauuauaaauaugaaaggcaccacagucagccaaguguugaguuauuugauuuucuggggcauuagccgcucuuguuugugacauuccccuguugggugcucgcuugcaagcucauuaauaagguuuucucauaggaacauugcugggaauguuguaugaagaacauacaguagggcucuugcuuugcuagcuuucauucugaggcccagcaaggguacagcagcaugcagcuaaauguuuaaaacagaaaauaauuauguuagcaagguagaauuccgagcucugcauucuuagaagcuacgcagagaacgaacgcuugugcuuuuuggaucugcugaucuggaugacccuaaaguccuucugugcugcuuuucuucuuccucaucuugcaaacgccuuguagguguguuacgcagcuguacacggcggcugauuagagcagagugugauucuguccuaaaacuguuaguacagcuucagcucugaaggaaugcgcuccugucagauaacagccuguuuaaacagaccaguucacugucugugugcuaaaagaaaccugucuaaauagcaucaagguggcaacacauggcgacauaagcugggaauucaaagggaaguugugaccuccaguauggaauucugagugcgagcugaaggaaacaaagccuugcucuggacacaaggcagccugagcugggauuccugcugugcgccuuccgucuuccccaccagagccuugcucuuuagaauguuuugcaaaacauccucauuuuguucagguuuugcccauuuauaaaaagagagaaacaaaugaagagcugagucuagaagggaaaaaugaaaacaaagcuuccagaaaccgguauuagagcacuuccccgcccagauuaccaccugacagcuaaucacagacaugggcaugacucucaaaaugaguuuuauugacuggguguagccagguauuuuauaaauccauauccccauccauccaaggucuagagaaggguaggugucucucccugcaucccuaccucccauccccucaacuagaggaaaauugggcauuggagagaugaucaaaauuuguucuuuaucugugacaaaaugaauguuucugugauauugauagugcccuguggugauggaggaugaaaaaccuggaaauugggaacucccuccuguuuagacuggaggauaaagcuucccacagcaggugcuuggcuccucccuggcucucccagguuaauucuguucccagguuguauucuuaaagugaaaacagcuguguucucagguugggccaguugcuaucuggucucuguguucuguguccagcaggcuccaguguguguaucaaugagcuggguucagagagguuaucuuagugauuauuauuccuuaugagaaacaaucaaggcagagagaccgcugauugaagcccaguuuguaaccuagcauucuuugugcaaggccagaccagggacaucuuggaguuccuggaguuuccauggacuguggguaauggagcccacaggaccaaagcaggcaggguugggcaaguugagaaugaucccugggagaaaggccuuugccuuccuuagcacagacaacccagugcugcugccccugaccuuaguggauaaaagauggcucugguuugguguacagauccaguucuuacauagauaguaagcucgucuccuaauguacacccugccugauggcuuuuagcucaccauaagauucugauucugugggaagguuaaacgauuucaauuuaaaaagaauagucaaggaaauuucuugauccuaucccuagagauuccagaaaugccagguaaccaugccaaaaaaugcagguucaacagucaaauuaccugggcugcuccucaaacuuggggaacuggcuugaucuccaaaacagacaaaccuacagacuuaccguauuuugaggcuaagacagacuuguguauuuguuacuauuguaccuaguggauucuuagugggaaauagcauugucuggugcugcugaugcucucuuaaguagaguuguuuuaugcccgucuuaaucuuuuaugauagccccucccucuucaagaaguguaguugguugguuuuuuauuguccuuucuucuuuccuuuguuuguuuguuuguuuguuuguuuguuuggaggcaaaugucucacucaguaauccaggcuguuauccaacucauggaaauccuccugccucagccucccagcuguugggguuacagguagugaguauaauuuuaagugcugcaaaccauaccagacaaagaccuuuaaccuagagagcaaacaaacagcuggggaaguugucacucaugucucaggacaauaggaaggaagcacuuuacagccugccccuuucccuucucugggagcucuguggaccuguucccagccagguguauguagucuccuugggugcccuacauugcccucuucucauuacaaagcugucuuccccggcacuuuagacaaccgaauuguaggagcugauuuuggcuuugcgcucaaacagcuucuaauacgaaccaaaucucggguuaaucuuugcauuguuguucuacuccacacugcaguaauccuccaugauugacagacuccucagccagccacugcuuccugcaagcuccagugcacagggacugacccagacccucuccuagccagacugguagcagccuuaacugaugcugcccugagggguggggacugaaaacgugagcccuugaucuacaggcgccaaaccccacacacaguguguuucugaacauuagaugaaaaugaaacauggaacuuggagauuugcacucaagcccuuguaguuacagguagagauuuucaugcaaagcccuugggccugguuauaguagccaugucaaagaacauuugaugucagcaugcccugauuuagaacuucuaggaaaaagagggaaaguugcaggugccccugggauaauagcucuccugcugagguaucaggacacacacccccccccccccccaggccucaguucuucugcucucugccacgggaaagacggcauccuagucaaagggacuggggaccacagaccugauaugcuagggucaggcuucugacaggagccugcgcgucuucauuugcauaggaaauugacauacagauuacagaaucuugaguuucaucuucuaagaagaucacagaacagagugcaaggucagacuggcaugaaaucaauuguaaucugccagcaagccauucagaccucuuuaagaguuuccuuuauauuuuccccuuuauagacagagggaaaguacauuuaaggaaugucucaucaaaucagaaugccuuccuaaaauuauuuuuuuaauugguugcuacuauagugugcccuauggccuccugguauuuaacccucugugcaacuuugacuaaugaacaaauuuugucggcuguagcagucuugcuaaguguauuguagaggguuuaagagaaauuacaguguauuaugaaaaccucagaucuuuccaccuaauugauuggcuguugcugaugccagcgcuacaagugugaugcuccuuaagugcacaggccuaacuauuuccuuauuuuuuuauagagcaguuccauuuuauaaugacauuaagccauucugagggauaugucgcuggacaguuaucgcacuuggguagaaagugucgucuggcuuuuagccuugcgccugacgacaccaaccgaggcguaaaaugaucccccagaaaauguacuaggcuuuaccucauuacucaaagauaaaacuuggagccugauucuguuucagagaagauuugguaaguuauaacauuugauuuaugaacauaauuaaaauauaaauggugagcucuugcucugcagucaacugucuggaugguuggacauuuugccauccuccuauagcagccagggucuuuucugggagcacucaacgccccugagacaucacuggaauccccaggacucuguuccaccugcugaagagccuuacguuccucaguuagggcagagcaaggagaugagacuugccuucaaguuuccugucgccucggggauagaucuuagaguucaggccuucugugugguuuauagggaaugaagacagcucggcugcccaugggcagauaauaugccauaaauacugugugugucuauggaaagggaacuuuucuauauaauacaggcaauauugaugugcgcguuuccugccagccauuaaggucauguggcagcuguguccacacauaacgugguacaaguuuuccugggacuggaccauaaucagagaaaagaaaucaguuaucaaaacugaagguguagcuuuuguggcuuaaaauacaaauuuuaggugugacaagcccuucacuuauucuuccugauuggugugugauugacaacuaguacacauguuuuuaaauauguauauauauauauauauauauauauauauauauauauauauauauauauauauaacgaaaacaaacucacugguuccagagaggcaggguggacuagaacuguuccugcucucuuauuacuaauggaagcugagcauggaaagaccagaaugcauucucuggaaauccacucuuccaguuugcuuguaaauuacacagaggagagaaacaauagaaauuuuacaugcaggccacaaagcauagaccagcaacuccagaccagaaagaaagagcagcaagcacacauuaguagcacaaaccaaccagugcagacuaagagagcaagaagcaugcucuggcaagcacagguagcaagugcagaugagcugcugaagucagcagggcaugaaaauuaaccuauaaacaaacaguaaguugcugcccagauuugggcuccauguuuaugucagaaguccccuaagcaagaguucuuggaugcuuuuugguuucugagugugaauuauuagacagguuuuuccguuaucugugugucacaaccucacauucauuucucuuucuccuuuuaaaacacaaaauuucaucaaauagcuacgugccaggcagaagaaguuguaucacuaaaaauaauaguccugcagugcacucuagggcucugcuuggucugagauaugaucuaaacaugguuguccaggagcucuugauucagccccggagccagagcuagcucaaggucacccuguuuauucuaugcaaacauuuccuccuuucucugauaacauuuaucaggauccucaacaucuuccuuugccuguaaguccaagaaaaggacugugucacuuggcaguggccauccgggucuuuugucaucuuuauguccucugacaagugaauauuguucuucagaaaacagcaccuauuccagugggcagugcacacaggugggcguucagggggcucuuuuaaaaggaccguaauaucuugugugacauugcagaaggcaugugguggaaucaagacuaaaguuucaucugguaacagcuguccuaggcggggugucccaugugaugacuucacugugcagcggccauagcugcaugaggggugagguuggcagagccuggccauauuucugucuucucucguguuccuuaggagcaauacuaaugagcccaccacuacuugugaaaggccaaggggcuguuguuuaaguggugggauugugugggaaaguaaaacugugguaauuguuuuaacuucucagccaacugauguccugcccucucacacuugguacuccuggguccguuugcaaaaauacacauuuacagagccacagaauuaaaugagaagcauaggaaaauaucugauuccacucagguucuguuuagaaaugucuuuguguaucuauccauguugauucuaaguacuacugcuucccucccuacucccuguggcccuccgucauucaucucugguacccaugcauccccucgcuagcagucacagcuuuaagccacugaccgaagugaaaagaacuugugucacuuccuagaaugcacaacucuauuagaaagauauacucugcuuuaauuguggacugccauugagaaaugcacuucagaaucagaacucucccccacucuauuccacggagcugucuggaauuguguuaucucugagaccuucaacuagcugcaucauucuauggguaccaaaguuaaaacucuugguuauuccacuaugauugcaugguuccucagauaauaggcucgggaugaaugucauuucucuuuccucuauguuuaugucaggauaguuuuauuugggaccacccaucucuccuggaucuuuucuucauaaagcaguuugaguggaauucgggaaacaguuugauagaaagagcauagaagagauaacuuauuaauaugcagugucaaaacacauugucacaugguaauaugugugauauaugauaaaauauaucaauuuugaacaccacaaaaaucugcagcuucaccucagcaugaaggcaaaugaguuucccuuagcuugacugaguuuagagauaaacuucaauguaacaaaauguauuucacaggaauuguuugaugugccacaguuggcuuaugaaucucuuaucuauucaagguucacuccuuagaguuauuagucaauuuaaugugaacaaaugccaggauuacuaacuaauuagaaggauguugcugaaggcacauggauggggacagaguaagagcuggcggugugggcuuugugacaggaugcgggucugaucugccugaugcuaucguuugcuaaacaccgugcuuuguguugccacacagauaaaccgcaagugcauauccagaugacuuacccucugcaaggccuaacccgggaaggggaugcauuugaguuaacgugugaagccaucgggaagccccaguaaguucugaaggccaagguuggcagagggucgugagcaguaaaugucacaacaugaagaugugcauucacagcucauuggccugucaccugucucccaauguaaaaaggaugggugacuuuucagaaaacgaagaauauucaaugacaggggaauaaauaucugugauucuuagugguuagaauuaggagggaaugccuuccuagucuaaaauucuagugaauucugucuguauuagugucauuaacaggauggccagggcaauucauucucucucucucucucucucucucucucucucucucucucucucucucgguuuuucaagacaggguuucucuguguagcucuggcuguccuggaacucacucuguagaccaggcuggccucgaacucagaaauucaccugucucucccucccaagugcugggauuaaaggcgugcgccaccacugccuggcggcuauuuucucuuacaucaaauuucaacauacugggccuggaaagauggcucagcaguuaagaguucuuacugcuaguguagaagcucuaaguuugcaucccagcaccccagucagguggccuacagcaagcauuucucuccagcuccagggacccaacguccucuucugacccccacagauacccacauaugugugcacacacacaaauaaaaauggucuaaaaugucaguauagucucagugcacuaggaugucugcuaacagugguggacuugguacagcuggaagauaagguuuucuagacucugaugugcagagguugaggccagauguaaggcaaaagaauuugcuuccaagaaaagcucaguacucaacugagagaugcagggaugcucccaugggcgaaugugacuguucugccuaggagaaagggaggccaacagccuugugcugcugaggagugaugcucuacuuaccacacaguaguccaaugugaggcagaagggcggcguggaccaccacuaacacagccaacaagcuuugaggcugugcucccacaaguaccucacagucuccuuagacaagaagagagccuuucaucuuucuaguaaaacaaauuaucuuuaacuguuuuuaagggggggggaucccaauucacagacugaugaaguggaggacaggucaaguuggaauuaaggucacucaaacuuuuagugguaccaaaccagaaaagcagcagugagcucccucugcugucccuguggcaugauuucuuucuuccccucacaguucagguaagcggcaucuuccugauuuuuauauaaagaccuuagagcaucuucacagcuucccucccaguccuuagagagaacucacccugugacagcuauggagccaaaagugcacuacguuugagaggagccuggcuauggccagucccuuugccugcuucuacucuccuuuauccaggggcuagggccuucccucugcuagaggagggagagcucuaaagauaaccuuuggagggaggugggucugguucuguuuugcugcuucucugcggcugguggcuuauuugaucccagcuuugacagagcagucuuuuucucuuuuaagcccuucaaaaagauccagaucauuccuuuuauaaacugauuuaugcccuaauuagaagcuucccuugucucuccaaaaucccauggguggaggggaacccuucucagggccucugacuguuuacagcaacugcauucaaccaccuacgucacauuuauguuguuuggauugcuaaccuauauuuugcgucuguaauuuuuuuuucuccugaagaagguacuauguucguuugccugugccacagggacaguaaauuacauguuuccuucaggacauuuuugccagagaggguauuuguucguuccucucaaauuggaaagggcauguggcugugugagcaagcaggcauuacucggcaacuagcccuccuugcauauuaccuauuuauuuucucaagaaauuguauacaauaaaaaugguaauuuaacuugccauuaaaugugugaauauucucagugcuuacccccacugauuguuucagcugucaagcagcaggacgcgaggccugauugccaggcagccccauuuuccacugccuacaaggaggacaugugcaguacuaccugcaauaauucaccgcauucugaugacaaacccuuaugcaauuaaagagacuuguaaccucccaucucuuuugaacaguggaacacuacuuaacaggccucgcuuaagugucaggguggcauuuacaccugagucccugcccaugucgcugcuccuaaagguaguaguagggaccaagagaggaaugcuaauguguucaggccaguagcauccuaccugucaaauaaaaaucaggacugaggauauaaguguuugccuagcauucaucaggcccuggguuccgucucuagaaucacauaccacccaaaagaugauuuucagacacucuagguauacccuugguuuuguaggaggaugaaagagucaccuucaagaacacagguuucaaguucagugagugaaagguauuuggugugugugcacuccucucucuagagcaucuugucaaauuugcuuuucccuaauggcuaugauaagauauguguaguauuuuaagucacuaaaacuuguuuuugauaagcaaguucccuuguuggaccuaaagagucuauuuuaagauguguucauucaucauuaauccaagagccagaugcacucacagggaaaguccagcuauaucuggcccuagaggagcuaauagagagagggccaguuacuggccaggggcagauagagaagguagacagagccauucacguggcaucucagguggggagagucaggcuaaggggagaggaagugauuggaucuuuccagaaucaaaggugauuuuuccaaacacagauuaaaaauaaagcucuguucaagccagggcuguaaucucagcugcucuggaggcaaucaggagacucacugcaauuucaaggguagauuggucuccauaccaaauuacagacuagcuagggcaaccuugagagcaaauagaaauaaaagaaggucaaggcuauaaccuagcguagagcuagcauaugccaguauccaccagagaaagggacggacaggaggagggcugauccaguguaaaacucacacgugccuucugagcaagcaaaugugcaguguauuaguaaccauugggcugaugcguguaccguuagccaagaccuugcuuuuuuucucccuaauuauugagaugauuaacacugggugagcucuguccugccugagcuggugugaaaccgcacagcugggcaugugaguugggcauguuggcuuguuugcugacuuacuaaaaacgacuuagaaaucauaagacuccugcuuauaucaagucuggaaagcuuaucaauagcugauucugguuuuuaagaauuauaugguagacauguuugcauagccuuaguuuuaugaauuuagcaucucucucauggguccaguuacuugcaucacccugcaugggauucguuugccgcauggguuaagaaacuggauacagauaccuuagugggaaaugauucucugaccugucuuucuugccuucccacaggccugugaugguaacuugggugagagucgaugaugaaaugccucaacaugccguacugucugggccaaaccuguucaucaauaaccuaaacaaaacagauaacgguacuuaccgcugugaggcuuccaacauagugggaaaggcucauucggacuauaugcuguauguauacgguacgugagaagauacagugcucgcccacucacuccucugcauguagcugcugccugggcuucaccccaaagccuuuggucaaguugaaaaccaaaaaaaaaaaaaaaaaaaaaaucaguuggucuccuucaggaacuuaaagaagccuggccugagguggaccccagugguccccaccugggucgacagugacuguuguucucucccucugaucguggggguuccccacaagaucauagucucuggucaugcugagaaggaaggcuguccucaggcacaggccauagagcuuauguuagaaguagugucugaaaaauucaacccuaccaauuaguggcguucagccgagaaaguuuauucccaguggguuuuuuucccacgaugccugggcuagccuuccuccugcuuugaugagcagagcuagcuucuuuuccacaugaagccauuaaguccagaagacucugcaagucaguaaacucuccaaagaaauauaagguucuugguuuacuugcagagaccaccuacaccuucuguuuuagacacaaaugccaacuuuuuaaaauaugucuuguuuucuuaacaucuuucuacaggguuauuaaagcauauuacuguuaauuucauuuuggaaucaacagauauauauauggaacaccuauggugcuggguauuucccguuuauaucuugcuguugauuuuacauacugugaauaugcucucuuuaguugagaacuacacucucuuuauagucuuaugcuaccaaauugagucucuucuguccaauugaacucucuucauucuacaccaagaaauagucaugcauuggcccaacacaaaaugaguacccagaggcaaaaguaaaauccuaauguuauaaauauuugaauauggggaccacgugucugccuucauauuagcuuuguaagcaagccaaguuaaguuacauguguacgaauauaggcacugacacauacauuauacauauggaauaauauuugcacugcacugucucagaaccuguggauccuccucaugaaggaagaaaggagagagguuugaacagagacacauccuuuauaccaugccuauaugaauaugaaauuauaauccuuagccuguacuugaggauucuuucccauagcacagugauucucaaccuuccuaaugcuguggcccuauuugacaguuccucauguuguggugacccccaaccauaaaguuauuuuguugcuacuucauauuauaaauuguaaugauauguaggauaucugauaugugaccccaaagaggucaugacccacagguugagacccacugccuuuacauaaugcaaaauuaaaagauccuaucaaauuccuauauuggcaaacgucuagucuuuguccagucucauuagugauccacagacagcuauguucuccuggggaguuaaggaaauauacaaauauccuucucugcuauauagaugagaaaggacacaaggcacccaguuuuagcaugcagaacugcccuguugcacugucuggccgggauggaagauacauuccucucugugcuuugcauauacccuuuccacucugaggcuuaagccucaugggagcaacucugacauuagcgcccaagucuauagacaucaguauagcucuuuuuagagacuuuauccacguucucccagucuuugauacacucuggagacuagauuaucuggaaaaacaauugagcuuacaguacauacuauuccuacagcucaagaggagaagcauuuuugaggccuuguugggcaaacguauuugcauaauuuggaaaauuagcuuauaaccagcauguguugagcguucccuucaugcuguuucuggcauugacaguuuuacacacucucaucugauguccacaacaccaccaugauaugugcuuauuuuccaucccauuugacauacaauacagugaagcuucgaaagaucauacaguguagucuacuucacacugaagacugcuuaaggccaccauacugugaacccaaugccugcugcaagguuggucuuugcaauccccuguuucucacagauuuucaagccaagucuuuaaagugggccuuuuuagauuagcguccuagauauuauuacauuauuugaaaaccaaguauuguaggagcccaccuacuuagacaaacacaucuguauacaaguguaucccugauccaggaugauccaucuagccuccuagggauucucuaucucuuggucccugcucagagcaccauuggaauggcagacuagcauacuaaacugaagucuugcuagucuaguaacaaaacagucugacaauuagggcagggaugggcagauagucuuuucagagcaauaugcugcgauacugcagcaguuuuuuaaguacucagugaacuaaaaguugacacacuuggaaagcguuuaauucucuggaaguaauuucucuacuugaagcuucugacugucucuagcccaagucccaguuggguuuggucuucuagcauccguauucccagcacagcuuauuuagcuucagcucuuuguguuucucccuguuuguuguaaugcugcauguugauuucagggccucugcauacuggguaagcacucugaugagcuacaucccagcccuucgggcuucuuaaauaguggccuugugcugcccuucuuacuggaaaggaccucagcaaggauguuucacccaauaauggaauaugacucauucaagauuuccugaaccaggugugaaggacaagaauugccuaguagcaauggagaucacugaaugugugccauuuuugcauaaggagagggacuaugcccucucccugacgucuaccccuucguucaucucgucugccuuuugguucauaaucaugucuuccgaucacauucacacucauucuuacuuugucacaccauccugagcuuugugccauuacauuuagaaauggguugggaaauagcaucggaguguagcagggccaggcuucugaguggccguucugccuuucaguggcuacacuagaauugaaaaccacaggauuugcccccuggaagggcaggagauacucuggacaguuuccuuguugaagaaggaaccagaaucucagugccaucgagggucucggggcacucggcucgucuguuucugaguuggcaccugucauggauguaacuguguucaaauaaguugccuagucacaaaacaaacaagcaaacaaacaacgcuuccuuacuuguggcuucuguaaaccaaagggcagaacugaaaugacgcucacacaucauuccaucaucagcuaauccuguucuuucaagaagggaauuuaaauuuuaaauuucaucauuucaccauccuagaaugagauuuuacauggaauucuuuuuuucuucuucuucuucuucuuuuuuuuuuuuuuuuuuuuuugaggcugcaauuaaacaacaguuuaauuugcuugucuccacaucuucaaggagaagucugucauaaagcagaaccauuugcuguugguucuuccuuaccaaguucauacaaguaugacugugugcgagaagcaguuugugaaggaaaugaaaaccuuugauuauugaucaaugauagucaucauuuuaugcagacuuugcagccaagcaccaaaagagucauccaucaacuuccaggaaguugucccaaacccaguaaaggugcaauguauaauuaaaguuuugauguauuaauuagacaauccgagagcucacuugaagauaaaaggacaccagaugugucagggagaaaaaguugacgugcuuuagauaaaauuuaaaaucaaaagccuucaaaucgucuuaugcucuauuauagcgaaaugauugcuuaguucaaagucucacugacaauuuaacauauucaguuugaucaucugggcuuagauuuuuuuuucuuuuuuugcccuuuccuuauccccaaauaauuuuugagacgauggaagauacagugcaacaagaaccagacagcagcuuccuaucaggcuccugguuucgagggucaaaccucauuuauauuuagcucucuuguuuacaagauggaaaauguccuuucauuuuuaucacugugguccacuuaggucaagcuuuuaacacaagcaaaggcaacuuauuaauauuuauuagguggaaaaaauuauugacuuuaaaaaaaaauaacaucucaguaaaaucucacuugccuggaaccugguacucaguccgcgguggcauccucucuucuuuguacuuauggauacagaaguggccuuccuuccugcugggauguauugauggggaauaaugaacuuagcauuugcagggagcuugugugcagugucacguucauccuuggcugguacaggcccuuuaaagcagcagccccuucuccucuuuccucccaucugugcagcagaaaggaagggacggucauugugcuuucuuggcaccgaggugacuuagccuugcuuuuaaggucaggccgggcaagggguauccaguguuuuagauuuucguuccucaccuuucuauaucucauuccaauucugauucacucuguaaauaagaaagcuguucuucuuuucuuagcucuugcaacuaaggcuuuagggauaguuucagaccuacaucuuccaaggagaaaggauuuggugguguaaagagggaagccauucaacaaacaucucaaugucuccaugccuuuguuugucauuacuggucauuguuguguucagcauuguggguuugauuuuccuuuuuuuuuuuauccagauccccccacaacuaucccuccucccacaacaaccaccaccacuaccaccaccaccaccaccaccauccuuaccaucaucacagguaugguaccuucauugccauuggaaauguccugaauguuuauugucuuuuugguauaaucaaaaagaagacuagcuguucccuggaaggccucugagcuuaacuguuccucuacuuuggaacucuagagacacccaauacuauguuauugaauugagucuuaaggacccaggaagaacuuuuaacaucugagcuguuagcagaucagaugcugcgcaccuuagcaugagggaauucuuuacgaagcgaucacuacucaaagcaaaaacacuagaaaaauggcagccuggcuacucgcuuggccacagcuggugaaaugguaaguaccauggccuagaucacauaaugccuuggucuaagcuucaucuuaauccccacaaagcaaauauaugcaccaaguuucagaaugucuacgugggccacauaugugucauccuccaucuugugacgggugccugcuggcaugguggcugcacaggccaguuguugccugagagauugcaggaaucaggcggagucauugucuuuucuaagcacuugaaugcaccaccucuuuauauauauuauauauccucccuccucaucccaguguccaguggaucucaacgguuugauguuucaugacuggaagccuuggaguuucuucuagucuagcaagauaugacagugcaugccaauaccauuccaacacagugugccaggcuuccuuagaccaagccuuuccuggcaaccauuuccagguguccacucuaaggaaggaaagacacucuugcaaaagugacuuuuccccuuaggaacauuacccaacaagugucugagguuucuuugaaccgugagugcugucauugugucccuggaccccuugauacccacugaauaucucacugggugcucuuccguguuuacauccuuagcgcccaagaucuaacagccacuuccuagagucauguucaucuccugaagacauuuuauuuuccauuugcucaagaguugaugagaugacagaaagcagagugcucugugagagagggaggccucaucacagauacuggaauggauggucuaauccaggguuucuucaucuuucagcuauuacacugggacaaagaacugugccauaagccaccacugaggggcuuccuaaacacugguuacaaacacgugugccuauacuaaacgucaacccuucugaaaauccaucaauugauguggugucucgcuccaaaccuggcuuccucuagagaaucugcuuccugagucuugucuguuucugcuugagcucucugucaguucccucggcuucuuagugaacucaguuuggagcacaguagaccagugccuggcaucuucuguaucguucauuagcauauggaagauguuccuccucugucagaucuccacaaaagcuauccugccaaugcuucauccuaagaauccaauuccucaucugucucuuaucugauuaguaaagcuggauuggguguguacuuauucucucuuguuugccuggcguugcugguguggaauccagggccucuagaaugcuaugccaggcgagcacuguguagcugagcucuauccuccauccuuuaggcaugugcuuuucuuagcagguuucaugguuuccucuggaagacccuuuggaugucagacuagauaaccaagccucagauaucauuagcaguauguucaucuuaggagaaguaugucacagccuuuauaucucccguaguagaagguuccaucuagguaucuguaaggguuuauaucugacguccauaaagcccucucccauucugugaaaacagccccauuucucaugaauguagagugacacuuuuccagugugacuggcuucaucgcuucagcagcugucccugacacuuccccaccaccacaauccgucucacaagucaccugagucgcucuaagucaccgcucuuaauccuuugcucccaaggaccuccuucuccugugaggcccucaaacauguacaacucacugugaucacagcucugacugcagcgacacugucagggaagaaauucuuagaagaaauggcaccauauuucuagccacaucagagaagacuuuaauuggaacaugucuacuucugucucuaccacuggccucucaguucaaaauaacuuaggaugaucucacaggugcacuuuggucuguggauguuagccuugaaugcuuucuacaacaccgaaugcaucugugguaacgaaugcccaggucuucagcggcacacccaagagucauuaaacuaaaauugcuacuaaaacacguaguagaaucuguccccuuaauggaugugaucuuucaggcugacugugucuuaacaagccgccuucuauauauauuuaucuuguccagaaagcaacuuguagaauuuaacauuuguuccuuucugcagacagauuagagguuauggacuugaaugguucucugucccauuuuaaagguccaggcuaucuucuagauuuagauugguuccuacagaauauuccagacggaauccugacaaauggauagcuaaauuaauuuccacuccuccccuccugcacuguuugguccguuuacagccaccauuagccuuaaaagcuucaauagccgaaucuagcgacaagaacauaaaccuggggcucuacaaagaaaaagaagcacccguagucggcuauuucuuuccuccuagucaaaugcaauaacugaaagccauuccccaggucagaguuucauuacuagaaaaauguacaaaugcaauagaaaaauauuuuucaagcucaaaaggcccuaguugauuucugauuuccccuaaagaagcguugcauagcuaccuuuuaucuucccuaccuaggguaauggaauuguucccuuuguuaggaaggcauucuguccccaggcaccuggcucucaaaacauacugcagcucccucguggagauaccugaaggaaucccauaccccuccaacucuuuguccccccaucccccaaaauucuuagauuucuugcucuccucagagagcaguggccucugccugcuguccucuccgcuugaagcagagcuagugacaugucagacucaccagaaggguagcccuauguaaggaaauuuuucugcagugugaagaguauucaggcugagcaugguguucauaccuuuaaucccagugcuugggaggcagaggcagguagaucucugugcguuggaggccauccaggucuacauaaagaggccuugucucaaagaggagagggagggagggagggagggagggagggagggagggagagagagagagagagagaaagagagagagagagagaauucagcaucugucagcuauaucagcagggauguaacuuuacagcugauaagucauugacauuauucuaaggucucuccacauuuaaaaaaaaaaacaauuugaggauggaauugguugagaagccauuuagagccucauuagcauuugcccuaagauccaaagguaucucucucaucuuuccugcuucuuguuguuaugauugguucugcucagcucuuggcuuugggagguccccucacucccaccacuuaguguuuuauuuuauuuuauuguuuugucaugucagguuuuccaugggguuucuuccuuuguaagaguauaugccacgguauaggagagcaacccgaugaaaucauuugaacuugcuuccuagucaaccucauguuucagggaugguagcagcuccugucucugugccucagugcuuggagauagcguuagccucuuccucuuaauugggucaugcauccuuccugaaauuuucuuggaaaagcguucuauguuucucccuuuaauuaaccuggauauugcauuguuccuaccugauggaauccugaccugugugcuugguggagagagccaugaaaaguacucagcauccagcuuccgucauacacaccucuaacaguuuagauacaaagcacaggccaggagaugcucaaccuguaagucacacuauacauacagcugccauagauuuuaaaaauaaaaauaaaaaauaaaauaaaaacagccuuagaguaagaaugaauagcuauagggcuagacugugaaacacauuuaaaaguccucuccucagaacgaaguaggucauuucuaaaugaguuuuuccucuuuuuuuaaaaagcauguauucaauuaaguauuuugaauuucuuagaaaagaaaauagcaagguuucucuuauuggugucaaagcacucaaaagccaauacacuugggaggaagugacuccuacccucagggccuuguauuauuggggcuuucacagcuugaugucauagacuuucuuccauguuaaugugaauuagaucgaguacagaaggcauauacagccuuuuccuucagugguauuuggaaagcaugccaguaggggagcuggcaccaagcaugcccgugucuucacuguaaaggagggacacaugugacaccaagucgcugguguggcugucuaaauaguaacagcuuucuccacaccgagcucucgguuccccagugauuccagcccugagcugcugcuguuggcagggugcaaaggcuauaaagaugaucuacgucuaggugugcauuuagcaaagauugagcacccuuaguacguguagaaaaggacuuuuuaaaccccaucuugugugguugagagaugccaugccccuggaguguuugugccaaaggcaacaggugcgacagggcagcgucacagaaguggucuuugcucaaugccaucaaagaauggauagaauguagauacaaaaauaggcaugaagaaccaauaaugcuucuagcaucucucuucaagacagguguauuucuguugccuagagugacccccccccuuucccuagaaaacacgcauccuucauccuagaguguuucugaguugccuuuuuccugggauugccauccacacuccauuuagaccgucuucccucagacacugaacacuuauagagcauacugagaucccaguaugcccgaggacaggaauguuauuagggcacuaguuaauaucaaugagccucuuuuuaccuagucuaccaccuuugcauguccaucucuuuucauacuguccugucuacauuuucauuuugccaguaauugucaacccacuaccuguugccucauagccaaccauuuuugacccaugcugguuuagcaaggaacagaagaaaguaagaaugccacaaauauuaaaaguaaucagacuccaccuuuuuuuuuuuaauggugaggguugaaaagugaggugagcucuguuuauucuacuacuucuaucauaauuuuccuaaguguacauucuuuauuuaaaacuuaauccuggagauagaguuccaaccaguguccguacucagcaucugucagcgaagcacauaagugagaguagcagggauucggaucucuugggauuucagaagugaaaccuggaguucucccaaugguaggagcaugggcaugaagagcucagucguccaggaucucaagagaugagucuuagccuugcagagccccucccucuucugcccuggcuaccacccacccuaugucaccccuacuuuaguccccagucugcucuuccuccccuggcuugugucccgaccccuaggucccauucccaaccgcauucagagacaaugccauagggauuguuuuccuuguuaaaggaaaccacucuauagauugugauuauuguacagaacaucugguuugcaaacgagaggaucucuggggcuugggcugcccggagugaacaauuuugaagaagcuuuuaacaaaacuugaaacugcuuaacagcaaccaggaaaccagcuccucuucccgcuguucuggggcucacagucucgucacugcacggaaaaggugacauuuaaaagauaaucuagggcuggugagguggcuccauggcuaaagagcuuauuccucaagcgugaaagccuggguuaggauuuccagcacucacagaagagccgggcauagcgggcgcucugugcucauagucucugcacuugggagcagagacccaggguccaggagcucacagccuucagguucagugagagacucugucucaaaaaauaaggugaagaagaagaaacaguugaaggcauccuaaugucaacugcuugucuucacgugcacccaugcagggaguauacacacgcgcgcgcgcgcgcgcgcgcgcacacacacacacacacacacacacacacacacacacacacacacacaauggcuuucuuagggcauccaguuaaggccuuuuuagcucagcucuguucuuggccacuuucuccaucauuaaggaaugauagguuaauuaggcagaacauagguggcaaggaaauuaauuggaaaaccaguagaaaauacaguucaaaacuugaauuuuccagcacuuauuuuucucuuucaacagauuucaaauaaauggagagggggaaggggggagaagaaaacacccauauuuaauauauauuggcaagcauggcacagcuaugaaguuaaauugucaggggaauucuuugccugcccuggugcugagauuuaaaaccucuccauugcagagacugaagaggaauucaauuaagaaagcccguugguucuguauugacuuuaguuaagaaaauaaaguagggaaaguguauuaaaauguggcuaggcugcucgccucacuuccagcuaagcuuauggcuggcaagacaggguugucugaauuccccacagcucuagggcaggcuguuuuuuccagguuguacccacagcauuuucuaguguccacccugaucucacauagccaugugcugcccuacagugacucuaucauaacacaagaaccgcacaggucaauugguaagaaaaguauuuaagguugggaauuuaauuuuguucuuggauuuccauuuauggcccccguuguguuugagaccacggacuaauuuauggauuaguuuuaagcccccagucugucacacucagugaacaauucuaaguuggagagaauccaucugaaaggauuagaaugaaccacugugggacuuacacaugacuguuucaacuaaauauugcccagcugccacucagcaggcugagggucccccccccccccacacacacacacccuuccucuuggcuacuugguuaaauggcuacugucucuaaucucacacauugucaaagccuucucauuucguaaauaucuuaaccucggcaugaaagaucuguggugguuucauuuguuugaggcagggucacauuaacugcuugcaggccucugagccuaagaagagaagucagcuuugaggggaagacugacaagggaagucagugcaaggccugucucaggcaccuucuuuggauuguaaacucauaaacagcuaagaauugccuaggaagaugagguacccacacagucuucgugagaaggggauuggcucgguuucguuuguuucauguaucuuuuaaaaugguauuguauauuauuauaaaauaauauacaauacauuugcccucaucauaauuaaaacuagagagaaaggcauaacuuggccauuuuauauauuaucacccagugcuucccaaucaacuuuuugugaccuauuuuucucauaggccuagcucaaagauuuuuuuuuuuaagacaacaaaauuagcuuuuaaaagccuuucugagggcaaccagacacuauuuuucaagccaauuauugcauuuauaacuucguuuggaaacguuugccuuugcccacacaauuaaaauguuaugaaauacuccacugaccaccccugcagcugauucuugaggguggguuuguguuuuucucuacuuccuguugaagacacccuaauaaaaugugcuucacggcuuuaggcucaccccagagccaaguugucugugaugucugcauggugucauaaugcaauuauaaaggagaauuagauccugucccagugucccuguggggagcacacagucacuuguaaaguguuuucccuucucucuucacuugaaauagccucugcucaggucguauaccagaugcucucugagaaagagucaauagcucccggacacacuccuaauccugauuucagccccguagccaaccugaguuccugcugcagccccccuccuggugcugcucauggguuuacccuuuccagcugcaauaaccaugcuguuugacuugaguauguguuugcuuaacuguuuuagaguguuuuccugcaaugucccuuuuucucuucuguugggugcaauugauggauuucgcaucccuggaguuggggugcaaaaugcacgauggccguggcugcauuuauuguccggugcccauguuaagagcugacgccuggcuucaccugguuuaauuuugucaugcagcugacauaaugcccuaaugcaggaagacaguaaauugggaucauuggucaaugcucagaucugacuuuggaaacuuuuaacuccuugcuuucguuuuacacuaaugauuuaccugguucaaaagaaaagaacaauacaaaaaugaaaacaaaacccaagugcauauuagaaacgcuaccaugaaaauaauaauaagugccaaagcauugauugcuuuuccuuuucuguuuggaaaggggccagugccugcccaucaacuguacuaauguauuaaugcguagaaauuauacaaaugugcuuuugauccugccccucaaauuuaaaguuucucacacuaguguuggacucagaugucucaacuauggagaggugucugucccuuuaaggaucuaguguaggguuuguuucaacugcacaguuuucugugccguuccuaccgcuaugguaggcacacagacuugacuuguaaguaaguauuguccucuuugcuuuaugcuuuuucccuccuuccuccacucucaagaaauguagugcuugguuauaccaagcugcauuggccucgcagaccucugguuaaucuggcuccuugggagggcucugaguucuuuaugguaacugggucccucuugacccagaaagcaugccaauugagggggaacaccggugugaauucaugugucauauuuauacaucagaagcuccaggcucauuguacccccuuccuaaaaaaguucuguuuggagugccagugcauuuaaacauugccugugucaagaugcagagaguccauggaaacaauugccagccagagaacugcaucauaaaaagggcggggauuacuugugauuuuuagcccucacuauuccacuucaccagcagcagcuucugacuagagagggccugguaggagaaacaccauugaaaacugcagaacugaagaagaaaguagguccuggugcgacgacauuaagaugaaguuugucagaagcaccaagucugaaacaaacaucacugcauauauuguuacuuaugcaccccacuucuguagcuaaaagaaagggcaaacccaugccucaagugccugggggugggagggaauguuccugugaagaaaagccacugccacaaccugauaggaacgaacuugaacaaccucaaaaaaugaagacagagacaggccacagcgggagagaacagcauuaaagaugaugguggcucugucuccugacccagccaugacagcagaauccugacaaccaaaccugggccauggugcacugaguacuugagacuuugaaauucacaaguaguguuuggcaguugugugagcauguguguuauugugacaggccuuggagaugauaacaucugguaaaauggaaggaucagagugugagugagugagugagugugugugugugugugugugugugugugugugugugugugugugugugucuugaacacauucacucccacggccucuccaugaacugaacuugccagcuaucuucugaugaaauaacaacaguggauggagaaccugaaucuggguguggcacguucaccugcaagcaucugagcuucagcuggaaaaguauccuccuaagcguggggcugauugcugugauguucacuugcugauggagaggcacggugccccgccccggggggugggguggggggcguggcuaacacaaaggcaauguuugaaugucugaauccauuguuuaacuagccuuccgacugagcuuuucugucgcaguccugagcuuugaugccuugagaaccauguagcagucgcugaguuugcacugguguuucucgucacuuugcaugugccccugacuauucacucgcaaacgcguguguccuggcaagacccccagaaccaaagaguuuacuguuuuccuccccggcucggcucgcagcuuugggcucaaggcaugucuuaaaacagugcaacucacuucaaaugcuuuuggcuuuucauuuauuauugcuugucacgcgguguucuuugaaagcuugcucauauauuaucuguuccauuuuuuuuccauucucccuuuuuuugcaugccguuccuccuguuucuucccuuccuccaauccucuguuccugucuguagacaccacggcgacgacagaaccagcaguucacgguugguaccacauuacuguuuaucuacuuucucagcgcugcugagaggcaaggcaagccuggggaaaagaaaugcagucuucaagggaacucaugcuucaaauagacugaucucaugaaugcacucuaguuuuuuuaacgcuugacauuacgcugagucuugucauuucuguugugaguucaguggccagugguugcagucugagaugagcccuccccucugguggcaaacggggcaagauguccaucccauguuccucugauauauaaaacuccaccacaccuuggaauaaaggagccuucaaaaauguuuuaauuaaaaauguaaaguguauuugucuacagagcuaggagcuguaggccagaguguuccaggacucaccagcuuuuaccucaggauuuuggaagggaguucuucgucccucagugcuugaggcagaggauccaggaggaaaaucucuaguuugaccccugacguggacagagaaagccugcuagucuucuccauagaaguccugacuuuucuuacauccugcugggaauuuacccaccccaccuccccaggcccucugcucacugccgcuccccaagaauguuccccaugcccguuugaacagcaucaaguaagguuuuaaggaagucuuggaugugugccacuuggcaagccaaauaguaaaaagagcauuaaguuucuuuuuagccaaaaggugauuaaaaaacagagugcauacacuucagacagggacaucagggcacucugccuccuuuccccugucaccgaaauggggacaagucugucaacuuuuguuuuuguguuuuauucagucagaaaaugagaguccuuuuucaucaguguauuauuuugcuccucagcucaaaucuaacuuuggcaagacaauacuuagagcagauauuuuaguuuaaagggggagucauaacugaauccaagggaaucauuugguaaagggucugcaucaaucacuuuauaugcugugcagagugaaaagucuguuacuucagugacaggaggugaucacagccagccuuguagucaacucaguugcuagaauaacaucugucccacacugacuaccguagauaacuaugucugagaacuuauaaguuaggaauuugaauaaaaccuguugggcagugcuuggucaagaucagcagggaaccccuucccccuuuccucugcucccuuccccuccuccccucaugccucucuugcaaaguaacacaagcuuaaguaggagaccuaaccuacccccacuucacugcccuuuccugccauugggacaaagggaaauguccaugcaguaaguuagaggggccagguacacugggcggccaugagaaaucaguuagguauagaaugugcaucuccaaaguaguguccauuagagcuaacuauaucucaggcagcaacuccauuauacuuaguuguugguauaguggcccauaccuuuauccuagcaccugggaggcagagucagauggaucucugugaguucaaggccaguguggucuacagaggagcccugucucaggauuggggggugggggguggggggcguacuuuaguuguuuguuuuaccuauaguugaguaccuccugacucuuaucgauuauccucugaucuuuaaguugguuucaguguaguucaagagauuuuguuuuauucuuucuaaaguacucuuaaguuuugggcuuucuauaauuagcuccagggucaagugcauucccaacauucccaaauucucugggcucuuuaaagaaauagugaccauuucuucccuaaagccccaaaguucuauguuuuaguuccucgagaaaaaaagaagcacacgcccuuguaggcucauccuuaagcucccggacagggcgagcaaacuagagaccuuguccucucgucuaaaguauugaggcaucaacuaaaagccaauucugauuuggggcaacucauguuaauuacgacugucucuuuagaaagagaacaaaggagagaggagucucuggacacauggauuggcaugauucuauagcacacugaccgcaggacauaggguuggcugugccaugagaagcagccgcugucauucuaucuggaaacagcaucaagcuggguguaaagggugagaccaacugguaugagauguuugugggagaaaguagcaaggccaucuucccugugcccuguauuccucgugccuucaguuggccugcuuagcagcaaacaaguagguaauccgagcuggucccuguauaauguauuuauaaaugcauuccucaacuugucucugauccucauagcuucuccucaaagggucucccacuguuuuaaccagcugacucucaagcccacagccaaaagcucuaacaagaacuaagauaaugccuggaauuuaacuugaugaaaagggaagacauuucugagucaguuguaaaggguaacaauguggugagagcuacagaccaaggcagcagagcaacaaggccauuauaugauaucgucaauuuuagccuagugcuagaggcucagcucuucaguacagcaaccgcaugacagauucacuugaugaccucaagaugguccuaacagugacuugucccaggggggggcgggagggggaacaaguuaaguggcuugauaacucagcaacuuaaaugacaagacauccuaagucagccagcugugaccaucuuaguggucucaaaaguguuauacuggguuuuccagauggcuguuuucuuugauuuaaaaaaaaaaaaaaaaaaaaagacauuuugaagauuucccuuugaagacucauuaaacuauuugauucaagcuuguguugcuagagucuguaugaaguuucuucuaguuguuucuguauguugacuguuuguucuuaccaauaacugauugcaauaagcauggacuggaagguuggaagugcaugggcaugaacugagaccaaauggauuuucuccaaaagaaaaccaagcaacaagucaccaccguauguuguuaaggcucucacugagaauacagauaaauguaagaacgagauguucacgccaggcugacccgggggucucuuugaauaagggaucuugagcauugugguuuuguggcucauccuuaagggccugcacagggggaagaaaacaccccuguguuguugugugcauguugaacgaugcaaaaagaaaaagaaaaaaaagaaaaaaaccacugccaaauccugauagcucauggccagaagcugcaggcagacaugcaugggugguuaacgcacgggcggggucgucgucauucugguuauucgguguaugggugugugugaugguuucugucuuucuguuucacuguggacgcuucucuguaaaugucuugugccuuguucuuuucuguucuguguguccccucucccuuucccuccccuccccccugcccccacgaggggugggguaacagcaugcccacggucuggaauagcgcuugugccucuguuacacugcagacagcuggcuucuggguugggggucucuccucucucuaucugucuguuugucuaucuaucuaucuaucuaccuaccuaccuaccuaccaauccaccuaccuaucuaucuaccucuucccauuccccuucucacucucuuaauucugccugccuuuucuaccuguugagacaguggaggcugacaaucccauggauuuccuuaucucagauuauuuuuuaaauagauuuuuaacucauuccaaaaugaagaacccaaucugaagcauuuuucauuuucuauuuugguuucagaguguuugcccagugcuagguaacaacccccccccccagaccacugccccaugugucucccuuucccugauuuaugacuagcgcagaccaugauaggaugcuagaagcacuguguucuguccuuaccuuacuugauauucaguuguggggaaguucuuaagcccauuugaaagaagacuagccagcagugcacacgguuacaaccgcuauguccaccgucuguguaugugccucuguguacaucucucuguaugaguacguaacaguggcauucaaaggcugucauucagucaagggacucugcagaccuuguaugcucuacccaagaacaaagcuaaagagguuuacgaauggcugcaggaccugaagauugcguugcagccuugauaugcaguuuggaaaccguuuaacggcgugaaccaaauuucugcuaaugggaagaagggaaaaacucuccacaaaagcugacaaagcaggaagaacaggaugacugagcuuuuagauuaaaacuaccgggggcgucugaacucuuauggcuggugguggaaguaucaguuuccacgacauggccaagugaucagaugcgugcugcguagguaagagagagaccgucgccuacuuuguuuuuauaaugggaguggcacuaggccacugggccaagguuuugcuuccuagggauuuuauuucauuguuauuuuuuuuuguaauuuucuguggaauauuuacaugaugaccugaugaaucgaaccaaggaaccuuuuuagguauacuugauuuuugcacuuauggaaauggcuaggauuucugacugauucugauucuuuggggucuuucucuucugguuuaaaauugccaugucaagaagaaaucacagcuucagaagcccacagugcugcaccauagcaccuguaacccagaaaagaccaaacaggagucucggcagaagauaccgccacugugcauaaauuaaauuaucauaucugcaccuuaggacuuccuuaauugcucaaaaaauaucccauaugcaacaaaaguaaacuuucauuuguuuaacaguuuaaagaaaugcacugcaugcauuuuaauuagaagugacuagaaagagcgugaauagaugauaggaaauuuugaauagaagaaccaagaaguaauuucccacugacuguucagucacaguguuuccuuuugagaaauauucucugcuucauaaaaugcaucuuugucauuuucuuugagagaaugagaggagucuaauuuuuaauaugaaagaaaaauaccuaagccaaagcaauucuagggguaaguuuuguuuuuccuuacugugccucgagugcuauggcaaaguccccuaauuauauuuauucaaaaauuauccagcuaugacagugugcuguagauuucauuuaaaacacacacacacacacacacacacacacacacacacaaucgaacugcaaaaacaaauguaaugccacuguccuaaauggcuucucggucuggaacauaaucuaagcaggagauuccagaugauuuggucuauuuuaaaguuuaugccauuaaaaaugacaguuuuagcucuaaugagguguauaucaacugucugucgcuucuuaauggaaaacuuugcauaucaaugauacuucauaaacauauuugucuuuauuuuuuaaaauuagcuuucuagugcccuccccaaggaaacaggucuucagcaguaaagcugccuacuugaagcguccuuguuuaaugugguucagugggcaccaagcacguauguagaacacuuugauauucaucgggccacguaagaagugagggauuagccuucugagaacugcaaauuuauaauuaacuacaaagaacuacuuuauguuacccauuuauaacaguuauucaaauaauuguauucaucagucuuuauucaauggauaaagccaauuagaaauagaaacacuuucagccaaucagauuucaggacaaaaggcuagcauuucuccucagcugccuguauaauuuaucacguugccacacucccuuuagucaccugguuccauagcuugggaacaccugugaacucugaaggcuuuaguguugguuuggcuucugcucgggagcuuuuggcauccaggguucaugugggaaaauguccuccccuaggaguggcgguggagccaccuccucacgagcucagccagcucuccacguucaugugucagugaccucagaagucucaagauuuaaugaccacucauauaaacuuguuuaguucauuugauauauguauauaugcaugaauauauggcaacccgucagccauaauguauuuucagagcacuguuuugguugccuuaaagcucugguaaguaauucaccaagaaugacucucaaaacauucuuucagcaaauacuuacugagaauacacuuugugccaagcugcagggagggggaggauacaaaauaagcgaaauccgugucucuccaaagaccuugcagcugaauuagauccacaccaucuucaaaaugacagcuaaagacuauaggacagauagugugggaauuugaguuccuggggcaguaagucggauugaagaagaacagcaaccaauaagcaaagggccccgugaccaccuuaacauguccugugcuuuaauaagcuucagcuuccuuaaaagaucagcgcaggaaggaggaugaggacauggaagccauugcuagcugaaccucgcuccgcuuagcugggcuccucuucgccucucucaauucaaauuagagcugguggagaaccauccaagcagaccagcacugggguugacuggaguacagucaccucaagccccacucgauuaucuccugaccuaacugcuuuuucagcuuugaggguuuuauuuuuccagaaugccauugaucuauaaaauucuuuuucuuaaaaaaaaggggguuguaagucaccuuuuucugaugaaggcauaaccugugaucugcauuuagcaggugauggaccauuuugacaucaugggaucuaagauugugcuaaauuaauaguguacuguguuugucaguauuggcaaaggauuucaauuuucaggaaaaugcaagauaaaacuuacauacaucaguauguagcaucuaaauacauucauauucaagagaccuguaucagagugcccacagcuaacacuccggcuuugcuuuuuccuuucugcaugcuguuuugagugagugauuuuuaaacauucaccccucauguuucaugugcuuucaacaguggaggccgaggauuccuucugccucgauugucuaucaauaacaaaaaaauuacauaguuaaagaaaugaacguauggauuaauauauucuagcucuccaaaaaaagugagagauagcaagagauuuggcucauguuuuauuuuaaaaagacaacaaaaacagaaucccuccucaguucuuaaguguuuuguuuaugucccucgaggaaugaaaagaaaaacgauuuguuuuuacuuguaaggccuuacucaguugcccaauuccgcagaagaacuggacagugaggaucucucagguaagggcuagucacuagguaaggcacugcaguguccaaccugugggugacuuuguccacugugacccaaugaccacuugguuugcuaagcaaucaaucaauguggauccugagacuaagaagagaaugaauuuguggagcuaacucuccuucucuguucacucacccaccuuucucuccucugguaacagugugucucguuucggaccaaggccugcaccauaaauacaguagagagcagagcgccaaggccaccucugcuccaugacuugaaguaauguguuccuuccuacauauguaauggcucaggacaaauuugguuguaucauaaagcaguugauguuggauuaugugacacgaucuaaagucauauugacugucgacuucuguggaauagacgagaaggccacuuggaaguagcugguggaaagcagguucgggugggcaguugauuuuucagacaccgggcuguaaacucuuuauccaccucagaccuuuuccacagcauagugagcucuugugaaaguagguuucaugccugacuccaggauuuagguguuacuaauccagaauaagaagcauauccuaaaaaggccggaggaaggagauuuaaaguggucagggcuaaacaauuauaugagcucccauugauaucaugagauuucagugccaacugccuacagcuucugaagcucucugauuggucacuuagugaaucaguaagcaagccccuugacauugcauuggagaaaccaaagcacacauaugguugcuuccuggagaacacaggaaagcaggauuccauauuggucuuucccaaauaauguucucuauaguugguuugaauggcugguacuuuaggugccaucuugaacacagcuaguacucacucccccccccccaaugucucagagcacauaggauuuauccagucuugugcuucucucagaccucaggggugcucucacuuuucuucucugucccaugugugagggugagcugagcuguuggagacccccagaguagaagcuuccaggaggaggcuauaggcugggucuguuuccugcugugcaccuguccugcaauaagcagccagcuaauacuuucugaacaaauggacaaauucuaaguacuugugaauuucaguaaaucaguuguuuagaaaggaaacuaccuauuagccaugucauucccucaucucuuacuugugauagauauauuuaaagaaguuguaaaagaaaaaaaaaagaaaagaaaccacacuaacuuuacuuuccuuaaaaacaagaguaggcauguccuaccuggcaguaauacaacaccagaaguauaaacaaaugcuugccuccccaggugacagugggcauuguucuggcacacccccccccccaccgccccuaaacagagcagcccucaggugcagacccugcacaacuggaucuuucaagaauccugaaguucuccuggguugacccugaucuccuuuggcacauauuccaggcaaggaucccucagacaggcaaacagaacuuaauccucuuuaggaaaacacgaaucagccaggucccucuucucccagcaccaucaauuaggggcacugcaggccucagccugccccugguuagaugggcccccacugcugcucuaucaaucacccgagucaggagcaauaaaccaacaaccuuuuguguucauaauaauuugguuaaauuaauaauuacaccgccuccccccccucccguaccgaccccccccccccccguuggcgggagucaugagucaugcagaacggugauaaaccggcagggcggcuggggcagggcugccuuugcaucugguuugaugaacuaaucaaaaacugauuagcaccuuuguucaaaggggaugcugauuaaucaauuacuauugauugugagcuuggcuucuccaggcagcgaagagacgucuaaagggagaaaaaacaaccaauaaaaauugagcagcugucauaguguuuaaauuuauuaaaacaaaauacauuauuuuuuaugaagcugucuugaaaugggucacugaaggggagcguauugacugaggaaggaugaacuucucaaguuucuguagccugcagacugaauucaauuauaaugcaagacaaacagguuaacacccgccuuaaacagcccgucgauaaauuagaguagguguugcccauuuaaugcuaaacugugauaaugaauaauguuacccacucccugcuguacuggguagagaguccauccuuuccacauuagggauuaauguuucacacuuucagagcuuccccugcccugcccccaccuccauuccccggugccugccucaguuaaugacaguuucauaggcagcauaugguaugccgcccucaaccagcaaagcgggaugcccggcugauccuccuuuguaaucugcauuuaaacaaaaaaaaaaaaaaaaagauuuggggccuaguucacugauuuaauuauuggccaacuugggggggcggggcuuauccgauucuuucucgaacccuuuuauuuaguuuuugggucuuaacuuuauugacuauagauccacacuacuuuugaauuguuuuaucaauuacaucugcuguuucucggugacagcuggugguuauuaccacccauguggaauagaauagcuuuaagcauauuuauccuucuacuuuauuuuaaaacuuuaacaaaaaugucuccaacugccucccuccccgcagcauggaggagccucugggaacuguucaguggagugcggugguaaauagugugccagagaauggcccucagcagcggcagggcagcccauccgucuucagcuggggaagcagggcaccaacaaggcauuccagcacugcuuucuuguuacucucaaaaugagagagugaucuggaaaauuccuccacgcccuucacacgccacagaaacacgcgggggaggggcaggcuuccgccuggcuucccugaccccugcguaggugcugggagcaacccagugacccagcuccuggcuccccagguggauuacaagagcuugggcuuuacccccccagcccucaucuccagggugucucaagcagggugcaguacaugguggacucaugugugcgugcgugcauucccgcacaggugaacgcacuugugcauacaagcacacacacacagccacucaguaacccuucaguuagcaccacaggaugugugacccugcuuuggaaaacaggcuguuggaugucaggagaaggaaagaaagacucuaccauuaagcaaugccccuggcccuccuauauaucaccuaauuucuuauuccacaaaagcauuugagcaccaugugcuugguucugggcuagccccuacuacacagugguaaagaagacccaguaggaguuggagcagccuuggaucucacaggcucguccugccaccccaugauaacuuuccacuggggaacacagacugcuuacccaaguugccuguggcuauggagaaguagcaccaaguagugagagauggagagcaggggcaggaaggccugguggaugagaugagccacagcugcaggggaucccggagcaauccaugcagguuaguuagggaggguugaucauaagugaggaaagcaggcagccauaggggcccacgcaguuuacaaggacagaguuuaaacguggguccuccgauucagggugcccggccucugagaucaccacagcucccuuuacucagcagucucacacuccuccuggcccuucuucauccauuuuagggugggcaucggggaucaugcagcggaaagcugggcucugagcagccuaucagauacacagccaugggugcuaacugaccuggaaacacuauuuuaaucacuaaaugaagccccuuccccuucagaaaagcuccauccugcccugcucugguguuuccagugcagguggcccuaaaugccguuauaaccaauacuugggaagcuccggucuuuaaaguuuaaguuguguucccuggugcauaccuguaacaucaguguuugggggcugaaacagaaggaucuuaagguuaguguaaaucagaucuuugagagaucucgggaagcccguggucagugacuuucccacaacagaaguuuggguuuccuccuaauacugaccuuucccauaauccaacaugcaacuguuuuaaccauggagagcaagguggucauggccaaguagaccaaacauuuccuucagacuacaaagucgcuagccacagugcgaagugugaguuccaguuccacagguuggacacugcuuuggggugacuucaccacauucaugauuccaucuccucacaccccuaaaugccugaggccccccaaagcaucuauagagacagauucuagugggaaugccgguuacacucuguccucuuuaccagguuccuauaaggaaaaccccagugucguccucggugccuccccuuugcuuaaaacggagaaggcaaucccacugucaggguccuguuacaggaugaggagugguccagggucccucugaagaugcuaaacaccuugggauuggcacggcuccaugaagccauuucugcugaugguuaaauuaacuaaaccaaauggcuagagaagggagagacaccaacauuuucaaagacugguccugacuuuuagcuguggaggguuuagcguugugguucucaaaugguauaccugaaccauaacgugcauccgauggccuggugcuuccuuaguccccauggaaaccagcaaagccucagcuacagcacaugccaauucuguauaagugaaaugacaguuugguccuuguuccuaaagagcugacaaacauuggccuaggaucagugauacgaaccaaaaagcucuuccucggguuuuuauagagcagacugaugcucagcagacaucaagucccaccagccugcucuagccccugacagcaacccuggcagaaucucauuggggccagugucuuagaguaggugauuggcuugccugaagucacacagaauagaaugaaguucagcuucugacccaggucugauggcaaaugggcuccuaucccaucccuugugccuaggcacuggcaggcagggagagccugaguccuggucacugagagugcacagcaagugucugugcacaguugucauuuaagugagccucugcugagauccaggguacacacugaggacgaccucggguuuucuuugcaguggccucgcacagccccucuaaaugucggaauagccgcaugccauugcuagaauggaacacagcuaauggcugaugcuggccgccuggcaugcuguaugggaaucuucaugauuuucuugccuccguugaugccuugccuucccuucucugagaagauggaaagggaagguuaugcugcauaaaggcuagugugcuccaauauauauuaacaucuuaaugggaaagcugugcauguacuguauacauuuacuacucucugacaagagggaauuaaaugucagaaggauuuguagcaucuauaauugaauuggugcugagaaaagcaaaucuuaagagaagaauaacauauuaggauuagcaaacaacauggcguuuugucagcgcuugccauucaguguguuccccuccaguaauaaagcugugcuuuuaaagcacgagcuuagcucgguugccuuaggugagagcuaccauaggugaugagacucgguagcuuuaccuuucagauagcacugugugugugugugugugugugugugugugugugugugugugugugugugugugugugucugugugugugugugugugugugugugugucugugugugugugugagauugugugugugugucugugugugugugucuguguaugugucugugugugauuguguguaucugugugugugccugugugugauugugugugucuguguguaugugucugugugugugugugagauugugugugucugugugugugugugauuguguguguuugugugugugauuguguguaucugugugugugggugugugauugugugugggugucugugugugugugugugauuugagguuuugcuuuguuuuacauuuuugcuuuagcuuugggauguggaccaccagccuccccucccucauccuuagcaagaagcagcaagugacaucacagccauuaagccuuuucugagauagacuaauccguccagcucuaggaagccagaggcagcauuuccaucauaaacaccaauucuaagaguuuuuaauuaaaccaacuuguccagagagaccuccgcugcaccaagcgacagaacuguugcaaaaugucagccucagcucaggcuccagucaccccugggcaggagaggcccccccggggaggggguugaaggaggcuuagaagugccccacuuuaaaugagacugaaaagaacagaucggugggugcuagagcagugucuagccugccccaaggaagccugagaugugaagguacaucagugcaguuauggccaugaugccugacacugcaugcuuacacuccaccuucuccaaagcagggacucaguaaguauccuuuagauuauucacccugagguugccaugagggcucugcuccgugagucccucugccaguccuuccuugccaggagcuugucaagaacauccuagccauucccugguuacccauccaucccugcuuuggcagcacagccagcaaggcuuaugccagauccacgaucauggcauucuccuggcaguucgugugccacaucuccugccaggugguaagguagccauagaaaccugccccuucgcagacgccugauccucccauaggcagcaggggcuggggagugcugugugaaggaagugcuccacuuugguaagcguuuaaggagugaaugcaaggagaaaaagugagagaugaagggguagggaggaccuggaaguccagucuggccuuuggaguuauccccauucacauugccuuuggguccggucaacugcagagcugcagaaagcugagcagguugggacaucccugggguuuugaugaaaggauuuguguuuauuuuucauuguuuuauuguuauucugagaugucuaaaauacuaaagucaaggccagggugguugaagcgauggcggagcguuuuguuuuguuuuguuuugucucaucuuguugccaacuugacauucugcaagcaacuuagaaaccuccccuucaacuacguuguuucagcuucuugccagaagaaaagcuaacacacaguuauaaguaacucaugauguauccggcacccuuggaacuacacaaguggugcaggaugguaccggacagaacaggcaagccagaaguuguaccacaacaacuugucucgcucaguguucaguguugugcaguuuagacuugcauccaccucacucauuuaucugaauuuguguauggagguugacuacacacagaccgugguuaccugaagcuagagugacugucuauguauaugcauguaccacgcauguauuugacauuccucuccaggacaacaaggacacaccuuuaucccaaaauagaaacgugcuaacacuggugaccauauaugaggaagaaucguacccucuuaggaagcaagaaagcaagauugcgcaagccccagagguuucccuuugccugaaguuaggcuccuuuauaagagcuuacacccccauagucacuucucaccugagaagcugcagcaaugcaaagggcacaggacccacauggaugcauggacuuccucagaggaacaagaccuuccacugauggggacggacgcacauggccuucccaccuaguaauucucaccuugugagcaggacaggugagauggaggcuggcagacuuuaccagggauccucccaccgucuccuguuucaauccaucaccugucaaccaacugcaucccucuagcaucgcaugcuacugcucuccguaaccagcaaggugccagcugcagguacggguggugcucaccugguagcaggugaccagcaucaccccuuccacuuuggaccaauccacagcacuguuggaaucuccucccauucccacaagaagaaauaaaagagacagugagaaacaacugcucuccccagggaaagccagaccaugacaggcacuuaggaacagucacggcucuauuacuaccucccauggucagccaggggugggaguggggaggaggagaggugggaagaggcggcaaggagcucauagccagcaguguucccuguaaauuaaacaucaguuacccucuguguccaucugcuauaauugaagguaggaaaagugucuugaugaugaacuagcggugguaaacuuucugaucaaagugaauauagagagauuacacauauaaauaaguaucugaaaaguguuuguguguccuugaggguagggaagagaagucaaacagguauuuaguguggacugugugcagggggaaauagcuagacugagcacauuuggagggcacaggucagaugaguaguugggcucagguaaggaaucccacagauguuuuuacccuuguuuugagaagguucauaguccuuccauauuccuacccuuucccaaagcucaaacauaccaccacaucucucuggagauggagaaauuggucuuuuaauaguggacaggaauugccuggcucugguggcuggggacugucuuaaacagcuucuagagacguccauguacccucauguccucuuacauggcuccucccccucuuccuugccucauguagccguuuucccucuucuccaucacugucccaagucuaagacacucagaguuuguuaaaauauagucaaaccucaauugguuugaagcaacugaagaugaguugauuucauucccacacaggaaacauagcuggcagguuuugcuauugcucgaucccugugagaacauuuaggugguuuuguggugggcugugucuccacgauguagagagugauccuccagcaggcaccaggacccaguaccacccugugaugccccuccaucagcagcuugacuggcuuuaggaucaccauggaaacacacucaaggauguaucuuuaaugguaucuccagaaagauuuaacugaaaagagagggccaauccuaaaugugggguggcuccguuccauggaccagacuccagaccaauagaaagaaaaaagcaagccaaggaccagugucugcuuccugcuuccugacuggggaugccgugugaccagcugccccacucagcccuaccaccuucccucccugucaugauggacucagucuuuaaaaugggaaccaaagcaagcccuccguuacauuauuugaggccaguguuuuguuccugaacaagaacagaaauuaaugcgcgcgugcgcauacacacacacacacacacacacacacacacacacacacacacgguacuucccaacaaugggcuguuucuuaaaaggcaaaacguuuccaagaucaccuucugcuccgcggaaaggacuuugaggacaguagaggcugcauuggcuggagucagcaacacuugggcugagacagaaaggagauuccucacaaccacaucucaagcggagcuuauuagacacguugcugaagaggcuugcacaucacggaguagacuaauuggcugcagcacucugccuccaacccucuccauccuccaauuaaacucccaucauccuguuguccgggcgaccugcugcugccucugacuuggcauuucuguugggguuugagguuugaguuaucccguaguccuuccaaagcuaacuccauggaacacuuuaaauacuccacguuuuaauugaagcucuuuaauuaaagcacuuuccauagaagccacaguuauuuugccacauccuuccguguuuagucuccaagcagaauuggaaauaucgauagaaagugugagcccugcgcucccgcugaaagcguuguaucagguuucggcucagaagaguaccauuaccuuuagcugucacggaucuguacacuugaucgauaaacuucaaauauuauuagagguggaggcuucagagauuugcucuguucuuuggagagagacagagauaaaucuuucuuagaaauugacuugaauuugcacucucggucuucccggugaaacgcauuucucuuaggcauccagcaacuacaaggggggcagauuuauaggccaugugcuucauguacugaaagauuuaaaugguaaauccuucacauaugacuucacaaaucauguaaaguuaaaagauuuuuaccguuucuguugcugcugugcuuaaauuguaagguacagccaguaaaucauuuuaauggaggugucguacuugacucaauaaaaagaagaaaaaaaaaagacaaugguuuagcuucuacuccaaaauguuaauguauuaaucaacgggagaauaauuguuucuuacuauguuauaaaucucaggugccauuaggauuucagcaaagggugauauagccaccacauuccuaaauuacaguuguuuacccugccaugcuuccauccugcaucaccauagcucauucuggguucauucugaaguuguuccccagccaaagagccaaaggggacacccugagggagugaggcuuauaagagaaaacuaauuacauuuugagggguuaaauaacaucaaaacugucuguggugaggggcaagcaucccuuuccaccauaguuuucucucuuuuuuuuuuccuuuuuuuuaaaaaauuagguuuuuagaucuuaaaucgaggcucucuccuuccucacaccuuuaaguguggcuggcauauuauaugccucuaguccucacaagccugccuuccuucccuuugcgaguucuucuaaggaagugagcugugggucuucugucguucccuccccugcccccaguuccugugauagccugaggguucccuccgugauguccauaaauaguuaggccacccuccuuaauuauuaggagccagaagucccaggauguguacagugggcacuaagaauagguucaaacaggcagaauccagcaccuucccuccccacccccacccccacccuggcagcuuccuaagcuccccccccccccccaugcaguagcacuccugugcugccucuaaugaaauggccuuguggggggagaacagaucaauuccggacuggucaggucagucuguucccuccguguaacuugauccaucugguuuguucucucugacuccuccauuaaaaaaaggaagguguucuucugacccuggaggcagugucccuggggcccuuggugucuugucauccguucuacaucccuguuccucuucugauuucaacagauucucgagcaggugaagaggggaccauuggggcaguggaccacgcagugauugguggcgucguagccguggugguguuugccaugcuaugcuugcucaucauucugggccgcuauuuugccagacauaaagguaagcaggguucucuggcaggcuggagcaacaugucaccacagcccuggcucuggggggcuucacugcuggcauuauaguaggcaguuugguguaaaggacggcacagccuauaugguuucuaaaucagagagaaggggauuggggcggguggagaaaccuuagccacggcugcugaggacucugggaggauuucgauucccucugaauacaaagcgguauaagucugcgguucuccagucuacauuugggaaucaaaaugguaaggucagggcuggcgugacaaggagccugagcccuggaagguuguguaugcauggcaagcauagccacagccugcucgcuucccaggagacaggaggacccauuugcugccccugaacucugaguaagcugguccccagagccagaauauuucccucucgaugugauaugccugggcuuuguugguuuuuuuuuuuuaauccuuugccuuaaaagccacauaaauauguauuuuuuaaauuaucggggcaauugauuuaaauugccauuaaucaucacacuuaccaacugugcagacuggaugggcaaucaucuuugccgaugcucuuccucucugccucaugcugcucugggccucuucuccccuccugguaauuuagucuuucuuuucuuugucggcccuugucuuucucucgguuguuuuucucaagcauugugcacugagcuuuggggcagagggggagggagguguagaugcuugcauacagcuugauuguuacuuggguuuggcgaaggucccuggagcccagcaguggagguccaggguacuuaauaaaagccuuuaggauccagaagugucuguuugaagcauggaacaguuggggagcccuggagcuaugugggucagaaccucugccuuucagugcuuagcuugguaaagccagagaguggagcagagugugcacagcaucuguggaggaucaggggaaggggauacacgugcaagcgcucucugcaagagagaacauagcaagggaacacuugaccaccugcuugcucaguuuaucacuuuaagaucugagaguucggcaaaaugucuuaggcuuuuuuuuaaguauaagaaucguuaaagucagaucauaaugguaaguggaugaucagauucccccaggcaguuugaguucuaccugccugcuacuccaaggugaagucuugucucucuccauguaaacguuugggauuuggugauagaaaugucaccaacuugguuaauguucugucuauugucauuauaaaguggcugugacaauuagcaaauccaugaauccggguccaggcuccagucagguggugagaacgaaucccuugcucaugaagacagagcccaagccuccauugcagcccuuaaaaugucaaaucaccugcucugccuggagccccucucugaaucggaaggcacaggggaaacagcccuuacccagcgcaucacagucuccccguggguagccaguagccauucaugaagccaggagacuaugguuggaguaacugguucaagauggcaguagaagcaucuuuggggcccuaauucauuuauuggcuaauugcucuuccuugcuuuggucuuuaaccaugugcgaacauuucuugucaucggucuuugguguucacuguuaauucgguagucagcagcucuccagcuuucugcauuuuagccccacucacgccuucuucucuggucauaaucacugcucuaaugucucguuugcugaauuacaucgcagcggcucaguuggagugguuaccuuuggagcccggauucccaucugucucacccacccugcucucuucuuccuauuguuuuuuccccccucugcugccugcacaccacuucggcugaugauggccauaaagcaacuugccaucucuguaccacuucucacagaggccaccagagagucacagugcuuuaccccuucaucuuucagguacauacuucacucaugaagccaaaggagccgaugacgcagcagacgcagacacagcuauaaucaaugcagaaggaggacagaacaacuccgaagaaaagaaagaguacuucaucuagaucagccuuuuuguuccaaugagguguccaacuggccuguuuagaugauaaagagacagugauacuggaacuuucgagaagcucgugugguuuuuuguuuuguuuuguuuuuuuaugaguggguggagagaugcgagacugggaaggcuugggauuugcaauguacaaacaaaaacaaagaauguucuuugaaaguacacucugcuguuugacaccucuuuuuaaucugguuuuaauuugcuuuggguuuuggguuuuuuugguuuuuuguuuuuuucauuuauauuucuuccuaccaagucaaacuuggguacuuggauuugguuucgguagauugcagaaaauucugugccuuguuuuucauucguuuguuguguuucuucccucuugcccauuuauuuuucccaaaaucaaauuuguuuuuuucccccucccaaaccucccauuuuuuggaauugaccugcuggaauuccuaagacuuucucccuguugccaguuucuuuuauuuguguuaacggugacugcuuucuguuccaaauucaguuucauaaaaggaaaaccagcacaauuuagauuucauaguucagaauuuagugucuccaugaugcauccuucucuguuguuguaaagauuugggugaagaaaaaaaaaaaaaaagaaaaaaaaaagaaaaaaaaaagaaaacacugaaaacucuuugcugcugcccaugucuuaaauacguagagcagcgaagacuagaaacguagacugugacccagacgcugucgucugcuguggaucuucauuacuguacaggguuaucugcaagugaggugugucgcaaugagauugaaucugucguuaauucuuuaucuguaggcggcucaguauagauuaccccacgcugugcagaaaguuuuuggaguggaaaggucuccuccuuccucguugcccuaaacagacccgacaugugaggucugucuguuuuauguaaguggacaaauuugagaugucacaggaggggaagcagggaggggguacgacaguucugcucugauuauuucuacucucaacaauuccauccaccuuucccaauuggccuuacugcucacuaaugcaggagagagcaaguccgugugccgugugacugacuggaggggacaggcuuuguuuagguuuuuuuuacccccacuuugguuuugguucuggguuguuuugcuuuguuuuguuuuccuuuguucuuauuaaggacggcagugggcuguguccuguguguacuguauguuacagacaccguccugcugggacacuuguccugcugggauucccagcucccacccccaacuccucucauuccuucagauuuggcuugacaaaggcaggagguacaaaagaagggccaauuuuguucuggaaaggucagagcccagagucgaggugggaaaguggcauauagggauuuccaguuacuuaaucaaaacucaaaaugugaguguuucugucuuucgugcacuaggccuggccucuuaccucagccuuaagaaccaucugccaaaaacuacucaucucgcaugauggcagccagagcgcauagcuacuaaaauaaguuuccgugaacauaucuuacaccggagccugaggaaagauagaggcgcaaaggaacccuuugcauucucuaaagcuaaguggggguuugcagaagugcuggggucaucuagcaguaguucugaaggacagaaccuaaacucuuaccacacgugucgguaagcuccagacuccaaaacagccccucuggaaagauggcaucagaaaagauagaucuaucuauauauauaaauauauaaauauauauuauauauaacauuuucagucaguacuuuuggauuuugcaaggugcauuuuuacuauuguuacauuauguggaaaaccuacgcugauuuauuuaaggggaaaaaagugucgacucuguucuuugaaagcguauuucuuuuucuugucuuuauuuuaacuucugauagaaccacugcaauaugggggccuuuugggaacggacugguuuguaaaggaaaauucauuauggagcaguguuuuguuaaccccucuccugccccuaggcacuuaaccaagacaaaaagccacaaggaacaucccuuuuucaaaaauuuuauaaugugcaucuauuccgagcccuuagcacccauccugaccauagugaccauaucaaagggugacaaccaguuagcaugucguugaaaggguuuuucagcuguucuuuuuagaaaaaaaauauauauaaaaaauauuuaaaaaaaaacaaaaaacaaacaaacacaaaaaaacuaccauuguucacagaauuggcaucucauuuucgggaccgcccaucuuucuguuuugacaaguguacaguagugcaguguucugauguaacuuuauggcuuacaauguugacaugucucagguuccuguguuucaauugguguuuuuccgucucagguagauugcaaaguguaggccccacacauuggaaaaauaauaauaauaauaaauaauaauaauaauaauaauaauaaaacaaagcaaaaacaggaaauuauggauuuuaguuguauauugguuuauguauuuuucuuaaguauacagugcacuguuugaaauguauuguugaguauuacuuuguacagguugaucacuuuuuuuagagugaagaaagaacaaacuuggguuuuuuuuguguuuuuuuuaaaggaguauaaaauaaugaaggauguauaauugaugccaaauaagcuuguucuuuagucacgaugacgucuuguuuuucccucuaggccaguucuguuucuaagguguacaaggaccauguuacaguguaagaaacuccacauccguguguucccauucgcauuuuguaucgguucauguauaccauuuuuacaaaaagaaaaaagaaaaaaaaagaaguacuauaaaauaucugucuucuuaauaaaaaaauuaauguuacaagugauccuuua

SEQ ID NO: 5081 - RNA, 1096 nt, Mus musculus
ccagucccaggccuaggcugccugcucagggccgaccgacccuacugcgcacccucagaaacacucacguccucccguucagacgucacgacguaaaggcccgccgugcgcgagcgcagacgagcuacgcacgcgcgcgggacaagcgcccguuuccggcggcugcuccuuccgccguugcgugaaaaauggcuacugggguugguaacgguugcgucugacgcgggcuggagugaccugcggcgccgccgagggcccaguuugaucgacauacgucuagcaaacacugcaggcgguguuugaagauggcccagaacucggugucgcuguccgccggcgaucaagccaacaggauggcccaccgauccucccaaggagaucucaacccgucggccauggcuugggcaauggucuccggagauagcuuccugguuacuaggcuggauccgaaucagccgggaccucggccaccagcgcgacccagcguucgggccgacagacgucgagucccugucgguggccgcagccggagccgaagccgccaaggcagauucucgccuuacccgaucccaggcgucaagcucgaccucuuaagaagugugcugcagcagcgucugguugcacugggaacugcucucgcaacccgaaucucagcguagaacgaaugccuccccucacuuagcuuacaaacaaggccucuccaaaaaucaugucuuggugugacggcaguuuuauucuuacgcauuuucaccgaugugggcgguuaauauaggcuaccaaagaaaaguuuagccgggcauagugacacacauuuuuaaucucaagacucggaaagcaggcucugaguuacaggcuagccguuuguuacauagucgaggggcuuaauauccauccauguggggccaagaagaggccaggagggcuuuucuuaaguagucacaaagcuaggugacuaguugugaaugauguagagucuuauagugcagacuugccguguauuaaggauggucuugaacucccccuugccugggccucccaggugcugguguuuacaggcgcgagccauacaccaggcuugaguaagcugcucaguaug

SEQ ID NO: 5082 - RNA, 57183 nt, Mus musculus
cggugccucccggugcucccgggcuucgggggcgguggugguggcgguggcgaccgcggcgaagacgacaacgagaguggggcuacacgcggagggacaccacggccaugacugcggagcugcagcaggacgacucggcgggggcggcggacggccauggcucggugagcggcgggugaggguagcggggcccggguuccggcugagaggggcgcggcgggccaagcgggcgagggccgacagaggccggggccugcgggcuagggcgagagcaacccggucuucccgggacuuugcgaggcuggguccgcgagccugugugagguugccuggguguauaagccagcuaagguuccgagcgggauugugggacccggugcuagggacccuaacgggagggguugcacgugagaucguaggcagcgaggucaccccgaagugugcaccgggcccgacccagcagcuaaaaacuucccaaaagcacggccacggugccuuguucugacucucaaaucaguuuuauggcaguggcuucucugaggcuaacgcagacuuaaguuaucucacuuaaagccggcguuuaucaacaaagugcaaaaaagacccggagccccacuccucccuuuucccgccccgcuuuucauucaguucuuuuuuucccucggaaacaaaucagcuucccgaauuaucucauugaucacuguagguuuugaaggaggggagagaaaagcacaaugaauagaaggcacuuuacuauguuccuaguaauauaaaaagguugaaaaauauuacaaggcucuuagggcuuagauggugggccuuuaguaacacugauuuggaaaaaaaaucaaaaggcucauaaugucuuuuaaagaaacuugggaagugggcaauuugagacugucauccaguuuuacuuuggaauguuauaacguaacacaacauccucgucccucaagaacugcacuuuuuaaaugacaaaauggaaaaccuauaccaaggauucaaauaccgaguuugcagucgagaaaauuuauaaaauauuuagaauaaaaauuugagauacugcuaagaaaaacucuauaauuaaauucuauaauuaaugucuucuauaguuaaauuuuaauaauuugaggugcugaggaucaagccuagggccuaucgcaugagauaaucaagcacuacacccccagacuacaaguuuaaaacauagcaggcucuuuaaaauucauguagaaaaagauaucucuaagucuuggccuguaaaaugaaaguagguggauuuuuuuuuuuuuuuuuuuuuggcgaucagauaaaaauuguuuauuacucaacagugucuuuuggacauugggucuguauuuuucucuguuuuccuccccacaagucuacuuguguuggggacagugacuuauaaacagguggugagauuugguuuugagacagucauauugauacuauuuugagggagagcaagucauauuuaaauuuguucugggcccgucauuuaagaccacaugccuuucgaucagugguauuuucauuuaccucugucacaggcugcugaggagugaccgguaguugagcacucucuauuugaggguuugcauguaagguguuugagcauuguguauaaagucagagcuauuuugggaagguuuggcacucccaggcuguggcuagcugcaguagccugauucugggcgggcgaccugcggagugaugacauuuacugguuaguauucccagagauuuugccccaggcugacagaugauaagcuuugaaggcuugauagcccguugcccuuuuuucucaggucaggauaaaaugcuugaggcauggguuaccuugaaggugugggugcugcauaacuuugacauuucaugagaguauuaauaacuucuuccucuugauaagcuccguguaggacggauucuuucuuuugacuucacaaggcuuucuccuuucccuuaaaagauguuuaauauaguugagaggagcuauccucccccgacacucaggagcuauuuaaaacuugccacguuuucccuuccccaguuggucauuuguacaaaggacagacaaaacuauguauaggcucuccaggauuucagugagggcucuggaacccgagccgacacuugguuaucuuugaaucccccagacuggugaguuaaggacaccuuccuguguuuuaaucaguucucaccuuagguaaaaaccugcugggaaguuuucuguuggaguaggagaaacagcuugaagucaguuugcuucuuaggaaccugaugcccuugacucguugggggaggauucaggacacacaauccccucccccgcucucccacuuggaacccagggccucugcauucuaggcaagugcugcuuccucacugagcuuuguugugcuggcuguuucgguugguucugauuuuccuucgagguaucuuugugguuuuugguuugguuugguuuuugagaccaaggcuggccuggaacuugggaguuagucauccugccuuagucucccagguguacuuaacuccugucagguugugaauuuuuuuuuuuuuuuuuuuuugaguguuagaaaguuguaaucuggcuccccaacucuccugcucuuugagccacaguuauugugcacacagagagugcuguauuuugagcucguaaacagauaaucucuuaucagguggcccggugcauucuguuucaucaaaaugacuuuuuguguagguguuuuugagacagguuuucuuguagcccagacugaccuucaacuuuguaggggaggaugaccuugacccuugaggcuccugugucuguuuucuaacugcuguauauaggcuugggcuacaguaccuuauuauaaucaaagacauuuaaaauaaugccaacacuacaaguaauaacuaacacacacacacacacacacacacauacacacacacacacagagacacauggucucccuguaacccaggcugcgcuccugagugcugggauuacaaacuugguccuccuacccagguuccuccucucagcccuuuaguguuaggcacagccuuggcuuguuagacaucacuuuccaccuuguuagagacacuguccccugcauguggcaggcuagcuggcccuggcccuucuagggauucucugccucccaccccucuguagcaggagugcuuggaugacauugcuguuguguguccggcuuuuauguggguucuugggaaucgaacucagguccuuaugcuuguggggcaagugcuuuuauagugauaagccaucucacacuccccuuuaaauuuauuuguuuacuuuuauuugugugugugccuucauguguuuaugggcacagugccugugugcgugcgcgcuguuccuggagaggucauuagaucuagaaccuggguauagcucaccuacaccugugagcucuugguguuguagguguuacgaucuaaacccagcuccucaucugcaagugcucuuaacugccaagccgccucucucuccggcccucacuuccauuuuguggagaugacagguuuuuauguagcucaggcugugugaacuugucaggugcucagacucugcagcagacucuucugaauuacugcucucuuaacugugccaccaugccuguccucccagcccuuuucuuuuuugagagaggccuggggucucacuguauaccucuugcugcccuugaaccuuguaauagacuaggcuggcaucauauucucugagaucccugucuucucccacuggguuuaaagguaugugccaccauacccagccuuuuguuuuguuugcuuuucuuuuugaggcaggguuuguguguguguguguguguguauguguguguguguguguguguguguguguguguguguguguguagccuugagcuuccuagaacuagcucuguagaacagcagugcauccgccucuuucucagauagggucuuucuguacagaccaggccagccuugagcuuggaacaguucuccugccucacucaguuucuugagugcugggauuuucuugugugucuuuacuuuccagcaacaggacgcuuucugucagggcagauuuacuucaaacugaggcuuuuguuuuguuuuguuuuuuuuuaaagauguauuuauuuauuauauguaaguacauuguagcugucuucagacacuccagaagagggagucagaucucguuucggauggugugagccaccaugugguugcugggauuugaacucuggaccuucggaagagcagucgggugcucuuacccacugagccaucucaccagcccugaggcuuuuguuugagguauucucauaaaguagcccugacuggccuggaacuuacuauguaagccagaaaagccuugaacucacagagaucugcuuguaccugccucccaagugcugcccaggagugugcccccaugcuugagucaaagugaguauguuuauuuuguguauuugugucgugcuggggaccaaacccuagcgggcuagggaagccccucaccucugagcucuguccccuccuguggcuguuguuuugugggguuugguuuguuuugagacagggucuuacugcaguuuuugaaccuuccuaccuuaccucccagagguauuacuacaggugccccagcacagagcccugcuuagcuaccuuccuccucuccuccuccgcucucuuacucuuucguuuuuuguucuuguuuuguuuguuaguuuaagaugagcucucagauagcucaggcuggccuugaacccugugguugaggaugcugaaggugacaugggacugaucuucuugccucugccucccaagcacuuggguugcagaugugcaccaccacacuugggucacauuugcuuaaagucuuuccuagaacucuucuagugguuuaaacuuugaaaagauuaauacaguuuuuuacauuaguuuugugaggggagggcagggaggaacaugggcacccacguggaagucagaagacaucuugucggagcugguucucuccacagugugaguccccggagcugaccuccggugcucaggcucugcagcaggugacugcuuggucucaguguuuacagucuuccuaauugucagagcuugcccuuguucaagagcuauuugagguuuuguccaccugguucccuagcaucucgucuuauuuccauggaaaaacuauaccuuguuuaauccugcuuguuucugagaggccaaccucucucagcagggagaauuugcacuccagaagauauuauacaauguccugggacucuucuuuuuaauuaguuuauuuugaccuuauguauggggguuugccuguauggaugucugugcuccaugugcauggaaugcccacagaagcagggaaagggcauuacauccucuggcauuggaguuguagauaguuuuuagcugccuuguggguguucugcaagaguagcaaguccccugaaccacugagccaucucugcggccccuggggagguuuuccauuaugacuguggggaagagugcugcuggcaucucaccugguauaguuuaaccucccaagaguaauaaugucuggucuguuaugugcacaguguggguacaaguaaagaaacccucaucgaagcuauuugugcuccuuuagccuaaccccacaaauucucagucuucccgaugccaagggugaucagccacuucugcucaccaggaauuuagacauaggaaguuggugugugagcuggcuauggccagucccggugcccagccccugcucaguggucuauguugaacacuaggauggagugcugauaacgugggaucaaggguguuucaagggaaggggcacuugggcccccaccuuagaccuacuaaaucaaagucugcuugggggcuggagagaagguucaaagacuuaagagcacugguugcucuuccagaggacccagguucaauucucagcacccacauggcagcucacaccugccuaacugcaguucaaggugauccaauacccucacacagacauacacucaggcaaaacaccaguguacauaaauacauuuuuuuuaaaagggcuucaguucacucuucgcucaggucugccuggaacauauuauacaggucagguggccuucaagcacacagcaaaccuccugucuccuccagaaugcuuggauugcagguagagauuaaacccaaggcuucaaggccacccagucuaccuacugagccacauccuuagccccaauucugccuuuugcuuccaucccugggggacucauuugcauauuagccuuuuagaagcuuaaggauagaauucccuuucugcugugaauaggagcccuuaaucccgagaacaacaaacccuccaaaaccuugucaacagcauuuucugcuguccccgcccccagauguaguucucuugguuuccagauccaccucuuuucuuccuuuucuaagugaauagaaccuccggauuuuauugucuucuaucaucuucauaacaaaaccagguggguucgaacuagaagaccuggccuccccuccucucucagcucaaggcuugcagcucuuaaaagagcucuuagcucuacagauagauaggcucagcuuccaagccacaccaugcgucuuacaccuuuguuuuuuucuagaaaauaggcucagucugcucacuuccugucaucaggccucuuccccuggucacacugagaaaauacugugccaccaugaugcuugccacguuccuuaagggaaagucucagaguuuuaaacuuguugaccauuuuugccagagugccuuugacacugaguaaccuuuucuaaaacagcuuuguggaggcaugagaguugcuauaaguuugguauuggugaaaaagugaggcccuguuucaaaaaaggaagagaccccugccccccucauaacuguguguuuaagaguuggaaaaagccaggcgugggugcacgccuuuaaucccaggcagaggcaggcagauuucugaguuccaggccagccuggucuacaaagugaguuccaggacagccagggcuauacagagaaaccuugucucgaacccccuccccacccccacccccccaaaaaaaagaguuggaaaaaagaagagcuggguguugauggugcaugaccacaauccaaguaugcgggaggcagagguagguggagcuccaaguuucaggauagccaggacuacacagugagaccuugucuuuaaaaagaagagaagagaagagaagagaagagaagagaagagaagagaagagaagagaagagaagagaagaagcuaauauagagaccuugaaaccacagcccugaccaggaucaccucagcugaggggaugaggcaaguggguuucuagaucucugcagggauggagguguuaagugaaguuucugcaaagcucucaucguaagguggccauggccaugugcucugggcuccagcaaguccugagcugauuggccaguggcuuacagagagccgacaugguuuuacccagucagcaucugcuggugccuggugucgaggcuugccaaaaagacuuauuuuacacacacaauuuauuagagagucagagggcacgugugcuguggggggcgggggggugucagaggacaacuuguaaggaguuauguuucuucugccauauacguucuaaggauggaacuuaggucauccggcuuggcagcaagcucuuuuuuaccuggggagccaucucagcagccuguggaaaaacauuuaaaauguuuuaaaauaauuuuuuaauuuuuuuauuauuuauauguauguaugucuguauaugugcccaaacaggugagagagguuggcucccugaagcuggagucccaggcaguugugaccuaucugaugcgggugcugggaauagaauuuggguccucugcaggagcaacauaugcuccccaccuuaagccguuucuccagccugaaccugugaaaucuuaagcagauuccuuuacauacacacauugggguggacugauccagccuggcuugaguucugagaguugccuagcucugaugucaaagcacuucucccauuguaucaugagccuuccuagacccaaacuuccugaugcccacuugacuggaaggcgcuugaaccugcuucauaccucucaaggcagauuuuguaaaucuagaauguagagucuuccgaguggcacaacuaggaaaugguggugcugagacuggaccgucuuuucucuaggguggcagugguuuucuacaaacaggagcagacuuuacuuggacacugagaugauucuuugacauccuguggaugcuaugaaucucauuuuccaggcacaaaaacgugaugcuugggaagguugugauaggugagaugugagucccccucagcgugaacuggcuuuccagucaagccagccuaaaggucuucuggagugguuccagcagcaugcugcuugacucucagauacgauguaaauuugagucuccugggcaaugguggugugcacucaucagcucagcauucuggcaggagcuccagccacccugugccccagagcaggacugucuuugcuuguuugguuuuuuaggucucuaaguuuugaucacccuaaaagaaaagguggauauguugagugucuuuccuuggucaugcucucccuuuaguuuuuccuguuacuguuuguguguguguguagugugcacguacagggugugugugugcgcgcguguguguagggaggacagcuuuguggagucaguugcacacacuuccacaucccucugagaauacgugacugaagcuuuauuccuguugucugaggugccaaggugugcucuaccucccugcuuuccgccagcacccugcccccuccucuccucaccacugcuuugcccaaaagcccugucacucagcugaaaugucuuucccucaccccauuuugaaauaguuguuaacaugcgcuaaaaacaaauaaauagauaaccuuucccaagggcuggagagaugcuuugguuaacagcauucacugcucaauucccagcacucacaagacaguuuacaacuccaguucucccagaucuuaugccuucuucugcccucuguagauacugcaugcauauggugcauagacauacaugcagcuaacacaccaacacacgcaaaaauaguaaauaaucaaaauauuaaaaauuguaaauacacuuucugagccaggaggauggcauagcagauaccaggugcuugcugccauaccuaacaaccugaccugagugucaucccugggacccacacagaggaagaagagaaccagcuugcacagcuuguccuaccuccacaaauaaagacacuucuguacacacagugcccccauuugucuguggcagagccgcuggccuucucacauucuaucugaauucauccugaccccaggaacccggugccggagcaagacacgccugacaaugacauuuuacugugccugaauuucuaaaacugggcacaugaacccgauggcccagcuuccuguuaucuugcccacauacuauacuguuggguacuguuuuucuuagguuuuguaggcguguuccacauggcugcuggcuuuguggucucuucuuauauuuuaguuggguguguacugaaagaagaagcacucucuuaggucuucuaaagcaaggcauaggaaggacaucauauguagucugagaaauacuccuggucaccuguucuggugagaugaacagagguagccucuagcuguggcgauggggugaaggagcaguuccuuugugugugugaucuaguacuuuugggacuccuuucuccuggguuguaggggcggggggaggaaagcgagccauuuauauauguauauauauauauuuuuuuuuuuuuuuuaaagauuuauuaauuuaauuauauguaaguacacuguagcugucuucagacacaccagaagagggcgucagaucucuuuacagaugauugugagccaccaugugguugcugggaauugaacucaggaccuucggaagagcagucagugcucuuaaccaucucuccagccccuauguuuauuaaguaauaaauucuuuuuguuuggggcuguaagccaaauuauuauuaacucccuaacuauaaaugcuuuaaauuuuaacuuauuggggggugggugauacaagugugaugauauguguccccaucuguguggagaucagaggacagcuuuguggaggaaguucuuccuuccagcuguuaaggucuuggaccaaauucuggucaccagacuuggaaugcagaugcuuugaccaguugacauuguuggcucuuuuccuuuccuuuuuccuuuccuuuccuuuccuuuccuuuccuuuccuuuccuuuccuuuccuuuccuuuccuuuccuuuccucacuuacauauguauguauguauguauguaugcaugcaugcacugcucugucuucauguauuccugcaggccagaagagggcaccagauuucauuauagguggcugugagccaccauaugguugcuggcaguugaacucaggaccucuggaagagcuagcuuuuaaccacugagucaucgcuccagccccucccuccuacccucccuuucuucuuuuuuuauacaagguagauaauuaccccaauggguauuuucaucccauuuugacuuuauuaucugugugugaccuagcagaaauacuccuucucccuuuuucccaucugucuccccacucccucauuuuuugcccccaagacagggucuugucacuaugucaguaugucacugcccuggaacucacuggguagacuaggcuguccucaaacucagagauccaccugucacugccugaguucugggauuaaaggcauguaugaccacugccuaaaaauuuucauaucauuuuuuaaagacaguuucuuacagcccagguuggcuuugaauguagcuaaggcuggucuugagugccugacccucuugccucagccucaaguaguauuuacacauauguauaccuacgcaccauuuaaaauuuuuaugugaauagcucuuuugccugcauguauaguugugcaccauguguguacagugucuuuggaggccagaugggugcuagggauugaaucucacauccucuggaagagcggccagugcucuuagcugcucaguuuugucgccugccccaacuucuccauuauguauuaauuguauacaguggguuucauugugaccuuuauauguguauauauuugauccuuuaucuuccuuguccugaugaucccccuuucucuugacaacuacucuuccuacuuugaugucuuuuuggggacccaguggcuuuaauuacaguuucuggagcgugggugagagguuauuuacaggccuaagaacaauuucugagugacugcacaacuggagaacugucuuccucuccuagcaaucauuaucuacccauagguccucugggaggaccaugagcucuucccguguucauuuuuuaagacaagucucuaugugguuggccuagaacucauucugugacucacuguguagcucaggcuagucccaauuccucagugaucuuccugagagcagguuacuggcuugcuccaacaugccugcuguccuagcuacacuucuauuagucacucgcucuuaagguugcacacuggaucucaguggccagggugggcugcuccaaacuaguuggcccuaaaaagacugccagaaugaccaacaggcaaccucuaaugcauuauguucccaucugcaugauaaaugauaccccagcucucugaaaaccgcuagauagcaaagaauuauaaaaggaggaaaagagguaguggcucgauccccagagggucuguccgucucagaaaagccaugaguucuuuuuuagacaccccacccccaccccauucacacucucugacucccagcacauagguccaacauugcuguguggagacaucgcucacucuucacggaauccugcuuaaggcugaguugccuuuacugcucaacugguauuggucuguuacuggcuacaguuucuuucccaguuuggagacaugagcacaaagucccaucccuaaccaagaagacauuugcaauaccugccugggagagaaaguucacuuuucucuagugaccguggguguaucagucacacuccagggcaggccccauuacugagcaguucaccaacacaaacccccacacuccacauuuguuuguugguuucagugugugcuuguuuuuguuaugguuugguguuuuuugggggggaggggaggggaggagggaggagaaucugaaguuagaugggcggugguaaagugaggauuagggagggcaaagaauaggaccaaaauauauuguaugaaaaaauguuaagaauaagagaaaucuguccuagugaggucugguuggcucucaagccacuggagcugaggugugcagccagccuuccucuagaugggcgggucuguuuccuuuaaaagccucugaaaacaguaugaaauuagucaaggaaaugcaaaccugucugugcuugccaccuuuugacuucaucaaaacagagcacgggcuuugucuuguuugcacuagaguguauuuucuguggaguaguguaguuagagaggguuagucuuaaagucuacuucugugaggugucagagcgugaacuggggacacugugggugugugauaacuuuggccguuguaaaaaaaaaacuuuuguaauucuuguuugguuuuuugagacaggcuuugcuggccucccaacuuguaaaauccugccucugucucucaagugcuggggugccagguaugaaccaucacaccuaacaaacagugaaggacuggaaacaugacuccaugcuuaagagcguuggcuucucuuccagaggacccagguccaauucccagcacccucauaguagcucacacuguaacuccaguuccaggggguccaguccuuuuucugaccuccccaggcaccaggcaugagcauauagacauguaggcaaaacaccuauacaauagaguacacuuuuaaaaauuaacacuauaugaugcuugccuugacugguagaaugccacaguuguuacccuccgaccugccaauacuagcuuguuuagagcacauuguaccacugaguaaucaacuucugauaguauaaagacuggcacauuuuuaaaagagaaguuuaguauugugcaaaguuccaggucaaaauacagccaaauaaauaaauaaauaaauaaauaaauaauaaauaaauaaaauguuugcacugguuuacauuaagaggguauuugcuucuguuucauugucucuuuagagaugcuggcagucagcccacccaccccagcaguaauucuaaguuacuccucuguggucguagguugcuaugagguuugaaugagcuaagccagcaucaguuaguuaauacuuauggagcuuucagaacagcacagagccagaaguagguuguguguguuagcacuuauuucgugcugggacucuuauugucucugcauuggagugacuugugacauucagagcaauuccagaugaagaugugguucuuauuuccccuccuucuuaguccuucuuacuccucucucccacgauuuuucagguauguugauuuuggcuuuccaaaaaauuuuguaggcuccagauucauagauucacauaccuuuuacauggugaaaucaaaugggauuagaauucauuuggaaggaaauuaguaccuuaaagaaaaaaaaaauaaaaccugcuuauauuuccaguuuuugccaaaguagaaucucagccugauagccccuuccuucccugcccagcucuggugguggcuuugucaagacccauaauguccaagacugcugucucagugggaagauuccauuucuagcuucugacuggagagguugugacaagagaaaggcucugaucccuuuuccaggccugggagggcuguucagucgguuauuucuaguugugguacuuaaguguugccagcggggcccucagcuguugaagaccuuaggauacuguuucgguuacagcuggcaguaaaugaagcugacucucugagacauuacuaauugaacuuaauggugaagccuguagagugugaagucaggacuuaauccuggcacacacaaccuuagcuaugguauaaauuagaucgcugcucacgauuuaaccgguuucuuuuccauacuuaccuacuaaacggccagccgguuguuugaguugagcuuuccguguccagagguguuuuauaucagcucuggcugcccaccaggaugguagggugagcacuuaggcugagaaggguucuuaagaugagcuguguaguuaggccucucugugguuccgaugaauggagcaccugcagcucguucuuccggaacuuuaugucuuauuugauaguugagaaagugcuagcuuucuuuuaagguuaguaguaccagccauuugcuaauuacaugguuagaagcuuauugucagugaaaaaugacacacacacacacaaauggcaugcacaguaaagcuuaaaauagcucauccucacauucaugcagauucccugugcgccuuauaugaccugaugcucugcuccgagaaaggaaaggccaaggcuccuuaagcauacguuaaggcugacgguuacaaguguccuggguauuuggaguuuucuguugagucauauauaucucuuguaacugcucaaaguauauccggagaccaaaugauagaccgggcauuuucagugucucugaccaucagcaacuugcugcauggagcuugucagcacuuuauaaagugaaaagugcaagauuugggccucucuguccagaagguacccaggaaugcuuucugacaccuaucugauuuugucucucaaaaacagagcugccagaugcuguuaaaucagcugcgagaaaucacaggcauccaggauccuuccuuucuucaugaagcauuaaagguugguuuccagacccagcuuagcugccagacgcugaagcaguuucccacaugucaggugugucagcagacgcucuuucuauaccaggugcaagcauaagaacaggaaccaacuacaggucaggugguuaguuucuucaacauagaaacuuggaaguagauggugggaauguacagugggcuuuuaggagucccagcauccaugugcauuguauccauauggauccugagugggaccaacaaaccaaaaauaacuccagaaggaaacuuguuugcucuuaacacgugauauucuuaaguauuguugguuauauuuugaaaagauacauucugaauguuacccaaggaaaugguagcacaccuagcuuuaaaauagccagcagguauaggcaguauagauaaaacaugguucugugauuggguaaaaggcauuguugugccuuuuagacuauuuucuuaguaagaaguucaaggggcuggugagauggccuaguggguaagagcaccggacugcucuuccgaaggcccugaguucaaaucccagcaaucacaugguggcucacaaccauccguaagaucugacucccucuucuggaaugucugaagacagcuacaguguacuuacacauaauaaauaaaucuuuaaaaaaaaaaaaaagaaguucaaaacagcuaugucaccguguaaaacauggugacugcucauggcuucacugucugggcugagugcacuuaucacccguguuagcugccaguucccuggagugacgcgcugugcccuaacuauucugugaaguuagacuccugagaugacugaacuguccagccaggcugugacuugcuuuucauguugcaguuuagagucuucguaucaccuggcuugcuccaucuccaggugcaccaggcucccugccuucacuagacugucugcucucugccucagaccuaugauugggcuuggucgacucacucugucaccaugguaguaaaagaacagcacccaaacuagugcacacgguuaacucugccgugcuuuacuuuugaaauuuguuuguuauuuuuuucuuuucuuucuuuuaggccaguaauggugacaucacccaggcugucagccuucucacagaccaaagaguuaaggagcccagucacgacacaacugcugcagaaccaucugaaguagaagagagugcuaccagcaaagaucucuuagcaaguaggucuccuguccuugucuucugaacaggcagaagacagcgacuggccgcucauuuaucacaucaacccuuucugaggggucacugagccauugcuggaagccaggccuggggucaagcuuuuuuuuuuuuuuuuuuuuuuuuuuuuaagauuuauuuugggggagugggugggggacuuuugggauagcauuagaaauguaacugaaauaaauaccuaauuuaaaaaaaaaagauuuauauauuauauguaaguacauuguaguugucuucagacacuccaaaagagggcgucagaucucauuacaggugguugugagccaccacgugguugcugggaguugaacucaggaccuucagaagagcagucaguacucuuaacugcugagcuaucuuucuagccuggggaucaaauuuuuaaaugauuucuuucauuccuucuuucuccuuacuucagcccaugauggcuuuaaauguuuuuuucuucuugacuaguuuuuguaugucuguacuaggucauaagccaacuuuauaaagcuagcccuccauucaucauagaacacuauguguaugguugacuaucugaugcuaggauguuuuuacaaugguaaaguaaaggcaguuagccuacagguaugaaauauauuuuugauuuugugggauauuaacauuuuauuuauugcauguauguaggucagagcuuuguuucacgugucuuugucuaucucauuuauuuuuaaaguucugguuauuuuuauguauauaaguauuuugcauauguguaugucagugcauugaguacugccuagugcuccucagaggccaaaagaggcuugaguuaugacugguuaugagccaccagguaggugcuguuaauugcugaguuaucucuccagccucucuaccuuuuuuuuuuuuuuuuuuuuuuuuuuuuuuuuuuuuuuugagacggggcugcucaccgaaccuggggcugacuaguuggcuaagcagccaggcuacuaaguccaugaacucuucguucucccccaggacugagaauauaggcaugcaauuaccgugccugucuuuuuuacaugggugauggaacuugaacucaggucuuuaugcuuaagcagcagguguucugugcacugaucauaccccagcccaggagaauuguuuuggucacuuacuugggaacugucgggauaggauugcagugcagcuauauugcucauuugccuuugagacaguuacaagaugugugccgaggagccgcuggugagaguuagggaugcaugugguuggaagugcuuugccuucguuacuuccugacaugaacuaaugaacgaaucucuuccucacagaagugauagaccucacucacgacaacaaagaugaccugcaggcagccauugccuugagucuccuggagucuccuaacauucaggcugacaacagagaucuuaauagguuguugcuuuaauuuaugaucuuuguuccucgugguugcuuugucauauuguauucugggaaagcuacucagguuucuucauugcuccaagauaguuucuuuaaggagcaaucuuagcuuauucaguucccuuucuccuccccgucccucuuuuuuuucuuuuuucuauuuuuuuggguggggggugucucagaguggccugaaaucugugaccugucucccucacccucgagagugcugggaucccagguaugugccgacacucuggcucuugguucacucugaagagggacagacauggagacucuuaacccggucuguaguuuuugaguagaaguuuacaaaguguguucccaguuacuaaggaaaaccaauaaugagcccacguaccugauaaguacaagcucuucaguaggguaucccgguugaguguaaaccuuuaaugugguaggaaugaauagccuggaaccucaacucauuuuuacuaugggucuuacuaguaauaguuucugguggaagggcuuaaauuuguaauuaaaccucucuuuucacuuacuuacaacugaagagcuauucuguagacacuugauuguccaguggaugguuauccugauauuagaaucaucuguucaaaauaccagcauggucuguauaguaaaucauucuuuaacugguuuuuuuuuuuccuucuuuuucuuuugauaugugguguugguaugcuacagagcgcaugaggcuaacucugcagaaacuaaacgcucaaagagaaaacgcugugaaguuuggggagaaaaccacaaucccaauaacuggaggagaguggaugguuggccaguugggcugaaaaauguuggcaacacauguugguucagugcuguuauucagguaugguguuuuuaagagacaacuguuuucuccuggauauaauuucauaguuugcuaaaaugaaacaugugaaguauaaguugaauugggugaaacuggguagguagucuuuguugucguguuguuguguuguaguuauuuugguauguuuggacugagaauuugugaugucuaaacugcacaauacuaaaauauaaauacauuaaguguuuggggucagcaguuaaugaauaccauucaggguagucuggaguaggggcauggcagaugggcauccuggaaagaggacuguaaaauuacucuuuuucauuauguagucuagacuggccucaaauuugugacccuuuugcuuguaccucccaagugcuaggguuuuaggcauguaccaccaugcuauagcuauaugcaugaauuacauauauauuauuuacuccaagcauguuaucacugagccacauucccgguccugugaaaacacucuugggggaggaggacugugaaaucuauaggacucgaaggucucgaggagugaacagguagcucacugccguuugacacggaagggauaauuugugguagaaguugccaauaggcuguagaugugcuaaguucaaaauaccuauguuuacauccuuguauacaacacuacauaagcauuaacugaauguauuucuaguucagaaaagaauacucucagguucuaaguaaagccaggcaaguggauggguuucauuugagagaaguggcuauuaaauauuuccuggagcuggagagaugguucagcaguuaugagcaauuguggucgcucuguagugcugguaucucaaaugcuggggucuacagcaacuggcugcacuuucaccaaaagcuucuccuacacucucuucauggugcaaagccuccccuuuuuuccacgaccccuucaguucuggggcuucuacugcuaccgaggcugcacccucuucggucgccucugcuggcuucucauaugccaagccgcuguccgugacccugucaugccuucaaaaccacuaccgccuagguuacucuuccaugguaccgagucuggcugccagcaugagguccaaaucaccacuaauuucacagcuccagcugaccagcaucacuuguccuggcaagcagagguuucccuuuaguaguacugauaccuuguuaaucacagcuguucuucagccccagcuaaccagaaccacagaaucuucccacaaaagcccaggagagucuuugcuucccucugaaaagucgugagucuggccuccaucguccggacugcucucagcauucuuccaagcuccuagagaacaguccacugaacucucgacacucaguggcucuucuagcccaaaguucaaagcccuuccacaguccucuccaaacaacagagucuggucuaccacagcacuccccuacuccugguacaacuuaucuuagguaggguuucuauuguuacaguaaaacacaugaccaaaaagcaaguugggagugucuugaguuaggguuucguugcugugcagagacaccaugcucacggccacucucauaaagggaaacauuucauugaggcuggcucacaguucagagauuuagccuggaaucaucauagaggaaagcaugguggcacgaagguaggcaugguguuggaaagguagcuagcugaaaguucuacaucuugaacugcaggcagcagagggagacugccacgcugggcuuuagcuugagcauauaugaccucagacccugccuccagcaaagccacacccacuccaaaaaggcaacacuuccugauagugccuuucccuauggccuagcauuaaaauacaugagucuuugggggccaucccuuuucaaaccaacacaggaaggaaagaguuuggcucacacuuugauaucacuguucauuauagaugaaagucaggacaggaaccuaaacaggccuuggaaccuggaggcaggagcugaggcagagacuguggugcugcuuacgggcuugcucugcauggcuugcucagccugcuuucuuauagaacccaguccaccagcccagagauggccccacucaugguguccugggccucccccauugcucacuaacagcuggguguuauggagggaggcacugucccaacugaaguuccuuccucuuagauugauguaguuugugugucaaguggacauaagacaagcuaucacacacuuaagaaaaacguucccucagcacuaucagcuucguguguucuuucccucucccugccuggaggcaugucugugcuaugguucuguggcaucaccuagcugcucaagccaaaauacuuuguuuacuauaugccuggcucugauugggaccugggaaacagcaguggcuaagacaaagcccguacucuacuggaguuuggcuaagagaaucaggucguauaaaugccacaaaggcauugugaaggaggguguacuggcugauuuuguguccacuugacccaagcuagagucaucagagacgaaggagccacaguugaggaaauguuuccaugagauccagcuguaagguauucucgauuagucaauaaugugggagggccuaguuuuuguggguggugccaucacugagcuagggguucugaguucuauaaaaaguaggcugaugaagcagugaggagcaagccaguaagcaagcacucuuccauggccucugcaccagcuccgcccuccagguugcugcccugcuugaguuucugaccugccuccuucuguccaucaacagugcugugaaaguguaggcugaauaaacccuuuccuccccaucuugcucuuuggucaugguguuccgucacagugugaugacucagcugaggugcugcugcuguaggguggucuucgguggcuuagcugguagaagcuuuuaagcagaggcaugaagggaggacugacuccuucaggcuuccauacaaaugaccugaugugugugugcugccuucccaaccccucagugagcacauaauuaaagcacagugaguguagcgggagcaaagccacgugaggugacucagaucuguagucaccuuugaggaaagggcaagaggguugcuacagguacagccugggcuuuguggugcauuccacaucagccgcggucugugagaccugucauaaaagcacuguggaaaguaggacugccagugaguuaguccaagaccacagcucucuaguguguguacagacaggcauauacuagagucagaaugcccuuaaucuugacugcugugagagguguucaacaggcuuagguuuucuugcuugcuugcuugcuuuuuuuuuuaaaucuuuuauuuuuucauuuuauuuuauuauuuauuuauuuauuuuugguuuuucgagauaggauuuuucugugcagcccuggcuguccuggaacucacucuguagaccaggcuggccucgaacucagaaauccuccugccucugccucccaagugcugggauuaaaggcgugcaucaccacgcccggcgcuuacuuuaaaaaaaaaaaaaaaaaagauuuauuuuaugaguacaguguugcugucuucugacacaccagaagagagguaagaucccauuacagauggcugugagccaccaugugguugcugggaauugaauucaggaccacugcaagagcagucagugcucuuaaccgcugagccaucucuccaaucauuuccuuauaauaguagaauugguagguugacaguauagauacuuuuaaaacaagguaaugaugagcuaggauuucacaguguggcgauggaccuagaccucacugggucccaggauggccuugcaaccacuguacuccuuuugcuucagcuuccugagugcuggaccacuccaagcuaccaugccuggcuuugacauacugcaccuguaauuaaacaugccuguaauccuagcagucaggagucugaggcaggaggaucaagaauuuaaggccagccuugacuacauaaggaguacaagggcagccuaaaauaucuaguaagacccuguuagauaauuuaaaaaacaaaaacugcaauuguuuuuguugggguucaggagccgccacacaaaccauacgaacugccagaggcgaggguggaggcaguuguacguuuuggcugacuuuuaagcugauugguccuaagugagguaagagggaugguggcuggguggugaacaggggaguuccagaggacugagcuagcagcauaaguaauacaaccauagugccuuuuaggagaaauucucagugucggcuauggacaguuccuucugggacgcagagucugggaaccuguacucaauuucaccuuaggagcaaaauggagacuaaauacaaaauggcuucaguuacauucaaaggagcaggccucaacaguugaaagaaguugagaauaaauuucuuucuuucagucucucuuucaguugccugaauuucgaagacuuguucucaguuauaaccugccacagaacauccuugaaaauugucgaagucacacuguaaguuggcacugagacaaaguuucuguguugcuagacccagugugggaacugugauaguccuuggcuaaggcacucuucucccuccuuuggacaagaaguaaggguuugcaaagauacaguuaaguaggaauaagcaaugccaaggaagugcagugaggcacuguuuuauuuaacuguagugcugcacuguuggugauacucagaaccuguucuccgggugcugucucucuccuaccuuuggcugccgaggucaaaggaugcagagcagauagcugaggcagagccaggcccuucuuggacugcauccaucuugcccuugcaugacaccgugcuacagugcauccucuuagguuggugggcagcugcaaagaacuccagaacauugugucuuguccucagcauguccccugacugcuucacagcuccgagugcucuaggcuuaccccugcuguccucaucuggucccucuguuauucuuacuggucuagaacuugguaaaugugaacuagugauuguugauaauuuuuuuuucauuccuuugagcuuuccaaauaagaucuuggcuuguuuucucuaggaaaagagaaauaucauguuuaugcaagagcuucaguauuuauuugcucuguuguugggaucaaaucgaaaauuuguagacccuucugcagcccuggaucuacugaagggagccuuccgaucauccgaggagcagcagguacuuuguucccuugucauauuucaaaggccagugucugagucacccuuugcuagugugguacugcuauuugaauuguuacuguaugacaagcucugaacaaagacaagaugacugccuucaucugcccuuuauuucgcucucagaagguguaguuagagcagguguguucacaugggugagaggugcacgaugcgcuggcacugaaggaggcagaagugggaggaagaguaucguaaguggggaggauggcucuugccuuaaccagcagaggcuuuugaagcaggaacaaauucgaaaaguaacccagugagccauacugaaggauaauugagaagagucaaguccugugucugauggcccagguagaaaucuugaguugguuuggauuuuaaggcaggucucaguauugaacccaggugauuguugaauggcagguccuccagccucagccuccugaaucugggauugcaggcuguaacgucacgcugggauagauagaaauccucuuucccacucugcugaagcugaguuuggcagcuuuucucuuucagucguggaaucuuccccuuccuucuccaccugcuacugagcucagagcuguugcuguugcaccagcuuugggcuccacaaugugaaacccccacacuauuacauggcuacauagcuaacuagcauucucaaaacaguuuguaaaauugccuuucucugucacuucucacagaacccuaguggacuccagucuguuccuuuuguuuuguuuuugucacacacagauguggccagcccuguagcguuccacuuccuccuggccuagcugauugccaucacagcagugcccugcuguuugucucuagucacugggcuuccugcuccuaugucuuuugccucuuaaaagggagauuaugucauaggaguagaauauuuauuuguggacuuaaaagcagaccuuuguuuccuugaguacaguauugcaucuaacuuacugcaauuugugccucucuuauagcaagaugugagugaauucacacacaagcuccuggauuggcuggaggaugcguuccagcuagcuguuaauguuaagugaguguugaggguuugucugcacauccuuccgacucacgguggccgcugagaacaguuggugggcgaagucacucuucuaaaguagaaacugccaguguuugccaaacuucuugguggccacugagcccuguuuuggcuuuuccuguagagaucuagacuguccccucaaccuuuguuucucugaaccugaacuaacugcuugguuguaagauguaauuaaaagcggguaaaggacuccuaaauguggacaugguguaugguauggaaccauuauauuuaaugucacucaccugugacaucuuagcauucacagagcaugugggucagucaucccagcauggacacaggaccuguaucaucuguguguggcugccaagaaccacuuuucuaaauaguuuuaagucuggaguuggagaauaaaguaucaugaaauaguuugcaacugggaacuuacacacauaacuaccguauaagacgagggaacuuaaaacauacuuaaguacaauguaagacgagcuuuaggaaaagcacauuugcaugcuacuuauauugugccacugaggaaaucugaaagcauuuaccugugaaacucugggggaguccauucuuugcuccugugcuguucucuaccuugcauauacauguaaucuggcaaacuguguguagagcaaauguauauacacacauauuugucaccaagugugaccccaaggucaggguucacacauugccucccagcacagugccaggcaucuucuugucagucagggucugagcugaacuacaucuuugcuuccuuagaaacuaagauaccuaccaugugacaguguggugaugagaaugggcaggcuacuguucucauuucuuucugagugcugcucggguuuuaugggcauguauuugauucgagucacacagaacugucuuaucucuuuuaaaauagcagccaucucaggaauaaaucugaaaaucccauggugcagcuauucuacgguacuuuucugacagaagggguccgagaagguaaggucugucuuuguccuguguguguguugucaccugugacugggucucauugcuucauuguugcaggaagacaggauagauuugaaaguccaacaaacugaagacuuauucucuggcuuuucuccaugugacuaugggcacauagucugaguccucagucucuagaucuguacagugggcacagucuuuauccuagaacugucauguuaaauuguguaauaucuauguugauggcagugauccuacuuaauuuucuauauuacuuuuccugauggagcaucuaaucucagguucuauagaauggcuaagcacauagcuuuuacuuuuuuagugucaggauuuugccuauguacaaauagaauaguaucgaaaccucuguggauucagcagcuugugaacccauggccagcucuucccuauaucagccucauucucaugugauuacagccaugcaccaccacuggaccuuagguuuuagauuuacuauauguguuuauuuuuguuaguaggacuugaacccagaauucagggugcauucuuaacugcuacaccaacagcugcaguuuucauacauggauggauggguggauguuagacauagcccagcaccauguguaguaguaacuacuacucgguugcugugauaaaauaucaugccuauggaaaucuauugaugaaaguuuucuagcuucugggucuagaggauuagaauccgagauggugggaacaaaauggcaagcaggcagcuguuacaaaacacugagaggugacaucuuuaacuguaagcacgaagcagccagagcaaguggggagcagggcaaagcugugaacucauacagucugccuccuagugacauaccuaccuccgucaacaaggcuaccuccuggacaggaaggguucaaauaggagaccaugagaaacauuucucauuuaaacuacaguaucccacucccuggcccccauaggcgugugggggcccaacagaguuuuacaaguaaaugcuuacauuacuuguaaaacauaaccuccuaacaguuacagccguucuucccgaguguuuuggcuguaacaauaaacuuccugguguucuuuucucuccaaacuguacauuuuguaguuuuuucugccccacuuuuuuuucaugguagacuuguggaagcauuaacaauaauaaccaugccacaaucucaacauuauguagucuugaaauuuucuaugccaaagaaaccaguccuguuuuaaaguuugccucaggcaaguucauagugcaaaggcagaagguggcccagauucuuugccagaauaucacgggacuggccucugggugcuguuagucuuggcuccuauuagaacacuccuuuaagcucugccuacagcauucaacacuuuaguuccaaaaucuuccacauuccuccagaaaucagcagggucgggugcuugauugccucaggccauccagucauucauucucugguaugagcuucuucuguguuaggggcuuuucuguuggguaaaacaccaggaccaaaagcaaauuagcaagugugauuuuagcuacuguuccagggggcgauguggggagucauggcugcacucagcaggcaugguggcaggagcaggaagcugagagaggaacgagcaaacugaaggucgggugaggcugugaacuccauaaggucaccucaggugacauccuucuccacuaaggccauacauaccuccuaagcuucaaucuggacaugaggcguucacaugucugagccugucagagaauuuccucauaaaucgccacacacaauuucuccaaagaaugagcauuuuuaagugucaaauauauuuaaauucucucucucucucucucucucucucacuauauauauauauauauauauauauauauacauauauauauauauauauacacacacauacauacauacacacacauacacauauauauuucuuauuuaggguuauuauugcugugauguuaaaauaccaugaccaaaacuaaguuggagaggaaaggauguauuuggcuuauauuuccacaucacaguccaucauugaagaaaauuagggcaggaacuaaagcagggcuagugagugaaaacaauaauuaaaaaggaaaggacauuguguucauugugggagagcauugccagaggcagaggcgucugagauaguccagaguggcugugagcccugagccauguggauguagggagaaggggaaagaagaagggaaccagcugcaguauccuggaggcccaaaaaagaguagacagguagccaaaacgguuggaucauauaggaaagggcggccuagacccugggcuggagagagucaugguagugggcagggcaugccaucaggagaaccuggcagucagguccacuuugguaugugaaauacaccucugccagccaucccauuuuaauagcuagagacaggaacugauggaagcaggccagggaagggugcuauuuacuacugaccugcuccuauggcuugcucagccugcuuucuuauggaacccaguaccaccagccuaagaauggcacuguccacauugggcugggcccucacccaucaaucacuacuaauuaagaaaauucucaacagccagaucucucuuuuuuuuuuaagauuuauuuauuuauuauauguaaguacacuguagcugucuucagacaccccagaagaggacgucagaucucauuauggaugguugugagccaccaugucguugcugggaucugaacucaggaccaguuaagagcagucaguguucuuaaccacugagucaucucuccagccccucaacagccagaucuuaauagaugcaaauucuuaauuaagguuaccuccuuucagguaacucuagcuuguaucaaguugacaugaaacuaaccagcauaguuccauuuuacauuuugugagacugcccaccaccccaagagauggagaagugauugaagaagaucuccaaaucgauuuccucccugugccuacguggguuaguaaaccccacacacaaaggggccagggcugaccuagaacacucaaccucagaguuuguuuuagucaauauugaaaucccuucccuuggagaaagcaacccggagcugcccauauugagucagaaguauccacucagccuccagguucuuguaugacuguuggcaagucucauuucaguaucugugggcuucacuuccauccacguucuuuuccccuugaaauaucuuguguuacugauuuuuuuuuuuuuuuugguuggggugggggcagggucuugcuguauaguugaggauagccuuuauucucaguaguaagccuuucaaggaccagggcugcagguguucagcacuguguccauauuuguguccauauugaaaugcauguuuugaagaagguaauuuguuuguaauaaccccuaggucuggaauucacuggccacguccuagcacacauaguuaacgugacacgggccucugccacucuuguguguccuguguagucuuauuccagccaggacucucaugguggguuugacggggaagccugugccuugggcuugcuacuugcagcaugcacaggcccggguccaauaggucaguggagguuaccuccaguguauuuuucuccacuucucagagacuacugaguccuaacaguggugucucaguggagccagagaaauagacuuuaaguggugguaguuaagcuuaacaaaccccucuuugccuaggaaagcccuuuuguaacaaugagaccuucggccaguauccucuucagguaaacgguuaccacaacuuagacgaauguuuggaaggggccaugguggaaggugacaucgcgcugcuuccuucggaucguuccgugaaguaugggcaggagguaagguguauauuaccagugacagagccaguuaaguagggcugaacuugaggcaaaccaguucacguguuaggucgccacacgcugagcagaucuugaaucugucucccaucucuaagcaguuggugugaauccugaguuacacauguaagggcuugugucgcuuugaugugauuucaguaugaucacguuucucccuuucuguugaagccugcguguaccugagcagggagaacgcacugccuccguauuuuuggagguaaaaaacucuuaaugaugugccauuuagaauauuuugaggcaaaacuggcuuuuggaacugaauuucaagaauuauguuaggagaaauugacuugaauuaaaguagggcaccugacauaggccuguggagguguuuuagcccuagacgaugguagaauguugagagcacuuccuccucagcuucuccagggaaaaagggauuccuggcaguuccuagugugagcuauaccuuguguguacagugaaugagcaguuacuacuuaaauggcauccagggacacggauuucguaaaaauaaaacccuagcaagaguccuuaugcuuguuuaauuagauuuaacccagaagagccagucaagaugguucaugcuuguaauucugucaccuaagagacugauuaaucaggauuguuacaaguucaaggccagcguuggcugucuagugagugagauccugucucaagaagcaaacaacaaagauaaaaagacucagcugugggggagucggaugcccauggggccagccgccacccguggaagacucuggggggcaggcaaagcugcuggugcaggcuugcuucccucagcugcgcucggaaaagaacgugccuucuuuucaaacucugguugccauuguggguucacuggccuggcuggcuuuucaagaacuucugucuuggaagucagauuauuuuccucagaaacaugagacuuuuacauuuuuauuuguaaauaggacuuaaaacuguggcuagcuguaaauaaacaguacauaguauauuuauaguguuugucuuuuuagaugauuauugagagcaguuauccccuaauuacacgcuguuaggcuguuucucguaagaucugaacaucuuaaauucugaugacucuuagggaaugacuugcauuggcgcauggucaguucuuguauucuguggugcuuauuucuaaaggugaugguugaacgcaaugcuggugguaaauguggaugcugaggaagguuuagucuucaaguauaauucuaaguauuuagauaguaugugagauaaaaugcuguguaacaguugucuuggauguaaauuucauaucaaaagaaguuuggugaaagguauuuuaaauguggcugauauuuccugacauugacuucucuuuccccuaugguuuuuccuuggcagcguugguuuacaaagcugccuccaguguugaccuuugaacucuccagauuugaguuuaaucagucucuugggcagccugaaaaaauucauaauaagcuggaauuuccucagauuaucuauauggauaggugaguauugguucaaacacaauaguagaagugacugugagcuacauaguuauguguggagacaccuaaacauuugauaauguguacauuucaauugugugaaccuuucagaguacugugacugaguagcuagggcaucugucuggacucagaacauaaaucucaucuccauggacgcuguaaagcaauaaagugaagaaugcaaggcaggugcuaguuuauacugucacgguaaaacuguaugcacacaaaccacuggaauagcagcuggguuuuuaacuaugcuuagguuccucuuuuacauccagauaggggaacaaaacuuccucuaacuuugacauuuuuuaaaaagcccucauucuccagccaucaccuggaaaauucauuuucugaaaucucuucuaagaaggacccaguuauaguuuaaaggggggaacggggagagaagggggaugagagagaaaacccaauauuagcaaggaagcaaaccgagcucagagcucacgccacagcccucggaacuuuagacaguuuuuaauuuguuuaauuugucuuuauuuuguuuaguuugacaagaaaauuuauacacucuccaguggcuuuagcuuuaaaacaauuuuggcuuuuggcuccuugcauuuccauggaaauuuuagugacuugccaguuucugccaaaauaagggauacucgguuggauugugccacaccugucguucagucuggggagaaaugacaucuuagagugugaucuuuuccuucuaagcauaguagcuaccguuuuguuuuuacaccuuucuuucuuuuucuuuuuuuuuuuuuuuuuuuuuuuuuugguuuuuucgagacaggguuucucuguauagcccuggcuguccuggagcucacuuuguagaccaggcuggccuugaacucagaaauccaccugcuucugccucccuacaccuuuauuucuauuggugaugcuuuacaaucugguguacagcccuuucaucauuaguuaaacuuuugaaauucugaguuuuaaaaauuuuacucuguucucuuugaacagauggaaauaaaguuaauuguacuggcuauuaaauugacacuguaucuucggguuggaguaaacucaccgagucagcugggucuuguggcugcugugagcuguagcugaagaacagcucugcuuccuuugcugcugucucccaccuuuuguuucuuugacuugugagccacuguacuggcuucaccauuagggaagcauuuagugauaguggugagagugggcauccauccugcuuccuugcugaccugagugugauccauagcagugcacuccgguggguuugguacccuguaauuuagccagaaaugcaagggcaucccccccacuacagggggaguuggagaccacucugagcuauaagauucugucucaagccaaaaacucaacaaauaaaggaaaauaaaaauguaauauuggauaauggauaauugccuguaugaagucuccacugaggucuugucauugauaucugcugaugucacuucugcacguggguaucauuugcuuagguacauguauaagagcaaagagcuuauccgaaguaagagagagagcguucggaaguugaaggaggaaauacaaguucugcagcagaaguuagaaaggugagucuucugggucguuucaugcuuugaaacauaaagcaacuauuaagauuagagaguauguuuaaaaguacagagcauaauuaauuaauaacuggugguuuauaaaaaaggcaguacccucauuguaaguguaaaggaaucuucaaggccagcuagugccugugggugagugguccugaggacuugagggacucggacauacucugacggucuggcaguuucucuccccugcccuccugcucucugacuaaaugaacgugagaaguagugcugucagucacuuguccucuuugguuuuuuugagacaguuuucuguagcccgaacucaaagaggauggccuggaaccucugguucuccugucuccacuugcccaaggguuggcauugcucugauuggccucugggccuggcagcuucacguggggagaaugggcuugugaaguguugcauggggugaugcugccugagaacaggagccugagcuccucgcgugugccgaguucuucuggcagacucugugcuuucuuuaaaacaggucuuuguagucuagauagagcuguugguuuaacauuuacaaaggaaaucuguacacuguuacuggcuuucucucuuccucuucaacuccuuuuuuauucccugugcauuuuuggaaguguucuuuucuuucugccugcguguacgugugucugucugugagagauuaucagagcuucuguaacuggaguuacaguuggggagccaccacguggguccugggaauugaaccgggguccucuggaagaacagcugguguuuuucuuucuuuuuuuuuuuaaagguguauuuauuuuauguauaugagugcccuguugcuguacucugacacaccagaagagggcaucauauucuauuacagaugguucugagccaccaugugguugcugggaauugaacucaggaccucuggaaaaacugucagugcucuuaacugcugagccaucucuccagcuguuucaucuauuaacauucucuguccuaccucacggguccacugcuaggucauuaauuucuccaagggacacgagauuuacccagauccaauauuaacauuuaacauuauuugcugcguguagggauuggguaagagaaugggaggagggggaaagagauggggagaggggaugaacaugugugcuucgcauucauaugauggucagguaacaaccugcagaaucaguuuucucugucuaucuuuauguggauucuggggaaucaaacuuaggcuuggugacaagugccuuuaucugcugugccaggucacuggccccguuauuuuuaggaaacuuaaagaaaccaagaaucggugagacuuuggaagcacuuuccuuaguguaauauuacuauugcuguuuuuaagauuuauuuuugauuauguguauguugugucuaugugugauuaugugcaucuggcagugcuaguaccucuggaggccagaagagagugucaguuacccuggaucuagaguuacagacagucuauccacacugcaaggaguggaacuagggccuucuguggagaagcaugcucuuaacuacugagccucuacucugccuuuaaaaucaacugguuguaguuuuaauuguuuguuuauuuacuuacuuacauaucuuauguguacauguaugaguauaugaaggucagaggaugcugucuaaaguugucuccuucagccauguggauccuagaaaccaaacucaagaguuccaggcuuggcagcagacaccuuccuccauuaaaccaccuuccuggccaaaacauaacuuccuggaugugaccuaaagacuagagaaggguggcuuaaugcucagcaaagagcauuuacugcucuugcagaagaaagcccuggcuugguuccuagcagccgugugacggcucacaacuaccuauggcuccauuuugaaggaaucugaugcccugucugacuucuguagguuccugcacacacgugauacacacacaaauaugcaaacaaaacacucauacacauaaaaauaaaugaguggauuuuuuuuaaccuauauaaacauuguauguauguaugugacauauuccagggaaaauauccaaaaacuaauaaacaugcugugagauacagaaaugaggugggaguagguaacuuucauguuuuuuuuuuuaaauacaacuuuauauuugaauuuuuuaaacacauccauacaucacuuugaagccuaaaaauaggcauuguggccaguaaucucaguguuugggaggccaaggcaagagaauugagugaauuuauuuauuuguuuguuuguuuguuuguuuauugaggcuggucugggcuauguaguccaggucagguuagucugaguauagcuuaaacucugccucagaagaacaaaaaggugggguaagguggagcauacuugugagcucaggacuuaggaaucgggaguuccaggccaacuuggauuuccgugaccuugucucagaaaauaaacaaaaugcuuauuauuucuucuauguaagauauugaaagggagauuucuucuguacaugauagacaagacgguuuugaagcuacuuugcuguguuuuuguuuuuauccugugcuaagacuugaacaccuuguacaucguagauaaauacucuuggacuguaucccuuccugucucgaccugucccauccccugcccugguccuguuagucaaaacaggugcugcauuucgugaaguuguuggcucuaagagccaggacucuggugugauuguuacugauaaacucaagcuccuuagaggagaaaaacuucugugggguuuuaaguauuuuauuaaaauggaaugagccugggaggaggugaaggcugauacccauuccugugccaagauaccagcucugcucucugugaagugugcacugaguagaguuugauaaacucguagcggaagagcauggccaagugcaugccagggauugaacaacuggcucaggaucuucacccuggcaggcacaugccuguucucuguuagugacccugagggacagaguaggugguaggcaaccuuggcuaaggcugccuuugcucuccgcucuguggccugugugguggauuugaugcugaguuaaagcgcucauucucuacucauuuucauuuucuucguucuuuuguuuguugguuuggguuuuuugagaaaagaucuugcuguguaagcaagccuugguuggccugaacuugcuuuguggaccgggcuggucuuaaaaucauaaugauuugccugccucugccucucaagugaugaaauuauaggugcuugcaacuaugcgcugcucguuuaacuaaccacaguaacuacuguuguuguuguugagguggagucuccucucuccagggugucuucacacagcaaguaucuaaggauaacccugauuuccuguccuuccugcagaucucuccauaugaguuuagaguaaugugcuagcaauggggagauuacacauaucuagaaaacuuuguuuagaggcugauggugaaaguauacacugugcucacaauaguugaguuucugacacucaucucauggccacaaccaucuggaaucaaguuucagggaauccagggccaccuucuggacucagagcaccugacaacaugugugugggcgcgcgcgcccacacacacacgcacgcacgcacgcacgcacgcaagugaagaugugcaggcagagagauggcucagugguuaacacuugcagaggauccaggaucagugacuccaguuaucauggauccuauaccuuuuuuauggccacccagggcaccaggcaugcauauggugcagauauacuugcaggcaaaguaucuauacccauaaaauaaaaauguauauuaaauaacuguaaaaguacccuauuauuucagucacauauuugagaauauuacucuuacuggagaaaucuuauaugaaaucuaucacaacaugaauaauagaguauauaagggcuggagagauggcucagcgguuaagagcacugacugcugaucuuccagagguccugaguucaauucccaacaaccauauggugacucacaaccaucuguaauaagaucugaugcccucuucugguguguuugaagacagcuacaguguacucauauacauaaaauaaauuaacugauuuuuuaaaaauagaguauguaagacccuguaaaagaaagauugcgggcuggagagauggcucagugguuaagagcaccaacagcucuuccaaagguccugaguucaaaucccagcaaccucaugguggcucacaaccauccauaaugagaucugacguccucucuucuggugcaucugaagacagcuacaauguacuuagauauaauuaauaaauaaauaaauaaauaaauaaauaaauaaauaaauauuucuuuuaaaaagaaaaagaaaaaagaaagauugcuggcuuucuuuggcucugaccuuuacuaaugucuaauuucuuuucuuucugauaugagaucugccguccucucuucuggugcaucugaagacagcuacagcguacuuagauauaauaaauaaauaaauaaauaauaaauaaauaaauaaauaaauaaauauuucuuuuaaaaagaaaaagaaaaaagaaagauugcugcuuucuuuggcucugacuuuuacuaaugucuaauuucuuucugguuuggugguggugguuuugguuuuggggggcuuuuuuuguuuguuuguuugguaugguuuuggguuuuggagacagcuuuggcuguccuggaagcuccauagacuggcuuugaacucacagaaaucagagucccucugcuucccaagugcugaucaaagguuaccaccaccuugcuuuucuuaaagccugauauuuauuucuggauuucucucauucuugguuaugaggcaguugguuuaggaaggacaaagaaaaugucaugagaacuaaugaccagaucguuuuuuucaguuaguuuggaacauuguccuuuaaggaagaacucagguuugugagcagcgccuggcugugguauguaagacaggagagcagaacugagcugucugaaacaguccuguucucugugugaugcaucagacugcuggcagcuuucauggcuaaagcacuuuuuuaguuuuuaacccuauagauugaauaaccaauuaaauggcauaugccuuuaggaauaauaugggauuuuguuguuauauugagguaggcugucacuagcuugccccauacuuuguaacccagacaggccucaaacuuuuuguggccuucuacuucagccuccugagcuacuaggauuauauagcuagguauuagcagcucugcaugguaagucuuuaucagcaguuauugcaaugcauaguagacuugggcaguguguuccagugucuuugcuucuuagguaugugaaguacggcucgggcccaucucgguucccacuucccgacauguugaaauacguuauugaauuugccaguacaaaaccugccucugaaagcugucugucuggaagugcugagcaugugacauuaccacuucccucggugcacugcccgauuucugaccucacacccaaggaaagguaacaagcagauuucuuaaaugguuuguauuguuuccccauucuuauuugacucccuuccuauccucccaccugcugugagccucucugaucccucagagugggguuugucaccuggcccugcccugaguccuugcaguacgcuugcuccaggggcuucugucugcugugugcaguguccagcaggcagcuuguucuguacuucaucugccuugaaggaggcuaaauuaacagcaaggaaaaccguaugggcagaguuacacaaggaggaacuggccagaauucugaggccaagccugcaggagcuaggcucuugaacacacagggaggccacguugaggaauccucugacucuaccuauuuaaccggcagucuuuauagcuagacggugccugcagguucagcuugggucacgcuccaugauaugugugucuuuagcuaauaaaauugcuagggcacauuugucccucacggagaaaaaaagcuuauguuaaaaaccuguuguuagauggacuguggugguacacaccuuuaaucucaccagcugggaggcagaggcaggcugagucugaggccuacaggacaaguuccagaguagucagagcuacccagagaaaccuugucuucaaaacaaaacaaaaccccagaggcuauaaagaugauggcucagccauuaagugugcaaauuaccuugccuagggcuguuguucaguuuccagcauccacaacaggaagcuuuucuggugcuauuagagauaaauuugcauuuauuucuccuuucuucuugcuuauuaugccaggcuuauuugguauaggguaauuccaaugucucgugcuagguaaguaagugcuaugccaugugagcagcauaguacuuuucuguuuuguuuuuuggguuuuuuuccccauuguuuugagacaggaucuuacuuacccuggacuugaguagcaguucucaaccuguggguuccaaccccuuuuugggaaguugaguaacccuuucauggggguggcuugaggccaucagagaacacauauuuacauuaugguucuugaguagcaaaacuauaguuaugaaguagcaauaaaagcgauuuuaugguuggggggucaacacaacaugagggacugugugguuaaaaggguugcagcauuaggaagguugagagccacugagugugaggcuuuccugccuccugucauuucuuggguaccaggauuauaggcacuaaccauuaagccagcuaagcuugcuaaaugcuaagcuaguaguucaucagaugaggguaguacuaauguuagcuucauaaccagacugucuuaaaugagaugauuauuacaagaaaaaguuagcuuuuauuauauuuguagauuuuagcuaaggccucacuguguaugcguagcuuauguuggccuacaauugaggucuuucugccucagccucacaguuguaucuuaacuguaccuuuucauaaagcagccgguuuucugaaguauauuaguuugggucaaguugaacuauuuuuuggagguaggcccuuagcuauaccaggauggucucaaagucacaacaguccuguguuagccucccaagggaugagauuacugguuucugcuaccacgcccaccccaacuugcauuuuagauauuacaaaaugagugccuucuuuugucuucucuaguucaaguccagaaagcugcucucagaaugcuggaaguaccuuuuccucuccagaagaugcucuucccagcucugaggggaugaaugggccauuuaccucuccucacucgucucuggaaacgccugcacccccagcuccucggacagucacagaugaagaaaugaacuucguuaagaccugucuucagagguggcggagugaaauugaacaggauauacaaggugggugcucugaaaacuuguuagcuacucucuguuuuuccuggcuauuuggaagccaggcacacuggguguuuguucccugacugcugggcaucaggccuggcaacugugacuucugcaguucuuuucuuguaaggcuugguccugugggauuauuuguccuccuccucaaaaccuccucucgaaggugcauaguugcaaucaugggagcccucgaugagauaaagcaguguauguuccuccccuccccgcuucccugcucuuguccuguccccuugaagcagggucuccgaacugaccugacuucauauggcccuugugcuuccauacugcugcacauuuacauugguuuaaauguaaagauuauaauugauuaucaaaggauaauaauaguguuugccuuauaaucaggccuuguuaaaagaaaauuugguuugauaucuuugcuguuuauaaagauaaguucuccuuuuauagcacagacuagucucaaacacauuauccuccugccucagcuuucccaguguggggacagugcucacagguuugagaaucuuaacaaaaugaaugcuuucuaaacaauaucuuacccguacuccauucuugcuuggcuucccuccuguccugggcccucagacgagauaagcaugugcucggccauuacacccagguuuguccuaaauggagacaauugcuuuaagaaaugucagugcagauuuauaagaauaauuuguuaagcgccucgauguaauuacguugaguuaaaagccuuugugucggcagggcccgucacggacacuccaagcuaacaagguuuuccuuccuaacagaccuaaagaacuguaucucgagcagcacgaaggcgauugagcagauguacugugacccucuucuucgucagguagaguuaaggguggagggaaaugggcugcacugauggcagaagacauaguaccacaagagcugcacggaguucucacuaacguaggcauauaucccuacauccagcugaagaacucagagggccuucugcuuacauugaaaccuaaaucauccuuuuuuuuauucuaccacucgguguuuuuucauacaguggagauauauuugcuguuaggagcuggcgagaugacucagcagcuaagaguguaugcuguuuugcagaggauccaaguucagcucccagaaaccgcuaacuucaguucuagggagaccugauaugucucacccucugugggcaccugaacucucacauaauacccacaugcacaugauucugcaucauuuuuacaaagacaaaucuuaaaaacaaauuugcuguuacauauuaauaaaacauuuuucucuaagugguggugguauuaaaauuucaauuauuugauuuuaccaauaaagacuugggagccagauguuggggugaaagucugcuagcucagagcaucauaggaaacacccagguuuuuccaggaaauaacacaguuuuggguccacagucugaucaauauccugcaucauccacaugguaauugaagcagugcaguggggaaacccagcuggaggguccauuaguauccucaggcuuuauuacucuacuaacuggauuccagaagggagccaggcagaacagaaauccuuguuguccacacuuguuuuuauuccguuuaaggccuuggacagggccuaugaagggcucauggccgaguaacauccagaacacagcucugcucccagcagugcagugagcaugcuugugguuggcauaggaacagaucguguggcucuugacuuucccucuucucuucuguuuugcugcuucaaagaaaucuggcccugagugaccugaaagagccuccagcaaggcuugcuuugacucauucugagggcccugggauuggacccuugauagccuccaagcuuguguuuucguuggucugucuugagcugguaaagugcuugguguggauguuaucuuguguuugugugggcauucccuuuuacuugcugguugggaauguucagaauuguauugacauagauagcaucugacuucugggccuggucugagagccccccuuucugauuugcaggugccuuaucgcuuacaugcaguucuuguucacgaaggacaagccagugcaggacacuacugggcauacaucuacaaccagccccggcagaccuggcucaaauacaacgacaucucuguuacugagucuuccugggaggaacuugaaagagauucuuacgggggccugagaaaugucagcgccuacugcuugauguauaucaaugacaacuugccccacuucagugcagguaaacaugcugacuagaggagagcauuuaggggaacuagccccuggaagaggggcagucucauacuucuuuugaagacauuuguaaacuacaauuuaucacuauguaaaauguucuuagaacauaaaaacuguaagggaauaaaagagaaaaugucucaaauagucagaaaccaaccacccucugugauguaaagucauaaauacuggcugugaggguuauaaaagccuguccuagccgucgguuguugggaguuccuuguuauugccuagauugcucauuuuuuuaugaaguacacauggggcuggugauuaagauuuguuuguagagugcuugccuggugugcaggaagcccugguuugacccacagcaccuuguauaccagggguggcugugcaugcuugcagucuuagcauucaggcacagguggcagaaucagauguucaaggccagcccagguuacuuaagacccugacugaaaagaagcaaauagacucuuacugcuucacgaaaaggcggcggccaacaagggcuuuguuguuuuguugcagauucuuuuuguuguuuuugaugacaugguuagaaauagaauucaacuuguccuucauauuuuugcaauuuuuucuuguucucuuuugauuauguauacagcauucugccugcauauaugccugcagaccagaaaagggcgccagaucccauuagaugguugugagccaccaugugguugcugggaauugaauucaggaccucuggaagagcagccggugcucuuaaucucugagccaaaguacuuaaugacuugacuaggcaccauuuacccaguaauucaccuugguuucugacaacacaauaauuguguggaauuucaugaaauaaaguacucgucuccuuccuuccuuuuuaaaggcagggucucaguagguagcaccugccugccucugccucccgagugcgcucagagcagugccuucacauuuaaugaagugggggaucacucucuuaucuuucggaggcaauagcucaucuagccuuuccuaccuugcgggcuccugaucuugccuucaccuguggagcugcccugagguuguagcugugugcuaccaugcccagccgggacguucuuaccacucucagauggaagaguuaaacugauacgacuacuacuuuaaacuuucuuuucccuuuuuuuaagaaauuuauuucgguguauuuuuaguuucuguguaaauuucuuuuugugccuguguuuauguguguuugugcacaugugcaugcagguaccuacaaggacaagauguagggcauccuggcguugguguggcaggugauuaugagccaccucauggguccuggaaacugaacuuggguucucccaaaagagcagcaagccuucugaagcacugaacccccuccauuuccuucuauugcauauguuaauguucagguuuuuaaagaaaaacuggcugcauccagugacugaccacgauuaagucauuaaccuaucguguucauucagucagccaacagauacuaauuuuuaaggguuuauuuucauuuuaugcugaugaauauuuggcuacguguacguguugggguccaggaauugccccacaaaccauaugaacaccaaucucagucagacaggucguuuauugaaugcacacccgaagacugaucgauuagggcuguagcucagaauuggcucagaauccagggacuaagccaagaugaugaacauuuaucagggccggggcuaguaaaggaaaaaaaaccauaaaaacaaucuugaacagugaguucauacacagggcaggaagugcagguuggcucugccucaagcuacuuuacauacugaccuuuaaugugauggguccuaccuaaagcuuuguggaauaucuuaagauuagcaaaccucaugcagagcauacagaacauaauaacaggguaugugaucagcaugaccuugcucugagucaaguucuuuuucugugucagugacuggcaggcauggaacaaguggcuaagcuauuccaagguugggggcauucacucaaccacauaugugccugaugugucagauauccuggaacugagaaguauggacaguuaugagcuaccauguuggugcuguaaaccagaacuggguucuaugcaagagaaggcagugcugugagcugcagagcugucucuguagccccacuagauaaauacugccugcuuacugauguugccuguuacaguuccuaaugugcuaugccgguuaaccucaugcugucagaguuucagauugaauucugugugagugugugagcauacauauaagugugugugucuagggacacgaguaaagcugggaugugcugcccugccucugggauaauguguucguuuaccuuucucuguuuuaacuauuuucccucagaggcaucuucuaaugaaucugaugagacugcaggagaaguggaagcccugucuguggaacucaggcaguacauucaggaagauaacuggagguuucagcaagagguggaggaaugggaggaagaacaguccuguaagaucccacagauggaguccuccccgaacucuuccucacaggauuucuccacaucacaagguaugguccggcagggccuugcucuucccccacacugugccaggucuggucagguccuugcuguccucugcagccaacccuggauccucagugacaugucaauaucucucuucacagugacauucuuuuuauuuuuaacuuuuuuauuuuucuuugaugggaggaguguggggacacgugccauauaacacauuuuuuauauuagaggacaacuugucagggccaguuucuccuuccaccaugugggucucagggaucaaacccuggucaucaggcuugggaacaaguaaguaccuuuacccacugggccgucuugcuggcccugcaucagguucuguuuauaguggcuguccuacaguuuguaggaucaguaugccuuuagaaguugcuuucuggggcuggugagauggcucaguggguaagagcacccgacugcucuuccgaagguccagaguucaaaucccagcaaccacaugguggcucacaaccauccgaaacaagaucugacucccucuucuggagugucugaagacagcuacaguguacuuacauauauuaauaaaauaaaucuuuaaaaaaaaaaaagaaguugcuuucugacaagcagaaauacuauguaugagaaaggcugucugugcuuucuauagugcuuugcuuauccuccagcuuguagaagaaugacaggauggaaaguuacagaugaucuuauuaagugguuaaugagaggaagcaucuuuggugugaaaauaggaaaaauugugcacaguaauuuuaacagaccuuugagauccuugauguggaguagaaaguccuucuuuucuuccuuuaaaugauuucucaagacaggguuucucuuucuaguccuggcuguccuggaacuugcucugcagugcuggcuggccuugaauucauaaaguuccaccuaccucugccucccaggcucuguaauuaaagguguguaccaccacugccucgcaaaaaauuuuuuuaaugauuuuuuuuguuuuguuuuguuuucaagacaggguuucuauguguagacuagacuggccuugaacucagagagauacaccugccucugcuucugccucugccucccaagugcuggguuuaaaggugugugccuccacugcuuggcagaguguguuucuuguccaacuuucuaggggcauuuacauggacuuugaaagaggugugcugggucuguauauugaaaugugugucccuccugcucgccggucaucagaugugacacuucugugauuauuaauauuuuuauuucuuuuuguuagagucuccagcaguguccucucaugagguccgaugcuugucuucugagcaugcugugauugcaaaagaacagacugcccaggcaauugccaacacagcucaugccuacgagaagagugguguagaagcagccuugagugaggugagacuggcugagugacccuccuuugagagggucugguuuuugacaccagcaacagcuuucugucgucucugcugacuuuaaccagcccucuuuauuucuuccuguuuuuccccauuguucuuaacucuauucccuccauucugcugccacagcauaaugaagcugagcccaagaagccccaggaaacaaaccuugcagagcaguuagagcaggcggccgaggccagggacacggaggcugcugccgcaccuaacucugaggucucugaaguggagauucccagugugggaaggauucuuguuaggucugaugcagauggcuaugaugaggagguaccgagacgagugcaggggagcuguguguuguuucucaaaaggcgugugucacgagcuaauguuuucucacugaaucaagcaacagccauggaggccugucugcugcugaccuuguuguccuuuaugaaaaggcaugggugacccauuuuugcugugcacuuuuggcaugcgugugugcauguguauguguguacacccagcuuguguugagcagggacugcuacaaaagccuggauggccuagggaaaggauuaacuccauuugguauuaugaacaaaaauacgcuuaccuuugagagauuguuugguuuugguggcaguccauuauuuugucuuacaaguagacuuuuuccacuugcucggugaauaaaacaaauguggauuaaaguugguuuugcuuuuaauucugagguugagcaagcagcuguuccucaugcucugucuccuuuucgguugcacugcacauaaauagucuuuauccugucucucggguuucugcucuuugcuguggcuguguauguuuuuauuggaaguuagcagcuacuuaauacuacauaccuuuauaccuucacucuaguggagcgcuagccauauggcugaacuuacucuucagcagugccccaucagaaaugcucuuggacaccuuuguuuaucucauagacuuagaaugugcacauagaggaacggcuugucauaggcaucauuacaaggagagccaaggcucggcaugcgucuagaauagggcugugaagcuuggccugcaacccgugccagccaaggagacagugcucggcuucuccucagcacucugcucaccucgcuucauacuguuuccuucugaaccugucugcucuccuuuuucucuguuuugugcccucugugguaggugaugcugagcccugccaugcaaggggucauccuggccauagcuaaagcacgccagaccuuugaccgagaugggucugaagcagggcuuauuaagguacucuuguuuuaaaaucuuuuuuuuuuaagauuuauuuauuuauuuuauguauguaaguacaguguagcuguacagaugguugugagccuucaugugguuguuggggauugaaauuuuaggaccuuugcucgcuccugucaacuccgcucacucagucccugcuugcucuggcccaaagcuucauuuacuauuaugcauaaguacacugaagcugacuucuaacacacuagaaucucauuacaggugguugugagccaccaugugguugcugggauuugaacucaguaccuucagaagagcagucagugcucuuacccacugagccauuucuccagcccccuuguuuuagaauguuaauccuuguaacacaggaauauuucuguaagacaguggaaaaugcuguuacaguugcuugugcugggagauagcucagucgaaaggauacauuuuugaucuccagaaucuacauuuuacaaaacaaaauuuuccacaggacuggaaagaugucccagcauauacugcuguccccgucugguucccaguaccuaacacuggacagcucacugcuaucacucugguuucagguggucuggcacucuucugucuucuguggcuacuagacaugcauacccugcccacacauacauacguguaacaugguacaauacaugucuguaaucccggugcuggaaaggcagagauaggaucccugaggcuugcuggccaaccaguauagccuaguuggugaguuugaagucagugagagaucuugucccaaaaaaguaugauagagcaaggcacaugccuucaguaccaguguugaggagacagaggcaggccgauucaagugagguucaagacuuacuugcugccgggcagugguggcguacgccuuuaaucccagcacuugagaggcagaggcagguggauuucugaguucaaggccagccuggucuacagagugaguuucaggacagccagggcuacauagagaaauccugucucaaaaaaccaaaaaaaaaaaaaaaaaaaagacucacuuguuuacaggccagccaggacuacauagugagaccuuuucaaccccacgcccaacuucuccucccccccacaaauguauguuggauagaauuugaagaacgguacucacaguugcacucuggucucuacacuugugcacacuagcacacagacacacaguauccuguguucaaaugaaacaugacacugucuuugcugcccagaugaugagcaagccaucccacaaagcugguggcuugcucaucuuugccuggcaguggcccagcagugaggagugccacugcauugcaucuagucuagaggaugacgagguuguuaaauguucaucgaugacacaaacugagacugacuuuguaacuugggauccuucauuuuaaaaggcauacuauuugagguauuuggucuuuaagauguuugaauaagauuacauuuggguggguuuuuaaacaauuugacuaagugcuuguguuuuuauuuaagaacuuggugagaggugggcaugcccacacauaccuguaguccuagcgcuuuggcacaggaaccaagagggcggccacaaguuugaggggaaccuaguuuacguaaugaggucuaggguggccuggacuacagaauugagaccuugucuccacaaaaccaaacuugaugaggaaaaugaguuuaguuuuuugaauauaguaagucuucagugucagucuuugagggaguucugauauaccaauucacaucccaucguugcuuuuguaauuucuugacaagaauuccuuagccuagugugaaucaaugagaggcccucugguguuucuugucaguuucugucugugugcugaaguccgugguguccccuuucccaugccucaguucugucguuaacaggcauuucaugaggaguacuccaggcucuaucagcuugccaaagagacacccaccucucacagugacccucgccuucagcauguucuugucuacuuuuuccaaaaugaagcacccaagaggguaguagaacggacccuucuggaacaguuugcggauagaaaccuuagcuaugaugagaggugagaaugugccagccuguuccuguguggggucuuacucggcaacuuccuccaauauggaggagcugcccugaacccugccauugcuuucugaacucugucccucacagaucuaucaguaucaugaagguggcucaggccaaauugauggaaauugguccagaugacaugaacauggaagaguauaagguaaguguggggcuuuguuucuuuuuaauuccuuccaaaaccuuacuucuagaggcaagugauucuuaagauaaaaugaaguuuuauguuaccagacucaacuaguucccuaugaacuugaaaggagaaggaaaaaaaaaaaacaaagcugaggguggugggccacacuuuaaccccagcacucaggaagccaagaguaaguauaucguugaguucaagcccagccuggccuacauaaggaguucuaggacagccgagauagagauugaaaggggaaaaauugccgggcauuggcacaugccuuuaauccuagcacuugggaggcagaggcaggcagauuucugagugaguuccaggacagccagggcuauacagagaaacccugucucaaagaaccaaaaaaaaaaaaaaaaaaaaaaggcgggguggggguggggggaugggguggugaaauugaauacaaauccugucuuagguucagaagcacaggccuuguuuucagucuuggguagccugugucugcucguuuccuaagggcucuuccaagccuugcccuaggcagugugucgguguguaauggcaugguuuuguagugugcauuaaaauacgugugacuacagaguucaguaagagaacagacucuucuguguacaaagcacgcugggcgggggcugugcuguuugacugcugagccacagcuggcugucugcuucgcuugugcucccuucuuccccauggcugccucugccugucacacucgggcuugucaucuauauacaccagaaggacuuugacaaguuguguugggauuaggagaguuuauaaacucaaacgcuuaguugaaaugauuuucugauccucagcagaaggaguagaagagagcagguuaggucagugguguaaacauacucaggcugagcucggcucgcauuugucagguuugaggaugacucuggccuugcugaugcuccugcauccccucugugcugcuggggcuacaggugugcaccuccauuuaagucuuuuuccugugguugguuuuuaguuuugggguuuuuuguuguuuuuguuuuuuguuuuuuuacccaaaaguuuuguguguuuuuauacuugaccacauguugugaguacaugguugcuggguguauagcaccaaaagggaagcaggcagcaguuuacugagaucgugucacuaauguugguccuuccuuuccagagguggcaugaagauuauagucuguuccgaaaggugucuguguaccuucuaacgggccuggaacucuuccaaaaaggaaaguauguuggcccuuuuuuuuuuuuucaccagcauugauagucagaacacugacaccuacucaggguuacucagaagucacugccaugagucuccuucuuuguuacauacacugggccugcccuucccccaccccaugcuucaucggguucugcacauuaugcuuuccccuguccuucaugugacuggguuuaccagugaggagauguuaugucgggcuccguagugaccagagagcaguuuugauuagcacaggcucuagugaauagccagucucuuuccuuuguuugagacagagagaaaaccugagguccaaagaugaaaguuuccugauuugccuuaccuuucuugcuccgagugcaaaacagcugagucuggcuguggguuuggcccccauguuuucccaguacaucauauuguaguugaauggauucgaguuacagaaaagugagagcuaagcccuagguuuuggcaaaaagaacucacuauguggauugucucccacuuucuaagguaccaggaagcauuguccuaccugguguacgcauaccagagcaacgcuggccugcuggugaaggggccccgaaggggcgugaaggagucugugauugccuuauaccgcagaaaaugccuucuggucuguaccauuuacaaaacauuacucucucuucucugucccugccucuccuguucucuuuuucucaguguauaauuuuucuccaacccuugauaaguugagccagccuugccuuucucgugugccugcauuaaagcuuuuagcauguugcucccaugagguaugaguuugcuagcacagagccacaugcauacguuggaagaaugggauguuucccaggguugccuagcaaaggggaguuuucagaacuagagguaucuuaaaaaucuauuccagucuuaauacuagguuacagaguguaagacucauucuugcuaaccuuguuaccuuaccucguuugcgauggacaaccauagggaaggucugguauaacgcugucaaucugcccagcaguguauauauagcaugcuaguucuucaugaaauucucaagagauggcuggcuuguaggcuguccuuguauauucacuucugugggcuuaucuuugcaacauccuuauuuucugggaauucuuugauugcugugucaauuauaggugugguaagacugucuacugugcugagaagcggcuccuaaaagcucugauuuugcccucuaagucagcagauucaaaucaucaacuugaguguccuuacaccuuccuuccuacugcuauacuagggaugguuuaggcuucccgucacugccucugaugagugucagucacuuucagccauuggugacaacuggccaaucugggaggaaccuggaucucagugucuucugugagugguccuaguggcuagugaagauugagaaucauuugcuagguuuuagaguagaaacagaugucagaugugaccuuggcugguaauguaggccauugagucacaaguuuaggugcauuagaaucaucacaggaguuauaaagccccagggcccagaucaccuacauccuaauuaugucagaacaucuggggcaggagccagugcgugguuuuuuuuuuuuuuuucuuuccaguuagucgauuuuugugugacuguuggcuuagauucacacuaaagugauacuuacuuuuuccagucucccuuugucugucuauauuuguaggagcugaaugccaaggcugcuucucuuuuugaaacaaaugacgaccauucuguaacagagggcauuaauguaaugaaugaguugaucauucccugcauccaccugaucauuaauaacgacaucuccaaggacgaccucgaugccaucgaggucaugaggaaccacuggugcucuuaccuggggaaggauauugcagguguguguuauuagcacugcguaguuucugugcuuuuguguaucugaagccucacagugcucucgcucguuuuguuuguuuguuuguuuauuuuguuuuguuuuuucgagacaggguuucucuauguagcccuagcuguccuggaacucacuguguagaccaggcuggccucgaacucagaaauauauugcaacuucaaaccucaagaaaguuuaaagagccaucagauaaucauacucuacauaaauaaacuauaaaaccccauaauuuaguagaugggaaaacaaugaaaaacuaacacuccugcagagcaccgacuguagcuagggagcaggguacccuggguuuaguuccaaguagucacagcuccugggaguagcuggcugacccuggaguggcuucagcugcugacugagguaaggaggcagagagaaguagagcccaaauuucaugcuguauccaugggauguuaggggguuucaaucccccuaacaaccagugaugcuaaagagcgagagcaaaaaaaaaaaaaaagcaaaaaaagccaggcgugguggcacacgccuuuaaucccagcacucgggaggcagaggcagguggauuucugaguucaaggcagccuggucuacaaagugaguuccaggacagccaggccuauacagagaaacccuguuucgaaaaaaaaaaaaaaaaaacaaacaaacaaacaaaaaaaaagaagaagaaagaaagaaagacagacaauagcaccauuuugugugugugugugugugugugugugugguacagagcaucauauccaauuucuuaagauuuaagaggauaguuuguuaagaauagccaugauaacgaaacagcuuugcuacuugguaaacacaccuuugcucguagcuggcccgaagcuuacuauguagaccaaacuggccuagaauucaagagaucccuguaucucugccuccugagugcuaggauuaaaggugugcucuagcacaccaagcuaguuaaaaguguugcuuguguuuacugguguuggguguauagaggguucaugugugucacucagagggcagcucuguguacuuaguccuuucuucccaucuuucccugggcucggucugcugaacacuggucagcuugugcagcagacgucuuacucucggagccagcuccuuauucucagccaagaggcuugauacaccccagguucacacauagcaaaauggauauagauuuuaaaaaauuauagagaaauuuucuguuuauaaauaacaaauuugcaugauugugagauggguuguuuaucuuuucauaaaagcuuaaaucuucgauaaauaucugauacuucggaauuuagaacaucugaaaaacaggguuuuucagacuugauugauauuuuaauucuaugaauaucaaugaugagcauaccaugucacauaaauacauaauuuuaaugcuagagauacauugagggccauuucagaaaugauugaaauucugagcuaaucacaagccaaggcucacuuaaugcccuuuuauaaaauaaugaaacaaaaaucagcaacccaaauagcaguuuuuaaaaaccaaaccccuuauuacaauucacuccacagguacacugcuuugaugcucaugugcaucagauaauggugagaaaguguuugaaaggcuuuucuagccaggcgguaguggcgcacgccuuuaaucccagcacuugggaggcagaggcaggcggauuucugagguagaggccaaccuggucuacagagugaguuccaggacagccagggcuacacagagaacccccccccccaaaaaaaaucuuuucuguaguuaguaauguuucuauaagaaaggaaaacuuggcacuguuugacagugacuucauguauauuguguguuuugaaccaagacugcaauggugucaugguuagauguuugguuuugagugagugaguacccuuuacugcugccaugacaaacucuuuccccaacauacacagacauggacauagacugaguuaugcagcccuaugugggcuucuugccuagugugggagggugaguugcaaaggcaucuuccucuuagcugcagcaggaugccugcuguugaguugaauguuggccccugaaggcccucccggaugcuauagccuuguuuagcuguguguaugacaguucauuuucccucuacagagaaucugcagcugugcuuaggagaguuccuacccaggcuucuagauccuucugcagaaaucaucguccuaaaggagccuccaacuauucgaccgaauucucccuaugaucuuugcaaccgguuugcagcugucauggaguccauucaaggaguuucaacaguaaccgugaaauaagccgcucauggacagucaagacucagucuggucuccgguccccugccuguuauguggcagucuguugugacagauuucccuggacagagggauugggugucugagcgagauucagacccuccccccucucgugauguguguuuaagggauuaaggauaaaguugcacauuuuagguacagaaccacaagagcuauuucacugaagaaggcaggagccagugcauuaagguuuugaauuauccuagaagaccugaacugccuuuguaaaucucccauaacacuuggguuugucuaaaccucgugccacuuuuaaauuacccuucaggcaccagucuuugacagcaaaagggugacucaucagaacugagccaggggagcaguuucuaguuauuuugucaaguucaggugacauuuaaaaguccucagcuaccagagauugguaguaggggucuugccuggcucuugccagugaugaaaagaggugcuggugagcccuuccuuccacauaaggcugcgccaugaagccgccaagggaaagcugcaucccccuuuggucuguuuauacuuuagauaaaccagaaaaccucacauucagucuugagugaaagaaaagaaagcauccugggcuuccagcccugugcuggugugacagaugccacacaaggaacacuuaauaguuaauaaucaucagaagcaggugucuaaggcuacccggccuaagagaauuuugauccuuucucucccuuuuuuuuuuuuaaagaaaauaagggaugugaauuuguauaaaaaauaacaucuaucuguguauauguagaaagaagcugcuuuuuaaagaacuucuaauuggaaacucauguuuuaaccaaauuuuaaggauuaauggagcaaucaugggagggaagaacacaauacaacuaugcagguuuuauaaaugugcaauaaaaguauuuguuuuaccuuugguauguagcaugacccuuuuugaaauacauguuuucuauuuugga

SEQ ID NO: 5083 - RNA, 57183 nt, Mus musculus
uccaaaauagaaaacauguauuucaaaaagggucaugcuacauaccaaagguaaaacaaauacuuuuauugcacauuuauaaaaccugcauaguuguauuguguucuucccucccaugauugcuccauuaauccuuaaaauuugguuaaaacaugaguuuccaauuagaaguucuuuaaaaagcagcuucuuucuacauauacacagauagauguuauuuuuuauacaaauucacaucccuuauuuucuuuaaaaaaaaaaaagggagagaaaggaucaaaauucucuuaggccggguagccuuagacaccugcuucugaugauuauuaacuauuaaguguuccuuguguggcaucugucacaccagcacagggcuggaagcccaggaugcuuucuuuucuuucacucaagacugaaugugagguuuucugguuuaucuaaaguauaaacagaccaaagggggaugcagcuuucccuuggcggcuucauggcgcagccuuauguggaaggaagggcucaccagcaccucuuuucaucacuggcaagagccaggcaagaccccuacuaccaaucucugguagcugaggacuuuuaaaugucaccugaacuugacaaaauaacuagaaacugcuccccuggcucaguucugaugagucacccuuuugcugucaaagacuggugccugaaggguaauuuaaaaguggcacgagguuuagacaaacccaaguguuaugggagauuuacaaaggcaguucaggucuucuaggauaauucaaaaccuuaaugcacuggcuccugccuucuucagugaaauagcucuugugguucuguaccuaaaaugugcaacuuuauccuuaaucccuuaaacacacaucacgagaggggggagggucugaaucucgcucagacacccaaucccucuguccagggaaaucugucacaacagacugccacauaacaggcaggggaccggagaccagacugagucuugacuguccaugagcggcuuauuucacgguuacuguugaaacuccuugaauggacuccaugacagcugcaaaccgguugcaaagaucauagggagaauucggucgaauaguuggaggcuccuuuaggacgaugauuucugcagaaggaucuagaagccuggguaggaacucuccuaagcacagcugcagauucucuguagagggaaaaugaacugucauacacacagcuaaacaaggcuauagcauccgggagggccuucaggggccaacauucaacucaacagcaggcauccugcugcagcuaagaggaagaugccuuugcaacucacccucccacacuaggcaagaagcccacauagggcugcauaacucagucuauguccaugucuguguauguuggggaaagaguuugucauggcagcaguaaaggguacucacucacucaaaaccaaacaucuaaccaugacaccauugcagucuugguucaaaacacacaauauacaugaagucacugucaaacagugccaaguuuuccuuucuuauagaaacauuacuaacuacagaaaagauuuuuuuuggggggggggguucucuguguagcccuggcuguccuggaacucacucuguagaccagguuggccucuaccucagaaauccgccugccucugccucccaagugcugggauuaaaggcgugcgccacuaccgccuggcuagaaaagccuuucaaacacuuucucaccauuaucugaugcacaugagcaucaaagcaguguaccuguggagugaauuguaauaagggguuugguuuuuaaaaacugcuauuuggguugcugauuuuuguuucauuauuuuauaaaagggcauuaagugagccuuggcuugugauuagcucagaauuucaaucauuucugaaauggcccucaauguaucucuagcauuaaaauuauguauuuaugugacaugguaugcucaucauugauauucauagaauuaaaauaucaaucaagucugaaaaacccuguuuuucagauguucuaaauuccgaaguaucagauauuuaucgaagauuuaagcuuuuaugaaaagauaaacaacccaucucacaaucaugcaaauuuguuauuuauaaacagaaaauuucucuauaauuuuuuaaaaucuauauccauuuugcuaugugugaaccugggguguaucaagccucuuggcugagaauaaggagcuggcuccgagaguaagacgucugcugcacaagcugaccaguguucagcagaccgagcccagggaaagaugggaagaaaggacuaaguacacagagcugcccucugagugacacacaugaacccucuauacacccaacaccaguaaacacaagcaacacuuuuaacuagcuuggugugcuagagcacaccuuuaauccuagcacucaggaggcagagauacagggaucucuugaauucuaggccaguuuggucuacauaguaagcuucgggccagcuacgagcaaagguguguuuaccaaguagcaaagcuguuucguuaucauggcuauucuuaacaaacuauccucuuaaaucuuaagaaauuggauaugaugcucuguaccacacacacacacacacacacacacacaaaauggugcuauugucugucuuucuuucuuucuucuucuuuuuuuuuguuuguuuguuuguuuuuuuuuuuuuuuuuucgaaacaggguuucucuguauaggccuggcuguccuggaacucacuuuguagaccaggcugccuugaacucagaaauccaccugccucugccucccgagugcugggauuaaaggcgugugccaccacgccuggcuuuuuuugcuuuuuuuuuuuuuuugcucucgcucuuuagcaucacugguuguuagggggauugaaacccccuaacaucccauggauacagcaugaaauuugggcucuacuucucucugccuccuuaccucagucagcagcugaagccacuccagggucagccagcuacucccaggagcugugacuacuuggaacuaaacccaggguacccugcucccuagcuacagucggugcucugcaggaguguuaguuuuucauuguuuucccaucuacuaaauuaugggguuuuauaguuuauuuauguagaguaugauuaucugauggcucuuuaaacuuucuugagguuugaaguugcaauauauuucugaguucgaggccagccuggucuacacagugaguuccaggacagcuagggcuacauagagaaacccugucucgaaaaaacaaaacaaaauaaacaaacaaacaaacaaaacgagcgagagcacugugaggcuucagauacacaaaagcacagaaacuacgcagugcuaauaacacacaccugcaauauccuuccccagguaagagcaccagugguuccucaugaccucgauggcaucgaggucguccuuggagaugucguuauuaaugaucagguggaugcagggaaugaucaacucauucauuacauuaaugcccucuguuacagaauggucgucauuuguuucaaaaagagaagcagccuuggcauucagcuccuacaaauauagacagacaaagggagacuggaaaaaguaaguaucacuuuagugugaaucuaagccaacagucacacaaaaaucgacuaacuggaaagaaaaaaaaaaaaaaaaccacgcacuggcuccugccccagauguucugacauaauuaggauguaggugaucugggcccuggggcuuuauaacuccugugaugauucuaaugcaccuaaacuugugacucaauggccuacauuaccagccaaggucacaucugacaucuguuucuacucuaaaaccuagcaaaugauucucaaucuucacuagccacuaggaccacucacagaagacacugagauccagguuccucccagauuggccaguugucaccaauggcugaaagugacugacacucaucagaggcagugacgggaagccuaaaccaucccuaguauagcaguaggaaggaagguguaaggacacucaaguugaugauuugaaucugcugacuuagagggcaaaaucagagcuuuuaggagccgcuucucagcacaguagacagucuuaccacaccuauaauugacacagcaaucaaagaauucccagaaaauaaggauguugcaaagauaagcccacagaagugaauauacaaggacagccuacaagccagccaucucuugagaauuucaugaagaacuagcaugcuauauauacacugcugggcagauugacagcguuauaccagaccuucccuaugguuguccaucgcaaacgagguaagguaacaagguuagcaagaaugagucuuacacucuguaaccuaguauuaagacuggaauagauuuuuaagauaccucuaguucugaaaacuccccuuugcuaggcaacccugggaaacaucccauucuuccaacguaugcauguggcucugugcuagcaaacucauaccucaugggagcaacaugcuaaaagcuuuaaugcaggcacacgagaaaggcaaggcuggcucaacuuaucaaggguuggagaaaaauuauacacugagaaaaagagaacaggagaggcagggacagagaagagagaguaauguuuuguaaaugguacagaccagaaggcauuuucugcgguauaaggcaaucacagacuccuucacgccccuucggggccccuucaccagcaggccagcguugcucugguaugcguacaccagguaggacaaugcuuccugguaccuuagaaagugggagacaauccacauagugaguucuuuuugccaaaaccuagggcuuagcucucacuuuucuguaacucgaauccauucaacuacaauaugauguacugggaaaacaugggggccaaacccacagccagacucagcuguuuugcacucggagcaagaaagguaaggcaaaucaggaaacuuucaucuuuggaccucagguuuucucucugucucaaacaaaggaaagagacuggcuauucacuagagccugugcuaaucaaaacugcucucuggucacuacggagcccgacauaacaucuccucacugguaaacccagucacaugaaggacaggggaaagcauaaugugcagaacccgaugaagcauggggugggggaagggcaggcccaguguauguaacaaagaaggagacucauggcagugacuucugaguaacccugaguaggugucaguguucugacuaucaaugcuggugaaaaaaaaaaaaagggccaacauacuuuccuuuuuggaagaguuccaggcccguuagaagguacacagacaccuuucggaacagacuauaaucuucaugccaccucuggaaaggaaggaccaacauuagugacacgaucucaguaaacugcugccugcuucccuuuuggugcuauacacccagcaaccauguacucacaacauguggucaaguauaaaaacacacaaaacuuuuggguaaaaaaacaaaaaacaaaaacaacaaaaaaccccaaaacuaaaaaccaaccacaggaaaaagacuuaaauggaggugcacaccuguagccccagcagcacagaggggaugcaggagcaucagcaaggccagagucauccucaaaccugacaaaugcgagccgagcucagccugaguauguuuacaccacugaccuaaccugcucucuucuacuccuucugcugaggaucagaaaaucauuucaacuaagcguuugaguuuauaaacucuccuaaucccaacacaacuugucaaaguccuucugguguauauagaugacaagcccgagugugacaggcagaggcagccauggggaagaagggagcacaagcgaagcagacagccagcuguggcucagcagucaaacagcacagcccccgcccagcgugcuuuguacacagaagagucuguucucuuacugaacucuguagucacacguauuuuaaugcacacuacaaaaccaugccauuacacaccgacacacugccuagggcaaggcuuggaagagcccuuaggaaacgagcagacacaggcuacccaagacugaaaacaaggccugugcuucugaaccuaagacaggauuuguauucaauuucaccaccccauccccccacccccaccccgccuuuuuuuuuuuuuuuuuuuuuugguucuuugagacaggguuucucuguauagcccuggcuguccuggaacucacucagaaaucugccugccucugccucccaagugcuaggauuaaaggcaugugccaaugcccggcaauuuuuccccuuucaaucucuaucucggcuguccuagaacuccuuauguaggccaggcugggcuugaacucaacgauauacuuacucuuggcuuccugagugcugggguuaaaguguggcccaccacccucagcuuuguuuuuuuuuuuuccuucuccuuucaaguucauagggaacuaguugagucugguaacauaaaacuucauuuuaucuuaagaaucacuugccucuagaaguaagguuuuggaaggaauuaaaaagaaacaaagccccacacuuaccuuauacucuuccauguucaugucaucuggaccaauuuccaucaauuuggccugagccaccuucaugauacugauagaucugugagggacagaguucagaaagcaauggcaggguucagggcagcuccuccauauuggaggaaguugccgaguaagaccccacacaggaacaggcuggcacauucucaccucucaucauagcuaagguuucuauccgcaaacuguuccagaaggguccguucuacuacccucuugggugcuucauuuuggaaaaaguagacaagaacaugcugaaggcgagggucacugugagaggugggugucucuuuggcaagcugauagagccuggaguacuccucaugaaaugccuguuaacgacagaacugaggcaugggaaaggggacaccacggacuucagcacacagacagaaacugacaagaaacaccagagggccucucauugauucacacuaggcuaaggaauucuugucaagaaauuacaaaagcaacgaugggaugugaauugguauaucagaacucccucaaagacugacacugaagacuuacuauauucaaaaaacuaaacucauuuuccucaucaaguuugguuuuguggagacaaggucucaauucuguaguccaggccacccuagaccucauuacguaaacuagguuccccucaaacuuguggccgcccucuugguuccugugccaaagcgcuaggacuacagguaugugugggcaugcccaccucucaccaaguucuuaaauaaaaacacaagcacuuagucaaauuguuuaaaaacccacccaaauguaaucuuauucaaacaucuuaaagaccaaauaccucaaauaguaugccuuuuaaaaugaaggaucccaaguuacaaagucagucucaguuugugucaucgaugaacauuuaacaaccucgucauccucuagacuagaugcaaugcaguggcacuccucacugcugggccacugccaggcaaagaugagcaagccaccagcuuugugggauggcuugcucaucaucugggcagcaaagacagugucauguuucauuugaacacaggauacugugugucugugugcuagugugcacaaguguagagaccagagugcaacugugaguaccguucuucaaauucuauccaacauacauuugugggggggaggagaaguugggcgugggguugaaaaggucucacuauguaguccuggcuggccuguaaacaagugagucuuuuuuuuuuuuuuuuuuuugguuuuuugagacaggauuucucuauguagcccuggcuguccugaaacucacucuguagaccaggcuggccuugaacucagaaauccaccugccucugccucucaagugcugggauuaaaggcguacgccaccacugcccggcagcaaguaagucuugaaccucacuugaaucggccugccucugucuccucaacacugguacugaaggcaugugccuugcucuaucauacuuuuuugggacaagaucucucacugacuucaaacucaccaacuaggcuauacugguuggccagcaagccucagggauccuaucucugccuuuccagcaccgggauuacagacauguauuguaccauguuacacguauguaugugugggcaggguaugcaugucuaguagccacagaagacagaagagugccagaccaccugaaaccagagugauagcagugagcuguccaguguuagguacugggaaccagacggggacagcaguauaugcugggacaucuuuccaguccuguggaaaauuuuguuuuguaaaauguagauucuggagaucaaaaauguauccuuucgacugagcuaucucccagcacaagcaacuguaacagcauuuuccacugucuuacagaaauauuccuguguuacaaggauuaacauucuaaaacaagggggcuggagaaauggcucaguggguaagagcacugacugcucuucugaagguacugaguucaaaucccagcaaccacaugguggcucacaaccaccuguaaugagauucuaguguguuagaagucagcuucaguguacuuaugcauaauaguaaaugaagcuuugggccagagcaagcagggacugagugagcggaguugacaggagcgagcaaagguccuaaaauuucaauccccaacaaccacaugaaggcucacaaccaucuguacagcuacacuguacuuacauacauaaaauaaauaaauaaaucuuaaaaaaaaaagauuuuaaaacaagaguaccuuaauaagcccugcuucagacccaucucggucaaaggucuggcgugcuuuagcuauggccaggaugaccccuugcauggcagggcucagcaucaccuaccacagagggcacaaaacagagaaaaaggagagcagacagguucagaaggaaacaguaugaagcgaggugagcagagugcugaggagaagccgagcacugucuccuuggcuggcacggguugcaggccaagcuucacagcccuauucuagacgcaugccgagccuuggcucuccuuguaaugaugccuaugacaagccguuccucuaugugcacauucuaagucuaugagauaaacaaagguguccaagagcauuucugauggggcacugcugaagaguaaguucagccauauggcuagcgcuccacuagagugaagguauaaagguauguaguauuaaguagcugcuaacuuccaauaaaaacauacacagccacagcaaagagcagaaacccgagagacaggauaaagacuauuuaugugcagugcaaccgaaaaggagacagagcaugaggaacagcugcuugcucaaccucagaauuaaaagcaaaaccaacuuuaauccacauuuguuuuauucaccgagcaaguggaaaaagucuacuuguaagacaaaauaauggacugccaccaaaaccaaacaaucucucaaagguaagcguauuuuuguucauaauaccaaauggaguuaauccuuucccuaggccauccaggcuuuuguagcagucccugcucaacacaagcuggguguacacacauacacaugcacacacgcaugccaaaagugcacagcaaaaaugggucacccaugccuuuucauaaaggacaacaaggucagcagcagacaggccuccauggcuguugcuugauucagugagaaaacauuagcucgugacacacgccuuuugagaaacaacacacagcuccccugcacucgucucgguaccuccucaucauagccaucugcaucagaccuaacaagaauccuucccacacugggaaucuccacuucagagaccucagaguuaggugcggcagcagccuccgugucccuggccucggccgccugcucuaacugcucugcaagguuuguuuccuggggcuucuugggcucagcuucauuaugcuguggcagcagaauggagggaauagaguuaagaacaauggggaaaaacaggaagaaauaaagagggcugguuaaagucagcagagacgacagaaagcuguugcuggugucaaaaaccagacccucucaaaggagggucacucagccagucucaccucacucaaggcugcuucuacaccacucuucucguaggcaugagcuguguuggcaauugccugggcagucuguucuuuugcaaucacagcaugcucagaagacaagcaucggaccucaugagaggacacugcuggagacucuaacaaaaagaaauaaaaauauuaauaaucacagaagugucacaucugaugaccggcgagcaggagggacacacauuucaauauacagacccagcacaccucuuucaaaguccauguaaaugccccuagaaaguuggacaagaaacacacucugccaagcaguggaggcacacaccuuuaaacccagcacuugggaggcagaggcagaagcagaggcagguguaucucucugaguucaaggccagucuagucuacacauagaaacccugucuugaaaacaaaacaaaacaaaaaaaaucauuaaaaaaauuuuuugcgaggcaguggugguacacaccuuuaauuacagagccugggaggcagagguagguggaacuuuaugaauucaaggccagccagcacugcagagcaaguuccaggacagccaggacuagaaagagaaacccugucuugagaaaucauuuaaaggaagaaaagaaggacuuucuacuccacaucaaggaucucaaaggucuguuaaaauuacugugcacaauuuuuccuauuuucacaccaaagaugcuuccucucauuaaccacuuaauaagaucaucuguaacuuuccauccugucauucuucuacaagcuggaggauaagcaaagcacuauagaaagcacagacagccuuucucauacauaguauuucugcuugucagaaagcaacuucuuuuuuuuuuuuaaagauuuauuuuauuaauauauguaaguacacuguagcugucuucagacacuccagaagagggagucagaucuuguuucggaugguugugagccaccaugugguugcugggauuugaacucuggaccuucggaagagcagucgggugcucuuacccacugagccaucucaccagccccagaaagcaacuucuaaaggcauacugauccuacaaacuguaggacagccacuauaaacagaaccugaugcagggccagcaagacggcccaguggguaaagguacuuacuuguucccaagccugaugaccaggguuugaucccugagacccacaugguggaaggagaaacuggcccugacaaguuguccucuaauauaaaaaauguguuauauggcacguguccccacacuccucccaucaaagaaaaauaaaaaaguuaaaaauaaaaagaaugucacugugaagagagauauugacaugucacugaggauccaggguuggcugcagaggacagcaaggaccugaccagaccuggcacagugugggggaagagcaaggcccugccggaccauaccuugugauguggagaaauccugugaggaagaguucggggaggacuccaucugugggaucuuacaggacuguucuuccucccauuccuccaccucuugcugaaaccuccaguuaucuuccugaauguacugccugaguuccacagacagggcuuccacuucuccugcagucucaucagauucauuagaagaugccucugagggaaaauaguuaaaacagagaaagguaaacgaacacauuaucccagaggcagggcagcacaucccagcuuuacucgugucccuagacacacacacuuauauguaugcucacacacucacacagaauucaaucugaaacucugacagcaugagguuaaccggcauagcacauuaggaacuguaacaggcaacaucaguaagcaggcaguauuuaucuaguggggcuacagagacagcucugcagcucacagcacugccuucucuugcauagaacccaguucugguuuacagcaccaacaugguagcucauaacuguccauacuucucaguuccaggauaucugacacaucaggcacauaugugguugagugaaugcccccaaccuuggaauagcuuagccacuuguuccaugccugccagucacugacacagaaaaagaacuugacucagagcaaggucaugcugaucacauacccuguuauuauguucuguaugcucugcaugagguuugcuaaucuuaagauauuccacaaagcuuuagguaggacccaucacauuaaaggucaguauguaaaguagcuugaggcagagccaaccugcacuuccugcccuguguaugaacucacuguucaagauuguuuuuaugguuuuuuuuccuuuacuagccccggcccugauaaauguucaucaucuuggcuuagucccuggauucugagccaauucugagcuacagcccuaaucgaucagucuucgggugugcauucaauaaacgaccugucugacugagauugguguucauaugguuuguggggcaauuccuggaccccaacacguacacguagccaaauauucaucagcauaaaaugaaaauaaacccuuaaaaauuaguaucuguuggcugacugaaugaacacgauagguuaaugacuuaaucguggucagucacuggaugcagccaguuuuucuuuaaaaaccugaacauuaacauaugcaauagaaggaaauggaggggguucagugcuucagaaggcuugcugcucuuuugggagaacccaaguucaguuuccaggacccaugagguggcucauaaucaccugccacaccaacgccaggaugcccuacaucuuguccuuguagguaccugcaugcacaugugcacaaacacacauaaacacaggcacaaaaagaaauuuacacagaaacuaaaaauacaccgaaauaaauuucuuaaaaaaagggaaaagaaaguuuaaaguaguagucguaucaguuuaacucuuccaucugagagugguaagaacgucccggcugggcaugguagcacacagcuacaaccucagggcagcuccacaggugaaggcaagaucaggagcccgcaagguaggaaaggcuagaugagcuauugccuccgaaagauaagagagugaucccccacuucauuaaaugugaaggcacugcucugagcgcacucgggaggcagaggcaggcaggugcuaccuacugagacccugccuuuaaaaaggaaggaaggagacgaguacuuuauuucaugaaauuccacacaauuauuguguugucagaaaccaaggugaauuacuggguaaauggugccuagucaagucauuaaguacuuuggcucagagauuaagagcaccggcugcucuuccagagguccugaauucaauucccagcaaccacaugguggcucacaaccaucuaaugggaucuggcgcccuuuucuggucugcaggcauauaugcaggcagaaugcuguauacauaaucaaaagagaacaagaaaaaauugcaaaaauaugaaggacaaguugaauucuauuucuaaccaugucaucaaaaacaacaaaaagaaucugcaacaaaacaacaaagcccuuguuggccgccgccuuuucgugaagcaguaagagucuauuugcuucuuuucagucagggucuuaaguaaccugggcuggccuugaacaucugauucugccaccugugccugaaugcuaagacugcaagcaugcacagccaccccugguauacaaggugcugugggucaaaccagggcuuccugcacaccaggcaagcacucuacaaacaaaucuuaaucaccagccccauguguacuucauaaaaaaaugagcaaucuaggcaauaacaaggaacucccaacaaccgacggcuaggacaggcuuuuauaacccucacagccaguauuuaugacuuuacaucacagagggugguugguuucugacuauuugagacauuuucucuuuuauucccuuacaguuuuuauguucuaagaacauuuuacauagugauaaauuguaguuuacaaaugucuucaaaagaaguaugagacugccccucuuccaggggcuaguuccccuaaaugcucuccucuagucagcauguuuaccugcacugaaguggggcaaguugucauugauauacaucaagcaguaggcgcugacauuucucaggcccccguaagaaucucuuucaaguuccucccaggaagacucaguaacagagaugucguuguauuugagccaggucugccggggcugguuguagauguaugcccaguaguguccugcacuggcuuguccuucgugaacaagaacugcauguaagcgauaaggcaccugcaaaucagaaaggggggcucucagaccaggcccagaagucagaugcuaucuaugucaauacaauucugaacauucccaaccagcaaguaaaagggaaugcccacacaaacacaagauaacauccacaccaagcacuuuaccagcucaagacagaccaacgaaaacacaagcuuggaggcuaucaaggguccaaucccagggcccucagaaugagucaaagcaagccuugcuggaggcucuuucaggucacucagggccagauuucuuugaagcagcaaaacagaagagaagagggaaagucaagagccacacgaucuguuccuaugccaaccacaagcaugcucacugcacugcugggagcagagcuguguucuggauguuacucggccaugagcccuucauaggcccuguccaaggccuuaaacggaauaaaaacaaguguggacaacaaggauuucuguucugccuggcucccuucuggaauccaguuaguagaguaauaaagccugaggauacuaauggacccuccagcuggguuuccccacugcacugcuucaauuaccauguggaugaugcaggauauugaucagacuguggacccaaaacuguguuauuuccuggaaaaaccuggguguuuccuaugaugcucugagcuagcagacuuucaccccaacaucuggcucccaagucuuuauugguaaaaucaaauaauugaaauuuuaauaccaccaccacuuagagaaaaauguuuuauuaauauguaacagcaaauuuguuuuuaagauuugucuuuguaaaaaugaugcagaaucaugugcauguggguauuaugugagaguucaggugcccacagagggugagacauaucaggucucccuagaacugaaguuagcgguuucugggagcugaacuuggauccucugcaaaacagcauacacucuuagcugcugagucaucucgccagcuccuaacagcaaauauaucuccacuguaugaaaaaacaccgagugguagaauaaaaaaaaggaugauuuagguuucaauguaagcagaaggcccucugaguucuucagcuggauguagggauauaugccuacguuagugagaacuccgugcagcucuugugguacuaugucuucugccaucagugcagcccauuucccuccacccuuaacucuaccugacgaagaagagggucacaguacaucugcucaaucgccuucgugcugcucgagauacaguucuuuaggucuguuaggaaggaaaaccuuguuagcuuggaguguccgugacgggcccugccgacacaaaggcuuuuaacucaacguaauuacaucgaggcgcuuaacaaauuauucuuauaaaucugcacugacauuucuuaaagcaauugucuccauuuaggacaaaccuggguguaauggccgagcacaugcuuaucucgucugagggcccaggacaggagggaagccaagcaagaauggaguacggguaagauauuguuuagaaagcauucauuuuguuaagauucucaaaccugugagcacuguccccacacugggaaagcugaggcaggaggauaauguguuugagacuagucugugcuauaaaaggagaacuuaucuuuauaaacagcaaagauaucaaaccaaauuuucuuuuaacaaggccugauuauaaggcaaacacuauuauuauccuuugauaaucaauuauaaucuuuacauuuaaaccaauguaaaugugcagcaguauggaagcacaagggccauaugaagucaggucaguucggagacccugcuucaaggggacaggacaagagcagggaagcggggaggggaggaacauacacugcuuuaucucaucgagggcucccaugauugcaacuaugcaccuucgagaggagguuuugaggaggaggacaaauaaucccacaggaccaagccuuacaagaaaagaacugcagaagucacaguugccaggccugaugcccagcagucagggaacaaacacccagugugccuggcuuccaaauagccaggaaaaacagagaguagcuaacaaguuuucagagcacccaccuuguauauccuguucaauuucacuccgccaccucugaagacaggucuuaacgaaguucauuucuucaucugugacuguccgaggagcugggggugcaggcguuuccagagacgagugaggagagguaaauggcccauucauccccucagagcugggaagagcaucuucuggagaggaaaagguacuuccagcauucugagagcagcuuucuggacuugaacuagagaagacaaaagaaggcacucauuuuguaauaucuaaaaugcaaguuggggugggcgugguagcagaaaccaguaaucucaucccuugggaggcuaacacaggacuguugugacuuugagaccauccugguauagcuaagggccuaccuccaaaaaauaguucaacuugacccaaacuaauauacuucagaaaaccggcugcuuuaugaaaagguacaguuaagauacaacugugaggcugaggcagaaagaccucaauuguaggccaacauaagcuacgcauacacagugaggccuuagcuaaaaucuacaaauauaauaaaagcuaacuuuuucuuguaauaaucaucucauuuaagacagucugguuaugaagcuaacauuaguacuacccucaucugaugaacuacuagcuuagcauuuagcaagcuuagcuggcuuaaugguuagugccuauaauccugguacccaagaaaugacaggaggcaggaaagccucacacucaguggcucucaaccuuccuaaugcugcaacccuuuuaaccacacagucccucauguuguguugaccccccaaccauaaaaucgcuuuuauugcuacuucauaacuauaguuuugcuacucaagaaccauaauguaaauauguguucucugauggccucaagccacccccaugaaaggguuacucaacuucccaaaaagggguuggaacccacagguugagaacugcuacucaaguccaggguaaguaagauccugucucaaaacaauggggaaaaaaacccaaaaaacaaaacagaaaaguacuaugcugcucacauggcauagcacuuacuuaccuagcacgagacauuggaauuacccuauaccaaauaagccuggcauaauaagcaagaagaaaggagaaauaaaugcaaauuuaucucuaauagcaccagaaaagcuuccuguuguggaugcuggaaacugaacaacagcccuaggcaagguaauuugcacacuuaauggcugagccaucaucuuuauagccucugggguuuuguuuuguuuugaagacaagguuucucuggguagcucugacuacucuggaacuuguccuguaggccucagacucagccugccucugccucccagcuggugagauuaaagguguguaccaccacaguccaucuaacaacagguuuuuaacauaagcuuuuuuucuccgugagggacaaaugugcccuagcaauuuuauuagcuaaagacacacauaucauggagcgugacccaagcugaaccugcaggcaccgucuagcuauaaagacugccgguuaaauagguagagucagaggauuccucaacguggccucccuguguguucaagagccuagcuccugcaggcuuggccucagaauucuggccaguuccuccuuguguaacucugcccauacgguuuuccuugcuguuaauuuagccuccuucaaggcagaugaaguacagaacaagcugccugcuggacacugcacacagcagacagaagccccuggagcaagcguacugcaaggacucagggcagggccaggugacaaaccccacucugagggaucagagaggcucacagcaggugggaggauaggaagggagucaaauaagaauggggaaacaauacaaaccauuuaagaaaucugcuuguuaccuuuccuugggugugaggucagaaaucgggcagugcaccgagggaagugguaaugucacaugcucagcacuuccagacagacagcuuucagaggcagguuuuguacuggcaaauucaauaacguauuucaacaugucgggaagugggaaccgagaugggcccgagccguacuucacauaccuaagaagcaaagacacuggaacacacugcccaagucuacuaugcauugcaauaacugcugauaaagacuuaccaugcagagcugcuaauaccuagcuauauaauccuaguagcucaggaggcugaaguagaaggccacaaaaaguuugaggccugucuggguuacaaaguauggggcaagcuagugacagccuaccucaauauaacaacaaaaucccauauuauuccuaaaggcauaugccauuuaauugguuauucaaucuauaggguuaaaaacuaaaaaagugcuuuagccaugaaagcugccagcagucugaugcaucacacagagaacaggacuguuucagacagcucaguucugcucuccugucuuacauaccacagccaggcgcugcucacaaaccugaguucuuccuuaaaggacaauguuccaaacuaacugaaaaaaacgaucuggucauuaguucucaugacauuuucuuuguccuuccuaaaccaacugccucauaaccaagaaugagagaaauccagaaauaaauaucaggcuuuaagaaaagcaagguggugguaaccuuugaucagcacuugggaagcagagggacucugauuucugugaguucaaagccagucuauggagcuuccaggacagccaaagcugucuccaaaacccaaaaccauaccaaacaaacaaacaaaaaaagccccccaaaaccaaaaccaccaccaccaaaccagaaagaaauuagacauuaguaaaagucagagccaaagaaagcagcaaucuuucuuuuuucuuuuucuuuuuaaaagaaauauuuauuuauuuauuuauuuauuuauuauuuauuuauuuauuuauuauaucuaaguacgcuguagcugucuucagaugcaccagaagagaggacggcagaucucauaucagaaagaaaagaaauuagacauuaguaaaggucagagccaaagaaagccagcaaucuuucuuuuuucuuuuucuuuuuaaaagaaauauuuauuuauuuauuuauuuauuuauuuauuuauuuauuaauuauaucuaaguacauuguagcugucuucagaugcaccagaagagaggacgucagaucucauuauggaugguugugagccaccaugagguugcugggauuugaacucaggaccuuuggaagagcuguuggugcucuuaaccacugagccaucucuccagcccgcaaucuuucuuuuacagggucuuacauacucuauuuuuaaaaaaucaguuaauuuauuuuauguauaugaguacacuguagcugucuucaaacacaccagaagagggcaucagaucuuauuacagaugguugugagucaccauaugguuguugggaauugaacucaggaccucuggaagaucagcagucagugcucuuaaccgcugagccaucucuccagcccuuauauacucuauuauucauguugugauagauuucauauaagauuucuccaguaagaguaauauucucaaauaugugacugaaauaauaggguacuuuuacaguuauuuaauauacauuuuuauuuuauggguauagauacuuugccugcaaguauaucugcaccauaugcaugccuggugcccuggguggccauaaaaaagguauaggauccaugauaacuggagucacugauccuggauccucugcaaguguuaaccacugagccaucucucugccugcacaucuucacuugcgugcgugcgugcgugcgugcgugugugugugggcgcgcgcgcccacacacauguugucaggugcucugaguccagaagguggcccuggauucccugaaacuugauuccagaugguuguggccaugagaugagugucagaaacucaacuauugugagcacaguguauacuuucaccaucagccucuaaacaaaguuuucuagauauguguaaucuccccauugcuagcacauuacucuaaacucauauggagagaucugcaggaaggacaggaaaucaggguuauccuuagauacuugcugugugaagacacccuggagagaggagacuccaccucaacaacaacaacaguaguuacugugguuaguuaaacgagcagcgcauaguugcaagcaccuauaauuucaucacuugagaggcagaggcaggcaaaucauuaugauuuuaagaccagcccgguccacaaagcaaguucaggccaaccaaggcuugcuuacacagcaagaucuuuucucaaaaaacccaaaccaacaaacaaaagaacgaagaaaaugaaaaugaguagagaaugagcgcuuuaacucagcaucaaauccaccacacaggccacagagcggagagcaaaggcagccuuagccaagguugccuaccaccuacucugucccucagggucacuaacagagaacaggcaugugccugccagggugaagauccugagccaguuguucaaucccuggcaugcacuuggccaugcucuuccgcuacgaguuuaucaaacucuacucagugcacacuucacagagagcagagcugguaucuuggcacaggaauggguaucagccuucaccuccucccaggcucauuccauuuuaauaaaauacuuaaaaccccacagaaguuuuucuccucuaaggagcuugaguuuaucaguaacaaucacaccagaguccuggcucuuagagccaacaacuucacgaaaugcagcaccuguuuugacuaacaggaccagggcaggggaugggacaggucgagacaggaagggauacaguccaagaguauuuaucuacgauguacaagguguucaagucuuagcacaggauaaaaacaaaaacacagcaaaguagcuucaaaaccgucuugucuaucauguacagaagaaaucucccuuucaauaucuuacauagaagaaauaauaagcauuuuguuuauuuucugagacaaggucacggaaauccaaguuggccuggaacucccgauuccuaaguccugagcucacaaguaugcuccaccuuaccccaccuuuuuguucuucugaggcagaguuuaagcuauacucagacuaaccugaccuggacuacauagcccagaccagccucaauaaacaaacaaacaaacaaacaaauaaauaaauucacucaauucucuugccuuggccucccaaacacugagauuacuggccacaaugccuauuuuuaggcuucaaagugauguauggauguguuuaaaaaauucaaauauaaaguuguauuuaaaaaaaaaaacaugaaaguuaccuacucccaccucauuucuguaucucacagcauguuuauuaguuuuuggauauuuucccuggaauaugucacauacauacauacaauguuuauauagguuaaaaaaaauccacucauuuauuuuuauguguaugaguguuuuguuugcauauuuguguguguaucacgugugugcaggaaccuacagaagucagacagggcaucagauuccuucaaaauggagccauagguaguugugagccgucacacggcugcuaggaaccaagccagggcuuucuucugcaagagcaguaaaugcucuuugcugagcauuaagccacccuucucuagucuuuaggucacauccaggaaguuauguuuuggccaggaaggugguuuaauggaggaaggugucugcugccaagccuggaacucuugaguuugguuucuaggauccacauggcugaaggagacaacuuuagacagcauccucugaccuucauauacucauacauguacacauaagauauguaaguaaguaaauaaacaaacaauuaaaacuacaaccaguugauuuuaaaggcagaguagaggcucaguaguuaagagcaugcuucuccacagaaggcccuaguuccacuccuugcaguguggauagacugucuguaacucuagauccaggguaacugacacucucuucuggccuccagagguacuagcacugccagaugcacauaaucacacauagacacaacauacacauaaucaaaaauaaaucuuaaaaacagcaauaguaauauuacacuaaggaaagugcuuccaaagucucaccgauucuugguuucuuuaaguuuccuaaaaauaacggggccagugaccuggcacagcagauaaaggcacuugucaccaagccuaaguuugauuccccagaauccacauaaagauagacagagaaaacugauucugcagguuguuaccugaccaucauaugaaugcgaagcacacauguucauccccucuccccaucucuuucccccuccucccauucucuuacccaaucccuacacgcagcaaauaauguuaaauguuaauauuggaucuggguaaaucucgugucccuuggagaaauuaaugaccuagcaguggacccgugagguaggacagagaauguuaauagaugaaacagcuggagagauggcucagcaguuaagagcacugacaguuuuuccagagguccugaguucaauucccagcaaccacaugguggcucagaaccaucuguaauagaauaugaugcccucuucuggugugucagaguacagcaacagggcacucauauacauaaaauaaauacaccuuuaaaaaaaaaaagaaagaaaaacaccagcuguucuuccagaggaccccgguucaauucccaggacccacgugguggcuccccaacuguaacuccaguuacagaagcucugauaaucucucacagacagacacacguacacgcaggcagaaagaaaagaacacuuccaaaaaugcacagggaauaaaaaaggaguugaagaggaagagagaaagccaguaacaguguacagauuuccuuuguaaauguuaaaccaacagcucuaucuagacuacaaagaccuguuuuaaagaaagcacagagucugccagaagaacucggcacacgcgaggagcucaggcuccuguucucaggcagcaucaccccaugcaacacuucacaagcccauucuccccacgugaagcugccaggcccagaggccaaucagagcaaugccaacccuugggcaaguggagacaggagaaccagagguuccaggccauccucuuugaguucgggcuacagaaaacugucucaaaaaaaccaaagaggacaagugacugacagcacuacuucucacguucauuuagucagagagcaggagggcaggggagagaaacugccagaccgucagaguauguccgagucccucaaguccucaggaccacucacccacaggcacuagcuggccuugaagauuccuuuacacuuacaaugaggguacugccuuuuuuauaaaccaccaguuauuaauuaauuaugcucuguacuuuuaaacauacucucuaaucuuaauaguugcuuuauguuucaaagcaugaaacgacccagaagacucaccuuucuaacuucugcugcagaacuuguauuuccuccuucaacuuccgaacgcucucucucuuacuucggauaagcucuuugcucuuauacauguaccuaagcaaaugauacccacgugcagaagugacaucagcagauaucaaugacaagaccucaguggagacuucauacaggcaauuauccauuauccaauauuacauuuuuauuuuccuuuauuuguugaguuuuuggcuugagacagaaucuuauagcucagaguggucuccaacucccccuguagugggggggaugcccuugcauuucuggcuaaauuacaggguaccaaacccaccggagugcacugcuauggaucacacucaggucagcaaggaagcaggauggaugcccacucucaccacuaucacuaaaugcuucccuaauggugaagccaguacaguggcucacaagucaaagaaacaaaaggugggagacagcagcaaaggaagcagagcuguucuucagcuacagcucacagcagccacaagacccagcugacucggugaguuuacuccaacccgaagauacagugucaauuuaauagccaguacaauuaacuuuauuuccaucuguucaaagagaacagaguaaaauuuuuaaaacucagaauuucaaaaguuuaacuaaugaugaaagggcuguacaccagauuguaaagcaucaccaauagaaauaaagguguagggaggcagaagcagguggauuucugaguucaaggccagccuggucuacaaagugagcuccaggacagccagggcuauacagagaaacccugucucgaaaaaaccaaaaaaaaaaaaaaaaaaaaaaaaaagaaaaagaaagaaagguguaaaaacaaaacgguagcuacuaugcuuagaaggaaaagaucacacucuaagaugucauuucuccccagacugaacgacagguguggcacaauccaaccgaguaucccuuauuuuggcagaaacuggcaagucacuaaaauuuccauggaaaugcaaggagccaaaagccaaaauuguuuuaaagcuaaagccacuggagaguguauaaauuuucuugucaaacuaaacaaaauaaagacaaauuaaacaaauuaaaaacugucuaaaguuccgagggcuguggcgugagcucugagcucgguuugcuuccuugcuaauauuggguuuucucucucaucccccuucucuccccguuccccccuuuaaacuauaacuggguccuucuuagaagagauuucagaaaaugaauuuuccaggugauggcuggagaaugagggcuuuuuaaaaaaugucaaaguuagaggaaguuuuguuccccuaucuggauguaaaagaggaaccuaagcauaguuaaaaacccagcugcuauuccagugguuugugugcauacaguuuuaccgugacaguauaaacuagcaccugccuugcauucuucacuuuauugcuuuacagcguccauggagaugagauuuauguucugaguccagacagaugcccuagcuacucagucacaguacucugaaagguucacacaauugaaauguacacauuaucaaauguuuaggugucuccacacauaacuauguagcucacagucacuucuacuauuguguuugaaccaauacucaccuauccauauagauaaucugaggaaauuccagcuuauuaugaauuuuuucaggcugcccaagagacugauuaaacucaaaucuggagaguucaaaggucaacacuggaggcagcuuuguaaaccaacgcugccaaggaaaaaccauaggggaaagagaagucaaugucaggaaauaucagccacauuuaaaauaccuuucaccaaacuucuuuugauaugaaauuuacauccaagacaacuguuacacagcauuuuaucucacauacuaucuaaauacuuagaauuauacuugaagacuaaaccuuccucagcauccacauuuaccaccagcauugcguucaaccaucaccuuuagaaauaagcaccacagaauacaagaacugaccaugcgccaaugcaagucauucccuaagagucaucagaauuuaagauguucagaucuuacgagaaacagccuaacagcguguaauuaggggauaacugcucucaauaaucaucuaaaaagacaaacacuauaaauauacuauguacuguuuauuuacagcuagccacaguuuuaaguccuauuuacaaauaaaaauguaaaagucucauguuucugaggaaaauaaucugacuuccaagacagaaguucuugaaaagccagccaggccagugaacccacaauggcaaccagaguuugaaaagaaggcacguucuuuuccgagcgcagcugagggaagcaagccugcaccagcagcuuugccugccccccagagucuuccacggguggcggcuggccccaugggcauccgacucccccacagcugagucuuuuuaucuuuguuguuugcuucuugagacaggaucucacucacuagacagccaacgcuggccuugaacuuguaacaauccugauuaaucagucucuuaggugacagaauuacaagcaugaaccaucuugacuggcucuucuggguuaaaucuaauuaaacaagcauaaggacucuugcuaggguuuuauuuuuacgaaauccgugucccuggaugccauuuaaguaguaacugcucauucacuguacacacaagguauagcucacacuaggaacugccaggaaucccuuuuucccuggagaagcugaggaggaagugcucucaacauucuaccaucgucuagggcuaaaacaccuccacaggccuaugucaggugcccuacuuuaauucaagucaauuucuccuaacauaauucuugaaauucaguuccaaaagccaguuuugccucaaaauauucuaaauggcacaucauuaagaguuuuuuaccuccaaaaauacggaggcagugcguucucccugcucagguacacgcaggcuucaacagaaagggagaaacgugaucauacugaaaucacaucaaagcgacacaagcccuuacauguguaacucaggauucacaccaacugcuuagagaugggagacagauucaagaucugcucagcguguggcgaccuaacacgugaacugguuugccucaaguucagcccuacuuaacuggcucugucacugguaauauacaccuuaccuccugcccauacuucacggaacgauccgaaggaagcagcgcgaugucaccuuccaccauggccccuuccaaacauucgucuaaguugugguaaccguuuaccugaagaggauacuggccgaaggucucauuguuacaaaagggcuuuccuaggcaaagagggguuuguuaagcuuaacuaccaccacuuaaagucuauuucucuggcuccacugagacaccacuguuaggacucaguagucucugagaaguggagaaaaauacacuggagguaaccuccacugaccuauuggacccgggccugugcaugcugcaaguagcaagcccaaggcacaggcuuccccgucaaacccaccaugagaguccuggcuggaauaagacuacacaggacacacaagaguggcagaggcccgugucacguuaacuaugugugcuaggacguggccagugaauuccagaccuagggguuauuacaaacaaauuaccuucuucaaaacaugcauuucaauauggacacaaauauggacacagugcugaacaccugcagcccugguccuugaaaggcuuacuacugagaauaaaggcuauccucaacuauacagcaagacccugcccccaccccaaccaaaaaaaaaaaaaaaaucaguaacacaagauauuucaaggggaaaagaacguggauggaagugaagcccacagauacugaaaugagacuugccaacagucauacaagaaccuggaggcugaguggauacuucugacucaauaugggcagcuccggguugcuuucuccaagggaagggauuucaauauugacuaaaacaaacucugagguugaguguucuaggucagcccuggccccuuugugugugggguuuacuaacccacguaggcacagggaggaaaucgauuuggagaucuucuucaaucacuucuccaucucuugggguggugggcagucucacaaaauguaaaauggaacuaugcugguuaguuucaugucaacuugauacaagcuagaguuaccugaaaggagguaaccuuaauuaagaauuugcaucuauuaagaucuggcuguugaggggcuggagagaugacucagugguuaagaacacugacugcucuuaacugguccugaguucagaucccagcaacgacaugguggcucacaaccauccauaaugagaucugacguccucuucuggggugucugaagacagcuacaguguacuuacauauaauaaauaaauaaaucuuaaaaaaaaaagagagaucuggcuguugagaauuuucuuaauuaguagugauugaugggugagggcccagcccaauguggacagugccauucuuaggcuggugguacuggguuccauaagaaagcaggcugagcaagccauaggagcaggucaguaguaaauagcacccuucccuggccugcuuccaucaguuccugucucuagcuauuaaaaugggauggcuggcagagguguauuucacauaccaaaguggaccugacugccagguucuccugauggcaugcccugcccacuaccaugacucucuccagcccagggucuaggccgcccuuuccuauaugauccaaccguuuuggcuaccugucuacucuuuuuugggccuccaggauacugcagcugguucccuucuucuuuccccuucucccuacauccacauggcucagggcucacagccacucuggacuaucucagacgccucugccucuggcaaugcucucccacaaugaacacaauguccuuuccuuuuuaauuauuguuuucacucacuagcccugcuuuaguuccugcccuaauuuucuucaaugauggacugugauguggaaauauaagccaaauacauccuuuccucuccaacuuaguuuuggucaugguauuuuaacaucacagcaauaauaacccuaaauaagaaauauauauguguauguguguguauguauguauguguguguauauauauauauauauauguauauauauauauauauauauauauauauagugagagagagagagagagagagagagaauuuaaauauauuugacacuuaaaaaugcucauucuuuggagaaauuguguguggcgauuuaugaggaaauucucugacaggcucagacaugugaacgccucauguccagauugaagcuuaggagguauguauggccuuaguggagaaggaugucaccugaggugaccuuauggaguucacagccucacccgaccuucaguuugcucguuccucucucagcuuccugcuccugccaccaugccugcugagugcagccaugacuccccacaucgcccccuggaacaguagcuaaaaucacacuugcuaauuugcuuuugguccugguguuuuacccaacagaaaagccccuaacacagaagaagcucauaccagagaaugaaugacuggauggccugaggcaaucaagcacccgacccugcugauuucuggaggaauguggaagauuuuggaacuaaaguguugaaugcuguaggcagagcuuaaaggaguguucuaauaggagccaagacuaacagcacccagaggccagucccgugauauucuggcaaagaaucugggccaccuucugccuuugcacuaugaacuugccugaggcaaacuuuaaaacaggacugguuucuuuggcauagaaaauuucaagacuacauaauguugagauuguggcaugguuauuauuguuaaugcuuccacaagucuaccaugaaaaaaaaguggggcagaaaaaacuacaaaauguacaguuuggagagaaaagaacaccaggaaguuuauuguuacagccaaaacacucgggaagaacggcuguaacuguuaggagguuauguuuuacaaguaauguaagcauuuacuuguaaaacucuguugggcccccacacgccuaugggggccagggagugggauacuguaguuuaaaugagaaauguuucucauggucuccuauuugaacccuuccuguccaggagguagccuuguugacggagguagguaugucacuaggaggcagacuguaugaguucacagcuuugcccugcuccccacuugcucuggcugcuucgugcuuacaguuaaagaugucaccucucaguguuuuguaacagcugccugcuugccauuuuguucccaccaucucggauucuaauccucuagacccagaagcuagaaaacuuucaucaauagauuuccauaggcaugauauuuuaucacagcaaccgaguaguaguuacuacuacacauggugcugggcuaugucuaacauccacccauccauccauguaugaaaacugcagcuguugguguagcaguuaagaaugcacccugaauucuggguucaaguccuacuaacaaaaauaaacacauauaguaaaucuaaaaccuaagguccagugguggugcauggcuguaaucacaugagaaugaggcugauauagggaagagcuggccauggguucacaagcugcugaauccacagagguuucgauacuauucuauuuguacauaggcaaaauccugacacuaaaaaaguaaaagcuaugugcuuagccauucuauagaaccugagauuagaugcuccaucaggaaaaguaauauagaaaauuaaguaggaucacugccaucaacauagauauuacacaauuuaacaugacaguucuaggauaaagacugugcccacuguacagaucuagagacugaggacucagacuaugugcccauagucacauggagaaaagccagagaauaagucuucaguuuguuggacuuucaaaucuauccugucuuccugcaacaaugaagcaaugagacccagucacaggugacaacacacacacaggacaaagacagaccuuaccuucucggaccccuucugucagaaaaguaccguagaauagcugcaccaugggauuuucagauuuauuccugagauggcugcuauuuuaaaagagauaagacaguucugugugacucgaaucaaauacaugcccauaaaacccgagcagcacucagaaagaaaugagaacaguagccugcccauucucaucaccacacugucacaugguagguaucuuaguuucuaaggaagcaaagauguaguucagcucagacccugacugacaagaagaugccuggcacugugcugggaggcaaugugugaacccugaccuuggggucacacuuggugacaaauauguguguauauacauuugcucuacacacaguuugccagauuacauguauaugcaagguagagaacagcacaggagcaaagaauggacucccccagaguuucacagguaaaugcuuucagauuuccucaguggcacaauauaaguagcaugcaaaugugcuuuuccuaaagcucgucuuacauuguacuuaaguauguuuuaaguucccucgucuuauacgguaguuauguguguaaguucccaguugcaaacuauuucaugauacuuuauucuccaacuccagacuuaaaacuauuuagaaaagugguucuuggcagccacacacagaugauacagguccuguguccaugcugggaugacugacccacaugcucugugaaugcuaagaugucacaggugagugacauuaaauauaaugguuccauaccauacaccauguccacauuuaggaguccuuuacccgcuuuuaauuacaucuuacaaccaagcaguuaguucagguucagagaaacaaagguugaggggacagucuagaucucuacaggaaaagccaaaacagggcucaguggccaccaagaaguuuggcaaacacuggcaguuucuacuuuagaagagugacuucgcccaccaacuguucucagcggccaccgugagucggaaggaugugcagacaaacccucaacacucacuuaacauuaacagcuagcuggaacgcauccuccagccaauccaggagcuugugugugaauucacucacaucuugcuauaagagaggcacaaauugcaguaaguuagaugcaauacuguacucaaggaaacaaaggucugcuuuuaaguccacaaauaaauauucuacuccuaugacauaaucucccuuuuaagaggcaaaagacauaggagcaggaagcccagugacuagagacaaacagcagggcacugcugugauggcaaucagcuaggccaggaggaaguggaacgcuacagggcuggccacaucugugugugacaaaaacaaaacaaaaggaacagacuggaguccacuaggguucugugagaagugacagagaaaggcaauuuuacaaacuguuuugagaaugcuaguuagcuauguagccauguaauaguguggggguuucacauuguggagcccaaagcuggugcaacagcaacagcucugagcucaguagcagguggagaaggaaggggaagauuccacgacugaaagagaaaagcugccaaacucagcuucagcagagugggaaagaggauuucuaucuaucccagcgugacguuacagccugcaaucccagauucaggaggcugaggcuggaggaccugccauucaacaaucaccuggguucaauacugagaccugccuuaaaauccaaaccaacucaagauuucuaccugggccaucagacacaggacuugacucuucucaauuauccuucaguauggcucacuggguuacuuuucgaauuuguuccugcuucaaaagccucugcugguuaaggcaagagccauccuccccacuuacgauacucuuccucccacuucugccuccuucagugccagcgcaucgugcaccucucacccaugugaacacaccugcucuaacuacaccuucugagagcgaaauaaagggcagaugaaggcagucaucuugucuuuguucagagcuugucauacaguaacaauucaaauagcaguaccacacuagcaaagggugacucagacacuggccuuugaaauaugacaagggaacaaaguaccugcugcuccucggaugaucggaaggcucccuucaguagauccagggcugcagaagggucuacaaauuuucgauuugaucccaacaacagagcaaauaaauacugaagcucuugcauaaacaugauauuucucuuuuccuagagaaaacaagccaagaucuuauuuggaaagcucaaaggaaugaaaaaaaaauuaucaacaaucacuaguucacauuuaccaaguucuagaccaguaagaauaacagagggaccagaugaggacagcagggguaagccuagagcacucggagcugugaagcagucaggggacaugcugaggacaagacacaauguucuggaguucuuugcagcugcccaccaaccuaagaggaugcacuguagcacggugucaugcaagggcaagauggaugcaguccaagaagggccuggcucugccucagcuaucugcucugcauccuuugaccucggcagccaaagguaggagagagacagcacccggagaacagguucugaguaucaccaacagugcagcacuacaguuaaauaaaacagugccucacugcacuuccuuggcauugcuuauuccuacuuaacuguaucuuugcaaacccuuacuucuuguccaaaggagggagaagagugccuuagccaaggacuaucacaguucccacacugggucuagcaacacagaaacuuugucucagugccaacuuacagugugacuucgacaauuuucaaggauguucuguggcagguuauaacugagaacaagucuucgaaauucaggcaacugaaagagagacugaaagaaagaaauuuauucucaacuucuuucaacuguugaggccugcuccuuugaauguaacugaagccauuuuguauuuagucuccauuuugcuccuaaggugaaauugaguacagguucccagacucugcgucccagaaggaacuguccauagccgacacugagaauuucuccuaaaaggcacuaugguuguauuacuuaugcugcuagcucaguccucuggaacuccccuguucaccacccagccaccaucccucuuaccucacuuaggaccaaucagcuuaaaagucagccaaaacguacaacugccuccacccucgccucuggcaguucguaugguuuguguggcggcuccugaaccccaacaaaaacaauugcaguuuuuguuuuuuaaauuaucuaacagggucuuacuagauauuuuaggcugcccuuguacuccuuauguagucaaggcuggccuuaaauucuugauccuccugccucagacuccugacugcuaggauuacaggcauguuuaauuacaggugcaguaugucaaagccaggcaugguagcuuggagugguccagcacucaggaagcugaagcaaaaggaguacagugguugcaaggccauccugggacccagugaggucuagguccaucgccacacugugaaauccuagcucaucauuaccuuguuuuaaaaguaucuauacugucaaccuaccaauucuacuauuauaaggaaaugauuggagagauggcucagcgguuaagagcacugacugcucuugcagugguccugaauucaauucccagcaaccacaugguggcucacagccaucuguaaugggaucuuaccucucuucuggugugucagaagacagcaacacuguacucauaaaauaaaucuuuuuuuuuuuuuuuuuuaaaguaagcgccgggcguggugaugcacgccuuuaaucccagcacuugggaggcagaggcaggaggauuucugaguucgaggccagccuggucuacagagugaguuccaggacagccagggcugcacagaaaaauccuaucucgaaaaaccaaaaauaaauaaauaaauaauaaaauaaaaugaaaaaauaaaagauuuaaaaaaaaaagcaagcaagcaagcaagaaaaccuaagccuguugaacaccucucacagcagucaagauuaagggcauucugacucuaguauaugccugucuguacacacacuagagagcuguggucuuggacuaacucacuggcaguccuacuuuccacagugcuuuuaugacaggucucacagaccgcggcugauguggaaugcaccacaaagcccaggcuguaccuguagcaacccucuugcccuuuccucaaaggugacuacagaucugagucaccucacguggcuuugcucccgcuacacucacugugcuuuaauuaugugcucacugagggguugggaaggcagcacacacacaucaggucauuuguauggaagccugaaggagucaguccucccuucaugccucugcuuaaaagcuucuaccagcuaagccaccgaagaccacccuacagcagcagcaccucagcugagucaucacacugugacggaacaccaugaccaaagagcaagauggggaggaaaggguuuauucagccuacacuuucacagcacuguugauggacagaaggaggcaggucagaaacucaagcagggcagcaaccuggagggcggagcuggugcagaggccauggaagagugcuugcuuacuggcuugcuccucacugcuucaucagccuacuuuuuauagaacucagaaccccuagcucagugauggcaccacccacaaaaacuaggcccucccacauuauugacuaaucgagaauaccuuacagcuggaucucauggaaacauuuccucaacuguggcuccuucgucucugaugacucuagcuugggucaaguggacacaaaaucagccaguacacccuccuucacaaugccuuuguggcauuuauacgaccugauucucuuagccaaacuccaguagaguacgggcuuugucuuagccacugcuguuucccaggucccaaucagagccaggcauauaguaaacaaaguauuuuggcuugagcagcuaggugaugccacagaaccauagcacagacaugccuccaggcagggagagggaaagaacacacgaagcugauagugcugagggaacguuuuucuuaagugugugauagcuugucuuauguccacuugacacacaaacuacaucaaucuaagaggaaggaacuucaguugggacagugccucccuccauaacacccagcuguuagugagcaaugggggaggcccaggacaccaugaguggggccaucucugggcugguggacuggguucuauaagaaagcaggcugagcaagccaugcagagcaagcccguaagcagcaccacagucucugccucagcuccugccuccagguuccaaggccuguuuagguuccuguccugacuuucaucuauaaugaacagugauaucaaagugugagccaaacucuuuccuuccuguguugguuugaaaagggauggcccccaaagacucauguauuuuaaugcuaggccauagggaaaggcacuaucaggaaguguugccuuuuuggaguggguguggcuuugcuggaggcagggucugaggucauauaugcucaagcuaaagcccagcguggcagucucccucugcugccugcaguucaagauguagaacuuucagcuagcuaccuuuccaacaccaugccuaccuucgugccaccaugcuuuccucuaugaugauuccaggcuaaaucucugaacugugagccagccucaaugaaauguuucccuuuaugagaguggccgugagcauggugucucugcacagcaacgaaacccuaacucaagacacucccaacuugcuuuuuggucauguguuuuacuguaacaauagaaacccuaccuaagauaaguuguaccaggaguaggggagugcugugguagaccagacucuguuguuuggagaggacuguggaagggcuuugaacuuugggcuagaagagccacugagugucgagaguucaguggacuguucucuaggagcuuggaagaaugcugagagcaguccggacgauggaggccagacucacgacuuuucagagggaagcaaagacucuccugggcuuuugugggaagauucugugguucugguuagcuggggcugaagaacagcugugauuaacaagguaucaguacuacuaaagggaaaccucugcuugccaggacaagugaugcuggucagcuggagcugugaaauuaguggugauuuggaccucaugcuggcagccagacucgguaccauggaagaguaaccuaggcgguagugguuuugaaggcaugacagggucacggacagcggcuuggcauaugagaagccagcagaggcgaccgaagagggugcagccucgguagcaguagaagccccagaacugaaggggucguggaaaaaaggggaggcuuugcaccaugaagagaguguaggagaagcuuuuggugaaagugcagccaguugcuguagaccccagcauuugagauaccagcacuacagagcgaccacaauugcucauaacugcugaaccaucucuccagcuccaggaaauauuuaauagccacuucucucaaaugaaacccauccacuugccuggcuuuacuuagaaccugagaguauucuuuucugaacuagaaauacauucaguuaaugcuuauguaguguuguauacaaggauguaaacauagguauuuugaacuuagcacaucuacagccuauuggcaacuucuaccacaaauuaucccuuccgugucaaacggcagugagcuaccuguucacuccucgagaccuucgaguccuauagauuucacaguccuccucccccaagaguguuuucacaggaccgggaauguggcucagugauaacaugcuuggaguaaauaauauauauguaauucaugcauauagcuauagcauggugguacaugccuaaaacccuagcacuugggagguacaagcaaaagggucacaaauuugaggccagucuagacuacauaaugaaaaagaguaauuuuacaguccucuuuccaggaugcccaucugccaugccccuacuccagacuacccugaaugguauucauuaacugcugaccccaaacacuuaauguauuuauauuuuaguauugugcaguuuagacaucacaaauucucaguccaaacauaccaaaauaacuacaacacaacaacacgacaacaaagacuaccuacccaguuucacccaauucaacuuauacuucacauguuucauuuuagcaaacuaugaaauuauauccaggagaaaacaguugucucuuaaaaacaccauaccugaauaacagcacugaaccaacauguguugccaacauuuuucagcccaacuggccaaccauccacucuccuccaguuauugggauugugguuuucuccccaaacuucacagcguuuucucuuugagcguuuaguuucugcagaguuagccucaugcgcucuguagcauaccaacaccacauaucaaaagaaaaagaaggaaaaaaaaaaaccaguuaaagaaugauuuacuauacagaccaugcugguauuuugaacagaugauucuaauaucaggauaaccauccacuggacaaucaagugucuacagaauagcucuucaguuguaaguaagugaaaagagagguuuaauuacaaauuuaagcccuuccaccagaaacuauuacuaguaagacccauaguaaaaaugaguugagguuccaggcuauucauuccuaccacauuaaagguuuacacucaaccgggauacccuacugaagagcuuguacuuaucagguacgugggcucauuauugguuuuccuuaguaacugggaacacacuuuguaaacuucuacucaaaaacuacagaccggguuaagagucuccaugucugucccucuucagagugaaccaagagccagagugucggcacauaccugggaucccagcacucucgagggugagggagacaggucacagauuucaggccacucugagacaccccccacccaaaaaaauagaaaaaagaaaaaaaagagggacggggaggagaaagggaacugaauaagcuaagauugcuccuuaaagaaacuaucuuggagcaaugaagaaaccugaguagcuuucccagaauacaauaugacaaagcaaccacgaggaacaaagaucauaaauuaaagcaacaaccuauuaagaucucuguugucagccugaauguuaggagacuccaggagacucaaggcaauggcugccugcaggucaucuuuguugucgugagugaggucuaucacuucugugaggaagagauucguucauuaguucaugucaggaaguaacgaaggcaaagcacuuccaaccacaugcaucccuaacucucaccagcggcuccucggcacacaucuuguaacugucucaaaggcaaaugagcaauauagcugcacugcaauccuaucccgacaguucccaaguaagugaccaaaacaauucuccugggcugggguaugaucagugcacagaacaccugcugcuuaagcauaaagaccugaguucaaguuccaucacccauguaaaaaagacaggcacgguaauugcaugccuauauucucaguccugggggagaacgaagaguucauggacuuaguagccuggcugcuuagccaacuagucagccccagguucggugagcagccccgucucaaaaaaaaaaaaaaaaaaaaaaaaaaaaaaaaaaaaaaagguagagaggcuggagagauaacucagcaauuaacagcaccuaccugguggcucauaaccagucauaacucaagccucuuuuggccucugaggagcacuaggcaguacucaaugcacugacauacacauaugcaaaauacuuauauacauaaaaauaaccagaacuuuaaaaauaaaugagauagacaaagacacgugaaacaaagcucugaccuacauacaugcaauaaauaaaauguuaauaucccacaaaaucaaaaauauauuucauaccuguaggcuaacugccuuuacuuuaccauuguaaaaacauccuagcaucagauagucaaccauacacauaguguucuaugaugaauggagggcuagcuuuauaaaguuggcuuaugaccuaguacagacauacaaaaacuagucaagaagaaaaaaacauuuaaagccaucaugggcugaaguaaggagaaagaaggaaugaaagaaaucauuuaaaaauuugauccccaggcuagaaagauagcucagcaguuaagaguacugacugcucuucugaagguccugaguucaacucccagcaaccacgugguggcucacaaccaccuguaaugagaucugacgcccucuuuuggagugucugaagacaacuacaauguacuuacauauaauauauaaaucuuuuuuuuuuaaauuagguauuuauuucaguuacauuucuaaugcuaucccaaaagucccccacccacucccccaaaauaaaucuuaaaaaaaaaaaaaaaaaaaaaaaaaaaagcuugaccccaggccuggcuuccagcaauggcucagugaccccucagaaaggguugaugugauaaaugagcggccagucgcugucuucugccuguucagaagacaaggacaggagaccuacuugcuaagagaucuuugcugguagcacucucuucuacuucagaugguucugcagcaguugugucgugacugggcuccuuaacucuuuggucugugagaaggcugacagccugggugaugucaccauuacuggccuaaaagaaagaaaagaaaaaaauaacaaacaaauuucaaaaguaaagcacggcagaguuaaccgugugcacuaguuugggugcuguucuuuuacuaccauggugacagagugagucgaccaagcccaaucauaggucugaggcagagagcagacagucuagugaaggcagggagccuggugcaccuggagauggagcaagccaggugauacgaagacucuaaacugcaacaugaaaagcaagucacagccuggcuggacaguucagucaucucaggagucuaacuucacagaauaguuagggcacagcgcgucacuccagggaacuggcagcuaacacgggugauaagugcacucagcccagacagugaagccaugagcagucaccauguuuuacacggugacauagcuguuuugaacuucuuuuuuuuuuuuuuaaagauuuauuuauuauguguaaguacacuguagcugucuucagacauuccagaagagggagucagaucuuacggaugguugugagccaccaugugauugcugggauuugaacucagggccuucggaagagcaguccggugcucuuacccacuaggccaucucaccagccccuugaacuucuuacuaagaaaauagucuaaaaggcacaacaaugccuuuuacccaaucacagaaccauguuuuaucuauacugccuauaccugcuggcuauuuuaaagcuaggugugcuaccauuuccuuggguaacauucagaauguaucuuuucaaaauauaaccaacaauacuuaagaauaucacguguuaagagcaaacaaguuuccuucuggaguuauuuuugguuuguuggucccacucaggauccauauggauacaaugcacauggaugcugggacuccuaaaagcccacuguacauucccaccaucuacuuccaaguuucuauguugaagaaacuaaccaccugaccuguaguugguuccuguucuuaugcuugcaccugguauagaaagagcgucugcugacacaccugacaugugggaaacugcuucagcgucuggcagcuaagcugggucuggaaaccaaccuuuaaugcuucaugaagaaaggaaggauccuggaugccugugauuucucgcagcugauuuaacagcaucuggcagcucuguuuuugagagacaaaaucagauaggugucagaaagcauuccuggguaccuucuggacagagaggcccaaaucuugcacuuuucacuuuauaaagugcugacaagcuccaugcagcaaguugcugauggucagagacacugaaaaugcccggucuaucauuuggucuccggauauacuuugagcaguuacaagagauauauaugacucaacagaaaacuccaaauacccaggacacuuguaaccgucagccuuaacguaugcuuaaggagccuuggccuuuccuuucucggagcagagcaucaggucauauaaggcgcacagggaaucugcaugaaugugaggaugagcuauuuuaagcuuuacugugcaugccauuugugugugugugugucauuuuucacugacaauaagcuucuaaccauguaauuagcaaauggcugguacuacuaaccuuaaaagaaagcuagcacuuucucaacuaucaaauaagacauaaaguuccggaagaacgagcugcaggugcuccauucaucggaaccacagagaggccuaacuacacagcucaucuuaagaacccuucucagccuaagugcucacccuaccauccuggugggcagccagagcugauauaaaacaccucuggacacggaaagcucaacucaaacaaccggcuggccguuuaguagguaaguauggaaaagaaaccgguuaaaucgugagcagcgaucuaauuuauaccauagcuaagguugugugugccaggauuaaguccugacuucacacucuacaggcuucaccauuaaguucaauuaguaaugucucagagagucagcuucauuuacugccagcuguaaccgaaacaguauccuaaggucuucaacagcugagggccccgcuggcaacacuuaaguaccacaacuagaaauaaccgacugaacagcccucccaggccuggaaaagggaucagagccuuucucuugucacaaccucuccagucagaagcuagaaauggaaucuucccacugagacagcagucuuggacauuaugggucuugacaaagccaccaccagagcugggcagggaaggaaggggcuaucaggcugagauucuacuuuggcaaaaacuggaaauauaagcagguuuuauuuuuuuuuucuuuaagguacuaauuuccuuccaaaugaauucuaaucccauuugauuucaccauguaaaagguaugugaaucuaugaaucuggagccuacaaaauuuuuuggaaagccaaaaucaacauaccugaaaaaucgugggagagaggaguaagaaggacuaagaaggaggggaaauaagaaccacaucuucaucuggaauugcucugaaugucacaagucacuccaaugcagagacaauaagagucccagcacgaaauaagugcuaacacacacaaccuacuucuggcucugugcuguucugaaagcuccauaaguauuaacuaacugaugcuggcuuagcucauucaaaccucauagcaaccuacgaccacagaggaguaacuuagaauuacugcuggggugggugggcugacugccagcaucucuaaagagacaaugaaacagaagcaaauacccucuuaauguaaaccagugcaaacauuuuauuuauuuauuauuuauuuauuuauuuauuuauuuauuuggcuguauuuugaccuggaacuuugcacaauacuaaacuucucuuuuaaaaaugugccagucuuuauacuaucagaaguugauuacucagugguacaaugugcucuaaacaagcuaguauuggcaggucggaggguaacaacuguggcauucuaccagucaaggcaagcaucauauaguguuaauuuuuaaaaguguacucuauuguauagguguuuugccuacaugucuauaugcucaugccuggugccuggggaggucagaaaaaggacuggacccccuggaacuggaguuacagugugagcuacuaugagggugcugggaauuggaccuggguccucuggaagagaagccaacgcucuuaagcauggagucauguuuccaguccuucacuguuuguuaggugugaugguucauaccuggcaccccagcacuugagagacagaggcaggauuuuacaaguugggaggccagcaaagccugucucaaaaaaccaaacaagaauuacaaaaguuuuuuuuuuacaacggccaaaguuaucacacacccacaguguccccaguucacgcucugacaccucacagaaguagacuuuaagacuaacccucucuaacuacacuacuccacagaaaauacacucuagugcaaacaagacaaagcccgugcucuguuuugaugaagucaaaagguggcaagcacagacagguuugcauuuccuugacuaauuucauacuguuuucagaggcuuuuaaaggaaacagacccgcccaucuagaggaaggcuggcugcacaccucagcuccaguggcuugagagccaaccagaccucacuaggacagauuucucuuauucuuaacauuuuuucauacaauauauuuugguccuauucuuugcccucccuaauccucacuuuaccaccgcccaucuaacuucagauucuccucccuccuccccuccccucccccccaaaaaacaccaaaccauaacaaaaacaagcacacacugaaaccaacaaacaaauguggaguguggggguuuguguuggugaacugcucaguaauggggccugcccuggagugugacugauacacccacggucacuagagaaaagugaacuuucucucccaggcagguauugcaaaugucuucuugguuagggaugggacuuugugcucaugucuccaaacugggaaagaaacuguagccaguaacagaccaauaccaguugagcaguaaaggcaacucagccuuaagcaggauuccgugaagagugagcgaugucuccacacagcaauguuggaccuaugugcugggagucagagagugugaaugggguggggguggggugucuaaaaaagaacucauggcuuuucugagacggacagacccucuggggaucgagccacuaccucuuuuccuccuuuuauaauucuuugcuaucuagcgguuuucagagagcugggguaucauuuaucaugcagaugggaacauaaugcauuagagguugccuguuggucauucuggcagucuuuuuagggccaacuaguuuggagcagcccacccuggccacugagauccagugugcaaccuuaagagcgagugacuaauagaaguguagcuaggacagcaggcauguuggagcaagccaguaaccugcucucaggaagaucacugaggaauugggacuagccugagcuacacagugagucacagaaugaguucuaggccaaccacauagagacuugucuuaaaaaaugaacacgggaagagcucaugguccucccagaggaccuauggguagauaaugauugcuaggagaggaagacaguucuccaguugugcagucacucagaaauuguucuuaggccuguaaauaaccucucacccacgcuccagaaacuguaauuaaagccacuggguccccaaaaagacaucaaaguaggaagaguaguugucaagagaaagggggaucaucaggacaaggaagauaaaggaucaaauauauacacauauaaaggucacaaugaaacccacuguauacaauuaauacauaauggagaaguuggggcaggcgacaaaacugagcagcuaagagcacuggccgcucuuccagaggaugugagauucaaucccuagcacccaucuggccuccaaagacacuguacacacauggugcacaacuauacaugcaggcaaaagagcuauucacauaaaaauuuuaaauggugcguagguauacauauguguaaauacuacuugaggcugaggcaagagggucaggcacucaagaccagccuuagcuacauucaaagccaaccugggcuguaagaaacugucuuuaaaaaaugauaugaaaauuuuuaggcaguggucauacaugccuuuaaucccagaacucaggcagugacagguggaucucugaguuugaggacagccuagucuacccagugaguuccagggcagugacauacugacauagugacaagacccugucuugggggcaaaaaaugagggaguggggagacagaugggaaaaagggagaaggaguauuucugcuaggucacacacagauaauaaagucaaaaugggaugaaaauacccauugggguaauuaucuaccuuguauaaaaaaagaagaaagggaggguaggagggaggggcuggagcgaugacucagugguuaaaagcuagcucuuccagagguccugaguucaacugccagcaaccauaugguggcucacagccaccuauaaugaaaucuggugcccucuucuggccugcaggaauacaugaagacagagcagugcaugcaugcauacauacauacauacauacauauguaagugaggaaaggaaaggaaaggaaaggaaaggaaaggaaaggaaaggaaaggaaaggaaaggaaaggaaaggaaaaaggaaaggaaaagagccaacaaugucaacuggucaaagcaucugcauuccaagucuggugaccagaauuugguccaagaccuuaacagcuggaaggaagaacuuccuccacaaagcuguccucugaucuccacacagauggggacacauaucaucacacuuguaucacccaccccccaauaaguuaaaauuuaaagcauuuauaguuagggaguuaauaauaauuuggcuuacagccccaaacaaaaagaauuuauuacuuaauaaacauaggggcuggagagaugguuaagagcacugacugcucuuccgaagguccugaguucaauucccagcaaccacaugguggcucacaaucaucuguaaagagaucugacgcccucuucuggugugucugaagacagcuacaguguacuuacauauaauuaaauuaauaaaucuuuaaaaaaaaaaaaaaaauauauauauauacauauauaaauggcucgcuuuccuccccccgccccuacaacccaggagaaaggagucccaaaaguacuagaucacacacacaaaggaacugcuccuucaccccaucgccacagcuagaggcuaccucuguucaucucaccagaacaggugaccaggaguauuucucagacuacauaugauguccuuccuaugccuugcuuuagaagaccuaagagagugcuucuucuuucaguacacacccaacuaaaauauaagaagagaccacaaagccagcagccauguggaacacgccuacaaaaccuaagaaaaacaguacccaacaguauaguaugugggcaagauaacaggaagcugggccaucggguucaugugcccaguuuuagaaauucaggcacaguaaaaugucauugucaggcgugucuugcuccggcaccggguuccuggggucaggaugaauucagauagaaugugagaaggccagcggcucugccacagacaaaugggggcacuguguguacagaagugucuuuauuuguggagguaggacaagcugugcaagcugguucucuucuuccucugugugggucccagggaugacacucaggucagguuguuagguauggcagcaagcaccugguaucugcuaugccauccuccuggcucagaaaguguauuuacaauuuuuaauauuuugauuauuuacuauuuuugcguguguugguguguuagcugcauguaugucuaugcaccauaugcaugcaguaucuacagagggcagaagaaggcauaagaucugggagaacuggaguuguaaacugucuugugagugcugggaauugagcagugaaugcuguuaaccaaagcaucucuccagcccuugggaaagguuaucuauuuauuuguuuuuagcgcauguuaacaacuauuucaaaauggggugagggaaagacauuucagcugagugacagggcuuuugggcaaagcaguggugaggagaggagggggcagggugcuggcggaaagcagggagguagagcacaccuuggcaccucagacaacaggaauaaagcuucagucacguauucucagagggauguggaagugugugcaacugacuccacaaagcuguccucccuacacacacgcgcgcacacacacacccuguacgugcacacuacacacacacacaaacaguaacaggaaaaacuaaagggagagcaugaccaaggaaagacacucaacauauccaccuuuucuuuuagggugaucaaaacuuagagaccuaaaaaaccaaacaagcaaagacaguccugcucuggggcacaggguggcuggagcuccugccagaaugcugagcugaugagugcacaccaccauugcccaggagacucaaauuuacaucguaucugagagucaagcagcaugcugcuggaaccacuccagaagaccuuuaggcuggcuugacuggaaagccaguucacgcugagggggacucacaucucaccuaucacaaccuucccaagcaucacguuuuugugccuggaaaaugagauucauagcauccacaggaugucaaagaaucaucucaguguccaaguaaagucugcuccuguuuguagaaaaccacugccacccuagagaaaagacgguccagucucagcaccaccauuuccuaguugugccacucggaagacucuacauucuagauuuacaaaaucugccuugagagguaugaagcagguucaagcgccuuccagucaagugggcaucaggaaguuugggucuaggaaggcucaugauacaaugggagaagugcuuugacaucagagcuaggcaacucucagaacucaagccaggcuggaucaguccaccccaauguguguauguaaaggaaucugcuuaagauuucacagguucaggcuggagaaacggcuuaagguggggagcauauguugcuccugcagaggacccaaauucuauucccagcacccgcaucagauaggucacaacugccugggacuccagcuucagggagccaaccucucucaccuguuugggcacauauacagacauacauacauauaaauaauaaaaaaauuaaaaaauuauuuuaaaacauuuuaaauguuuuuccacaggcugcugagauggcuccccagguaaaaaagagcuugcugccaagccggaugaccuaaguuccauccuuagaacguauauggcagaagaaacauaacuccuuacaaguuguccucugacacccccccgccccccacagcacacgugcccucugacucucuaauaaauuguguguguaaaauaagucuuuuuggcaagccucgacaccaggcaccagcagaugcugacuggguaaaaccaugucggcucucuguaagccacuggccaaucagcucaggacuugcuggagcccagagcacauggccauggccaccuuacgaugagagcuuugcagaaacuucacuuaacaccuccaucccugcagagaucuagaaacccacuugccucauccccucagcugaggugauccuggucagggcugugguuucaaggucucuauauuagcuucuucucuucucuucucuucucuucucuucucuucucuucucuucucuucucuucucuucucuucuuuuuaaagacaaggucucacuguguaguccuggcuauccugaaacuuggagcuccaccuaccucugccucccgcauacuuggauuguggucaugcaccaucaacacccagcucuucuuuuuuccaacucuuuuuuuuggggggguggggguggggaggggguucgagacaagguuucucuguauagcccuggcuguccuggaacucacuuuguagaccaggcuggccuggaacucagaaaucugccugccucugccugggauuaaaggcgugcacccacgccuggcuuuuuccaacucuuaaacacacaguuaugaggggggcaggggucucuuccuuuuuugaaacagggccucacuuuuucaccaauaccaaacuuauagcaacucucaugccuccacaaagcuguuuuagaaaagguuacucagugucaaaggcacucuggcaaaaauggucaacaaguuuaaaacucugagacuuucccuuaaggaacguggcaagcaucaugguggcacaguauuuucucagugugaccaggggaagaggccugaugacaggaagugagcagacugagccuauuuucuagaaaaaaacaaagguguaagacgcaugguguggcuuggaagcugagccuaucuaucuguagagcuaagagcucuuuuaagagcugcaagccuugagcugagagaggaggggaggccaggucuucuaguucgaacccaccugguuuuguuaugaagaugauagaagacaauaaaauccggagguucuauucacuuagaaaaggaagaaaagagguggaucuggaaaccaagagaacuacaucugggggcggggacagcagaaaaugcuguugacaagguuuuggaggguuuguuguucucgggauuaagggcuccuauucacagcagaaagggaauucuauccuuaagcuucuaaaaggcuaauaugcaaaugagucccccagggauggaagcaaaaggcagaauuggggcuaaggauguggcucaguagguagacuggguggccuugaagccuuggguuuaaucucuaccugcaauccaagcauucuggaggagacaggagguuugcugugugcuugaaggccaccugaccuguauaauauguuccaggcagaccugagcgaagagugaacugaagcccuuuuaaaaaaaauguauuuauguacacugguguuuugccugaguguaugucugugugaggguauuggaucaccuugaacugcaguuaggcaggugugagcugccaugugggugcugagaauugaaccuggguccucuggaagagcaaccagugcucuuaagucuuugaaccuucucuccagcccccaagcagacuuugauuuaguaggucuaaggugggggcccaagugccccuucccuugaaacacccuugaucccacguuaucagcacuccauccuaguguucaacauagaccacugagcaggggcugggcaccgggacuggccauagccagcucacacaccaacuuccuaugucuaaauuccuggugagcagaaguggcugaucacccuuggcaucgggaagacugagaauuugugggguuaggcuaaaggagcacaaauagcuucgaugaggguuucuuuacuuguacccacacugugcacauaacagaccagacauuauuacucuugggagguuaaacuauaccaggugagaugccagcagcacucuuccccacagucauaauggaaaaccuccccaggggccgcagagauggcucagugguucaggggacuugcuacucuugcagaacacccacaaggcagcuaaaaacuaucuacaacuccaaugccagaggauguaaugcccuuucccugcuucugugggcauuccaugcacauggagcacagacauccauacaggcaaacccccauacauaaggucaaaauaaacuaauuaaaaagaagagucccaggacauuguauaauaucuucuggagugcaaauucucccugcugagagagguuggccucucagaaacaagcaggauuaaacaagguauaguuuuuccauggaaauaagacgagaugcuagggaaccagguggacaaaaccucaaauagcucuugaacaagggcaagcucugacaauuaggaagacuguaaacacugagaccaagcagucaccugcugcagagccugagcaccggaggucagcuccggggacucacacuguggagagaaccagcuccgacaagaugucuucugacuuccacgugggugcccauguuccucccugcccuccccucacaaaacuaauguaaaaaacuguauuaaucuuuucaaaguuuaaaccacuagaagaguucuaggaaagacuuuaagcaaaugugacccaagugugguggugcacaucugcaacccaagugcuugggaggcagaggcaagaagaucagucccaugucaccuucagcauccucaaccacaggguucaaggccagccugagcuaucugagagcucaucuuaaacuaacaaacaaaacaagaacaaaaaacgaaagaguaagagagcggaggaggagaggaggaagguagcuaagcagggcucugugcuggggcaccuguaguaauaccucugggagguaagguaggaagguucaaaaacugcaguaagacccugucucaaaacaaaccaaaccccacaaaacaacagccacaggaggggacagagcucagaggugaggggcuucccuagcccgcuaggguuugguccccagcacgacacaaauacacaaaauaaacauacucacuuugacucaagcaugggggcacacuccugggcagcacuugggaggcagguacaagcagaucucugugaguucaaggcuuuucuggcuuacauaguaaguuccaggccagucagggcuacuuuaugagaauaccucaaacaaaagccucagggcuggugagauggcucaguggguaagagcacccgacugcucuuccgaagguccagaguucaaaucccagcaaccacaugguggcucacaccauccgaaacgagaucugacucccucuucuggagugucugaagacagcuacaauguacuuacauauaauaaauaaauacaucuuuaaaaaaaaacaaaacaaaacaaaagccucaguuugaaguaaaucugcccugacagaaagcguccuguugcuggaaaguaaagacacacaagaaaaucccagcacucaagaaacugagugaggcaggagaacuguuccaagcucaaggcuggccuggucuguacagaaagacccuaucugagaaagaggcggaugcacugcuguucuacagagcuaguucuaggaagcucaaggcuacacacacacacacacacacacacacacacacacacacacacauacacacacacacacacacacaaacccugccucaaaaagaaaagcaaacaaaacaaaaggcuggguaugguggcacauaccuuuaaacccagugggagaagacagggaucucagagaauaugaugccagccuagucuauuacaagguucaagggcagcaagagguauacagugagaccccaggccucucucaaaaaagaaaagggcugggaggacaggcaugguggcacaguuaagagagcaguaauucagaagagucugcugcagagucugagcaccugacaaguucacacagccugagcuacauaaaaaccugucaucuccacaaaauggaagugagggccggagagagaggcggcuuggcaguuaagagcacuugcagaugaggagcuggguuuagaucguaacaccuacaacaccaagagcucacagguguaggugagcuauacccagguucuagaucuaaugaccucuccaggaacagcgcgcacgcacacaggcacugugcccauaaacacaugaaggcacacacacaaauaaaaguaaacaaauaaauuuaaaggggagugugagauggcuuaucacuauaaaagcacuugccccacaagcauaaggaccugaguucgauucccaagaacccacauaaaagccggacacacaacagcaaugucauccaagcacuccugcuacagaggggugggaggcagagaaucccuagaagggccagggccagcuagccugccacaugcaggggacagugucucuaacaagguggaaagugaugucuaacaagccaaggcugugccuaacacuaaagggcugagaggaggaaccuggguaggaggaccaaguuuguaaucccagcacucaggagcgcagccuggguuacagggagaccaugugucucuguguguguguguguauguguguguguguguguguguguguuaguuauuacuuguaguguuggcauuauuuuaaaugucuuugauuauaauaagguacuguagcccaagccuauauacagcaguuagaaaacagacacaggagccucaagggucaaggucauccuccccuacaaaguugaaggucagucugggcuacaagaaaaccugucucaaaaacaccuacacaaaaagucauuuugaugaaacagaaugcaccgggccaccugauaagagauuaucuguuuacgagcucaaaauacagcacucucugugugcacaauaacuguggcucaaagagcaggagaguuggggagccagauuacaacuuucuaacacucaaaaaaaaaaaaaaaaaaaaauucacaaccugacaggaguuaaguacaccugggagacuaaggcaggaugacuaacucccaaguuccaggccagccuuggucucaaaaaccaaaccaaaccaaaaaccacaaagauaccucgaaggaaaaucagaaccaaccgaaacagccagcacaacaaagcucagugaggaagcagcacuugccuagaaugcagaggcccuggguuccaagugggagagcgggggaggggauuguguguccugaauccucccccaacgagucaagggcaucagguuccuaagaagcaaacugacuucaagcuguuucuccuacuccaacagaaaacuucccagcagguuuuuaccuaaggugagaacugauuaaaacacaggaagguguccuuaacucaccagucugggggauucaaagauaaccaagugucggcucggguuccagagcccucacugaaauccuggagagccuauacauaguuuugucuguccuuuguacaaaugaccaacuggggaagggaaaacguggcaaguuuuaaauagcuccugagugucgggggaggauagcuccucucaacuauauuaaacaucuuuuaagggaaaggagaaagccuugugaagucaaaagaaagaauccguccuacacggagcuuaucaagaggaagaaguuauuaauacucucaugaaaugucaaaguuaugcagcacccacaccuucaagguaacccaugccucaagcauuuuauccugaccugagaaaaaagggcaacgggcuaucaagccuucaaagcuuaucaucugucagccuggggcaaaaucucugggaauacuaaccaguaaaugucaucacuccgcaggucgcccgcccagaaucaggcuacugcagcuagccacagccugggagugccaaaccuucccaaaauagcucugacuuuauacacaaugcucaaacaccuuacaugcaaacccucaaauagagagugcucaacuaccggucacuccucagcagccugugacagagguaaaugaaaauaccacugaucgaaaggcauguggucuuaaaugacgggcccagaacaaauuuaaauaugacuugcucucccucaaaauaguaucaauaugacugucucaaaaccaaaucucaccaccuguuuauaagucacuguccccaacacaaguagacuuguggggaggaaaacagagaaaaauacagacccaauguccaaaagacacuguugaguaauaaacaauuuuuaucugaucgccaaaaaaaaaaaaaaaaaaaaauccaccuacuuucauuuuacaggccaagacuuagagauaucuuuuucuacaugaauuuuaaagagccugcuauguuuuaaacuuguagucuggggguguagugcuugauuaucucaugcgauaggcccuaggcuugauccucagcaccucaaauuauuaaaauuuaacuauagaagacauuaauuauagaauuuaauuauagaguuuuucuuagcaguaucucaaauuuuuauucuaaauauuuuauaaauuuucucgacugcaaacucgguauuugaauccuugguauagguuuuccauuuugucauuuaaaaagugcaguucuugagggacgaggauguuguguuacguuauaacauuccaaaguaaaacuggaugacagucucaaauugcccacuucccaaguuucuuuaaaagacauuaugagccuuuugauuuuuuuuccaaaucaguguuacuaaaggcccaccaucuaagcccuaagagccuuguaauauuuuucaaccuuuuuauauuacuaggaacauaguaaagugccuucuauucauugugcuuuucucuccccuccuucaaaaccuacagugaucaaugagauaauucgggaagcugauuuguuuccgagggaaaaaaagaacugaaugaaaagcggggcgggaaaagggaggaguggggcuccgggucuuuuuugcacuuuguugauaaacgccggcuuuaagugagauaacuuaagucugcguuagccucagagaagccacugccauaaaacugauuugagagucagaacaaggcaccguggccgugcuuuugggaaguuuuuagcugcugggucgggcccggugcacacuucggggugaccucgcugccuacgaucucacgugcaaccccucccguuagggucccuagcaccgggucccacaaucccgcucggaaccuuagcuggcuuauacacccaggcaaccucacacaggcucgcggacccagccucgcaaagucccgggaagaccggguugcucucgcccuagcccgcaggccccggccucugucggcccucgcccgcuuggcccgccgcgccccucucagccggaacccgggccccgcuacccucacccgccgcucaccgagccauggccguccgccgcccccgccgagucguccugcugcagcuccgcagucauggccguggugucccuccgcguguagccccacucucguugucgucuucgccgcggucgccaccgccaccaccaccgcccccgaagcccgggagcaccgggaggcaccg

SEQ ID NO: 5084 - RNA, 4135 nt, Mus musculus
cgcaggcgucaucugcucccuacagguuuucaaacgccagucuguucccgccgguuuuuuucuucuuguauuuuggguaggguuggguugguuucgcuagaaacugcggaauguuucagguaauaauccuuuauggcccucccuauacucaguaaucucagguuuuccugugagauuaucuagcucgauacuuacagaaucaucucgaucuuuuuuguuauucauucauugggcucagcagcuaagucuacccgaauuuugcccucuggaauugugcgagagagugacauaagugaaaggauccccacaauugcaccuuucuaauaguguuuguuaauagugccucauauuaaguauauugauacauggauaugguacaaauuuauacuuaguguaacgguccuguaagugcuacagacauucuuuuauaaaaccuucuuucuaagauacguaugaauguuuuggcuguguccauggaagucagaagcaggcaaguaaguccagucccugaaacuggacuuacagaugacaugagccaccauguggaugcugggaauugaguccugguccugaguaagggcaacgagugcuucuagccaccgggcaauccccuagaacaagauucuuaucacuuccuaucagagauuacaaauaaauuucaccaaaggcuuuuuaucguuguuuaauuuuaaaguuuucagugauuuuuuuggcucuguuuugagacgugguuucuguagcccuggaaggcaucaaauucauagcuaucuuccugccucagccuccuguauacaggaauuauacacuuauuccacuauguccagcuagccauagcuuuuuagaacuauuucauuguugaaggucaaaagaguguuccgcgaagaugagaucacucguucacuuugcaaaacaggcugaccugaaagacagccacugggcauuauuaccaacgugacacucuuuguaggagagggaugcgugcuguaagagcauccuuguccccuuuauacacuuuuuguuacuugaccagcagagcaagcaaguguuuuacauagccaaauggaaugccauuagugcagcaauaccauaaaguauaaaauuaacagagacaagggugcagauacagguaauucaaucaguagggauuuagaacagauguuaucugucuccagcauccuuccuggagcaggcaauaaaaccaauaaacaagauguuuauuauacaaaugucaucuuuucucuugcuaauuuacccuuuguccuuuuuuaucguugauggcagggaaaauucuugcacugagagcuugaccuuuaacauucuucaacugagagaucacuuaguaguuaagagaacuagccuuguggaggacccggguuccaguccuaugugaggcagcucaaaaacaccuguaauuucaauucgagggaauccaaugucuucauucgaccucugaggguuccuguacauauaugaugcacauauauacacugagacacauacauauaaaagaauuacuaaaaauaauaaaaucgucucauuauugguauguauugcauacuuggagauauucacacaguauaguaugauccuuuuuuucuaagaaaauaaaauagaggugcaggccauacauggucacacacaacuuuggauucaagcuuucagcacugaggaggcaaagacaggcgaauaucugaguuugaggugaaccuggucuacuagugagugccaagccugcagggcuacaaagaccuugucucaaaaacuaaaguguguguuuaggguauguguggugugugaugugugugugugugugugugugugugugugugugugugugugugugguguccucuggguggacuuuaauggcuuaugcuguuucuucgcauccuuuucucugcuuucuguuguucugcaauaaacauguacugcuuugaugaaagcaucuuucauucuuuaaaaggagucuuaugagagaggaccuuagguagaucccgacucccaagguccauugcaacauugggucccuaaaccaaucaagcucauccuaauagagcauaggacagguaguuccuguuccaugggggaagagaaagaaucuuggguugagaaagcuugugcucuaagguggccaggcuguccuuggaaagcaguuuugcguggaguccucucagccuuacuuuaaauacuugaaauguugcaaacaauaaaugcccaaugacaaaaaaaaaauaauaauccacagaugacauuucugaaaaccugcacugugccuucacugaggaauacuauguggcgaguucuguacuaggucuggagccccggucacgugacuuaaugaucacaaaaaacaacacaguagcuauuuucaaaauaagcaagggagggaaaagacagaguggggaagauucauuaggggaaauuacaaaauuacaaauaauuuugugauuuugcuuuuggagggagcucauacaaauaacaagccccaaugcuuaauuauuucuuaggaaaaugcaaagacccgggaaauccugggcgggagagaugacuccgcaguuaaggcacugacugcucuuccagagaaccuacauucaauucccagcacucacauugcagcuuacaacugugugcaacuccagccccaggggaucggauauucccuucuuguucuguggacacucuacucauacacauaaauaaauaggcaggcuugguggcaggcagaggccugaucucuaugguuuguggccagccuggauuauaugaagaguuccaagccagccaaggacuauauaaugagauuaugcuaaccuccagccaaaaaaaaaaaaaaaaagaauaguuuugauuugcauuucccugauaacuaagaacauuaaauuuuuauuuuuaucuuuuuauuuguuuguuuuguuuuucaagacaguuccucuuuguaagucuggcuguuuuggaacucacucuguagacuaggauagccaugaacucagagaaauccaccuggcucugccucccgacuacugggauuaaaggugugcgccaccaccaagauaaacauuucuguaaguguuucucggccauuucuguuucaccuuuugagaacucucugcuuaguucugauucccauuuuuaacuuuacuuucuuuuuuuuuuuaaaaagauuuauuuauuauuauauguaaguacacugucacuaucuccagacacaccagaagagggcgucaggucucauuacagaugguuguaagccaccaugugguugcugggauuugaacucaggaccuucagaagagcucuuaacugcugagccaucucuccagcccuaacuuugcuuucuugaugccaaguuuuucugguucuuuauauauuuuauacaccuaacccucuaucagauguaccugauauaaugguguccuuuauaaauaaguaaauuaauuaaauaaguaagaugaugaauaauauaagacaacacgggacaucgacuucuggccucuacacacauacgcaugcacauguaugcacaugcuacgcacacauacccaaaagcaugaaaagagaacacacuggccagaccuuuaugacuuuggugcaauaaaucccagguuucuuguguucugccauagagacaagcucuuagccaacaugcugggucaaugcuguggcuggggacaagaaccugaaguggucaaguccaagucacuuaacuugagguuacuucuguccccuaccagccaggacaccuugcuaauuucccuaaaguguuucacacagugucagaauaaaaauucagugccaagcaccgaacucaaagccuggcauuuagccaugaucagaaagugcaaaucacuuccucucccaucagauccuguggcuuagaagcagcaacagacagaauggaagcugguaugauugacagcuacuugcagcugacuuuggaucagcagaggaccagcagagggagcacuucucuccagcgauguucugagucuaccaggcgguaggaaaauucgcuuggacugaggaauaguagucuucaaaugaaugggcuuucugaucacaaaauaucaaacgacaaacuuaucuaauguguaaagaaaugaguaagaaaauuaaaacaccaacacaaaccuaacauu

SEQ ID NO: 5085 - RNA, 297309 nt, Mus musculus
agaagaaggagaagaaggagaagaaggagaagaaggagaagaagaagaagcagaagcagccauaugcuuuuuauugcaaggacuuuaguaacuaaacuggagggggggguguccacaacuuugaaaaucgaaccgaaucuaaaauucuuuuucccccuaauuauuaaaaacguucaaauuccugauuaaggaacgccggagggcagaaugaucuccaaagacgugaaugaaggaaaagggugaaaagaaaucccagcucugccuggaagguucccugugaaagagcccggcucccuugguaacuccaggccgcguuuuacaggcagccgcaucugccuccccugucucuuaccuccuggauguuaggaacuauuuguggucggcgugguggaaggacacagugaggcucucaccuccgccccccgcccgucgcucgcauccccaguuccaucaaagccaacccgggccagcgcagggaucuccgaguugcgagugugcugaggcugggacugucacucauucuccgcucagcgcgugaacgcagcucggcaguggcuggcaagaaacaauucugcaaaaauaaucauacccagccuggcaauugucugcuccucgguccauugcuccgccgccguccacagucgcuugcaaggggaaggcacugaauuuaccgcggccagaacaucccucccagccggcaguuuacaaugcugcgaacuaaggaucucaucuggacuuuguuuuuccugggaacugcagguacauuuuaauuuaauuuaauuaaaaaaaaucuacaucgggucuguuaauuguccgcuugccccugucuucucucccuauccccgagaagcccgguucuuuuggcugguuuuguguguaaagcaaagacagcauuuucacugagcugagaagggagcgcaucguaucguccuugcuuggccagccaaacccgugcccuccgggacggcgcuggacgcggcugccuccccgcucaguggcggccgcgcacgcccuucccacuugugugcccgcggaggugggacagggguauggggaccgggaugcugccgugaugggcagcgcugcuuuccccuuccccgaaggcggguggcggaugcguggcucggguggugucgccccccaggcucaucuuucaccuagagguguuugucaagcuucgagaagagugaacaauaaggcuggggcaguuuuacccccaccguuaugucccgggcugggguaaagugaggcuugcagccuucgcuuacucccccgucuuccccgccccgaauaacgguuugcaaaauggggcaaccaccggcagcaccgcagggcccuguggucguuccugcacccccgugcaaaugacguuaguuuuucauuugccaaauugcuggguaguugcaaaaccugcccucggccgggagcacggagggaugggaggguccagcgccgcguuuugacaggaggaagugcagaggggcggagggugaggagggcgugaucggggcugccugguugugugugugugcgcgcgcgugugcgcgcgugugccuuuacacgcaccgagagccuaggguugcacggugccagcgaagaauggcagguagccagcugcccaagacaccucuuccuuucucugggcgauauuccugauccuggcaaagugugaacaauggggagcucgggagaaagaccguagcgacgcugucgcggguggcgagggcugugccaccgcccagagauccuuagcauucgggaagggggcgcauugcauuuuggcuauuuccaucucggcuuucccuggaaaauuccucagugugcccacccucccuuccagcugcugccccuaccccacccaaggauuugugcuuuggcgucccaauggacugggagagggggaagcaaagggcacuggggccgccgagagcugggugggaugggccgacagcuggggcggggggggggcgugugcugccaagcaccagcugaaagcaggcuaggcggaggagaccgcgcauggcuguggcuucugccugguguggcuguacugguccagaucucuaagccuuggguguggagcccacagagcggccccgggagcacccagugcgccccccuccgagggcagcaagagagcagagcugggccaccgccuccagccaacucugaucggcgaccaaucagagcgaggcuggcugggcgggaagccgcgagaggcuuuuauugcggcgcggguggcgcccaagcugccaggaugguccccggguguucuagcuuaacggucucgcucgccucccguugggagagaccccgcccuguuacugccccuagcugcacggccguuuucgaggacguaaaauggagaaggauaggcccugggacaucucuugguccagcuagcuuauucucgcccacucgugcuucuuucuuggcgcuuuggagcauucaggcucccuguccauggcgcacaguugcgacggagcgcuucgcuugcgagugcagaagacagcagcucccaagcugugucccggagagcagacgcgccugcgcugacccucuggccaaggacuagacgcugggguggaggggcguggcggggugugguagggcgugucuugacagggcgugccaaauggguccucgccaccaccaagcccuggacuggcagaggcgugcccuucccuguggugcugugggugaccuccucuuaggguguguuuacugagaccauccuucuggauagcagcaugacaauggagaccuaaucuuccaugaugcgucuuuuuaggaucuccuuguggucuucuccauaauggagauggguguaacccucaguguuccuauccuggugggagcugagggagggaauccuacaguggcgugauacuggaugcucaggcaagacuggcauccuaaccaguguucccuggaacgaaagaauccuuauucugccccuaaacccaggcggcgaggacgaagagaaagaagcacauaccagccuguuuaacaaaagaaagugguuuuacaaagagaauuuucaauuaaaguauuguuuuaaccagcuuaaaaaaaaaucuagagaauucagaccaaaggguuuggaaggauauaaaagaaggauauauaugaauaucccccgucauuaagcugcaaaugcuguagaguauccacagacaaugguauauauaauucaaacucuguuauuggugagcaugagaauuuaacauauaagaaacgcuauccauagcacucguuaauaaauauccuggugcauagcaaaugaaucagauguuguaggugucuucugcccuuuagaaauaaaaaggcagcuugcauaauugcauaguaaaucugagauuguggaagcagcauuuguugcaugcuggcuggcugacugaauucugugcuugaacgaucuggaaccacgugcuuaguugacaauuuuaguccuuugcuagucgaaccugaaaaaguuaaggauuaggcagcacuguuuuucuaacaagauaacaccagacuuagaacaaagagcaaauuuaguacaaaaggaaacauacauaaaauauaccucauaucccuugcuaagcaguugaagaugcuguucaaaaagguguauugggagaguaauuacacagaccucuauucuuuugacauugguuuucauuuacaagaggaaguguaaaauuuggacaaaauuuaaaugacuguaacaaagccauacuuauacagaaaaccuuucgccacucacagccuuuuucaaaaacaugcugcuguccauaaaguuuagcuaaaaaaacauugagauuaacuuagaauucguuuaaauuguaacaagacuaaagucaaauggagauuauaaucuagaauuguggaacuauggcccucuuuuuauuuaaguugcuguuuggcuauuuggggacaguaucccuuaguggcuuagaacucaauaucuagaccagguuggccuugaaccauuuuagaauccucuugcuucagcuacagugcugauaguacauccaugagcuacuaaaccacuuauuuacguuuuugcuauuuccacuacaaaagcccugaaaaucucucugcccugcuaaguuuucacuuauccuacacugacagcaaccccaccuuccugcuuccaccaagagauuaaacuuggugcccucucucuagguaccuucuccucagauaccuuuuguuuuagcaguaucaggagacaagcagaagguugugucucagagcuuggcuuaauaaagcagcuuuuuccagaucuaccccuggcaauugauuaaacuaaggauguguuccuugaaugggucaguaguucucuaagcuugaucaaaauuaaaguagauaggcucuuaaccagcaaauggccuaguagguacagcacuugucaucaaugcauucccagaacucacgugauagaagagaggacugacuccugcaaguuguucucugaccuucacacauaugauaaaaauacauacauacaaaaaaaucaaagcaaauaucaagaauacccccccaauacaaauccccaacaauacaaggaaaauuaagguguuggcauguuauuaauagacaguauaguuauagacuccagugagggagaaauuagcuacagggagcccuagccucuaagagcuuuugaagugauucccuuuggaguauacuuaucauuaauugaauucuucugauagguaaucuauaacucaauguaaauaaucucuaaauuuuccugucacugggaacaaugucuuaauugccuuucaaaauaaauggcaccauuuugucagacagacucuaaucuuuacugugacagauguuuuucuucaugccagaacucaguuucuuaacuuauaggcagcauuuguaaaccuuacauugcuugagauauggacuuugggauuucuggugcaaucacuucuucuucuucuucuucuucuuuuuuuuuuuuuuuuuuuuuuuuuagaugaugaaagcuguauuuguaguagcucgaugaauucccccaccccuauuuacgucaucaguauuaaagcacuguggcuuuucuccagauuugcaaguuacuucggugcugcuggcagaccuccagauauguuacagucuuucucaacuuugugagaaauaaguggcugaguaccuguugcugaaggacauuugaacugucugugacagucuuuagucugugaugauagagaccagaacgaauugucaaggagagaaagcagggguugcaccuggucccaucuaucuacugaaacagucuagcuugggaggagacaaaggcuggugcuccuguccuacuaaugcugucgaauggauaaacaaugcuuuguggugucaagauaaauauuuaaaugcaaacuccaugauggagcuuggugaucuaacagaucuauagaguaaggaguguccggaauuuuaaaagaaauggcaggcaguaaauuacaagcagcauuuuucuaauacuaaaaacuccauuauggauuaaucagaacuggaaacaugaaucaucaauaaugcucauuucagcugugagucaaaagaccaaggcucagauaucuuuugcuacaaaggaagaauucugaguaaaauccaguagggaacugugugugcuuuuuaaaauacuccccaagucucagcaauauuguaaaagguagccucaaaggaagggcagaauuucacaaggaccuuucugaauccuaaugauuugcuuuuaugaggccuggagauuuuaguauuagaaaagauuuuagcaagaauguuuuugauaacacgaauagauaugcuugcucuccugcaggacacuggaauacagaagucagucugaacgccauggucuugucaccucgagcccuuuguguuauuaacuccugaagcugauguacagggauguaaaugaccuggcacuggcagcaccaccauugugcccuuugguuucaugcuguugaaauacugucuuucagcugcagaugcucaguaggaacagugccuucugauguuggucugggugccaaguggaggccuuucaagcaguuucaauacauuguacuuaaaaugcucuuagggcaugucuacuggcagccacugaguuaacugguuuuuaguuggguugacacacuucucccucccuguagacauaauuuaguuucuaagcaaucagggaucuaaaagagacugcaguugaaagaccuauauggggcauauauagggaaucaaagauuuuaauggaccuguuaugcauucuuuccaucuugauauuuguaaugcuuucuugguugcagagaucauguggcuggugugacuucagagccuccugucuaaccugcaccccacugcacacucacuuuugauggggagcugaaaacacugcaaugucugagcuccccccuuuucuagcuuguauaauuccugggcuaacacagacaaagccuugcuuugcccccucuccauuggcuucugauuaccucaucauuucacagcauuccugguaauuucacacucuuugagauccuguuacauauucucuuaaacagaggaucggauauguuuaccaagugccaaacuuuaaccaucaucccuguggugagccacacuggcguucgaugaggucauuugugcugucagagaagccugcuaugaguacucaggcuuggagaugaggagaugagagcuugguaccuaagcucggcagcagcuucagccauaucucucccuaacugucugaccuuggaguccugacuauuuuggagaccacaggaauucaauggaugugaccuuugagucuuuacaugaggaaauggauguaucuggagcuuuuucuagcuuacuuagacauggugcugucuuuuugggggauguuaacaagagcaucaggagacauuggcguuguuagugucagaacuagauggagacaugguugcuaagugucccaacauugcuauguugggaggcuuuaagaggaaaaagugacuugaugguaagauggagagccaucaguacaaggacggauaugguucuguuggccaugcagguuauaaaauucuggcccucagaaggaaaauccacaaucucauugcuuuugcaaggauuuagaagacacaugaccaugagaagacaucaccagguucccaucucucagugucuaggaaggcaggugcuucaggacucuggaaaacucuggucuugcuuuagcaacuguguuaggucuguuugauuuuuuuuuuucuguuucaauucaguugcuuuggaauauaggugagugguuccagcuugcuguacguggacucgacauggacaaguuccguugcuuucaagcuuagaaccauguaucaagaucaagguuauuucucuaaaaaagcugcuugaccuuuauuuucccaaggaucugcagugagaucuaagguauucuaugauuucucacugcagguauucuuguaaauuaccaacucgaauaaaauagaguaauugguauucuuauucaagugaaucagacuuaaauacccuacuggcugggcaggaaguagcucugccaacuaaaggugacuuggguaggaggcugcagaauuuguuuuagguagcuaaaagcagauaccauggcauagacuaccaauuauuauaucuuaaucaucaguuugugguucauaggcccauuauaucauuuugucuucucaucguuuauuugguaaauauuuacuaggggcuuguuuggugccuuuauuggaagcacaguggucagauaacauaucauaucaaugcuguuuguguacaggaccuaggcuaauagugcaagaggaauguagcuguuacacaagaaaaccacaugcacacauuugaaaaaaaaaacugaggaaggagacaggacacugucggaguuugugaagagaaaaucuacuuauuggaugguuagagaaaugaagauagcauuuaaacaacucucaaacaagagagauggauggcguucauucucauuuuaagacaugaccuacgaccugcuccauuggacaaacagaguaaaacaacaggcagagucaaaucccuguaucuaauaaaaauucccaccaucuugagaucaaacagcuuuggagauugugccuaguuuugguuuauagcgucaagagggacaugccucuguuuccagagcuuucccucauucacacagagauauaaucccauggcucuuuuugggaccacaauaaaggaagcaauuaauucuguguggggucucccuugagcuuugcugaagagacgaguuugccuucaugaagaagaggugauucaaagagagcaaaucacuggagcaaaauauauacagcuggguuuggggaauagaggcaggauuugaccagagaguagaagaaagaaacggaaaccuaagguauuugucuauugaggcggggcugggccaugguuucuauaaguugacugcauuuacuccuuuucucaaugauaacuugaaaacagguagccuugggaaauaugguaacagacuugccugcgguggcucugcauagacugugccucaccaaagugaggagucacagggaagggaccuuguggggaacucugggguuuguacaucugcuagacacacugacauucuguagguuguugcuuuucugagcccgugcccuuaucugcaacgcugaaccccugaugcccacaccaccuacuggguuuuaguaagcuuaaauaaacaguuaauaaucaauaggcacuuuuggaacaguuuaguucaucuucagccaagagauuuuaucuaacauguuuguuuaaagaaaauuuacugugacagcuuugggcauggcucugaguaagaggaagaaggagaaaauaaagcaaaauugagacuacuuuuggcucugccgaagcuuccaggugguuacaaugcaaguacuaauuuaguccccauaguuaugaaagaugcuauguggcaagucccuaagugaaggagccaggccacagccccuuagauaggcagaccucuccuugauuccuuuuaauaucuaaaaaaagauggagaagacugagaaugugauccaggcuucuagggccauggaccaguagggcaaagaagauguguuuccucauagaagaagaugggacuggagagagaauuguaaugaagacugauuuaaggugugugugugugugugugugugugugugugugugugugugugugugugagagagagagagagagagagagagagagagagagagagagagacauuaaagccuuaaaugcuagacuaaggaaauauguauuaccugagauauaagagucaaaacaaaacaaaaaaaacaaaacaaaaaaaaauauguucuagaggauggucagguauaggaaaggaaggaugugcugugcuguacuaugugugagguugaccagaaagucuaagaaaauguuuggcucuaucuauuaggaagacucaaguauggagaagggaaacuuuuagguuuagagucaaaagauuauggcuuaaaacuugacauugcucugacuaagugaauuuauggacauuacuuaucuccuuugaacacuaaugucuucauuugaggggaccaaaauaagaacauaugugugaaacccauuauacaugaaaguacucagcugggcaugguggugcacgccuuuaaucccagcacuugggaggcagaggcagacggguuucugaguucaaggacagcuuggucuacagagugaguuccaggacagccagggcuacacagagaaacccuguuuugaaaaacagagagagagagagagagagagagagagagagagagagagagagagagagagagaagagcgagagagagaggaagagagagagagagaguacucuacaacucuacucuuuauuaggucuuuauuaggagaauuauaguugaaugguuuuauaaaaaucauuuuucuuuguucaagaagggcugcuuagugaaagaaaaaacacugugguacacguuauagagcagcucauuuugaaaagucaucauuuuaaugacuuuggagagaggaggugcaugggugagauguuagagaugggcaagcuaugccgcgguccaucauauccgagauggaagaugccgaagguggacaggguuucuggauuuucaucaguguauuuccuaauuuugaaguucagggucucauucuguaccccaggcuagccuggaucucacuuuguaaugcagacugccauuaaaugugaacuuaugaguuaucaggauuacagacauaaugcccagcaagauugugauauuuuuuuaaggucugcuuuaauuaaguacuagaacuuauuauagcacuguuaauaaagguggaguuuggacauuguggguuuuagggaacuucuggacauucuaauaucuuaauuuauuauuuucuaagcuguggguagugauauugucucuuuauuacacauuaauaaagaaguaaagaagggaaagaggaaggaauaauggaaggcagcauuagaguggauuaaauuagaaaagaguauuuuauagaguuagacuuguuaaacuuuuguuucugguuuguguguguguguguguguguguguguguguguguguguguaaaaccugcuugugaugaaaaacauauuguaacuuaggucaacauacuuugacaccuacugucacacaaggaaagguaaagggaaagcaagagaauaaagcuaugugcagcagagagcauggaguaagaaggcuaagaagguucaggguagggauugguggccuuugagggagggaaaaaaugacagcaauauuacuuaccaaacaaggacucagcuuguaaucugcaggggagggagcagagagcaagaagggaggaaggagagaggaagaaggagggaugaggagggaagagggaaaaaacuccauggcaaccugaccuaagaaagcuugucuacucgggagcaaaaggacuagaaacaccaaaaagcaaccagagcaugacuuggagaauuuaacacaugacuagccagauggagauugucagggaaucaggagugguuggaauacccuucucaaucauugagaggaggcuuaaaggaaggauggagguggaggaagguggguggggcuagucuguacaugcacauauaggauguaucuguacaaagcccagcuaaggaggagaggaugaagacaggugguaggagucuuacuuuuaugauuacaauagaaaacaugaugaaucacgaucaauacuugguagagucuuucucauagccuaagacuaauguaguguuuagcauccagaaugcuguccugucuacaauucagaaaggaauguugaacaauauggagggaaccaguuccuagaaguaugaacuacaaggucauacacacacacacacacacacacacacacacacacacacacacacauauauauauauaaaucauauucucucaucaagacuggaaaaggagagcuuacguuucacagugcuugaguuuucuggaaugagaauauagggcuuugcguacaguuguagaacagauagccccgugaagaggagggcagcgguucuuaagugaggagggugagacccaaccagaaaguuaggaguuguuugagagaagcacgguaacauuaaagccauuucaguugaguggagaauuucaagaucuuaggaaucaaauaccaaggcauagaugauauccaagacaccaagacaccuguuaggaaaggugacaugguggggaugggcuuuuguuuuuguugcugcugauggugguggugguacuacagggagcaaagaugccauauugggaucacuguccccugauugacuguaccaagaggaaagagccagagaggaaaaaguuggugaacaaccucuuuacaagggacaaagggacaaauucauaauuuugaaaagugucaaagucagggauucccacaaauucuguuguugguaauaugggcaaauaguuuuuagauaugguugcucuguugucuuauauugguaccuuugacagucauagccgcuauuaauuuuuauuauuuuauuauguauaugaauguuugccugcauguaaguauguauguauaccaugagugugucuggugcucacugaggucagaggaagguauaggaucccaugugacuggagauacuggcauuugggaacuggcauuugagagaugucaugcaaacccaaguccccuucccuucccuuccccuuccccuuccccuuccccuuccccuuccccuuccccuuccccuucuuccuuccuuccuuccuuccuuccuuccuuucuuucuuucuuucuuucuuucuuucuuucuuucuuucuuucuuucuuucuuucuuucuuucauuguuuugggacggggucucacuaugaggucuaagcugaccuuaaacucaagauccuccugccucagccucugcagggcugggauuacagccugcacuauugugccuagccuuagcagaaucccuacaacuugcuggguuuuccaccaauuacauaucuuuguguuuuguuuuguuugucuguuuguuuucaugagaucaccaaaggaguggcgaaaguuaugauuggcuacgcuuucugauuuaaugaaaaagcacauucacuucagaguauuugcuuugcuuagaagagaagcugucaaguacaaguuaagcugacauuacucucagaauuauauuuaggugacaaucuggcagccuucaaggccuguugccauccagugcaggcucuuuauuuuggguggauaccaggggucuuuaagacugcaguucuuaucuuguccaugaccuugagcauuaguuaauccuucugacauuuaguuuauuuauccaugaggcagcgauaauaaugcuuaccuaauagggauauugugaggaggaaaugagcuaauucauauaacugucugcuacauagugagcuuggucauuuuuuugucuuccuuucuuuuugcuaaaguucccacugaaggaaugugcaauuagugcuggguuuagauauugauuauaauuaaacucacauuuuucccauucgguuuucauuuccuaagaacuuaggaucaccauguguuauaguugaggcagauaugccauaguugguugcuuaccuguuuugccuccuucagaagcaaagucuaguugauauugacuuuggaaaagcagaauuuaacaacauaaagguuggagaaauggcucagucggucaagugcuuguuguaugaaaaugagaaccagagcccagguccucaccauucauaugaaagcugggcauggcugcauguaccuguggcuccagugcugaggguggcaaggacaaagaaucaggaagauggcuggggcuuccuucaucccagccuagacaaaaaugaguacucaccagguucaauaagagaccuugccucaggguagaaagccauugaguaggacacuuacuguccucuuccagucuccuugugugcaugugucagggugcacacacaugcaugcaugugcauaugacacacaaaagacacacaaccauauugauguaugaauauuuugcuuucuauaugaauaggcugaguaucaaaucuguccacuugugguggugguggagccauaaaacuuggcuguuuaaauaauggcuccugcugaagaucauauuggugacacuucauuagucuagaagucauuugucuggcaaccuuccuccuuuggaagaugaagaaugguuugccaaaauagauaucccaaaguccgggaauuaaauuguaugcacuugacucacggggaagcuucuaaguuuuuauucagagaguccaucuauucuuaauuaauucccuagcuacuacuucauuuauaacagcucugagauuugaauuugaaucgagggaaguugaguguuagguauguguacacugaugguaaaaugaggugauagccugaaaaaaacaggagggguuagaaaaaguaggaaaacagacuacagauggaugcaaagaaauaaaaaauaaaaaaaguauuuggacagaacaggaaaaaccucacaugucacaacaugccaaaggagugccuauagcaaaacaaauaggcauuuagcaaagcacaguauagauagguauucauaauauuguaccaguuggaagaagcaguugugguuccuuacaaggagcaggugucagucacauggguucagucauuugaacaugugccuucaguguuuuagcuguguguuagauguucagggaugugaguaugaguucacuguuauguacaguugaaaagaccaagcaaauuuagaccuuaauaucaaugucuucaggaacugcaaauugcgggggggggggggaguuggggagaugagggugggaaagaaaguguacaauuaaaauuauucaccugaacacuggcuugugauacagauauauucuaugccccaaggauuuaggacauaguucauaguucauuauuugagagauacuuuguuauguagccauuucucagcucgguuuaaaauacauagcaguaagagagagugagcuuaguuuugucaacucaauauaaguuauaagcaucuaggaagaaggaaccuuaauggacgaacugcuugcaucagguuagccuggagguaagucuauggagaauuuuccugaugugggagggcccagcccacucaaagcagugccagcggugggcagguggucccaggugguauagaaagauagcugagccugagaccuccagccagcuauguauguagugaugcuccauggucucugcaucuguuccugugaccuguucccugcuuugaguuucccccuaacuucccuaggugauggacucagaugagaaugugagagccaaguauacccuuuccucuucaagaugauuuugauuuuuggccauguuguuuaccacaggaauagaaagcaaaugugguuagugggucagccaagacuuuucugcugaguuaaaauaaguacauuuuauaugaaaauaccaauccaguaauuacuuagaauugcuuacuuaggguuauuuuucuuccuuauugaaauuaauuuuacauuuuuuagcaaagugauauggcuagauugcuuugaagcuugaauaguucuauuagaguuagaaucaaacacauuagacccaggcccuaacccccucugcauuccucaucucucccaucccuuauuuugacuccucugagguacacgcucuguacauuucuuaucuccauacuuacaguuuaccaguuguggugguuuguagaugcuuggccagggagugacacuauuaggaguugugaccuuguugcaguaggaguggucuuguuggaguagguauggccuuguugaaggaagugugucacuguggucaugggguuuaagauccucauccuagcugccuggaagacaguucucuccuguuugccuuaggaacaguauguagaacucucagcuccuccuguaccaugccugccuggaugcugucauguuccugccuugaugauaauagacugaaccucugaaccuauaagccagauccaauuaaauguuguccuuauaagaguugucuugguaaugguaucuguccacagcaguaaaacccuaauucugacacuagucuuccagguuaaguauuauuugcugccuuuucccuguuggggcuuagugcuugcaugugugucucauuuccacguucuccuuguucccucugucucacagaauaccuauuuuugguuaaaccaauauuuaauguuuauaucacuaugacaacauaaacguuaucacaguugagccuugaauaacaccacggguuuuguuuucuuucucauauaacuuuauguuuuuccaugaauuuguaauggguuugguuuccuuugguuauuuuucuauuugucugucacuaaucauccucaacuucuugggcucuagccuacaucucuucuagacauccauguuugcuucuguugccucuggggguucugugcuacacuucaaucuguugauuuuucuaggcuuccuguaguuuagauuuaccugguauaucauuuucuagauugggcauuguguucccuguuaauuuugaaggugugguuucacauuucuaacucucaguaaugugugagcaauguuaguugccaaccugauuccuacuaaauacccauacuaauaauacuaaauaauacuauauacaacacauacuauuaaauaccaauacaauaauacuaaauaaauaccaggcuaaaaaguuugauaacuuguuuacuuuuucucugaaagaauggaagaucuuuuugccugcuguauuuguaaguucucaguaguggacuuuuauguaagccuuaccuucauguugagauagguucuccguggacaguuuuaaucuggaaauuuaugccaucuaguccugaaaaggguuucucuauuauuuacuucagcuuccuuccuuccuuccuuccuuccuuccuuccuuccuuccuuccuuccuuccuuccuuccuuccuuccuuccuuccucucucucucucucucucucuuucuuucuuucuuucuuucucucucucucccucucucucuuuaucccucccucccccuuucucucucucuuucuuucuauucuuuuucaaaaguuagaugaauuaucuaauuuuucuuaauauucucuaucuugucagaaauuucuuuauuccauuucccauguuucccgagagcuucauuuguuguauuguuccuggaacuuacuauuccacuaacccuuuugguuuccaaagcaccaucuugucuuucuugaugcagaaccauuugcauugcugagaauuuuggaaaauuuucuuucuauaucaccaauuugucuucgagccuagguucauuauauguuagugucuccuuccgugaaucagguaucaacucauugauucauuccucacaugcugauaauccuuccuuugcugugaugaggagucagccacugugaugaugugaggaagcccguggcuugggcuggacgguguuaugcagagauagcuaggauguuagauggguccucucuacucauucaugcacacauuuccucucggccuaacugguuuaagaaauuccaacagucagacaccugucuuucuauaaguggaagaaauauguuugguguauuuccuucaggauuccaguuaguccccucuuugaaauacagcacauugccuucaucagugcaucuuagccccucugguauaacuuuccuagucaauaaaaguguagacuucuauuaggguggagggugaugggaaaagagauacuuggcugcuuccuuccauaacuuagaagugugcgugcauguguguguaaguguguguguguguguguguguguguguguguguguguguguauuugggagguugauguuaaugguaagaaaugcuucugaaggccugccuagguucauaaucacuacaagccaaagcaggcuuuuaaaucuuuuaucccacaggcuuuaaugugaauuuguugagauagaaagaagcuggcagaauucuuaaaacaaaauauauauguuuggggguacaucaaagacacuccccaauaggauugugaaagcaacgucaagggauugauaggucaaaguaugaaggccagccauaggcuuuugaggaacuuuuaugaacuuaaaguucugagaugacuccaggguggccugagagucagugguucuuggauauaaagccaugggcuuggcagcagugcugugaaccagaagagcauucacgccugugcauacaaauggccuccucugagacuugcuaggcaguaguaggcuuacuugggacauucuccucgucuagcaugccccgaauaacucugcgauccacacagcuggccugggagucggagguaaauucagagugcagcuagaagguuugugaaggcucucgaccacaucuaaagugcuucugauuacccuguagugucuguuucuguggaaugaaaaugugacaacccugaaguguugggagaagauaauuaaaacucacuuguuccugucucaaauuauucuuuccuuuugucuacugaccuucaaguuacucaugaugucuaauuuuuuuuuaaaacgguuauaaauaaagcaaaacaaaagaaagaaggaaagaggaauggugugugguauucuuugaauauaauagguugaaaguagguuagcugcccuagauuaggauuggaggucauuuugagcuaaauuggcuuugaaaucagaacucgaauugcuagucagacuuaauuaagauaacugggcaugaaggccaucguucuuccucuagucucacaaaaagaauguauuuuauuguuugugcuucuuuauagacaaauuagacucuggguauuaaguuuugaggaaaucauuucacaugguaguugacuuaggaauuuaaaagugguuuucauguaaauaauuaaaccccauaauaacuuuauuugauuuuccuagggauauuuggaguaggucucucuaaagucacugggaggcaaaucaguacauugcucugaacugugucuuuucuacccuguucaguauuaagaagaaugcccauacagacaucucaauugcuuuauuuaauuaaccaugcggguggagcuagcucauggaagugugaacuucaaauaugucaaucaccuuacaaccuauauaugcuucuguguuaauaguacaucuacuuauuuuuuaucucugucucugugugcaugcguguacauaaguguauguaguugguuuucucuuucugucauguggggauugaacucagguggucaggcuugguagacuugcugaaccaucuuggcagcuuuaaccauucauuugcaaauacuaaaucuuuuguuugugguaaacagguuaaauccauacaguguuaacuagcuuggcagaggagacuuacaaugcuguuguuaauuagcuuucauggccaucgucuucuauggacuaagacaaauaaauuaguacaauaaauguuuuaccuuaggauggaaaaauagaaagaaagagacgaaaucgaaucuagagaugaauacuguuucccaggaaucugagaguguaggugcauagcugacuguggucggcggacagaaccauaaagcaaacacgccuugacugucuugauagugccuugaacugauacuaacauccaucuugaggguaugucgaugcuuuugguagagugaacauccugguauuugggucugucggcaugauaggcugacauugccagugguuaauauugaucugaauauaguuuuggaauagcuucacugaaacucauuuugaagugguaaagaacaucuuccucuuguauaugaaaacuguaucuacaguuuuuacaaaagagcauaaaaucaaauuuacauuuuaaugcuuaauacauuaauuuaagaaaaacccucacauccaagguaagacauuuaagucauugcucauucuuuguugaaaacauuaauuggaaaugucagguagcagguugauugguuuuucuucaugggacacuggacgcacagugaaaugaugaggcugaugaaacuuuccuuauggaugcucuaaggaucgugucugaugaguuugaacucauuuuaaggcucugguacuggggugaugguucagagaguaaagugcuauaacaaacaugaggaccugaguuccaguuccuaguaacccaaauagaagccagacauggugguucacaucuucaauucccacacuccuaagguaggacaggagauggagacaggagaacuuccagagacucacggacuucuaaccuccacacaagugcugugguacccaucggccugcacucacagacaugagugugcaacacacacauaccauacaccacacacauacacacacacacacacacacacacacacacacacacacacacacacacacaccacagcacuaucaccaccaccacauaccacauaccccugugguguuuugaaugaaaaauguccccauaagcuuguaaagaguagucuuacuugacagggauuaggagguguggccuggaggaggacuugugucacuggcuggcaugacuuugagguuucaaaugcucaagccaggccacagugucucucucuuccugcugccuguugaucuagauguaaaacucucagcuaccucucuagcaccgagucugccugcacacugccaugcuucccaccaugaugauaauggacuaaaucgcugaacuguaagccagccccaaugaaauauuguccuuuauaagaguugccuuggucauguuguuucuucacagcaauagaagccccaacuaagacagaaguugguaccagggacuggggcauugcugugauaggucugaccaugcuuuuguuuggaaguauggggauuucagaauuuuggauuagaaaagcaguugaauguuuuagguggcauuuaaugggccauacgaguaggaauaaggaagacaucagugcugagguuggguugaauugggaguggggauggggacuggcucaggaaguuucagaggggaggaauauuaguauuggccuagagacuguucuuauauucuggugaagaauguggcuacuuuccacccuuguucaaaaaccugccuuaggcuaaagugaagaguuacagaugaauagcuuuagcagagcagguuuccagacagccuaguauugacugugcugcuuggucauuaguggccacacuuaugcagaucuauaaugaaaaugaacaaacggagccagggaaaacacaaaauguauaguuugugggcaaaggaagugugguggagucaaaucuagugcucaaggagauaaaaaaaauuaaagaaaaaccugauacuaaauggcaaccucaggggaagacugcagccaacuaagcuucuaacuugggaaaaagaauuaaagaaaaguuuagggcuggacaugguagcacacaccuucagucccagaacuugggaggcagaggcaggaggaucuccgaguucagggccagucugguucacagagcaagugccaggauagccaagauuaccagugaaggaaaucacgggaaucagaaagaugaugccgauguaagugacugaggagucauguugcagccccagcaagcagcagaaccuggcaguuuuggacaaguggcucuggcuuuagagucaaggauacaagagaggguugcagagucucucaggcucaagcuguuucuucacagcaauagaaacccuaaccaagacacuagaaccccacuuccuacccuucaagaugaaagagaaaaggucugggagaaagcauucaugaaauuugugauuagaaaugaucuuuaaugaauacauauguaugugaucuguugcauaguaaauauuuaauauucuuuaugguguugcguuauugaaauaguuuuauucguuuuucuauuaaaauaguuuuauauugaauguaauaauuuggaaaagucacaagucuuacaaagauguauaucauaccaaucacauauuuuucccaaggcucaugcuagguggauuauuugcuauuugaaagugaauucaguuucuuaaaacaaaacaaaaaaagguauaacugaaucuuguuccagacaaacuacuuaccauucugucccaugcaaaacuaauacauuaaacucaauaguugaccauaguuuuaaauaugacaaaaaauaagguuuaaaacucuaaauugccauuguuuacaaaauauuggcaaauuagagcuaaagugccugguguuauugugcaaucuucuguuuaaaaauaaacaguggaaauaauuguagaaaccucuggguuuagaaaagcuuguugguggcucuucacauccuacuaaaaaaagcaggcggucuuugcauaguaaucacucucugaaaggaagcucgcuuuauuugcauugugugagcauuaagaaguccaauaguaugccugagggaaaaaauggggggauuguaauuguuguucucaaaagaguuuuuauucuauucaagugggaaggcuggaugcuggagaauuggugcaguguuugcuggaagaagagucccuuuuggcugcuguguuuuaugugguacaaucccggugugccaggauccaggacgcugggguggagaccauagggacucauggguccaugaugcaguuucucuuuuuaagauggcuguacuuuuguaagcauuuuucuccuuacacaucugcaaaggggaugaaaauuuggcaauguguacaguauaggagacuccaagagcaccgaacaagaacggagaagugggaaccuuaaguggcugccauugaagggaggggagacacaauaugaaauuaaguaaauuaugugugaggauuucuguagaaaaugcgaucuguuuaaugccuugcagauguaauuugcucccccaaauugauuuuaaaugauauauuugaaauucucuuaauaacgauagcaucguucucacaucauuguguuuuaggacucauuggcugaguauaaacaucgagaauaaacagaaauguucuugauggcaaugcagacauccuuuaagcuuuuauaggcaagcgauuuuaacacuuuucuccccuucuguccagccauccucuaggaaucccuuggauguucuaacuuguucuagcugacaccaguucucuuagccacuguggauucugaagcucaccaggugcacuccauacaucagauguuuaauauacuguauaggguuuuaguauuuuaaauuugcauagaccgugacauuuccaacuaauuuaccuuuuagaagugggcaagugugcugugaccaguguacauauauuuugacaaaaaggcuguauacaaucauagagaugaagcucauugcucugaaugauuuuguuaacuagcagaggguaggugacagauuccaaaggucauaugcauguuuugccaaaacccucucugcuuaggccugugugacuacccaugaagcuccuuguuuuuguccucuuucagauuggaccacucggguuauuugagagccauugcagaucccuuggugaugccacuucuauuugauuugaaaugcuuucugugauaccauaccuaugacaauucuguuuaauccgggaguauguggaguacuucucagacauuuagacuguguuuagguugcucuguaggaauacgaagaagucggagcacagaaacucagaugguccaggaaaaaaaaauacuucuguaaaagauuaugauagguuacaucauaaauuuguuuucacauaaauaccucuucaguuuuuguuacugauaucacaaaagucaaauuacaacgaauuuaguuguguaccuaauuaauuuuuaucuucaauuuauaaaucugaaauaacauucauucuacaaaguaaaauuaaaaugaauuagcugauacuggaguucccuuugggcaguaacagaagaguggguuuuguaaaauaggaacaaggaaauagaaucauaugaaaagcugaucguuugacaaugguuuccucagauuucuagaagggauuuggcugugauucuguaucacagagccugggaucuuccacuuucuggagucacaagucuguuccaggcucugucuucucuggcuucucauuuggaucauguggcccuaagcaugagcgaguuuaugcugcuuugguuugauguguugguaccuagugaagggguucaaucaaaaugauagcaucucauggguacuuagcgaacgaguccaguccaaaauugucccaugaccuguguuuaacaguuuacauaguuuauaguuacuaauuuaaauuugaaacuuaaaaaaaaaauguaggguggaccugagaacuuagcuugaugacagagcacuuugacuuggauuucauuccauuaccauauauaaguauagauuuauacacugauaaaucuauauauuaaugugcauguuuauacacgcauguguguggguauaaggcgucacacauuuuaaagcugguauauuuuucaugugaaaaaguauguaacaagcugggaugaaaagguguguggucauuuucacacucauauaaaacuuuugacaaaauggaacaccuuucaugauuaaaaacaugaaccaaagaagaaauagaauguaccuccccaagcagagcaggccugaaaagcucacaauucacaucugaauggccaaagaccaaaguccugaaugcuuuguccaaagacaaagaugcuucaucucuucaggacacaggaaacuaaauccacgagagguacuaccucccauccucuaggauuucaauaauaacaauaauauaauaauaauaauaauaauaauaauaauaauaauaaagauuaugagcuagaacaauggugaagaaacguuagggucuuuggacccuucugcuggggaagacagugguaugccucuuuggaaaacugucuuguagucaugaagcagaguuaccauguggacuauuagcuucccucuguuagagauuaaaacauguuauugcaaaaccuuacccaguaaccauagugcaccauuacuagccauaaucagaaauacaaacaaacuaaauacaccucaauucaugaauguggcacaacuacacaguggaauauuauuauuuggaaaucaaaagaauugaagucaugauuccugucucaacccugaugagucuugguucuucguugucaucauguaagaccacuaauuacauuagcauuuauuugcugauagcuuugaagguuuauuuucaucccaguacuuauuaauccuuucccauaauucuuaauaauguucagcuuaugugcaugacaucuuuaugguaauaguuaagauaacuuuauucauauuuauggacuacaagcaugcuaugaggacucuuggcacacgcacaaaaaauaaccaguacuucaaaauaucgucgucuucuagaagaaggaaaacauguugguuauuuaucaauguuuuugacuuggguauuuuccaugguuccuuuguauaaugguuagaguaucgggacauacaggagaaccagugguuuucauaauuugaauauuuguaguauauguacucaggccucacucaugcugugcaagcaaguugccucucugccucauccccaugccucucucaccuuuuauuuugagacccaagcuaaccuugacucacucugaaguucaagcaagccuugaacuugcaaucucccuccuucagccuccugaguagcugggauggcaggcuuggcccacgaggcugauccucaguaucucugaaggugcuuugguagaggcuuccuuagucuccagcuuggcugugcugggaaguggugggaaguucaagaggcagggcguccugggaggccauaggcaggcccuuccaggaugcuggaacucugcuuccuugcucugugucugaguucuucaccaggaggugcaugguuucauucuguugcuugccucuggcauggcguguuuuccuuuuggaagucuaaagccagugcauaugccugauuguagacuguguucuccaaaucuguguccacauaccccuuuuuuuccucaugaauuguuucugagguguuugucaugcuggaaaguucacugauauaccuugcucacacaagcuaauggcuucaugguagagcugugucaugggcauugguuauugauaucaucaccucaucucugcuacuuccauacuuuaaaguuugauacccauucuuucuacaaggaaggauggaggaauacaucucccaggauuugacaagaggaaccuguucauuuguuuuuacucucauucauccuaacugugaacacgguacaugcaguuacauuuuauaggaagguuaagauagacuaaggauguuuuucuugguauguaaaacaaguuaaaugauaugaauaaaauauuaauuagcugauacuagaguggugacuaugaaaauguuaagcacauugugggugcaaucauuggguuugacaaacccuuggauugcucuucaggugaagcuguuguuucucucuaauaggaagaacauguccuucaaggccaugagcuaacuaagcacacucuagguagaucauucucagauuuucuucugccagaaagcuuucuaaaaccgguuuaucuugcuguugucacucucagaauucucugaggauccacaagaagaucuuuaauuccagacaauuaagggauuugaaggauuuugguuuuuuuuuuuuuuuuuggaaacuucaugucacugaacuugcuucuuuaaaacaaccauugcaaauaucucagauacgaaucuugaaaaacaagacuuguuagauguacagacagagaugaaagauuauucuguaaugaaauuaguugccuccccacuggcugccucucuucuuuuagagugguuugauauuuguaaaagagaacagugagguuuaaugucuuuucagacauauuuauuuuaugaugugggcuccucaccaucuguaauaagaucuccaagcaaacauuuuuuuuauuugauuguuaauuggauugaauuucucuguugaaaugcuguaugugguagguagcucuccugagacacaucguaaugaaaaguccuaauaucuucuacagugguuagcaaacuucuuggaaaauagauucucaagccagugccaagccgacucugucucacuggaaggaccuuacugguagcuuucguuccuccguuccucgauucuguuuguuuguuuguggguguuuuuuuuuuuugcuuguuuguuuguuuaucuccuuugaggaauuugaaggaggaaugguuguuacugaacugaguugcaaaauggaugccagcuaguaaacugggugcauccgugggucugcaagaacugaugccuuuggaagguaaacugcaggugcccuugccacuagcuggagagguuaggaagucagaggaagccugggacccgggaguaacuugaugggauguguuuuggaaagcuagguauagugaccuucucugggacguuuggugagacuagagucuggaaacagaacuguggcagagucucugugagguaauuagauugaaaugaauucugauugugaggauugaaggacuuaaguacugcagggcugggagaggcucaaaagcugaaugucccuucugcugagcccgaggaucuucauggcuguggaacccacaugguggaaggagagacucccucaagaucuuuucuguuuuccucaagaggcccugcaaaggggagguuggucagcuugauguuuguuuggguggauguggagcagagugagcaacagacaugauuuacagugcagaccagggucccaggaagaaugagcgucacuggacacagaaacggggacaagggagaaaggaaacuuuaaauuuuuuuuuuuuuuuuuugaaaaaccauagcuuggcccaguggaaggugaccuugagguuaaagugaagugcacagaaugaaaagcccaguagacaucuggaggcauaauuagaguucuuccgagucuaaguuagaggaaggacugcagucauuaagcaggagauugcucucagagggcaaguccauuuggauggagcaguggaaagaaccaauugcagaccuuuccccaauauucacauuguggagauggacacuucuuagguaggauagcuguaaaaaaugacuuccaaguuggagcagaguugguuuuguuacauguguccaaaguguuaaaaucauagaaagcccaguguuagaucagacuccuuccuuggauucucaggcuccuuuguguccauuuauccugguucuguuuuaauaaagaagucuuuugcagcccauccuaauuucuuuuuaggauuuuuuuuaauuuuaguauuggugguuuauaagcauaaaugguagguaaaaaaaaaaaucguguaacacaaauagauuuaaaagccuuaagugcaaauggaaauauauuacaggguaccaagagaacuuggagauaagauuucuggagagauauagaaaguaaccccaggaaagcaugaaaugaacaagaauuccuuuuuuuuuuucgauuggaaaaagagguuagucuucccuagggaaaauugugcaucuuaauauccauccugacacauuacgguuccaauucagugugugcuuugguaucccaguucucucucucucucucucucucucucucucucucucucucucucuuucucucucucucucucucucucucucucucucucucucucucucucucuccucuuccccucugucucuccaucuuucccucuugucucucucugugucuuucucugucucuguccucucucugucucugucucugucucucucugucucucuguccccacccccucucucuuucucucugucucucaugcuuuucuuuuugaaaauuagaugcucauguauauuuggguuuauuuugggguuuuacuguccucuguuggucucuguaucucuuuugaugccagcauuuguacuagguuuugagauguuuccagccuuguccuuuuuuccuugauauuguuuuuggauauuugaggucuuuugugacuccaugugaaaguuagauauuuuuuuuucuacuucuguggaagcauauuucaaugcaguaugucuuacacuguuuuuguauguuucuuugggcagcuagacauauaaagauaacauuccagcauaugacugugggauggcuuucauuuauuuguguccucaguuucuuuuguaaguguuuuaaaguuuucuuucuagugaccuuuuaccucuuuggcuaaaacauuuccuaagcuuaucuuucaaugccauuauguguguuggucaguugguuuauuccuacaguacugaauaucgaacuuagagcuuaauauauauagagaaacauucuacaaucaguuguuuucaauucuuuugugaauagguuuguuuucuugauuuuuuuuuucuuuagacaauucauuguugacacuaguggcuuauguacauugaauuuguauuuucugacuuugacaaaauauuuuauguggauacccuuaugguagagucuuuagaacuuuauauaaaauaauggaaucugcaaagagcaacaacuuaacacuuuuaaucuucguucgaaugcuugagguuguuuuuuuuuguuuguuuguuuuuuuuuuuuuuucuugucuaguugcucuggcaaggacuucuaguacucgcuugagggaauaugccaagaguggagauucuuuccuuguuuuugguuuuagaaggaaagcuuuccuuuucuaaaaguuggguaagaugugagcucugggaucauaucuaagacugucuuucuuaggauagauuccuauuggagccaaaguguugagaauugcuacgugaaaagaugcuucguuuugucagaugauacuucuuugucuaaacagcugaucauauuaguucugcuuuucauucugucaauaugauguaucacauuuauugauuugcauguguaugaaugaaccuugaauuccagacauaaaucccaagcacuggucagugauccuuucagugaauuggauuaaauugggucugcuaguacuugaugaauggggacuguaaauaucuacauucaugagagcaugccuccgaguagucuuugaguugauccuaccuggauuauuuugcauuuaaugagcccuaauguucuuuucuuuuccaaguauugcuuucagacagcauuccuguaaauguagaucacugaggcuuucaauguggggcugaauuaguagauauguuagcucuuugauggguauuuuauaauaucuauauucaucaaggauauuguccuguaauuuugguuuguuucagcauucuuggucugcuuuuauuaucagguuagcgcugacuuauuaaaaugaguuuggaaguguucuuuucaauuuuggggggaauagaaaguauuuuaaagaucuuguggugauuugaauaagacuagcuucuaaagauuaauauuugaauucuugguccucaguugguagaauuguuugggaagcauuaagagguguggucuuauuaaaggaggugugucauuagggugagcuuugagguuucaaaagcccacaccauucccacuuagguuucucugccuagugcuucugaauaaagaugugagcucucagcuauugguucaguauggugccaugccuggcuaccugcugccaugcuccccugcuccagcaccaugccuggcugccugcucccaugcuccugccaugaugguucauguucucuaacccucuggaaccacgagccccuaguuagacacuuucuuuuauaagucgugguguuuugacucagcaauugaaaaucccuaaaagggacugcuccggguucuuuaaguguuuaguggagaucugcccugaagcuuucaggguauuggcuuccuuugaugggaaaucucugauuuuggauucaacauucuuacuuguuauugguucauucagauuuuccuuuuauaauuuuaucuuggcuaguuacauauuuuuagaaauugacacauuucuuuugggucauguaauuuucuggcacauaagcguugauggucaucucucuggaucuaagcgcugcuguggugucuguugagaugucucuuuuucacaucugguuuuauuggcauauuuucccaguuguccuacaaaaguuuugcagauuuuuuccuauauuucuguuuuguugaucauuuuuaauuuguguuugagcucccuauaugcucuauucucugcuauuuccuccccuuuccuaauuuuguccuuaucuuugucuuuuuucuguuugcaugaaguuuuauggauuauuuggaaucuuccuucugucagauuuaagccauuuauugcuggauaccucucuugagacaugccuuugcuacaccuugcauauuguguuuucauuuugguuuguuuuaggguuuuuuaauuuccccuuugacuucuuuuuguugacccauugguugcucaggaaauuuuguuuaugaaucacccagcucuccacuguuaugauuucuagucugaugcuacugucaucaggaagauauaugccuucaaucaucuuaaauucauuaagacuuguuuuguaaccacacagaguccauccuaaagaauauuuuaugcgggcuugugaaggauguauagucuaguccuguaggauggaauauuucugcauaaauuuuugaucuaauguaacucagguccacuucuuauugauuugcuguuugaaagaccuauuuauguuuuuaaaacuuauuuaguuuuuaauuaucuauaagugucuguuucuguaugugggcauaugcacacagugcagguccuugggucaugucagagccaccagaucccuauugcuagaguuacagguguuaugagccaccccagguggaugcugggaaccaaacucaggucucugcaagaacagugcaucuucuuaauuccuaagccaucucuccagccaugaccuauucuuuaugggauauuuaguuucccuaauauuacuaaguuguuaacucuaucuccuuuagaucuucuaauauuuacuuuguauauuuagguucuucaaaguugaguacauauauaugaguuuauaacuguuacuuucccugauaaguggauuguuuuauuacuuuauaauggucuucuuugucuuuuuuuucauaauuuuagacuuaaagucuauucugucuaauauuaauauaauuaccacuuuuucucuuauuuucuuuuguaugcaagaucucuuucuauuucucuacuuugaacauuacauuugucuuuaacguugaagugagucucuugcagauuucagauaauccucuuuauguuuuauguucauuugguuauucuuugcuuuuuaauuggagaauuuagguaauuuacacucugaguaaugguggacaugcagaacuuacugguguuauuuauuaguugacuuaugaguugcucuuguuugucuuuuguguuccuucccuccuaugauaucauaaucccuuccacgugauuuuguucacuucuuauacuguuucugugcaucuaucauagauuuuacuuuauaguuaccacauggcucacauggaacauuuuacaacgugcaauuucaagcugauaaagcaacuuaaauuucaugacauacacuagacauuuucggcacuuuuacuuccucugccccacauuuuaaauaauucauggcacaauuucuaucuuuuaauauugaguaaguuuuaagaaccuuuauuauagcuguaguuauuuuuaguugucuugucucuugauguuuauguuauagauaaaauugacuuacauucaguguugaguauuccgaguuuaaguauguauuuccgguuaccacugacuauuuuuacuuuuaaaugauuuuuuuguauauuuuuaauucauauucuuucauuucaacucaaagaauuuuuuuuuagaauuucauguaaagcagauguaguaguggcgagcucucuucccuucuacuugccuggaaaaugcacuuauccccuuucauuuggaaugguccuggccgguguuuauucuuuguucuuguagcacuuuuccuaugaaucauccuguccccucugcagugguaguguuucuuucaaggucuauugauacccuucaggauggucccuaguuuacacugagucacuuaaccucuuguuguuuuuaagauucuuugaaauuugauaaugugcccccagaguguuuuuuuuucaagauaccuugaccugggauaguuuguguuuuaugaaccauaguguuugcuuuucuuccaacuauuucuucauuaguaaaauuuaggacaguauuucuuggugcucacaagugcuauacugaaaaagccaucuauagcacacucuuguucauguuuuguuccccuaauuucuaaauuccuaauuuuguaauaguuaccuguuuguagugucuuguagugcacuaggauuuuuuauucuuuuguuuauuauuauacuuuuguuugcuugcuuuuuauaagggucucacuuuguagcccaggcuacucaaagucccgauucuucugccauggcuauuuuuagugcuacagcugugugcuacccugccaagaugucuuugguuaacagugauuauuuagaguacucucucaagcuuugcuuugagguugguuucugcagcuucauggguauuauauuggauugauucugguuuuucuuuguagcauuguagguccuuggagcaucuuuuugucaucuuucuagacggguuuuagcagauuaaggaaugcucuugcuagcauccugggauagugugaccaccucugggaagacagcugaguggguuuggagugggucaugugguugauguuguguucuuggugaagucugcucuuguagagggacucuagugggcaaugauuuugucugguuccuugguggacuaaauugucuuugggaccuuggccuuuguacugggaugggauucuguguuaaggcuuauagacugaacuuuuuuuuuuuuuuuuuuuuuuuaccagauauggauggauauggcuccccuuaggucucuaagaaaguacuugccagggcaggcauaagugcccuggucaguggcugagggaauggaacagagacacaggagucacugaagcaggaaggccuguucagaggacucaggcaggauugucuuuccccuacucccaguguuugagcuguuagccuaaucuuugacugcugaugagagagaauagauucaggccuucgagauauuucuggucaauacacaggucugagacucaacacaugaacauuccagccccugggauacauaguuguguuacuagauccccaaacaaauaggccuaugacugggucuacaggggaauauguaccauuugguuuugaagccagucugugaucuguuaacuggacaaaauucuaucuucuaaaauggcuuuuuuugugccuugggcuccagcaguguuuuauagucucuagagaggauuguaggacuuccaaaaccaccugugucuguggaugacuauagaaucauuuaacuguccccacauacuauggagcauccucuguggucauuuacuucuguccuaugguuucuuauucaacauugaagucagugcuucagauagaaaugucauguaggugacacaaagaggguaggagugcuauugugaaggauaauaggaucaggcuucaguaagcaggauuaacgggcuaaauuuaacacaaugaaauuuuacaagggaaaaaaaagcaaaacucacacuuagaaccuaagauguguuuugcaguucccuucucuuuuccauggcuccuuuucaggagcuuagcagaguuaauugcuccuuucucugugucuccuuagcaccucaggcuuaacccagucauccugaguacuuuucauucagcacugugccugugccccaauccuacacugucaacaauuugggaaugagaucuguccagucucaucucucuacccugcagccuccagagcaaugacaaaugagcaacagaauucaugauccagagcucaguggggguguauggacagagccuuagcacauggucuaacgacacuuguagaagacagaccaugagaaggagcccaauucuuauccuaauggcauguucaugucugggaguuggucacauucagugaucuuuuucuauuauaguuucacuaguaaauuggguggaaaguuaaaaaaaagauuggagagauuagagauaauuggauuaauucaaaucauuuuguagaugaagaaaugaugcacaguaggaagaugagaguugacccaucgaaguucacaccaggacugugcugaaacaggcucugggauggacccuuaaauaugaguuguuuguacucuuuuucuuuuuaaucugggaacauaaucugcuaguaacuauagaaauauuuuauauggucaucaauuaguaauuaugcaugauaaaagaguuuauuauagguaauacagucuguaaaaguuaacauaguaauuuaagucucguaucuuuuuaaugacggauaauguuaaccauuuauacauaugugguccuguuuauaaaacuuuuaaaagagaaauagucauuuucauucaccuuuauuacacuuuuaagguauuaaauauguuugugcacuguuuuuaaugguggagcaucuuguagauuguguuaugauuaugaaugacuugggggaaagaggagaugacgcucugguugucuuagguuaaaacugcuucuccugaaagguuucauuuuaaauaucagcauacauuaauuaugaaaaauaaugcacuuauuauguccccauuuuuuagagagggucuugaucuguuaaccuggaugaccuagaacuuaacaaguagacaauugacuuguaaggauucuccugccucugcuaaugccgugcugggauuacacacaugcaucucaucauauguguauuuauguaugugccuguguagguauguccaccugaguguggaugccugcaguagcuauguggaauuagauccucugaagguggauuuaggggcaacuuugauacccagcauagacgcuaggaaaucgcacucaggucuucugaaagaagaguaugugcuuguaauacuuauaaucacugagccaucucucuagcccccuauuguaauauuuuaaaaggcauuuucuccuaaguaaauuucuccaugugaaauuuuauguauuuaaauuuucgaggaacauugauauuugcauuguuaagauuguugcgcaggagaguuuacagggacaagcauguguucugaggcuaccaccucccaucucuagaagaagaacccaacuuuacaucuugcuauuucuuugaauguuugucuuuauacaaagaaaucugauuuuugugucuuaaaauugaaugcacuuaauuauguuaaaagguaacucacuuucaugguucagaaauaaaugaaacauguagauauaggcaaugaaaauuuuccuuguaacaacaacaaaaaagcccucacucauuucuucuagagcauuuucauauugacaaguaaacacaugcacaggcauuguccugcucacaaaugucuauauuuugguuacuuagacuaucuauuuuaaacauuuauugacauuuuaucaucauuugcacaaaggaagugucugucacuguauaaucuucuucacuugcuuucugugucuuauggcaacucccucacuauucauaaguuuccugucaguuaaauucuuaacucaaggaagccaacugagaguuugccuugucaucuguaucuuuugaugcucauuuauaauucagaguuaauacuguccccaaauuccuccaguccucccuuuuaucaucuucugaucuuuuauuaccuuccaaugauguauagcaucuguuucauuaugugucuguguguguguauguauguauguguauauacauauauacauauauguauauauacacacaccuauagagagagauuauguauauaaauauauacagauauauaaauacauauauauaaauauaaagacacacacacacacauauauauauguauauauauauauauauauauguauauauauauauauauauauagagagagagagagagagaaauuacuucauccauaguaucuuuagagcauaacuguaaacguuaaaauuaaaacaaauagguuucaucuuucccaguaugguagucagguaaguuuuauaaucaaccuucaggaugugcaaauuauuaucauaguuucuauuauacucuguuacuguuuaaccaguguguccagguuucaaggaaaggaucgaauuuguugacucccucuugugaaagggaaccucuuguucuuuucugugcugcuuucugcuggguugacugauccucaauccacugcaaagcuaucuuccacgggcaaucauucaucauucuugacugagcccagaucuucggcuuccugguuuuccauaugacuucacaugagcaaauauuuucaguaauuuccuaaggagugggagugaaagguacaggacacaucauuggcccaugcauuacugacacauauccaaugucuuuauucuguccugucaauuauaagguugacuagaugugacaucuagauugaaaauaguuuccacaucguaaguggaaggcacuuaucaugauauucaagccuuugagucucaugagaagccugaugacaguuugcuuucugggcgugugcagacuccucaguccucacuuaggaagcauguaaauguaucucuucaugccaggugcuccaaauuuaaugccccuguuuaaaugugagccuuugaauacucacuuuccuuacugucaggaggcucuuuccaaugagaggacucacauccuauaguuugaucaauaggucucuauuaggcugggguccagaaaacugauaauuuugcccucugaauucucuuuggugccuuuucaucaguucucaacaguuaauguugaguaaugucaacccuuagucauguucagaguaucuggcaucucugaaccagaaucuggaaugucugggauguagaucaucugcuuucugucccguggucccccaacuguguggugucuacugggucuucuuuauucuuuguuuaugagaaauguguuugaauccuuugaaguuggugguuuucuucccauucuucaccuggcguuuugugauacauuuaagaucuuuauuauagcuaugagagcuuccuuaaaaagauacagucauaugcuuucucguuucauaauuugaagggcucaguuguaucuuaggcuucauaagaccuuugugccucucucacugguuauccacuccuuuucucaucugucuguacaguguggagccugacacauuaagucugcacuggauaaaucuacuacguuucaaugggugaaaaaaaaauggaaugguugcauuuaagaaagauaaucucuucauuuucaacuuuggucagcccuuuauugcuagaagggauuuuaaauugugucucccuuaucaccacuccugagauaccugagcauuaaaaggacaugcaagaaauaaugaggauuuuacgauggauuugguacccaucuaccuugcuuuggauuaauggaagagccagcuuuagugaugucauuuuucauaucguagcucucugagcgguucuucagaacagacuucauguaauuacuugguuuccacuuagaauuggaaagcugcuaaacuugggcauuauuuucauaagagccaagcugaauuuuuaacuacuauaaggaucuucuuccauuggcaugcgccgauguuuacaacaccagcauuuuauauacuguaaaauacuagugcagucugagccucuguugguauuacaaagugggaacugccacaauuguguugugaguuuugcaauauggagccaggauuagaacgcuaauuagcaugccacugucaugucuuuucuuacuuuaaauggagaagggaugauccuguaauaacagaauuguaaaguugagacggcagucgagcaggggggaucacucugucuugccuaucaguaguuccagauuuauuaggcaaguguagaccuggcuuuaggaaaacacacacugaaguuuaagguuacgcucucuggccauaucucaaguauaaauguaacaugguaccaaggguagaaaucuacugacccaugucugguucuguuuggcugguucuauugaugugauccaucuaugccacaugacuggagggcagugugggagagccuggccaugggcagggcugagacacgguguugucauugaacauacgagacacacucuucaauuaacucaguaccgcccuccuucuccuuuguuuuuaagguuaaaaaaagucucauuacaaacugguuaauucaguaaagaaauguaguauaauuucauuuaaauguguuugcaguguuaaauuugcuucuuuaacuuguauucauacaaguagcauuauuguuaaggagucuguacaaaauaauaacuuuuuugcuauguaacagacauuaguguauaaaacucuguauuugaacugucuucuuuuugugauacccuuuauauauauguauauauguauauguauauauacacacacacauauauauguauacauauauacacauauauguauauaugugcauauauauuauacacacauauguauauaugcguauacauauauauacauuuauuuuacaaaucaauacaaugaucuauagaaccuugucacuugcucauauuuauacuuuucacaugcuguuuuugacauugauaaacuauuacaucaaaccacacccucauugugacucuggcuuguucauuuuuagaauuagaauaaacaguaucgguguaaucaucuuuauauaaaauauuuucuuuggcauuaguuuucagaacauauccucaauaugggguuauccagucuucugcaccucuuguuuuuguagcuauuuugaccucaucagugaugggaccaagucugguacuuuuaucugauuucauaaaugagaugggaaagguuucaaggagggaggucaguguuuuucauguucaagaugcccccucuagcuuuaucuucacacguugcuuuucuaagaguaaauucucccaaccaaaacacagcuuggcugauaagguaacaaaugccaaaccguuagcaacaaguccuaugguaagaaccauuuguucagcuuaaucuccaccucuuaccaccuagcccacaguagauguccccuaagaacagaaucuggggcaaguguuaacgacacagcccagugccauggcagaaggggaggagggucagcaucugaaugaacuagcaugugucacacacuugcuuucugggguuccuccuuugcaucaaaaaagguaaucugagucaaaaaagaugguuuccuauugggaagcacugaguucaugaguuagguaguguauuaauucaccgcaagaugaacuuauauguguuguuguguccuggagggcauuuuuaaaagaauggcuaaggagacuguacagaacaugcugugaagaaguuuguuuguuuguuuuguuuuguuuucaucauuugguaaaaccgcuccugggacagaucccauacucuucaguaaggaucuaaaugacaauaccagugggauucagaguuggggaaaagcugauguuuucugaaaagcauacuuuuguagauacuaaugagauucaugcaacuauaugugagucccacccuuggucccaguguaggggaaaaggcaaagaaauaaaugaaucaaagugggauuuaagacauaaaauaauuauuaagggcuguuuaucuggaaugccucucauaagaacuauaauuaaauuuaguaagaaagaaguuacucccaucaaaaacuaucuuccugucuaaagcaauauauuuugccucuaacugcuuggcaauuucauuucauauaggauauacuugagaucuugggggucugaccuuauggagcgccuuuauuuuuccuagcaagaauucuuucuagaucguuuccaaagaauuacagaggcaggaggggacuguacaaucuuagcuugccuuauggaaacaaggugcugaccccagagguccagagggcucuccugggaucauauguguccagaaauuauuaaaggcuggaguagaaaagggcuccgugaggaaccccauaugcugagaggaacaugccauuuuacugcacacagcugccagccacacaguaugcuucacccucaucuucugcauccuggcaccuuucccaggccaagugauguuucaucauaaagggagcugccauugccagggguuucacaagccuguagaucagagaccugugugaugagaugccuaggagucccacaggcaauuaggcucuggggacggggugccagagaaauggggguucccacuugguucaucugauguuuauauuuuuuccauagcaaaaaaaaaaaaaaaaaaaauuaaccuuuaaguccugcuuucaaaaaaaaaaaaaaauccuagcuacaaaugugguccuagaucacggauucuccagcuauauuuguucguccccugcugucaaccccagcucuggccccaucuguucuuccuccgcuugcugccuuuuaaaaauccacauacuuaccaccguccaagcacggcucuccaccaaucugcuuuuguuuucugccaacuugagucaccccucucugcccccaaccucaagacaaauaucgacuugauucgucuaguugcuuccacuguuccuuucagacaggcgaaauuagauuguaugugcuccggcuccuuuuuccuuucucaaccagggcuuugcuucccgggaaauggccccucuguuacuccagcgccuuuugcacauuuagauucugccaaauaaauaaagcagcauguuucuaaaccgaagcaguauaguuucucuauguuuuagugacauauggcuauuauggcuuuauucucgacggacugagccaaaaauaaaccuucugguuucaggcccuaacugaacuacuuaugagauucuccacacuuaaccuguuacaauggguuuugcuguggcugcagagacagcuuacagauuaugaaugcuuauugcucuugcagaagccccuggcuuguuuucccguaccacugaguggcuaaugagcaccugcaccucuaucucuaacgcccucuuauggccuucaugggcacuacacacuuguguuguacauacuuauacuuuggcaugcacauacauacauauguaguuuuauuuauuaauuuauucauuuauuuauuuguuuguuuguuuguuuuuaaugcaugguuguaguaaaucaccagguugguuugaaacaaauacucacaaugggagauggaaauuaaacagugugauaaccuuguuugaauauuuuauggaaaauaauuauguuauauaaguaauuauaguuuaaagggaucuaagaacaaugaguggaaaaugucugucuacaaauagcacuuaguuuucuuuauucuguaacucugccaguggcucacguugguaaucuuauuccauuguucuuuugugcagaacagggaaaugccacaaauauauaucagcaaaaaauuaaaacauaaaucaugcuuuuagaaauguuuauaguaccuguucauuuuacauuucuagagaauccugaagagaagaaacucuugauauuauuccauuuccucuuuauuuuuuuuaaaguucuuagcugcuuguuuucaaauuauggcauauuugagucugccucugcaccauaauugacaguuuuucuuccaaaccaaaaauaaauaaauaaauaaaaaauaacuagaagaaaguggauaauucagauaacccuaauuacgaggaagccagguaccaugggacgaucgcccgauucauuauaaaucacagcuuuagaauuuagaaaaugguguuauaaaucaugaugucauuucuagguaaucacuuucaggcaaugucuccccugagagugugugcuugucacagcagcugugucaucugaggggaugugggagagccugggcagaccagaguuguuugaugugugcugauuguacaggucuuuguugcaaggcucacuggcaguaaagauuguuccuuaaagucaaaaccagcaucuauggaaaguaagcagaaucaaaugagacauuucaaucacuugggcaauugguuaacuagaauacuuucuauucugaaauaaauucacuagaguuucagauaaguaagaggauugcuacacaaagcaaagaauuuguacauuugguguguguguguguguguauguaugugugugugugugugugugugugugugugugugugcgugcacgugcacuguuuugacauucugccaccaauuaauuagcuguugacauauuuuauuuuuuaaacuuaauaccacuuucugcucaacguuuuuuuuuuuuuguuuuuuguuuuuuuguuuuuguuuuuuuuuuuuuuuuuuuuuugccaucaguauauagucuuugagugucuguuaugugccaggcacuucucuaggugcuggggauaaugugguaagcagagagugugcucacagaacugaugguuuaguaggaaagccagauauuaaacagauaaucacaaaaugauacaacuacaguuauuauaagugauaugaagacagaaugcagagcuaaguagcaaaauugggauaauagucccuccuuugcaagacucugacacauagaaagcacugugaguggcggagcugauuguuagacauauuggugguguuauuacaaugucauuccaaaccaaaacaugaucgggugcggacagacaguacagacagcggugcaggcugugggaggagccagugacaugcaauugaauucaaguugaguuguaaggcaugaaugugcccauuaagugcagcauauccaagguauggauagauggcuauuauaccaauagaucuuugaaugauuuaugauaaugcuaugcuccuggaugggucaagacugcuggggaaggucauguugugagaggacaccuucuaaagccuacuuacauuuuucacagacacagacauagacacagacacacacacagacacacacacagacacacacacacacacacacagagagagagagagaggggggggugucuguauauguauagcugggucuucuguaggaucuaggauuugguuuguaaugauagaacuucccaguuuucauaaugaaguuagaaaucagacagccucaauccucaaauagaaauuaucuggugcucuccuagaggugagugaggcuguucugugaauccucuagcaccuguuuagugugugugugugugugugugugugugugugugugugugugugcaucccucauguguagcuggcugagaagagaauagggcauacccgcuucucuucugugugggguggugccuucauuauggcagcgcacacccgcaugagaacugugaggacuccugggugaugaauggcauuuccuggaguguagacgcuauucugagaaugcuugccccaguucuaggaggacuggauauaaaagcccugaaauuucuguucaaauaacauggaauggcaauguagaacucaguagcauuuuccuuacuaauaauagucauggcugcuguugauucauaagcuaagugccuuuccucuaaagucucauguacuuccucagauaaggcugugagagagguaggucacguuauggucaguugauggaugggaacagaggaaggugauaugucuagcaaauaucccuucacagugcugaacaugagcuccacuugcgaacucagucucuuuacuaaauugacaguuauucauauuuauucucuucuuguggaagccacagagauaccuacuugacugucucaggauggugugcccuguggcuggaguuuacauugcauugacugguauccuuugaguugcaaguuacagaaugugguugaaaucaacauagagacuuuauuggaagccggagaagaagcucauggugaggugcaggaccucagccauggugcacacaccuuucuuuccaucuuuccaguguuuccaucuucuuggcaucuugccuaguagauucuguccauggggaagcaauuaaagcaaccagcaauuccaggcuacugagcccagaaauaagagguugucuccuucaaguuguuguaacaaaagcccucgggaugauucugauuacggugguuugagucaaaugcccauuucugaagugauuacucugguagucaggugaugucauccuuaagccuggagcaaagggaugggaagucugcuucaccuaaacuccauggacugauccuggaggagcagguguucccuaaagagagagugagaaagaagagaccuaugcuuacugcaaaaccuuauccauaaaaguuugucaaguaaacaagugaaggaaagagcauucgcuguauuccagagagcauuuccaggcugcgaaaaaauaagucuaaaaauaagaugucauauaguuguacucuugacauguauuuuuguuaaguggcugugguaauaauuggaugacugugucagaggaaggcagacuguucuacagagaaggaaaaccaaguaaacacuccgguucaaaguaauaaggauuuauagauguguccauugaaucauucugguuuuguguuccucugugcccuucagauauugggcugguggguaaaaagguacuuaaugaggagacugcauuuuccaugcaggcucccagcugaguccacagugaccgagaugggcaagcacaaaaagacacugagggcucccaagaggagagagcaaguggaauuucuuggacaucuuguguuuuuaucgucaagguuucugcaaauaugggauucagcuuuaugacaaacacccauuuccuuuuggucaucaaugaauguuucaagguaguuaccacagugaagggggcacagcagaacuaaaagugcuucccaguggccucaguggaacugaagacaauaguucacugaaucuugaccaauuuugacaaacaagguugaggggagccugaaccacagauuugucucaugguccaguauuuccucuggccuugguuucuugacauuucauacacaucaauagauguuucgcagccacuuagaugagacguuuaaaauauuggggggaggggcgguggagguagcuagugagacaaagugcuucuaucaugagugguuauauuuuuauuugaucacuggugguuuaauuugaucaugacugaagugaguggucccacauaaaguaggcauguuucuuacuugucaucuaccacucuaacuugaugcuuuuguuuuuguuuuuuuuuaauuuugauuauuuuauuuuucaucugauuuguccuaugucgaaaacuucucagcuuccuccuccuccuccuccuccuccuccuccuucuucuucuucuucuucuccccuuccuccuccuucucuuccuccuccuccuccucuucuuccccuuccuucuccuccucuccucuuccuccuccuuucauuuugccuuucaguuguugcuguguguaagucugugauuagcugguucugugaaauauuguuccuucuauugccuucagggagcaccacaggguauuuguguaagaguuuguucugcauguauauugaaugaaguuuuaacagaccuugggugagccauucagucucuccugucucuugcaugggcuaggaagggguaguugcuccuuuaacagacuuucagacaagcaucuucuuuccuuuuuaucccuccaacuuccucuuccguguuugauuguguuuuugagucuuuuuggggggguguuuuucucuugucacuugaaaauggaaauugaaugugucucuuagcauguaagaacauguccugaaccacagucauuaagcagugguagcuuuuaaaguauuacucuguuucuguuucugaaacuguuuggaccauaucucuaguuuaguaucucaacaaaucucuuaauuuaugagauuuccuucuucagagaggagaugggcagucuuggcuuagaacaauguuuuuguuuguucugugaugcaugcgccauguccuucuuagccaguauauguaccuuuuagguuuccaaaaacucuggcagcaucccaucuggcuuuucccgauuugucuuauaaaaugucauucugagauggacagcucugggcaugcuuugcccauguuuccacaggagucucauuugcaucuauaugugaucaaacucauauuuuaaagcaauggccugugcuccucagauuaacucuugugauuuaccauggauucauuauccuugguccagggagcccugcugcugucagcucauaaugggaacucccagggacaaugaaugucauaccugucucugucucucauaccuuggggcuguaauuuaauauuuucuuccacauauggcacagcuuuaaggcucccacuuuucauuuacuguuucauauuacuguccuaauugaaauguaacuuuaaaaucuuuacacuuuagauaaauaaaauccacacacugugguuacuuccauguuaagauaaauugggguaguucuauguugguaaacagaaucuuucguuaaagggucuaaguuaaaccacuggauuauucuguaaucaaauaugaaacaagaaaaaggagccaaaaugcuuuauaagaugauaagaagaacauaauuuuuaaacauuguuucugggguucuucagggaguuuugaacugucaguacccagcugugagacagaggagggaauagcgcaggcuuaggucucaaaaaaucugaucuuauuaaacuacugcacauuuucacuuucacagcauauaaaaugugauaucuagaagguguuauaauugggaaaaauaacaaaaugacccaaaacaaauuagucacucugaaaggagauacccugcuaauucccaggagugaggcugucuuacaagaacaacucccugccuuauucacccaggucauugagcagaaaguaucuccuucacagaggcaacuuugcaaugaacucuaccucugguuugggccucccaaguggugaaaugaagacaaggaggaauguggggacaucuguguucuuuagucaucauccauccgucucuaaagcaccgugccacuauuggguggagaccugccuggaagaauggggugcagagaaagugacaaaauccacacgcccugggaugaccuuuucuuuugucaacuggccgauggaauccaggaagagagccuaacacaaggucacacacccgccagagguguggauuccuagaaaugggugcauuuccaugugaacagguuagaaaguggaaugguuuccucuauuugacagugucuuaaagucacucguagccaugcuguaauugugaccuaguuguaauugccugugcauuuguggcuguccaaagagccagcaagcaacacagaaugcgggauaagcaccugguuugggcugugguuguggaaaguaccuucuccuuccacuggggaauuaaaugcaaaaucauggaccugaguugucuggggucaaaacauaauugaaaguuggauuccaaacgugaagaaggaugaaauguggguuuuuaauucacuuaauucauuaauugauucugaugcuggcuuuuguucuuaaacccucaagugggaaacaugagaaaaaucuguuuucacaagaauuccuugaauagcauagaguugaaagcugagaggcuaaagcacugggucaguuucaaccauguaacuucuuucuucauguauaaaacaguggcuuaucugacacacacacacacacagaguuguaguguucguaacuugacaagauaucuggaaaucaacucacacaucugauguacaacuuuuuccuuccuuucuaagauuuguuagcuuaucuauuuaacauuucaaauguuauccccuuucccaguuuccccuccauaaaccccuuuccgcuccccugccucuaugagggugcucccacccacuccugccucagcagccuagcauucuccuaugcugggucaucgagcuuccacaggacccgggggcuccccucccagugaugccugauaaggccauccucugcuacauauucagcuggaaccaugggucuccccccucccccauguuuacucuuugguuggugguuuaguuccuaggaacucauuaauauuuaccaaagacccgcaggcccuguuugcuuccaacaagacugaaaucaucacaggaguaaaaugugaaauucugaggaguaagugaaagucucuccucuucaacuuuuuuugccaacaugcuuucaauucucacaaauucuuuuaaaaauaaauuuuacaaacuuuauuacaaaaacaucacaaacuacaauuaaccagaccugaaguccauacaucucaaugaacuucuguacgguaagaauagccauuugggauggaagauguguggcuuuacauuggauuuuaugcucucacuaucaaauauauuuuagacacugaauucuguacgugaauaaugaugacauuguagugaagaaucaguaaacuuacccccaguugggcuguucacauuauaaagcuuucuugcuggccuuaacaacaauuauguauagacugaguuccacuggguguuucuuggaucugagagaucuauaucugcaccacagucaaaauguuaucaguggagccaugauggacaacuucaaccaggacagcuuccggggacucucuuuagccaugugacuauuuuauugugucuaguuuaauuuuauacaucuaguuuucucccuacaaaaccuuacuguaaguuaguucuucugagugaacgguuuuaacucaguuaauauuugaagaccccaucuaacaauuuaugacuuuuacuggaggguuuuucaagugacaccauucuuucugauagcaguuccacagagacucaucaaaggaacgccauguugaaaugucuugucuaaaaggauggaccaucuagagacugccauauccagagauccaucccauaauuagccuccaaaugaugacaccauugcauacacuagcaagguuuugcugaaaggacccugauauagcugucucuugugagacuaggcaggggccuacaaacacauaaguagaugcucacagccagcuauuggauggagcacagggcccccaauggaggagcuagagaaaguauccaaggagcuaaagagaucugcaacccuguaggugcaacaacauuaugaacuaaccaguaccccugagcucuugacucuagcugcauauguaucaaaagauggccuagucggccaucacuggaaagagaggcccauuggacaugcaaacuuuauaugccccaguacaggggaaugucagggccaaaaaauaggaauggguggguagggaaguuggggggaggguaugggggacuuuuggaauugcauucuaaauguaauugaggaaaauacguaauaauaaaaaauuuuuuuuuuaaaaaaagaaaugucuugucuagagguugcuuaucuuccuguucuguaugauggacuuaaaucggucacucaaggcagaaaggaaacaaaaacagaguuccgcuuucccaggaugaauguuuuucucccuuugggcuuuucaacauuggcguuagaugcugucugagcaguauaggagcuggcgugggcuacagagcagaugcgcucaaaaauuggggaaaggcuauuauuagcuauacuaccuguguucugauagacagccuaggaugucucaggaugcugcugugacuauaauauccugugcugaagccuuuggcuguuccuggaggguagccugagaaacugagccuuuacgucuauaaagggaaaacagcucaacauacuggccaacaugcuagccuucugaauguguucauucauuuaaaaauaucuuagugccacgugcgaucauaucuucaggauuauuaccauuugucaaaaacaguguagaccuugaaauuugugggggcaggaagucuucacugggugcacuuaaccagaagguuuugcaucacuguugugugugagagugagcauaaccagacacgaggugcgggguucucagcaagcgugugagagagugggaugcgguguuugcuuucuuccagaguccauggacaacagaaagacuuuucaaagacuaugaaguuuugaguuugaaaaugagaucaggguccuagagaggcuucagggauguagaaggugaaagacuagcauugacuugaaggaguucauuauuugugacacuuuacaaggcacuagccguguuugcuuuuauguaucugagaaaagugggacaggcacagaugacuugagccuaagcaugaugggacacuuaacuuauucgaggcaucuucauuguccaaugugagccaaggccagcauguagguuuagaagauaggaaccacauuuugauuuaggauauugaacugcguuuuguacccaaaucaaauuauuaugauuuuuuaaaggaagcuaaaaucaucuaauaaaccaauagcacauuuucagaguccauuuaaacuggaaccaaguagcaugucagugcauccccugcuccaauucuaagcuaaauuaguuuucuauuugauucaugucucuagcugugguaugcuaauuauggaaccuucauauauauuuaucgaagcaggauccaacugagcaauucauuuguauuuggcuuuaagaaauaacuguuuauacuugaaagaauugaugaaauguauuuccccagaaauauucuauaaaucaaguauuuuuaggcagauggacuuucuguaaagugaaugggacuuagagaaucuugauucauauugguucauuucuacuauucuaaugaauaacagaaucaaauaggcuuugaaaccagggcugauaaucaaacuaccuugccucuucuuuaugaguuguguucuacucccuggagugccguugccuaaugagcaaacaucagcuguauaccugaaagaauaaugcuucuuauggaaauaauuacugauugauaauuacugccuuuucugcuacggaaagauguauucugugcccuuucuuucucuugcuauacccaagucaagcuggaaagcucaguugguaagaguaucaaguauuuaauuguacaauaaauuuccugaaauaguagucuaauuaaauucaagcaauaugcacaucaagugaacaguacauacuauggggguguuaguaagaugugacucauuuaaugacaauggagucagggacacauuaaaagucaagggucacuugaaaugguaccuauugaagacuguuugggauaucggggagcuacaugaucagcaaaggauuagugaugagcaaagcuuucaggcaagugaaagaaugaaguugaauagaaaaguaaugguaccaagcaaaaguauugaucuauccuaugucuaccaaccccauggcccacacucauucaaacuacgcauucuagaagauuaagaaaagguugaagaauagauucagauggaccaauagaaucuaagaagaggugauggcaaaacacagugugugauccugagguaggguuuggcuuuguuggggguggggagaggguggggcaggggcuggaagaauuuacugugaauauuaaugaaauuaugauauucuaauauuguauugguguucaguuuccugaaugucauaaauguauugugaguauguauuaauucuguagggcaucugagacaaauaccacacacuaguggcucuagugagacagagauacauugucucaugguauuugggccucaaagucugaaguugagguguugguggccuugggaagccauuccuucaucugaagcugugccauuucuaucugcccuaucacauuuguggcucucuccuuguguuaauacauagccuuguaaaagcaucaucuauugaauucagcucucccccccacacacacacacacuaucuaaugcaaugguaucuucauuaauuacaucuguagaaaucugaaggugaggguuguuguuuguuuguuugcuugcuugcuugcuuuuugaaagaagacauuauucaguuugaaaccgagaacaaauaggagaaugucuggauuucaggagagaaagguugacgugcuuaggaguaagggaucauggugucugcaccuuacucucuuugguacugggauaauaguuagaugauuuugcauuuguggagaagaaaacaagaaacccugugaauaauguuaaaauuaugaugucugucugucugucugucggucggucugacuauagagcuuuucugacuucagucacaacaguacugcacgucccuguaugacauuaagcaggcuaaagcaccaggaaaugucaucacacuuaauuucuuugaaauaagcaaaacaccauucugacauuuccauauuuuauacauaauuaugaaaguacauuaaauuuuuccuuagucaaauuccagggcaguuuucacaauaaauguugggcauucugccaaaagacuuugauacaugaugccugaccuaauuucagugccccagauuaaacaucauuucuuagagaugaguaagauuuuuaucccuccugauuuuuuuuucuucagaaaccuuacuucaggcaugaucacagauauuuuucuuggacaauucuauuuuuuuuuaacuuuacgcacuaaugcuguugcauauaaugauauauccugcacacagaucugggugacauuauugacauuugcuuuguuucucaguuggcacuugcagauuguaaagugcaaucuauuuugcauuuccuaaaauauauaaaacgcaguugugcaaagugugaaauggagcagcccuuugaaaagagagguauccuggcucagggcaagccuaauggaaauagcagucuccccaagcagauggugcuggcuccucccaguccugcagagggccaagggggcuuguuugugcacagagcuugggucucauggcaagagaacuagcuuguaaaguuauucccacggggcucauuuuccucagcccagcgucacccuggacacaaucaaaacaaccacgugguuccuucauuucuuuaagaugcaugaaugcugcuauaaagaaagaccuuuguugaacagugccucaugaugcagaaagaauguugucaugauauguaaaaccauauguuacgaaguaggucaugacaguugaucgagguccauuuuguagugucagaguguccauaggagcacaucaaggaaccaguuauuggaauaaaaggcugaacccccagaguguggggcauucccacuagacuccucuguaaagggcagaaauauguucaaggaaguacacauguaagaaaugaaagaaaacaugauuaagagaaucugggagcuggaagcauagggcuggggccagcagaguggagagcuucaaagcuuacucugguccuagagccacuggucuacaggaaguacacccaaagucuccuggugaugguugccuuaaccuguguaugccacagcagcauucagcauucugucaaccugcauccugcacuucacgggauuuccauacaggcccugucacuucacaguuucugcgaaagaucuuaacacacuucagucucaugggcaucauucuaacuacuaucuuguauucuuacaguuucccuucuugugcuccaucuucucaguaaugcuucauucagaccuauaaagacacaaauuacaguuuuucauuguagccuucaauguggucuuugcagcuguccaccccaucuccaggggacaacaaccagaagcccagaagguuuugguggaauagacuuagucaucuaaggcagcguccucugucauugacagagaagcaugauagggaagucuuauuacaaccaaauacugcaaaaguguuuugauugugacccuguggcauaguagacacuuuaggagagcuggcuuggcugacucccaacuuacagaucuagauagguaacuggggcuaagcauuacccuucaauucucaguguugaggucagugcccccauuuuaagacguuugcuauaagaugaauauauagagaagacuuaggaauggcaggcugagagagcuuagauucagcagccuggaguuauuagucauuggguaggcucccugugaguagagccaucccugugaggcugaugugccaagcuuuaaauauuuaauuuaaauagauuggaauccaauaacagcugcaacuggaaaaacccgaggaaaugcccauaaauggcucacuuuacuaagcccauucauaggucuauuuaggaacuccaguuccugugaacaauagcaguaauucuugggcccuuacuauaagucaggcaccaagccaagaacuuugacaugucaccccuuugcauccacacagcaaucuuuugaggacaauucugcucauuaucucuauuacacaguugaagggcuuuaaagaugcuaugugacuuuuuaggacucucggagguuggagucuagcugugacuuuaaacagugggucuuucuccuggggacucuaggucucucuuugcugaugcugcacccuguccaauccaagugacuuuuauuuggcaaugacuauucacugugugaccuugugguucuccaccgcucuuuaagagaagaauuuacaggacauuguuuagaacugguagaagaauaccuaagaagggaaugaacgagaugcuuuaggaauagagagcagaaccugagaugagugcugguugcucaauagcuaccaccugagagucuuuacuugagacccugaagauuaccagacaucuagucagcuggagaaaagagguaaugaauuggcucaguauguuuauuuacuauucuagaccauguccucugguaggggcagauuaaccaccuaacuucauaugcaacauaguggacacugguuaaaaaaaagaagacagaagacauauguaaacacauguguuucuugaucacaggucauuuuggcauauaccagucaagccaauggucugugauuucugugugugugcacuugugugugugugugugugugugugugugugugugugugcauuugugugugucugucuguagguaugcguguauaugauguucacauguauguauuacuuugagagcauguguacgcaugucuguggaaaccugaaguuggcaucacacaucucuaguugauucuucccaccuuauauaugagguaagaucucaugcugagccuggagcucaucuuuuagccuaguagacuagcaagcuugcucuggggauucccugguucauucuccagaucccugggaugaaaggcaggccauagugccacgcccacccaccugggcuuccagggauccaaacuccuguccucaggccaucucccuagcucuaagggucugugguuucuuuguugcauaguuuucaccagugggggcuuauauuagaggacucgguccagucuaaguacagagcccacaccuucugcucuuaugggcaucauuaagccuucuuuuuagcacaaacagcaggauagggguggccaguuagauuugggggugggugcuuguuucuuuucuuuauguguucuuaccucccauacuucaaaucuauuuuuggaagagaugaagguuuagcaaaguuuuguagccuguuucagugacccaugaauuggcugaugcugcuuugaaaucacguguacaauuccagcaguuuacauggagguggaagaaaagacccuucuaauuuuucucuuguugcaacucuagcucuagagggcugcagucagagcccugggauccugaaaugcagugagguggauggggaaaagcaguuaucauaacaaaucucacuugacuagaaguagaauuguguugaugucauuauaaaauaucuguuuuaacuagacauaauguugcaaugauuuuuaaagcuuuuagaauuuuuauuugcaggaugucuccucaaccuuuaaacaggaagaugucugaaacaauaucuagccacgugacucucagaaaaagaaagguugcuauuucccuggggccacauccagcuuauuuagcugguagucaauucccagggcuacagugacgucaucaauggcccugaugcacaaacaaaaacagccuucacuggcgucuuuaggaaaaggaauuauuauacuuuuguacucaucuuaaaaucaaccaccaaggugcaugugugcauguguguguguuuaugugugugcaugcgcucaugugcuugcaacuacaucaaccauuguaccugaagcagggaaaaguuuagagacaaagcaaguaaggaguuuuauuucuuuugauagauaacaaugauaugauacauguuaugucaacaucacauccuuuugucuucucauauuguaucggcaaugucuaucccuaggaaaauuuccagcaguucaauauucgaauggacagguggccuucacauaucuagugugguugguuguauacaguugagguucagcugaauuccucucucaucuuuuccaacaaauagcuauaaagguuggaagaaaaaaagauaaaagacuuaagaaaaaauaguccccuuucucguaucuugcuaugguuacucucggcaguuguauuuucauuacaaaauuucagugcgguaaagauauaagauauaggacagagagcuuccaaagggugguacagugaacaaaauucucugucggucucugucucucuuccccucugcaacucugucuuucugucugucucucuaucucugucucuccccaucugucugucugucagucugucucuuucucugugcauuugugugugugugugugugugugugugugugugugugugagagagagagagagagagagagagagagagagaguuucaaaucaaacccuccugucuaugaaguguguaccacuguaccauugaauuacuccucugaccaccugugauucuaacugggggaauaggaugcagagcacguuuuguuccuuccauguucuagcuguccaugaguagagucuguccauguggaacggccugcaugaaaugugauaucugcccaugcuuaaggggagugacaucucaugugucauuaugucaguccacagcacccucugugguagucugugguccuuacugagagcaagcuagagccugcuuguguagguaacacaaagagauauguacagagacugcaggagugucuacaaacuuuugagaacuuugaguugaaucucuugcugaacuucagugcuggugauaaaaguucucacagaaauuguugccuauucuuggaagccuugcucauuuccucccaguaaucaccguuuuccuugauuucaucucugauuuccuuuuucuauccauccuuaaauguuggaguauauuggcuauugucucuucuuuuucauucucauuggauaaagcauguguacaccuguaacaggcagcaucaccuacuuucuagucuuuguguagucaacugccuuuuacauguaacaaucuguaguuuccacagacaccuaaaugucauauaccuacauugauguugggaauuuguugguacuuccauuauguaaaacagcaugagaccaaaacuuuccaagagcugcaaauagaauuaccauaugauccaguagucucaauauugguuauauaaucaaagaaauuaucauaucagauauuaucuucaugccuguauuuuuuggcaauacuaacaauagccaagauagagaauccaccaaaauguuuacuaauacauaaaugaauuggaaagaauggggcacauaguaccugauauguauucaaccauaaaaaguugaaauuguaucauuuacagaacacggauggaaguggaagaugucaggcuaagugaaauacagagaaagaugaacaccacgucuucuuacucaucacaaucuacaaaaagaugauuaaauuacaauacuauccccugucaauauguacaaauacaauacaucaaaaauaacuguuuauauaagucaagcaaagcaaacaaaaaugucucaacucguuucacauggaaaucagaaacauuuguagagccaugggcagaguuagcuacaguaagcauggaggcucuguagcugaauggaaacuaacccauuacaguaucuuagcacucauaacacagagaccauuaaggcaaucuuaauauugaaacgguacagaguggguaacuuuuugugguaauaaaaaagugaacuuugaugaaaauaguuucacacgggucaaauacaaaacuuaucugcuucuccucuccuuccacuccuuaacaagagucuagcaugugcuucaaucugucugcauugccuaucucugugaaggcgggagucuuggacucuuaugucucugucauucaucaccuacuuggcccagauugcuuucgucccuccuacuacuucuagauuauguaauaaaagguguaacauggcaccuuuuacuguguuugacuuuccacccccuuauucugacugaagaacuucauucauuuuccucuaugucaggacauagacagacacuuuauguccuugggaaucaagccauuucuuuuggagacagcuaugcaguucgcuagucucacugaugccuccgcugucucugugauuucagcaggaucugucuuuucuuagcacuggucucgcugucuuucugaaguagcaugaaguaagcucccaggauauucucauuacguuuguauccuagccuugaauauucagcuugucuacagacaguagccugauguaacuggaagaacaucagacaggcuguuccuggugggaggaaccacgggauucagcucaugaguagggugcccugaaugagggugaaguuucccacucacccgcuuagcuguagggucucagaugcucccaaauaaggcuaccuuguuuguaccuuacuuuugaagcauucuuuauauugaaaaaagguuuauuuuauagacuauaaugaaccuuuaauagggaaggaaaaggaaaccucagagagauggggaugccucuuuguuuguucgaagccuggccuugcucuucucauuguagagcuuuggggaugcaggucuccugcagaaugaugccuaguguugaaagcaauuuugagaugcuuagaaucaaacccagggaugcacuuaugcuaauaaacaaccuccuccugaguugcaccccaguccuauaaaguauucucacacauaucuuuuuauuggauguuuuauuuugcuucaagugguuuuuauuuaauguaugcuauuacuauugucuuaacugguggcuacuauuacucaucuacugcuagcuuguaaagugagaaauguuucaaaauaaaagucauaacaguaaugcuaaugaaugauuaccacaugugagcaucuguauuaagugcuguguguguuugaauggcugcauugacccagugaagcagacauuccuaugcaggguaccaugaaugugaugguacauucuugcuugcuugacguuuguaggcacucuuauaggguauacaguauugguuauugggauguucugauggaaauguuugauucagggucuaagaauaaagaagauguuguagaaauauguccugggcacaauuuagauguuugauucuaauuggaaacagaauuaagguaagacauucuucagauuuggggaugguggcgguuaagucagguaguaguugauauaagagagaauuuuuucaauuuuuccuaaaccugagaguucauuggcuuuuagggacuacuguggauuuuucuaugcuuaagaauucaagaaagauaguucuuauugauguauuauaucaauuaaagccccgacaauaucucuuuuaugcaaaaaggcaacuaacaaugucauggugaucuucuaauugucaugacagugaauaaacuggcucaugcaggcuuacccaaauugucauuugcaugguuauuguguuauaagaauaguguggcuuuuaaaacccugcuagagacaguuugacucugcuuggcugggauucaggacaauaauggcuuuuacuagacaguacuaaagcccuggcauaaagguagagaauuaaaucaagcuacagcuguagaacagaucauuucugugcagucgggagccaauggggagccugguuauguguuaguacaaugagcccaucacugaagugcucagaggggucuguaaaaaguagcuugcaguaguauuuauguaaucagcagaacuaacagaaacucauaacugugauccugguguuaguccauuaaguccaaaggagagcuuaaagauacauggagauuaaguguuuucugaccucaguuacuucagcucacauaauguucucagugcaagcacacuggcuuacgacgacggucagugcaguuuuggcaggcauuucucauggauaaauaauguauugaugguuuaugcagcuaaugaaaaggagagugcauuucucagugccaacugaggugcugaguucucgguauguucuuauuugucccucuugggcaucugugaggauccccagccucacaggaagacaaugcugugcuugucucauggcuugugggaugaaggauugcagcccaagucuucauauaaacccaauguuagaauccagacauccuguuucuugagaacugaucaugagugguuuugagaauccaguacagaaaauaccaaccacaucauaugagugagcgcuugguauaugagugaccaaaagccuaaauaguggcagauucuacauaauaguuguuucuuuuggauaaaauuaaugcaaaggagcuaagcaauucaggguucuggaauugcuuggcucaguguccucucuagauugacauagauggucccaaaacagacugauuuaaauaaugcugucagggacccaaguucccauuuuucugguaucaguccuuuguuagacaucuaccugauggcccauuauggcuacuagagcucagucauuacaucacagcuacauucuggcauguuguaaggaggaacugauaaaaaggauaaucuuuuucccccuuaugaggaaacuuguuggauguuacuugucuuuucaucagaaacuuggucguuugaucaaugcagcagagggcacauacagaauuccccuuucaacuggauucuuucaugauaaauccaguucucaguaccauggaagaagagguagauugggaaguggagaaugucacagucccugggucccacauacucauaucuaaaucagagcugcaaggacuuugaugaaagguggcaucucaacguugaaggaaucaccacguugguagaagucguacuuugguggacagccuucauuauugggagucucuuugguaguugauaaaaaucggacauuaaaacaucacuucccucugagccacccgacguuucuuaugcaggcaagcaggaaugaaacggaaaugauuggaugccagcucccugacuuuuauagcagcacauucagcugccuacccacaaagcacuuccccaggaaguugcagccaagaauuugcuuggccaggcuuguccaguuuucauucauuucaaugaccaucuccaggaaaaaaaaucucacugaaggacuuagggaguaugaauagaaaaaaaguggcuuaaagcuacaugggccuacuugggaauuucaggauuuuccauccucucuguacacaucuguguucgugucuuuaagcucaugacaacaugugaauaugcauucaagaucaaguugaccauuucagagucaaggacacuguuuucuuguuucggauggaaacagcagagaauucuuuugaaauagcccuuuuuuagacucaggacagcuuuuggcauucagugaaccuuguguucaacccuguugaggugucaagguguaucucauguguaugggaagauuucaguugauaccuucaaaaaugcuuccuaggcaccuuagacacaagccaguaagaacuugcaggaccccaggcuucucaaggcacuugggucuagguuucccucccugaugguaugucuuaugucaucaagagguuccaguaggacauccuugagcucacuggaggugggagaauggaaaagggaaccuaccuggucucuggaauugcuuuucucaaugucuaccacaaccaucuccagaaaggcuuggcugguccaaggauagguuuggguccuuccauguaugauuccuucuuuagggcagggcaaguugugauucuuaccuucaguucugggaguuagcugacauuuggagccaaggggugaauucuccuucuauaccuaguccugugugugguucauuuuauaauuuagauaauuuuagauaucuagguuuuuuuuuucuuuuuguuuaccucuguuuguggucuguuugcuuuauccuauggcuauuagagaccuuuauguguuuaacuguauucccuuaaauauccagugucuaggaaaggagcccagacaggauuagauccagucagcguguucuaaaaguuccuugucuaaucagcagaaucugcuagauggcuuucuagacaucaacacagccugacaaauuguuugaaaaaaaaucauacaacaacauauguacuuuucuuuucaccucauuauguuuuauguuuucagcaguaaaaugggggauuaugaaacuaugacuuaugguaugguuaaaaaaauaaacaaacaauuaaagguagggguaauuugccacuuguguuuugcuuaauacauuccagaaagaaucuggaauuaccuacauuuuauuuuugccuaaaacauguccuccauuauaaagguugucuuggaucucuucaccaguggauacaaaaccaagaaaaacagcaagugaacugauugaagacaguauaugcuuuuaaacaucuuaaaugauuauuucaaacacuuucaucuucugggccaucuguuccuuugucagguagagacagugaggaggagagcuguuugggccaguguugaaaucauucaacauaucacaggaucugacuggcacuggucuucuaaauugucuccucuuaagcuucaggaaauccugucaucaguuaaaaauggcacuguagcuaaacuguuugaccauuuaguauucaaauugauggaaugaaaugguuugcuuaacucacagagcaauugagauguuucuccuccuuuuuucccaugauauacaagaacaugcucagguggcuccugaugucaggaaugugugguaguggcuugcacguaucucagagugugggaagcagagagauacaaggaaugcugacacucaucuggcuuuuucuuauucuuccuuuuguguuuagcuuagguccccaggcuauaggaugcugcuacccacauucagagccaccaccuaauccuuucuggaaauacucgaaacaauaagucucuuagguaauucucaaugaugguggaaaguaacagagaaagaauaagagacacacagauaaauagaugugaauacaugcuugaauguauauguguaggcagguaguagacagacagacagacagauugauagacagacagacagacagacagacagacagacagauagauagauagauagauagauggauguugucagucuucuaggagugggaaacuuucugaguuacuuauggugcuaaacgcgcuguguaccucugcacaguuugcauauauuuuuaaguggguuaccaucaucagcuaaugcuuacugaacugucagcaaauauuuauggaaugccugcugugcuuaagaacacuuaugaagcucagagcucugaguuaugagugguaaggauuuugaaaagauagaauucuaugcuuuaaggggaauauuucaaaggaauuaugaauuaauuugaaaaaacucaggggccuucuuagagaagcagcguacauccuagauacacagcauauaaaaccagaagauuaaaccaccuggguaaucauuuucuuucucguuacucaacaaaugcggauugugaaauggccagagacucaugguggccaggcccuaccugaccucacagaggaccaaguggacaauccucuagcauaaggaagugcauugccugcauggcuucucugggcuuuuguguucucugauaaagcugguaaucuuucucccaugucagcaggcgcuccuacccucuugaaaaccuuccagaaaugaaggaggagcggucacagauucacuccugagguaguaauucucucaaggacuaagacagggagcugucaacauacugcuuugaaacaacuagaaggaacuuucaagucucaguuacuguuguguaaugucugacaaaaacuugugguuugggguuacaaucuguccugguggugggaaaauggcagagggagcaucagaggcugguuguguuguguggcagccaaaauacagagagagcugggugcugcuacucagcugucugucuccuuucucccucugcauucguucuggggugcuaguccacagagugccgucaacccuguucacauuggguucccuuaguuaauccuuucugggcacacccugagaaauacacucugggguacaucuccuaggugauucuaaauccagucaaguugacagugaggauuaacuaucacugauagugaccacaaggaugcuacacccuuuaaaauguuccucugcggauggaugcuuuaugugggagaaagcacaggcucugggcucagccccacaaaugaccggaugagugacuuaccaucuuuagagucaccacaauaaugaagauggcuaaucucaguucagcaccugcuugccacucaguauccaucaaagcugcgccgacuuggaagguuuuaaucucuaguuugcagcagaaaucaggcuaagagugagcaggcagugucccugucacaugaguagggagcaggucuggacucacaacccagccgucuuggccucugagcuucacuagcuccuucagaagaccagcaggacugacuuccggauguuggcaagcaggcuaauagaagcacugaggugagucacuuucucucugacugcuuuaauuuuccaccucuagccaaagacuuaggcucaccuugaguacaacaaaaaauaauccaguaagacaaaauuuaauuuauuuccuacugggcagcucccucgcacacccucacuuaccucauacacacacacacacacacacacacacacacacacacacacacacacacacacacacaaauagaaauguguaauucauuugcccuauaaagacaacuaugcaggaucucagaguacaugagauauguccauguaggacccaugucaggggaggacacagguacaaaugaccuagagggaacucaguagaauggugguguagguguucagaaggcuggcgucuaaucaacaaaaccaccacaaccauucgagggaaguugcucuucagugugauggaguccguuggaagcccugaagccgcagcucaguaauaaguaaaucuugauuugugaagaaucauguucagaugaucuccugaugcccugaugugugugugugugugugugugugugugugugugugugugugugugugugagagagagagagagggagagagagagggagagagagagagagagagggagggagagagagagagagagagagagagagagagagagagagagagagagaacacuuuaauuuauuuuauauuuugguugugagccuagccuuuaacggcugagccaucucuccagcccuaacuuuaguuuuuuuuuaaaacuaucuagacuuuuaaaaucuauguuaaaaucccucuccaucaugggcucacugaugugucagugagacaggugucucagugacauggcagaugccaaacauuaucuuuggacauuuacuguggugacuuuucacccagauaugcaaauaauuuucucacccagaucuucacugaggaaauuauuagaggagacgccccaaagcacugggauugcuaucacugcaguaagaugacuuucuaagaaugacuugaguuccuuuaguaugacuucauuucaacugaaagucauuuaaaucaucccauuuuugagguccccugucuugauguuaauguguccuguuggaggccaaccuggguuuagauuuauauggaaagccguaggaaaccccuugcugauguugguauggaaagauacgagacacauuaguccagaggccuucucagauugguacauuuuucccuauaaucugagaaggccucuggauuaauguaccauuuuuuccuaaauuaccaaauguggaaguugacacaucccaaaaccagacuauagauuaaugcauccugggcaggucucucuggguggaggagcuguccauauaguagcuucgcuuucuuugucaaauugugucaacauuuuucauuugcucuguacugguuaauuauaaguuagcuaaaaauccaaauaugugcacauuuacauuuuaaacauaucaauauugauauuuuaugugcuaucagagugacauuuucaaucccaaguugcucagcuagccuccccccccccccgccccuguauuaacauagggaugauaucacagaaggauugcucauguauuuacagugcauucaccuuuuauucucagcaacauguaauacagcccuuuuagcuaaagagcuaaaaguaucacuauagcucagaaaacggauacauucuaaauauaaccugcaaaccuauuuccuggguguuaugagucaaugaucucagucuuagugcagauacaagcugagaugagagucaacccggcuggcauggcuucuuuagcauagauguuaugagcaggucuuuucuaugacaagauaaauaauagauacaaugcagaagaaaacuugugcagcgacuguuggugggaggcagcacccuacuccaugaccaugaucucaaggucuuccgagaaacaguaacucuagguucccuaaaaagggaguuacccugagaugggcuucagcaaacuaagugagaaagucaagaaagccggugagguggugagggaaguguguguaucuagaugacuccagagagaagugaauggaagccugcugucaacuggaggguuaaggaggagacagauuggaguaggaaaauucagggcuccugaaauguggcaucucuggagaaguggaucucuacucuauaaaagaaagauauuauuaaagaauuuaaaauuuugacuucugacagguggguagaugaagggaaaaacaacuagacuguggauuuaaaaucuauauuuaugcauguuauuaaaaugaacauuuuuuaauaauuuugaugacaacuuaguuauuuaauuuuacuuauguaugccauuuaauuuuugugguuuuagguuuagagauggcaucuccuguguaucucgggcuggacuuuaaacucacaguccuaaagauucaucuccuugaauacugggguuaucaaccaugccuggaauaggaauuaaauucauuuuauuuuggcauucuuuauugggggaagugagguagaaucccucuagguaguccucacugaccuggaauucacuguguagcccaggcuacccucaaacuugcaaggguccucuuguguuagccucucauguaccagaaucaagugugugcuaccaugcccagcuaguaauuacuuuuaaauaaaauacuacuuuguauugcaaaccuuuaugugugcauaauaauguaaaucucacugauuuaagcaaaaaaauaaaccacugagaagaugaagguguuuuaagaauaugaauuuucagcuacuguaugaaauuaauagacauaguaauauucauuugaauggaguauuucgagauuuggagucaugccagaacaguuucauaaaagauagcagaaggugggaaugagaguagugggguugguacacugguacucugggauaaagcuuuuacccggccugcuucucuuucagagaacacucuguuuaauaauuuaguagaauagaauauuggaacaauacuccaauuuaaaagaaauaaaagugaaaugaacugaaguaguaaggcuggcaaaggaaauuuuugcccaucuuacuaagaaugccuggcuuuggccuuugcuucauugaugcucuaggaccacucaggugugauugcacaagugucagucagggacaugaagagguugguugugagucuuuugaccucuuacuagucauguaacaugcuguggcaacacaccuacugugugcagagggcuagcaggauugauuuucuuuaucugacucucagaaagaggguggcaccucucuugcugauagcuacuauuggaugguggcuaaguaacuuuaacaaauuuuacuccuuuguguagauuugaugaccucagucauguuggaacaaaaauggucugcaggucuuugauaaacauucaugugaguuguacgucagacgugcaaguugguuucccgauauuuugucuagaugggaggaaauccuucuguugucuguuacagaaagucguacuugaacuugugaaguguuuuauacuugaagagaguucuacuaaugggaauuuacuugauccuugucccacuggggacugcagguaggauacagaaaccaauaaagugaugucauuggcccaacugugcagcuaaacuuuguaaaaacuagcauucuucuaccaaaggaaguaauagacaacaccuauacugcuuagguauggcaagcauuaauccacauuacuaucauccguuacuccccaaagucuauuugauacuguaauugucagcucuuuuguuuuugcuuuguuuuguuuuguuuuguuuuguuuuuuuguaguuauguuuguaaggguuccacagugaaucagagagaaccucuagucugagcaguuuggucaaccugauccauacccagccuuguuuggugcuugucucuaauuaaagaugccacuguugcuugacuaacauggaauguguuuccccucagcucaccugaagucauagccugaugcucaccuaacacuugcaguucuuagugauuuuucucacacuggggaacacuaggcucuacuacuucaggacuacccuggggccauuugagaccgaagaaucacuaacaaaagcacagcacugugaaaaauguagcgcugaauagagcaugaaagggaggcuuguuuacaguuuaggagcugaggcagcaaggcagggccuugccugguuugaccucugcugggaaugugggauuuagacacugcucugugcaugacccaaagggcuuuggugggaucaauuugggaggugaugccuauauuuuaauggguuugcuuauguauguauagaaucuacaaaugaugacgacuuagcuguaauaacaaauacaucgaaauuugagucauagacugaguaaccucucgaacuuccaugaaaauaauagaugcuaggauugauuccuaggcucuguguguguuuggguaagcuguguuaucugcccaaacaagcccccgcuuagaucucuggugcuuacugugcccugcaugugcagcaaguuccgcuucuuacuacuaccauucaaggaucccauccuccucucuucugcauccucuguguuucccacaaucccuugcaucuugucagccaaccuaugugaagucuuagagaugugguuuagcucaccugcauccacauugcuuuuuuagugcucuguuaggaaggcuggguaauguucuauucuuuccugcagaagcagaaaaaggagcuuggugaccacacccaugcugccuuucuuuuaggauucaacucuaucccacgcuguucuguauuccaugugucacauugcuguuucccaguaagagguguugggaauggucauguucuagcuguugggauugaguggaacaaaauugaggaaacugaggguuuguuuucugugcaguaaaaguuuguuccucuguaagaagaaacuugcuaaugguuuucuuauucuuagcugguuuaucagcaacaucuuucaaaaacugaagaaaaaaaagaguuugccaaaugagaugcuuugauuuaaaauuaaaauggugacagaaagccauuuucuucccucuguaaauuuucuguagguagguucuugccucuuguaauucaaagcaagcauaauaaggaauaugauugcauggauuuugcuauuacuuuugagguaauugccagaucggcauacacaguaauuuguaggugagaggugaucagaugugaacauuuccacucagucaucucccuggaauucagacacaucacugcuucuggcuuuagaauuaggagcaauaauugcagcccugggaugagcccggaaucugaaauaggcuauuuccugagugacggguacugcugugggcuuacugcgggaggccgagcugagcagaguccuguuccacaccauaccccggaguaauggcaacagaaguaguagcuauuguccucgugaugguaguagugggugucgucauugucucccuagcaaccgcaacacugccuuaguuguuauuuugaaacucagcagcagacaugcagaugggaugggguugagaggggccuggcuucaggauuccauauggggacagaaugaaggaguuuaucacuugugaccucacuucggguuuaguuucccuucaccuucaaugaaaagggacacauucuuuucaugaacucugaggaaagaacagaggccguucucuggagaauugaaaagcucccaugaguuuaaggcaaacaaaacccgaggcuggguaccuagcaccuugcaggagccgccuucuuaaagaaagaugcuuuucuagaucccugggacauuugaugaggcaggcuuuuugagaggcucuuuucuuauauuggugcaauaccaccaccaauaauaauaaaugggcgaugauaaugauaaaacuauaugauguuaacuacuugggaggccaaaaaacgcuuacccagguacacauaugcuccuaaugcuaauauacuguuauacauuugauacuuguaauuuccuauuuucuauuaugaauguguguaugcuuaauugcuucuugcccuuuucccacaguacaacccucuagucuugaauugaaaagauagagagguagccuugugucccacaaauauucugcgugaucuuuucugagauuuugcaacucugcugucguauaaauuacucuguucucuugcggcccuuuugugaauuaauguguauucuguuggccaucucuguguuuugcaggguuguaacaugcaauccuagcggaucccccagaaaaaugcucuuaaaaaaucaaucccacugauuuuuuuuuccggacaauuucaaagacuccuguccagccaaguuuucacauugcagcccugagauuguuaguguugucgacauaauuuguuugauaucauucaacaucccuaaggcgcgggaagccccugagacuuagaauuugcaauuguugaagaucagguuuguaacuuauccugguuucuucaagauuuggcuugguuucuuuaaagguucggucuggggucuaugugaauguacaugauugccguugacagaauaggacaauguaaccucagguuuaguguguccugguggugggaagagguuugaguuacuuucauuuuccuuucugugguguuguagaugauaccuaauaagcuucaacaugcuugggagguacugccucucagccccagccccagugcuaagaaugcuaagcaguuuguuuuguugucuucuuaaguaauuguacgccugccucucucucucucucucucucucucucucucucucucucucucucacacacacacacacacacacacacacacacacacacacacgaauguguugcuguguugcucuuggccuuguggcacaauagacauaucauuuucuuuucugcuuuucucucuccuugagaggcuggggaacuuguuacauucacuuauaagaaucauauaaagacaaggugucuaacucggugauagaguguguuuagaauacacaaagccuagaauugggccacuaucuggaaaacaagacaccaccaacaaagaaagaaucaaccccuccaaagaaaaacucacaggaacccuaauggcccauauccuuuacugcccaagauaggauccauacuaauagaugaguugagggcauaucucgggcuuaucaagauaucuuuccuuuuacuaagacaggaagccauuuaucauuguaucauaagaacaaaaugacuagccauaucccccaaguaagacaauuuauuugugcguauaaauuguucaugagcuuuuguggucacucuugcuucauuguuuuuaacaaugguuucgguagaucuaguucaugugugauuggaagccauuuccaaucugugaaguagaguauagaaugagacagaagaagaugauaaaauauuguuuuaauaaucccuuuccuugguugucagcagcuuuggggauucacaaauagccuguggucuauaaauauuaaauaagggauucauuacuggaaagugucaccacaacuagccaaacccagaaccaaagcgauuuaagucaacaugaugccuuugugaugagaaauuuugagcuuagaaauaguuucuucucucuuuaaacauuucagaaugugugggaaaugcucuguuauuauaagaaaauagucuggagucucuguuaagaaugcucuguuaauaaccucuaaacagaaucuaccacauuuucauagucaauaagguaauggagaaugucagauuuuaucucccuauucuuugauugagucaagaucaugaaacaaaguaagaugcagcaaagauauuuaagcacggagagaaacaguugucacacuguguacacugcucuauaggaaaccaauugaaacaccauuagucuaucuacugaggcuuaguucuacaucugugcaagcaauguuuucuggcuuaguaacuuggguuauggauuuuuuuccccuuggaagcuuaguucuuuugaguuuagaucaaugacauaucuuacguuucgucucaucuugagaugaggaggaaggaaugagcccaguuggaaccuagacaggauccguguucuacgaucucuuacugaugggcagggaacgcucugcaccucagcaccacuucaggcaucaucuuuugucuggagacagacauuuguaacuacgauagcaagacaagagauagcaaaguauguauuauauccugcuauacuauaauuuauacccgacuguaguauaaauguaauguucuuguuauuguaauguuuauauauauucucugaauauuuuauggacauacacaucgcauuuugacuauguucaucuuccccuacccucaagucuuucuggacccuuccuccacaacacacaucccuuucaacuucacaucuuuuuauuuuaacccacugaguucaguucaugcugacauaugcacguggguauguagcuauucauggagcauaaauaaucucucaagagucacacaccugaagaaaaacucuccuuuccuuaggagccaucaucuguccaauagcuacacagguauggaugagaccuccugugccucucccuauccaugcuggacucuaaaauggcucaguuguauagacauaaccacagcugcuuuguguucaugaauguagugguccugccaugugaggaacacacuggcugccucugagcaccccaugucacuuauuugcugugcuuugaacaauuguaaguuucuggcguagcugccaccaacuauaaaaagaaccuuuucugauuaggauugagagucacacugaucuauggugugaagauaagaauucagaaggcaauuccauacuauguccuuuuaucaaguaauacuagugguagaauuuuguccucaucaaccaugcauuuuuggccagguuuacaguaucaggcaugagaguccaccuuugaguugaccuuaaaucuaauuauagagcaccuauuacacuaaggggcaugucuugccauauuggucaucauugcagcuuguaggguucgcaguuacagaagacuacuaacuaacuccugcccaaacuccagcagcccauauaguaccuucuauuacuagcaaagcuagucaccagggaggaagcuuccacuguaacuaccaauuugaugucuguaaaucuuguuaugaaaguauguagugccuucgucgauagggucuuacuaaaaaguuuugauagucaaucaagaacaagagcaauagaguguauuguucugagggucucuggggacucucuggcccacaauucaaauggagguaucacacaccuggagcugggauuuuuguuuaauaagcuauggauucugguaggaguauuaucagucucauguagggugccucuguucacacuauuuuuguuauauuuuaaugagcuugugaaauagcagguucccacacaguuuuuucacaccuccuuauuguuaugcauuaucucagucucuccuccacucucccucaucccccucacuauuuaaccccccuccauuauuccccuaccccuuucauaccaccugggacuuacuucuauuguuuuaaaagaauauggcauuaaaauuauuauuuuagacagacaugguggcucaggucuguaauccuaucucuugggaacuggagcaggaagaugaggucauagggaauuagaggccagccugagcuacauauuccuacaaacaagccucagcccaccgcuguaacuaagcccaguaaacucacuggcucacuaagccagacuuagagggguucauuuuguuggcuugucaacaguguccugacuguggcuuugggauucucagaugcaucgcugacauacaccaaguguuucugauucagaguauucccacagaaacgagcuuauugaguuuucaucauaauuucuugagaaaaaaaaaaaagcucagccugcuuuaaggaugaggcaauuaaaaggcaaaacagaugcaugaauugcucaaagugacacccagaaagaaccaagaacccuggccugggaauuuucauugcuuugaucuuaucugauacuaggcugccugggauauggucuuugccuagucucaggcuaaaauuucccaaaugguaauaaaauaucaaucaaaaucaaacaauaucaguuacaugcuuguucugauaaaggaaccucuuguccacagggacccugaccuuguugucucugggaccccuguccagcccagagucuguuacauggaaggaauguauuccaagaaucucuggaccuggguugacuuaagagugaaguauuuuucuccugcacccagaccaccuuugauuccuuucuauucaaucaacacaccaaagcagacucuaaacuuugcaguuaucuuugacugcuuucaaagaguccucuuuauauucccauuuuccagcauucccagaguuucuacaccacuccguuaguucuucugacaugcccucauacuugucucucuugucccuguuccggucccccagccuuccagccucuggcuccacuaaugcaagacaagucucccccaaauacagcucuccuccaaaggcucaaccuucuuagaguguggggguuugagagcuugucugagccaggucaccuccaagaaaagagaccauucuaaagcauagucccagaggaugacuggcucaccagcgggugugggcaccacccacaacucugcuuuccugagacccagccaaggaucuuggcuuugucccacacuacaucuuguuauucccaccaucugcaguccucauggauucuccccagcaugcccacgacagcccaggucucuuugucugguguggagacacucucggugacccaguuccaacauacuguucaaaugaucucugccuaaucccuaaaucaguguuccagccaagaugugcgacucaccauuccuucaacaagcccaccgcuuucucacuuuccugucucuuugcccuuuuaaggcaguguucucuacacagagucucucccaucacccucccucugccucaggcuaaccuugccucaagaagaaccccugggucugucuucucugcuugaagcugaaaggauguucucagcucugggagcucacagaccuuugccugccugccccggauuuauccuacucuguuuuuacauugugauaacuuuaugaucauuuucuuugccuacuacagccucggcaagaauugugucuuauucuguaucccucuuuaucaggcuuagcagacugguauugauuagaaugagcaacugcuuuggugaccaaauauuuggaaacaccaugcugaagaaaacucuagccagcauugggaggaaacaggacuucaguaucuccaaaacuauucggguuugggaaaccuguaaaaaccuaggcaagacagcuugaaccuaggaucccaauacuagggaaagagaugagacaaucccuuggacuugauagcuacccagucuaaaagaaucauuaaacuccagguagacaugauagacccugcucuguaucugguguggaaacacucucaguauguagcuguaccagcaagaucuugauggagacccccccuccgucaguagauaagauggaagagugaucggaagaggacaggguucucgugagcaagagguuccuuuaucagagcaaguguguaacugcuauuguuugauuuugauuauuguuuuauuacuguuugggcaauuuuagccugaaacuaggcuaagacuuuaucccaggaggccuuagugucagauaagaucaaaacaaugagaauuuccaggccagggcucuugguuuucucugggugucacuuugagcaauuaaugcaacuguuuugcuuuuuaauugcuucagccauguacaaaucauacacauguaaaccucuggcuuuuacacacuuauucauacggguguguaugugaacauacacauucacacacacacaugcauacauacacgcacacacgagcacagauauuaauguuuggccccauagaguugaaauuagccacagacuuuaagauaugauaaagaugaugagggaacaccucuuguccuaccugccugugcugguugcuaugagacugcuucccugaguaguagaaauggguuuccuguuuaaaaucaggcuucauguguuagcucuggcuauccuugggagaaauggcuauuuauuucuugggaugugguugccggguuucacaaauucuaugagaccugaugugaauguucaucuccagagcuguagacaccucaucauguauguaaauguugccaguuugucuaauuauacaucucagauuuacauagaaauaauaugccuaaccaaagggaaaacuuaacugauuagaaacaacugccuucuacaucuguugaccuuuggguguucagugaggcaaaggcuguguagaaugugugugagguugcaguaguaauacaguacauauccuacuauguuuuauccagaaggaauuuugcauugaguaaauuugggcuaacuugaauacuugaauuugacuagcugaggauuuguuuguuuuuuuuuuuuuguuuguuuguuugauuguuuuugcaguacauugugugugugugugugugugugugugugugugugugugugugugugagagagagagagagagaaagagagagagagagagagagagagagagaguggugcauguauacuucuaugcaugguuugcaucuguuugaguacauguguuugugcuugcauauggggguuguuggggaucaccccugagcauccuuucaccuuauuccuugguagaggguguaucaguccaaguacucgaaaauggcuagucauaaucugagcaugcucauaugacuaguccuaaccagagcaugcuuguauggcuagucaacuagcucugucuuuaccuuaggagucuggaauuacagaguggcugccgugccuacccagcauuuauguggguuuguagggaugcaaacucuuauccucuuacuuauccuuuaagugccuuaagcagugugccuccucucuagccccucccuuacgucucuguacacugcaagaccuggguagaguguagcuucuauugcucugaacuaugucucgaaggaugauggaaaaaucuaauuggcccucaccaaaucuauugcucaacagcaggauccgggacguuauauuguucuugcaugcagacaguaaugaacaucaacagcuucauucuuuauuuaaccaucuuaaagaccaaauuaacaaggaaaguugcacaaacuaauuacuaagaaaacugaagagugacaaguuaucuaucccuugcuaugaaagucuaagaaauaaagccugggguuauuuuagggacagugcugggaaaaaugcuagcuuuuagagaauuauuuauucagggucuagacuuuaggcuacaagcauccaauagaaacaaacugugaacuccauaauacaucuacauucuucucauagccacauuaacaaaauaaaaauacagaggaaacucauuuaaugauauauuuuuacucaacuaaguauaugcaggauaugacauguaauuuccauuuuuaaaauuaucaguaauuuauguugcuguuguuauuuagucuuugagaucccacacauguuuuacaccuuucgguucaggguggccauguuucaguuguauaauggccacaugcuaauggugaccacuauuggcaacaguucggcuccaugcugagauauaacugucugagaacaaaaaugguaaagaaaugauuuggucaucacuucgaaaaagagucaccaagccuuuucaauaacgggccagccagggaauuggggucacaugccuguaaucccagcacuugagagacggaggcaagagggucaugagcacaggagcagucucaucuauauagugucagucugucucagaagaggauagaggcauaaauaaaaccaaaucagguuucugugagucaugcucccccccccccccaguaauauagcacaagcguaguuacagacauugcuuaaaaauugaaugagacucugugucaauaaaacuuuauuuauauaaacaagcuguggaugaauuugucuugggugcuacuuugccuacccuuuucuaacuuuaaagcacguugcuguagcauauaaauaaaaaugauuccugccugggaggacuguuuuuaugugagaagucucuguauuuagcaaccagaaauguagaaaaugauggcugcuagauuugauuuccuuugccacgaaacacuguuaguucucacuuugccacaaguguuguuuauugguugguuuaguaaaugacaagguuuuuauaucacuauugaucucaaugcuuuucucucuuuuuccccacccacucuccucucugcugggaccauauuucuggacggcuuggcucucauaaccuuguucacucugcccuguuaaaacagguaaggcucgccuuucacuuugaauuaugauucucccaguguuacauaagguuucucuuugaauuuaacuauucaagggaauagcauaacauaauucaccucuuaagauaaaucauuuucagcuacaauaguuauagucucugugguaacauguauguucugucagcuguaggaacagccucuuauauuguuuugugaauuacgguuuguacuucacauacagucagaaaauagaggucagauuuuacugucuucgguuuucauucucaaguucuauguaagacuaucacaaacccauccaugccuugugguuauuuguguucagaaaggauuuuaaaaccuuuuuccuauuaggaauguugggaaaagauuuuuuuucugaaugucagagcccuggggagugugcucuugugcccucugaagccaguagaggcaguacuggagauacuucaaauuuguuuugagacuuucuuaugucucaguuguaggcuuguucauuagcaauccaugggaacacuugaagaaagaauauauaagcaucuauaagucucuuccuuuugcauuucauugugugugggaaacaaaaaccccacauuuugguuuguuugugggguuuuuuucucucucuuaauuuaaacauuaacaauugcaucacucugaaccugccaaaggcaauucauguucuuuugcuccucugauggugggugauuccaugggaaaucugcugcagggacccuguggucagacgaacacagacagagacuuucccagccuccucaggaagugcuccgugccuccaucuuuccggucuuacagaaaggcagcauccccugagacugguucccuagcccugcucccucagcccaaaugaccccuuuaccuuaaucuccuucccuugucuuucuaauuucagccucugaccuugcucuucuuauccaugucugcucccuccuccauccuucccgagacccugggaccauagucuguggcccuuccugugcacuggcaguauuuucuuugucaauaggcccucaacuguagucugcagacauuaccagacuuccuuaggacagagaaacagaaaguuucucuccuuccaucucauuucucuuucuuugucaggacuagcuuuuaaagagcaacugugcccaccuucaucuuuccuucugcauuaccugugugcugagcaacauccuccaguuaggaauuuuacagaccacccccacuuuggucucacugucacacauuuaacucauguaacauugacuuucccuucccucacccuccucccauuugccuacccuuucugauuagcgauuucuucccauuuucuuucuuuacauuuccauucuuuacauuuccccagauguagguguucuuagaagcccuagacugauugguugcuguuuuuuuaaauguccccugcuguuccucauaccuccuucuucauggcuucaggguguccagguggauaaacaccaugccuguccucagcucugcucucacagaugcagcccacauuacucugucuucccauugcaggucauuaaaguuugaguauuccccaaugagcauugucaucucaccuucucucccuuguuaccugucauucucccuuccucaacugucacaucugucaccuuuccagguccucacucgaaucuuuguccuuaccuuuccacggccccuucgccauuucauuugcucucuaaaggagcuggacucaccuccuucuccuaauuacccucugaccuguugcucaagucuuaggugaagcuacugcugcugcucacuugcuucaaaagucuucauugaucccugguuacuuagugauaacuggugcccuguauacagcaagugcucaauaaaaaaccagguauaccccacuuccucuucuuucuggucagcuuuuauaaucucaaccuuaccuuauguuuaaaauccucugggaucugguccaaccuuuuuuguuuuauuuauuuauuuauuuauuuauuuauuuauuuauuuauuaccaguggaaacaaaacaggaauccuggaaacugcaggggucucuuaccaggauaagaaauagggaccauuuggauugaggcuggcagggaucugcaggacaguccaaggaacuggcuucccuuggaguuucuacuuuauuuugagagugacauggagcacuauagauuauuggcccaccgguuccaaauuuauacuuuccuuuuccauguguuccucuuaagaccagggccuaaguaaaaguggguuugaacucccauucucaaucuccucucucucucucucucucucucucucucucucucucucucugucucucucucucugucucucugucucucucucucucucucucucucucucucucucucucucacacacacacacacacacauucacuuuacaucccacacucacugucccccucccggucaucccauuucauaauccuucccccaucucccugcuucuccucugagugggugggggccccuggauauaccccgacuuggccuaucaagucugcaagacuaggcacauuguuucccacugaggccagccaagcagccaaggcagcccagcuagaagaacauaucccauggacaggcaguaguuuuggggauagccucuguuacaguuguuucgaaccuacaugaagaccaagcugcacaucugcuacauaugugaagggaggauuagguccagccuguguauguucuuugguuggggguucagucuuugagagccccaaggguccagguuaguuucugugggaacucccaucacuuuacagaagagauuucugagucucugcauugcugucuccacaucucuuugucuugugcaugucuccugugucuauaguacauguggcaugccaucaucuuucagggccugugucuaacagaucugcguguccuugcagggccgacagcaugaggcagucaguuuacacaugacuauaaggguauaaauauaaccuggauguuuugaguauuugccauguuguaguaaaauuucacaguaguuuauucaggaucacuguuuuuagugauauuuucauauaauauuuaaccuuggcaagauuuguguaaagccaauaaaaucuguuuagcuagaggaaacaagacuugcuggcuccuuuugaaaucaaugaacacagggugggaagaaaauuguuuccuuucucucuguucgcuuccaucucguuccauaucagccuguugaagcaacucuggaccuguaaccccuucccaaacugcucacacaucaggguugguuugccagguuuuaccuaacucuuucgggagaauaagaaagagauuuuuaaaauagaauuaaacaauuuuuaaauuuguuucauuguacuuguauguugcuaguucuuacacacucacacacauacacauguagauaaacacucuuacacauucauagacacacccacacauacacauauaaacacucuaacacauucauacacaaacacacucacacauucacucacagucacacagacguauacacacaguuacacagucacacacagagaugcacacucauucauacacaauuacacacauacucagacauacagucacacauacagacucacacccacagucacacauacagacucacacacacggucauaccuacagauuuauacacacucacucacauucucucucucucucucuuucucucucucucucucucucucucucucucucucucucucucucucacacacacacacacacacacacacacacaaacaggucaaauuuugaacuaaacagcuccugcuuuuaaugugcuuuuuaaaugucuaaaugcuuuguugaaaugaagaugcaaguuugguuuggccaugaccauuauccuaggacaaggaggaaagcauguuuuaccuggccaggaagaaccccagccuugggcagccucccucugacuccacaucuuccugggcugugggaaaauauggcugccuuccagcaccucccuggagagacagagagaaauccucaaagguguggcaggggcucaggagcagcugucagcaguugggaaggugaggcaccugcugggaaaaugauaguagugcaagaagguagcacacaaaggccugaggcccaggagaggccuucaaagcuauccuuccugaagcagccucaugggagccaucuuggaguaccugcagaggaacccuguggacugagacuacaggaugcaagacaggagagcacgcuggagccagauccgaggcucagagacaccagcaugcauuauuuauaccuccugacaauacauaccacagacaaauuuaacggauagauaauauuauucuuucuuuuguucacuuuugauugguuccagcuagaaaaaagaaauuccuuuauuuuauuucaaccugucugcuaaacuaggccagugugucauagaaacagacuuuuuucuuugagaugagugaaguguccaacucgaagaaauuuuucuuugaaucaguggauuauuucuuuuuaauuggcuuuuuaacuguguuucauucuuugaggaucaguccugggggaacguuagaaccucugucauuuaaagcuuugagguaagaugacugaacuacaaagcugaaggugaauuuuuuaaaaggugaauuauagaauguuccuccaucccuauuaguggcauugagagaaagugaugugggagagaggccaucuuuugauaauuauuuaucaguggcuguguguuggacuacacuaaugcaaaagcuagaaagucacaguuaaugguauuauuugccacucaguaggugccaggugcugguuaagccccuugcuuauuagacucauuuuauccagucccagaggauugauauuaauaccaccucgugucacaguggaagauacgaagaguaaagagcuuagggaacuugcugguaacagaggaggccugcuuugaacacagucaguugggugcaggagcccaaggucucugcugguaagcuugccuaccuccucgauucuacuggugggaucaaaacacagcuguuggaaggcacacagggccugcaacuucugcauaguguuuauagauagcucaguugcccaaaacuagaacuugcuuuugcagcaagagaugaacaggaaauagcuauuuucaauagcaagaucaaagauccuggcugggaaaauacaugcuuagccucuuaaauguuuucaugguaacagcauagcagauguagauauauagguagguagauagauagauagauagauagauagcaaaaaaggcagauagggagguaaacagggaggauggaaaggaaggaagagaggaggaggaagagaaggaagaagaaagguggguaaugaaugaguggauagauaaauaggaagaaaaagaaaggaaggaaggaaagaaggaaagaaaaagguagguagaagauagguagauagauagagauaaagagauagagauagauagauagauagauagauagauagauagauagauaaacacacagauagacagacagguugguaaauagucauauggggaaggaagggaagggagaaaaugaagaacaaagaaaagaaagcagaaggugaugaauggauggauagauggauugauaguagcuguauggauaacuaguacauguguguucauacaugaacaaugaugugguugaagauagucuuuuaaguacuguaauugucacacauaugauuuuuuuaugugaccagcaaagagguaccuagguguucaggagacaggggacuuuauacuccugguucuuuuacugaaauguacaaguuccuauaaaauugaaaaucuagaauuaacuauuuuuuucacuguacaaauuuuuuuguaaauaauagacaaguggaaugaauccugcuuuucuauuauguuccauuauguauucaauucaauauucacuuucuugagggaaugccagccaaagaaaaucacuaggaaaguuauaacuacacuuaaaacuaaaaauaauauuacacuuaacuuauuuaaaaauaaucuuaagauuauaccccagucuucacacaagcauuauugcaaaaagucuuaacuauuaguaacaucuugggcauaacccagcagucauggacuaauguaaccucugcuucccaaggcagcagggagccugugccuguaaauccagacauugucaagugagcucagaugucuccaagugaguuucacaaaagcagcagguuaaugacaaagaagggcaacuccuagagauguccaagggucugcuuucauucugcugcaggaggaugggucuuuucaguucguucuuugaaggacucuugggaaggucaaagcugaguccguggaggacugggucucucuauucuucucuguucugucacuuccacuccauggcgugcaguuucaugucacaauguuaaaaaguaagucacacuaaucucagaccccaaugaccaggugugggggucuuuguggacucccgaaggggugugcuguauuucuguuuaagguuauuugcauuucggcuggggguggguggcuugggauuagugucccgaguuagacugaauuccuuggauggacugacuggauuuaaaaggguaaagguuccauucaccaagcauuuccaauguguuccauugaccuugagacgcugaggaacuuucaauugacagcaucuuucuuuucauaaucuauuaguuauuuggguaaguuuuuaauuuauuucauuuuggauuaaauuuaaagauaauauuagcacgaguuaauuauuuauccuuuuaagcugcagaaauaauacauguaaaauaaaaggcuguaauaaauuccuuuucaagucuuuuaugucuaaccguaacccccuguguuagcuaacuuuaguugucaacuugaaacaccuggaaagaggaaaucuuaguugacuaauugccuccaugagauuggccuguggguguaucucuggaggcauugauauagaaggcccagccuacuguaagugcugucaacccuaggcagguagcuagaagcugcuuaagaagguagcuuagcaagccagagguagcaagucagcaagcagggcuccuucgagguuccuacuucaagcuccugcccugaguucauggcuuagcuucccuuggugauggacaguaacaacauguagggugaaagaaguccuuuguuccccaagugcuuuuggucaucucuuuaucacagcaauagaaagcaaacuaggaugcaacugaucauuuauuuuuauuaaaaguaaugcaugcuuuuuguaaaaaaaaauugcaaauguagauaaaagaagaaaauaaaaauguacaauaaaucuauuucuaagaguaaauagcuucagcacucuggugucuaguuuguuuuuuuuuccuucuuuugcauuuaaagucacaugucucauaagucauucuuuuaaaagcaguuaguuuuagauuuauuuauuuugaugugcaugaguucuuugccugcauacuuguauguaugccauguaugggcuuggcgucuaugggaaucaaaagaggguguuggguuccagcaggcggagcuguggaugguugugaaccaccauguggauacugggaacccaaucuggguccucugcaagcuagccaacucucuuaacaucucagcaaacuucccagcuguaccuauaaucguuguuauuuauuguagcacacauuuucauaaguucuuuuugauguuucaguuauuuuguacuuuuuagcacuuuaucuuuagcaucugaagauaacuucagaaucucaaaucacauauucaaaacuacuuacuauuuaauauaauuuacuuagaaauuucucccucuaaaaaccaucacaaaugaagaucuuugccguuuucuagacuaauuuucuuaauauaaauuaauuccuucaguagaauagcuguaucuaaagguguaaacaaagaucuuugagacuuuugauaccuauuacaaauugcucuccugaagggugguaccaauguggacucgaggguugaguuuaucaccuuggagacacagugcuccuaaggaucugagaacucuuaggucucuauagcagcaaggugcacgcuuugaugaaaggucuuauacguuuuucucuuggaaggacguucaauucaauaacauggggauuucauuugggacugagucugugcagggagugaguuguuuaccugccgguaaucgaauccagcccuugguugaauuggaugcgcuggugguaccuaccugagggaauuguugcaacuggagucaauaaagcaauuucaaauggaggaaaaccugcacuuccuuuuuaaagaauaaauggguaaaggacuuuuccuuugaaacccggcuaauuaaaauggaguuugaaggacccuuguucugcgggaagcagauuugguaugucuugaaguucuuguuaaugaaaugugagcugaauuuccaucuugcgcuuaaucggaacagaguuuugcggaggugcccauccccucccacccagagaacugggcccucacugaauucuagguaaauggagaagccaggcuuuuaagugaggagacaucugacagacuucccccuucacacucuaaugucacugagguguguucagagaugucuggaucuguauucaagcuagaaucuagugagucacuaccuccguacaagauaggcaguuugcgggcgaaaucagagaaauaaaagugauguaacuaagcauuaaaugaagacagcucucuccuaaaaagucuuucgccauucucuuccuaaacguguugaugcuucacugaguucagcaucagccaguuuagugcucgagcuggagaaucugcaggcuaaacuaaaggucccacucucaguguuacaaccccuuaccugcuacaaacugucaccugguucugucuuugaggaaggaaauuuugccaugugaauccuugggaugcuauuggugcuccauggaaacccuaaaaucuaagaauagacauggguauaucucagagaccacucaauuuacgcuuucuagaaaauacuuuccucauuguaugaacuaaagaggggccaggcaggcucucuucuccuuggccuccuugguaucuuagaaaaccaugguggcuuuauuccuuuaaagaucuuaauagcuguaugguuuuuguggaacaucugacuuaugggacuggagauguaggucuguggcaagguaccuacuucaaauauacaaaacuugauuucauucuccaguacugccauuuaauacuaaggaaaaagucacgguguuggccuucaugcauugccuucuuucuacagcauuuauggucuucucccuggcuguugcaauuacuucagggucaaagagaaaaaaagagaaucaaucagagaggaaacaaaacauuuaugaaaaggccuaggcgcuugaaaagucagaauacagaaaauccuugaaacaaauuauagcuuuaagcgagagcugucuccuuggucauuuucaggguugauuuguguggagcauggcaggccccaucgugacuuaguuuaucauguuuaucagagacguaacacagcccacaggagcgccucuaaacagugcugauauauuaagcacauacuuuauguuuuaaagugucuuaaaauauuuuugacuugcuuuauuuucauaaauuuugcuuucucuaaggccccaaacacccuauaaaauggaugaaaaaaauaaauaauuuaggaagauucuagcaaucuagaagagucaguuacaaaaauaguaauacugagagaaauacagaaaugaaaaauagucaggguuucagauuuaggguuuagcccucaaacacaaauuaugcauuaugaauauuuuuaucaauuguagaauucuguaguaauaggaaguuaauuccaaagagagaaaaguaaucuacuaauauaaauacaguuuuauguguaaagaugccucuauauuaacacuuuugcuguucucacucuggucuuugcugugguagcuacggagccuuucugguaaggacugaaaaauaagaucucugugaaaauaauaaucucucagauagauccugagguccccacguuuuggcaagauccauagccuauuuaucuacgauauagaauacacagcaaagguaaugggcuauccuuuuguuuuguuuuguuuuguuuugucuguauuuugcuuuugaagcagggccucauauuuuagccuugaacucggagcaacccuauugccucaggcucucuagugguaggauuacagcacuugccaccaugccuggcuguucuguaaucacacaucguguaaagcugauguuuuucuugcuaggagauuugccucuuucucuuucacucucuuuuauacugugguaagggaccuuugguuaguguccagcugaaagccacugaagcccuugggccaacagcccacaaggaaaaauaaaugcugucagugccuuccugagguccagagcaggcccuuucccagucgagauucagguaagaucauggcaccagacagugcuuucauggggguggggugggcaggggggcagggagcuuugauccccugaaccagaagaccuugcuaagcuguacuuagucugcuaacccacaaaagcuguaagaugauaaauauguguuauguuaagccacuaagugaguuauaauacugcuauuaaauuuagcaauggggaaguaacauauuuguguuuauagagucauuagucacccugucguuaauuguucuuaguguuauacucuguaauaguagacuucguguugggugcugaagaaagaaagaacaaguccuuuaaauuaugugaccauuaguguugugaagggugcugggaagaaagugauagacuuagccuggaucucccagccagggaaccucgccugcaggugaggaauaaugaagaauaccuuugcaagcagcagggaugcuugagguaaccaacacugaccagaagccaacuugaaagugcaggggaggacauccaguguagagcagcacagagaggaccaccugagcaaaagcaccagcggaccuggaacuggaguaaggaggggagauggugacaccuccaucgaugcacugagaauagaugggguaggagaguggagggcuuagucugcaguguugaagaaggaaguauucuuucugcaagcaaagaggaugauggaggagcuuaaauaacaugaaaggacacacuuguauguuaauccagccacucuggcuaccugagagucugcguuuggacuccagccacuugggagcuuuugugaggccacuacagagcugacuacugccuaaacuagcccugcauuacagcagagaagaaagauaaguggaaauauauguaaaaugacaggggcacaauccugauucaacagaaacuacagaauaagcugacuuagcacagagaggcugagcaaaugcaauuguggacuuguggacuugagugccugugggacauucaaggugaggacacuugguuggcaguuggccauguuguucauuaaaacagcuuucuuauuauuuacccauuguacugcccucugguguagagguuggaggagaagcuguauguucuaguuaggguugacauugcugugaugaaacacuaugaccaaagcaacuuggagagggaagggcaggaaccaugcagaggccauggaagaaugcugcuuacuagcuugcuccuuaugguuuguucauccugcuuuccuauaguacccaugaccacuagccuaggggugauaccauccacaaugagcugagcccuccuccaucagucacuaauuaagaaaauuucuacaggcuuauagauacaugacacauuauaugcugauuaguaguaauuuuuguuggaaacaaagaacauacaagauuugaugguuaguauugaugcuacacuugauaggaccuuaagucuccugggggauaagcauaagauauguaacucugggcaugucuaugauggaguuucuggacuggguuaauugaguugggaaaucccauccuauauguuggugguaccaucacaugugcagagguucuggacugaauaaaaaagauagagcaagcugaacaacaaaauccaucacucugcuccccaacugaggacacauugggaucaguggccuccagcuucuacugcuaugccuaccugcugugauggacuguacccucagacugugagccaaauaaaacuucucuuccuuagguuguuuuuguuggguguuuuauaguagcaacaaggaugacacucaggacacucauuccucaccagaaugccacaaaaguucaugcagacaggagauagaaguaaugaauaagggcuauuaugaaacacugaauagcaucugagggucuagcagucaccucauugauguagaaaaguugaguacucucaugauuuaauuaucccuggcuugagagcauuugucuccaagucuuauugaucuuggcugcuucauuguaaaggaucuucagacacauuuucagacaagaucuaugcaugcuuauuauuguuuucugagaguaucauucuggguuuuuuuuuuuuuguaaugacaugauggugaauuuuagaggauaacuaaauauugacucuuuugacuucauagauuacuuuaagauauuucuuggaugcauguggauagugcagccauucuuauguuaaugacuuaauccaguucccuaagauacugugugugcauuucuuuacaguugugugcauuuuuuguuuagcaauaacucagguucaguuuauagucuuaaaaguuaauuuauaaagauucugugagcuugucaagaagaaaacaauucaaucauagcucugaaaaaguuguguuauuccuuucgggguguaaagugagggacauucaggucuccccugucccaaagcugaguuucagcuuuucaguugcaaguuuuaucauuugaaauuccugaauauaaaugcguguguauuaaaagagaucaucuauuuaugucuuuuguauuucauugccucggugugccccaggauuuacugaacaugcaguuuuagcugccauuaguauuucccggagccauggaagagucuacacgauguagcccaaggugugggaagaagauggaauccuagagaacaggagcagagagaguguagcagaagcuccuuacgcaugucuuaguuuauuuuagccauuucaguguuuagaaaaugucuaaacaccgcauuguacguguuaaacacauauuacuuuauaugucaauuaaaaauaaauuaggaucuguccuuuuagcagauuuuaugagccuaaugaagugcuaugaugagaaauacuauguguaauuggcccuagagcuuaccuuggcuagcagaaauuucauucgcuguggccaacauccuucugccuccucuucuaagccccugacaaacuuuuugucauuucccucagugcccaggagcgagauccugcagaccucggcaauauucauauagcacaauguucucuaggguuaucaaugucucaaaagucaggggcaguucuuguugccugagacuccaaggcacuuccuuauguccaacugggugcugccugauauucuguucggugggaaccauaccuucuguuaaauggcagggaugcugccagaugacugccacacuaacggaguauggagaaagggaggccacagcccacaggucacuguucccucuucuuccucacugugauaacuguuguucacacaucucagaguggauggugauccuguguauuuggaaaucagguucugaguucuuuuaugcaggaguaacuuagcuguuuaaucuuuuaaagagacauacauguuguaaaccaaugcacuuaaauuagugcuuagcuuaaagcuaaaugacaaaugggugacacuaauaauauaaauccaaacuccaaaguuacuguauuauauauuuucuucuugacccuauuucagcauuuuaaguuuuuauccuccaguuguuacaauguuauuaaguuucagguuccauuguggacacuaaaguauaucacuuuauuuaauucuuccguaguucuuugcagugucauaucaccggugucuccauucuauaugagacccaggcccuuucacucccaacagauacagccgaaccaauuccaaauaacauugggcccauugaucauuagucauaggagccacugucuaaugcaaaugacauaauagucuuaacaacugacauucuggaaaacuuuagaauguuuuuuuaaaaaaucuggagauuaaaauaaaugcaauguuuaacauaaauaaagauggcugccaagagaaacacuuauagcuaagugcagacacauagguuaguuagagagaacuuaaaggcacaauacuccaguaguguugaucacacugggugcccguauccaaccuucugaugucacucuccaauacaaaaagcuauguguccuuguagcugugccugauucuaggaacccugaggugcgcucacuacaucucuagugugggaaggugaaaggggcaguucugcuguauagagcacugcugccaggcauuccuucagaucagugauagaggacugcgcauggcggguuaaugagguaggaaguggauggagcuggaaaggaucugaagauaacagcacuugugugaauuacuuuuauaaaaaauuuuuuguggcaaaauaccuuacaggcugugacuuaggauaguucacaguccaucauaguggggaagggcauggcggcagccacugcaauaagcuguggugucaggagugugugcuugccaguuugcucugugauccaggcaauaggaagggaagguuggcacuccucuggccuacucuuuuucuccuuuacauucagucugggcccuucgcugauuggaugguguccuucuaauucagaaaggcacuuccagccucuguuaaucuguuaccuggaaaugcucucauggaugcguccagaggugugacucccaugugauuuuuaaacccagucaaguggacaaugaagauuaaccaucacagcacauugccugugggauuuucccaccuuguaaccccagucuaaucaugaggaaaacgaagacaaauucuaagaggggggcaucucgggagagacaggcacuugcucuucacagcugccggggccuuuggaauaagcaaugucugagaaacugucacaguugggaggagucucaggagacauggugaugagauggaauggagucugugcuguucccgguaaaguccagaugaauaugaagagaaucugaauaaaugaugcacuuuaguucaugagaguauggaaauauuggcucauugcaugcagccaaugugcaggauguuaacacuuuguaaauugauaggauauacagaaacacuaauauuuucucaucuaaaugguuuuugaauuaaagucuguuaauuaaaaauaaagugcaugugugcauuuucagugugauucaugagaaagcagcauccgcuuuguucuugagccuucauuuagauaaugcaucugucucauuuauccaaugaguaugguagguguggauuuauuuaauugauuacugucagauaagucauuuucauaaaaggaaugcauaccaagaucccuuugaacccccacaacuaagaagaugaauaguucaagacaaaauaucuacagggaagaagucguucuuuaauuuaauuuuaaucuuauaaaagaccauagaaagguauaaagauuauuuaugaacagcaauauauuuaauuuuuuguaaugguuguuuuaauggaucuuaaauuagcuucuugucuuuccuauuuugcuucccuaauuguguugggccuugcuaucauguuauauuaauuggccuucauugcauccaugugggacauaggggagaggcaggaaggcaaguguuuugcuuaaagucauccagcauccaaaaugaggcucucggagcuugauuucugugcuuugugcaccgugacuauauugauuggauuucaaaccacacauccuuuuuuuaucaaguucugucauguagcuccaacuuucauuuucuuuuaggauuuuggagagcggauguuacuauaugcaugcauggaggaugaaaacucgagacucuuacagucucuuucuuucuagaguuaggugggcaaaacuugggaaccauccuguguguucccaguggcauacugagcaaaucuguaacaucucugaacucugcuuucuguucaccagucagagaucuuaggugggaaaggcugccuuaguguagagguugauucacaugagguguucaguaaguggaauucaauaaguagaguuccaauaagcaauagcuacacaaugaaauaaccaaguacacuuguuauaauauggaugcuuucucugcaacccucuuguuauucugucucuaagacuuguccaggagcucaggaucuauuuuaagguugcaacuauccagaaagagagagagagagagagagagagagagagagagagagagagagagagagagagagaggaaaaaugugucaaguuuagaaaaacaaaaaaacaaaacaaaaagacccaaacaaacaaacccccacaagcaggcacugauauuaucucaaaagcugaaaaccacagcacccaguuaacagccuucauugacugugcccccuuuaggaugugguuugugugaaucugauucugaauucaugggcucaagucaaagacauugauguuuaaggccaccaauggaaaauucuucccguuugucucauagacaguaugucgucauuaugccaucuggcauuugauaguagaccuaagugcuucacuuuuuaccaccugaaacaaauacugcaauuagcuucuuucuccucucugccccugcaugaguucaguguuccuuugacucucaacuagagcuaaguucuguccugcugagcgugggccccauaugcuacaaaggccucugcuggcccauaaacuuggaaaaugugaugagcaaaugcuuucuuuucucagagacguugaguccucgaaagguuaagguauucuguagccuuuaaggaggguauuaguauggcauguguccaaacucacuugaauauggcuuauuccuaagugggacaaucuuagagacaucuacuuggaugauggccccuggagagaguucugccuuaaagccccaguuuccuguuguaaaggugagugugcugauccuuagagucauacugaaaguucagaaagcaacaauauaaaauaauucaacauggugucuggcaucuguggugacuuuaguaaauggcagcugauggcagucacuauuguggagaaucuuagauuucaggagaacugugggaaugcagagccacaaaccuaucaguuguuuauucuguuucacagaugaagcuaaagaugggugucuguggguuauucaucuguguguacguagggggggggaguguguguuugugugugugugcauguucaugggguggggcuugugugcuuguggguacaugugcaauacauuuaugcauguguguagaacccagaggacagucccugguggugccaucucucagguggcaccuguuuuuguucauuugucuguuuuguuuuugcuuucuacacacacacacacacacacacacacacacacacacacacagagucaguaguauagaacuuaccaauuuggcuagggugguagauagggaaccagaguccaaucugucucuuugccagcaccaccacacacaguuauuuuuugcuugcuugcuugcuugcuuguuuuuuguuuuuuguuuuuuaaacauggguucuggggauuaaauucaaguucugcucucaagacaagcacuuuauaaaucaaucuaccuuccuagcuccuucgugauuuuuguuugcuugcuuguuuuuuccaugaauuaaauucagcuaugucauccagacugcauucaaacuccccaucuuacugccucacuuuccuagugugggguggcacuagaguggcuaauuccugucauuuauucaauagucuauaaaaugcuauucuuauagucuuaguaaacauauuugaugggaacauucuaugaaaauggcuucauuuuaaugcuuggucuuuguaaguauuuuaggaaucuagggccucaaagagaugacaauuuggaccaagagaucacaauuagucuagucaauacuauuagugugaccauaaaauguuacacaguacacuuugccaugagaguacauggccauccucaaucaagaaggcagaagauuuggcucaccaguggagaggagcgauagcuggcuaaacuugauuaugcuuaauuauuaugugauuaguauuuguguuauauuaaacagauguccuggcacaacguacucuguuuguauucauuaauuaguucacuuauugauucacagauccuuaaugaucaucuucucugugcugguaaagggagggcagaaaugaacaagauauggucccugucccucaggcuguauccuuucaucacagaaguagccuugcauucaaagagucaggagacagugaugaugagggcuuuggggaggaaauauccccaguguagauugaaguccaucaugcaucaaagagaggaaaaggcuuuggacuuccaaggaguuuuggaaucaucccuguagcagagggagugggcaaggaugcaggauaugauuggaaaugugaguaggaacugaucaagaugaagccucugugacagguuugcaggacuuggacuucgauacagcaaccagauuaccuguaugcagguaaguggaaugaagcaguauggaguggagcccagaaggagccagggucgaagaauggggaccagugggagcaggaaagucaugcacauagaagaagucucaggaaaacacuugauaugagagcgugagguccuggguuuguagccccagcauacacacaaaaaagcugaacucaguagcauguguccucaccaugacugcagccuccagcaagcaguuuccaaggagguggaaaugugagaccacuuucucuagucaaauugauuggccucaaauuuaauuagacagcaugucucaaaaaaauuaaauaagguagagagugauugaggaagacacgcagcuuuggcuucuggcugcuguacacacaugcguacacgugcaucugagcaucuguguacacacagagagacuggugcaagaugggguguguuucugguuagaaacaagagcuagacgcuucugaaaagccaggcauccuugcucuguguugaagaagggcuaggaacguuguggcuuuggaggagaggacagcagaaagcagcugugagucucuuuugauagaagugaaagauuaaggaugacuaagauuucuggccuugguuauggcaucuagucaaaauauggguugauauggaggguugugguggccaggaagaaaauguucuguguuuggggaaggcguagucuauggagucugaagugccuauggggccaggaggauuuguacaauucgaagaaaaugcagauguaugugacuuuaaguuagagauggggagauguggauacaggcuuuguuccacccugucuuggggagaggggaugccacaaggaaaggaagguggcucaaacuggauuccagugaaacugcuugcuggagacugcagucaugaugagccccacacacaugaaccucugcacaucagcuuguauguguguucaguguucuaucuauacuucuggaaacucuagaaauaccacuguggggaucaaaagagaguagaaauuucaggagccacucucuuaagccagagagcuuaaaggacauaaagaagaucaguggcauaccagguguagacauagagauggaggugagaucauagcgcacugggauaucaauggaagaugcagaaacaggucucuccaagaagugugccuacagggagaaaaaugcacaggaagcugguggaaauuaauuagaggacagucaguauuucuuuugaagacuucagugugcuggaggaaaucaguaguggggggggggaucugaggcagaggagagaggaaagauggguugggagauagucagggaggagaggagcacuccuaguggagaccugagccuuccauggagggcuccacuuguucucuucaacuggaggaaccagagauugacaggaucauaacucaauccaggaucacgcuguggcuucaagagcugauaaaaccaacuccucugggcauuuaucuucacuauaaaggaaagacuaggucauuuucugauggugagagggaagagggagucaaauucuugagaauauggaaaauuugggggguaaauaggaaaugauggguauaaggucccuuccucacaaaaguauucugagggaugcuagaaccaggugaucacugguuauucucuguccccuggaaccauugggagccccaugauggagaugguuggaccuauucuggggguagacagauagcguggaguucaugcauaagugaauaagccucugcuuguuuccaagacaaggggaaggaagagaacacaguccgauggugguguggagcaggaagagaauagucugaugguguagugugugcaggcaaaugaaaaagcauagcuugcagguagauaugggacuauuacgauuucagacuauagaguuagaauaauugugagugggagcaaagcccaggagguagugugcuuacgggaaauaggugaguguuuguugaacaaacaaauagcaggggauucccuggagccuuuuguugaacaaguuucccaaguacuacuuggggauuugcuacugcugaugggaauguacuguagaccuggaucucuuugacugaguggccuagauaaaaauacuuagcugacaucaagcaagcaguaggacucaguuuccauuuauagcuucuguuaagguaggagaaaagaaaucugaaauaugcuaguuuuucaaaggcuagccugggcuacauagugaguuccaggccacuguaggcuaaaaaggcuuuuccucagagauacagacagacagauagaucgacagacagacagacacauggacagugagaaaaagugaaugaaaucuagcauugagacuauauuccucacaggaaugccacuuuuagacgugcuucucuuuacaccucucugcagucaccucaccuucuggcacuccaagaauauuuuuagcacggcauucaacuuuuuggaugcugucucuuaauauuuaaugauaagguuauuuuauguuaauuguguuauuuccaaaaguuuugcugacuuuuuuuaauguccuggggccauauggaagcaucuuauuccaauuuaagcuaaugacaagagaauguucuacaaagcauuuaaacuaagcacagagcguuugaaagcacgccaguuggguggcugugggaaaggaucugugugagaaguuugacauaccuccgccacccucuucucaccucauccauuaauuuguaaccccauacccagaaagacacagaaggaaauauaaaguaguccuuaaauuuugaaucauggggauauucuuaugaaguagccaaaugugaugguuauguaucuggaagcaacugcaccuaaauaaugucuucauaggaguugguuucugcugugugguagauagaaggggucagagcacagacguagugagauuuugaagaagagaucugaaguauguuagcauuuacagugguacccuauuucaucagagguacccccagacugcugucaguuggggcuacccucuuguuguuguaggacaguugcccucugaguauaacguggcuagugcuaucuugaauugucaacaguuaggauuacugauagauaccugcaccaaauuagucccauuaaucuuccaucauugaaauggggagggagggcucuugacacccuuaucuuucuccaaggauuuauuguuagugguuacuagagaagagggcuuacaaagccuaacugccgauuuauagauaguugcuaaauggaggugcucaugagugaugccccucuccaagacaguaaccuguuguuagagagaaagucaauaguguauguagccugcccucuacccuauaacuuucuucagugaaggaauacgaacaacacuuguugcauggggcuagaaugaggaacuagauuuuaugucucacuccauagaaacuaaaaugaucccuguggcuagugucuaccguauuacauagaagcugucugaacagagccacacccuggauuccugcccucucagcuccaggcccugcuguuaccccucacaugcucuaguguugaugcacaagcacaaggaagccuggguauucaccuguuggaguugggaggccaccggggaacccuagacagguggcacccccucuugaguaaugacccuuagagugaaauauguagauucagagucaccaguucagguccuccgcuccccuugguugcuucuacaaauauaaauaacgagcacuaaauugagagagcuggauauuuuuugagauuuuuguuuuucuagagacaagaucuugcuauaggaccaauacuggggauuuauaaguguauaccaccuugcccaaguggggaaauuuuuuaaggugcuagguagguugggucaacaagaagaaaggggccuauggcagggugauggguggaagcuuucucugggguuggcuggugauugagaauaggcucuucucuuacagaggagcagaguguggcucccagaauccgugauggguggcucacaagcacccggaacuccagcucaaggaggaucugacaccacaggcaccugcgcucaugcacacaguuuaaaaauaggagagacacaucuugaacaagugacaucuuugucuauaucaacucucacauccagaugcccuugaggagagaucuuaacugcugagagaguucuuuccccuucaaggaagggaaggugaacccucuguucugcaucugggugaacuuguucaauaaugaaucaaacagugucaaggacaaaaauuccauuuaaacauuuaccuugucauugucacugcucuggacuuguaaguuuucugguuuguuuguuuguuuguuuuucaaccuccugugacuuuucguugaguagaaaggaagugcaaacaacaaagggauuuuauauacugaagaaaugccugaaggauccagauuugcccauuggcuugcaguaaaaggcugggugugcagugggcaaaggcucucagucuuccuuuaaauuuucuguggcucaugaggcuggggcccugucauauccagaccuggaauagcaccaccagcuucggugugccuggucagaaggccauaugcagagggacuccuggcuuuaagagggagggucuugcuuuaggaaaguggggcugcugcuguauuuugugaccuggaaguguccucagcacacucugaagcuuagcuggccuccuggccucagagcaaaccaugaagaagccauuugcuuguccuuacguggcuuccaauuucugaucugcaaacugugacaauuuccuauuuucuuuccuauccaugggcagagccauggcccccgugggccuauggaaacaccauuaguuucauuaggagggaaaauaaucuccggagaagcgaagauguuuucgcugauucccugaccuccacgcuaaaagcagaaguagaaucugccucuuacaaaccacugagugacaguuuuccccagcuucaguccucagcacaaaacaguuucucccaacacuagccugcugaaacagcugcuccauaccaaaaaaaaaaaauguccucccuccaaauguaaaaugacgugacaugguuguacgcauuucccuucuggagagaaccacagcagacuuuuuuccagcauuucagagaauucuguucaacugauuugaaauugaaaaaaaaaaaagauuuuaucgccucuggcuacacuguguucaggccacuuauuuagauauuugcauagaaugcucauguuagaaggaggcuguaacucugucguugaauccuaugcagaauagacgugauaaaaauauuuccauauacuaauaugauugggccuggcuggcuguaugacugcuuuuaaguauuugaccuaaaauauuucaauacuuaauuacuaugcaggugucaacacaagaucucaugaguaaauagcccaacucauuuauuuaagaaagguauuacacauccagggccugugaaaccugccaacauagcccuucauuucucgaagccugucagugggcaauugacaaagcucgauguucugagaggcugagugaggguauccaugugaggggaugucuacugguagggagucauucaagccaaguucuguugagaauaugguauuuuuucuggacauaaaagcguuuccuggguaagaaaguaaagaauaucaacucaaggaguauuuuauguggugacauggggagugguuugcuuggacuggacacugaaagugucugguugacuucauuguucauauugguucucugaauggcuccuaacuaucccgagucauuuagccacagaguacuagcugucuccacuguaggaacuccguuauuucagagucuccuuacuuuccgaccauacuaugacauggagucacaaugacaggccaaccuuuguccaagcuugguuuguugaagccaucuuuuuucguauuugucagcggcaguuguaugguggcugcugagacuccuucucacuucccaaacguggagcuggaggcaacagaaguugugauaaguaaccagugaccuuauagugcccaaaccaacccccauucuuaacuauuauggcuucuuuucauuccuagcuucugucuaggccacagccuugucuuguuccucccuauagaaccugguaugucuggguuucaugucccauagacagauguagaguugauugggcaaauaaacaaacagcuuuaaagacaugacccagucuuuuuauuuucuccucauucgauuccaaucaccauuaagguagccgaugcuaaauuaugagacuuacagagugugggaauaaauguauugacauguuccauaauaaaaucaauugacauuuuuuuaaauagaguguuaauauuguugaauguuagccuaagaauauacagacaccuucaacaaaauugucuccagaaaucuucuguuucuggugacugagaggacagccagaccuuuugucuagcuguuucccuuccuugggaagacauagccacuggacaauaucacaccuauuucaagauugacagaucugagaaaugaguuauucuuggauuuuuucuucucaaggaauggucuuucuuccagaaagcuugugcacagagauaucauuagagguuuauuaaguccuaauaauauugcaguguauuauaauuuaaguacaaacuccucaaggauaauacaagagauguagauucugaaauccugcagaguacauucuuggauaucugauuauguuucuggaaaaaggaauagauuugaagcugagagaguccuauggaauuaaaggucaucagguuuuguuguugguuuuguuuuguuguuugcuguuauuguuguuguuuuguuucgcucauacuguccauuuaugugauaaugaaugggaagcuggcaggagauaauacucuaccaagucaguaauacagggugggguugucaagugaccgcuauagaaaugcacuuuaccugacaguuugaaauagacagguuuccgcguugacgcuuagcucccccccccccaaaucugcaauauccccaaaggaaccaucuucuccugaugcagauuuacauuugcaagucaaaaauacagaacugucccacuggaaucacacacagguugucaaaucagacacauaaaaacuggaaaauuaaaugccuugaaaaaaaguguuuuuuuuuuauauuacuacuuuaaaaaaaaagaacugucagucaaguuuacugugggugguauuuagggcugugcugcucuugcauguaaaagcaagcaucuguccaauuguacacuaauugauaaucauggaguauuauauuaauuauuugaaaggagucuagaaccgauaugcuuucagaagccauagaucucauaacaguauuuucauagugacaagggggagagagacacggcugugacaaaacugccaaaacauugaggcccaucgacagacucgcagaccucagcggguucacgcuggcuuuguuuuccuaaguaccugacagguuccugagugccaagucgcuuuauauuuggucgccaggguaaauuuaagucacuaagggacacagcagaguggcuuccgcugugcgguuucucacuuuguuuuggauccagagcaagaugauuggcauuugaaugaagguuaagcaccauauuagcggcugagauaaagaaaaagacaguugguaucuugcagucaaaauuucgcuguuacauuuagaagucacuuucccauaggccauuucaucuaguuuucacuagaucaugugagaacacaacaucaaaaggucaugugauuucuguucuaggagccaauggagggagagagagagagagagagagagagagagagcgagcuccuucuugcagacaguguauaggggacacuacuuuaucuccugauuggguaacugacugccaggccacaguauuugccuggacuuccagcuuccuagaguaaguaaagaggaagagaacugagacaagaaacaggccuggggcuugcaggguggaggaaggggccuaaaguagcuccuguucacagccacaucucagguuuuaagaaguagaagaguaaaaucacaccugugcuuacaggucuuguagccggaugugaccgacgggcgugguggaagaugacugucuuucuauuaacucuuccacaugcugagcaaagaggcucucaucagggagccuggggugguggccuggcugcgggacccacuuaaagaucuucugaaucuuacaagaagagacuagagacuuuuaaaaacaauuuggaaagauucuuucauuucauuucucugauuugaacucaacuccggucuucauuggcagccuacauggacuuaaauuguaauucacguccaaguguauguaggagacauauguacacauucucuuuacacucugcacagacaaauagaaaucugauguagugauguugccuuuuaaucaguguacuuaauauccuacuuagcauacaaauacaccagaugcuaucaucguuucgucucuuauuuuuuuuuccuucguuauuuuccuauuugguccagcccuuauuauaggcuugcucaacugaauugaaaaagcaguugauacuucaccuugauaauggccagucauaauugguaacugagaaagaguuaucagaagagaagaugggccaagagccacacacaaugguucccauggacucuuaaggcuauuuaguauuuaaauuggaaaggcucuaguuauaacuuuuuuauaugcccauagacuuguauauguaucuccugagaugcagauuaaauuuugagaaaauguuuugagcaauaauuuaauuuaaagcagugguacucuuauuguuaaacugcagggcugagugagaauuuuuguugugucaccauagauaccaacaucuaauuugauuacucuugugaauaguugcuaacuauaaucugauagugacuguuacuuuucaucagcgggaaggagccuguuaauugagcuggagggaagccagagaaaucuuucagaggaguaguuuuacauacagugguuuuaauaagugauccaaugaaaccuuuuauaaaagcaacaaagacaagaagggucuggacucaguaaguaugauccacacagcuacaaaugagccccagacaaugcuggaucaugucggucacucaaacccaucccagcaaggucaaauaagaauagcuuaauuuauucagccgccuugagcauccuuauuugcucaacaacucuuaaagaaaacccugucugucacugggguucaguaaaugggcaaggugccucuuaugcuaucaaauuaugcaagacugucauccugcaaggaagauguuugcauguuggcuucacaaacacaauuaauguucuauuagauagauuccuuugcuaguaagaggacuuucuguaagagauaaugguauauuuccuuguaacccccuaggaguguagauggauacuuccaaacacaguuuuuauuuccuuaaggaaauugaagcauggggcaaauucuuaagcuaaaaaauuauauuuuauguuguauacuugguuagccuaacaauuugccucuacuggcugugggugcagcauuuuauuucuuaccuacuacauacuucuaagcacuaauauugguccuauaauccugccuuuauaauagauccuaugauucuugucauguuggucaagugacacgauuucagagaauuuaagccaagugugcacuuuaauaucagaccacagcauauggauguggccuugaaauuuugugacugaacugccucccaccaaagcccgaucuuuagaugaggagguagaagugcuauuuuaauggcaacaggguuuacacaauuuggauuguuaagcuuaaagaccucauuuacuucuaauguugaaugggaggcagauguugcauggaaauccuuuggcauguguuggauguguggcaaguaguaguuaucauugggguauuuuucuaugugcuugucaugguuucaccuaguucugugcugcucaaaccuauuguacuuauggauuucuucaagaaaucuuauguagauucuccauuucccaagaaggugagaauuuauauuguaaauugucccugagcaacgcugguagguucugcuaauagucugagauuuuugguauacuuagucucacuaaagccuuaggcuuuucauagaaguaaaaggauguuggagagauugcaugcucaagucaaggaaauacaucucaggaaacauaaauuucacugggaaaaguugcuuucaaguauaaaugggucauccugaaaagccuuugauuggaaaauucagugacaaacugacaaacugucucagccccacaaugagucccucauuagagcccuuuaggcaaauggggcuggugguuuguggaauugcaggagguguuacuuucuggguacuuaaccugaacgaccacaccuuaugcuagucuagcuaguucuuccuguagguucuguguagaggcuggcauguaccuuugacaucaccagcuccuagcuuccauagguaggcacugaaucccagauuaaaugagcuguucaauuuuuaggcacucuuagcuauacacuugccccacguguccacagcucugaagucaggauugucuucucacuggggacuuuggaccacugugucacugugugauaaguaguauuuugucucucuucgugguauaaguggcacuacugaaacaucuugaaauggacaggcuuucagauguaaugagauauugcaguggagagucaaguuuccuggaucauuauauagcgcuccuccacugcauacgccaugaugcaguuacccugaugcucuugaagacauuuggguaucacggucaacucuaguagcugaguaucuucuauuaucuucagcauaugauccuauagcugugugagacucugucggugaauccauuuauauaaaacauucagaaagcugcuggcauauaguaacuccucaacaaguacaguguuacuaucauugaugaucuuacuaagucagcccagacccucgacagugucuacacaguaaugugaacagaacagguauuuauuucuguguacaugcuguaaaacucuccccauacagaaagucuuuuaaagcccugaauaagacuuagguuuuucaaugugcuucaauacuaacugugacaccaagggaaucuauagcacuucuaucuauaaaggguagugaaagcauaaauugacaaagauuugucuugacugauauagacauuggccugucugcaaacuuguauuucaccuguccagugaaaaccaagacaguggcgagauugucuguuaggugaggaccauuauucuauuugcccuacucccacagugcuaggaagcccugacgagauuguguuuguuuugagaccugaucaaaugagacauaguuuaccaugcugccuccuucguucugcaucaaguccuggaguuauuacucauauugguuccauugcgugauugccuaauucagucguugucaguguaauggauauggacacuuucuuucauucuguguauuuagccuuaagcuucucccuauguuuuccuucucugcuuaugaucauuguauugaaugagaggagcugggaauccuuuaucgggaugagaaacgcgucucccccuagacccccaacgcacacauguggucuuguacccauugccaugggcugcacugccuuaccuuacugguuugcuuuuucucccuguuguuaugaggauccuaggagaaagaccuuagcguauuuauuuaaaaaaaaaaaaaaaaaaaaaaaaaaaaaggcccugcagaguguggcagaauucaaaguagaaaccaccugacaggauuucuuuucuggguagauccaagcuaauuugcuucacugauuucauacuuacucaagagagauaacagcucaucugagcuccugucaauuucccuagguacuuuccugauaaaaauuggaaaaagcuauucucccacauuuuagcaaauuacauauaaaauuuauaaggugcaucgccugucaauaauagcuaacauguuacauauggcggcuuugguaauagauggauucagauaaauuuguuucgaaccaccuauucuauagacacacauuacauuucacuacaucuccuggccagugaggucauagcucucaucagagcgcugugauggagaggugcugcagaagugaacaacggagagaaaccgagggaggaagcaccuggcccuuagugcagcaaugaaccagaaccggaagacucuugcaccaagaagccgaacagauuccaccuauggaaucuaggucuuccagaacugacaauguaguaaauauuucgaguaaaguuuguuuguuuguuuguugacaaauguuccaaaaggcaccucagauuucuuccgaaucuuccaguaacauuuaaucaguuuguggccaaucagucuuuuugaaugcaugucuggccgaucaguugacauguuaggaaagguagagcacacuggcauugacguuggaacagcuaugccuguggacacggaguccauggcugagaacucagggaugggucuuguuccugaguccuuacuaccguuccccaggaagguggcugugaaaagcccauucaucccagggcacucccuugcgucucccuucucucuuacacaucagaaagugugagccacacguuuuggguuagguucauacuugccauucauuuaaggugaacaaggccacuuccaacuuggaaccuuggaaagagaugcgaacagaguaguagauaaagaaagccaggcuaauuuccagcgucugcuggaaaucuuuauuaggcaacuuuacaauaucaaagcuaggggugcuggccacgcuuagaauuuaaaucaaauucucagugcaaauuuagaaacguaacaguacauuuuuaucuuagcaugucagaaaaacuaucugagcuuuuuguggaaacuuacaaauugacuauccuuaaaucuucuuuguaacaguguagacggugugacuaauuuaaauauagcagaaauguagcuauauuuuaguuucaaagauaaaauuaaagaauacaacaaauauuuuuuaaaagauuuauuuaucauauauaugugaguacagucacugucuucagacacaccagaagaggguaucagaucccauuacaggugguugugagcuaccaugugguugcugggaauuggacucaggaccucuggacaggcagucagugcuuuuagccacugaaccaucucuccagccccaaauacaacaauauuaaagauuacuuuaaggccucagcuauuuuguauguuccugcguuugagugcaugugugugcaggugugcacacauguguguucacucauguuugcaucuguguguggaggguggaagaauucagcaggaucggcuuuccauguugguuuucuucuuuacuucuuucuuuucuaaguauguuugaggcacaguuucauuacucgaggcuccccucuuugaccaaggcagcuggccagugaaucccaaugguucccccaucuccacuuuccaagugcugggauuacaauaucacagcuguuauuuuuauuuuauuuuuuacaugguuuuggaggcuugaacuggaguccuugugcuugcauagcaagcacuuugccaacuuaccccggccccuuagguguauuuaugacugagaccuuagaauccuuuuucccuaaggcagagacagucauuucaagcacaccaggcacgaagucauuccuccucaagcugacuuguuugcaaacagauccacugagagcaucacagguggugcuggugacaggcagagccauuuuucagggacugaaggccuuuugguaaccuucugcaagagcuugcgacaggacaggauuugaccucucguuuccccuugaucccacuguguuugaagcauuuauguaagggcuaaugauggaaggacugaggggcggagcccaaacugcaguaugcuagugacuuggguugacuuuuucuuuuuuuccauuuuuuuacuucaauaugaaccucuaugucuguaagucucuaucuccugcugcucauauuuaaguaaaccuucagcuacuuauugcucgguuuugccuugucugcuccaucccacuuugugguuaucuacacauugguguucuaggaauacccuuccugaagggauaaagccgguugaagaguaucaggcuccuuacugaugguuggacuugacagguuggcuggaggcugaguuugaaacauaggugaccagcaaugucuucuuccucaucacucaugucuccaauauugucaucaucaaauaaacaaacaucaauaugugcacacauugcuuuuucgguacuguuaccaggaaguagguuuccuccugcuuuagggaggagaggcucugugacaguccaucaugagaacaucaugccacaggcaucucagagaugagaugacauggcuuagcauagccacuaagauuagaccauccucuggacucuacaacagcacaugguaucuugugcaggcugcauuuuaggugccauagaaaaaaggcuuguucggcauuuuaaagaaaaucugaacuucaaccaccucuccacaggucgcaguguucuaauaaaaugaauggcuacagggguuacugugcucugcagcaucuuguuucuugguuuucuucaucagaaguaagcagcuagacauuaggagaagagcuccuacaagguuagcuccagacacacagacugucuuaucuuaacugcaaaucacagaagaaccagggaggcucaagagaauguccuuuauuuccccaucccuggugggcaauggaugaaaugaucggaacuggaaucugagcacaaggcugcaugcuuuuaaccugagaacucagaguguggaggaagaaggagcgcaagauuccgcccagccugggcuccagaaugagccucuguucgaaagacacaaacaaaagacaaggauuagggagacugagagugaauaaguuacauuuuaugaucuuugaagauacuccgaagaguguuguguugucgggguugugggaaggauccguucauccgguaggcuuccuucugaguggaggucggaaccucguggcgaguucagcgugaucagucaaaagucaagggcccuguugguuucucucauccauuugaugugguacugaggugagccaagagcuuggggaugcuaccgacuauaaaaucugcaugcagagcuacacugugugucccaucugcugaagccuguguuugguaagugacaaaagacaggcguugauaggccugagggguguggaggaacccuucuguggcccauucccuucguucuuucugccccuccaccccucaucguccacccacccccacugcuuuccagugcacccuuaacaccccugcauaugaaugaggcuuugaaagucagcuucuaacaaaaccauuuuucauagauagaucauaucuuuauugacuuguuuuucugaaguuuaguggagguguuaaaagacauucuuauuauuguuuugcuuugggcuaagacagcuauaauugggacuaguguuuauugaaaacguaaaauuagcaaaacaguuuagaaacaagauuuuugccugauccgcacauuuccugaaaccccacaucuggcuuaaauucgaaugguuuggaauauguuuguuguuguugguuuuuuuuuuccuugagagcuuaaaaauuagucuuguuucuuuuuuaaaacauuagagcauguaaacuauuaaucagguuuaaauuuacugaauugaauccauuuuucucuuucauggcuuuggaguggcauauaccagcaguucacagaguaggucuguuggaaaggguagaaaaaugaggauagcuuuguguuggagaaaaugugcaaauuguuuuacaagcgagcagccugggagaggcauugaaaaaggaggaagacaaagaggccuaauaaugauaaucacacauuaaggaagugaauuuuccccaaaggaaggugguaauguuuauuuggaugaacugaaccaagaauucauuuuucuucccuaaaguaauucaaaguauucuugucucuagcacuuuauuuuauuaugggaccaagaguuuuguuuucagaguauuagcucaacaucgcacgaagugaaauguauacauuagacugacaaaaaggauauuuucaaacucugugagauuuuuuuuuucugcacugaauuauucugcuuugugccugugguauuuuaauuggcuuugucuuauaaucucaguggcuagcuaugaguuaagaauccuuaacuguccucucugagcucacuaauauuacaugauagcaugccccacuaguugcuaaguucaaagacccuaauaggaaaaacagcguuccuugcaugcuuuagcuagcauucaugaucauuuuuuucgcgcuuggauuaguaugcaagacuauugcugacccauauuaauagguauaagauuaacacaacuucuggaaaggaagaguccccuacuacugagcaagacaacaaagcuugugagaagauuuagugcuauggagaagugacuuuacgucugccaagugauuuguagcggcaugcagugugcaaacgcuugaacuuguagagaguacaugaaacacagaggccaaggaaggagugaugggggugaugacugucaaguuauuuuuucccuugcuuccuccaaacacagacacagaaccaggaggccacaguacugucagccacaugacugcauuagcuagggcaauguuuggagaaagucaaguuaacauaagucuccguucacuugccuucagcucuccaaguucuaguacaugagaaggagggcagaaaugagaugguuaaauugcuuugaauggacauauagggaagugaaagcccuugcagaaauucaacccuccgcagggcgagaugaucacaaguaacacagguagccacugccuaauuccuacuccuuauggcaguugcucauucagcacacaucagcagcugcugggaccaggaacuguucuugcacuagggaugaaggagugcaucauccacaggaggccaaagaucccuguaucuuagcucaaaugccaguguggaagaugggccacggguacuaaacauagucaugaaguaagcuguacuugaaggcuuuaaacaggagcuggggagacggcucgcuggguaaagaaguugcuguguaagcaaaagaaccugaauucagauccccagaacccgugcugagggcuugggguugagggcuguggucuagguauaguaugugccugcaagccaagugcugggaagacagagacaggaggauuccugagguuuuccuggccagacaaucuucuaagcgccaacgucaaugagagaucaugacuucagagagaagggaagagaagacucaguguugaagaucacauguugcucuuucagagggcaagucaggcuguuccuaaccaccuucaaaaugagugacaccuucuucugggccucuuuggauaucugcacauacauggcacacaugcauacaugcacacacaggcacacacaggcacacacgcagagaaaggcauaagucaauaauaagccuuugaaaaaugcaagauggagaguauuaagaaggacaccaaauauccaccucuggucuacacagcagugugagugugcaugcgcauacauacacucucacacacacacauacacacacacucacauauacucacuaacucacucucauauacauggacacagacacacaaacacauuuauugcaugcaugcauguauguaugcauggauaaugaaagugauaauauccaaaagaaagcauacaaauagaauaaaagugucuuggaguaugugcugcgcagacaguaugaauuggauggaguauguauggggcagugugugggcagcuggcaccaauccauaaaaagacccucuccccuacacacacacacacacacacacacacacacacacacacaccccaaguauaugucuauuuuaagguagaagcuaacugcuucucaaggggguuaaguaccuugccccagaucaaacagcugggaagaccgaaaguugcuuacucaaacauauuuuuauucuccccugcugccgcucugcuccgugggcuccccacuccacuguuucugugcuuucuaccagggauagauucugcccaaaugaucgguuucaagaugguguugugcagauguuugauuggauguggggguuuuguaggccacucaggguuccaguaccagacauaguucauugcuguaguuauaaccuugggaauagcagcuuauaauaacuggaaauuagacaugcaugagaggcuaggaaggucuggaugaaaaugcuaagaggaagaaaguagguuagagggcagggcugcagcacaggugaaggggauaauuacuuaacaagggaaccaugcccaggguuggugcugagggcaguaaauaacucgugugcaccaugaaucgaggagagccagugcuagggagucuuacacgcagagccucacacaggccuuggauuuggucuguggcuuagggaauaaucauugugauggcaugagaauccaaaccuggguccuccucuuucccacuggggcaaagaauaaggagauucaaaagaaaaggcagcaaaagaacaaagaggacugugugcacgcugaauucuuaccgggacguaggcugacuucuuuuuguucauuuguguuuugauuuuccuuguugagacuuacuauguagcccuggcuggccuagaacuugcucauuacccaggcuauccccaaacucaacucuaucuuccucuugccccagcuuccugaguacugggauucaaggcaucuaugacugugccuggcuacaaaccaaguucuaacaaagauaauaauaauaauaauaacaacaaggacaauaauaaaagcaggucucuggcugaacuuuguccuacacuuucugugucccugaagaugaccuugagucccucccacaucccagagugacagacgagugugccacuauacauguuuaugcaguauugggaauggaacccaagauaacuugcauacuaggcaagcacucuugaaacagaucuacaucucaaaucccucuccucgaguuccaauguacggacucuugcuaggggaguauuaagcuucauuuccacaccugauuuuuagcuuucugguacacacuuccccuugcuggugaugauuucaaacaacuuguguugucauuaaugguauuaaaaaaaaaaaaaacccacagcuuuuaguauguuugugagcagucacagauaaugcaccuuaagcauuuaacucaugccaaucuccggucucaauuuaauuauauagugagccaggccuggugguccaagccagcaguuccaccuacuugggaagcugaagagggagguuucaaauugaaggacuucucagguuacagcaaauaaauuuagggcuagccagugcaauuuucugagaccuuguuuuauuuuuuaacuaauuaacuuauuuacucccucacuuuacuucccaauaucagcccgccguccucuccuacccccucaacaucuuguuuuaaaagagggcagagaagaagaggacaaagagcaaacaugggugguaacaacggcccuuucauaaucggcaucccaggguguugagucuguauauucuguguuuuauaagggaacacagugaggcauaggaaaaugaacuuucccguguugucacaagucagugaaggaaugugguuaaacuccaggcaguccuuagccaugauccuacguggccuccaaaaggaaagcagagcaacauucagguacuucaguucuuuccccaguuaggaagcacuaugauuagugccgaugauggugaugaugauggugauggugaugaugauggaggaggaggagauuagugcuaugauuucuuucuauagcaugaggaggucacuugaauuuguccacaagcaugggggcuccucaaaagagucaagaggcaaauccagacauacaugaaacaauuuuuaaauuaucauuauugcaguuauagguuguguugauuuaaaaguuugaagugcuggagccgaagggguggcucagaggguaagagagagcacuguuuuuucagaggacccgaguucaguucccagcaccgggaucuuaacucagccccaggggaucagauacccucuucuggucucuggcaccugcacaccucauggauugagaaacaugauagauuucagauuucuagauuaaggacgcuccguuuggaaugucucaguccauuuacgggcuucagguucugaguggucacaguguguuagaggauuugaagagauuugggggagucucguugucugauagcuggagcccacagaaccuagugaguguagacagacagaaugauuauguaauaaacagcagaagcuaucuggucugcuuggcuguauuuugggacauccaguguugauauuuuuaucacaccucuacuauagccuaucacaucugggucuucuuuccaagugcuccaguucccguucaaaggcuauggaggguaagcaucaguggcuagcaaacagagaaaaaaagaugccuauguggcacaugaagacccacuugaugaaugcuuagcccugggugguaggccuucuuguaagcaagaaguuaaacuccaggacagccugagccccacauuaucaguaaccucucucaacaaaacaaacgaagcaagaagaaaagauacaagacucuuugcuguugaaacaacaacuggaaagggaacauuuuuuuuccucacauuugcuuugcauccuaacccuccugucuccguccaccccauaauugcaaggcagcucuguauugaagcuccuuacagccccuuuaaaguuuaugguccuaugaaacacagcuggagagagaaaccuuauucuuaagccuuccuuugaaagucugcuagugcccaaccucuuuucucuaggugggacauuagggagcacuuguguucaagggagacccaauaagaguccagggacaccauuaagcacacggaaguuauucucuuucugcccagagggaucguuuccccuccuuucacuuacaaggaaaaaaaaacccacagaugggauccaagcaaaggaacaauagcacuuggcucugggaacagucaggaaucccucuuuggcuugcaggccuuggagucauuaccuucugcugguggucugccuucacauggucuuccagaccaguuggaagccacuguuuguugugcuucucugcaggagaugcccgcuggcacaugcucccacacaaacacaccugcaagcugccucaauugcugcuaggccugcggaguuuaagaauacauuaaacaaucaaagcagauaggccuugucuugcccccacauugcuucauacacagagagaagggggugcacgaaguuagagcagcuacaaaagacugaauaggagugaccugggguauccaggggaccacucaucugauagcuaaugaugaacucaguugcuguaaagaaacaaggacagcuuuaaggaaaagggugaagaauggauuuggauaucuggauagggaagcaagcuuagccauuugguaccaguuuuaccaaaggcagaagguagacuugcuagcuaggcauuaugguagcgauguugugagauagccaaauuuggagucuuuccuacagaaccugggugggaugucucucuuggucuuccuauuguccagcaagagaaagguuuuucuuuuacuagaccauuaguucaugagaaggagaccagggcuuucgaccauuaguucaugagaaggagaccagggcuuucgaccauuaguucaugaggagaccagggcuuucaagacuuuuugugcccuugugagagcgucucauuccucuucugggaugagaagagcacagagcacauuugaggcccacauuuggguggauuccacguuucagaaccagccacggcccaugcuucccaucagagucagacccucugcucccugcccucuaccugggauguauauuuuuuuaccagccuuaauuccaucaacacuuccccagucuaugacuaauggacuaggaaagguugacuuagugagggacucuguaucacuuaaaccauaguuuauaaaauucauacuugcaauuccagaucugggagguagaagcaggaggaccagagguuagccucaucuauaagccucaucuauaaggcuagccucaucuacauagaaggcuagcccuauuucagaaaacccaaaacaagcaagaaacuggacuaugacaggacagcaaugauguuugcuauugacucccagcuaacuccuagcuguggccaaacucuucucuaggucucauugacaagaacauuucuggcagcuucucuaaacaaagagaaaucuuuaauaauaaauuguauuugcuuccaacgcagacauugguauauuuugguaugagugauuuauaaauaaggcagcuaguaucuggguuugaauuaugcauuauuuucccauuucucuucuucaagcuguuacauugcugacagaaaaugggaccauggaggucuuucaguucagauuuccugauaaccuugaauauagagaaggacuggauuuugguauuuugcucaggucuuaacaaaggauaauaauuuuauaaugcaaauaaaacugaggaggaacaguguagcuaggugauccaucaucagucaauauuugcagugugcucauuuggaauucauguugucauugaguuucacuuuaagguaaaaccaaucaccaaucagucaccaugccuuucucucuguaccauaacccuauacagcacuauccacucccacucugugaaaaaugcaugcauguguagguuuguguguguguuuaugugugugucuguguguacaucugggugucugugugagugugugcgugucuguguguguuacacacagaccaugugucuacagucuguuuacuagcucucaucauagagaagcagagggccuaccacacugagccaaugagugacuggagaccugugacugagugugguuucaugaacaccagaucccauauugaagcaaauaaccagaggagcacccacucuucccaggaguccugaaauauccuagaggcuccugggcaaaacaugcugagcuaacaaaugucuucucaagagauuggaaccagccuaauaagucauacuagcaaaugacuuuugagucucuuuuuuugcuaauccucgaaacagggugaucguuacuaaauaaccucauuuuacaggugaagaaccacgucucaaggaggcuagcuggaaguuugguaguugguuagauaaacuuguaggagcguccaggcucuaacacuaauggaccagguucauagcccagcccucgugccauaugacugaucuugaggcaguuugccauccagaccugguuggagacuuguuauggaggauggagagauggcucaguguuuaagagcacuucccacucugaaagaagacccuaguacaguucucaggaccguguuggugacucacaacaagcucuaacuccagcucugugggauuggcuugcccucuucuugccuucauagguauccacacacguuacgcacucacacagauacaugcacaugcauauaaauaaaaacaaaucuuaaagagugcugugaagguaaaaugauguaaaggaaguucugaguguaguguuugguuuaauaagugccgggguugugcugaggcggggaguggucuagguuccggggauaaacaggaauguucucacagaauuucauuccgguagcagacgaaauaaucaaguaaacaaaugagagagugauaaccuuagcuguggugcucuugcuacagagacacuaaacgggauacuaagauaaggaaugauugguuaugucaaggcucugggaggagaggcuccuuuaauuaggcuggccagauaaaaccuccucggggagauacauuagcucugaaaugguggcuuggaacaaagaauuggaauacagcagaagccuaugacauuguauucccauucgaguuuguuguucacugggcucagagcacucaaggaauguucagggggacaugccagacaggcagaugggcgugggaaccaggagcaagagagaagugacuggacagugcucagguuccuggagaugguuaaagcuguugaauaggaccauuguuuccaggaaccaacaugcauguggaagucacaucccuuccccaugacgacaguaagcccaaugggacauucuuuuaugcauauuacaaauaguuguucaaaacaaccucuagguccccaaacaacccucaaagggagagggcuauuguuuccuuuccacuuaauacauuucauuaauagguggcugaggcacagugacauaacuuuuuccaagcucaaacuuacuuaguaaggaggaccucaguagcuugguugucagccuacagcucuaacugcugaaaugcaaagcgacauccauuuucauagacugaccguagaaaugagcugcacauggccucugaggaggauggaugagggaauccagaaaccaggaggagaaagugggagggcacugagggaaagagugaauguccucaucugcuguguuuguugccgcauaguugcagaugacaauuauccuguuaccucggucgcaugcugugcuggaccaguagcucagcuacauuaaugugaauuccauugauaguggccccuucagcuggcugacagaggaauucagaugaacacagucuucaacaaagcaagaggccaucuuuccccagguuuccugcaaaagagggcuuuucugcuuuuuggagaccuggucaggaaaaguggacccaaaccacaccccuucucuucaaccucagcagacuaccucauggucugccuguugugguugguagagacaccagccguguccucacaagguguuuuucucucugaagucaucaugggaguggcugugucgauucucauaagcggugccugcagaccaucccugaucugugcauucgggcuuuugcacugauuugaguuugcaaagcagaauacacaaaacagggucauuuccucuuugucugccauacugcccuggucucagaaauaggccugcgccuauuaaaguuggugaaggccagauuaggguauaacugcaggugcaaacuuacaucuuuugggaagaccucggggacguuuagcuucucuggcuuggaauuguucuuucuccacuuuguggcacuuaccaacuacuaaacaauuuuuugggaggggggugacucugcuugcauuccuaacucuccaguguugugcagcaccagaaaguugggaauaaguauaaaaucuuuaagaugaaauaugaaggaggcagcaaauuccuugguaauggccucagucccccugugaguuguuagugccgcugaaugugugaccuuguuuuuaaugacaucauuacuuuccuucguuauguucauacucugcuucuuuccauacuuaacuucgcuccucuaugaucugcucuaaauuauggcugcauuguguauugcuccuuaauuauaaguccuccugucaugauuuguccugcuuuucucccuccuccuccucuguuccugauuauccaauuucucuacuuugacuggauuuaugcuccuuaggcaaauacggguuuucuaagaucccuuugaagaaagugggguugaaacuuugagaauaauuccauuaauuaauaauugugaccaugcuagaguguuacccuucaccaagggccaugcuaaacucauucuccaaaaugugcagucacucuuuguaucauguuuccugugaaaccccaccugugcuuauacguuagggcaugcuucccaaauacgucuguguuguuuuagaauguaaauggauuuucaagccuugaguauuucuccuguuugcacacauuaguuuauuuacucgguagucugacuuuuguaccaauugauuaagaauguggcuguguuuauuuucuuuuccccacaaguauagaugaguaccugauaaaaaugaaggagggccaauucuuuccuaauucugcaagcucauuacuugcucaaaucguaauaaacucuaccuuuguguaaugucaagaauaauaauggcuucuuuuuuuuccaguuguauggaaauguuccuuaggaauauuauuucauccacauuuaaauuuuccaagaggaccuuuuuucaugaacuguaaauuguaaaugugauaaggcuugccuggaagaaacacuggaggcuauaaugcacagaggggcacaccugugcacacaugugcccacccacgaugcacaugugggcacaggggcaugguugacuugcuccagcugcaggaaagggggcugcuuucaaucugccugaaacuugguuugcucauuugagguaggugauucugggcaucuggagucugcuuuuuuuuuuuucuuuuuuuuuuuuuuuuccagccuuaaacaaaagucuugaaguuccuuuuggcugguguaagggcugugcaggugacauuuacuccagguacucucagauuagaagcugccugcugcuggaauaccucuuuccugaaccacauuggcaagccagcuggucuuuccauccaucccuagcucaccuguaccccucugugacuugguauuuaugacugguuuaaggaaacaaaugaaaaagaacaagguauuuaaacaugagcaaaguuugauuaaacuuuagaccaucauugggcuggagugauggcuuggcaguugagaguguaguuuacugcuuugggaaaaaccgguucaguuuccagcuccacauaagguggcucaugacccaguggaacuccagccucaaggggaucagacucuggccuccccagaccuguccucccauacacauauccucauagggacacacacagucuccccccccccccccgacccucucaaacagaucuuuauaaaagaacuauagaccaucauccuacacuuaaaccaaauguaaccauuaaaaccaaaucaaagaugcuaagcagcuuugugaggaacuaaaacauaccugguugauuauuagacccccaaauaaacagggcaacauugagaucguuaaaaccuaguuagaaacguguuuuuacacaccaguuuugagccaggccaccgacacaagccacacugcauuuccuggcaaguucaggauagaguuaaggaagugagcuagaugaacucuuagggaguggcugcugaacacaaccaguuaaugaaaguuuacauccugacacuuuagcuauuguuggaaagccagguaggcuucagguuccuauucauuagcccugauucugcucuugcuccaguccuuagcccucgcccaacagcagcuguuauuaaccgcaggcuugcaagacgcccagugagcauaagcagggggaagcagaccuaagccugaauugugcgacaauaucagcuacauugcuacauuguugccucccauuuccucugcuuuacuuucgccccacugccuacugcuucuuuuauuuuuuuuaaccuggcccucucuuuauuuugugagccacugucuuaauuuauuccaucaguucaaaaauaucacaucagcuuaguaucaaauaaggcuccuuguguuuugcuuaagcuucuuugagcaugucagucaugacuaaggcuuuuaauugguccuuuaugauagccagccauucauucguuuuuucauuaucaccuacucuuugucauuagccuuuuguccucucuuuuucuuucuccccaccccccccuugugacaucacucaugaauguuaaaauucucacuuuaaagucaauuuuuguuuuuuauuuuuguuggcuccugguaugucuugaguuuuugcuuguuucgcaucaugccucugggugcuugccuuuguccuagcuguugacacagggaccuuucuucagccgguauuucagagccuggaugugaucuuaagggggccuuagcucugaacauauugaugguuacuucagguaggcucggcuggcuuuaugacuuaaagucucugaccugggaauaagaggguugguuuauuuuuuuuauuucccuaggauaagugguccuugaaccuuuucauucaccuuuaguugguauaucuuuggcugggauacauaaagcuuugccuuuacaaaaagaucaccaucacuauuuguguguugccuuuagcuuuuauuuuauuuucuuccugauccaaguauuuaccaacuagauuuaauucucccuguuugcucuuauuauagcuuauucuuguuauuccuaguuuauuaugcugucauagggaggguaugcuuuuuucucauucuagcuuuauaaaaguauuuuuguuuuauauauauauauauauauauauauauacacauauauacacauauauacacauguauauguauauacauacguauguguauauauguauguguauguauauauauauacauauacacacacacacacacacacacacacacacacacauauauauauauauauauauauauauauaugucacaagagaaagaaagaaagaaagaaagaaagaaagaaagaaagaaagaaagaugguauccaaaaugauaagaaguaguuaucuaguguuccuggauguguuuguuacuugaaaaaaguuacaggcuaaauggagugcagaagauuugaauuguaaauggauuucuugucucuuuuguagauaauuguacuaaaugcuaauucauggacaacuaauguguucuuguguucacugauaagcuguguugcuugaaacaaauuuauaaaagagacaaaucaucugucggcagaaacucucagcccaguaaacuugguuggugugcccaauauuucuuuaugcuucugcaacaggaauccaauacaaauuaccucccuucacaaacacacaccucccaccuacuacccagugacaauggcuggcuaauaaaccucuccuuauugacauccauuuugguggggaaacaaauauacacuuuggcuaaguuagauaggagaccuucccccaacuuuuucuauaaaggaaugauaauaauuaguuucuaccuuucaggccacauagcugcauccacaaguauauaauacaguggaaugggcaagucugaggggugcuccaagaauggcauaacugauagcugcaagaacuuucuuggccauagauggcucauugcauucccauuucagucugcuaaaccguuucagugccaggacacaaaucagucucuggaaaguucuuuguuacaacuuaaagcaaccaguugaaauuaaguaucaucucucaccucaaagccaaauccagagucaaauccaaacaucagcccgucagauuugcugggccucagucccacaugaagcagccaugacccaccauucccaguagcugcugcuucugucacugccauacucacugccccauugcacugcauugaauaaccaugcuuuucuacucuaggcugacuugaaugaauuccuucccugucccuaacuguccugacacacacaaccccaaacuaauguacaaaugaaugagcaagaguggauuccauaacacuaucauacaacccauaguuagauaucauguauuucuuguaugaaacacuauuacuuugaguuuuauuuucuugaagcaauugaaugaauuucaccaguucaauuuuuuuauaagucugagauuucauagacaacaacaacgacaacagcaggcuauggucuggcuugauugucucaggaacucuaaguuuguagagcccgaggcuaaaacucuugaguguguccauuucuuucugaugucuucuuuugcuggaucucagaacucagauccaggucuauuccugguaucuuuuggggaaauguuuggagguuuuuaugaugaggcuaugaguaggucuuguuuuagcuuuguugugggagauggugggggugccaaggguuauugauuugcagauauaggaagaacacgagaaggugaguuacauuaaccacuaagaggacuauuuguucacauauauggaacaugauacuguuccuaaauuuuguauccgauacuuuuuuuggcuauacauuuuauuauucucuuauggaggaauuaagaguaaaaacuugaacaaaauaaccuuuuuuuuuucuaccacccaagugaaacccuaacacauuagcauggcgcaauaacaaauaguucacugcagaaaucacagacucagcagccuaaaugcacacuggacugaagcugucccuuggccaggggaggugaguugguaagcagacacaucuggcuauaaauuaacauugaccuuagccaucaaguaagucauucggcaugggcacucuaacauuccuagugugaagaccguuuauguaugaaggaggaaauuucaccucugcuccauguguuuggguagauauacuaaauguaaaugcagaucuauugaugaaaagacaaaagcaauugccaccaggcuaccuggcccuggcugucuuucagcccuacugaaguccuuucuucaagaacaaaauccaguugugggcaaucccuugugguccuuagacacugcuuagcagcaccaguaaucuuggggaagaugcagaguguuccuuuguccuguggggcccugucaugacugaucuuuugaacuucaaguuugggagcaaauugauucuuaugcaugagaguccuguaaggcuguuucacuugagggugaagaccccaaacuaagacaugucugccuagaacuucagacauugggagauucuaaugguauuuauuugucauaggugcuaaauaaaguuuaacuguggauggcuuuuuuggguacccuuaacaaagcaggucaagagguccuuguuaguaaucuaccucuucagaucugcucuugucuuuuggaggaaauagagcaccaugaggugggagaauagggauaaacaagcagcuaugagccuacuuaagugcuaaggggaauucucagagaugucaaguugagaggucaaaucugaggggcaagcucacugacucguugaugaguggaguuuggucccuuuuggauauaugcauuuggguucaagguccaggggaucucuguagcggguggaagaagccagaggagucacugcuuugcuauggugacagcuggaccccacucuguucccauaccucccaagcgcacugugcuucugguaccacaacucugcucuguuuccaucacaggucugacucuuagcaccuucccucuccuggcuaucaaacaacgugcauguguuucuuugcuagagacugagguucucauuucuaaaguuagguguucuacacgcauccagacagaguuguguacagugcucauugaugcaugguucacagcagucagucagaaaguagcaguaagcagacaagcaaacaaacaaaacaguagaaacaaaucaaauguucaucacgcagugacuggauaaauaaaggguguguuugauggaauauucuuuauccauuaaaaugaaugaaguguagauaaaguaggccugaaaacucuacgugggaucacagaagcuauguauaaaggacaguguaguaugugaguguguuuauaucaaguguccucaguagacagaucuacacagagaggacaacuauugcuuguagccgugaucuagggagagagaauagccuaucacugauuguugguggccauggggcuugaugaaaaggcuccagaacgagaugacagugaugauuuuccaacccuaggaauuuauuagaaaccacugaauuuuuuaaaaggcugauuuuuuuuugagggaguguauacagaauagcuccagacaacuaucauguaaaauagaaaauuugcaggucauuacgcaaaacuaguucuggaggggugaagugauggaguuuuaaugcguauuuuagaauauguguuuaucuaucuaucugucuaucuaucuauuuauuaccucugugucaguuuaugaaggucuuugugaggggaaagaucaugggacaagcaaguugagcuacuucucuaugauaacagacugaauccuuuauucuguauagugugauuuuaguucuuucuagauauuauugggccccauuaaacaguuacauauuuaccaguuacaaaacaccauacuuuauuggagaugugaauuuucuuacuguuuaccuucaugaacaaacauuguaauucuguaaacuucugaucacauaacaugauacucuagauaugcccagugaagucuguuauuuuauacaaacguggccuuggggcaugguggugaucacugagcagauaagcuacguaacucggguacucuacucgugaaggcagccgaucauccucggugaggaaagaggagagcagcagaggguuucuuuccaucuugcuuuuuuaguuuauaagaaagugaugagaaauaguucugaaacccuaauacagucuuccuguguauuugccuuugcccugacagucagaaguucagguguuccacaagcacgaaguacaucuuuugccaaaauacaaaaugacaucguaguuuaaaauacauugcccuaguguaaagucuuggaaugggaggaaggcucuccagccccacgaagggcuuguuaccagagagccugcaguuguuugcaaugggaagauuuauucugaagaucacuauuucugcaacccugggaugcuccagaugcguagauagaacugauagcucucaguagcccaucuguuuccaaaaaagcccaaagagaauuggaaagauagcuguuguaacagaagaggcaaacaguauaagcugauguacccaggccacaguugcuaccugcuuguggcucuaaccccugaugcucuggaagcagaauucuauuccacaaguuuuacaagugauuucuuacuuacaguguuuuugacuuuuaauuuuguuuggucaaauuaagagaugaugaggguuaagaagaugauuguaauuuugaucuuggauaaaaggaaaccagagugcuggggugaaguuuaguggcuagugagagagaguaggucuuaagauuucuugugaugguguauaugugguauauaugugugggguuauguguacauguuagugcagaugcccaugguguccagaagagggcagcagaucuucuagaacuggaguuacagguaguugagguccagccagcuaacaugccugggugcugugauacaagcucagguccucugcaauagcaguaugaacucuuaaccuaugagccaucuuucuagccccagcuaaaaaaccuaguuuuaaauaccaagccauuugaccuauugcuccugcucugccucucauuggcuauguacuaauguuaucuguccguguaagcugggggaccucagggaugaacugcuaacgucaaggaguggcaagaauuaaacauaauacugugcauaaagauucagggcuuuuuaguguauauuccccaaauguuuuugaaguuggauaucaagaaagagaagaugaccacaacagucucauguaaguuuuauaacaguucugugagauaagcucuguuuuaaucguuauuuuuaaaaugagcacacugaaguuaggacauaauaaacagccugcccaguaucauucauaccucauaguuagcaaggcuaacauuuuuaccuaaaucacaccaauccuggcaccucuuaacauuaacucuuaagggagacagaugagcuuaccaggccaaugagaaacccugcgaaagaaagaaagaaagaaagaaagaaagaaagaaagaaagaaagaaagagagagagagagagagggagggagggagggagggagggagggagggagggagggagggagggagggaaggaggaaggaaggaaggaaggaaggaaggaaggaaggaaggaaggaaggaaggaagaaaaugaaaagaugaaaaagugaaaagaaaaagaacacaugucuuagucaggguuucuauuccugcacaaacaucacgaccaggaagcaaguuggggaggaaaggguuuauucggcuuacacuuccauacagcuguucaucaccaaggaagucaggacuggaacucaagcaggucagaaagcaggagcugaugcagaggccauggagggauguuacuuacuggcuuucuuccccuggcuugcucagcuugcuuucuuauagaacccaagacuaccagcccaaugauggcaccaugcacaagaagcccucccugccuugaucacuaauugagaaaauaaaugccuuacagugggaagcuccuuucucugugauaacuccaacuugugucaaguugacacacaaaaccagccgguacaaacacgcuuuuauuccucaguaacugugauugaaaaguuacucauucuugacuucuacucauacauucuuccaccauuuucuuguguauauucacuacacauauacacauaauguauaauaugaaacguaauauaaaacacacccucuaacaauagauuaucuuauuuugucuuguagccauugcuuuacuaaaaauauaucugaagugcccuuuuugguuaauggauguuugccucuacccuuaaaacuaagcacagcuauuugaauaaaaauuagguguuacuuagauuagcuucugcuggaguguucuuggaguagaucuuuuuaaacacugcuaguaugugaucacugggagaagaaaagagcaucucuccaagagcuuuggcugcuaaacugccuggauacccucuuugggaacauucuguuguuagccugcuagcuauagcuaucggguagcugaagaauguguuuccccugaccuugaguugaauauauagcgagggcaccaccagagcuugugagagagccggcgggggagcuguguuccacccuaaugauucaugugagccaaugugaccccuucacaaccagaugucuaacaacaaacuguuuuucacaauaugccaguggaaauguuuacucuauugcaacuuauuuuuccgagaggguaaugaaugcuauuucuucuaaaagguguaauaaauauuuuccuuuugaccucaaaaaguagaugguaggaaauacaaucaauuguuuuuuucccauaaauuuaaauggauguauuacccuguuucacaaaugacaucagccagaucgcuucucaggcuaaugacauuuuuccugccagacagagcacuugauuuaccaucgcuggggagcgcugugccaucccguuucccauccaugccguacgcuugaaguauugugacacuuaaaguuuccuauaaugaaaaauaagaaaaauuugacaaggcucauuguuuacaugccauggcagaagauugcuccacagucauugggaacacuucucccugggucugguguaauauagccaccgccuuucgacugccucagaguuaucaccuucucugccucaucuaugcggggugcuuugcuuguuugguuuuuguucuggguuuugguuuauuuuuacuuuaaacaguucaugauuuuaaaauauauucuugagaauuucauacauggguccuaaauuuuuacaucauguccauccuucucugcuuuccagccccuccccaugucucccuuccaaauucaugaucucuucuuugaugauuaagucauuucucuguaugugugugugugugugugugugcguguguguauauauacauauauauacauauauauacauacauauauauauauauauauauauauauauauauacauauacauaugugugugugaauauguaaacauuaucugcuggauaguuuaguauuucuuguguguggaugcaugaguguguguguguguguguguguguguguguuuaaguacuuguugauaucaugaaaaccucucugcuuggaggagugagauugaaacugagagcugccaucuugugugcaagaugccccaacuguuggaaaggguucaauuagcuauacuauuucacuaggcuaauguguguuccaguggcagcuuuacaaaaggggcuaagucucugguuucuuuguagguaaggcuaaagggugggucuguaaguuacugauguuggccuggugcuaugaauauggcaggguacaguggacaacuuaaggagacgugguugguugucuuacacccuaggaacgcaucauugugcaucuggcuuugcugacuauguuucucucuagaauucuauauaacuuucuguuggcuccgaucauuaccuaaaauagaccuggaagauccugugggcgccucuugggcuauucugauucaugucugcuuggcgguuauacccaugaccgggcucccaggaauguucuaaguuggaucuacagguuugucccauucuguguggcgccugguagggugggacuccugcugaaauauggaguuucuucugcuguccugcuggcgucagcagccuugggaggauaacugacucuccaaagccucauuagcuaaauuaaacuuaagucccgauccuuuagugugagacagcucugggguuugugguauuuucuuuguuuuuguuuuuuuguuuguuugucuuuuaaucaugaugcaugugaagucucauucauggauuguuuuuccuuugagaggacuuggucaggaucuagauggugagcaggaaaugugaccaaaucagccacaucuguccuuuucaaucucccugcauuugcuguccacugcaggaucucccauugccaugcugagagguuuaggaagggcucugcaguuacuuuuaaaucauacauuuuaaugcguuggaauuccaccucucuccuuuugugguuugaguuuuccuggggaggaaaauagaggccuugacuguuucccaacuguggccuccggggauggaauguugcuuuucuggagaauuuuuuuucuuugauagcaucacagccuaaaguuuaaaaugaagucaccacagcuacuccugcugggccgaaaccaacuccaauaacuaacugaucuugucucuggggugugagacacaaacagaaugggcucagagcauggcagcugagaauuucagagugguugccuguggucacucugcuuucugccuuggagaugagcuguguugugccagggauaacucacauuaguaaccaggagacggcugcauagaagaccaggcucccugcgucaggaggcucugcugcuucccaagcccuuggcagcaaaacaagaucuaauuuggcuuuagccaucuuaugccuucuuccucuucuuccgcccaguuuggauuuaaaucccuuacccucccuugccccuauguuuaggaacuuggucauccucuuuugacaucaccugagguuuuacaucacgugaccucuggggugguggcccugcucccccugguggaagacuugagccaaaauauucagagagcaucaaguaccccaggcaaguauuguggcuaugcaagugauucugcacugggaggugagagcauggguucuagcuuccaguuggaagucaccauucauucauucauucauucaauggguuguccaacaauagagauuucuugacuguuuaugucuggcaaaucagcaggaaacuauguugcguuuuuacccuuagagcuucuauuuuagaguuguauuuaauauguaugguaaauauauuuuuacucuuugaaugaucguuaugcauuuauuguggguguuagugacuguucacauaguauguaugcacauagugaggccaucaaacagucuauggaagucaguuuucuccucccaccauggggguccuugggaguggacucuggugagcagacuugguggcaugcuccuugagccucugaaccaccucacaagccuacaaauagauaauuuuggaaaauacaaucuauuccagcaguugcaaccuagggguugcaaccaaagaccaucauaaauaucugauauuuacauugcaguuccuaacaguagcaaaauugcaguuagaguagcaacaacaaaaaaaucaucuuaugguugagggucaccacaacaugaggaaccguacagaaaggucucagugcuaggaaggcugagaacuguugcuucuuccucgaggggcagcugcucuguagaaucaucaucaccuuugaacagaaguggguagagaggaauugcagcagcauggcucucuguucaucuaccuucccucgcaaauguaaugcagagacgguacaaaucaaaaguccuuuucagucuggauggccaucgucaauggcacaaagcuacuuggacuuaagaccuauguaaagaaagcuuuacugaggugauauuuuugguggaaagccaaaaguuggaccacacauuuuugccucuauuuucuuggcaagugcucaaaacauguaggcagagauguugaugugucagcugggaauucgugguugaguucuuggucccuccagacaggacuucuggacguuucaguucuuaucaguuguuuugggcaucaaacaacauaugggggggggagcuguucgucccccuucuugugaaggaagccagcagugucagauucuguaaggaacaggaugacuagaaaaccagggcuaauguauccuaccauuaacugcuaacaaagugaauuuccaaauuguucuagaaggagagcacaagagcaaaggaugcaacaaugaggucucuguuggguacgcguucuucuucucuccccucuguuuggggaggcucugaacaagggauauuugcaugugcuagcugagaaacagcuuuuguuuaaaacagcuaacaaugguagaaaccuggccaaucuuugacucagagauucugccuagcuaaaugguaggaccucuccuucccauugcuucucuuucccucuuucuuuaaguugugggaaaugccacacagcauaaaauuuacccucaaaucauucugaagugugaagucaguggggaucuaaauuuaagaaggcgcauucuacuaagaacacaaaggaccucuucacucauaaguuuaaacacacuaauuguuuuccauuauuacuuauuauuuuacaaguaacuuaauacuuuacaaguaaacagguguaugcagcaaaaaaaaaaagagagaaagagagagagagggagagggagagggagagagagagagagaacccacaaggcuucacauaacaaaguaggcuuccugagccaauaugugcccccauaugaucaugcccauugccuguguaugugauaacgguuuugacaagaucuguccaacacuaacuuggagcccuuugcagcccuccacagugcuuagcuguaacauguuauaauaaagaauccuuuguucaguguuuugugcuuuuauuggagaaggguaagagaugguagacuauugauaguaccauaacuugaagccuccacucacucuucagagggaucuucccaaccuugcaaagcugucugcagaaagaacagcugagcagacaggguggacuuuacccucgggccauccaguccauuggcacccguuuucaaaugacuucaagacaaagcuuccaucugcaucaagugauaggauucauuuuaggcuuaacguuguuuaagcucaucgacugggcuggcaaacagcuucugcuuuucccgguggagucagccuguccagcaucacucugcucaaagagcaagaccaaucaauagagguauuauuugcaaagguaaaggagaagcugaccccagacaaggcuagcaaagaugcgcaggccaaggugaggagcgugguccuugccaugcugcuagacgugagcugguacugcacagugagacuuuuccuuaggcucuucaugugugcucuguggcugguuuggaaagguaccacuagguuugggagaggggccaaaaaaucagguuaaaaucuagcguuacaacaggaaucuauuuaauagugguaugauuucuugugcaaauauuucuacaaaacauaccuuuuuaggaauagcaaagauuauauuuccuuugcuuggugcauugaagugggcaugcccuguaaaaagaagcccaucucuucugccucaagugugaacagaauauguacacauugcacaucuuugucucagcaaaugagccuuaauaguucaugugccaagaacacauuacaaaauuggggaagaauuaaguaucuuuugcuaaugcucucugaacauacuuuaaggauuuuuuuuccuuuuuagucaucugcaaaagccauuugaaaauagcauaaacucuuauaauuuagaaaacugguguguuguacuguauauuguauacucauaugcaagugauuuucaauaugucaugcucucuccuauguagagccauucaaaagagguugugggaaacgugggguaugacaauugacacuguugucuugacugaauguagaaccacccaagaaacaaaccucuggaugugucuguaagggaaauucuacauuguguuagcugagaugggaagacccacccugaauaugguaucauuccauggggcugggguucuagacugaagaguacgcagcacgaaaggccaucccugucucugcuaucuuucuguagcugcaaugugaccaguugggucccaucccacuaugaaucgcugugcccacagaaccugugagggaaauaaaaccaccccucucuuaagcuccguuugucccagugaggagaaaggcaccaugggcuuacagaugucaucaguuugccaugcuucccuuggcuuuaacccuagcauauucugagcuugcacagaacacauccuaccacaaucccagcauccagcauguagaauggcaccaugcugacacuucugcuuugagcccuauuagaauggcuguggcagugcuagugacccuccagaaauuucuaggugaggauuuuaggcuuugggggauaaugaaaauuauugauuuacuucaaaucuugauccagcuguaucgaaugaagauacagucauguacagcauaaaaauuuaaauuagcaaaccacccucaggcccggcaaagcccgugccacuuaugaacccgugagacucagcuauuaguuuauagcuggaauggaauaugaaggcacugaccuaugagagucagauaauaauacaaaguacuugaugucucaaaucagguugggggcagaguuuccaaugcccagcaaccauaaguaaguauuacaggcaacucuuuacuccccauuggcuagaucauucugauugcuuagaccugggggcaauuaauagcaauaauuggaagagaggauaugccuuaaaaugcauuacuaacuuuuuauuuuuuuuaguuugaguaucaugagguucugcugguauugcauuuuauccuuacauaguccucuguaaauaagacuuuaucacguuuuuuuccauucaaaucuugucuuccgugggguuucuuuguaucacgcuaucgagguacacagcaucuaaaaguguggggaaucauuuuaugcugcacucucugagggccuugagcauggguucuucgggagugacugugcuggggaggaguuuugcuuuuguuuggcuguuauuucagcaccaauggguagaugaagaaccugaaugagcucacacuauucucaggcaguuaccaauuacaccuauuaagaagccuuuaaugggaaagagugucuuggacuuaggcggaaguuuuagcugggccaggucucugaucuguggccugacaaaaaucucauuuauagccuuugguguuuguccgaguaaggagauggacuugggccaacccagggccuuucugagggaaacugggcucugcguccagccuguggcuguggcacagagaacggcaaugagcuagacuuggagaggaaucaggcagaaccaaccaccaaguaucaagaaacacuaacaggacugggguguagccuaguggcagaaugcuugugcagcaaauggauagcccaaccucugaccucuagcuauagccaauagggaaacaguagcaggggacaggaugggagagaagugcacaggaaauuccuccaggcacaugggcaggugaggcggaaggacacccuugaagcagcaaauucuuuacaaauugugacugacugagaucagaaggcaagaagaagacugggaagguggcuuucagugaagugaguccuuuccaagcacaagaaucauacauacuucaauucucagaagcccguaaaaggccaagcauggggcuugcaauucuagcaugugcauucuaaucccagcacuguggacgccaagacaacaggaucucugggacucacaggccagccaggccagccuacuuggugaguucaaugccuguaggaaacccuaugucaaagagaaaagcuguauaacaccccgaggaaugacaucacaggcugucauuuagcacucacacagaaaugcauggcaggaauggaggucauuuuuggugguuuuccaaacaugucaccauucccuauuugucaccuacaauucaauaggugcccuggugacagaaacauggccacgaauuguuauuuacaucuguguucuuacuuuuccuauagucuucaucuugguuguucuuuaacaagcguuguuucauuaucccagggaaauacuuagggaacaugugugaacagcucauuauuguaaauucuuaucacucauuuucuaaacauacuuugucaagggagaaaaacaacaaacacaggaauguaggaaagugcuaucgaaacuuugagcaacuaaacaauucugugauuuagaguuaauaaagacagcucuguccugagaagcccugcuuugucuuguucccuuccauucuuuucgaugauuuuuuaaaugaugaucauuuggaaguguuuggaagaaguaauuaguuauuugaucuuggaauccugauaaaauaugcugcagauuugagaaucagaagccacagggucacauucuuccagaauuauguauaaaggaaaagauauuuuaaaaaaaaaaucagacaucuccauuucucuugaccugcuacuacccccuaagaacaaaucuaaguucuuucacagggaucuggcaagcucugguucuuucccucucugccaucucucccuguucuccucuucucuuacuugucuccggucacaugcacauacuuuccaaguccauagauauuucugacucuuucguuuuggaagacauuugugcuuuuuucccucccucuuugaaauucucuuuuccagcucgacaugacuaggggucuccacuggacuaaaauguccgucuugaagagggcucccuccagggcgucucuugcuccuucucuucauagacuggacauauucucuauaacacacauggucucccauuucuguaucucuacuauuugcuauacauucucugucaccucuucuacaaugagucucucauugaaccuacagugccuugcuagauuccuggcucuguuuuggugaacagaauuaaaauaugaguugagaacugaagcaggaagccaugacucuuugaaaauggaagaaaucuguauaggaaagaaucuagaggcguaacuguuggagucguguuccuuugaggcacagagaacuagaaugagccaccgaaggacagauaagggagcagagacaugacucagccuagugggggcuucccauaaaagucucuugacaugaauuugauuucucaaaccagcagaaaggcaggaggauaaaauagacuucacaaaguuguccucaacuuccacacagaugccuuggcaugcaucccaccucccaguaaaaguaaaaacuaauuaauuuuugaaagauauaacaaagagagaaaacccuuucuaugaaaagcaaaucuaaggaaaucaaguauuuaaagugccaaaaauccagugauugcaggguauagacaaagucaauuuaaguuguuuucuuuagaaauuguuuuuggggaaaaauauucaaauuugugccgucaccauaaaauucagaggagaaugauaaaacacuggacaaagguaagaaacuccuuuauggccacauuuaauagaagagaaaugcgaaggaaaaggagacuuggaaaggaaguauaaaagagaggacuuggaugauggaugaaaaagaaagcagagauaauaucuggagcaaggauguccuacccacugacaacaagaugucuauaaacagcuacccagggacaccugcggccuacaguucucaaggggagcauaccugauccuacuuagagaggacaggagggcagacacccugaggacccugguaacuguggggcuguagacaccucugccaugugaaauacagauucguagagcaccucugucugcagcucugggccugcccuauggaauggccaaauauuuccagagcagaauugcucuggacagcaguagccagugauagccauggaacgagugagaugcagucaaaacuccgacucagcccagugaccagagccugaauccuuuugaaauucacaggucuucaugaucuggaagcuucuaagcuuaugcacaguggauuaggaaaugggaccaugcgugggaaauggucuugacuugguuggaaucgcugguagugucauccuggauguaaacacugaccugacggugcuuugggauaaacaaaaauuuacuuuguugagaggcuaauacagguuucaguguugguggaggaagugauauuuaauaucacauaaaaccagaaugaauuauucuccaaggagucaucugguuggcauuucuuuccuacuucccuuccaucuuaugccugcucaauucuauuaaaaauucucucaguuaaaugccaauggguucaacaugucuccuccugguauugcucacuauaauuuucauauaaaacacuguuuuaauguauuagaaauaaacagaauuuuauuaaugucauucccagaguucugcacacauaccuugaccccaucuggggucacauuuggcagggcuaguuuauuucaccuuuucucaucucaugaugagaaaauaguuguguggaagaacagaaaugugaaaguggcgaauuuacuuggggaguauggcgauggcuuagucaaugccugcugugcaaaccugaaagccugaguucuaauuccuaauaccugcauuaaaagccaagcagggugguacauggucaugaucuuaagacuaggagcacugggaggcagaggcagaggcagaggcagaggcagaggcagaggcagaggcagaggcagaggcagaggcagaggcagaggcagaggcagaggcagaggcagaggcagaggcagaggcagaggcagaggcagaggcagaggcagggcuuguugaucagucaauguauucaaauccaugagcucuggauucaaugagagcuacugucucaaaaaguaaaggugagaggaaauugaggaagacaccuggcaucaagcucugucuguacuugcauguggucacaacaauauaugcgcuuaguacugugguuacagagcuuauuugggccuagaguucccugaaagaaaauagauacggacuauucucccagcuguucagaaagaauuugccagccuggguugugccggguuacauccauuguuucagucaugaguaugcccaguguuaauccugcucauucuaaggaauucugcugggccauuaacaccccuuggcugacagaauccacaggcugcuugaagaguagacucauuugggaauauuucgaagcuuccuugggaucaucacaggacaccuacauauugauguucuuaugcuuagcucugacucauugaggauggaguuagcauccuguggagaugaagcuaagcccaggcacuguguauuagauggaaucaaugaaggaagcgaaccccaacuguaccagugagacagaaaauucaccccaaggagaguuuccacagagaguggugaugacccuguccagaaaggagacuggggagcaagcauaguugacuguggacuucaaaguaugacccuggaggcugcucacuguuuuacugggguuucugaguuucaugauucccauacccugacaucucucagagggacaaauccuuaucuaggaaggaauucaaguagaacacuaaagguagaaacagaagcaaggaggauaggagacaguggcuuucaaagauuuuucacauuuucugucagcacagaccuauuaagaagaccuauuuggggaaacacaguaauuguuuggguguaauuuacaccagaucuuaaauccuugucuggcuucuguaguccauuuugagcacaauuagcaucaucaaaaacccauuacuucuucgguacuaccgacugaccuuccagucuccuuuccuuuguaauagcuguguccuuuuggcaaaaaacccaacguuuugagggagaacaaaguguuagaaacaaaucauuuaaccuuugaaagguguugaaacuggcacgcccacuaacccggacccacuauguauuuguucagucacuggaaaguaauggccugccuuaaaugucccuuguucaacaguaacaggcaggcugagaucauugugauacccaugccuaagacagaccaucagaaaagaguguuaaaccuaacaucuuugguagacuuccuauuguuuucaucaaggaagaauaugcucgcauuuguuuuguuuaaagcacccuuccuaaauccuuugcaaauccuuuuaccacccacaacaccugcccauauuggguauaaagauagcugagugggagagcuggagucuacucuuucugucaucuucauuugcaucuucgagauggaugauguaacaaguguacccugacucugagauccuccgagccuguccuuugccucauucuccauccuucccuaagucuuaggauuccauucacgugucuagcuaugccugcaggucucucucuacagguguagcuucuuccucauaucccuggcuuaugucccugcuuggugucuacuggggauacaucugaauuuugaccugcuugaggaacccaagaagagauuuuuuuucagaauauuuggagaaccuauguccuauauuuccuucauacuggagaccaagugucaccucuccuuuauccaaccaccuucagggcugccccugguaaugcaucccauagccucuuccuaggguccuuuccugcagacuucccucugagauacaguccugauaagaggauaugugaccacuugaccaaggagaggggucucuucuuccccuuccuuaagugguugccuccuuugucuugucacuuuucucugacucagguaagcucagggugagaugaaaaagaaaaccuacccgccgaucagucauccacacaagaaccaaauccagcuucccuaccagacagugcuuaucaauuugcuuucugggauaagcaccuuuccauugacauggggaauugaaugauaaugacuccagguaaaugggagaggaagaaaagccccgacuacucacacaggagaaagaggacacugcuugccucugucccuccaucucugugcuaaggagaaggaagaaagcaggaaguagggagugagguguaacagggcuguucuauauauagccuugaagccuugcuaggagggaucauuucccagacauuuagacucuggaucagguaagcauuaaauccaacauugucccuccguugcuggugugggacaacuucucaaaauucuguggcaaaacacagaucuccauuuccuaguguggaaucucuagacgcuccauugcugaaucuuuguucuaugcuaacacaagcuguugucagauugugaaguggagagaaacaagauaagauaugucaaaaaccaucgguuucuuuuucuuaagaggaugucucuccauucucuuaaaauucauuaccuacgagaaacugccacuuacuucauuuuucaauuucauucuuuuaggagagcuccugaacauaucaauuuauuuuuuuuugaaaggcauagaugguaacuaaccuaagagcaccagaaugaugggguauaauauuuugaaauuuuaaaaggggagaaaaaagaaaucgccguuguuucuucauguucuucuggcuuucacuauggcauuaaagucaguauaagacacacugacagcuggauuguuccagaucuggcaaaagagcaggaaucaacacuucuguugaauuccucggcaguacuaugauugcauauuuaaugugagucauaaaagugugugcagauugcuuguggccuucugucauuaaaggcccgaguaguuggcauuagccauugcacuuguagcaccucagacauaauugaaaaagguuuuggcaaaacaggagcauauguaauguuucuuguuucuauuagggcucuaauuaaaacugccuucuaaucagacaacuuaaaaaccuuaaguaaaauaauguaagaaacaauagaaugaaaccccagacguguggggcacagccugguagugacuuucccacaguguuuuauugagugauggguuugggggaguagaucgcucugccuuugaauagagagcaacacacaguuaguguacuccagucuucccuuuaaagauuccauacaagauuaguuuugcauguuaauacuuauugaacaauggacugcauuucucacacuguagcuguaggaaugcccuugucagcuuuuaacugucaauuugacacagucuagagucauaugagaagggagaagggaggcucaacuaagagacuggagacugcucacaucagauuggccugucaggggugggggcuguauugagaguuaauugauguagaaggguccaguccacuaugggcagcaccauucccuggacagauggucuuuccagucuguccaggaaagccagcuuaucuaaagcauggaccugugaacaagcuagccugcaguauuccuacauguuuucugcuucaaguucacacauuaguuacccucugacuuccugcagugacugugacguggaaguauaaggcaaagaaacccuuccucagccaaguugcuuuugaucuguguguuuaaucacagcaacagaaggcaaacuugugcaagaaauacucuagaaacucuaaucuaugacauacuuucuugcaggaaaaugacugcauacucuacauuugaaaaagugggaacaugauuaugaaaaaaugaagaaaaaccucagugaccuuuauuaauggaaaggauuuuauuggauuacauuucauuuuccuuccuucaugauuuuauuaaaaaucagagcagagacuguaguuugguggugauggaaaaggcccuuuguacacucuaggcuugagcagaaagaauaguguguggggcagcuuacaccuccucguucuagaaagugcuauuccaaccaggaagagaacuuguucacagagccuuucugggcagaguacaaggcaggauggaagugcugaccacaucacccccaaaaauuagagauugagaccacugucugugaaaucuuggaagcuguuuuaauccuuacauuacaaaguuuaauauuaggucuuucugggucucucaguuaccuuucauuguggaagucacaaggaacaguagucaauaagcauaccccauucccacaauguaccuggcgcuaugcugugugguuuucaguaucagcugaaauaucuauaccacucugagaacauaaguccuucaaggcuuacaagacccucucaagguuagaaagcucaugaaagcgcugauccaggauuugaacucaagacacaaagacaucuugcugccccauguuagguggggccuaggauggaggagguguuacaucaugcucauaaaaugaauucagauauguuuauggccauaucccuuauguuuauugccuuucucauuuauuacuuugucuuuaaguaacacagaaagaucuauuauaucauuacagcucauuuuuucauaauuguuuucucaguggaugcaauugacaaguuaucaaguucuccuaucucccugacguccuuaugucguuuugaaaugcauuuuagauuaacauuuuucucauaaaaagcaauauugcuacuguucaauaaaaaucuauucaacucccccuagccuuucacugcaacucaagaaaacuuccccauaacacagaaauaagccaauugauaaugaaaaacucauccaccucauggguaagacuuaggcagaauuggcaugguuggcuuuuaucucaagauguccaucacacguagcugaagacagcagguucuucucuugauggaugcaaagauuauuaaacacauccagaagguauaaagauggacagaguguguauugcuuacagcaaguauggagagcagucaaacuauuuacagagaugcaaagaaacccagauguuuuuggagaaucugugcacacuagagucagagcaugugggauaggcacacuacaaggugugcaugugugaaccuacuuacuugauggccauaaaucucauguuuuagaaauguagaaaacaggcaccaacauuuguauguggagaacuuagaagucacuuccugaacgagugagucacuucagcuuagugacuuuggcuguuuccuuguaaguuucucuaaaaugucuuaagugaagcauaaaauauaaaggcuggaaagaugguucauuugguagaguucuuggcuagcauucucaaagcagugggucccaacuucagccuuggagaaaccgggcauggggugagaagccucuaaagaacauucuuggguccacagagaguucaacccaaucuagacuaugugaggauaucuaaaaaaaaaaauaauaauaacucugaauguacaugaauagucuuuuaaaguaucagcacuuguuuacuucuaaguuuaagaguuugcuauccccaaaacaguugucuggcuuaguaaguaacacaaacaacacucaguucucuucagaccauugagacaagucuuggugaagggagcaaggccagguuuaaaauccuagagauagucuuuguuccagucuacuuucuuugccugucucuuguccacuagacagcauucaguaugcuuaccacauagauuucuucuagccuugaacuaaggccgaguugugcuuuucacuguuugugagaacagcacuguauucucuugaguccucuucuguuugaauugauuccaaagaucgacuccaccaugcauacuguuggugccuguuagauaaaugauuugggauucuuacccagaaucuccagagguggccuuuaagaauuauuguggaaaacaaacaaacaaacaaacaaaccucuacggguacuucuauucacauuuuuccuccagauaaaaaaaugaaguuuauuaggagcaguguaauaaauggagaucagcaaagcuauagcaagauguuuuggugugucuacuaaauauguuaucagaagcugcuaggcucuguaugugcagagaacugcuugugcccggucauuguucucuccccagaagccauuuuaaaaaucaaguuugugucauaaaacugcuagucuguuugcuacuguggaaagaaguggauggagauucuaauggagguaucaucagugcaacaucuuuuuagauaauaacugucuuuuagggagauuguuucaaaaccuaguugcuuuuagggaaauugguaauguaaguuaaauggggaugagagauagaacuuuuaaauguaucaauguuaggagcugggaggcauuaaaacuuuguaauucaauuuccauccaaagggaaaaaaaugaauuguaacaauaaaaagguaagugcuuagugcucauaacaaaaaucaacuagcugcaaacaccgucacuauauaagaaaaagauucaaguugucaucuuaaggcuuaaagaugggcugcauuuggacagauccacugagugcugguauuuugagccuagaauauauguauacuuagauacagaaaaacuuugccuuucugaugagugucuacuacagagagcuugacuaagggaaacuguacucaaggccuguuuaccacacugggaguggcugaacucuuauuucugcccauucucccugugacacgcccacauccugcuaccugccacugaggggcagucacuuuaucucagggcugcucuuggguucuuuccuugacuuguaucuuucuuguuacuugagucugguuuguugcuuaaaagugagcauccuccaacuucucucuugggagguggccuucuuuucaucaacaucaaacacucacagcagugcucauuuguuaagaaacucuuuucugcucaguuccugccuauggagguguaggcaguaauagaaguuugggaacacacaucccuaaguuugaguuccauguuguacugacugauuuugugugucaauuuaacacaagcuggaguuaucacaaagaagcuucccuugacgaaaugcuuccaugagauucaucuguaagucuuuucucaauuagugaccaagaguaggagggcccauugugguuguugccaucccagugcuggcaguccuggguucuauaagaaagcaagcugagcaagccagggguagcagacuaaucaguaacaucccuccauggccucugcaucagcuccugcuuccugaccugcuugagugccaguucugacuuccuguggugaugaacagcaauauggaaguguaagcugaauaaauccuuuccucuccaaguugcuucuuggucaugguauuuguccaggaauagaaacccugacuaagacacaggucuaccauguauuaauucugagucacacaacucacuuuguuauucugugacauaguacuggaagguaccucugguguuaucauccagcaugacccaguauagaaaggcccuucuuuggaguuugauaaauagucucuugagaucuguguaaaaagaaaauccaaauauuucaugacagugauaacaaaaccuuacuuacaugauauucuauacuacuacuuccccaucuuuccuguugcaggaucggcuccuccuugaauagcuauguucuggaauugacauacuugauuuucuggacauagggcuauauacuaaaagauaagcuucacauuuuauuaaggacuucccuuuauagagucaucauagacucaaaaauggaagggaggaacaaacaaaucagaaaaauggccagguuaggaugggagugguuauaaaaggcagcauuugucacugcagguaccuuguaauugcuacuguaugcccagaaauuauaauuacuggagucuagcuuucuguaaagguauguguguguagacacauacuaaaauuuaaaccuggaagccagauguagcaguaucugcacacauaauacuagucuuaggguagaagugggaauguggagauaggugggucccuggagauuucuggccauccagucuagccaaugauuaaacucugaguucaaugagauacacuguuuuaaaaauaaguuggauucaauagaggaaucuuaugcuucacaagugugcacacacuauauaugcccaugggcaugcauacacaugcacacaaauaaguacauaugcacgugcacacacauacauauuuauacacuauaaaauauauuaaaccugggaaagauuauacaaauggaaaaugaagaaacauugcaccaugcuuucugaggccauggagcuuuaaggauuccuuuuguuuucucaucaguuuaaauuucagagaagaaucauccugaaauggacacuaaauuugcuagauauggggucucuuguuucccaaagaauacauuuuuauugacaaaggaagauacuguuaguaaaauuccauugcugguuugguaucugagggccaaguuuugcuuuugaaauucaauuguccugguuagauugguuucugcaguucccugugcauguggcgcuggcuuuguacauauccuuuggcuucaucuucacuuuaaugagauucuuuuugguauguuucccaagugcucuauagacaaagaucuguauuuuuuuuuuuguaucugugacagugaccauggcauaugagcaucugucaucuacucuccaaacagcccucucagucacagcugugagaugaacacagccagccagcaaggccaaguucaguucauuucaccuugugauuaaagauaguguuguccuaaggaccacuuuagaauguaucucuuuucauagauacuagaggaacauaaagugcaaagcaaaugcccuggcacugagguugccaagaagaaaggcagcaaucuggguuuaaagauuucuuagaugagagugucuccuaacuuaagauaugugugaggcugacaaggggcuuggaugggcagcucccauuuucucugcccuggaaguuguucucagacccuagcuaguucaguaaauggccuaauuaucuuauagcuucaagguauauuguaauaguauauacacuuuauguagauuauguauugccauuucuuguuuguguguagggcacacauguaugugcagaugcauguagagagcagaggauaaccuugggugucauuccccaagaaugucaucuaccuuauuuuugacacuauauuucuuauuggucuggcuuucccaggagacuaggcuggccagccaguggucccuaggaaucuuccugucccaagcauugaaauuacauguaagcacuauaggguccaguuuuuuuccaucgguucuaaggaucuaucuugggcucucaugcucacaaggcaagcacuuggccaacugagauauuuccccagucucucuugccauauuuuaaguaucacuaauaauccuacugaucucuggauuugugagugucuagggucauccuguugauuacaccaaucaauuuaaauaaugagauagcuaugcagaacacaguuuagguccaggacauuuggcaccuaucaucaucuuaaugugucuguugaaguccuugugagugugaaauuaugcaccuuacucagccugugaguagcaucgaguaucuugacuacuguuggcagagugauggaaguaccaggaugcuuugaagggcuauaggguauuuuacagacuuugaugauugcuuguuguuaaucucuguuuugauaaacuugauaugcauuccauuuauuugauacugccaggcauuuucuauauuuucaugggcacugaucaaggcacugugcuacagcugugagcaaaacaauugaugucugucugccuuagggaagcuuaguuaguguaccgaaugggucuguugaauaguacaguacauagugguuuguauuuguuggguaguuggucaaaugggguaacugacauuggaacaaccaggaaaaagcaguguuuguaaaauagauggguuugaaauuuauuauggaaagaaacaauggccuggcucugcccagugaucagguugcagcugccuuucugacaucaucuauacuuugucuugccauuuuauuuaaccuuccauagcuugcccugcuucucuuaucuguaaacaacaugaagaggggaccuauaagucaaaggcucgacuuccuugacagucucaacuucagugugcuccccaucggguucuaaagaaaugugugcgucuccaagaaugaucuuagcuuuggcuauuucacacacagcucuuacggauggguaugugccugaacacguucucuaaugcacaaggcuggcacuguggcaacccuuugauagauaagcauccuugccucagugaugucugccuccuuacaguacagaggggauuaugaagaaaauuagccuuucacuguguuucugcucuguugauuacuugguauagaagucacaggagggauggucauugaagguauacuaagcagcugccaacaguugccaguccacaugaagacucauagaccucugaccaaacccagauguuccaguugcugccagaaaccucuguucauauuucuucuaaaugaacagucuaguugccuguuaugagucaggcucugguggaggcugcaguccaguugaugcaaggaacagggggggggggcugucaccauccgcuguguguccacugaaaucuggaugaguucggauuuuuuguuuaccaugaacuaaagauacaaagucuuugguuuucaugaacuaaagauacucuuccaacuggccucucccucagcuccaaggcgcccuuuucaaacuccauuucacugggauucaugggauauucagaccaccacauguucaggagggcauugcugaaaguguccaggggccaucggguagaaguuaauaccuggaacugagaccuaugagaguguguaagucaggcugauguggaucaucuaugacaggugagccccggaauaguaaaccccaggaauguagguuggcagaacuccuccauggaacucauaagccagucagccaauaggaggugaaagcaugaaagaugcaacuggcgguuugaugggcaacccaaauggugacuccccuuacagcccagugguccauucccaggcacauagcuuagccacggcugacuucuacagagacuagagcgugcuguccaacugucugcccacuaggaaauggaaguggguaugguggacagcucucacugucuaccacagaggcaaacuugaaguucgucuguccagcucacuuccagguagggcugggcugcugcuaugcuuauuaaggcccaagugaaaagaguguuacaugagacuuuccugugaaagggcaagacguuuccuccccucaacacccccucacuccccaccacacacacaccaugggcacccacaauccugcugaguagacauaguuuagcuauuagggcugucauucagaggaccuuccuagaggucaaaggucauccauacuaguagccugucuugccucagguagccuacagagaggcacuaaagcaacagcuguaagugaggugaggaaagggaguuuccccagaagguucugaccuaaauuugaagccaggcuaugaggauuugucuccuuuaaaauaaaaggaaggaaaaaguauucaaaaugauucccuccaaucguaucuguucaguuugucuccccgcacugaauaaugugugcuauuuaauagcccaggggaaagggcuuccacuuccacugccucuccuuccugaguuuuacacuauauucucuuccuaauauagcaggugacacaacucugugcccaagcuuagucacccagcucugaggagugugcagaugaggucauguccagacaugcacuaggagaaaaguguguguguguguguguguguguguguguguagagagagagagagagagagagggagagagagagagagagagagagagagagagacugugugaguucagggggugaguuccauggccuauuuuccuugcuuaggcuuugacucagcguaauuauaauggggaugagagcuaaagucagcccggugucccauggagggucuccugccuccccacacaugggccucuuauguaggagcaugaggcacugacuguuccaaaggucagcucucaaauguugaggacuaaaagaugaaggugugacuccauggguuagcgccgcuuggcuuuauauguuugcccggcucugauccucagcaccccaaaaaaagagagagagagagaaagagcuagaaggcaggcauguccaugccagggcacuaacacagguuuagagggugggguucuguccuuguauucaaaagcaguuauuucaaaaagaaaugagagccugagcagccccguugucccacacugugugaugaaggcaccaugcccugcaucuuucuagcaacagacgcaauagcuaagaaaagggccgaggaaggaaguccucagcuccaucucaagaugcucuguucuuggugccagaagcaauagguuucuaauuauguaggaaggagggguggcuccucugagaugccuaggcaucaaaauaccucugugcuguggguugcuguguuguuccucaguagacacugggaagacucugcccuuucauccaaggaucucaucuaauggccuuuucuguuuuccccgcccccucuuuuuuuuaaugcuucgauucucaaccugaugaugugcugcuguggccugcuccaaugaaaucccuuccauuaucucaccucacaaccaaaagguaaggaacugccaaucacgugaccgugcgcaggcaguggcaucaucauaacucgcggagggacauccgccuugauccuggcauauuuugcuuauuauuuuuacuuuaagagaaagugugagugagcaggggucaguucaguguuuaguugguuacuuucacaacccccaaggcuugaugcugaaugggcuugaagauuuuguacauacgugugugcacaugcacacagugcagaaagccaguguuuuuauuugugagguguuuuugucaguaguucacaauauggagaauaauucacagagacuugauaguaaagcuuuacaaagacuaaaccuaacugaaacagaaggguguucauauugcucugacuucauacuuuggagcaagcucggucaaugggauaaugacucuuaccugagauuccuuuaaauucgcucagugaucacuuggauaccccugcaaaugagaaaaugcaguuucccaccugccaaucacaccuucaggcuguggguuuuuuguuuuguuuuuauugugguuaaaaacgcuauauaacaccacaugugugugcuguuauguagucauauguguuuacguguguuugcucacaauguacaugcaucgugguaauuugcguugcuuuccccucuuagcuguuauacacaaugcugcaaaaaaaaaaaaaaaaaaaaaaaaaaaagaugaaugugcagggcccagguaaagguagcugccuauaauccuagugggauccacaugauggaaagacaacuuuuauacccaaguuguccucagaccuccacauauaauacacacugacacauguguccccauauauagcuaugcauguacacaaaauaaauaaaugaagcgaaauaaaauguuuccaaugcaaacauguauacaaauaccccaccauauaaaaucuuuuuauuuuauugcauauauccauucccgaagugagcuuccacguucccguguucauuuaauugucacuauuugcauuaauuggcucuuuaaaacuaagcauugaucuagcaacuuaauagcgaccaguguuucuucucuccuccacaucccagaccuacacauuucaggcagaaagcagucuccccucagucccagucacccucacacugggacugcuguccuuucucgcaaucaauugcaaguauuuuucugaggcaugucaucucauguagaugaugagauuugaggauuagccaccaauuuacauccugccacuguguuguuuagaaggagcuugcuuugcugcaguaauccgcacugagaagagacaagcaccaggugcauccuccagggcagauggcgucugccuuuuccuuaccaguucccuauggggacagguggaauugcaguggagaccauggccugggcuucauaacuauccaacuuugacaaagacuguguccuucaugagcuggaagauuggguggucaaaacuacuuucccagaaucccuguggguacaugagaacagugacacagguaggaacugaggaagugagggaggguguaggaagcuuuuguagauggggcuguuauagucagcauggccagcccucagcacccccagcccgcauguucugcagaagauccagaggcagaggguagaugagcuuggcauauuguaucagagagcaauaaccauuuuaugacuuuuuaaagcacauuuuugucaauaagagagucucaaggcauugagaauauacuucuugggaccuugggaccagggguuuaccugauuagagccccuguaauccagggcaagaugaagcugaggccauuguguaguaugugccaugcccugggaaguugucaaaccugcccuucggccucuucaggcaugugagucgacauccacugguaccuugaaccuugaagcgcugcuuggaaacgacuguccuuuccugugcuuuuguauauaguccucuguucucuuugagagaaaccagcgaugcauugcauugugcagccugccggguccaccugcagugcccuggagacaaguugauuuaauacuugcaauucgauuuaacagucagaauguaugccaggaaccucggggccagcuaguucuugaagaucuguaaugaguugacugaaaagugggguuucuugcauuuuguaugggucuggggaguuccuuuuuugugagaauaugugcaaaagucgguauaauugauagaccacaaugaauuccacaguggauucguuuguuuucaugcucauuuggaaguaaaugggguugagcccuggauacuuacuuggcauuuuuauuuuggugugcucuauauuuugaacgaguuuuuuuuuaauuuuuauuuuuaaguuauaaaugauagucauccauguuuauagagaacaaagugauguuaugaguuguaaauacaguguggaaaaaugaagucaaguuaauuaacaaaucucucgcuucggauacuugccuguuauuguagugagaauauuugaaucuuaucagugauuuugaaauguaccgcauuguguugguaucuaucauugucgccguguucugcaggacccugcaaagagcaaaaaagcuuauuccuuauucaaaaagcauuccuccauacucuuugagcacgaucuucacauuuucagcuccaccaugaaaccucuaaaucuacuauaccaucaccugcucucugcuucugucaguuucauuguuuuacaucucacagaaguguguguuuguggcacucagacucuccuuccguucucuucauacuacaaauggaaggacugccuucuuucccaaagcuuucuggugcucucuugugcauaaauacuacauuuccguacccuauccuucuguugauggacauguaggcuaauaacauaaauuggacacuguggcuagggauacagugauggugugacuguagacaucucuuugacaucuuugucagucuuuagagugaaugcauagcaauagguacugagucacacgacaguuggcccugggucuuucugaagaauccucgcauagcuuuucgucacagcuuuaguaauuugucuuccuaccaucaugacaugagaggcguuuuuacacuccacaguuuagugugcuuuagaucgaagaguuggaaagcaauacacagcagugcccugggacaggaaugaugagaaaggaugucucuugagucauugauuauuuuaguuacgguaaaccagaccacugaaagugugcgaguagaaauacuuccaugggcagcaucaggccagugaguuucagaguccauccggagaguggucuggaccuuauugacauggaggacuguuaacagacuggaaaagagaaagacauggggguaugacaguccuuuugagaauacacagaggaugacagcagaacaggaauccaagggacaaccaggaaccaucaggaagguggggaccaagagagaagggccacacacccgagcuccaccuggaggccuuucuguuuauuauuauugucauuauuauuacuaucaucauuauuaucauuauuuuaaacauguuuuaauugaaauagaauccuauaacucacucuccccucccuuuucaccaucuacccccucgaagcuacccaccccaucaagucucccucaugcucucaucuccaacugauagcuguuuuucuuggauaaugagugcuacauacauacauauguaugagcugaguccguuuuuauaguuuguguguaugugcugcucuuaaggcugaccccucggcauuagacaacuaauaaaggggcucuucgugugagaggcugauucuccuuuccccagcagucauuaguuaccuguaguucuuugucuaugaguggaaccccacaaaauuuagccccuuccuccuuaacaugcccaucaauguaguauggugcaggucuggcuuaugcagucauuucuagggaaguguuacacagcagacuuccugcuuuucuggcuuuuacagucugccugcccccuuuccacacaguuuucuaagucacugaugcagaaucuaugagccauuugggcuaggauccccacaaucuguugaucucugcauuguauagagaccuuucuggaugcacaccuugguuggcuucagagcugacuaaggccuagagcacauuagggccaccuagugaccaucaaaaauguaccugcuacugagccucacccuaacacugaaguccaguguggaaacuguaagugggagcccauagggaaggaauuugguagaaaagggauggagaaagauggaggggugauggggaugguuggaggggcagacagaagguuuuguuuuaguuuaucagauaaaguauuagagaaauugcuugguaaggagggacagagagccaugguagaaagagguagcauaaaaaaaugggucagaacauagacuagccuuccuggagaaaggaggaaaagaugguuuucuuucaugagugaaggaaggaggaagagauggggaaaggcagugaaggggcccagcagagccacccuccccaccagcucucugagaagggaacagggaucaagaagaaauuaggaguucaguagcaugggguggcagguuagacuaguccuauggagauagcaacaggaagaugggacagcaauagaugaugacuaggcaggauggacaacuuucaagugugcaguguuuggcuuugccacaacucagcucagcaaagaucuggcuucuugucucagagguaaaggauucuggcucaaaugagaagaaugggcugagaaaugggcuugacugggaauugccuugagggcagucagggaacacuggcacccggcaggaggcuggccacaaagugagugauuggauucccagugagaauccuaagucuuuccugcaguggggcaaccaguaugaggagccaggggaggagagacucugagaagagucgaaggcugugugagcagggccagguggggacguggaccucaaugaggagacagagagaaagggcgucuagagagcaucacgaauagcaugggcaagcuggaagacaaucuugggcuccucuguggaaugugaagugcaacuaagaccaagaaugaaugagaagacaagaaaauaagcuggggugagggguagcuuuacagccccuaaaauggccuaacaggaggcaaggagagaauuuccucugaggagacacgaguggauuaagcacuggucaugguuucuuuccccucaagaccagcaaaucaaagaauaugaguaagaugcagaaauggcuuaaauaacaugaauauuuuauguucucuguguuaucuagaaacccagcuguuuguugaccauuagaagaagacaguuauagaccuagugguguguuauuuuaaaauggauacucugagaauacauuuguugaaagacauuucuugacuugaauucuccuuuauauuucuggccuuuccaaaaagaagcaaauaaacauuauguacagacugcgcgauuacucacucaucugacauuuugguggcauuaagcaacaaauauuaauuugagacuuaacauuguuauuguuucuaagaugugcaaagucucccaaaauaugaagccugcauuccgaaaugacuuucuucaaagacugauuguuggcagaccacacuguuggagguuucuauaccuuaaaaagcuuucaaagaaacacugcaauuuacagaauucauuacugugcacaacuaauuagaacuuugaaggaaaucacaauggggaauuagauauucucaagagcacuuccuuaauccacaguguaguuugggaucaagguuguucucccaugaaagggacacuuggaucgacuaugaguauguccccgagcccugaagcacauccgaucaguccuguucagaaauccuucuugcucucuguucagacagaaagaaaaguaacaaagacaaggaagagacaagauagaaauacaaaguagaugucuccuugcauaaagagaaugcuaaacauacacacacacaaacccagacaugucuaauuaguuuccaaugccagcuuuacuguaaagagauaaaaauaaauaaaaaaaaucuaagauaagagaagcaagaacugcgugagucccaggcguacgggugauuacagcagagagcuccaaagccaccgccguucagcucagcugccucugugcuacgcaaauguguuuauagaaagaauauaaaauggaccauggaucacuacccccacacacauugauuaauuucuccacaugcuggcagcuuucuacauagcugggguaucaggcuugggagacgaauguggaaaacagcagcagguggggacuuagauuugucuggcccagcugcugcucuccgaauccccuauucuuuuugguuaucucaguccagcaucugugguggagcaggacucaugggcuucugucaucauaggcccaggaggcacagugucgccuaugucuccagcaucucagugcccuggauggacuagcaaauggcaagaacgagagcccugucgcuauuuguagagacugacagaguuuguguguguguguguguguguguguguguguguauuugaguguguguguguguuuuugauugugugaguguguuugaguauguaugugugaguguguuugaguguguaugcaugugaauguguuugagugugugugagaguguguuugagugagauuguguguguguguaugaguguguguuuguguuugugugugagagauugugugugugagagauuguaugugcaugugaguguguuuuugaguguguguuugugugugagagauugugugagugugugugagagagauugugugugugcaugugugaguguguuugauugugugagugugugugugaguguguauguguguuugagugugugaguguguuugaguguacauaucuguguguauuugaguguguguaggugugaguguaaguguguguaugucuauguuuguguuugaagaugauugugugagugugugugaguguguguuugauugugugaguguguauguguguuucagugugucaauguguuuaaguguacaugucuguguauauuuguguguauguagguguuagugugaguguaagugugugugucuguguuugaagauguuugugugaguguguauauauaaguguguaugcuugaguguaugugcaaguguguguguguuuguaugugugugugaguaugaguguguguugcaguuugagccuuuacuuucuacagaugcaugcuuuuccacugaguauuucauugacugggcuuuuuuguuuuuuuguuuugcuuuguuuuguuuaaauaauaaccccuugcuuuauuuaauuuuauaaauagcacuguuauaucugcaugugcuuuuuauuuuaauauuggugaugguguagagauuaaaaaaugaccugccuuccugaccuuuagauugaacauugaagaaugauguauucccuacauccucugggacuugcagaauuuaaucauccaguguuuucagagguguuuuaaucauagaauuuuagugugaccuucagaagucuccauucuuccagugccccacagauagccacccagccuauuuuggucaucagcugcugagaaucauggagauauccaacaaauggcaagcacuucucuuuaauuguaccuagccaucuuaaguaauagugagggcucuuaugucucccaggccaucuuugaaaucaacaguggccagauggccaugcuggaggcucacauaggugagaguuaucuuuccaacaaaaccagcuuccagucucauucuacaggaaauauugacugaugauugcugacaggaaggaaaucaagucucuaauguuuacuacagaaucgacaagagaaaugguuuuaaguuuggcuacaacaccuuauucuguuccaagcuucuugauauggucacugaccuauuuagcuuguggauguuuuuuaaauucaucaugugggcaguguuuccuccacuuguuucugcuuggaggccuuucaaauauaauuccaucucuaauaaccagcugagaugguugaagggcucauucuuuugaccugucaaccuacagaaaacaucaaauguugaccuugugcuacuaucaauuugauacaugucaaggucuuucucugcuucaugcacauguguauuuauagccccuauuuuuccucuuucagacuccagaagucuauuuguuuuuuauaugugugaucuuuaauguagaaagagaauuuugcaaguacuauuauggggcuagagagacagcuccaugguucggagugcacacuugcagagacaugggcucuguucuccaagagcaacugaguucuguucccagcaucuuucugguggccugugacuccagcuccagggaauaagacacucugguauggccuccacagcaugugaguucauguguacauaccuccacacagacaaacaauuuucacaauguacaaagucuugacagaauuggccuuuagcuuuuuucuuuacauucucagucuaaacaaacaagcaagcaugcugucacaaauugagcgugauuuaaagagaaauccuaaauuguuuugggaguaaauucgaaguugguauugguagagaauuaggaggagaagcauggagugcuugauuagaggcucagaucuuugcugaugcucucuuaggaaguggugcauguagauacgaaauugaaacaagguuauggagauagcucagcugguaacuauauacgcauagggacccaaauuagaaccccagcacacacauuaaaagccaggcacaguggcuucugcuuguaaucucuauguuggggagaaaacaggccaaucugaaacccacuggcuagccagcugagcccuaguuagggaacuacagauuaugauggaaagauccugccuaaaauaaaaagcagauagauuuccugagaaacuauacucaaggcugaugucugaccuccacacucauaccugcccacaugugugugcauccauacaccuacacaccuacacacacacacacacacacacacacacacagagagagagagagagagagagagagagagagagacacagacacaaaauaucuucaaguuuaaauuacuuuggguaucaaacccuuauagccauugauaaauuugucaaccugugagcaguuaaccaccaggauugugaaugguuagagcacagacugagguuaggcgcuguccuggguguuaguuggcguagugaccuggacaaaggugccaugaguagucuuggguaaagcaccuguguagcuaacauccuuuacauacacuaguucucaagcccaggaccucauuugucucugugacucagacucaggcugaccaucaaguuuucauccagccucuugcagguggaagcccagccuggcagcuucuugaacacccugcuuggauguacuccagcaaaccugagguucuaggaauucugagcagacuuccaccacccacccccugcuccagcacaacgcaacacuagcccuccaccugguguagcuuggcuuuuuguuggccaaggcaggguguuaaccuggugcauugcuguguggacugaaaacccuaggcaucuaucacacgaacuaguuuaaaaccaaguuucccacacauguaugcuuagcgauuggaagguuuugacccugaauguaggacucucuuuuuguauuuaucaccuuuauauuucauuacgcuaaaauagagcuuaaugcagcucuuccauuccagcuuaguuugagcuuugggucuugauuguuuucuuuaaacaguuuugauugaucacucuucaauacuuuguuauauaaauccauacuuaaagauucguaaacugugugugccaucagcuagugucucaaguccuaaugcacaguauggugaggcuccuagagugucuuaaagccauauucugaauuauuccgaugguugcauuguuacuguccuuguuacuuuuaucucaccuagccaacacaaugcuuguaccaggaacaacuacuccaccauugucuugagcuggccugugcuuucauuauuaguaucuugaacccauuguuucuuugugaaacucuuucuuguuguaagccagcuguucauuuuggaaagauugguuuaguuaaaacuagaaaauguaauccauaaaucuacuuaacagggcucagcuagauggcugugugggcugugugugguaauggggagggagaaaauagacaagggccuuauagccuuagcuguugggaauaucccagacaccucacaugcuucaugugacaugcuaucaucucuacuguagaccaggugacuccaucucuaccagucugugugccuacauaucugugaauauugaauuccuucuuucuuaacguuuaaaaacaaacagaaauagcucuaggacuguuuucuacaucaugugaaaucauuucacgagcuccuuaaagacuuguucacaccccuaagagccucuuauuucuguuugguagcucaccugaaguuguuugucauagucguguacaauauagaaauaggggugaaaaaauugugaugaauugcccuggguaugcugacccuugccuauaaucgcaacauggaagaggcugaaacaagagagccaguuaaguccaagucagacaagccuaggccaccucgucacucucuuucuccaaauaaaaauaaagacauaaaccaacaagcgagcauaaauagugaauucuuggaacaccagaacagacucucucuugguugauacugccucauuuuuuucaguguucuuaagagacaguucuuagacuagauugaguaaacguaauugagcugacagucugucccugacuucuccauuaaacauaccacugaauacacugauucuagaugucccuguggugguaauguuccugagccucugaaaucacaagcugagugagagguucauucccucaguuguuauuucauugguucucacugggaacccaugagaugggcacuuuauuucuagacuacaaauuaggcaacagagccauggaaagaguagaguugggauagcucuaaacaggaaguaaggugacaguugagcaucacuggaagucauuagaagaauauauuuggguguaugccccacauaaacacauagggugacugugcuggccucaagaugcaagaaagaaaaagugacuuuguucgcgguacucggauccauccagccuacugggggaggucugugcagauggucugcaauguccgcacuggcuucaucaagacaagauuuugcuagguaggccuuauuggucucagaguuacuauggaucccaggcuggccucaaaaucacaaccuuccuggggcuaccucccaagugcugggauuguggguaagccugcagaguauauguuuuaaaacaccguguucuccacauacaucacucucaaccaccauuuugaaaaaugaaacauuugaaccucugcauucugugccucucuuuucuccccaccauacugccucagggauagaggccagaguauccauagcugcugugugccuuuaaccugccaguuacaagccaccagcaccuccagacaaaaaauaucugggugcaccacuguugugccuugcccguuuuuacuccagucuuccaggcucuguucaucccugcugucuagaagcccaaucuaggcgccugcuuucuuuguggugugaugucaucuuaccaccugccucaaacaguaggguuuuuguuaaggacugaaggacuaagccacuuugaguuuuuuuuucuccuuucugaagaaauauuuuaguuauuuucaguuuuuuaucaugaauuuuucaacaaauuaaaaauguaaaaaaugguauaaucaauaucuagucaccaaccacuuaauauuccugucacuauuuuuuuuuuuuuuuuuuuuuuuugcuguuugcuuucggcugaauuauuuuuaagagcugaggauuuauguuaguuugcugccaaauauuuugguauugcaucuauuaaaaaauaagaaugcuggccagugaggcauggcuugcugggaaagcccgacuuugaucccuagaacccaugugaagguggaaagaaagaagcaaguucacaaaauugucuuuugucuuccacauauaaccugcauguacugcauguacacacacacacacacacacacacacacacacacacacacacacacagagagagagagagagagagagagagagagagagagagaacuaauacugacacugccuaauaauaaaaaaaaugacuguuaucacuauaguaaaacuauucuccuacacaaauggggugcuguguucacacaaaaaaauaauaacauaacuuuuacauauuguuuuuuuucucuaaaauauauuauguauuuuuuucaaacugaaacuuaguuaacucuugcauauuguaguuggcucuuauaucucaguuuuaggguuagggauuuuugguguaaagaaggugacauuauaagaccugguugauauauauauauauauauauucauuuuauuugaaugacuuuucagauuaaguagacuauugauuuagaugguuccggugguuuugcacuagguaguaaauggcgccggauauguucaaauuguaaaauauagaaaucucuaaagugugcccgggaaccacauuuuagcagaggucguccgucaucugcagauguucacgggacacuuacuacucugcugcuucgugcaugaaaccauccucuaagcagauaguacaucuaggguuugggcuuggcacugauaauggauuauaauagauugaaauuaaauaugauuuacaugacaggaaaaauggugccagcgaaguaaauaauugauuaauuguucccugguuaaagcuggcaaguuaaauugcaaggcuggaauugaaugucccccgaugcaucuuaguccuacuagaaacuucacagggauacaggucagcuacugcccagaaacagcaaagcagccuucccuugcuguguccaguuuacaccaagaugucccaugcauuaauaaagguauuagacagacagucagacagagagagacaagacagagagagagggagacagagagaaacagagagacugacuacacucaaggauaagcugccaaagaaauaaaaaaaccauagagacccacauuugcuuggaaaucaccaauuuagaaggucagagguagcacacauuuucuuuuucguuucuuuuucuuuuucagggcaaguacaguuauuugcuuauguauauuuuuauuagauauuuuuauauacauuucaaaugcuaucccaaaaguucccuauaccccccacccccacccugcuccccuacccacccacucccgcuucuuggcccuggcuuuccccuguacuggggcauauaaaguuugcaauaccaaggggccucucuucccagugauggcugacuaggccaucuucugcuacauaugcagcuagagacacgagcucuggggguacugguuaguucauauuguuguuccaccuauaggguugcaggccccuucagcuccuugggugcuuucucuagcuucuccauugggggcccuguuuuccaucuuauagaugacugugagcauccacuucuguauuuuccaggcacuggcauaguuucauacgagacagcuauaacagggucccuucagcaaaaucuuucuggcauauacaauagugucuggguuugguggcugauuaugggauggauccccggguggggcagucuuuggaugguccauccuuucaccuuagaguagcacacauuuucuuguuccuaugcugauuauggaacugggguuagugugacuucucaugaaugagucuaguguagcaaaacuagucacagguauguuggccacgaugugacuagcacagauccuggauuauugugagucauuuagacuuucagucauccaaucuuuaguacaucaucugaaaaugaaagauguggacagaagaucucugaaaugucuucugacccuucagauauaagguccugucaaaucagagucuacaaagucauggugacuucucuccuugugauuuuacaacuguucuuugucuucugugccuucgugaacacagcucacuagcugucucccuguauguuuccaagaccaccaaacaauuaacauggaccuaauuuauagggaguacuauaauuauuauuauuguuguucaugugcacacaugcaugcaugauguaugcauggguacccaugccaagacacauguguggaauccaaaugacaugcaauuuuguuccuuuucuugaagaucaguacuccuccaaggaugcuucauuaacuagaauguuuuguuagucagaauagaccauuuugugacuauguagaauuagaguaagucuacuguaauuugaaaaagauguacauauuuuagaaaauguaauaagcgcucacacauugcaguuucugcuuaaaagccuuuaauucacaguaacucagcaacguaagacagaaagagcugaccccagucauuacccaaggcaauguuguguugaauuuuaauuauaaagaucacuucagcauuuauauuuuccgggucagcaggauguguucuguauagcccuuaacgaacaucugagaugcuuccaucuguauuucucccucaucaaaugggaacaccuuugucacagaguaacaagugugaagcuagaucacagauguaaagugccucgcccacagcaugugcugacacuuuaaugaucacggauacuacaguaucucugagucuugggcaauuuucuuuggaguguaggguccuccagccaaucugcaugaccaagaacuuauuacauuaugucagucaucuuaauuaguucauaacauugaauugaccuugcagggauucaagaucuaacucaugaccucagaaagacagacaccuccucuuaguuuaauuuaaacaacucuggcucacacugcaggagucuucucuugagcacaugaugccauuuaucaacucuuccaauuucacuagcagcuggcuuaucugcaaauguaaacaaaugugaacaaagaaucuacaaaacagaccuuuguuaggaaauguuaugcuuagucuuuguauaugaaucugaacuuaggcuggauccaaugauauugccuuaauauaaagacuacaaaggcuaaaggggugaaauaaauuaggauucauagauggcaguaacauuaugacaccuaaauauuaaauugcaaauaguucuuuauuguuguaaccauugcaagaaaaaucagaaucuucaacccaauguuugucucugaaacuugcagacauccuuaaucauauuaauaaagauaauguccacacuggugauaaugagaaauaugaacauuaaaauuguacuuuauuguauuccuccucugcagugugagugugagugugugugugugugugugugugugugugugcgugugcacaugugcaggugaguguguguacacaugugggugggggaauguaguaauaguuuccgauacaccauccaccuuuucuaaaagggcuuagcucccuggcuugcagcucagcauguugcucaggccugccucuacuucccuuccaagggcugggauuucacaaacauacugccacacccagcuuuuuaugugaauucuggggaucaaacaggccccccacauuugcacagcagcccuuuauggacugugccacccccagucccuuccuucucucuucagugcucuauguagccauugucugugugcauguuacacaacagggaaaauguuaccuggcaguauuuuccagguccacuuaaagaaguguuucugccugugccuuguguaaguggagguaccaguagcauuuaguuaaugugcucugagcagaggacacuuccucuugccuuuggaaacacacccuugcaugcuagagucuacgacgcaagcauaucugaauacaaacggacaggcccgugagucuuccuggcacuaguuccuggauucauccagacccaggcaucuccaauaacauuuuaguuaguuuucaucaaaaucacucauaaucugguuuaaugauuccauaaaagccuugguucacccugccccaugugaauagaaauauuugccaugaaaaaaaauuaguuauuaguuuuauagcccugccuauuuccgugccucucuauauaaagaauaugaaaagagauauuaaaucucaauuuuuaauaacguuauugacaucuuuggggagcuuuauaacacuugacauuugcuuucgguguuggggagagagggagaaaguaaauugauuugguauuuauuuccgaaguuggaguaugacaaguuacuuuaaacauaaaauauguaggcacuuuggaacacaaugaacggaauggguuguugguuuugaaagugaacauaaauuuuagaaucaaauggguaaugugguaaugauaauaacaucauuugaucgcuaaacgaaccuguuuuauuauauucaucacuggauuucuauugccaccuagacagccuucaaaauugauagaacgugaugucuggaccugcagaacacagcucaugacugaacgucacagcucuugugaugaaaguuaaauucuucagagugcuaggcuuucaauagauccuuuuuuauagacaaaauguauguguuucaaaagagcacccucugaauguggacuucuuuguaagaaauagacauccauuuugcaauggacacuugcuuccaguuguuagcaauccaggaaugcacaggggagaugauggggauauuggcugggcacauguagauaagaucuagaaaaagccuaguaaaaucuugguggggugaagagaagccaagaucuuugccacuaccuuaacaggucaacugugacucaaaggcuggcuugaacccuacacaaucaguucaggaagauucuugcuuuguuauuuuguuuuauaucggucucauguagcucuagcugaccucagacuuauagaagugagaaugacccugaacgccugguguccuccccccccccccaacuuccaucucuaagacccaggacuauagucaugaaucaucacagccagaccaaaaaacuucccgcugcauaauaagugguacagaaagcggacuuggcagauuccaagccaguaagagacugucuggaaaaacaaagaugcacaggaccuaggaaacaacacuuagggcuaucguuuggccucugcauguacgugcacauacacaugcacagagguacacucucaccuacacacacauguaccuauacaugcaugaaaacagacauauagacacacacacagagacacacagacacaaacacacacacacacacacacacacacaagcucauaaaaugucaacucaucacauuuggucacuagacacuuaaggccagcucaggcaccagugaccuugaaugcaugagauucaguaccuuauucaguacuguaugagcuagugaguccccugguugagccauuagcuugcugccagaugcucaggggugguaaaaugcuuguuucucugcugcguacuugcacguucgggcaaaggcuuacaacuuuguacgucuccauccgccauccagcuucuuguaucugcugcucccauccccucgagugccagucugcucgaguucuucucccugccuugcuaaaugaagaugacgccaucuuauuuaccccagcaguguuucuuguguagauagauguuaaacuaugcaauagauuuuuuuaaaugaaauuuuaauuacuuucugcuauucugagcucauugcaaucagcagccaucuugcuggaagauaaaacaaaacaaagccgcucacugggaggagcaaaggccuuuuuugcagaguggggcacagaagcccauugucagcagcagcuguggacgccuuccccaggcacaggcucaacugucacaggguucagagguuuugaguuuuccacugauguuccucuucccuaaugaggucaccucucagcacaguaggggaacaacucugcuaaugggagacucagaaaugcauguugcaauuaccacucuuuguuucuaucuaucucccauaguuuccaaacagccgagagcuagaagggggguguuguguugcuugcuccucugaaaauauggaacagaacuagagaggggagcugcaucuuuuauagacuagccccugauuuccagccauugugcugugcuguuauuucuaaaauauugaggaugggagcaacucacuuuccucugaaaugacucuggccagcaguucaugugaugaccaugcuggcguggcaacuaaaucuuugucaaugacaacuuccuauauuugauuagucacuugauauacauuaugcucccccuucaaaaucaaaagguuuaaaugauccaucuguggcuucccucugguaccaucuucuacaaaaugauuauaacaccaucauuucaaacccacuauuugaaauggacaaaguaaaaugcauaaaaaugcuuugaaaaugcauaauucucuaauaaaacagugcccaauaaugauaggcagcaaaauagauuuuugugggaacgacacagaaaguggaaacaaaggaauaagaauauuccccaccguguuuccccuucaaggacucugagaggggacgcuccagcuagugacugaggcuggcacuaggucgacucaggauaagggguguagcucuccguuacuauuguaaucucuguucucccugaggacuggauuaggauccucaaguugccaugacaacaagcagcucuuagccacauugcucuaguuauuuuguuuguuguucauuuguuuguuuguuuguuuguuugucuguuuguuuguugagccuuucuuuuucccuuugucagagaaagcuauuauuugaauuuuucaaucaucugaauuccugacuauuucuuggaucuaguuguaaaccacuaauuccucuuucccucgauguuuccucucagugagacaggaugaaggguagaauaugaaacaagaucccauuugaaugccagccuggaguugaggaagcaggccuucuuccaagagaaaacauuagcuggaguugugucaggguguggaggcugauccaaagcuuugaugugucucucugucuugaauuuauagcugcauaaccaccuguguggcugaacguguccagcauggcuguggacgcuuucagguaugcucagaccucacaagaguguugagaagguagugcuucugucccguguucaagaagauguguucagaaaagcuguuuugccucagcaacuccacucuugugcaugaggcccucauuuuucucagagggauaaaacagaagucagaagguuaguaucuuaccuccugcccucucacuauuggccaaaacccugagcaucccagcuacuccccccuacagccucugauaggaccauacuuagucacauaggagcaucacuuaaugguuucaagccaaccagcagguugagauucugaaggaaaugauugcccauacucuccucuaaccaagacuccuaaaagucguuuucuggagcuuagauuuuuguagauaggagcaagugaccuugcuggagauuggauagacccugguagacccugagucauucucuaugauaagaggcuacauccccacaguacuuugacuaagucugugccuuuuugauguaucccuguuugcauuacaaggaaucaaaauaggaccugauguacguuggcaaguacucggccacggagcagcaaccacagccccauuuugcugccuuagugguauuggcggcauauuauuuauaaacacaauaauaccacaagagauaucuuuuuauaagaauuaaucuguagaccacauaaaauugcauaugagggcagauauugagcccagagaagccaucuaggaaucuguuaucauaauccagaugaaggauaacauaugguugaagacagagccagcgggaauagaagaaaacggaaaauggaggaagcaagaucaugcaaacagaagggcugguggugaauugagaaucuaggucugaggccugcaggguuuagaacuagauaacaguauuaaaggaguccuggaggugaggcccaucauggucucaauuucucugucugucucagauucaaacauugaggacaauguuaauuuucuuuaacugacacuccuugguguuucauuuaaucacgcuuauguuagcguauugcuuucugcugcuuuccacugcagauggauuagccaaacuuugugccgcagccagagagcaaaccgaauuacuauuuauaaugcaguuucuauggaaaaugcaaaucgaguugggcauguugugcugugggcuucuuuuguugcuuucuugcuugaagagaaauauucucaccguagguguggaauugacucucgguaaggagguaaaacggggaggcauguauuagugcguuuguuaaucauucgaagaaaagucagaauugaaaagggauugugacgguugaaaaggaauugagguggcaauguaugcaguugguucaaugaguuaaauacugaaaggaaagcaagggcuguuucauuuuuuuaaaaaaaucaauuaugccauggugaaaauaaauuacaaggacaggucugguggugcaugcuuuuaaucccagcacuugggaagcagaggcaggcagaucucugugaguucaaggucagccuggucuacaugauggguuccagaauauccagggcuauguagagagaccuugucuggaaaaaaaauaaaaaauaaaaaauugcagacaggcaaaucauuauuuucagaaaggaaccaauauuagugaacauauccccgagugauagagaauuugaauuaagauaucaagcaauguaaauguucuuuguaguggggucaugggguggauuggaaugugcauugaaguuugaguugauucagaaaaaaaucaauguugcucucuauggcaaggaaaggguuacacaugcugcucugucuucagggaaaccaaggaagucacuggggguucuuggugugcaugccucucuguggagacuaucauuuauacuguauucuguucaacuccacaagucuuuauaaagcaucuuucucccaagcuaacacuaguacaggaaguggaggaaucauaagcucaugaccucucuuccccuggcauuagggauauauaauucaguuggagaggcagggcagacagacagacaccagacagauaugagccagguagaguacacaaaagguagaguuuucccauacugucaggggaucuucacuauggacaugccauaagcccugugaacugggguaguuuggggagacuuugaagagagagggauucagaaacaguuuagauggauucgggauagaaaaaaugguuuggugagggagacggggaaaguuguugaaaauucaucuaauaucaagauuuggccauuacuggacaggaaaagggugaguccguaagaccuuaugauguuagaccuaaaagugcaggaggaggaggagcugagccaggccaugguacugagguuacucucugggacaccagacacucugcugauacucuaagacgacaaccuuccaaguggugacucuggccugccuccggcuccuaaauucaaaucuugaaucuuaaaugggccuuagccugaaccacagcaacuguggcacaauugaaaggacucaaaguacagagagcaaaacuugcagagcagagccuuguccacuugcaaaagcuccagccugcucagccagcacacaugggagccggggagagcacgagaaaacagcuggaucaaacugaccuucuuucaugaucucaaaauaauuccucaaagugaaaaaguccuuucugcuggggaggcuguaagugacuagucaguuggacauggcuaggagacaguccccugccugcacaagucaauacagcuuucauuuuuaaaggaggcuugccauucuauagaacaagccauaaaguugccuaguuagcgcauguuuucugagaucccacacuccacccuugagcuugaggaaagacauccuaccccucucucauccuaaucucccacauccucugucaguguucccugaagcucuuccuacagagcaggggcugcaggaugacacuggccagccaaaccuuaguagugguuucucagcuuggacccugucacaaaccaguaguguguccucuugcuucaagugcaacaaacacucauugaggaccccacugagcaacucccugguccucagccucucuggauuugguagcucgauuaagacaugccuugaacacuaugauaaggcaccaugaccaaggcaacauuaagagaaaacauuugauugagcucacaguuacagaggaugagucuaugaccaucacaguggggaacaugguagcccacagacaugguacuggagcaguagcugagagcuaauauugauccacaaacaggagauagaaagagacaaagauaacugggaaugacaugggcuuuugaacccuuaaagcccacccccagugacacaccucccuccaacaaggccacaccuccuaauccuucccaaacaguuccaccauaggugggcguaugggaagggggaauaagcauucaaacuuaaugaggcuauaagggccauucucauucaagacaccaggaaggauagaaggcaggugugguugucaaggauauaccaaaaggaacccccagcaggaugacaggccucaaggauggaggaggucuagggaccacuccacggacuguaaucgcaagaaaacaccccucuacacauugccuucagauagccagugaccuuagaacugguucaucuaauuggagagggggaguggguucuaaagaaagcuaaaaauauuugagaagcgcccuaaacuuaagcucacagugaguuggaagaacacaucacuugugugagucuagcuggagccagagauagauuucaggcauccuccucugcuucuuucaaccauauauuuuaaaaccgucucucacugagccuggagcuuguuagcuugguaacacgaccaaugagcccuaaacaaaugaauauuuguuuucaacccuuaaggucagagcucaggcuuugcaacuuugacacaccacauguggagguccugguggugaggcccugucuuugcacaugguacucaaguguaaaagcuguagaaccuugcuggggccauggcacauuuccacaacuccgcguuugagcuccucugcuugaaacaugccggcucccuuucuuuuuauagcaaacggagacagcaacugucacacauggccuggcaacuucucgucuccaagccaacaugugaaaggagucaggguaauguguucuaaaaauauuggugcagugcugaaaaaugcauauuuccaacauguucuccuucagaucccuuugccuuggcaggcaggcaggcauuaccucugcaugcuuucugcgcugugcauaccaggcccauccuuagccagggcgacuuugccauuguucaugcucuucaugaaaguggcaccaguagauaaucauagagaauuuuaaauauuauuuagugguccagccaacaaaacuauugaggcugggagauggcuaaguagguaaagagcuacccacacaagcacugaguccugguuucugaucucagcacccguguaaaagacaggcaugcuggcauaugccuguaacucaacucuggguaugacagagacagauggauccuggggaccugcuggucagcuagucuagccaaacaacaagacaggcuccaggcucggugagaaacccugucucaaaaaaauaaguggacagagguagaggaagauacccaaagucaauauggugagugcagccaucuauaaaugagcacauggaugcagacauguacacaaugauaaaaacauauacaaauuccaaaagcaaaacuacuguauagucacuauuauauugucacauauauuuguauauauaugcacauauauaaacauauguguauguguguguguauguaccuguacaaguacauauaugcauauauaaaaccuuuggucccucuuuuaaaaaaugugaagggcaauguguaagcagacaggcaaguaauggggcaggaagauagucaaagugacaaguaaagaugcaccaugugacauuagggaagcgcuaaugcacagcaggagcuugugggaagaguguuaagaaucagggaagacuuaauugaaaagaccaggcuuuauguaggacuuccuagagagggcugccaucaagaaaguguuccuuccagcagaggaaagagagaggacaggugugaagugccuugaaccgcaggcagcacagcaugccuaggacagggagcaugcucaaggaacagacugcagggaagauaugggacauagcuucaaugaaacccagagacaucuuuacaucuuacauugggagcuuugacucaagcaucuuguuaggugggagaccaagccaccucaaccccccccccccccaaauggcaucaugauaccugcacaguauacagauggccuugauaucaguagaagaaugagucccugagacuugacccagagcaaagaaaccagacacauuaaauagccacugguccaggugagaacugcccaagccugagcugggacaguuccacugaugaaguucugaggaaaggcacagauagugaagcggaacaacugguaacuccgaguuacuugagguagaaaagcauuugcuaugugagcagaugaugagauggcgcccccuugaguaugaaugagagaacaggcuugaaugggaaauacaaggaugaguuuugcaaaaggcagaggcuuucagaugaaaauugaagaggucaucugucugugagucuaagaagacaggccugggcuagaggaguaaauuuaggagccugucuucuggguauaggugucugugaugucagugggaaaagaaggagcaaaaagggucaaaaagagcuaucuuugacaaucaggucuggguuugaggucugugucuaccccugcucgcuaggcaaguaaccuaaagaaaguuguguagccacacugaaccccacucuucuccgugauucaaaggaggugagaauacaaccuuaagaggcuucuuagaauuugauuguuaauuaaauaaauacaaaauucuuacuguguguuugaaccuagaaacaccaaguggacaucauucaugcuuccauccucauguuaggguggagcauccauuagauguguauaacacaaacaguauuacugaagauacaaggaaguacagcacgggauaauggaugucggggcucuggcacuauuuauaucugaguggguccucaaguaguuccagcaagagaacugacauacauugucacuuuccgugacauuguucagacagacucugauuggcaguggcucaaggagaaagugggaaggaugaguuuguugauaaugaucaaagguugcuauuucaacgucgagcuguuaugagaaauaaugaucuugaaggcuagcuagagcagacggguacuugaggagagguuuggggauuccuagaugagaguccuaggcauagugguacaccgagggauggagcagguggggagaauacaguaaaggaagaggaaaggagaccucuagggagacuggcagaugccaagaacgagcccuuugcugagauagcauaggaagugcgugaagauuaaaugggauaaugcauucugaagugcagggagcagcauaugguggguacuuaagaagcuguugacagcagagucacuauagauaguguauuagucaggguucugcagagagagaacaaauggagaaugcacaucaauguauaagaagggauucauuuaugauucauugagucacaagauuaagguuaugguaaaccccacaacagguuuuucugaaaaccagacacccuaggcugacaguuguguguuucaacccaagccugaaggucucagaaccaaggaaacuggcuauauaacucuuauucuauuguuucuuuaauauuuguuuauuuauuuugagauagguuucucaguguaguccuggcuguccuggaacuugcucuguagacaaggcuggccucacacucagagaucugcuugccucugcccuccgugugcugggaguaagaacaugugccauuacccccuugaaacucuaauucuaaaagccucggagaguagggcuacagguccaaguccuggaauccuaaggucaaggaaccuggagcucugauuucuuaagggcacagcaggaaucucuguaagcucucagaaauggagggcauuuugccuuucaaauucaucuuuucuggacccucuacugauuauauguugcccaccuguacuaaaggcaggucuuguccucagacuugcauaccaucucuccggggucaucucacagauacccaaaagcacagugaggauaauuucuaaguauucuuuacgucagucaggcugauacccaaacugagacaccagagauaaacacaugcauaagcauucacauauguaccccacagagaaguaagucucucuugggacucaccuagggggaacuaaaagucccuucuguccccuuguuuuuuuuaucaagaaaguaaauugucugcugagacaaaggcagaacucuaaggucaugaggauaagaaggaugguuuuuauuguuguuguuguuuaagauauuccuuuuuauuggauauuuucuuuauuuacauuucaaauguuauccccuuuucugguuucucucucucccagaaacgcccuaucacauccucccucugccugcuucuaugaggguauuccuccauccaccuacccacuccuugccuucaguuccccuacacuggagcaucuaucgagacuucauaggaccaaggaccucuacuucuccucccauugaugcaugauaaagccaaccucugcuacauaugcaguuggagccauagucccugagagcucuggggggucugguuggcugauauugucguucuuccugugggguugaaaacccuuucagcuccuucaguccuuucucuaacuccucuauugggagccccacacucaguacaaugguugccugugaacauucgccuccgcauuuguaaggcucuggaagggucucucaggagacagccauaucaggcuucuuucagcauguacuucuuggcauccacaagagugucugggcuugguaacuauauaugggaugaauccccaggugggacagucucuggguggccuuuccuucagucucuguucaaaacuuuaucuccauauuugcuccugugaguauuuuguuuuccucuaagaaggacugaaguacccacacuuuggucuuccuucuuauugagcuucauguggucuuugaauuauauccugguuauuuggagcuuuggggcuaauauccacuuaucacugagugcauaccauguguguucuuuugugauuggguuaccucacucaggaugauauuuucuauuucuauccauuugccuaaguauuucaagaauucaucauuuuuaauagcugaguaguacuccauuguguaaguguaccacauuuucuauauccauuccucuguugaaggacaucuggguucuuuccagcuccuggcuauuauaaauaaggcugcuaugaacauaguagaguauguguccuuguuauauguuggagcaucuuuugugcuuguucaacuggaggucaacauauagaagaaugcaaaucaauccauucuuaucuccuguacaaagcucaaguccagguggaucaaggaccuccacauaaaaccagauucacugaaacuuauagaggagaaagggggaagagccucgaacacaugggcacagggguaaaaguuccugaacagaacaccaauggcuugugcuguaagaucaagaaucgacaaaugggaccucauaaaauuacaaagcuucuguaaggcaaggauacugucaauaggacaaaaaggcaaccaacagauugugaaaagaucuuuaccaauccuacauccaauagagggcuaauauccaauauauacaaagaacucaaguuagaguacagagaaccaaauaucccuauuaaaaauggaguacagagcuaaacaaggaauuuucaacugaggaacauugaauguccaagaagcaccuaaagaaauguucgacauccuuagucaucagugaaaugcaaaucaaaacaacccuaagaguccaccucacaccagucagaauagcuaaaaucaaaaacucaggugacagcagaugauggcaaggauguagaaaaacaggaacauuccuccauugcugguacaaccauucuggaaaucaguuuggcaauuccucagaaaauuggacauacugcuaauugagaacccagcuauaccauuccugggcauauacccagaagaugcuccaacauguaauaaagagagugaugguuuaaacuggccauaaaggaaugaaaaggugagacuugacccagaagaggaccacggggguauggagagcuccuacauaaacauuuuggguagaaaguucccuccaggaaguacuauuuccaucaguacugauggcuucaaccuuggagacugccauuuugaaugugguguagcagaguuucugaaagauccuuguaccccgagagaaacauguuuuagggagauguuaaaaaugauaaucaagugacuggaacgcuggugcucauggagaggaagacauugaugaaaggggacaagacagagacagagacagagacagagacagagaggggucuguacugucuguuucuaaccaugugaugccaugggccaccuuaagauuuugccggcaugagugcuaagaagcaaugggcucuguguaggguguaagacaaagccuauagcuuugacaagucagauggacaucacacacagagccauuucagguggcacucugaagacagcccugagcccuagaaguuuguaucugacagccuaccacaccagauugcucauguguaauaugcucuaugcaagaagaagcuaaaaccaacaaaaaucaaguagacaccaugggguagcuacagaaaggcucuuggagauauauguaccgggaagagggcaaggagaaaccaaagacaggaagggggagagaaaguauuguuugaaauuguauaagauguuugggagggaaaggcuaggaugauagugacuugguggaaggaugaaacaggacagagacagggcaagcaaagagcugguugcuggaugguucuacaaucagaagagaacuccuuggaucuaugucuuucuaaaauguaaaagaacguuaaugugaagagguggcaagcuggugacuucguuauuguuggugauagagaauguggccacauucagguggaaagcuuaguguggaugcugacagccauucuuaccucucuuuagaccuggggugugagccuaggaagcaagcagucaaucacauguagacuugcccaggacauucaugacuucugccuuuuuugccaguauaaucuccauuauacucuugucauucaguagacugguggcauauguugcaaagucacccuacagagaagcugcagagauucagaccagugacaacauccaaauaggacucacaaauuugaggcacaguggagucauagagaggaagguauggcucaaacuggucaaacaucaaugguguuugaaauaugauuagaauucaguagcuggacagagagccacacccaaaauaaaaauuucccaagguuuguuuuuuuguuuuuuuuuucacaccacgugagaucuacagcaguccuuuuguucauauuuauucugcucgguacaauugccaacaaaugcuuuuguccuuuguuguuuguggugcugguuugguuuggguuuuuuuuuuuuccuauauucuugauauauuaugcucuuacuagccacacgaucacuuaggugcuuggaagucugacauuuuaaaaaucaauaucuuaaguguuugaggguaugguggguauguggggaacaagccccuuuauucuucuaaaaguuacugagggacccaauguuguuguauuugggcuggauacuaacagaaauuaacacugggaaucugaagugucuaugaagucauuuuaaauuaaguauaaugcuacaauagguuauaaauaauauauuuugugaaaaaugauuaaaauuucacaaacaaaaccuagauuuuuuaaaaguccuguggcaaguuuccuugauauuugccuugaauaaaagauggcuugauucucuuaucugccucugcaugcaguccucuguguagaccauucuuguugaaagauaggaggaaaagccauccucauguggauauacugcaaauaccuuagccuguuuucuuuugagaauaacacaauauacacaauaucucagacugaggagaauuauugagaaaggugguuuauuugaauacauggcuagccggcagaaucuuaagguggcccauggcaucacaugguuagaaacagacaguacagaccccucucugucucugucucugucucugucucugucucugucucugucucugucucugucucugucucucugucucucugucuccgucucucugucucucucugugucucugugucucucugucugucugucugucugucugucugucugucugucucucucucucucucucucuguguguguguguguguguguguguguguguguguguguguuuguguguguguguguguguguguguguucuggucucacucccuuuucuuauaaaccuuccaggauucagucaugggggguucacuguggcgaccuuacuuaaucuuaauacaugaaaauuauacgcuucacuccaaugaagacuaaguuucagcccauuccuugugggacacaauucaaucguagccaaacuaaagcauggagugaagacgauuucagugcacuguacagaucuucaaagguguuugaaacacgaaaaugugacaaauggcauuuucuuaaaagccacuuacaauacagaaucugaagccaucacguagcucugagcuuuuuguacuuugucacauaaaagcacacugcuuuccacacaccauaagccauuaacuuaugcaugauuuuuaaacauuauauguucguauuuagaaaaaaaaauggauucaccaaaucauugacaaauguauugacaggaauaauauuuguaauauauauauaauuuuaaauugcaugcauuauuguuacuacaacuucagcagcaaagucguuaaguguugcaaagcuguuaagugcacacuaguaggaacaggcuuccccaaacaguaauuuuucuugaaagucugaauuuuuaccaucaaccacagauacuuucaaauuguuuauguaagaugacaagcucacuucauucauuuugaaaaauaacuuccaaguaucgaagacugaauuucuguacauugcuugucaguaguuauuucaaaugggauaaguuugucuagugguacuuacagcucacagcucaacauacccagauaccacugcacuugggcccacagaagcacagcucauucuaucuugccuuuacaucauggagagcauuaagauggccuuacgacucacuuuccuuucuacaucucucuugguccccaguuuagacccugcuguaauaaguuaacccuugaagauacuacuuuguugagguuguuuuucacuagucuguggcuuacccacccacaccacagaguccuugaagaggauucacacucauuccuucccagaaccuaugguauuuugcccaggugguuggguaguagacacuuacaguccacaguugucaaguggauacuagguggaugaaauuaacaagagccucuccuguauuccaagucaaguguuauccuuuggagcuuauuuuggucagguggcuauuaagacaaaaacaucaccuaaaacaaucagcauaucuaugguuuguaguuaucuaaaacaguaggcuuaugcauaaguguauuucaucaauaacaaauuacaacucauugucucuaacagugggugcugccucuaaugccaacagcaucuauggcgaacuaaaaauccagcauaucucugauuguaagaugggauuaucucguugaagcaugcagccccuaccgagaacaaugauuuacuuaaucuuucugaauucuauagaggcgcccgcccaugggagugcaaucagaacgaggcucuaacacaaucaaugguuugcugcaguguauuuguaaaauguaacaagauuauuuauuaaaugugcagucauacagcuccccaaguuugauuucuggaauacuauacuuaauaauuagaagguacacucuguguugcgcacauuuaaaccuggcgucauuucucaaguguuuauguaucugaacagucgacuucuuugugugcaaacaucuacgagaaauaaaaaugauacuugaucaucgggaaguacgcagcugcagaaacacagcaaguaugucucuauuucucugcucagccauccuccuuaguacuaucccccugagcaggcacucuccagcuggcugaaagucauuagaugucucaacaggaaaggaaaaggcugugggguagaacuuacagugaagaauuuaccuguaauuuaauuggaauuccggaguuuucaugcaguaaauggacuuauuauacagggaauuguuaguauuaaguacaucuauuuuuuucuuauauuuauuuauuaugggugguagcaugcaugugguauaggcagaggaccugugggaguugguucucuccucucacuguguggguuuccgggauggaacccagguugucaggcuugacagcaagugccuuaccuacucagccuuguggagcuuuugguaaccuaauuuuucaacucuugucgaaauggccccagugcuaaucagcucugccauucacuacuauauguagcccuuuccuucccacuauccugaaacuuuagguuucauuguucuugaacucugcacacccugugccugaagaagcuguggccaacaagaacacucugguuugagucuaguuguuuuucugcuuggcuccugaggucacacagaggggcacacgcugcugaguuuccuuaagucagccuuugaaugccagguacaggaacauagcuacagacagucucuugcuacauuaaaguugacagugucugcagagucaugaagcuaaaugguguuuuuggaaagugaguuuguaucuuaguucugccuuguccuggguuaccagcugccccaguuuccaugggaccacuccgacagcgagacauagaguccagggccucuuuuaacaauguccaguuuuccugauaugauacaaaaucccagaucuugcccccuggaagugaacuuggaaccacugagauuuucaagaauuaaaaagaaucagacauaaccaguguucguugaucuucaaagaagagaaacucuagaacauuucuuucucugauccaguuuuuuuuuguuguuuuuuuuuuuuuuuuuuuuugguuugguuuuguuuuguuuuuguuuuuuggcccacaguggcuaauacaaaaacucaaacccacuuggccuugguccuguuuuguuagaaacuguugguguuccugugccaguggugguccuggguguucaucaugaacuuuugacaugacuauucuuggaggugcaaauggcugugccaguuccaaacgaagagggucacagaggguucugcuuauauagugugguuucuggaaggaauucacuacagauugcauaagggagcauagcacaggagacucugcugacccaggcgauuuuuacaagguuaagucagccauaaauccagucuggcccugacaguuccucugagagugguuuugagacuggauggaacucuagcuucuugagcauugagauaugcaaccuccacuuucuaaaauggaucugugcaaauccuacaucaggaaagguggagcaugagugcccaggccuugugaccauuuuguagagaaaagaggcacaagcuuucucuuauaccugaucuuggccuacacagucuguuagaacuuacauuacaaaugaagacuaaggacagggagugaugauaccuccaagaaaacaacuuacuuuucuuuucuagaaaaugaaaauuacauacuauugggaguuucuuuugaugguucugauagucuuauuuuuuaaauuuguugcuuccaaauugucauuccuuccccuucugggugucauuuuaaagagaggagauacccucauuuggagguucaugcagguaucaccucagacuuuggucaaauguauuauuugauaaccuacaagaaauauuugggcuccauugucuugguucugccaucauccuuaguuuagacuuuagaccaacuuaaucuuguagucagguuaaaguacuuuagaaaaaauuagcacauacauauuaggugagcauauauaagucccuaggcugagccuggucaauacauugugcuaguaaaggucacugugccuucuguggaucuggaggauguaguagaagauucuuauuucguuuucacaccucugccuaucagugugcagauagugaagguuuuagccuuuggugcuuuguagcaagcggaguugagggagaagagaaaugaggagaagcauccugugucucugcagagccuccuaugccagggaacaagcuggccguguuuucccauauccugugcugauuuugcccccaaaaccuuggcuuggauuucucccugcauugaaugggaaaccuugcacacaccagccaggugagcuacugucgacauguuuucagaaugcaacagugccuugccaggaaguaacgaccacuuagguaaaacaucugaaagcaaguaguuguggauuuuacuuuucuguagauucuguaccgcuuaccuacaguuucuuuguacguaggguggggaucugaguugguuguggaguacuauaagguaauugccacagaagcaaguuugggauccuacgguaauuuaacagacagauaaaaccaucaagauacauuauggcaacaguguuuucuacuugacuuccauucauccaaagcauaucccuugucuugacauuuauguguuaaaaagaaaaauacagcccaugccugagauaugagcugcucauagaagaagucagagcccaggugccugcuguuaucuuacagacuguuuuugcagugccugcgccuagccuaauaaccaccacuggggaggaaauggaagaaccauuuuucuuuucuaaauugcacggcaagcaagcccaugaugucacucuccuugaacaaauaacagugaagaaauguuuuauuggauuuuuuuuuuuuagauaaauacaaaguguuguauagguuuaaaaauguugcaauggggaaggagacaaaagaaugucgaacuguccaaguguuugucucuccaacaaaugucacugcguucugcccuggcuaugcugcuuuguugauacaggcacggggcauauucucagugggcagcagccaaggcagagacagcccagacacaaguucaugaauaauucaagacaccacccugguggccacuggagcacgugcucuccuguagauuugaaauggauguuuaguucauuugucuuggccgcucuggaaaggggagcucaacuggacugccugggaaauucaccuggcaggcuuggucaccccuaucccuaaccauuccuagauccucucaucccugcaugcuuguaccuccuagucagauguaggucuuuucaagcuccuuguguguucugauacacaagagggagagguuuugcucugaaagguaugucuuggagaggacucugguaccugcucagcccaaaaucucaaagcaaauugcccucuguauucaagggaagguguugucuuaccucccggcugaagcagagaagacuguuggagacugaagccagggauauaauguccuucaucuguggcauaucuuuuucugucuguaagauaaauaccacgaaagugcugaaaagucugacaaaaaccacucguguugcugguucacaucagcguuggcucugcagcccggacagccagccagacuuaaugcuuuuguuaugauuagacccuguuucuuucccccaggagaauaggaugucacaguuuugaccuuugugguuugauauuaaauuaguccucagccagaaaguucagaacugggucugagguucccagacuuuucuccuggacagccaucaagagcauucagaggaguagugugucaaaaccaaagcaucucucauaggaauucugguacuugaaaaggagaggauguacccaguccugucuggaagagacagaagggagugcugcucacugugcucugguaggaaagacagugaauuauaaauccugccaaaaugggucuugagguagaugagaagggagcaucuugaaugguguugaggaaacauuuuauuuuaaccuaagauuuaaguuuuuaagaaaggcauuaugguuugcgguuuggcuaucuuauuguccuaaaucccauuaguauucuggguauugcgucaggggcuggaugcaaggaagaaagcucaucuuaagagucuggaguggacagugcagaaacagaugggaaggaaauauuuacacaggaguuucaaaagggauguacccagauaugggagucuuucucauugcauugguauauccuucccauguggcaacugagugugcagggucacugagcaccccggggcacauggugcacacugugaaccugauaucaauguuggcaacuucaguauuaggggagauagaguguguguagcuauuucacgauauggaauggagcacuuuccauguggagcugucauuguugguagaccagaugccuccgcugauucuucucuacaguuuuaacuaauauguccucucuuauagagggauaucauaugguaaaaaagcuaaagagguucacacuguucugaaugcuucacaucugaugucaugugcccauaguuuaccccaauguacaaacuauucuccaggagacaucccaagagugcccacuaauuugauaguaucuauuuaaaaguaucaauucugaugcuaugcuuuuauuguuggagucagaucacacagguuugggaucaguuccauaauccccauucccucaccucagaggccaauugugcaucuccaaaugugacuccaugaauuucccccaccagcuaucaagguuuccaugaccuccuguucaagcggcuugcuacagugauuaacagaacucagggaaggauuucauuauucuuuccuacuuauuacaagugauauuguagaugauacagaugccagauacacccaguaugaaaaaggacaagaaacauggggagggacacagagcuuccaucucucucucucucucucaacaaauuucuuuuuuaauuuuuaagaaggaaacacauuucuauuuuuuauuaagauucagacucucaaguguggugucuggguugcucuguuuugccucagcugcagucuuuaccugcuugacaaguaacggaaacugagaaguaguaagaaucacuaccuccaagauaaaggaaggggucaccuauagucaauacaagaauggcuuacagacaaccuagcugagcuuacaaggacaucuggucugagcaggggucuguaaagcugcccuaacuuaacaaauauggguaugcccuguuugccuauauccuuaaaacccaccacucaccacugagcaaagagaagcaaacccuagauguucccugcccugaccaccccauuuguggcccuucucauguggugguccagccuagcuagaacacuaccaucagcaguccuggcuucugaucugccccucagcuucuguuguucccaaguagcagaauggauauaucucuguuccaugccucuucauauuccucugcccucucccugagagggggugauaaugaggcagugaguagcaagaagccagcaucaaaaagagagagaagcacagagagcgaagaucacagacaaagccuuaccuuccaagcuucggaugccuuucagcauagucucugcaagauaaauaauaugaagcaaguuuguaagugaagaacuguagguaucacaaaaacacccagaauauagaggucaccuguggguacuacauggcugcaacagugagccaggguaucgcuguuaaacuacaggucuggguauuagcucuguguucuuaggcugucugucugaaucuuucugguuuguauuuccucacuuguugagcagauuaauuauaucuccugauuuguagcagauagaagaaaauuagaacgcugucuugggcaaaugcagucacccuugggauaaaaacaaacuucucucuaacuaugucuaaguuagaaauauacuaacuucauggcaugucaguuccauguagccccugacacacaccagaaagagaaagaaaggaaaagaagggagggagggagggagggagggggggagggagggagggagagagggagagagaaagagagagagagagagagagagagagagagagagagaagaaagaaggaagggaaugaaaggaaggaaggaagaauuauuuuacauacuacauaacuaagacucgauuuuaccagacugaauuuuaaaggauggauuuuuauaaaauugacucucauauuuguucauuccugcauuuagucaacggaaauuugauuucuagcucuuuggaacuucaauggaacuacuuuccuugcguuuaaaaggagcucagaugccgagaaacauuauuuuuaggacuggaagccucuuuaugcugacugcugaauggucuugauccugcuaucggagcugucuucucuccuguagugugugagcucaccuugaugccauagaggcgcugucgagaaucacaaacccuggcgccuugcugcugaccacugaucucagugcuagauggggauggaauguucucugcgucucuacacaucccucagagcaucaguguugcaauccugggaccaaauacaauucuaaauggcagugagcagcauuacagagaacacggucuagggacucaugguaggcacaucuuccagguuugcucuccugaagccuucagugcaaugcugccacaaugguucaggcugcuucuccacagaagcagugcgggugucacuguagcuguagagcucacggcuccagaauauauuaaaaaugcuuuuaaggaaagaaauauuucaucaaaccuugcucuguauucuuuggucacuccaaggguucaaugcuaagcuuuccagugaagagcagaccccuaggcaggugaagcauucaggccaugguacacagaagucucuuccugugcagagagaugugguucgucccuagauggcagucuggauacugggcauccucuucacccaguucuuauaacugaaagucagagucugcaugggacccaauuuccagaaccaugccagguuuacaagcagacauccuaugguggaaccauuauauagaauaauagcuuuuauaugggaagggggcccuuccuccuuuuccucuuccuccuccucuuccuccuccuccugucacucauccccaucuucuucuucuuguuauccaauaacuuaauuuuucuuuucucucuuuaaaaaguugcaucaccucuuuuacauaacuugggaaacuggagagauaggcuaaguggugccugggcucugaggccaggauuucacaguucaccuuucuccauaccuaaaaggaaauggaauuaggcuccaaguuguguuaagaauccaaagagacaagcaagccuucuuccagguuaggcuggauaaucaaauugauugagguauaucugaaugacucuuccuaaggaaauguuacccuuugaaaggcuacuauaugugcuuuacccuagaccacauucugaaaacuacauucucauugucugggucuuacugguuuugaguuuccuuggucuuuuggcucagucuauuucuauuguuccuauaaacugaaguuugcaauuuuaacuuccaacucuguuauuccaggguaugugugugugcugaaugguugcugccugauugugguagccuccuagcuagcaggaaacuguauugccuagucuggcuccaaaguucaauguguucccaccaaauaugcuguagucaucauggacuuuuucauagcugugacaaauuacuugaccaaggcauccuaaggaaguagggggugagugugcuuuggcucuugguuugagggcauguuccagucauggcggugggagcagcucugacaauagcagcaggcacacuaagcaacugauaguagugagucuagagucagcaagcagagagcaaugauuuuuccacucauuucugcuuuucauucagugccacccucagcucgugagaugacaacaccacgcucagggugugucuucccuucucaguucaauccuguccaaaacacccagggccguaucucccaugugguucaaaaauccaguccaguuggcauugaagauuagccaucacaccugccuuaugaaaagacaagggacagcauguguccucccagaucaguuuccacccuguaucacuugacuguguguaauuguaacuaguggugguguugauauccauugcuuaguaauuagugugcuuucuuccacucccacuugagauguguuauuagcaucucagaucuguccugcugcucccgguuuagucugcacacagugggaagaaaucuuguuucuuaccaaaaaauugcagagcaauuugauccagucucuucuguugaaaugcugaguuaauuauauuuaaccacggacgguggugaaguugcaauaacagcauuuuuuaaucaguagaaaauguuuagcuccuguaggaugggggaggugggaauccagauugguuggggggauugggagaccaaauccacacacagaaaaaaauguuaacuguuugauugagcauaagcuucuaauggaguuauuaugggauacuaaagaggccuuuauugcaugaacuuggagcuagaauauaaaugugcuugaaggccuacuaaagaggagauaaaagcuguauauucucucucucucucucucucucucucucucucucucucucucucucucaucuuuucucccuaucucucuccauugauucauauacacacuuuuuuuucagaaauaauugcaagacuggaaaguccauaguaagaaugaccuagcugauguaaaccuuauauccaaacccaaaccuggagacaguuggcuucgugguuuaaugugcaacuacauagaccuguuugcccauguuaugauguuaacagaucauuucaacuugccuuaauugguagaacaauuaagauuaaagccacccugguguaaaauuaaaaugcagauaggcucuacauuauuaauacagagaauaaaguuuuuugguuuugcuuuguuuugcuuuuugguuugggacugugcucucuaaacaucuuccuaugcccauggcuguaccagaaugugcuagaagauugauguccccucugggaacagauaauacaugcuuuucuuugucauaacuucccugauuuucacgugggcucaggacugugaaauaacagaaaucccaugaagauaucgaucaugauccguauacauuguuccuucagcaggagguagugauguuuuuguuuguuuauuuguuuguuuguuguaacugagacuuuuuugaguuggagagguagacauuugacaguuaccaaagccacccauaaccaguuguuccguguuuguugugucaugcucaaggagaaugaagaaaugucaacagagagugagcagagcccucaaggguaggaggagcucuaagugaggaaggaaggaccuauuauuuccaagucuggugacuguuccuggaucuucugacaaaaacuggauguauguggagcugaucaauauuaggguugcucuuuuguuguuguuguuuugguuugguuuuguguuuuguguuugugaguguguguuuaugagugugaguguguguuugagaguauaaguaugugugugagagucugugugugagagaguaucucugugugugugugugugugugugugugugugagagagagagagagagagagagagagagagagagagagagagaggagagagagagaugcuaaccagaugaguaaggagucuacauaccuuagccauauccaugcucuaucaucccaccagugaggugauccugccagaguaaagaccaccugugacuagcuaugaaagaacaaaacacccugacuuuauugccuaagggaaguuagcucuuguuccagugagagagguuuuccaccaccuugcuucacguuggcucauuugauucacuguuucccccgagaggugugaaauaaugucuagaacguucuuccuguuuccacaugacuucaguuuuggguacaucagacucuucacuucuuucguugaucaaaagcuauuuuuuuucuauaaaauuuuguuucuacuucccuagugcuugcuuauagagaacucuuaauauccugaagcaggggacaggggcagauuuuagcacuuuguguugaugaaaaagaagaucagaaagccaugugcaggguuccauggcaacuggaaaagaucacaacagaucauaccgcaaguccacaggucccaaaucuaccucaucccagugaagcccauagcagggcaucauugcuguccaucaguuucucucugcugcucaguuucuacccauucugcagucaugauugauguuucauaguucaaguauauacuugcucccugaaagccucugauguucaagguuucguucccagauggugguacuguugaaaggugaccagaucaugagccaaccaaccucaucagcaggcuaggcacagcaagacaaguucguagcugaacaggcugugaugaggcaggaccuaagugacggaugugugucauugagaacacgacuuugaagagucuaccugucuucauauccucccagucuuuccauuccuuccccacucgcucccuucuacuaccccauccugucauggcucuacuccacagcucuacuccacagcucuacuccacaacucuacuccacaguacccucccugccauaacacuguagcauaacacaaaaccacagguaagacccaagcagccauggaucugaaaacaggagccaaaaaugagcucccuccuuauguugucuguaguagguauuucaucgcagcaauggaaaguugguuaacauuuguccuuucuucauacccauccuuccuggcuuccuguaaaagaaaugguagcacaaguuccaaagcaauagagcauugggacacauuggccagaguuaaauuaauacaaaaaugucauccuaugcucuauuugagaacauauucauagaucaaaauaagaugaggguaauuuugagaaauuagucaaaggaaaggaagggaaaggaaaggaagauguugauggagauaggaugugauuuuguuggugaugagguggcguucuaucuuugggcugauucuccagguuuuauuuuuaugcaucccuggccuuuguuuaaaaaauagaaagacuaagaaaaugaaggcugaaaagagguggcauuuuucuuccaugcuacauggaauagacauuagaagucaugaaucagagcucucuugugugaaagcaaaaacaucauucagcuugccucccaacccucccucccugauugcauggucaggaccaauaaugcaguaaaacagaaaguauguaaucugggugauguugguguugcagugcguuuguguuuagaaaaugugcaauugcauaguuaaacuacagagauuugauuccagaugccaugcuuucccuagaaaguacaggguucaggagaagauggaguagagccaagggagguggcauaauaagaugugcuauucaccuguaacguauguuguuuucccuguuaaauaagacucacugcaaaccuguuaaggaaggccgaugucacuguugcacagagaagagaacauaaccagagaaguuaaacagcuuuuccccagaacacagagcuguuaaguagcagaggcugaguuugaacuugugugucuaguucaccucaucuuccaucauguuacuucccagaugggaauuugaagaggaaccugaccaagaauccaucauggaaaagaaugacugacucuccuggauauugcucuccgagaguucauagugagcuggauuuuccgaucauuuauuaugauccagccaaccuauaucuucuauguaccuaugauggguugaguagucacccucccaacacacaaaugguaaaacucuaaucccuugcacuucuaaauaugacuuuauuuacuaauuacucauuguuaguauaauuaguuaagauucacuuacuagaguaagguggcccaugacccaacaugaccaguguccuuauauaaagagggaauauggagacaaagagacaaaaaacccacaccugcaugugugcaugcaugucacaauccaucaagccagagaucuccggaaauuacaagagaggccuggaucagaucucucccuggugccuuagaaggaagcaugaugcucccugcuaacagcuuggucucugacuucugacuuccaaaucagugcaggaagaaagccacucugccguuuaugacagugugacuaaguagcccuagcaagcaggcuguguucacauacagauauccuaguucauguuuccuuuaaaugucuacuuuaagucucuagauagucccauccucuucuggccaggcugggugguugguaccagcugucaucauguaaucuuggaggaggcuaggcacugccucagaaccaucuugcuuccuguguuacaugagccccaucucucugaauuccaagcaaauuccucaccuguccuccccaggaagccccucucccaacaaccccaugcuuaaugugucccaggguuagugccacccaugccuuaagaggugcugugcguguucuucggccgaaugugaugguauuacagguggcagaugaaucuugguguguucuuuugucugggucuuuuauuuugccguucauuguuuauucacagauuuuagaagauagcacauuuuguuuaauuauguuggagacagacuggcauuccagcucuuacagucugugggagaggaguugauagcaaaaauuauguggagucuaaauuguguuuggugaaggaaguggaaaugaauaaagcuguuuuaccaugaaaaguagguauuuugucuuggaucuuggagguuuuuuuuuucucucucucuuagauggaaauguucuaagugcugcauugucuauuucguuugccuuuuacaagucugacguuauaaaaaggcaauuuguaucuguauuugcaaauuugagcaugacagcuguguuuuggagguuuaaucuggaacuaacugaacugcagaugauguggagucguuuuccccgugauguugucagguuccacucaucaaaaauacugcaugugaaagaaaauagggaagacuggagagauggcccagugguuaagcacuugccacuuuaggggaggauuagaacucaguucccagugcccccaugaaggagcccacaaccaccugugacuccugcccuagaagaucagacucccaguucucacauccucauauucauaaauaugugugcacaugugcacauacacacacacauacacauagagacacacagagacagacagaaauaaaauauaaagcuuaaaaguguaccacauguauauuuuuaagccucucuaucaggaauuuuagaaucuuagguaguaacaguguuacagugacgugacccugagaagccacccuucccuacccacacauaacugcuauagaggaacugagccuucucugcucuugcugcaguaaccauguuuuugauuaguuguugggggucggcuccugaaaccagaaagcuuuuugucucccaugucugucaaaauguggcugauuuaauuugaaugaaauuuuaauuagaaaaauucugccaagacgaagcccugauuugaauauuuauagauacgucaaggaucuccacauaccuggggucuaauuugaauugcuucacuggacuucagccuuaauagcucaggaagaaggagccugugugauagggcggauugcccaugcacagugggcuggaaugggaagccagccggggaagugacugcaugcuugaucuccaccguuuuaagagcagccguuuguccgcauacauuuuucaagcuugugagcguuuagcuaugggggugggaaaauauaugaccaacauuaacacgguaccuggaacacacagcuuauagaaacagcaggguauguuacaaaagcugugggggugagggaggccaccuccauccaggcucauucuccucuagcugcaggcuuguguucccggauuuagucuucagugccccgucucaggauagggaggcgcugacuucacuggcccuggguggacauuauugaaccaccugcccuggguagugagcugcuacagccaugguagaguugcacagugagaagagagagaucuuucucuucccuuuuguuguuucugaguaauuacauguccauucccacuuacccaaauuauucuuuuguguuggacauuuacaaucaggaugucugcagcccuuaccguugucacaauggauuuagugugaaugugugcacccugugcaaaaauaauguuuuuuuaacuagacaaugcacuguuauuaaggucagcuuuuaucugggcgauucagaagaauccuguauacaacccucuauguauauaaaugcaucuuccccucugaagaugugcuggcaaucuggaggcaaugaggagacucuggcugggauucaaccucccugcagagacccuguuagacacacagccccuuggcaccuccuguccaagggcugauccuuagcacgugcugacaguucucucagagauaagacucuauuucucccaucaaacgccaggaauucuaagcagucacaguuuugcucaguucugagugcaagggaguugagcagaaagguuuuuuugcauguuacaaaagaaauuggggagacuuugaugaaaaaaaaauugacucugcaguagugauuuuuuacauguaugaugucaacagaugcagccguggcuccuggaauggggguuucaugugcgcaggagauggucacgucaugaccuguuuuccagcuucuccuguguguggugggggcacaggguguucucuaucugccuccuucaaccucugacugcuggaacaaauuuuaauaucuuugagcaucugaaaugugaacauuuuuauauagaauguguuuuuuauauauuguaugcauauauuauacauauuauaaauuauaauuugcaugcagcuuagagaagccagccacuguuaaaauuuucaugaaaacaaagaaaugaggggaucuugaagagaaaagauacaguagggaaaggacuuuagagugggggaucccagccagaagcugcuucugugugagcuccacccacgcugggagaacauugcguacuaugcuuguauuuucuuuuacuccaagccugccaacaacucuaucaccacccucggggaauauaagagguuauguaugugugaaguuuacauguuugagggccaaaaggcuuccuuuuugcaaucccuacaaaauaaaagucucccaaacuaccuuggcaauaaaacugccgggugaugucauacuugggugggagacuggcauuucuuccaccgacugagccuuugaauacuaacuuuaauguguuguauuaaccaucuggagacauuuuacaguuguugucaaaagguugacucgggucucuaaugcaacacgaggaguugauggaagcuuaauagaguuuaccagcugcgcugauuugugaaugacagccucgcuguaaccuuuggcccagagagauggcugcuguguauacuguuugaauugaggcuucggggagcagaaugggagccaggcauuguguaacaauuuggaaagugcuuaaaucauguaccucaaccccagcuuuugcccugcuggucacauguacguuauugauuuaugcaccauuuauuuaccaugaagaaagcuauuagacuuaggaauguugcacgucagccuccauuucucagucaggugugcuggcuaguuuuauaucaacuugagacaagcuaggguuaucuagaaggagagaaccucaauugagauaaugccuccauaaaauucagcuguauggcauugucguaauuagugauuuaugaagagggcccaucccauugcggauggugugacccugggcuggcaguccuggguucuauagaaagcuggcugagcaacccgacaagcagcauaccuccacagucucuucaucaucuccugccuccggguuucuagagcccaucaaaguuguuuuacucacagcuuacugagauuggcuguggauguccuauuugaccacugucugaggcuuggacaucuggucuaucccccagguacuuucccuaccccaccucugauaacacccacuagucugagaugaaugaacacaaagcacugcaugguuuucauuggcaguguuauggagguuuucaaagauuaauagucucccuuuauucuaucucauauuggugauaccugcauacgucccuaguguuuauuuggguuuuguuuguucguuuuuguuuuggugacuuuuuuaguguuuauuuuaugugccuucucccuucugguguuauugagaugaggcuggaucuaguuuagcaaauucuucaaagcaacuauuacaaauucuuuccgaauguuuucauauacugcaguaaaauaugaugugccucacagucucaugagaaaagcuaguccauuaagcucuuauaaaaauugagcccuugaugaaaauuaagauacaaaaggucacaaaugcgacaugcuacauuggguuuaccagaaaggguaccuuggcuuugaaagguuggcaucuguaguacuuucucacguccuucaaacuuuaccaucgacuucauuaucuaccaguaugccgggaggucuuuguugaaauuaauguuuuaucucaaguacguacugugaugcuuuccuggcuaucagcagccaucacuguggucaggagagagaagccaguucacagauugcauguuuucaccuaucccugacucugcugcaggcagugcugaugcuagucacacaggagcccuggcuugaguuguugcucacaugggugacuuaaggagcacccacccuuccauccucccucuucgcaugccaugcuaagcugcaacugcccuucuaucguuuugugccauaacguucuuccaggaaaugccauuuuguccaaggugcauuguuucaagccacuuggaaaaagcaucagauuuuuuucucagaguuuguagcugagcacuccagaggaaagccuaugguaucaguaaguggaugaugggaaauguggauccgagccgggcagaccccuauuugaaaggagcccuggccucugcuucugccuuuucucuuuuaucucuaucucucuugcuugauaccuucauauucuccacggacucuccccucacucccuucaaaagcaugccuacagcgguaaugaaagagggauucacuagagggaagugggugggaagagugcuauuuuagaacaguagcuuuauaaaugggcaguugagcucucaaaaaaagaaagaagaaaaagaaaacccacguuccucagagacugugugggauuuaaaaauccaagaaaugaacaggagacagaccauacagaugaaacauaugcaaauaagggcuugcuuuacacaucuccuucuuauuccucacccuguucucagugugccuucaucuuagaggagaaaaaucaguguaggagaggcaaugaguuaaugugagagcaagcagcagucaggaauaaaacagagaaggaggccaguggaggagaaagacauaaucaagggugaaauagcuuaggacagggacaccugcauguagugccacauggcuagugagucaaauauguuaaguaggaugucgggguucaucuucaguaaaaggccacauguguggaucucagaaaugauaugaugucucaauguauauguccggagcaggguaggucagcugggagggacauggcaacuuccacaucuggcugauccugccuuauagccaugugacaaugauaucacaggaacauggaggcugguuagcauucugcuuuaugcucagcuauuuugcaaguuuaugacaggcagucuggcuucuggaagaugcaggauccccaaaagugagccugcccacuggggucagaagaaagaacuuggggaaaauuuuaagaagacccauuucuuccuggcuaaaggcaggcugcuucucaucugaccucagcacagaagaugucugcuugguuucugaaaagugaggaagcagagguuaagaucugagaaguacaaacugcauggaggaccucagggagauugcccucugucucaaccuuaacaugcaaggauuuuucucucauuuaaaccugcuaggcaacuugcuacacaucgaaccagaagaugcagguuucucauagaaauucuuucauguuucugcaacucaaggccuauguuugaaugucaguaaggacaaugguaagcuguggaugcuugguuggcaucccaguucugcauuuuauaauauuagguagaaugaacuuucauggccagaauauuuacaccacagaaaauugcaaagacugcacgcuauagcaucucuucuaccauagccgcuuugauaaacauuuaccagaaugucacuggucaggaaagcaugaauaaacuauaucuuauaauucaaauuauaguaacccucccagccacaauacauugaagauuguacuaccuacacaaaccaguauuacaggaugcucaagucacuucugggaaguagugugguaucugcguauaacugacagauacuccagucaucuuuggcaucucaggaucacuguugcugccuaauccaaugcaaauguuauaggauucuguguuguuuagaaaauggaaacaagacaggaaacugcacacccagcacaacgcaggauuuuuuucccccugaauauuuuugguguacauucuguuguaucuguggcuuuugaacauguagcuaggggggagugaaugcauaggccugaauguauauacguuagcuuguuuccugugaggguagaugucuguguucauacccccucccuaacuugucgguuccuaaguaaggaauccacucuuucuuagcugggaaguaaaaugagaacacauguccauuuucaggguuuguuuaagaauuuugcaacaaguuggaggaaaucacgucugcucagcuaagcaauuuggugucuguugauagccaaacagccuagaaaauuaucuuugccucagcucacccacugugcaaggcauugcugauguggagcuggcggcuuccaggggccuauugugugggaugccgcagaacacuggugagggagaggcagguauaugauuuagccaucucuugcucugccugcuuugcuuaauaagugagcauugccagacagucauuguguggcuauucugucaaugcuuggguaauuucuucucucccaucccgcagggaacugugauaaagcauagacaauuaccagaagauuucagaaagagcuuccaacaaaccacauagaaaucacuagaaacaugaagaugucugagccucuaauguaacaugccaagauuucuuuugcuuucagaauuugucucuuaaaguauggagacauguggauuuugugacagugucuccuugggaggccucuugcuuaauagaagaaaugggauagaaaagacucagcuaauuaguguucuagagucagagaauguuuaugcccagucuugaugaucauuugaggaagauaucagagggcuggagauuauaucuuucccagaggucaccaugucaaaacaagaccucugauuucuaggcaauauaaaugcagcagccacaucuacagcuaccucugcuguuccuuccuucucucugucacugucauguucuguggaugacugauagcagaugcuaugcuaaacauucuguguucuacuugcuucuugugaugagcacugggcagcuacugggcaugggugcagauggguacccgcaagaugucauuucaaggagcaugcaauugcaucauguuuacugccuacaaaaggaagaaaaacacacagguuugcuccuauccccagauuuauccuuucuuugucuaaaggaugaauacaagcuucuagagauaguuauaagaugguccuuuccuuagcauaagaauuuguauuuuaaaaauacauggaguuuucuggaaugaucauuccuaaagcuugauguuagucuccuggcucuaagcagagugcacacuggguuuacucucugagaaguguggguguaaccugggacuaucugguucagauguggccuccucaaucaugaaguuugcuuucuuccauuuuuuuucacuaagcucagaguagaauugguagaagacauccauugcccucugaggcaucaguaaguagaggcuucacagaaaccgaagaaaaauggacuguggaaaagagcaaauuuagcuucuccauagcuguguaauaaugaauaauccaucucaacugcuaagccucaguuuccccauucauagaguagaucgaugaguccaggggcuguggugggccccaggaaugaggucuauaaagcuuccagccuggagcuccaugcuugcuugcuugcuugcuugcuugcugauagagucucuugcagauucucuuuacuucuuggugucaacacaagaauaaaaauaucccugaucaggaguaguaaugcugauuccccugggcagaugcccuugucaguuucugaaagggaagacuuuucgaucagucugagaaugcuugguuugggagagaucuggggguuucuugaacacagucaguccugcuuucaaacugcugcugcucaagccagcuuuacucagaucuuaaaguuuauuugguggggcagaagcugcuuggcauggcagcuacaaacacuaagacccaaguuucugcuguacgugugaguagcaagacagaggucuggcccugucuuccuuaggcagaguuuacagugaaguuugaacccagaugcuccuuacugcucuugucagaaauaggaaggguuauagaagauugcuuggagggcugcuguguucacaucuggaccugagaagcacugagggauccugaugcugccugguuggcucaaccucuuugauucugcauauaugauuuaaucacaucgacagauaauugcccagaauuagacugagggacugucuuuuuuuuucuuuuuaacaaacaagccuccagaauuuaaacauucuuuaaaugaacacauagccauuuugacauccaaaaaaaaguauucuugaaauaggccaacuuguugagucuuaguguuggucaagcugaggguguggaaaauagcugugcuaauuggccucauuugccuuccauccacaugaucccaaggcuucucuuggcccucucaauguuguuagcagcugccuggggaugcuaacuugcuuuccuuugccuuauuuuaaggugauaauaaguaccauuugcagaacacccuuuguucaguaacaggaaacccucuguguaucauguagaucaccucuuaacacgcagcaggaucaaaugauguugccaucguagcuucuccccacaugggauuuccuaaggugggaaccacuguggcaugagcucagaucagaagcaggguacucagccaagcuguguuuugaaugcucuugucuaguuuagaccagagcaucagucaguaacagagaguccaaggauagagccccacuacagaaggguggcaccugcugggugcccucagaagccuggauggagggguagcucuggcuuugcccagguugugugaggccugugcugagccucuagaaucagcagagauugacucuggaacuaugugaaccuagaacuguguggaauccuuaccuacaggacuuggacaagccagagccaagagcgacugcuuaauucaacaccaguuucccuuccucagucgugucacuauugagggacaguggguuuucacaaucaguuaagucaacugcugccuuucccaaagggcucguagagaacuggagagauagaagaacuugccuaaagcucuaugaugguuuuagagauaagacuagaaaagaaaucucaaacuuccuuuucaacugaucccccccccccacacacacaccuuacuacccuuugccucugcuuucaugcugacuuuacagaagacauuaagcacaaggauccagaccuccagcugcacacgaccacucugucugucuaaguguucagaucuggcccaacuacuuccaauacuuuuguuuucuuuuuguuaaguaauuuaagaaacaauacucaccucugaagaugccgugugagugaaaguggaccagucaucaggcaggccgccuuugucugaaccugcuggugacagaaccaagucugagacacuuggaaauuacagaaccaccucaccucacuggggagcuuauuggugcgauacuucagcucuuucuuuucugccagguuaucauuuuugaaucaucccacguauugcugucuauaucucauuuuaugaugaagaaauuucaccuucuaaugaucugcccagccagaacuuccauguguuggaagcuauauaugugaaccacuguguauggggagcuauuuuagugaagucaugugugcugggagcuauaauagugaacuuuccaugguaguaaugaaauaccaacccaaggugcuuauaaacaaagagcgauuaguuugucuuaugauuuuugaagcucaagucaagacugaguaggcccaauggauuuggauuucugcugaggguagcauauaagggaagugccaaucaaagcaagcaugcacacaauaaccaggaaacagagaaagagagaaggcuggccucuuacagucucuauugaagagacacccucaguguucuaaaugcuuccacugggccccaccugccaaagguccacaguccuccugaugacugagccuuuaacacauggacacauccaggguaguaaugcaucacaccauagcagacucucccugugcuuauguagaugggucuccugggaaacaaaugaaguccccaugugucguucuuugcguccuuguaucagugucuuugguagagugaucugcagggaagacacuuguauggcauuugaauuucccuauaggcugaaauacagaagacaggaagaaguuacaggagagagucuuuauacauggucacagucaccugucuuucuccauggagauuauguaucagccacagucuacaucuaguaucauaaagaucuauagcuccaaugcaauagaugcuugggcaguaguuuugaauucucacauuugaagaagaacuaaugaaucaccgaauaaccuuuucuuuaaagugaggcauacauggcagggaagcagccaaagaaagcaaggaauagcauagagcuauuaagaagaagaaauacuaaucuuuuacauacaagagaagcauuuguccuugggacucuccaucucugaaagcaagaugaauucagcuaaggaauuguuagaaacaauucagaguuuucuuucauucgguucagcaggggauugagaauccuauuaaugcaccugucgagcuuggaacuucaucaguagacuagaauaaagguaggaggcagguaguuccuuauuccacagaauagaaagcuuucuucacaaaaacgacuaccacuuagugcugggugucuuuaaaauugccauuuugaagauucuauagccauaauuuauauuauuuuaugacuuauagcuaauucauaaugcuaaagacuuuauuucagagcccugaggucucauuugugggaagggugucugaugcuuccuucacacagucccucaccuuccuuuucuuccuuacaauuugcaaggaugugcacagcgcauacagacucuguuuugauuaccacucggugaucagcagacucaucucugggaguuuuggaugcagcucacaaaggaggccucucagucucaccugaugagcaaagcagucuccuaggugacagagaccuggcauuuguagacuguaugggaucauccugagcuaggugacgaugucagacucaaauaguagcaauuguagguuauccuuccuuuaucauauccgguuuauugcaacauguaucuacuuucagaaaaaauaauggacucaugugucuuggcaugcugauuguguugauucuguaaagaaacagaaccaauaggagacacgaaauacauaggcauacacuuucucauauauguggacauguauaugcacauguacaaaauuaugauauguguguauauauuauacaaguacagauuuuuaaaugaauagauugcuaugaugaaugggcucacauagcuauggaagcuaggaagucuaggucugcuaucaacaagcugaacauccaagagaaauaacagucucauuccagucugagucagaguccaagaaccagcagagccuauagcaugaguuccauuccaaguccagguacaggcaggagagguccuggaguccugcuuguuguuguuguuguuguuguuguuguuguuguuguuuaaggaaagagagauugagauucugucuuacuuagcuuucuaccuacaacuuaaccaauuaggugagggucaccacacaauuaggaagugcagucugacaacuccaccuaaucagcauguuaaccucuuccagaaacaccuucagagacccacccagaaugaugguuagccaaaugccaggguacucuguggcccaggcaagucuaucugcacaccuaucccucacagcagcuauggcuguacuuccugaagugcugcugugacucacaugaaaucagaauuuaugcagaacugcaucccauugcuucaugugaugaauggcaaaguaagagugauuguaaaaauaacuauucucagucaggggcuuggagacuuuagcugggucugcuuguuugcaguucuucaguuaccccaggcaggguaucgacugagccaguggucccugaccugguuacauagcaaacucuugagcauccuuagaccagaaccaugggguccucaugacagaggugcaaaaucggaauuuucaggggauggaaaggcgcucauugaagauaaauccaggaacaucaccucucagcuuccaggaggggaagucuuguguccugaucagucuaaucuaugccaagagcugaggccucauugcaugauuaacacuagccccuaaguccaggguauacuguuuuauggagaaggcugugcacagguuaacacagaggauaguuucuagaaggcuuagagacauggugggguuagcacagagaaucuucuuacuaagacuccuuagagacuacuagagcuauugcauccaaaugccaucgcugccuuuuauucuaaugacacuuuucuucuagaauguuccauuccuccuuuccuuuaacccgcucuccuccuucugucccuccuuucuuuccagguuuuguaaauuuguuaggcuccugcagcugcuguccaauggagacccguacgaugggagaaagcuuuccccuaagcauuuggcaauaggccgaauccaagucuccaucagaccuugcucuagacccaggcuucuccccucaggcuuugaucucugaucacugccugugacucuguaaaccuaagaaugccugugacucuguuggccuaagguuauggaucucaaagaaggaccaacucuaaacuugaauccuauuuaguugauaguucugcccuaaguacaggacagaggguaggaaaccacagcaugguaauuguguuguuuagggauguuguuguuguuguuguuauuuaggugacugauuuuucaacuguguaacuuaccugggagugguuuugagaaaacagauuucucauucuuucuuuccgccuaggaagcaagcaaauaacucacaguccaaugccuuuggaaacagauauggggucuucauggauguuggagguauuuguguagaacauucagaaucuaccagcccacuggaaugggcuuggaguagaaccauggugggaaagcaaaggaguaagaagcaggugcuguaucuccagagaguggggugauauccagagacugcugguauggcauacagaggcagacucauggucgcaaagggaguuuaagggcugcugcugguguugucugcccucguucucucuagccauuuauucuggaaauccugguccuugggagacuugcuugucagguuguuacuauuuaguagcuuucaauaagauacuggcaucguuaaaagccaaauaguggugcuggcaacuacagcuuguuuauagaaaugaaggcagcuugacuuguuauaaaauaagguauacugcgugaacagggguucacauucauauauguuauugcuuuucuguucugaccaauguuguggcugcugcuguugcuuuuaaguguggagaacuucugcuagucuuguagaaguacaguuaugagccucgcuguauauuaaggaccuauucugagaacuguuucauggacagauaucauuuugguacaagcaucuugcaguguaagaacacccuuacauaaacucagguagcacaaaucagucacuugacauggccuccuuuucaccccuuccauagucuccuaucuaguuuuauggaauauacccacucucacaacuccuggauuauaugcauauaaauauaugaacauccacauauguaugggagagagaggggggagagagaggggagagagggggagagaggggggagagagagagcaguguucucucuuucugggauugagucacuuaucuuaauagaauacuuuccaguuccaccuauuuuccuuaaaauuucacaacuucauuuugcuuaguagcucaauaaaaguccacgguguguucaaauuuucuaaaugaaaauguguuuggaaggccauguguuuggaaguucucuaauguaggguucaaggcagggggacacugagauagauugcuggggaucagaaguuuauuagaagguauuaaggccuugcaaagacagacagugaugugauucugaggagcgcucauccagcgucaggagcagagcauggcaggggcucugcagucaaauuuguacccauguggcagaguugggucuuugaaauucuugagauuggggcacucacagcaggagccugcaaugggcucuccaguucccgagaaggcagcagagauguguggccaccagcacuacuuuguugugccuucaugugucucuugauuaggugcuaaaaaauaagcugcaugaggcuacugcuggguaauguggcacagugcuuuacaguccuuuucauuuuuuuauagguguaaagaguacauaguaaaauaauacaagccauagaauacuuaaugcauaaaaccaguaacauagucauucaaggucuaucauaauugaauguguacauguuauccagcuggugacacaguauguguguuuucacaagcagugugcucuggugcuaggaauuuuuaagcucugcuuuuccaaacagggucucacuauguagcccacacucaccuugagcucauuauggagcccaaccuaugugcaucuguaugugaaucucugugcauuuauguccaugacuauguuguuauauucauguauguguaccuguauauggaucuguauauguuuaugugcauguccauuuuucugugugucuaugucugugugguucuuuucugcuucccauuccaaguccuuuauuuaaacaugacauggggaccaucaggccagguucgugguggucacucuagacucccaaugcagagagaauaguuuguucuccugaaggugaugggaagaaguuucccagaccuccacuuacagacuuuuccacuggguggauuuuuccuuucuugugaauaucagcaugaaagauccaagaacaagcaguacagauacuugauuucaaguuucuugucaccuugaggggugaaagaaggauuacccuugugaaaguaaucaaacaagacucacuaccuuggcaugagauuguuggaugucuggcccucaagggugagccucauuacuuguccuugaccuuugaauuggcucuuugggauccagucagacugcaguccuugaacaucaaagugcauggcaacaugguaccauggggccuuucauauuccugccuuugauuccacaggaugagauccaaaggcucuucugcuuguacaaccaccacagugagugugucaaggacaguauggugugggugguauguaaggggucgaguguagguaaacaauaaaaaggacuugguaacguuggugucuguaaaaucuuauugagaacacaaaccagaaucucugagggaugugaggauaccuugguccaggcucaauuugugugacuugaauccucaaaguugcagaacuuuucuaggcagaaugaaagggccagguuagcacguaggggagaucccagcuaccaggaugguaugguucuugcuguuaccuggugacauuuccaccacuguccaucuucccagcaaacucuucccaagacgcuacauucuucauaagucagaaaaagaaaaaaagaccaccggcagccuggagggcagccacgaguugcugcuguuauuaguaauauaaaauauacgguaaaaaaauaugccaaggaggguuaggaacuaaccugggguagggugggaugugggguucaucccccucucugaaaucacacugcaggagccagagucucaguagccuggagaugaugcugagauuuugagauuagcacucugaguaaucacguggguggggugggcuaucaugcuggcagaugaaauggcgcagacccucaaugucuuguuguaugccuacacuguccucucuucagcccucagugcacucugccucagccccaucucuuuagcacccaccccuacccagucuaaucuauagccaugcuaaguucugagcuuccaagaagcaugguggugauaaccagcauugcagcuuguauggugauuucugauagagagcagugaugcugaggauggcauucucccuggaucccuaacuuaugcagcagugugguuaacucaugaccaauagcuauacuauucuaagaauagccaugcaaaugcucagauauucuucugcugcuccccacuccaacauuugaguaauguggccauguguuuuauccaucaggccaaacaccauuggguuggguuaagaguagcuguguggugugagacuggacucugcaccucguagaaagaagugugaccucugacaggaauuccuuugccaggaacaugcugcaaaucaccucuucaggaggauauuuuucuugagaugcccaaguucagaaccagcaugaguuacuacgagugauucugaggaugaaacauucacaauccagacagcaucaagaaugccauuguugcuuugagauagguucuugcugugcaucccacacugcccucagacuucccaccuuccuuucagcauacugugauuacagguaugcacccgccacacccagcaaagaaucauuucauaccaacauucuaauagggaaaacgaugacuaauucagaacccacuggggaaaaccuaacuccuuugguccugccccugaugauggccaccaucagugcugagcacagagcuuucacgguuguaaaaugagcugcacaaaagcuuugaggccaagcccacgggggaugagcauaggguucugaggagggcuguagaggugagaaaauggccuuguugcuucagcaacugugauuuuagcuacugcucagagucagaaagagaucuacccggacugcuccuagccuguggugucuuucucuaaccuugugucuguuugccagcuccuccaucagaaaaacaaucaucuuucagcaaagaucacuuugagacugacucuauuaaguucauaucuacaacaagucccuggaggcaggucagccuggguucaauucuguuuucacaauuccuucauuauuccaauaggacaaaauaguaccaaccucaugggaucauuguaaagauuaaauaaauuaaacauuggcuggcccacaauaaucacacacaaaucauugaguguguagaauuucuccuuaauggaaaagagauuucgacaauucucugcaauguuuguuugaggaguguuaagcucuguaucuucaauagcccagaugugcuuaaagccaucaacacauaaggacaguuuugaaagacauuggcgauaucuaaaauucucaggaugaaguugcaugccagcacucucuaacuuucuauuuucacaguguaaagaauacaacaucugcaaacaacagcuggacaaauauugaaagauauaaucccaguuucuugccauguuagcagaagcuguuggaaguggggaugggggaagucugccucauaucgguaccuuuuuaugacugggagaaagaugccagugagucauuuuguuaaggcaagggcagagaacaaccugagauuacguuguccagagcaucccgggugccuagcaagagaggcuguuaccaagaagcccugauugauggauugaauuuaucuggagaacuucaucugaguuucaaacaucuguuuguuuccuugcccugcauuucccucauguagcuucacauaaggugcugcccugcccaccagcagagucuacccagagaaagggaagaacaagaacaaacaacaaucaaucaaucaaucaaucaaucaaucaauaguuucccuggaggacuggguagaugauucaauggguaagagugcuugcuguggggccugaguucaaauccuauacacccaucuaaagagccaggcaagccuaguuggcaugccaguaauugaaacuuuaaguggcaggugcaggcauaucccaggagaucauugaauggccagcugaguuaaaaaugcaaguuucagguucagugagagacccugucuuaagauaauaagguggagacaggaaaccugacagcuugcuuuaaguuccuuaagugaauguguaaaagacacacacacacacacacacacacacacacacacacacacacagagagagagagagagagagagagagagagagacauacacacacauacauacacacaccaccaccaccaucacaacaacaacaacgacacuuauaccauacacauaacaaacgagcaagucuuaauuaauuaauaaaaauugcccuggcuugggcucauuuggacauuuuagacagcucaucacaaagccuucaagagcauguguaguuuuagcucagcuuucuagagcuauuuuuccacuugguaacccuggcucuuugggguuggagaugagacuagggcaaaugaaauaaagagaacucagaacuagcuacugagauucacaagaaaauaagacacagaagcaaagggcaauccuaggucaagagucaauuuguggucaaccuuagggcuuccaaacuucacuugagcauaugggauuuccacuccugguuuuucugaagggaaaauaaaggaguuggugagggcacaucagucccuuccugcucugccucccuggucacuaauuaccucuacaauccuggcccuccaugauagugcaggaugggaagccacguuggaaauagaccauguuacagcuucucggcacacauauacguggcugugugcuccucgggguuagaugcucuauaacauucuugcccuuaccuguuaugcacuauaagagacugggcuagugcccaauuccaaaggauuuucuucccggacuggaagcuggcccuggugagacaccaugaggauacuucugacuugaugcuuuggcaaacacaaaaaaaacuuuaaguauauuuuaagaugagaaaauaugcucguuuugacgggcagacuggcuucuauacuggcccagugcugagucuguggauguggguaaagugugugugguuuaugccugugcucgauguuucuuagaguaugggagauggcauugguggugggagugaggggcggcaaacugugugauucuuauuucugaacggagagaccaaccaacacguauaguuucucgcucuguauucagaaacacgaggugugaaguuaccuggaguuaauuacauuuuccagcugcuagguggaugugguuuuuagucaucaacaaugugugugugugugugugugugugugugugugugugugugugugugguguaguguguaguguaguguagucuaguguaugcuugugugaaugguauguguauguguauacauacauaaaugcauauauaugguaggaggggcuguggauccuaugacaguguagacaguauauggcaucagaagagaagccccaugccgguccucacccuccaccuuguucugagacagacuuucuuaccaucugucaccgcuuaugucagccuggaugccucucaaacucagggcauucuccagucccugccucccaucuccguaggaaaacuggaauuguggaugcaugcugccacauccggcuuuacaugaggucuaggaaucucaacuguguuccucacauuugcauggcuggugcuuuucaccugcugagccucaacccugucccauaauguuucuuccaguaaaccaaaaccauuugauguuuaaaguuagaacuaauaaaaugauaguuugacucagcaaacucaagagcccaaggguucugaggcauuguugaacuccggagauccaggggccuguaaccaguauuggacuuggcuccagguccugauuuggagacggguccaugggauagaaccaguaaacauuuuaccucauucacuguagcuucuauaauuuauuaugcuaaggaauagaaccacuugcucugacagguggguuccuauuauuucacugccagcauuauauaggacagaauuuuuugaugguggaaucuauccgguuaaucguggaagccucaguuguuggaauacucaacauuuuuuaccaccuuaugguguaaaugauggguauguagaacaugcaaggauacugaggccaugaucaccuugccacauccuccacuuuucuauugggacaagucacgggaacucuucaccagcaucauuuguuacauggcuuugaacauguagcagugucaagucugcaugaguuuauuaaaauguuagguuuuggaagcuugcucagcacauaagcauagagagcccagugucucuugccagugacuuugguuuaaaucugucuguacugucugcagucugccaguggguuugucuucacuucagguauuuuaauuucuucuccaucaaacuggcuucaaccugaagacaugucuaccgucgccgacagccaucuucaucuucucuuuuagucugagagucugcucucacacaucaucuguguucagauguucacaaacaaaaaagaccucagcuguacccagaguguuccuucacucucuagcuuguagaaacccaggcaucacaauccggugagagcauuacauggaggguuuugaagugcuugguuauauacuuagugccauugaccuggaaaccucacuacauuacuucuggauauucaaguuuaaacaaaacuuauauuggaguaucuugcugaaagauuagcagugcuuauacagcuuugagaugagucuaguucugcugugauccagcuguaagcucucaggauguuuucaguggcagcugggauguagucuuccauguugaugccauucuaugcaaccagaaaucaaaaucuccgagagcgugugcuuuauagcaccuuuaaauuagcaucugcauugggguuaaugauauuuaaauguuuaccuuauuuuuuccugagcagcuauucccaacaacaucucaaaccauaaaugcagagcugauauaagugacauuccugugccaucuaguaauuuauuaaucccuuuucgcuuaaaugagauaaauuuacucauacgaaauuacucuuucaacaacauuaaucugacaugugcacuuauucuauuaauauauuguacacauuuguauaagcuuccaguggaucucucucccucucccucucuuucucucucucucucucucucucucucucucucucucucucucucucucauacacacacacacacacacacacacagagagagagagagagagagagagagagagagguauuagcuacaaucguacacaagaaauuucuaccauuucauuccuacuguuacaaauauuauuggggauuuuauuuauuugagauuguggggggaguuaagauugugugugugugugugugugugugugugagagagagagagagagagagagagagagagagagagacuacaugaaauaucuuucuaaaucaguucaauacccauaugaugucuauagggucagcauccugauuuggagaugaagacuauggacucaggcccacuugccagccaacucugucccuaagugacagaguuggaacucagacugucucccugacuccagaaccuguguccuuaacuacaaccagcuccuauugaacuuguguggcgauccaagcacagaaguucagucuuauugcauuuauagcuugagaagacugaggucgaggcaaaaugguccauccagagcacugcucaguguuuccauugcugugguuuuggcucugacugaauucaaaauuuuccaaacaaauaaguuagcacaaaaaaacagaacuaggcuaccuauccacacauuaggucauucgggaaagagauuguaugguucagccauaaaggaaaacaucacaucccucacacugaaauaaucuccucgggaagggugguuccuagcguuaugcacugaauguacaaguacugggagcuuugugugauccccacauaucaauuaccauaaucuuuccgaagcugugggucauuucaguuucucuguuuugccgagggggcacugagggguuaguaacuugccugugaucaaacagcuaacaggaggucagacugagagucauacuccagcagaugggagccugggccucgagcacccagcaugaugggcacaucaguuugucuugcuuucuuucuuugaguuucaugcuuaguggugagaguaaauugucgcuaucaauagggaugucucaguucugacacuccugaucaucugaggcuggaauuacagcaacuguggucacaugaaaaagcccccaguuauacuuagaaaacaaaaccgcaucucuccaccaaggugauuacgcauagcaacauuuaaggcuuauuucuaaagcaacaagaaaaaaaaaaguaaccauaaaagcuacaaugcaaugccuuuuucagaaguccuuagcuauuguuaaauaaguucuagaaaauucuuccaccucaugugaagccuccguagucuguccaucuuaauugaucggucauacgaugucuucuucagcagugcccacucugacccugggcccacaaacagaugccaucucaccuuuuccauggccaacgaccuucuucauagccuucuaacauggcaguacuuccagguggcuucagagaccacugaguucacuguccgcuggaagauccuagccugacaaaaucauugaaaacaaagccagucgaaucaggcugcugcgagaagaugcugacuuuagcaaagucuaugaacuacuuuggaaaucagaaugaaugauucuucucugucgcuuuaccuaacaagauccccaccucuccagauaagugccuuagcgucucuuaugaacugagauuuucauucacuuuucuuccguaacuaugacuuuauagccuacuuuuccuaggaaacugggaguuauaaaacaucuaucuacaccuaaaagagagagcauugauuccagaauauucaucaacuacaaaaaaaggagauagugaaaaagacaaauauauuuuagaaccaaguacucucccuugggcuuauuuacaugagacugggagagguggacuauucuguuuauggaaggauguuuuuuguuuguuuguuuguuuuuaaacauuagcgcccagggauuaacauaguaugagagaaagagcuggggccuuggacuuuguucacugugaguuugcaucuugaccauuaauuaaggccucaagugucugccuccccaucuaucaaauggggcugaugguauuaucauccgugagggaagaggaugaugaucauuaacaacagggaaaugaugacagcaauauaauugaaacauuuuugaacaaaggcucugcucuaucuaacuuacgauuuggagggagaaagagcaacgaaugggaacuaacaaguuacaguaaaccucuuugaauguuucagaaaggcucuaggagccuggggagauagugcuugaucugcaaggauccauaugcaaaagccugguguggcacugugcacguguacuacugcuggggaaguggaagagguuggccagccagacuaggguaaucggaugagcuccaggccaaugagagaugcuagcucaaaaaucaaaggguugucaccuugucuccugaguaauggcacaugagacugaccucuggccuacacaacaugcacauguauggacacacauacagagagagagagagagagagagagagagagagagagagagagagcuucaaaguagguguaaaguggagucaugugagcuggagcauuagaauuacacgauguuccuucguucauccuugaguugcucgucaucugagugaagaauuucaauuccugcaucucaguuuccucuucugcaggugauacagcacccuccuuggucuuuuauuuuuuaaguucucuaaauuauuaguagaauggugcgguaaugaacuggcuuuuguaagcccaauaguguagguugacugcagguaggccuggugaauauauaaggagaugguaauguggaaauugcugggcaguguuaucccaaccagcaaagcccacccagguccaaaugucuggguaugggagugugaaucuucauaugcagcuuagaugacaguguuuaugcaggggaggcugaagcaaagcaggguaugagccacaugauuggagagcaaugcuggccuaagugucuuuaaagguaugcauugugcuggcuaggaaauuaucuugcacacacaaugaaaggaaggugagacacaauucaggagauuuuauugcaaaacagugaaagagaaaaaaacagguagaagaagggaggcgaagaguuuggacuuuaccacaggguuccccuucucauuauuagaccuaauaauucaagguuuggcaugcgcaggaggaaaaucuacacggacuacagucuaaaacaucuaagcauuguuugcagaguggcuaggcuccucugccccagcccugucuggugcuuugagagagaaauaagucucuuuuccuugugugcaaagggccagcacucuccauggaagauuucuuuuuuuagaccugaugauaaaugugugugagggaucccguuaggcugggaauuccuuugaaauucgcauuucucuuucucuccuguuguuguccauagauagauccuggcagcauuugggaaugaaagcucuucagcuugacuccccccugagagucauguucuuuugugaaaggagcuuuaaaaaaaaagaaagaaaaaggaaaagugaaggcuguuuuuucacuuagaauaaggauauucuccagcagugagagcauugaaguaacaggauccauauguuggagcugagagcuaaugcucagcauaugggcagugaacuuugcagacagaaggaugucucugcuuuuagagaauguccuggaaacuccacagaggaauagugcucaggugagucauggcggaggaaggguuuccggacuuccggaagugugagucaccaagagcaacugaagugguucugguuggccuucaaauucacagcacuggcuuagagccuucuuggaaacuccccaagcucucaggauagcagaggggccucauccuggcuuuucuauacuccucaagaaauggcaaugcugagggaugucgcucggcaugcacagaugguuucuuucauuccaugagaacaucuucccucuucacaaagauugcacugcaaagugaaugagaacuuacccaagagccaggaggccuuugcuccacaacacugaccuacagcuagcagugauggugagggaaucgcucccgcucccugcucuucuccaucuggacagugaagggucagaucacagugauagcugagacccuuuccaaauggaacacugugggacugagcaccgccuaacuccagcuauagaaguaagaugggaaaaccaaccccagcuguuggcaucuggaccuguggacccagccccugcgagcgucaugugccaguacagcuuuauguaccaauagcuaugcacagaaaggaggaggguggggagggcucguucuuggaaaagaaugaagcuccaauuccuugacugguugguaaugacaaaggagaggugauugcaccccuggauuacuguaccauuuccuccaguucaguauuagaauaugcccaagcucagccacguauccauggagcagagcucagccuccugcccuccuuuauccggaaccccagcccuuuuccccuuucuccacauuggcuccauuucaccccuuucccuguacagccucugcugugcguuucucaggacuugcuuuguuugucagucagaugauuaggaaugcuguaccccaaauccccugccuaccccaccccaccgugcacucccuuuccagccccaggcaggcucuuugaucucuguauucugcagagcccaaccuuggucuccugucucaggagccuggacuuagagcugcugcuccaacccugccugcaagcuggucaccauggcaacaagcuuucccucuucuucugugaacagaaaauggcuguuggaaggaagagcucccagucucuaucacccagccugguugcuuucuagggggauguaggauguaggagaggguuugcuucauaauggcucugaggaguuccugccauugaacccacugagugcuagccuuagccuuucagauuuauuuaaagacagcagaggcagaaggaaguugauuucaaaugaauaaaacauucuguuuuccuauccuaaaacugauuuucaugaacaguuguuaucugcucuaaggagaugauaaacgggaagcagagugaagcggguaagcggugagaucugguguuguguauuuucuuaucaguaccaugggaagacugagcuuguggauauucaaauaagaauucagggaaagucgccaaggggugcgaagaauuccacaaagcacaggcugugggauuucagaagcacagcagacugauuggugugcuaauguuguuuucagcccuggagauagguggugguuauacguuguggggugaggugagcucucauuggcaccccugcuuuagaaugggucugauucacaguggccaagcauggcaacacagggagugugcaagcuaucccagugcauaguucuugggugacaggcucccugugagacacuuuagacugauacccaaaaggaacuggcuagcuggcucuuucugugaauacaaagcauaguuguuuagugagcggcccaggggguccuuccacugugacagcagauaacaguuccauguaggagugcucuaagcuguaucuccuucugguuaugguaugaaguugcuuuuucagaagucaaauaaaccucaucuuuuuaaaacugagcuuggacaaucucauuuuugaaugaaagcucucaaaauuuuaaugguauguuugaacuggacuuuuucuuucuuuuucaguuucccugcagguagauauuguucccagccaaggagaaaucagcguuggagaguccaaauucuuccugugucaaggcaaguguccugggucccaucacaucucaaggcuugccuccaaaccugcugcuccgagcgcaaacugagaguaccaaaccuagaauuccggucacugcucuucucuuggucagcaguguaaccauucuagaccauucuaagauaccuucccuugagagugagugacaugcuaucuauacuucuggguguucuuaaugccuaauuggaaaaucugccccuaauaauaauguggaaaccauccuauagaagaagggauggggaaauggacuucaagguguugggagauggugugccugggauuuggaaaagaacagaagcaggaaugaacugagcuagauguaggcugugacauuuaaacacaacuuuuggugggaaggagcucuaacugccaccaugauuugcaucugaccaggggacuauggcugcuggguacauuugcucccgcucugccgucauuacagcaguuucaaugaucugaagauacagcuuuagugcccgcggcacagcuugcagauugugauauuuauugaaaacaugaugggccccgaaaggaacacuacauuuccauaccacauaucugcacagggcuaggcagugcaggcuggugccccugugcaggcagcaaaucaaagaaggagucguggauuggagaaccgaucacccugacccagccuggccucuaggcagcugagugccccucacaaguccccagagaggccuugcugaugcucugucuucucagagcauggaaggggguugacugagguaacaggcaucagaauaucaaccauucauaccagucugaacagaguugcuauggucaaaauggcuggaaucuuaacucuugguuuagccagcuucucuuaacuucaacucagaaguugaacagucuccuucuuuuucaucccgaucaguugauucaggccagcgagguccuggagcucagggcucagacaaaccaacccuccuuuauuucccauuccauaauacacauucauuccuagcuuaguguguggagaacaguggguucauagcaacuauuguuucccuuuccaaagacuugacaacuaaaaaauacuauaugcacaggcaguggguaagucuguucaacuccgagagaugccauguguauaauuaaaccaacaaagagcagagcugcaaaaugccucaugauagagaucccuuuccagccuucuaggcuuuguagccauggacacucuggaaggacuuaaucuccucauuuucugcgcucugaaaauaaugucuuccuccuuaguggcaggagaugccaaagauaaggacaucuccugguucucccccaauggggagaagcugagcccaaaccagcagcggaucucagugguguggaaugaugacgacuccucuacccucaccaucuacaacgccaacaucgacgaugccggcauauacaaguguguggucacggcugaggacggcacccagucugaggccacugucaacgugaagaucuuccguaagagcccucauguguacccugcacucccaccuuuguugggaagauacaugggugggcaguaaaggcagagagaaggcaacaggaagcccaguaagggcauggugguuccuuuucuguccaaguugcuaagagaucuaguauauucucaaaugguuggugaccagcccagaaccaacaaggcugguucccacaaguugucacuacauucccaaugacugccaugcuccagaaacuacacaauugccagagggcuaaugucaguuccuccgugccuucuaagugacaaugacagacacaugguucagguucagguuuuugcuucuuaucccacuauauuuggcuagugauauagcccaaugaccuaguaagauguaguauuauaugucaacacuugaugcugguuggggaagguggcucccauggccauguaaguucuuacugugcauaguguuggcucaagucaugguaaguaaguguugauugccagagcauuaacugccaugaaguugacucucauucuucagaauuuucgcugcuacaggaaaauuggggagaggacagaguaggagaccaaaaaugaucaaugacccuuauggucaugguaagauagaugcagggcucaucacuguagcugugugcaucgucacuacaucagggaaccuacuccccuccauagaccccucucaaugcuaacuguucugccucagauagugacccagugcuaagugggagucccucuuacauugcugaguuauacauggaaacugcccuggagcugaaauccaggcaucagaguucuacugagaggguguuuguuccucacucugcuccuccugcuaucuuucagagaagcucauguucaagaaugcaccaaccccacaggaguuuaaggaaggggaggaugcugugauugucugugauguggucagcucccugccuccaaccaucaucuggaaacacaaaggccgagaugucauucugaaaaaagacgguaagaccugaguugccaugagcccucagguccccuagcuucccacccuccagcauuccaucuaaaugcagauucggggccccagaacucacgaaaucucuggauccuaaacaaauguuuaucuguaacuaguguguucaagcauuugcuugucucuccaaagcaaaagacagacaugccaucccuagacugacucaucuggauuucagggacagggauaucuuugcucauuucagccuaaaacccaacaccauaauaccugaggcagaagaaagggugagauagccacauugugucacacguuuguaaucccagcuugcagaagcugauacaggggaguaguugcauguuugggucuaaccuaggcuucauagugaguuucaggccaaguagacuacacugugaaacucugucucaaaaauaacacaaauuucauaaaaggcaguagcaggaagcucagcuucuugccugauuauggaguucacgaacugaccuuggaugaaccugccucuugucucuuccaguccgguucauaguccuguccaacaacuaccugcagaucaggggcaucaagaaaacagaugaggguacuuaccgcugugagggcaggauccuggcccgcggggaaaucaacuucaaggacauucaggucauugugaauggugaggagaucugcccuuccuguucccuccauuacuacaaccaggguuugaugggagaccuucuuuuccauucccuuuggguguagaccuguucugucucauuccuauaucucaagggaaccucuuccccacuaucacaaccucugggagggggauauuuucuccuuaaccacuugucuuuggugugucccuccaguuguaccuaccaaaugcccuccauugucuagcagaacuaaagacuccccauucugcuaauaaacccuccuucauccccaguguccuugauguuaccgucaguaggaaguuaguccccuugacuugaugggcagagaaaauacugcaaucaauucaggucucagaauagucagcaucgugguccgugggcuuauuaaucuuaauuugcagugucaaauaaacacacccguagcaucgaucugacauuugcaagaugcuuacaggaaauuauaaugucagugcuaagaaaauaaguaaaucacauuugaauuguuuugguuauugauacguguuuucuugccaagcuuucucccucucauuccuuugguggaagcaccuugugcacaaaguuguuuaugacaguugcagagaaugucacccugcugagcugguaucuuuuggaagcauaccaaccuggcaaccaacaggaacugcacuuucucauguuugccaguauggagagcagagccuuuuuuaacaucaagucccaccaacucuccuaguuguauauauuguauauauuauaauauauaugugucuauauauauacauacauacauacaucccaacaaauagccacuguaaaucaaauaccacaugaucaugaguuaaggcaugauauagggacugaacucuuaauaaugcauguuuguggacaaauuuuguucaguuuacauuaauuauuuagaaugccaugugaguuuaggugccuuccacuaacacuguagaccuccaggacuaguaaugcccagguggugaugcugccuccuguggacccccagaugccucuucucgaggccauccagaucuuuuaagauuuguacaaccaccgcugacauccuucuuuccuucaguaccacccacuguccaggccagacagagcaucgugaaugccacugccaaccugggccagucugucacccuggugugugaugccgauggcuucccagagcccaccaugagcuggacaaaguaagcaacuggcaugugccuugcauuuugggugagaggagaaagcaauccauagucccauugccugugggguuuucagaggcaugagugugggcuuccuaaaguaccagggugaaaaaaauggcucuuuucuaggaaguccucuucauuggugucuugauuauucucacauuuucaggcuugugggagcaggugcggguguagcuuuuugugccuguucuaugaaaucuuucugaguucuauccauagccuuugccauguacucaaaagauugggggagaggcauaaaaagcauguaacgggagaugaagucuuucccuucuauguagacugagcccguccccuucgcacagugggaaaugaucagaaaugaaccucuucaccccaugcucagaaucaucacccuuugcguuuccgcacuguguagggauggggaacccauagagaacgaggaggaagaugacgagaagcacaucuucagugaugacagcuccgagcugaccaucaggaauguggauaaaaacgacgaggccgaauacgucugcaucgcagagaacaaggcuggcgagcaggaugccuccauccaccucaaggucuuugguagguacaagauagugcaggucagggccccuguucagcuacaauuccuccuauucugcacauucuacccaucaaauaggcauacccacacugucauggcaugcauccaugaaacaaccaugagcugccugcucugacaccuaaaccccaguccaggaaaccacuuagcccucuucaguaacacagucucuuagcuggucuccuugcuccccagcuuggcuacuguaggucuugucuauuugugguagccagggugccucaaugucauuccucuucuccagaccccuuccaacuaagguaagcaccagaguaggcccaugguccagugcuaguacccuggcuccugccuucuacucuagucccucccucugcuccacagagaacguucuccaaccauaccagccucccuucugucucugccucagaaugagccaauccccuuugucggagauguugccguugaggcucuucugcuuaaagcaugcuucccuaugacaguccuacucugagcagccgucuuguuauccuuaggcagacuuuagcccaagcacaucuucccaggagcccuccccucaccagucugacauugccuccgccuaucccagcuaccacccuacugaccguccucaggacucacugccuucuccauacacaugaaaguuccugaacuaauccucuugaaguguuuguucgagggauugcuuaccuccagucuccaucagcaugcaaaguguaccgggagcacacugacugucuauacacugcuuuauccucgaaacagcuccagacucaugaugccuuaguaaauaucagugccuggcugguugucucaucuucuuuuuccuccucuacuggccugggugucagugucauagaaagucacagaaaaagcuuccuuaucuccauccaucuugaugaauucagcacauuuucagguguuucaggaucgaaaugcauuuugggccucuuuaugcaaaaagggauuuuuugcaaagaaagguguacccuaauggcucugaacaaucugcuguauuguagaacaugcugguuagauagaggcuggagagaacucucuggcaccugucccuccuagcuaguuaaaauauacaccuaggagccagcagugggaccugcuuguuuugugcgguggggagaacuguauguaaacacaauuugaaaguagggugccuuuaugccaauagcccugaugaucucagaagagucucuuuuguucauugauuuugaucauugaugaccuuggggcuacaaaugagcucuacaaagaaagaacaugaaacuucauaaaagugugcauuuauguacgugugagugugugugugugugugugugugugugugugugugcacauguuuguguauguaugugcaugcagccgcacauggaugugcacgaggauagaaagcaauggucaccuucaggugcccuuccucaagugccauacccuucuuugggaagacagggaucucccaaguugguccuugcuaguucagcgaggccaucuagcagcgagcuccggguaucucccugccuucaccuccccaagugcugggaucacaaguauggcugacuaugcccagguuuuuuaugugguucugagguucagacuaagauccucauuuugcaaagcaaacaccuuagugaaugaguugucuucccagcccauaaaaaaaaaaauucuugaugcuguuuuuuuucucucuauacuucagaauaaucuucccaccccaucauucugcucuuuggauuauagagaagggcaggugcaucuucauugaucccuucauuuaagaaauaucgagcaccuuugcagcuagauagaguggcuggagagauaaguaagaauuggacucugagaagaaccaagguagagauaaacauauaaacacagaaaagagaauaauuagugucaaucggcauuauccauuugaguguuuacugugaauccagucaucgccaaguuuaaaauaaaauuucauggaaucgauucccgucaguagauuugcaggcauguguagauguccaauacugacauuuuaaaugacagccuccuauaacgacuccauagcaacagcaugaugaugcuuuauaggaaaagauuuccuauccugugugacaucaguuagucaccaaacugaugcacggcuugaaauauagaacagcgggacaaguguuuugggcaguacuugcccuaggcagaguugagaaaaagacacuguguugcaugugagcaacuguggaccgggccucugcucgcugggcuuacaccuaugccuucagcaccuaagacagcagaagcaguugaauaauugaaggaauagccaguaguuucuuugacugaagcaugacccauguccuagggagaugauccugggaugaaguuagccucaguugucucuggaaaacuuuuaaagcauuauccccauagaauaauaauaacaauagccagcacagaaggagcauucuacgccaugcuacagaaccacaaaucagacuuucugagccucaucacagcccuuugagguagcucaguuauucuuccuguucuacaaaugucacaaggagcccaagugcuccuuauauaaaaggagccauaguguuagcuucuugguccuuacccuggaauagcaguggugguugcaucuccaugcagccagucagcaccugugcugaauccgcauagcuuagggaauggaugggagugugagagagagcgcucugccccucgacccccaugcugcuccuggguucucuagauguuucccacuugcaagcccuuuuuaccugaaaaaaaaaauuuaaacagccuuauuuuaaaacuaugguuuugguacacaugauuuuccacugauugaaaacuggaagcacauuugcauaccaaugugaugggcauacuuguuuauuuaauaaagaauuaaaacuuggcugaauauuugauaugacuggacacagacugucuucaauguucuucagaguugcuugauguuuuuguuuuauaaucaucauggcugagaacacuacuuugcauaaauacacaguacaaaauggcagaaauuuguuuaggaccauuucagaaauuguuggaaauucugucuccaaucccaagccaaaacucauugaauaauuuuucugugaaacucaugucagcaacucaaauagcaauuuuuuuuaaaucaagcauccuaacacaauacuauccaaagacauacuaauuugauacuuacaugcugaggaaugaugguaggaaaauauuugaagucgcuguuuuacauaauuaagccauuauguuucuguaagagcagaaaacuuugcauguguaguaaaaaccacuacaauucauaacuuacaauggucuugaaucugagccgaggcuuugcagccaguguuuguuggcauuguguggugggacagccauacaugcugaguauucagaaccaaggcugcagugacuucacaggauucaccaugagcaaacacuggcagaaacaacuuagacucuuuacacguuugauuuugaauucauuucugguuugguuugguuuguuguuguuguuguuguuguuguuguuuucuuuucuuuuuuuuuuaugaccagggacauuuuacuaugccaaacuuugugacuucuacuuugcaguuguguaacuucacagguucauaaugcagcaguuaagaagcugcucuauggaacaucccagcucuagcguggcuggaggagaugagcucuugaucuucuuccagggaccuuuggugguaaugauugcuugaggcaggaaggacagguagcaaaugagggaucacauggggccgugguagaaggaucaagauggauaaggacuaggggaaguggcaaggaaaagagaaaauaggaugaagaaccaggcaagacaggauuugucuccccagucuucauccugaaugaacaaauacaucccuacaucccugcaucccuuaucccuacaucccuuaucccuauaucccugcaccccugcauuccuacaucccugcaucugugcaucccuacaccccuccccauguaucuguaucuugcacaugcaccauuuauuucccaauacaacuagaguguucucuaaacaguacaguggaucaagcaaaagagagauggcuggccuuuuagcgaggucagcaaggaaaucauggagcuguaguaauugcaucagaccuagaaucaggauccuccacaaugccacaaggagagcucauccagccuucuugaacuccugcuuuucuccuuucugccuucuaauccuccuuucccuccuccuccuauuggucucucuuccauugcuugagacaacuaguaugagggucagagagccugguaaaaggggccagcugguuaggagauuuuucuucacucucuauccauucccuuagagauugguuccaugggcuaucccugagguggauugagaagguuugcucugcaguagcaaagguuaaugauguugaagaauaaagagaucuacaccuuggguagcaaagaagagaucagacugauggauucagaaaggguugcagucaguauguaaagaacaugacuaaagcagaaacuguugugguuacaacugaaugacaccuacgauagggaccugcucuagccuguggaguccuccccaguuagcagccuaggacccuuuccuuaaguacuacauucuuuguucgcugagagccuccauugcuguucuuuuggguccuucuguaagauaacauaagccugugcuagugauccugauaucucauggagucauggacugaggcaaauucaguggaaggcaaagaucuuguuuuccugaucccuguaacuagugcagcacccguggcugauggcaagagaccaccaagaggacugaaggagaaggucucggggcucuccucagacaagggucccagaaacuugacacaggagugggccgggcuauugcggaguggaaaacuacagagcuguggacugguuugcuguacucacaggauagugaggaaggugguggcuccucaugaccucaggcauuugaacacuugguccccaguaacuggcacuauuuggggaaguuuagaaugcauggcuuugcugucaaaguaagucacagggggcaagauuugagaguauauccucuuaccucacucacaguuggcucucucugcuugguuuaaagaugugagcucucagcuucuugcuccugcugcuaugccuaaugcuugcagcagugaguccuccaugaaggacuccaucaucugaaacuaagucaaaacaaacuuuuuucuuuuauaaauugucuuagucauaguguuuuauuacaguuacaggaaaguagcucauacaagaagagcugcagccauuggagguacgagguaucaggaaggcagugauaacacagaagauaacaccgggggcugaugcagggcuuaagcuauagcaaggaccauggaaagagaaaacucaaagagaucccucuuggugcuagcacacacagagaaggaaucuuuuacaagcaagagaugcucuaaauacgucucuauccaguugaguuuucugucucccuguaauuauuuaaaauaucuuuauuuuauuuauuuucuguugguuauagaaugcucagaccaaaaaaaaaaaaaaaaaaaaaaaaaaaaaaaaaaaaaaaaaaaaacuuagaagagaaaaggguuuauuuuggcuuacaguuccaaagaggauacaguaguccaucauguggagcugggugggggaaccuaaggagcaugaggugaggccagccuuacaaucaaaaaacagagagcgcacauuccacccacacacaagaagcaaacaggaaacagaaaguggcaccaggauauaagaccucaaagccuacccugugugauacacuuccuccagcaaaguucuaccuccccaaagugccauaaccuacccaaacaucgccacaagcaggggagcaaguguuccacccuguaagccucuggaacauuucauaaucaacucucaacaccugugaggucucaaagggcguccucugccuuccucuagagugcugccuccagaggcagaggauggaagcaccccuaccaaaagcccucuuuguuagccaacuuagucucuguuaauagugcgucuguggcaaauguuuucauucccugcacucuggaaggcagaggcaaguagaggccaccacuggucucaaagcaaagugcagguaaccuagagauucaauucguauuuuuaaccuuuauugguuuggcucuauuuuacccucuaaaaguaaauauuugauacuaaugaaccuucauuccauacgguguaaguuguugccuccuacaaggcauuguuauccaggcaagacauaaagucuuccuacagaaagcuucauccagagcugauggacuccaucuucaccacaucgucuugccaucuuggauuaccauuuguccgcguuccggccaugagaaaacaauuugcucaguguccugugguagcuugaggaagccacuuguaccauucagaugauuuuaucuggaagcaggacguuugucacugauaucuauuaagcaacauggaagacuucaagaccugugucuucaggacguauuuucuuagcugaugugcggugacuaugaauucagauauaaaacaaguguagugauuucaaaagccaccugucacccuggcuuugugucgcucuugccucgccuuucucucugguauagugaaauaaguuauuugugcagacuuaucuguucucuucuauggaauguucagcaauuucugaguauaauuguuuuaaauuaggaaaauucaauuucgcuuaauguuuucacauuucacucagcguuggaaugcaugcguuccuugcauuacuccagacauuugggaaaugaacugagcucagcuucuccccucccugcugucagccuacucugcagcacgugaccaaagcuuccaaaauggcuucugcuugaaguuuuaucugcucuagaauuccucaugcauuaaccuucuugggauucggugaccacuccauggcucugaugaaacucuacccgugagcuucaguggcuuguggguacacucccagcuccuuaacuuugucuucuugccccaugaaaucucucucuuucucucucucucucucuauuucucucucuccccccuccccccucccuccucucucucucaucuaucuauccaucaucaccaucccuccuucccucucucuuccuaccuuccccucccucuccauuuacuuuuuugcuuuucuuugagaaguuuucugagcuuagaaggacuucauuccacccagauuuuuggaaaccucaugguccagccucaagccaucuccaugugaaggcuugaguuagaguagcccucuucuggagcagaucucaaucacuuuaucaucuguauaucccagagaaugugucuaugacugucauuucaguguugucagaaugcgugggaguacaagucugugucuccuacuauaucuagaauugagucauauauuuaguaaauaagaaaacucuuuaaauggguuuguuuaaauccccaaagcuauauuaccaaauaacucauuaaaauauuuuuuuuucuuuucagcaaagcccaaaaucaccuauguagagaaucagacggccauggaacuagaggagcaagucacucugaccugugaagccuccggagaccccauccccuccaucaccuggagaacauccacccggaacaucagcagugaagaaaagguacaacgucacccgagagucucagggcugugggaugcagacuugagacacuaccccaugucuaccccaugcccaguucccuuuggcacaugggaagaugggaugggggucaccaguagccacugcagguccugcagcuuuccuccuccagccugccugguugugguuuacucaacacccucuuguauuggggugggcacuguucccuguaucgauagguaggaguguguugguagugggcacggucaauuuagauguucuuaggaggaggcaauagugaauuucugacccaggcuuguggagcuguaaggaaccaggauaagcgagauucuggggcaccaggugauguuuucaucagcucagguacucccaggaaagugucucccagaaacaacgggaaucgggaugagucuauuaauucucuuccucgcgucucauauacucaugcuguaugcacucugugcacaaaagcuugguugccuuugugucugccugcauucuuggucacauuugggcuccauuuuguucuaaaggcaaaaauaauuagcaguuucuagaugauggcucuuauaccuggguucuguaauguauucacccaaguugaagaacaugguauuaaaucccuggcaaguuaaaaugguugagaacauuuaacuuuuaaggugcauggagccacugggaagccaucuuuauuaguggcaauagauaaauauuggggugaccacgccacaucaugcagcuguuugcugcugaacaggcagagaaucaagaagaaaggccugccauggugagcaguauagaucuuguuaggacaaacaacacaguggggcacacagcccuaaauucagucugaagcauuucauaaaggaaaaaaauauugguuuccuggcaccucuucaguaguaaguugcaucuccuguaguaauaggcuucauuuuaguuggccaaagcucaguuaccuacucaggaguaauagccuuagcuugaaaaaaaacuauguauaauggauugccuauugaaccagaaugccaaauaugauagauauguaugcuucugccuugccagaggaaaucucuagaaacaaacugaaauaaagccaaaggggguggaauuaaguagcaggacuaaaacuggaauuugcauuugagggauugacuucugccucuguaucagaaaacaaagcaaaaccuaaaggaacagaaagcaccacuccaaauaucccauugcucuuuuugcaaguuuuauacccagaguugaaaccaauuuaacaaaaacucaacugaggaacugcuaaauauuuuugaaacucgcauaugcuguuugaucugcaaaagccagcuaaauuaagaagugagguauuuacuuugauaauuucuuuauugacauuuauuaaguucccagcuaagaugucggcucccuuuguguguugcguggauccaaugugcauuucagggcuuaauccacauagccacugcuugaccaaucuuuuuauauuagauuucaaaguagauuugucuaagugacccaguguguaucccugaccuagagugaaggacaaaacaucuauuucagaugaacgacguuuuuaaguuccgugucuuuucuagaaauagcucaacaguuaaacuagacaagaaggacuacgaagauuugugccuacuugggguuugcuuuaauagguuggcgcuucuggccuguaucuacgauuucauuuuuauaaaaugagaauaaauagcuaggaacuaauaugcacucauucgcccuaaauauugagacugaagcuauuagaaaagaccauuucaagcccaguugggacugauuuuuuuuaaaaaacaacucaguuuucucuaucgaccaucugucuugaucugagauagcuauucaguuccagcgcagguuagaucacagcuccuuuuacucuagacuagcuucaggguugcauggaguggcauugacagugcaugagccagucagugucagaacaagucuuccagauagguccaugaugcugucacauuaaugcauuuuuuuaaauaaaguccucugugauaaaaguugccacuuccacugauuaaauauugacauccaagaagcugccaaucugauauuguagaugacuagaaaugugaaacauggucugucugugagcaggucgaguucuagcccaaaucauguucacuauggcaaccuccacucacauucguucgcaccuaaauuuucauucuauguaauuauauauggagaucaccugcaccacugaacuauaggaguggaagaaaacuauaaaguucaggaugcuuuggcagacagaucacaagaauaucaauuuaccuaauggguacaauaaauaagcccccugagaguuaagucccaucgaacugcaggcuaagagaugguggcgaggcaccuuuuuggguuaugugguuccaucuggugcccuuccuagaaucccuaucaggucacccagccucugucuggcauguaauaguuacacugucacaaggggcuuucuuucuccuuccaguacucagaacccuccaccucuuucacucagucuuagucacuggaacagaagcuguugcccucuuuucuuucuuuagcgcacccgcacaaacacacacucacacacacacacacacacacacacagacacacucacacacauacacucccacacacauacgcacacucacgcacacauacacacacacacacagacacacucacacacauacacucccacacacauaugcacacucacgcacacauacacacacacacacacacagacacacucacacacauacacucccacacacauacgcacacucacgcacacauacacacacacacacagacacacucacacacauacacucccacacacauaugcacacucacgcacacauacacacacacacacucacacacauacacucccacacacauacgcacacucacgcacacauacacacacacacacucacacacauacacucccacacacauacacacacucacgcacacauacacacacacacacagacacacucacacacauacacucccacacacauaugcacacucacgcacacauacacacacacacucacacacucacucacacucacucacacucacacacagcauuuucugcuguuucucauaccucgugcuuuccauauccuccacccugcuagucguccuacaccucaagagcaucacuucacuagcacucaauaaaaucuuaccauccccugguaaccugaacagaucccagugagguuaucaucuugacccagauaccaccauguagucaaagcagcauuagcccuugaauccugucguaucguggucaccuagacuguguaggucuaacauggacugcuuguaggccacguaucucuuguccuagacuugugaaauugauuaauuaauuaaacaacugugcaggauuuuauauguauuucauccacagucauuuggccauuuaggacucucccuucacugggacuguccugugcauugcaaguuaucugacauuucucaccaguagccaauuguaagcaucacuaaaacacucccuggcuggaaaacgacuauaucaggccaucuuucaauuaggauugacuguucacuguucaagggaacuuuacucauaagucuggaaguuggaguacuuccucuaagauuacugcacuuacguuauaucugccuguuaaagguaaugagguagagcagucacuggugacccuagcacuaagcuugaaguucaagugcagguaauggauuagcuuucccauuguagcugucaccuaacauucauguuaccauugcuuccagacuugugugaauccuuauucaaaauaucugagucauugaugaaaauauugacugggacaaggaccgaguucacagaccucagauuccuuccaagucuguggcucagaaagugaugaucauggugcaacagugcuccuguguuauccugguugcuuugguuggagguucagcaaggaguauaaauggauuaaagcagcuuugucuuucacaucuugauugaccaugaugcugcccuucucauuggaagagggaggcaaggauuucacacccaguagcaacuuacuacuaaacaauuacagaauuguucuuccuuauaaaagggaaguuggaauaaauucaauaugaguguagucacaccauaccauuggucaugccucuggaucgagucucaucaauccauuaagcuucagcaaaugaaguugguuuaagucagcaacuauuaguagcuaagauaagugugauuguuuggauaauugagauaagugagguacaccagauauggaaaaguuuaucuacuucuuagcaaucauugguagccugagcaaaaagagaaaagugaacaucaguauggguuaagucuuguggagguguuugugauacuuuccagaguuccacaucugucucgugucauucuucauucuauacagauucauuuuaaauauugccagguguuuggguguuuacacauugagugagacucagggauuaugaucugcauacucaaucacuggcagaaaaaaaaaagacauccaucacuugcuauuagaacaccucugugccuuugagaugccuccauagaaagaauauggguccuucucuauuacuaaggaaaaagaaggguggggagcuaagaucauaggacauauaagaaguaccuagugagccuugagucuuuggcuggcagaguauccacaauuaagggagaccuuuugacauucugaauucuuucgaagcccaaacuuucuuuucacuugggagaauuccugauuggguacagacccacugcccacuuucaaacaucaggcaauguuuugcauagccugacucgucuaugcuaugggugguuauauagagagaauguuuaauaugagcuagaagagcucuguuuuagcuuauauacauauaaacuacuagauauguauauauaacagcaaaaagaaguauugaaacaaccaaauacuaacaacauuugcagcauaauaaccagagccugauuuauuucugacaugcauagauuuucauguaagguuaccuuugagugggccccaccgccaaauuguuagaguuaagacagacauuugcugcauuccaccaggcacagaggaaagaaucaggccacuaggaauguaugucccuagcaacagcuuauuuuaaaagccacagaaugcuggaguuugggacugagacacugaagaauccaauuugaaaauaaauaagcauauuugauagagucccauuuuaaaaacaaaaaacaacaacaacaacacacacacacacacacacacacacacacacacacacacacacacacaaaaaaaaaaccagaagucuugauugacucaguccuggcaugugacaaaugagcuuuaaagcauuguagaacuggcaacucuagcugacauguugggccaccaucacuuuguucugugcauguucuucuggucucacuuccucaucccagcaccaugugacgugauccaguguuucccucucccugucuugccaaagugccuugcauuuaaugggcugacuguccccuagcucguucacauucacuguuucuagcaccuuuuguguccuuugucaucuguacaucagggacagucagucaggaaugccacccagugaagaagcuaacacagcucugaugucuuugaauuggaguuugaaaacagaguagaaaacuacuuauaggauaaagcaacaaaucuauaccauaccugaacagaaaguuccccgaaucuucaugagcgugaguuuucuuacucucucaugaguggcauguuggauaaagaugguccauugcuuccauccaaacgccaucaucugagaccaucuaacuuuaagcacuaaggcuaaguuagguaucaucaccuagcauuuagcauccucaaagcucccugacccauagucucaaagauuucauacucccacacucauuguauggcucugcaccguguucuguucucucuuguuuucuguuuauauagucacuuuuaaugaaaugcaugcugaauuguaagaugcaugagcauuuaauggcuuuagcauauuugugauaaucugucuaaaacauucagaggggggaaaucuacucuuuaaauaacccuagauuauuugauaagaacugagugcccucaaauauuaugaagacuguuuaaguuacucagcauaggggaguugaaugugucuucugguauugauacauauaucuauaggguuuaggaugccuucaacuuuaaauuaggcauuuuaacaugcauaaggugggagguggugaacaucaacuaacaucugaauuaaauaugggggauggauaaucuuauccuugaaagggggccuugaaauuuuuuuccugaauuagaaaggaacugcaugugcacggaaugcagagugaguucucuaaagcaacaugugacauuuuacugccuucuuguuguguuuuauaucuuguucucuccaggcaucguggacucgaccagagaagcaagagguauagcuuaccugaccacuagccagucucuagcucugaaaacaucucaguuuuaacucaccaucacaguuaauaaccagacuugcuaaccuagugagcacuuuagguggauuaaagauuagguccauagcaguagacaucaccuagcaauagugucauuucuuaggaugagcaagcuagcuguguugggaguggaggagcaaaucuuuauuauuuccuaaaaugagaccuuauucucuugcuggugcugguaaaaucauacccaaguaauuauauugauagacauaaauugccccaauucccaagccaggcauuuugaaaaaaaaaaagaaagaaagaaaaaaagagagagagaaaauuguuuaaacucucaucugguggcuguggcuuuggaccauaaagucauagagugagugaucuaaaacccacucagcccuucccuuuccagcucagcucaucuugucgcucacuuacuugauaaugacuggccuuucacaccgcauuuccugucaaaagcaacaccaaagucaucucucaccugugucuccaaaucguucaauguaucuguuaucuuuauggagcauuaaauuuguaagauuggggugaucuggcacaaaugguuuuauguuuuguagagucaguaguauuuagccuuugcaauuucccugccuacucccuucaguuuaggugacaugggacucagguugaaaaccgaagcuaaucauuagccuuucuauuucauugcugugcuugaagacccuucaugucaucaugcccaccauauuuuuuuuaccugguuuugucacugugagugagcaauuguaacauuaaaaaccaguugcccuggaacuagggagguauaacucacucagcaaagugcuugccacacaagcacaaggaccugggaguuuugagccuuggcacucgcguuggaagccaagcaagguguugugggcuuuuaaucucagcacugggaagaaagaaacagguggaucucuggggcucacuggucagcuagccucaccuagugaaggaucccuggaucccugugagagacucuugaaaaacgaggcucuugaggaaugacgcgagcaugcacgcacagacacgcacauuuagaugagauucagauauccugugaauccuuucuauuaaagucccuuuuauguuccuccaaaugaaaugugacuacccaaaacaaccaucacagaaggggauucaggaguccaauagacucuagacuuuacuugagugaguguauccucucagucuuuugggguaguaaccagucagaauacauagcuccugucuucaggucacagacaaaguugucaccuauccccuggcagggacauucauuucugcaccugaacagccugccauggucaaaucuuguucaucguaaguucaucucuacuguagugugccuuccuugaugacacggagacuguagucaagcacauguccccacugaaaugcuucccuccuguggccuugaaaucauuuagugcugucauagcugagugcuuuauuggccaaaaaucauggcccuguuggcauucgggaaggagagaagaggggugaaugauggggccaacuuccccagcuacagaucuugugcugcuuagccuuguacaucucccccugucauucugaucuagacuugacuuaaggagaugcugaaauuuaucagggagcauuaaggagaugguaaauggauuauuauuauaagugaaacuaagagguuugcucccaggaaagcgggcaccucccucuccauuuuccagaaguaucuuuuaucuugaauauuucacuuuggacauaauugacuuccaaguaaaugagguccauggggcucggaaguuccauuuuuuuuccuauuugacucauucagagaugaaguccauaggaccagaugagugcaacaguugggauuguguuauggccagguucauucuggaugcucugaaaggcucaacacuuuuacuguuuugauuagaauaauuagaaccacacauauuuuuuuaaagagugagagaauaaucuccuugcuguaauauucuucuuccacucuuauccaaacucagaugcucccucuaagggagccucaguggucagcaggacuuuugguuggacugucuuauggguguguccgugugccaggagaaauuauuucaggaggagauaacccaaucacacaggagucuuaucaguauaaccuccaagggaugacuggauaucaggcaaagagccccaucaucaaacuugcagugagccacuacagaauaggaaauccuuauagaaauugacuccuugucugaugacaucauuaaaugacagaaaucuccacacagggaaauaaauguaggcaaggaggcagcuuuuuuuaaaaauaagcuaaaaaggucccacagacgcucugugcucaucuucagacauuucugaacaaaggcuauuccuaucuuguuuuguguuccaacuugugugccucuaucagccuucuuuccacauggaaauguucccuuagaguucugagaacuguguguauggcagucuuuggaaaagcacuauuuggaucacauagaaccacaguacaucccaagguggacaagacccuguguggacccagaguuccuucucccgucaguccuguugugcuucaggcagagaggaaugaugagcaaacaggucaacuuuuuagagauaccagcaagaaugacuucaugcucucagugucccugauugauacugaugggugaagacuuugauugacauauaaaaguagcuagugagcuggaccacuaucagccuauaagaaaaggaggccugggaucuagcaucuccaauaaauuguaugucucugggcucuuuaagacagucuccaguuaccucucuuuaauguauaucacuuccuuggaugaaaguucucgaucaacaagccuccucuauugacaggguauccuucucugagagaaagagcuacacacagauguaagcagagaugguguucuuuugcccugccuucccucauuggaagcauauuuuaggucccugauacaacucagacaacuaaaacagaccugauucaaauagugcugguuacugauggaaaauggacucugugccauucucuacugagauugcuguaaaaagccagagacaucuuuucaguugguuuugguuuugguuuugguuugguuuuuguuuuaugaaucuccuggacuggcuugcaaaguauggugcgguucugcccucuggucagcuucuaauugauagaaacugagguuaagugcccuuuaauucucugaagggcaaguccaauagcauggcagaugcagcacacccucuuguccuacucuacuaagcaucuugcaauggacuuaauagcccagcuuauguagaauagggcccuucuccaguuuacuaauuuucugggaagucuggcccaggcacauuugccuaaacccuucaauagcuagcaacccuuuugcuuagaaugccaaggaaggaacccuugcaaauauucuagaauccaucgccuaggguuuaugugcggauucauuucuuagcagugcuuguaauucuauagacugaguaaaguaaugguaguaucaaagacuaggaauggaugcaaacuuuggugcaaaggauccugggugagccugugacuuuuucugcacuguucuucaagaggagacucuguuaguuucugcuuaacagggcaugagcuuugauuuguuuccacauuaagaaugaaaauugucuugcuaucaagcauucaggaaagagaggcauuuauaggaaagauacuucuugcauuucuuacauuugugccauuggcauguccuacuacauauucacacaccagagaauugugggugauagucagaccagaaagaaaggacagagacaaugccgugauggaauuugugccagccagggcuuuuguuuccauuuuaacacaccuuaaacuagucuuggggaaccucccuauguccccaaccaacugagucccauuuucucuuggaacugcuuuucaaguuucuauucugcucccauacucuccuccauuaugaaauacauggcaugaauuuagagguugacauagagcgaggacuaaagacugaucacaagacaagcaaugaccuugucuccuagacccacacugcucuaguugccccugcccucugccucaccucagugucugaugcuguuccuuuccuccuggcagacucuggaugggcacauggugguucgcagccaugcucguguguccuccuugacccugaagagcauccaguacacagaugcuggagaauacaucugcacugccagcaacaccaucggccaggauucccaguccauguaccucgaaguucaauguaaggaauaacuugggaaggaguggguggagggaaaagcagugaagggucaggaugcaggagacauaagcuucagcuucaguaggaaguucugccuaguucauuccccaaggccuaguucauuccccaaggcccucaacuaugucagagcuauggcccuaaguacccacacacaaacgucauccccaagcuacccaccagaccuccaugcugugaguucucucaagcagagaauuccaacaugacuucccaaauuucccagagcucuacugcuccaggcagcucugcuuuguguccugcuuaucuuucuagugccagaagacagacugaaugucccaagaaaauguucugauggucacuguccuucauugcagaugcucccaagcuccagggcccuguggcuguguacacuugggaagggaaccaggugaacaucaccugugaggucuucgccuacccaagugccacaaucuccugguuccgagauggucaguugcugccaagcuccaacuacagcaauaucaagaucuacaacaccccaucugcuagcuaucuggaggugaauuggagggugggaagggcaggguggaacaggcuggguggucaugagaugaguuucaucaugucuccugcuucucuggcacauccagagcuggaggacauaggguggagaggaaauucagccuuucuucuagguccccauccucagcuucacugguccugaccaugugccuaggcugggacugggaaguggaauauaucucuuccaugagacacugagcuccuuccacugagauagauaauguguuccucaccugauuuauucuuugcuaacuguaucuaagaaauaaagaugagcauggccacccacgggacauuuguaaucuaugggauuuauccuucuacaggugaccccugauucagaaaaugacuuuggaaacuacaacuguacagcagugaaccguauuggacaggaguccuuggaauucauccuuguucaagcagguaagugccauucaugccaacuuccacaccauccuugcccucauuggugcaucuuauacauuuaaaggguauuaaugaagggguagaagauaaagucaggcucugaagagucagaugcugauagcaacuuagagugagagagaauccaucuaugggauagguugaggagaaugugaaguaagcuacgaaaguggagucuccaaaaccagagauucuuuacguuuagagaggguuuccaagauagagcagaaacaugagagacauacuucaaauuggguguugugaucuugggccacaucugugaccuggguguccauacguauucucacagacacaccgucuucuccauccauugaccggguggaaccauacuccagcacagcgcaggugcaguuugaugagccagaggccacagggggcgugcccauucucaaguacaaggcugaguggaagucgcugggcgaagaauccuggcauuucaagugguaugaugccaaagaaggugagucuaguacacacccucaaauucaucagauccuuguugacuguguagguggggagugagcaggaugucaccaucugccaucccauccagcuuccucuagagaaaggaacucuucaucuagaaauaggucagggucauucuuccauagaguuguugaccuucugucccugcugcuacagaagcuaguucuugugaccucaccaggauccucagacagacgaccugauuagguguugagcucaaugggacagagugcagagcauccccuacucugcucucugcuuccucucugaugacaccugggcaucccuaaugggcuauacccagggacagucauguacuugcugaccaagccagcaagaugacagacagaucuaccaugaguaaacccuguucuaucuuccaaguuaagucaaucuggugaugucuuucaagauuaaauauccccaucucucuuucuuccuuucuaucucccucucugccuuccuccuucccuuccuccaaaccccggguguguguguguguguguguguguguguguguguguuuguguguuguuucccccccccccgucucucucuguaccccccuucugaaaucagcaucaaauauccauggauggauaaagauuuccuauaucauuccccaccuuuauuaucuggcccugaaaaucaugacuucagcuaggcuggcugaccagggagcuucaguggucuauggccuaucugugucuaaccccuaugcuggguuacaggagagugccuccaccccggcuuuuauauggcuucuggggauuugaaaucagguauuucucuuguacaacagacacuucauccacugagauaccgccucagucacuucuguuuuaaaagaucacuucuacuuauauuuuauuuaugguaaaaauucacauguauuuugcauuuaaccauuuuuaaguauacaaguagcucugagucgcaacuaucccugcugaccagcuucuacacauuugcgucaccuuagacagaaacccuaacuccuccuuuaucuaccuccucuggucccuggcagcuaccauuccacugucacucccuagcugauuauucuagguucuucaugagagugacaucauaugcuauguuccucuagcagcagcuuauuuauuuaacaaaaucuucucaagguuuaucauaccauagcaugugucaacauuucgcccguaagacuggguaaaucccccaccauugcuccuugauacauuucauuaguccauucaucuauuauauaaaagucaucgaggcugcuugugacuccggaccauugguguguacuugggacuucacacugcaggugugaacgggagcguagaggucuucauucaucuccugcuuccaauuuuucugcuuaguugccaaacaaugguuguauuuaauuugcuggacaucugccguaccaucuuccaccacguuuacuucccuguacgugggcgcucuccuuuaaucauccccauuuucucacgacagccaacauggaaggcauugucaccaucaugggccugaaaccugagacgagguacucgguacgacuggcggcccucaacggcaaggggcugggcgagaucagugcagccacugaguucaagacacagccaguccguaaguacagccagcugcucugucucucuccacauucacacucuucccucuuuuccucggggacagaaagggacccugagcuguccccugucauagcucagaagauagcuuuugacuuucugguccccauguuccuaguggcccacucaacacucugguucucagggaugacugaucugcccucacucuucucaaacuguguggaggaggauacuuacuguccugauggguggcccagauuauuaaaguagcagccagaggccaccaaugauuaacuuugguggagagucugaggcgggaggggaaaaacacacaggacaaauggaaggaguugggagcgcugccuuuugagccaggccacagaggccccuuauaaauacuuugugacuugaaggaagacaacagagaccgugacagcucgugccauuggugccugcacuuuugacgcagugacaacauuaagucauaaggaggaaaauagagcuuuccuugugaggagguauagguacccaucgucuaauaggggcccuucccaagaugacucccccggacgucucugccucucagacucuuucaggagagcugcuuuccccggguuccacucagggcggccucuagcuucucucgucacucccaccaacccuaaacuaugcuugcccagcuuagccuucauuucccucagcagccaggcucugggcaagccuuuuccugaccacguuccucugccguccacacugcugccccacaaggccccugggucccuccagcuggugaagaugcuguagagcggugcuccugagugaucacggaggcuccaagcucuccccaggccuugccucaauccacacaagagaacccuuuacuucuuugccugagaagcuugggagccuacggaaaaaagaccccguugaccucuucccagcgauagagcuggcucacgguccuccugcagggacuguuucuuuccguuuaaagugauuugaugauuugaguuucagcuccaugugcucuguggauucuguucauuucuuuuacaucuuauuuuuuuucccuugggucugucucuuggcuuuucuuuccgucuguguuccauccaugggaaaugcagauagcccuccuccacguaagugccucuucauaccucauuaccuguuuccauaguguuaacaccuaguucuaguucauaauuuaguucuggccccuuuuuuuguccccuagaggcugaaguagaugaugcugucugaucccuaaccacacugaccuuagucuagcugugccuuuguuaacauauauaggucacuccaggaggcuaacaccucuguucuagagcaugcgacuuccgugucuuuugaaauuguguuuauuuauuaaucucuguguguaguaauuacuggugugggaaagauaagguuugcugaaccaagcgugguggaaaccugcagaugaucuccgaguaacaagcuaauagcauccccucacuuuuagcccuaguaccagcggagugacaccugccuccugaggacauuguuccaaauaugaucgaggagaaggagccaaaaauaaucuuccucuuuguuuuuaggaaguaagagaauggaggacgcaugcuuccuggcuugucuguuaguuaggagaugaggacaagcagagacaacuggugggaaggccuaaugggggcucucagaaagguguagacacacuguguccugcaggcagcugccugcagggggcaugggaagggagcuaaacccuugauucuagcuacccaguagcauggagagagggggcgauuccccuuggagugacacucuaauuauauaaacuggaaacacacacacacacacacacacacacacacacacacacaagaugcugagagcaaaggaaacaagagaggugguaggugcuacagagaguagaacuggcccugaccucucagccugaagagacacccgacucccaaaagucacuuugccacagucuggcucucccugggcugagcaccuugagaacagagugcagaggcaccugacagacccagacagauaaucaggaagcuauacaccauucuaggaagcugcuagauccuaaaaggcacuuggggaaacuucuacuuauaaaaguguuucgaaauacugcagccacagcaaaaacuaaguagcugagcguggaugcugugcuaccagccagguuggugucugaaugugucaacuagggaaggugucagaaucaaggccuguggggaugaggggugcagacacggagcaaugaggaggacugacagcugcgccccaggggaacucuggugagaacguucuuccuccuggauccuuccagcaacccuaagcugcuuucuccagacccuucucuauaggaaguaaucaggaagugaggaccagcuuugcgaguuagagggagggaggcccaaauaagacuuccuguugacugucuucucugcagcaauuacaguugacuuugaagaaauggacauggcccccaaggucacaguaguuucuauucauuaccaccuugggccuuaugaagauaggauuauugggggggggggguuuggguuuguuuuuuaauauagcagaagguauguuucaagccauguuaaaaauuauguguuuaauuaaaaauuuuacuuuuaguuuuaguucuuaauuuuuaaaagaaggaagcccugggcuuggucuuuuauuguauaguaguaugcaugugggugauuuaaggagacucugaguguccucugcagaaggcugugacccaacaacaauuagcacaaaaguugguuuucucaaucauauaauaaagguaugauuuaaagaguuaauaagcaucaggccuuacaggccuuaaaaagcuuugggggaggcuuagguggaaggaucauaaguucaaggccugccugggccacagacugagucccagaugacccuggguaacugaguuccagugugacccugucucaagauaaaaugaaaagagaaaggacuggagauauaucucaucaguggagcacuugccuggccggugcaacaccauagauucaaaccuccaggcaagcaaagagggagggaggaaggaaagaaagaagcaaggaaagaagaaaggaagggggcagcggggagggagagagggucaagaaggaaggauuauuuuugacaagcagacaugaaguguaaucuuagaagaguauauagaauaucagcauggugucuggcuaaacaugggaagagcacacucccugaagaaaccucagugagaucuuuccuuuaauccucgugagcuuuccccaagucacugacaagggucuguccagagaacauccugccuguccugagaaaggacaccgugggagagaugaagccaguguuuaccacugcugagacaaagcccgcuuuuuccacugugaagcuucacaggggucuccucuggguccucgcucccguuucuuggaagacaagaaaguugucuaaagucagacagagaaucauccguggacugcucugcgugugcuucucccaagccugcgcucacacacuggcaccguugcccuaaacuauaggacgacacagacugacugguggcucugggcugggaaccagaguggaacuccuaacccugggagaggggaaaaggccagacuucugaguugggagggguugguuaaggccaguguugggcauuaacuaacuguuggaguuuauugggauguuucaauaauagaguugcuuucuuagcucccuaggaaaccucuguacagucagggguguagguuaaucacagccagagaagagcaggcaaauccuaaggccucccagcuagcugcaaggcaaagcaugguauagcuuauugaggguccucuguguacagugcacagaggagaaaagagagcugcgagccuaaacaaacuaagcucuaacccggggaguguccugugcaugugauuucaaguuccaugccuguguggacuggagacccucugcuauuaaguucaugaucugcgugcugcaggaggagcugcuucccugcugcaaacuuguacucugucuucuuguggaaucuuuuugcucugucauuggaccccacacuugcagaaauucguggccucguugguacuguuguuuuugcuucuaugccaagaaacaaaauagagcauauugggugcacauuuuuaaaaagaugugucuugagauuuuuaucucaauauacuguccccucuguggcacaugugagaagaccguaaaugcauugcaguacacaugauuaaaaugcauagggaauuaggccuuuccccaaauaacguggacaauuacacaaacaucucaagacacacaaacgcacacacacacacacacacaagaaaguaagagacauuuaccuuaauuaacugagucaccuauucaucaaggauugauaaccaaacugcugugacaucggggacacuggcaaugaugguaucaucuggaagguacuggaguggguuccaagccccgagcacugaggcagcucugacaauagcuuucccauucugccacccagcucccaagggagccugccuuuuguuacugcugcugacggacaacuucuggaugcuugucagucaaacaccaaagucccauucagugucccagugugccagguguacagucucuaggcauccuccaggcugaaggcuacuugggauuguuugugaggagccuguaucuuuaacagcuccuuucuugggggagggggggcggaacgggaaugacacugaauugucucgcucuuccccagcaguauaagcaaucaccugcucuagggagggcuuuuggagagcaccccuguuuucagaggcuucuguauaaaaaccgcacugucccuugucguugaagauggccaaugccgucucgcucagcuguucggguuagagagugagauguguagguuuugcucugagugccaggagggagggggaggugcucagucauugaaucacuugcuggacaagagugaggcucugagucagcccucacauagaaaagccaggaacagcugcauguggcugugaucccaggaccagggccacagggacaauaggggucgugcugcauagccagcaaggcuuucuggaucagugagcccuagguucagugagagaacuccaucuuagagaggaagguggcuagggagaagaaagagggcucacugguuaugagcauguucuacucuuacagggaaccagagguucauucucaugauccacgucagagaggucacaaguaccugucacuccagaugauccgguguccccuucugguuuucuuggguaccuacacucauauacauauacaucuacaggaagacaugcgcauauacauguaauuuuaaauaaaauacuuuaaaaaugagguggagaagcaauugaagaagacacucaacaucuggucuugacacucaugcacacacacgcaggggugcacaaucacccacuaacacaagcaugcacacacacaaacaggagauguacguaaauacauuccuauauaugcacacauauccaggguguaaccugagaagcuagucccuuuccuugcuaaggcucccauugaacugaggccuaggugucuguccuccugucccucagagcuuaugggcacaggugagauccugcccagguggcuguuugugugcuguucagguuugaggccucuucagcugcuccuggccaauuccuuaccugcaugccagccuuagcaggcucuugggcucaaggugcacacuuagaagagagcccuguguacugcccgcuagcgugccaaccaccugucgcgugcacuuuuucucuuuccagcuuugcuccccaccggcuccucauaccagcaccccaggauugcuacucccauuuuuuuuuucaauucggcauccgugugcucccagugaucuauuuaccacuuuuuuuuucaccuucauuucuuguuucuccaguggcuccugcuaacucuuccacucuuguuccguugucuccucgagcuagugaguauugcucucuucacccccaucccugcagguaccuuuccacccggugcgacuccucugccuacggugauaacucagcucuggcaauggagagucaccuugggggauuuuuuuaguaagcaaagggaaaaaggaauagacacagggccucucagggcagacaagagaagagcuuugcuuuggcuaggacacccugcagacagcuguccugaggcugcuuuguauacuugugguaugauucccagcaggucagaccaaagccgauauuuggaaaagccaaaggaauuuaccaagggaaaaaaaaucucggcccugucugcagggucauguaaaaugguuugaggcguuguguuuuuacccuuuauuuuaguuggacuuaagcucugaaauuagagagugcagccuguagcuuucacuaugucuguaagugcauagaccccucauaaauauuuguggggaaguuaacggugccugcucacagaugggccgcacaaauuacuuaacacuucacaagugaugcuugcugaucucugcucuaaaaucaaauggugagccuacucccgcugcauaaccaucguaaagaaaauaacaaagauuacagcauuuaucaagcucugcuuugcuuacccugggcgggccucaccgacccagcugggccuuugucacauugggggagccugguuuuuuccucucaauucucuuuacugugcuauacuuuaguucuuugaaucuggaggaguggaacagguccacucuuuggaaacuugaaccuggcuuucuaguagggggaggguaaggcugcggggugagggugacaacgugagacauuaaaugaauaaugucuggggugauguccccacaagcccagagcagcacacagcagcauggcccugccuagauggcuuuauucuccauaauauugcagaagcccccauggauuggacucagccucaaucucucuucccaucauuuugaauaagaauccucccuaccaucucaauccaagcuaugcccuguggccucggaagcagccugccagcagcuccagucucugcucugaccuucgaccugugaccucaugaccacagaggagucucuucggaauccccaaaucucagauuucuuaucuccaaaacuaaagauagacuccccuuuaugguaugcauauuuguaaagaagaaagaaagaaagaaagaaagaaagaaagaaagaaagaaagaaagaaagaaagaaagaaagaaggaaagaaggaaggaaggaaggaaggaaggaaggaaggaaggaaggaaggaaagaaagaaagaaagaaagaaagaaagaaagaaagaaagaaagaaagaaagaaaugaaaaguacacaaaauauaauguccagcauuuaguaacuggauuuaaccaaaaaaguauuuggggauaucuuaucucuugcugcaugaguccuuuguaagcaaaaaaaaaaaagauuaucuuugauaagcucuccaaaauauuuauauuaauauugauaaauuggggcaauaggaaugagugacugacgcacugucucugauacauauguguguguguauauacacacacacauauauauauauauaugucucugauacauacguguguguauauauauauauacauacacacacugauaugcauaauuuguacuuuuggguaugugaguuuuauguccuuucuggcccucaccauuuagugcccuuuccaaccuucauguuuccauagcaaccuggccucuuccuguccuuccaaccacagaccugucuagugaguacagagccggcugcucugggcagcgccucugcucugcucgcaguagcacagucuacagugugacugcauggaggcucccagccuugagugguuucuaagcaugcugucuguuuagccaagaaagcaaauggagucgccuccaaaagaauaagggguggcuguuugugcuuguggagaccuuuccauauugacauuuguguuuaaaacagaaaagaauugggaaaacauggggggggagcaaaguauggcaacuccuucccacaguuuuacuguucaugccucaugggauugugcucguacacacacacacacacacacacacacacacacacacacacacagagagagagagagagagagagagagagagagagagagagagagagagagagagcgcaauauaauaaagugaggaaggccugggagcaagaggaaaccagaggaaguggagagagcugcucagagaaaaggagaaggaccugugccccugacaacauggcagcccgugucucacaacagagccuguagcucugucccccuucauucuggucccccgaacacuuggugcuagaaaaauaauagaacaaugccaccuccuaggcugcuggguuggaagggcuagacguccucuccagacaguaggauccaagggacaagagcaucccccuagacuagccugaaaaccuggcugaguccgagcugcaggcauccaggcuggccuuaaugaugugaggccacaugggugcugggggccuaaggcccucggcuaggcaacaagagccuuugcacugugacuguguauauuacagcacuugaggcuggaggccagggagagcugguccugccucccaccaagcagcagucagcuaaggcaggugaugacgggucuacggaguucagcucccacacccuggcuaaggccucccauacauaauuaaagaggggagaaccgugcuuccugguuguguauacugcauggaaugguuuuuuuuguuguuguuguuuuccuccugugguagacagcuacgggggcugcuuucucagugguccucuguguguggcugcaaugacuuucaguuccugaugccuuugugguuugguuuugugagaggaacaagcaugacaauaagcugggcucauuugcacggguuggaggguuuucuuguuuguuugugguguauuugcauuugaaagaggaauucuucuaacuacuccccucuaccacaguggcuccgcccucccccccuccccccuccccccgcccccaucccuccugcuauauaagucccaggaaauaggagaaagcuacaggacccauuugcacaacccuguccuguuugagacaccgcuuugcaucuuuggucuugucugucaaugaaacacaaucuuggcuccagacuucuccugaagaggaaugaaauauuucuccccugacggguguuucgguuuuuauauuucuucagacauuucuacccacagauaagaugcuuaguugugaaaucugagcaggagguuggagucuguuuuauuugaaccacuugacuacugacccaaaucauaagucccagaggacagugagauaaagcauaggguaucccgauuggcagcagccugaguuagcaggaauguauuagucaccauaggaucaagaugcagaggaugugagccaccgugcaaaggaagccgaguagcuggggucauguagaacuccgucagucagucagacaacacgggugaaauuaaauaauaucuccuacagagguguaguuguguguauguguguuucugaguguauauguaugugugugugugugugugugugugugugugugguguauauguguguguguguguauaucuaugugugguaauaaucuguuuauaaccauaggugaaggaaguuuucauaaagcguaucaagagaaacuacuugucacauauaagcccuuccaggcuugcuugggaagaaccugugucaugauagaccauaagaccgugcauucugucagcucacagugggacagggauaugacacucacagcuaaagcgcuucucgcucauucaacagaagcaugcuuucaaaagaugucuugaccuuacaucuuuucccuuuucucuuaaccucaacugucaaaagcuagaacuuccuucccccaacacccaggccugugaaaguuacaauuaggaaacuuaagacucuuagggucggucauucagucacaaacuguaaugugggguaaagcacauggcaaaaggaacauaggugaacugaaacccugguuuacaccguaaaccucgagauccugucuuauccauguagucuuggcaacucugaaggcagcauuggauccaugaguagucaagugugugguuaaugccacccucugugugcuggaccagggcugguuccugcuauuugguauuaaugcagccguagccucaguugccaagaaggugcuuaguccuuuaccucuguggccuucuccguuucugugugccuugacucuguggagucccauaggguguuaagaacaucacgagugugccauaaggaaguggaauuagacccuccaagcugucccuuucuggccagaaucuacccaggguccuucagucaucucccucuccuauuugaccaggacaaacacggaaugacucucacuaauuaaacacaaucuauuauucuuucaggacccuucccugaugaccuaaggcucacugccaucacuucccccaaggaugcugagaccgguccaguuucugugaauaaauaauuugcuguuguuuuucuuucccuuuaacaggcucugggauugaccuugauuggcaucugggccuugauggaaacacccccucauuuuaaaaguguucaugcuccuuggugugguauuaauaugcaauguugcaacuguaucuaaugcuuacugguguuguuaacuaaaugcgcuauauaguuugugauucuccucuuucugggcaauaugucugcccucccgauguuuccuauauaagcugcuaauuuaauuugguuucuccuuuuauuuagucugugauuuuguuguugguuuuuuucucccugcccauuguuuacaucaguuuuuaauuuuuuuguauuuuucaugugaccuccuccacuuuccuuucaaccaaucaugugcgugcguaucaugugacuuugucauguggcuugcauggugcugaugaugucguccacgcuggugaacagaagguaaaagcucuuuguucugauuagaggaauaaaccuggagccacagccuggcacgaauuuucucccugucuccaauagauacagcaaagacauuugaaagauuugcucuugccaucaauucaugucuagaauucaacaguccuugcaaccuugacauggcaauuugauaacuugacagccuuuaguuuaauauuuuucccucaagaaaucuggucauaccaacugcccucucaguaaagccauguuagucacagcacagugggggaacuugaauuuuuaacagaccuucauaaacauuauuucccagaaauaugcuuugaaaauuagccucuuugcuuaauuguguauccaguagcuccaucaacuacaauuucugcaaaauguguuacaaccccuuuggaaauauuuugcaaccuugaaaugcuccaggaagagagagagauccgugcaaagguugcucuccuguaaaacccgagagugcuucacgagauuugcauaaauggaggacuuuucugaagugagaauuuggauugaugacugaggugucacuuccccaaaguggcccucccccaagcagggggcacaaaucaagcaaaagucacuuggcaauuaacagugacuggaagucuccguguaaucaagaagcacaugauugacccuacagaaaaggaaauaaaauuauagccugaugaagcgcagaacggugacgaaauaauuaguuaauauugcgccugucacaaccuuguuaaagcauuucucacucaccaucaagagagaaggaggcgucggcucucagcuucccccacugaacucagaccuguucagagccuccccugggagucacaggcauucuguucucuccuaacuaaaguguuacuucgcaucacacccuaaagacacauacaggcugcagugaucacguagccagacuaacaccaauaaccacccagugugcuugcgcaugcaagagccuccccuccauuugaccucaccucugaccucauuucucugagaauugauugggcgacauccacagagucaaaaucacaguagcuugucuugcauggucuuuguuccuggucugagucacacucccuguauuuguuaccuuguguguauccccucuccuccucccuccauucacagucacugaggacuuccucuuuguagcuguggcaacaugacccuaaagccagucccauuuacacccagacuccuggacuugcagaggaggcaccuucaucuccaacaaugacuugucucauauuuuacgugguaugcaacgaaauagaaaagucccaaaaaccuugcaagccacaguaauaauuugaucuauguuaaaaguugguauugaaucugucagucuuuggaaagagaauauuggaaguuuaagauuacuaaaucuuaaagauuuugggacucccugccccaaauauauugacuuuucucuccuuuaaguuggcuuccagcagggguagacaucuuucagagucauggugacugcuaaaugguuaguggucuagaaaaauagccccugggacuucccuguaggaugcuaaguguaugcagauguugaaguuugaauuugaaauuugaugagauuuuuaaaaacaaauuuggcuauugcagugcacugcugugauucaggauaaaguggagcacagcauugaaacuaagaaauuuguucacuccugaagagagguccaucuucaggaguggucaacaaaacccaaaaaagggaggagggauaagagaaguuagcgcaaguaaaauuuauagaauaagagagugaagcuuuuuaagggcagcucccaccucccuccccuggucauuaguaaggauuuaagugacuugggccugauuucagaugcuuuaaauaaacuaauaguaucgcucuuguuaguggaucguacauagaacagcugaugaagucagguguuuccccauuccacucucuauccaucugcuccuacccaaaaucgccugggaugcuuuuaacaaguaccggaaacucugcccaucagccagacgcuauuuacuauguuccaucaugaaacacugaaugaagagaagagagguuaaggcagggacugaaucccaucccccaucaucaaauagcugugguggagaagacacuuaagucccuaccacagggcagcagggagugaauuuguuugggugagcugaacucugcauuaugcaaacuaagauuccccuacugccccacccucaccccuucccauauauccgaaccuuuagcuugaggugccucugcagagaaguagcuuuauaggcauuguccaaggacuauguaaaugggacuuccgguuucccaccaucagcaugagugugacaagcccgcuccccugucacuguguugcaugucugagcauggcucccuucacacccuuucauaaugaucuuuuuuuuuuuuuuuuucuucuuuagcuacugacccugacuuguguuaggcaaugcugguucugacgaacuaaauucuuuaacacccacucuuccuucuuagauugaaaacaucacuaaccgccccuuccacgcccuccuuuauuuuuauuuuuuuacagcuguguguuuggagccucggccucugacaggucgacacagacuuucuauucuaauugccuuuguuccgaaggaucucgcacccuggcggcucccaggguagagagguagcuguagccaagguccucagagaggggcaguggaguauuaucagccugaagccuucgaguagggaccggaucuccaaagguuaccagugugagggcaggaacaucccaguagcccacuuaauacccacaccaauguucaugaacuagugaaguguggcgccuccuuguggcucagaaggaguagcagcguucacucggucauaguuauuucuguccuaaauucuucagccuggaucagccccacaaccacaagcgaaaccuucauggucaguuuuuuuuuuuuuuaagggcaauaaaacaaauauaauuggucaauuaauccguuggugcuuucaugccacccacaagaauggaaucgguguuuuuguggcucagucugucagaguucauuuguugcugucuaauuugcauuuugucauccaaaucccucccuccugcucccaacacacauucauaauuccuaagagaacugggcaggaauggacuccgcaccaggugccucagugagcucggguccccccgaaguucaaggucaaccuugggucucugcuaagaccuaaggaacugagacuggagagacagcaaaccaccuugguuccauucccuguaccaacacggaaguucacaaccaucuguaauucuagccuuagaguauccgaugcccugggauggcacacaugacauuugugcaggcgaaauacccauacccauuuuaaauaaauaaaaccccaaacuggccacaucccuacccacauauuccauauucccugaagucagggacucagguggcaaaggucaggucaccuuagcacagacaucucuuuaacucuaaagaaaaaggccacuugucuccagagaccucauuugagaugaacagugccgaguacaaauugucaccuucaucuuuaauauaacugagcuaagcuuuagaaguaugggaaaucccgggagggaccccagaggagugucagggagaguuauaaagaccgagagcagacaaagccuaccucacauuagaguuauucauuugauaucucuagcuaagaacuccauuucaggacagagaauuaguggccuaaucacucuaaauccugauuccccaaggcaauuugcuaauccccaaaggaccugucaguacuguuccuugauggaaccguaaugugucugagcuggagacaugaaacaggcuucccaugugaauagggaaaucaucccauuuuggacucguauaaagaggcauagaauaaaaaagguauacccaagguuaaaauugcccgaagaaauaacaagggaaaugggaauugggauaagcaaaauauuccguguuuuuaauucacaacaacgauauuugauaguaaaaauucuagauuucaacacaaacucuagaccauucaguaguuauccauguguaaagcugagacugcagaccucugugcagauagaucuguuugaaagagaaggcacagugaacaagggcugaagagucggcucaguuaguuaagaguacuaguacauuugcagaugaccugggacaguuccaguccccacacugagcagcucacaacugcccguaacuccagcuccagaggcucugaugcccccuucugaccucuguaggcucccgcagacacacaauacauacauaauuaaaaauagacauugaaaaaugaaugagcaaagaggaggcauggagcccuugaagggcuguuugucccuuggucuuucaugcucagcacacuguuggcacugggccucccggagcggggcggggcucccgcugucccuucacagcucagagagguuucuuccccaagccccaggcuugcugugguuuguguuguaaagauucuuccaucuccagagcccugcagaugagagggaaggcacgcggcagacuuggauuuaaggaagggcacagaagcccaguaauuccacaggaggagccuguaaucuccagggccagaaauaaccauuucaauuacgguuucuuaagagggcgcucagcagccugccuaugguguaucugacaggacucggccuuuuucauaccauuuucuuccaugcguguauggacuuauggucugcuggaaaaaaauaucagaacugcccagagcauuuguuauugguuaagguuuauuuuuaaaguagcgcuguguucagcuuuaacauaaaauauuugagagggaaaaaaaauugaauccuagaugaagcuaaacucaaaagguauaauuaaccccaggggucuucuuaaagcaacaugccuauugcugaugaauggcaaaccaacauuuacaaauaauuacaauauugguuuuucugaaauugcccauaaugauuucaaucacagcagcagccaccccagaaccuugggacccccuaaaccauuuccucugcuaauguguucaauuaagcagugagcuucuuuaaugccgagggccauugccugcacaguguccccuuccucaucaugccaggcuucgugcagaaaggaauguuuuguuagcccgauuccucagccauaaugaaaaacggacagcaagcaucugaagaugcuaagacaaccgauguaacaacugcucucgccagucuugaugcauguacaaaaccuuguagggccaccaaauugguccaacguuccauguuaguugaaaacaaucuuccuucaggcauacugugacaggaaagguuacacuacugcccaaggaccccacuaucuuuuuaaugaaucaaacuauauuaugcuuuucauuuugcuaaaauaaucacgccucguucaccuuugagauaucauugcccgauagacaacuucuagaacucaauacaccauauauuugugugauuaauuguagguaaagcuuucuaaaugauaaccuaaauacuguaugauauaaaaugcucugaacuucaagagaaaauaaauauguaucagaguauugucagauagaaugauagcuaauucucuucuggguauauaaacugauagagcuguaguagcuuucaggaggguuuuuuuuuuuugagauucuaauuauauuaugcauauuuuuccuaaaacaaauccagagauaagacccuaccuucaguagggcugcuggguucuucagggacuccugggaaagaugucuguucauucaugugucuuuaaagggacuugaacucucuuucaaagaccagauuuuuuuuuuuaaagaaagcuuugcaaaacugcaaagcaugacgauaacuguaugucuuugagauauggagcuguugaugaaggauauaucucauaauaacagcuagcugauagucauuuaucaugucuuccacccucaugguguugugaggaagggccaaggaagaguugacacuagauucacccaugccaggaugacagagguggaaggacccuuacauuggaucccaugaucccuuucugcaaguauggagacagaguaaggcagugcugccaaugaugagcauaccucccaccaaucagaauucagaggagguguuuuaagucccugauuaugccuugaaugcccacagugcuccauucugggagaauauaguaagguugguucaacaaaacagcuggguggacuucccuccaccucacuccaaggggaccucaggcaaagccucugcucuuuaccugccuggugaauccccuccuucgcuagggagcauccaacgcaguccauguuaugauucucagugcagaaaacucuaaugccauucccauuuacucuuggcuaccaaucaucucagucagccuaggcuugaggguuucccuaagauauugauauuucagugcuaaagccugugaugucccaggaucccugggacuuguuggucaccuuagcucugucagagaguagaacuaguugagcucucucauggcuccuucagcauuauggaaccuacccagaggcccuguuuuauucuaaaugagacuccaccuugacccccuaccagauguuuauaaugguguagacacaauugacuuauugccuaagacgguagaaaagccaaaaggaauuugaaaagccuacaaagauugacauauccgaaguaggucuaaaugcuucccuucaaauagcuggggacaguggcugcauccaagcuuaaaaaccaggacacguauuuuucuacaaccuauuuaccuuugcauucugauuuuuuuggauuucuuaaauuaccaaccauagaacagauacugagccugacuuuuuccaaauauccuucagacaucaggauuaugaguccuccugguugcaguacacacucuccuuccuuuccucuaguucccagagcgagcacacccccacacacauccaacuaaggaguccuguuccagaaacagucugagguucuaaccagcuccagagaaugcugcgcauguccgucacaucucaagggacgccucccgggacucuggguggcgugcgcucacccucugugcucccaccuccgaauccaagagaggagguuaaccacugcacagggggagccaggcugaacugcaacuuugccugcagccguccauuuauggggaggggugcagugugagguaauuagccucucucccuaguggcucuccucuuccuggcucucaagucauaccccuguggacuacagccucccugagaggucaggaaauagauuacagagccugguccuucccuggaaguccuggucucucacaaguauggaguuuuaacuucaacccuggauuagacuuccuccccuguucccucaguguaugcuugcagcuucuccuacaggaaaccagcagcacaguacggagccauccugacacucucugauuccucacacacaggcucaucuuccuucucccacuuggauucccaauacuacuguccgagugaacauaaagcccaaauaaagagaaacaagaaaauuuaucuuucuuacuguaaaauauuaaagccauuuccaccucccccccccccucucacaaagaaaaagaccgcaaugauuguugcuuuaauauauugaagagccaaagauuaucccucacuccacugagccauaaauguaguuacauucacaggaaacuugccuauggcaauucguguuuuauuucgccacaauuggaaacguauuuuuaagugauccuaagcaauaaaauuuaauucaugaaacgcuaguugcaagaauacagagucauucacucccaucagugaccaugcccucgggacucuagggugagucacgaucuacucggggauaaaacacacaaggcuguucugaaaagucuauguuuuuaaauuuccuacucagaccugccuacauuugcccaaauuccaggcacucugucaagaugugucaggucuauagaaaucaaaccugcaggguugcaggaagaaaugugagugccagcgagagagacggagaaagaacuguguucauacggggugucuuccagaacauucccacaaaccacccccagcuaaggccgagugaggcagccaagcgggguccaggguucuacacucaucgcuuccuaaccauuugaaucucuggaaaagcaagcaaagugcccauccccaccacaucacuccaucccauuuugaugggcccacucauccuucuguggacccagauuucauggaaauucgcugacuguuucaggggaacccagugcacccaagcuggaagggcagaugggagaggacgggaacuccaucaaggugaaccugaucaagcaggaugacggaggcucccccaucagacacuaucuggucaaguacagagcggugaguagcuuccaucuuccuagacaucacacacacacacacacacacacacacacacacacacacacacucacacacacacacacacauacacacacacacacacacacacacacauacacacacacacagaaccugggacccugauaccuaccuuauugaaucaagaacuugagaaucucagguggggugagcauaggacagggucccaccagacaucuuguaggagacucuuggaacauggucaagguuuuaaaucccuagacugaccuaugccaugcccacggugggaccauuugaccuauauccaugcccccagugguaccauuugaaaacuucuaugaugacuggaauggugagaacaucacugugauuuuuuuuuugugauuccuucuguuuuccuucaaaguguuguuccaauaauccaggacuucugugcaaaauugucacaaugucauauaacagucacuucuuuugaucaggugugucuccuggaccagaugcaguacccaggcauauuucgugcacagagccuauggagcggguauuauaguuagcccccacauuacaggugaagcaaccaaggcuacaacagccaucagcugauggccucacacaucuuggcgaggucucuagcuaaggagcguagguucuuaagucacugccuucaagauccuaggcagggucccuugccuggccuugugcccucagccagaccaacugcaaacgcucagcuugauuucagcuucccuuuuuaccucacucaccacugagcuaagaucuaguccuaggccagcucucaccacugaucccccaaacugagaagcccucucuccuuuuccaguuucaggaugacagacaguuggcaagcaguugccaggggugagggcagucucuggacacuggggauaaccccuuacuaagauuuccuaauaguuggagaucaugaaccagagagcagcuagcuuucccccaugaagccucaaauaaggcuuuuuccaggaaguuuguucauuccugucucuccuggggggaccaguucucauagagaugguagaugggucuagaacagagcccugcaggcuugcaugccuugcagaccggggucagaccuuuaucuauucaauucucugaacugagucucaaaaagucagaggugagcuggcacuguagggaaaguugcugaagagccagcccagagauacugcagugcaggaggucccacgguuuucuuccuacaguaaaggaugccaagacuugccagguggcucugaauagcuuauuuggagcagguggaauauaaguaaccuacuuggaguaggguagaauaccuucuccacuauuugaauggcuauaaugaaccucgauggcaucaaauuccagcuuugccauuugccagcaugucaucugaaaaucagauagucacaucuuuccaaaccuccauuucccugucugcaaaacgggaauaaaaugacuugcacugucaaaguagucacaauauaugcaaauacccccaaaauguuccgaauacuuuaaaagcucugcaaaugguagccaggaugcaggaccuagcuagaacucucuaccacaggaagacagucuccuugugugcuugcccaaauggucaccgcggcuguguuuaacagagauacaaacugcugggcuacuuuagauuccggugacuuuaagcauccucuuucacuuugaagcauaauguuugcuaaaugcagucacauauuauuaauauguauuacauagcauaaaguuugcuuucuugcguguuugcuuuaucgucugguugucucuuuuguaaugauguuugccaaggaagacagagaaggaagagcaaagagagacagcucagcuuuuuuuuuuuguuuuaaauuaaaacagcaccauagcaaccugugcaaagcuaacuuauagagcccaucccaggcuuccugguuagaucguaggacaccagaagccccucugagcauuuucccacaacauucacagcccugcagugagcacucccacauuccuagcggcaucuuuguggcucaucagaacuacuuugcuuggugaaauccuuucguccagccacaggccuggaccugugguggucacuggacuaccucauaucugacauauugcuguguuccaccuccccuguccaguacacauguuucaaagcaccuugcgugcccagaguguacccgaggcacgcuuggcuuuuguaaaggccagagacugugaagugacaggcuuugcaacuagaagaccaucagaagauuucucaggaugacuugaggcuucuccuacacuguuuugcuauggaggugauugccuagcaauggcuuuggaaacuuccuucugguacaaacucagugguaaacaugaaugauguaccuagaggggauguuaggugagaaacagggaaucccuagaauuucacaucucuccuuaugcccuggacacuguuugcuaagcacagugggauacucuaugugggcccacgaguaucccagucuugagccucagcuguucagccacaaugaugccagacuguacuguggacuauagagaaaaaaaaaccaaaacuucaguucaacucaugcuuucugggcucccugguaugaaagggaaaaugcugucuggggauggaacaggcugggcuccaaccgugacugcagcgugacuuugugaagucaccugaacuuugcucaugucccucucaugagauuuacuaagagccugaaccaauguccuggcaggcuugauacaggaguguaaugagaaauggugaagccaucccucagggcagagccuagccuggggaauaggaggguuugcauuuuuaguaaaauuggaauccaugugauaaucaccuaucagaauguggacagcauccugaaauauaagaaacauuauagauaaugauaucuauuauagauaauagauagauauaaauauaagaaacaauauaagaaacuccucuaagaagcccuuacaccaugaacccagcauuccagaguauaggggagauagggcaaguuggggccaguguuccagccccuguuccaguccugaaguuagugggacgguagagucagaaccaugccacacuggcauucucuacuguugaucuuggcacacauacuagccaguuccaccaauauaaaaaacccacaucaauucccauuccuuacaacucaccccaugauuuucaagucccccgaguguguaucuccuagccagucuccccaguaugcccacugaccuucccuggugucuucuguccuuccugccgacugcucccagaagcucgccucugaguggaaaccggaaaucaggcucccauccggcagugaccacgucaugcucaagucccuggacuggaacgcagaguaugaagucuaugugguagcugaaaaccagcaaggaaaauccaaggcagcucacuuuguguucaggaccucagcccagcccacggccaucccagguacagccaugucuguuuucugucuguuucccccgcuuugaauuaaugcauacaagccgcgccuccuaaugagccugaccagcccugacaacgugcuugcuuacagccauccucaugacugguugcuccugccaagcuuaguuuugccuuauccccaucugugcaauggguugacauguggcauacccccaggggaguuuggccaagcauccuggggaaaagguccugucucacuuggcucugacagaucaaugcuaaccagucuaugggacucccuuggaugggaaaugcccccuacuccugccuugccuuggaugcugguugaacaaggauccuuaaugagacuuucucugccaucugcauuccggacuaggacaacagaacuggcuuuaugcugucuauaugugauccuugcuuuaagcuguacaaccauggucuaaaucucuucucucugguggccccaagagaaggaauagauggugcccaguuagcucaagcuuaucuguaaagagccucuccacugugccagagacaaauugagccucuuggaaugaagcaaauggaaaacauagauacugggacacacaccaucguugaaaggacagaccaugguagcggcauugcuccuaggacaugcagauugucucuaggauccaggaccaacucaagugugggaauaaagugagagccaugauuucuggaccacaugccuugcaccaguggccaguccccuaugaggcaaauacuucagagaagacccuguucuucaaccaucaccuuuccagggccagccaaacaccaaccacaggcaggagagauggucauagaucauacagcuauagaguguugggaagacuccccuaugcucuaccauggucaggugugguaggaagacaguuugggguaggcccaucuugccugcccugucuggagagcuugcuuagcugcugaauuuaauuaucaucaagauugcuccuccugggaaagucaggccagaaaggggacagguugccugcccuguaggguuuuuaugugccaacguggguagcaccagaaggaaagcuuggugugugguucuuuauaaucguuugugugugaguggguuugugggguggauguauguggagccugcagccagugggcaggugaguuuaagcuguagauuagaagugucaguugguugauuucacaauggggagggcuuucuugcucagcuuaggguccugugucucuacagauccuggaagggauuucuuagauguggcuacagaaauuugcccucauuguggcucaauaggauguccaaauggaggugcuucugucuuucuucuaucucuucuuuccuguguucuuugguuaguuuuccauugcaaucaagagugugacgcccaugccugugcagauccacacuuugagccucuuaggacucggggaauagugaggcuuggguuaagcccuuugcaccaggauagaagccaguucuucuccagacgagacuggauagacagcgugcuugggcaugcugucuuuccaagcugggcacugcuagugacuucaccuucuagguuuccagcauuagagagaaaaaaaugcuaaaaugcccaaccugcagaggccuuguaggacaucauccaggcugcauuagagccagauagcgauaggaggacuugccuuguccauggugacugugccugcuguccaagaacuuaaaggacacgcucugguuggaccauccuggcugcuuuauuggaauuggagaacaaagccucuuugcaucacaagagguaccuuuguggccgcauuccguggucgucagggcgguagaaggugagauguucaggacccucccacguggacagugaagguagggcuuguaugguagaaagacaggucugccugggcucuccagauugccacuauucugaccauaguguagcccuccacugcaccucagcaaaccuagacacagaagcacauucuccccgcccgcuccuaagaggcuucguccuagcaagaggguuacccucuccugcucugccccucuguucugcugcagaggcuccuguucucucacuuuaauuucauuugcucgcuggccccgacccccaaauuaaccugcuaugcugcuucuggccuugcugagcugcugacccggucuaugauguugauagagcgcugaacucucuaacuuuugucagccuaacuuacuaaguugaauuaaccuuggauucuuguuuuuucuauauuugaccuauuuuuccuuucuuuuuuuuuuaucuauuuuuuccucuguuucugucucugccuucucuuuccucccugcccacaaccccccccccccaugugucuccugucacacuugucacccuggacgucacugggacauccccacugccaaauuuaugucucaacaaccaccuuuccucugggacccauugcuuggcaccugcagccacccugggcggaagcuccaccuccuacaccuuggucucauugcuuuucucugcggugacucuucuucugcucugauagaaacuugaacaugcaugugugcgagcucucaugugcgcaugcgcacacgcacacacacgcacacgcacacgcacacgcacgcacacgcacacacacacacacacagacacacacacgcacacacacacgcacaugcacacgcgcacacacgcacacgcacacgcacacgcacgcacacacacacacacacacaccauuguauuugauuaaaagcccaguuccuaugaaaaucaucaguugucccucuuugaaagaaccugucacugagagaguggcucugugugaacgaggaaagucuuggugacuggaaacagauuuaccuccuaagauuuuugucauucacugauacuuuuuugucacuucuuauggagucuguccccuuuuuaauaguaguaaaaaauauauauauaugaagaagaagaacuugaaagaucuuucuuccaauacuauuuuuugagaaaaaaaaaaaacuuguguaaaguuuacggggaugucgccaccaucuguugcuugugucuuugcuguuuauaccuaacgugcagcagcagagaaauucuagacuucuaaagcuuggcucagauuacugugaaggucagcacaugugucccuuguccuaacacugugcccaccaccucucaauagguagcuuugccugcauuuaaguauuugagcacccacguuggaagagcccccugggugacucaccuaagcauucugcugcccugauaggcaaauuaaaucuucuguugcccacgcagugggaaaaguuacaaaucaucuauuucuucuggagcugaugaacguucuggaaagggucggcauuagucucaucuucugcugucucugugacaugcccgauaggaaugggcuuugcugucugauuccccgguaaagcuggcuauuccacuccacaguaggaugcuucagaugagcacuaaagcuccaggucccgguggcaggucuggucacgaccuccaucaucaccauaaacacaggaugcuggguaguuuggaagccaagcauccacugugagucagucacucuccccacuggccccugcaugcuccaaagagcacaagguaaggggccgaggggcauucuacucccccacacuguucaucaaucaggcagugugucugacaguacucccacagcgccccagcuugccuacuggccuccacgacacuuuuuaaauguuuaugaaaaagccaggaacuucugcugcugucgggcaguucagggagaagaggaggugggugugccacagucggaugcaggagagccacggcugaaacccagccaauagugucagugugugauggaccuucuaaugaauaaaacccccuccccuccuguggcacccgucauucuaccuaugucauuucugaccaucuccacacaaguuuucuuuauguucucuuugguuuuucaccuauuuuguuucuguugucauuuuuuuuuuguaaugcucaaagacaagccuuugccuuugaagaaaaauuacuccgaaugguggucugcaggcuguugccacccugccaguguggugcauugccaccugccaguguccccaaguguucaacacagaggcuucauacugcucagcagcuaaaaaugacagugccucucccucucuccgauaugaaccucugcucuggaccccguggccucuucgcaccagcucagugaagcaaggugacauggggcaguacagcagagaaaauaacacgggccucgaggccugccaugagagucacaggucauuuaaagaaagcagcagggagggcaaaagaggccccaccauuguccucuucugauggcccuagacagaugucacaugcauucaacuugguucagagagucugccucagccuugucucugaccuacucacaggagagggacagugucaauauucuaaagggaccucuggagaucaaccuaaauguccagaaccaagcaugguucugugcucuucgcagacacaaggcccagccagcuuguggcuuguaaugcuauggccuaccagacacagcuuuauugugcacucgccccugccagacacugggccccuccauuuaaaggcuguggcuccuggcucagccaggagucuuuaagagagaggcucccaggaauccccaagggagugagcucacccccaccucugcacuguguauuaguacaguccguacaccauguaucuaccaugaggguucucugcucuuuuuuuuuuuuuuuugaauauuuauacagcagguucagaucacauuuuucuacuaauaagaaugcuaacaucauuguguagauaaucagcaagacuuuaugaaguuuacaccuuugcauuauuaaaggauauaacaguucguguaaacccaacagcguguuuugauuuucuuugacuuuuguguccaacacagugauauaaacccucucccuccaccucaugugcacuuggcaacugauuaccaggagaaacacuuaaauucuaccccacacuuggugagaaggagaguucuaguugaaggcuuuuucuuguggaaaucauuaugucuuccuaagggaucccgagguggucagguucucugcugccugggaauccugagaagagaggaaugagccuuugcaaaaguguagucacucugaagccugcaucagggguggcauguuccaccagcugcagagcucucuagcaaggucuucuggguaugcagaaaaaucccccuaacaguacauacacacacaugcauuugugcaugagagcucgugcacgcaugaguguauacacacacacacacacacacacacacacacacacacacacacacacgauagauagaaacuaaggggaucuucuguugacagcuugcauucucugccuagccaacuccaggaaggagcaagcaaacguacaagggguuaaugagagaaugagcucccuagcucagccauucugguaaucugacagucauacuggggccaggacuucuguaccuggggucaugguacaauaacucagauccagcugggcacauggaaugugacacccauuuaagggcauaagaaaccacacacacacacacacacacacacacacacacacacauaugagucucagccuuaaggcaagccaguuccugcuuggaauaccaagcucucaagccaggaaccacagacaguugacagccccagccaggcacugcucaaggcagcucuuacuugggauacaugugaaagcugcccccaagaagucuucuuuaugugcuagacaucucugugcugggcuugucagggaggcaaggugaagaucacggcuaagacagacaucugaaaggguuuccuuugccuuuccuuugacgguuuguucaguaagaugcaagaucuagaccugguaccacuaguucuccugaacuaaauuacucuguaauacccacaaagaugugaugucuccugacuccaguacccuuuaauuuguacacagccuuuccuuguucccaucucugucagggucaccaccauucccuccaacuucaggaguacucacuuccuguagaagaaucaguccuuggaaguggugggcccuuuucaggaaagagucuuugcuaugucugucugucuaucuaucuaucuaucuaucuaucuaucuaucuaucuaucuaucuaucuaucuauuuaucuaugaucaaauuuguuaugucugagacauggagcaagucaugaccccuuuggugacaaacccuagaaucaggcauaagccacugggauugaggacaggcaggcaaggguuaggaauggugacccucaugugaccuggguacuuguucaaaucccaguuccugacccucacccccaacugguucuggcucuagaaugaagagccccagugcuaaauauuuaaagaagccuccucaggaaccccaccacaggcugagaaucacugcuaaauguuaaaaggcauuugacuuuugugcaaaaucuaaauugcaaagaggaauggcuacuagaguugcagucuuccuaaugcacacuauagagacugacugacaucuugggaacagugucauguguggugcacuguacaagucgaguuugagaugagguauuuaugguugauaaagauuugcagaccaucccccauccaaggcccuuccggauacagguaccucaucuaggaucaucgucagagguacaacaucucucuaaagagcuugucuggucucugcuuaacgguuuccagaaacagcacuuggcaagaaacagagcuuccaaggcagcucacucuguuugacuuccuaugcuugcuaauccuuccugaggggcugucgucugcucuucccccuauaguagcaccgaaagaugcugugaagaauacagguccaucuccuccccauagcacacaauugaaugcuuggaaugauguuuucauccccaggcugaagacucauuucagucacccaacaaauagccugugaacauuuacccaacgucagagucacacuagcagcuggggaggcagagaagagagugggcaccugccugcuugaauguucuagagaacccaugcaggaguagugugcauacgugccuauaaauguucaggggaauuaagucagaugggagcaagaggagaguagagcagaguagcuuguuagauaaagacgauaaagaagauaguagauauccaagaagauaaugugaaauuugaggugcuguaagacagcauagcuauacagucagcaagcucuggagagaugacaggauaccauguccauggggaagcaagcagaccagccugggcuggaauacaacacuaaaagucagacccuaguuuacaagggucuggggguggggguucuacacagaggccacgacacaugugagaccagaucagcugagcaaggcuucaaacuuugaucuacuuuuuuccuuauauggcauuauguucuucaaucuuggauacauccauucaaauaugcuuagacccgguggugaaaccuucagcuggcucugcugggcccagagcaaaugcuguccugccacuguacucgcacccucagaacagcuuucccgugguuuauuuucccucuuugaagagaugagcagucaugaggcuagagacauggcucaggaguuaugagaugagcagucacauaggacuucuuugauguauggagcugaagauaaaaacaaaaaccauugcugcugagauggaugugguagccugugucuauaaucagaucaagaggccuaggcagcaagagucucauaaaugugaggcuagccugagcuucacaaagaggcccagacuagccugggcuauagagaaauaaaacuugcucucaaaagaauuuuuaugaaugccacuaaguaccaaaauucauaauauccccccaaaaaauuccuuugauacuuuagcucuuuccucaugaagucugcacuggacaccaacuaggugucagagacugugguuaagauaacuuuccuauucaaggaaaccccuugggaugcuaaagaucaaggagaucaaggcaucuccuuauguccccauacaagugugagggucacagaguucucaagugugcacuggaagaaagagucccuccaacugagggcugaagccaggagcagugccaaagccacacaccugucuuuuauucauguuggggcaucucagagacagcagcugggguccccagugaaggauuagaaggaaccagcccaaaguccugaggaagagagaaugggaaacaagccgagguccuaaugagugaaaacaucugugaaccuggagcuuccuccagcucagggccuagggccccgagaggaguuggugugaggguuccucucuggcauccugggccagaauugaagcuuguaauuaggaacaguggaaacccuuaagaagcacuacaguaccucagugaggcguccuaguacagcagaacacaggcuacaccaggaguggaacaugguggccugguguggugacucacaccuguaaacacagcucucuggaacuaaagacaaagggaucagagccccuagccaaugagaucccauugcaaauauccaacaguauuaaaagagagacaguagcccacaggcaguaccguuccugcccuugucuggagggaugaccuaagauaagauugucaagcugcuggacuuagccauuuggcaaauuauaguauacuuaccaugaagacaguuggggucaauucccaagugcuguuaucugugguucuugcagccauucugaaaaccuaaguguucuuagucccuugggagcacaggacacaucaggcaggguagaaugguagacuggaaugggaccaaugaguaagaagugcccuguguccaucugagacuauuguccccacaaugacuuacauaggcagaacucugugcagagcuuugcuucccacaauaccagcacugaugggagucaucuagagucagugggucccucccagaaaacuggugugagugacgccacacagggaacacaggcagggucuucugugggaaaaaucuauaggccaaggccucagaggacuacuaauggucaccaagggaacuaggcagugaagccccagccagaguuaggaggcugggugcugucgggaugugagacugugagucuaugggcacuuguccugugugugggugugacugucugugagaauguucagaucugggaaagucuacagguuuuccugaagucugcucccagaaugcccggcucccauguggugaguauucccagacccccuucgccuuaccuguggggccuggggaggcugccaugucuccagaguugguaggccacauucauccuccugaggccugagaaaugauaagcugagccccaguucccucauaguuaaaguccguuggacuuacucuucaagaguggagaggaacuugaaucauauguugggcaucccacugggucuggcaucuccucaagacccaaggcagucuugggaaccccauaugggacccugucugucacugagccuagagccauagcauagccugaagacaagaaucacugccugaugaaccaggaaaaauauuuugcauugguccagagauacaucagggcccgccuggauuugcccucacucagugcccucaaagacuaccugacugggcuuccaggauucgugaagaucaguugagcacgugccuuagggaagagguucagaguggguugggaggcaagaaugaagacacaaucuccucucucaucuuaaucggugggaguacucaaaccccgucuccugcaugagaugaggcaaugugucccaucugaaaagugcagagaaccuauugucccuaccccaggcauaagaaggccucgaggaaggugccguuggucacaaaugccuuggcuucaugcucaggcccuguuccaucccagggauggcuguucuuagucucagggggcucaggguccuacucuaccccagggauggauguucauagggccuggggcucagggcacuacuccaccccagggauggcuguuuauagggccagggacucaugcacaaaccugcuaaccacagaccacuucuuucccacuuaagccaauggcagccccaccgcaggccugagcacaggcgccauugugggcauccucauugucaucuucguccugcuccugguggucauggacaucaccugcuacuuccugaacaaguguggccugcucaugugcaucgcuguuaaccuguguggcaaagcugggcccggagccaagggcaaagacauggaggagggcaaggcugcuuucucgugaguaaaaaacccguccugucagugcgguguaggcucugccccagcccagggccuggcucugugcuaucugagagugcucuagugaccucccugacuugaagcauggguuuaaggccagguggggugacagcuugaagagcagcgccuuuggcccacccuagguucuaaagccucauaaacauuugaagcuuucugaugaugucaaaaggugggacuugucagauuuaaacuuggagaggagcugugguggaaggaaccagccuuggagaaacacacuuaaccucucucuucauuuacugcucaagugcuucagcuacugaaggcaagaccccguauccuggcucuagggcaccaaagggagagaaacaaggcacaguguguauguucuucccaccagcagcaucuguuagcuaguuaguaggagauaucgaaguccgugggugaaggaggcuguuguagcaagcugagaaaggauggagugagaagauaaauugcauaacacccccacaugcaaguaacucuauagauagguagauagauagauagauagauagauagauagauagauagauagaugcauauauauacauauauauauauaugcauacauacacacagguuuguguauacacaguuacaaauacauuuuuaugcauacauauacaugugugcacauaaguuugcauuugagcaguuaagcacugugcuuaaaaccuuuucucauuuaguucucauaguuagucaagguauaugcuuacuuguccuaauguacaggugggaguacugagggaggggugaggugaggugaggugaggugaggugaggugaggugagguaacugucuuauguauagggacugcacugaugcagacacaaucauccagcccacucugauagccacaggcgaaaccccaaugcaccuccuuacagcuucuuucuucgaugacuuuccugggaagccauccugggaucuaaccaguggaacuuucuccacaggaaagaugagucaaaagaacccauuguggagguccgaacggaggaagaacggacuccaaaccaugauggggggaagcacacagagcccaacgagaccacgccgcugacagaacccgaguacguggaguaggagggauugucgccucaguagaaccccaacuccaccuuaucacccuaccccaaccuuccccacuucucacccucggcuccuggccaaagguggaagccagagcucuggagcccugggucagaagaccuucugaacccacucuccagagagagaagacguucuggcuucuccuuggauccuagugggugccuugccaggcccguugcauaagugggcuccccuggaguguuccaaaguuccacacauauucuaggaauggcuuaacuucauuuugagagaggacuagcccauuucauuuaggauuucuugaaaaaucuucaggaccuggguagguuccuuggucuucuuccacucagaaacuuuggagaucuucagggguucugaccagccauggcugauagccuuggaagaaauacgucucacaggaacaccaaucuauggcuggaagagaccuuggcacauaggagccauuuggagcacugguccucuucauucuggcucuccccaugccugccuaggauuguaagauagcuggaccugccccuagggggcuccagaaaccuagagaugauagacaucagcugccuucccuggaguggagauccagggcagcauaagagagcgcuagacagagcaguagggaacuggagcccuguacagagagcugaaggggugucagcauggaagaaggcuagcaggucccuuugagacugccacguucuuuguugucuccuguguccucuuccgcccgccuggggcauguacuuccucuuguccuuguuucuccgugggcccauguuccugcccguguaugguugcaugcccacccucccaccgcuccucuccucggcuccuaucuagcuucucugucaugucucagcuucauugucuauucucuuucuacuuccuguccuccccacaggcugccugccgacaccacagccacugucgaggacaugcugccuucugucaccaccgucaccacuaacucugacacuaucaccgaaaccuuugccacugcucagaacagcccuaccagugagaccacuacacugaccuccaguauugccccaccggccacaacugugccagacucaaauucugugcccgcuggucaggccaccccuuccaagggugucacugcuucauccucguccccagccucagcccccaaaguugcuccucugguugaccugagugauacuccaacuucagcucccucugcuagcaaucuguccuccacugucuuggcuaaccaaggagcuguacucaguccuagcaccccugccagugcgggagagaccuccaaggccccuccagccaguaaggccuccccugcucccacccccacuccagcuggggcagccagccccuuagcagcaguagccgccccugccacagaugccccccaggccaagcaggaagcccccagcaccaaagguccggacccagagcccacccagccuggcaccgugaagaacccaccugaggcagccacagccccugcuagcccgaagagcaaggcugcaaccacaaacccuucccagggcgaggacuuaaaaauggacgaagggaacuucaagaccccagauauugaccuugcaaaggauguuuuugcagcccugggcucuccugcucccgccacuggggccaguggacaagccucugagcuugcuccuuccacugcagacagcgcugugccucccgcaccagcaaagaccgaguacggccucucuuuguccacugucauuggguuguguccaguaguggugugugucugugcuguguuauguccuccguguucgauguguccucagccucuugcagggcuucugugauaccacugucagccagggccugggaugacgcaggaacaggggcaggcaaugggaugggcgauggcaggggcgaagcccggcucugcuccauaauuaggucauguuccuuagguuccauccuuaucauccuagccauccccccaccaggggaugucuuugcaguugggccauugaugagcagaguuugagaaggcacuucggaggccaaugugccuuuaucugccauccugggcccauaguuguguguguuauccagggccagccaagaccuccuaagaauggcaacaugguauucagaaagaaaugagcuagcuucuggugaggugcuugugcaaggaggauguagccacagacagcucuuucccacacgggcugcgagacucacucuuccccuacccaagacucucaggcacucaugugugucuccaaacucaaguucucauccuucaguuuucgguagugugaugcuaaccaaaugcguuggcacgaacagguagcugcacuugcucuaccacgucuuuaggcuugacucuguccugggagaccuguggagacagaggcacaccuggacuuuuacaaaaguuaauguggaugucccuuccagucucuuacagcaagcaggcccaugcuagccucuugccacccugguaacaguauucucucacccuacucaagccaccaaaaagaccccauccugaaacaguaugggaugaagccuuggggcaggcaaaagagaagugguuuaugguaggaaucccuggaacugguaccagaggcagagccuggggcaccucacugcguuacuaccacuugucacagugggagagaggaacucccagguuaacaugggcuggggaaaguuaagucuggaagaggagacgauuguucuuggcuaguucaucuccaccuagccaucugcaccuuggaauuaugguugcauuuaaagucacuauacccaggauuucuggggacaugccccaggugugagugguuuggagagcucucaggugauuucaauguucaugcaagguuagaugcugaagcugcaacugaggccuccuccaucccauguggcacggggagcagggggagggugguauuuucagagggggagggcaguauuuucagagcucuacuaaguggucuuagcaacacuguuucuguuucucugcagaaagggcccuguagaaacaaagucugagcccccggagucagaagccaagccagcgccaacugaagucaagacgguccccaacgaugccacacaaacaaaagagaaugagagcaaagcaugauggguaccaagcaacaagcaaagaucaaaaugaaaagugacacagcggcuucaccagagcauccccaaauaaucccccccccucucucucucucacauacacacacacacacacacacacacacacacacacacacgcacacacaaacacauuccucuagugucuuuugccuuuaaaaacaaaaccagauaaacaacacgggaaugccuuuuuguaggguucuagaaagggcuccugugucuuacacucacuuguuaagaaaaaaaagagacaaaaagguuaaacccacagccaaacuaggacacuccguucccugaaaccauuuaaaauucagacaaaagggccccagauuaagaaucuaggaagcucagaucgaaaaagaaagaaagaaagaaagaaagaaagaaagaaagaaagaaagaaagaaagaaagaaagaaagaaagaaagauagaucuaggcucggggaggcugcaauugguauuacccaauuggcacagaucaguuucagaaaaaaaugcuuccaagaacuuagacuaaggaaugaaccaagcccacaguuuauuuuuauacuuucagucaaguuggaacucugucgaaccucacaaauaaguuauacuuuccguucaguuuguguuuguuccauaugcggaguguggcacucuggcuagcugaguucaguucccacggggacuccuguuucuuaggaagcaugccaaaugccagcuuauuccaguucuuuugcuuuugauuuuuuuuccucuacucuuucuuuucuuucccuuucuucccuguuuaucaaguuugcuuuccaguguuuacaaguugacagacuacguuugacuuugguuguguuuaaugucccuguauaaaauagcucccccccccccccgcccccuguuuuuucuuuaagcaacagguaccccguagaggcagguagaauccucacagguugcuuuuagcaugggugaagguuacaaaagaugauuguuuacaguggcucuaucccccuaaccauccccugcccuaccccugaggauucugauucauuacaguuuuuaccugugucaaacuggggcgagagccccuccuucugaaaugauuuugccuuuuuuuuuuuuuuguuaauucuguuucuuagggggagaugggggauguuagaccacuuuuggauuagcugccaccugccugugucugugacacuggaccuacugcccaggugucugcgcacccuuccucugaaggacuccuuuggcuuuguugaaugaagcagagaagauuguauaguuggggcuggggcuggucuuggugaacacacuuuucuuuuuuuuucuuuuuucuuuuuuuuuuccuuuuuuuuuuuuuuuuuuuuuaccccagacaccuccuuuuuguagaaagccaaauaaaauauauacauaccacuuccuuuagagcccagaaucuagauuugaacggaagagcgcgugugcuucagggaaguagugucuccuuuuggaaaucuauggaaguaaagugacaucggccuucuguucaguuaggcaacauuuguaaaaaaaaaacaaauaucgucuggaguuauaauacaacucuccuggaucggaaaccaaguggggggaaaauacagaaacuuucaggggaugggaggggggagaagggaaaagccagcccuuuguauagaaauuuugcuuuuguuuuuucauucugcuuuagaacgcaagcuugugcacuguggaugcgugaauauuuuagugugaaacguguuuuugucauaguauugaaauaaaacuucaacauaguuugguuguggaagguauagcagauaguucagaaaagaaaaaaaaaaacacaaacaacuauucaggaaacaaaacaaaacaaacaaaucccaaaaggaaaaaaaaggaaucaaggccuuuuaauaggcaauaaaacagagugacacugaugaagaggacgcuaagccaacagacgucccccgacagcacguguuccuuucccaaguacaaagugacaagagguuaggguggccagacgcacccguguucacucugugggccacaucccccaggguucugacacuucugcagugugaccaguggugaugcuagguuauaauuucaaacugugaaaaauaauggucucguccuuuacucagugugggguuauuuugcauuuucucagcucccggggaugggaauggaggaucccagaacacucagcccagcccagccccuuucauuccagggccugcacagauccacaguucacguacacggguccucaggaagagcuaucggguagacaacucugagggcacuuagcagaaugggagagcuggguagcacccgagccagguccuugcggugaggggcagacuccuugggccacagccuguuccggggaaucgcuuucccauauggugaagucggcggcuggaccggcucugccgagggcacacuguaccuccuggaaaugguguacuccacuguuugugguuggauacauugagcucaacucugaugauaagaagagacagagguauggccaacuccaaaauaauguggcccagaguagcugacgcucagaacacuggccacacauuugcuggaagccaagaccgcccacacuuugauaugccucucucuuuauacauauguuugucucgccaugcauggguuuuccuuucuuccuuuuucuguuucuuuuuauuuuuaaacagcaguagucucucugauaucaaagagggagacaguguaucccccccuauucuuuuaugugaagaaauaaguauuuaguuuucuguaggguuuuuugguuuugggggggggguuguuuguuuguuuguuguuuuaguuuuuggaaggagggauggacuccaccagugucagugucggugugucuuaugucuauguggcauacauuguaucacauaaagaccagcauggccaaguuccgugggaagguuacccaggugccaccaguggggucucccaguccugaagggccaagguguauccaacaggauucuauguccucauuuucuauggaaccucccaugucccagggucucacccucagcuguccgucuggaugguggugaucacaccuccauuaacauccuuacccagcauucuguacuucgggggccuucucucuuguuauaaaaacuuuuuacugagugaaacaucaacaccaccuuuguuuccauucucacugcuguaaauacugaguacuaacugagaauuuugacuuugcauucugucagaauacuuguguucaauaaaaguugaaagaaaaaaaaaagcaacucuag

SEQ ID NO: 5086 - RNA, 2481 nt, Mus musculus
agagucucuucuccuucucuucuugaccuugcccagagcagccacagcuuccauggcuuuauacaugaucuccucaucucccaggaacugcaugggguugaugggcuucaaguacuuguccaguucaucgacaaugggaaugcccaccaguggggucuuuuaagagccucccagaugugaggugaugccccaaggggugcugcaaugguggcaaucaagaccuguuuuccuccauuuaucugggggacaguuucuucauuccagaagggcagugcucuggcaguaguguccuuuaggcucucacuggagaguaacagguccucagaaaggucugcauaccugcgacuauugcugaugucacugagaagggaugaccaggcuccauuggugguggugggacagcguaagauugccuccugaucuuuagcugcuccucaucauucuuagcagaaguuuuugcuuuauugagacuaguuagaccccauaauaucucucucugaggcaucaaguucugaccacugacagucacaucuggucauuuggcauccagaacuguccugaggguccgauugcucucuucugcaccaaggugaaggccucauaccagccacuaaagugguucuccagguucugggcacugucccugugucaaaucaucccuaccaugugccauaucaauagacaaaggaugugguagccacugaggauagcugagauuccucuuucuuuuagauggggguugaggaaggcauucuaucuuuccagagcuucaaccugcuacuuucccaugucucagcuguaaacuccacauuuauaaugauugucaucuuuauugugagcucacugcugaggacaaaccauuucagacucucuugccuuuuuucuugcagauucccaggguucagcuugccuuuuugucaguauuaagacucucagguuuuucuuucucugaggagaggauacuuuuuaggucucucauaacuguuuugugauuaucuuaauuugcaggcaaggggaacaaggccgagguuuuaccuugggugaucuccaaagacauccuuuccuguagguguuccccuuggggaaaggcaggcacgaagaugcacaaaggcuuuuccacuguuggagguuuaaauaagggugucccccgaggggcauugauagucaguuugauuggccugagaaacaacuaccagauuaguaaagcacagaaugggcuagaucaugaagauucugaaccaaucaaugcauuaaacccuugaugaauucauaauaugagauuauggggaaacggugagagguaggaaguaggccguguucugggaagcugaucacugugaggagaguuuuaggguauguguguuuguauguguggugugugugucuguguguguguguguggugugugucugagugugugguaugugugucuguguguguuugugugugcgugugugguaugugucugagugugugguuugugugucugugucaucucuauuccugugcuuccuggacaccacauugugacugcuguucucugcugcagucuccucacccaagcagacugacauuucugaaauggugagccuauagaagcccuccucuccucagguuaugucagcugucccaucgugggcacaugaaacucagguaguucaagcacuuggggucaaauaaauucugcucagccccuuucacccagcccaagcaugcuuugguuuaucgagcauccucagaaguaaacuggaacuggaauuugugcaagggaccugacaaaaaaccuugggugcuguucguucucagauugcuugacucauccuggugguaccccagccccugccaagcaagggcuguauauuuuaugcuccuccucugacguccugugaucucuugccucagguugauuacaaaccugaucccagccuagaacagaaaauggcugcugggagauggaugccuuuucuaugucuuccuuccguucacacacggguacaaaaaagaaggcgucuuuucuuuuuguaauugcuuauguuacaggguguucaacucagauaagccauuugaguggaccaaggagaauagaaauuggcuggggaugauagacauuaguaccuggugucauuuuccagcauccucugauugucccuuggaggaggaugugucuuucgggcuccuuauugccucccuguuucucaaguacacacuuaccuuucacuuuaagagacacugaaaucaccagcuaauagaaagaaagaagccggauaauaaaaucaucaaacaagguaaaaaagacuuggguaauuucuugcaaguucucauuuguucuauacagaaacauaauggaucgacucagcuguugcuguuucuuuuagggcuaggucccuuuuguggggaccucuuguccuuuccuuuccuaggucaggaucucccgcccaccuccgccuccaccccucacucucagagcucuggaaauccaug

SEQ ID NO: 5087 - RNA, 7114 nt, Mus musculus
cgaguuugcacugcgcagccgcgggggcgggacuggccucggucccggaagccggaaccgcuagcuugugagucuucgguccgaagaccaugagcgcggcgggugaccuucgucgccgcgcgcgacugucgcgccucguguccuucagcgcgagccaccggcugcacagguggggugugcccacgugugucaccgcacgcgcgggucuugucccgcuaugucccuggggggcguggccacgcgcguggguuagagccgagcuggggcgggccgaagaggaaauggugaaggugcggagcugcacuaccggcacucacccgggagagggcgguauagcuccgaucccggaggauccacucuggagaguuucccuccagagguugcccacauccagagguacaaugacaggagcaugggcuaccgggugcaacccaagguaguuuucaucccccuuuuaccaaaaaaguaaaaccagccuugauacuuuccaaaggagcaacacagucgggaauugaaucccagagaaacaagaccgcaccugagaguugguuucaaagggagcuucguuacucacuugaagguuugcucuuuggaucugcaugucaucaucagagaacggccuuuucuaacaacaggguugucauagggaacagcugacacuugucaucccucuacccccaccccuccguguggucaaguuggguacagugagaauuuucuucaaaagucuugugagcuguacugcucuaagugcgcaguaggagagagugaaggggauaagaaagaguuuaaagaauuuaaauaaaaaguuguguuugugugugcuugugugcugugugcacagcuugcacgaaagagucuguggaagccaaaagaggauuccuugaaacuggaguuacaggcuucugagcugucacgugggugggcugggaccugaacccuggucuucugcaguagcaguaagcacucuuaacugcuaagccauccuuccggccucucaaaagggauuuuuauaauaggaagcuuacacacaagguuaguaaggaugcacagauaaguugacugauacagauucauuaagcuaauuguuuucugucuggaaugacagccauguguaguaaguuuaaaguuucaccugacuugaguguccuggaacacauugguaagguuuccacuaggcaacugcugaggcagaggagggcaagauugugaaaagaagagccugaggucauuauuugucaggaggaaugacguuuuuaagccgcuggaggauauguaugucuucgugcuuaucacugcuccuugcuucaucucuuaucccauagcuaauacucagggcuuguugaauuggaagguggagccgggauguagcacaguagguagagugcuugacuacacagugccugcuuacauagaucucaggacuugggagguggaggcaagagggucagaaguuggaagucgugcuaaguuaccuagugaguuugaggccagccagggauagaggagaccucgacagagagagggcaggagagacagugcugacuaugggcagaguuguugacaucuuacuguggacuaaguggguugagaugaaggucuuggaugauuuaugugguaaucuaguuuaauuagagaguggaguguugguucuugauagaaacggggaucaugauaugcaagcgaucuaaccaguugaucaucuacagugacaugaaauuguagaguuuucuggacgucugaacuucgggcugaccucuaucuuucuccugucagcccaucucugagcgaugaagagaacuuaagaguguuugggaaaugcaacaauccgaauggccacgggcacaacuauaaaggugagggaggggcacauucccuccuagccuguugggaagaaggacgagggggcugggagccagacgcuuccgggacagggucagggcucugagcccuucaguggaaauucaagacagagucauugucuugguuggauggguguucugguuuaccucacaauugucuaccauguuaaagacaguagaaaacaacaacaaaaugaguuaaagcauuuucuuugacauucaaaugcauaauaaaacugccauucgcuguuuccuuuuaauuauguugggcuaaaacuaauguuaaaauuugauuauagugaauguuugaggacacagguauguuuaaccugauuuaaacaugauaccauguauauaugaauugaaacaucaaauagugccccuuuauauguagacuuuuuauauuuuauguauuagcuaaaauguaaaacuucauaguaaaauaaaaagcaauuauuuugaguaaauacuggcuaaugaaacguaaauuacuuagggugcauucuauugcagaaaagggggcuuucuaaaaaugauuuauugauuuauuuuauguaugugaguacauuguagcuguacagaugguugugagccuucaugugguuguugggaauugaacuuuuaggacccucugcucauucaggucaacccugcucgcucuggucagcccugcucgcucagucccugcauacucugguccaaagauuuauuuauuauuauacauaaguacacuguagcugacuucagaugcaccagaagagggggucagaucuccuuacaagugguuaugagccaccaugugguugcugggauuugaacucaggaccuuugggagagcagucagugcucuuacccgcugagccaucucaucggcccccaggaguuuguauauaaaacuuuucugguaguauccuaagaaagugauuugugggaggagaagggacaugauucucagaacaggccuccuaagcccuggaguggagugguguauggugagacaggguuacagaaggcuuggagagaucagaguuugugguuuagcuccugacucucauuuccuguuaccucuuagccucagugugcuuacucacaaugaaauacccagugguguguguguggaagggaaaaaguccaaacuuauaaaggugcugaccaguuuucaagcacaucaggugacuacccgcuguuuuaugagcugacagugaacgacgacugguuuugccugcagaggaggugggucaguuugcuacauagcuggaugcgcaugcgcauuucccacuuuacaggcagagacugagcggcaucucccuccucccagugauggcagccuuauaagcaggaaagcuucacuccuuuuuggauuugcuaauuuucucugcucagccaaagcuuccuccaagcuccucugucagagcugagucuucauugaccgauaaaaagaucuuaaugaaaagaauaccuauuuggagaaaaguugaaguauagccuuggggaccguagaucuauguuucugucgcuaacuugcgcuaaucuguugaaagucauguuuuguugguauuuuuuguuuucuuucucacaguuguggugacaguccauggagagguacgugcuggaaaggggcugugaauuuguucagaucguggggccaccuuccagacacuggugaagucuguguugaaagcuuguguuucaguugcuucauggcuguguggugagcugccgccuugccaagccuggcuguuaugugugcauggggagaagagccauccaguggaaaggguguugccgggacauggcauuucuguacccagaauaagaagugucucuagggugagggaauguggucagucugcauguuguacagccuuuacuaacucgugaaguuuauuuuacauuuagacagggucucauguucaaggcugcccuugaacuuccuguguugccaagaaaggcuuugaccuccagauccuccugauucuguuucacaagugacgggauugcaggcaugagccauuccccagcuuugugaaagcguucauauggagagccugcuacaauggucuucacccucauuucuuccuuagauugauccuguuacaggaaugguuaugaauuugaccgaccucaaagaauacauggagguaaugccguguugggugcuucaugagugcuauccccuuaacaccccauuaaguacccugcucaccugucuccugagaugacgcgauuuuauggguuggaguaggugggggagugacaggauguuuguaguuggaguugugcugcaauaaugggaagagacguugcaugcgcauuuccuaguugcauuggaaaccaccucauuuuucuacacauuacauuuuacccccuucacaacaaaacuuuuucauuaaagcuuuugcucauucucugaauguuguacuauuaauaaaauuuuuuuaaaaauaccacauuuuccuuuaaaaguuauuuuuguaauuauguaagucaguuuauuaaagcuuaaguauuggaauacagagaagaaugaaggagucauggccccauaaauauaccaguccaggugaccguauuggcugggagccuugggucucugggagcuggaguuacaggugguuauaggccaucccaugugggugcugggaaccccaauuggguccucugaaagugcaucgagugcuuucuagcugcuuaaucucagcccaucucugcagccccaacgcuacacuuauuuaacaacuguggcucuaugccaaguaacugagacaaucgugauagugauaacacaucaggaucuagucauuaggaaguuucucuguuccauggauuaaaauugagggaugcuggauaguuagcuccauugcccaaggccauguggucuuucuuguucacaacguugggaauuuuucuuuuucuaguucuuucaauuacccccccccccauuugaacuuacuuguuuaguucuucacuucaguuuacuucuauucucaagguugacagauguuuuguuaaaaauguuacuaauaauuacuuucucauauucauauauucaacaaauuuguuucuuugcauucuuuuaaaaagcuaauuauuuaaaaauaaaaagcuaauuauuggaaauacaaagaugaaugaauaacacauagcucauagaauauauucacuauguuuucuaggagguaaauaauaguaagugauaaaacauuauugaauaaacaaauaagggaauuagugaauagugcagugcuuauuaauuuagagaacuucuaaagacagaggcuuuguauucacagaggcacagaauauaugcaugcaauacuguccaccgcgagacagcagugagaugccucagcaaucaaaggauugaauacuuaggaagcuuuugagauuuucuuccuccuuugggagccuaaauuauuacauagucccaucaguaaagguggcuucuugugaccauagaaugaaguuagaaagaguccuuuagaaacuuugauagagaaguuggggccagaacaaggauccaagauagaacaaagauauuuauuuucuuggcauucauaucucuauuugauuuauuuuuaaaaauuacuucagguguugauuuuuggccuauucuuuuuauaugguuccaguuuuacugaagaaaaucaguuauuaguguaucuugaaaucaggccagguagaaaauuaguuuguuuugaaaugguuaaauuuuuguacaagagcuaaugguaaaaauuuagaauaagauaauuauaaucuuuguuaauaacaaaaaguaacauuauguuaguauauauaaacauuaggaagucauaauuuucauguuuauuuuuucuucuaagacagaagauccuuaaauuauucuucagggcagaaauguagaugacugucauuccagaccaggucuuaaaguaggugacacugugcuguggaaggggguuuguaguaccauuguagacagaauucaagaagcgccagacugaacugugacucgugauggcuguguuucuagaaagcuccaggaacucucuguuuuugugguuucuuccuucugcauucaggggcaaggauacauagucaugacagggaacuaggucugaccuuguuucacaaccuuguaaggcugcuuuguacagccuggaaggaccgcuucccagagucgagucuuggcuuaaugagagggggaggcucagagacucaagaagccuuuggaguuugagugcaaaugaggucaguggccuucucucuccuccacgugcaggaggccaucaugaagccucuugaucacaagaaccuggaccuggaugugccguacuuugcggaugcugugaggugggugucacugucuggccucgggccgcagaaaugaagcacauuagcauugugauugucaugugauuguaauuucuaaaauauugcugucgugguagauuuuguuacuggaauucauguuuuaucuauguauuaaaccugaaauuguguucauuauuuguauuuugagcuucuuucauucuuuuucuucagcacgacagaaaauguagcugucuacaucugggaaagccuccagaaacuucuuccagugggagcucuuuauaaaguaaaaguguuugaaaccgacaacaacaucguagucuauaaaggagaauaggucuuaggguugcuauuguagacaggcacauuucuuuucacacuugaaaaaggcuuuguccuuccagaguucgcagcagucaccacaugcuugugucuccauguucuguucuagaguacccgagcauuaaaguaauguaaggccuguauuuagauguauuuacgaaucaaacuuucaguguauccugcaugugguuuuggugagaagguagagaaggauugaggauugacaccagggccucacacgggaagcauagacucuucugaagugcauuccaguccucucaaggcuauuuagagggucuuuuaucuagagguuuaaaauuauuucaucuugggcuggagagauggcucagccguuaaguacacugacuguucuuccagagguccugaguucaauucccagaaaccacaugauggcucacaaccaucuauaaagggaucugaugcccucuucuggcauguaguuguacaugcagacaaagcauuccuacauuaaaaaaaauacauaaauaaaauuuaaaaauaauuucauuugagcaaaauguuuugauguggaauuaugcaaagguaaaauaaacccauuuuuguuaucuaccucg

SEQ ID NO: 5088 - RNA, 10332 nt, Mus musculus
uguuugugacaagaauuuuaaugugagccagguaugauguacauagcuguaaucucagcacugaggagauagucaggugguuugcuuaaguacacagcuagccuguuguguguugcaaaaaugcagaaaacaaaaagcuggagagguggcugcuuuuccacagggucuggaguuugguucucagcuccugcauggagcucacaaccaucuguaauucuguuuccagggaauuguugacucucuucuggccucugugggcacugcaugcacaugguacacagacaaaauaagauaagacaaaaguuaaaaacaaaacagaguaagugggaagauagcacagguaaaaacauuugcuacugcaagccugguaacccaaguuugaucuccagaaccgagugagaagccaggugcaaugaugcaaguauguaaucucaguacucguacagcaugguugggguagacacagaggagcuggccagaagcucaagggccagcuagucuggaguauguaguauaauaacaggaaacucaguaagguagaaaucaagaacuaacaugaaagcugcuucugacccaccacaugugugccauggcaugaauguuucuccaucucccucccuuucuuucccucucuugcuugcucucucacugucauacacacacaaaauaaguaaauaaaaaugcauaccuaucuaucaucuacuuaucugucuuuucuuaauauaaaaagagauuaugccuagggaauuuacagacuuguccuacugagcuauggcauaggcaucuaaucucagccauccaggagggugaggccaggcuggaggaccacaaguugaaggccugccuaaguaauuuagauuuuagucucaaaacaauaacaccacaaaauaaaaauucuaccaccaccaaaacacaauaaaaacuaaacaaaaaccaacaggcagggauuuggaagggguaccaggccagcgguagaguguguacugcacugagaagaaaaaccuaagcaaaccuguuucuagccuggagguggagaugcacaccuuugaucccggcaggaggcagaggcagucagaucucugaguucuaggccagggguuguaaagaaacccaguugccaaacaaaacaaaaaaacaggacaacaacaacaaaacccaaagcaaaaagaaaaccugucuaauuguuuuaagaauauugguaaggucucugagguuuugcaguuucuuuguaaacuauucuaauggugccugcuuugcuuuccuguaagaucacuuacuguugugauuaagaucuuaguguagcucagaacaauguaggguuauuuucugguugcaguaggacuguaaaacuaauaaggcgaucagugugucucugcagggcucaaaacccguuacugcagaauuguagauuuacugcauuggacugguuagucuguuguuuuuucuuuuuccauugagacaggguuucucuguguagaccaggcuggccucgaacucagaaaucugccugccucugccucccaagugcugggauuaaaggugugcgccaccacuguccagacagauuuuaaacucuguagagaaacuagaaguuacuuuccagaucauauccuagucuguacccuaauaguuagggcagauuguacuuucaguuaguuuguguucuguaaugcaaagagcuguuuuagugguuggguuuuguuucuuuuuuuaaacgucuagauucaggaggagucugacauguggaaaaucagagaacuagagaagcagauggaggaugcuuaccaggggaccagaaggaacacagugcccagcagcucaaggugaaguaugcuucugagagccaaaauaacucucaucuucuuagaauuacuaacuuuagcuuuaaaacagucuguuaaggguagaugcauucaguucagcaaaucaguaagccuuccuuguuaacuaaauuuagggccaagcauaacaguggcagcuguguuagcgugacuagccguucuaguccucgguggggaauugcauuuuaaauuuuauagauuccaacuuugucuaauagcuuguaacuuaagauuuucuauuggagaaucuuuuguucuuucuuccuccuuucucucucccucucccuuucccuuucucccuccccccauccuuuccuuucaucuuauaagaauuguauuugcugagcauggugugucaugucuuuggucccagcacucaggcagaggcggauagaucucuugagucagagaccagccugaccuacauagugguuuccaggccagccaagacugcaaagagagacccugucucaaaaaacaaaaacaaaauuaauuucuuuuauuuacuguguuggcaauauuuuguaugaugugugaauguauaugggugugccagugcacacuugaaagucagagcauaacuuucagggauuuguucucuuaacaacuguagguucugggaguggaacucaagucaucaggcuugccaggcaagcacauuuaccucuagccaucccuggagucuuaucauuaauucagucagucauacuguuuuuccuuuagucuauuacacuuuuaaaaauuuauuuuauucauguaaguaugcuauaugucuguugguggucagcaggggacagaagaaggcauuggaugcugucuuagucaggguuucuauuccuggacaaaacaucaugaccaagaagcaaguuggggaggaaaggauuuauucagcuuacauuuccacauugcuguucaucacugaaagaagucaggacuggaacuuaagcaggucagggagcaggagcugaugcagaggccauggagggauguucuuuacuggcuugcuuccccuggcuugcucagccugcuuucuuauagaaccaagacuaccagcccagagaugguaccaccuacaaggggaccuccccacuugaucacuaauugagaaaaugccguacaguuggaucucguggaggcauuuccccaacugaagcuccuuucucugugauaacuccagccugugucaaguugacacaaaacuagccaguacagaugcccugaaguuguaagcugccugacuuaacaugggugcugggauuugaacugacaucucccagaagagcaauaaaugcuccuaaccauuaagccauagcuccauccccaugcaucuuuuuaaaagccacacuaucuuugccagguucaugggcuuuuauauuuccuugguaauaguuugagugugaauauaaaggauuuugcagccuugacucuggaagguguaggguauauuaugaguaauuaggaauaucucuagggcuucauaggcuuuuuuuuuuuuuuuuuuuuuucuuuugagacaggguuucuuuguguagcccuguccuggaacucacucuguagaauccgccugccucugcuucucaagugcugggauuaaaggugugcaccaccacugccugguucagugcuuuuuaaggauaagagauuagguacaugagauagguuagaauccagauuucuaaagaagaaaucuaaaguuagggaacuauuagaagaaaagaauuacaagugagcgugcuuguggaguauguggacucuggugcaguacaaagcugagugugacuggugucgcaguguuacauggugcaaagguagagucucagcauguuccauguauucuguucuugcugcuccauaaagugauaucacagguugcuuauaaaucuaaaaguuugucuguuuucauuuauagucggaugagaagugaugguuuugaugaagaaagucagagagauuacuggaggucaaagaaugaaauuucuggggccuuggaagaugauuuucuuaagacuaaguccuggaacaagaaguuauaugauuaugaauccaauauaccagacagguuugugacuacaugcuugugaccccuaaugguguuuggcuuuagaauauguguuuguugaaauuaauuuuccuagggcuggagagauagcucagugguuaagagcacuuguugcucuuguaggggacccauguuugguuccuagcacauacgaggcagcuuacaacugcccauaacuccaguucaggggaucugacacccucugcugacuucugugggcaucuggcauacauguguaggcaggcaaacacucauacacaaaaauaaaaguaaaucuucaaaacagauuguucccauaaaagcuuauaaguggauguacacagcaguauuuacaauggcuaagaaauggcuaccgccauuuggaugauuguguuaaacaaaauguagguuuuccuuacaguggacuaauacuugugguaaaagggauaaguacuaauuauucgugcuuaaccucaagaaugugacaaauguuaaaggaagucugaugcaaaggcagcauguucuuuguauuauguaguauguccagaauggaaaauccagagagacagaaauacucaggcuucuucugggcuacagguucugcaccuggcaugcaaaacacuuuagaguguuccagaguagauagcguguuauaaaguaguuuggggagagaacuucacugcuaaagaaaagagauauuaauucuuuagugucugguaaagaacaguauuuccugugucugauaugauaguaguauagaaaguagagcuauuacugagcuauugugugguuuuacugugucccuuuuuucucucuguuuguguauacaguauucauguaauccaaaaacaauaugcauuguuucauaaaauacauguauuauguuaacuuacagauggggucacagugguuauaaagaguuguauccugaagaguuugaaacagacagguagguaaaugcacuuacuggaacaaaaccaaacaccucagaugacaaaauugugccaucaguaguguuccuaacauuuucaaaguauuaguuugucauugaaaauaacuagaaccuggaaugguagugcaugguuauagucccaguuauucaggagccugaggcaggauuucuagaguucaggaguuugagucuagcuugggacauaaugucuugucuccaaaacaaaggaaacaagcagaacuuaguuguaaggcaaugcugaugugacuuuccagacuuguucuguaagccuaaggguuuaaaaaacgauugugcaccaucgucugcaguaaacguguuccaagaugccccagaccuuagauauuuuauaaucuauuuuacagccugucuuccuauguuccauauuguuuuuuuaaauuauuuuuauuaauauaguaccuauuaaaaccuuugcucuguaaggaaguauccuguuucuuuuagccauauauaaauugugagaaucaugauugugcuuuggggucauuguuaaauaaaacaagcuauaucaaacaauggaucugauaacccagauggcuguaaaugacccaagaugguuagaaguagacacagggaugauucagauccuaggugggacacaguggaauagugaggauuuucaucuucuuauucaaaaugauaugcaauuaaaaucuuaccaauuauuucuggcauugacccugguuggcaggaaucugcgaaaaugaaaccaugaguaagggagccgugguguuugguauuucauauguaacucaagccugccaggucagggauuugcuuuuugacaggauuucaagauggccuugaacuccugccucuccugccucuaucuaccaaauauugggauuauagauauauaccaguaugcuuagcccaaguucggguuuuaaagaugaggaaauaaaaccuuuguaguagaugagucacacaguaacuaucagagcucucauuugcuggguauguauguauguauguauguauguauguagacggugucuuuuuguaguccuggggguguagaacuuguuauguugaggaagcuguccuuaacuuaggagguuuucuugcuuuugcuuuuuuuuguuuguuuguuuguuuguuuuguuuuuuguuuucaagacaggguuucucuauauagcccuggcuguccuggaacucacuuuuguagaccaggcuggccucugccucccaacugcugggacuaaaggcgugugccaccacacucggcuugcuucugcuuucuaagugcugggauuauaguuguguaccaccauacccaacucaaagucugacuuacaguucagauguuaauaauuuacccagagugcagaauaugaaauagaaauguacuuuuucuuuccuccguaaaaguuuugccuuuucuuuuuauuaguagugaucagcaagacauuaccaauggaaaaaaaccaucuccccagguaaaaucaucugcccgugaaucucgaaaacauaagaagucaaagaaaucccauaagaagaagcagaaaaaacggucacacaaaaaacagaagaaaaacaaaaaggaaguuacggacauaacagcagauuccucaagugaguucucagaggaaacucgagcuucuaguacuaggaaaaggaagcaaccacacaagagcaagaaaaaguccaggaaaaagucuccuaaaaucacuuucccuuuagggggagaaagugguacuucucagucagaggauucugcaucuagcaguucugaggacaucgaggaaagagauacuaagaaaaccaaacggaaaaagaaagagaagaguguccauguccccaugccugacccugagguacaggagaggacaagcaagcgcaggaacuggaagguggcuaccgacgccaggucugcugagagcucggaggaugacuaagugggagagcagcaguccugcuucccacugacucguuagggggguugccagugacuccugcagcacaggcaggcgucugaggucagaguuguccugccccagauaccuuuuuuccuauuuuggcuuguuaaucuccauccucuuuuguuaauagggaaucugguauuuuauuaagguuucuugaaaaaauuauuuuuuucaauuaaucacuuaggguagaauaccuauacagcaaauuaaagaacccagaaagcugaacucaguaaugaccugggcacaccaauugcaauguuggauuugauggaaucaagaguccaggauggaggaggaagacugaaguagugcuaaauagaaugguuugacaaggagaccgugcuauucauacaggaggcaugcugccuucagcuuuggugcuuugguucuucugcaguugggcccuauaggcauccaguuuacugagcgaggaaauaguuaaaagaacaaaccuuuucccuucaugguaaucucuacagaugacugcuaaggaaccuaggguuuucagccuaaucucccugcuggccagggucuacagcuacauuuagcauaacccaaacauaacaguaacuggauaguaaauguuuuucuaguuccauugcuguauacugccuaaaugggcuuguauuugaaauuguuugguuguccuaucuaucaaauggaaagaauuaggaaguaguuauguugccaugaugcuuucaaagagauucagggcaucagccaucuaaaugucuguuuuuuaaaaaaauuuuauuauuauuauuauuauuauuauuauuuuugcugaguuggggauugaaccgaaggccuugcauauacuaggcaagugcucuaccauugagccauacccccaguccuguuguuuuccuuguucauuucuaauucuauuaauggauuuuagauuuucccugaaaccaguugaaucaauuccaaaaugaaacacacuucucagggacauacccacuucccagucugacuuuguguuuugauuaucaagaacauauuauuucccccugcuauauacugugauccugauauuaaaagaaaccaaaauaccacuggaaaguggcugguagaacaguuggcuuuucauuaagaggaaagauaaagugacauuuaucaggguuuuuguuuuugagguugucacuuugguacugagcgaaugcaugaaaacucaagacugugggccaugguucugccacuaauugauugaguucuagagcagguuaaccucccuggccuuacucuuugcauguguaauacaaagauacuucaugguuagcaugacauacaccagcaauagaauaugauaaugcugacaucccaugaaguggcauuuuauaguaauaacuaaauuugugcucuuuauggaacauauuucuaauaaaaugcuuguucuuaaaauauaugguuggccagaugugcccuaucccuugauuaugagcaggugccgccuuuugggguacugaaacacuaaugauuuuaguacucaaaugccaauauuccaugagccuuuugggguacugaaacacuaaugauuuuaguacucaaaugccaauauuccaugauauauucuuuuccuugggucuaguggagggagagucuaguuacuaccucauaaccuucuagaagcaagugauaucuuuguuggaaguaguuuugggcaugcauucuuaaugcaguuuugugcuacaaauguacugauucuaagcacagacucgggaagauuguccugcagaauaaggcacuuccaaguuugaguuuugaccuuaccuuccucccauacaacagacauaucuuuucuccagggaaagcacauuuugccugauuuaacaccccugccccaccaccccgcacuguucuaucuuuucuuggucacauaagcaauaaaauuguuucuguucuaauccaugccuuaggcuaaggcuuugaugguuccucuaauccccuuaacagugguuuaggacuacuuuugaaaaccugucucucccauuuccacgaucagcucuggaacauguauuaguguuccugagagaugauuauguugaauccuaaauugggauuuagaagaacaagaauuggagacuucacauuuauuaacuggugugauacaaguuggaauuacugaauucccauaaauaaaauuucacuuuugaacauuugcucuguuacuuuuuaacaccaacagacuuuguaacugccugacgcuaaccugacagguuggcaggucuuucaccacuggccauucaaucugcuugguaacaagucuuuuggucuucugucauucuaagguauggccuacugcccuccuuucuguacgaucugggcaaaccgaccggugauggcaagaguagugucaaugaagcgauccacacagcuagagaggcaguuuucagugcgggagucuagccgacuuccuggcuucuccacacacuuaucccaacauaguuccaugaagugaugcaccuaagggcagagaaaaaccuuuuuuagucauuaggguaugagauaucuuaguucaucauucugugauauuuaauagcauauuguaggaucacuucaggacuacucuuucuuuacuuugucaccaguaacagccccagaucaguaaauucucauuagaacucauucuuuugcagagagaugauggggcaggucuuuaaucccagcacuugggagucagaggcagguggaucucagaguuaaggccagccuggucuacagagggaguugcaagacagccaggcuaacagagaaacccugucuucaaaccaacgauucauacuuucacaauucucaaagcaacuagcaguacuauuaaaucagaggaagucaggacauuaaccugucgguucuugauagcuaucaguacuuccaagguuaucuugauugaacgguuaaaacccuaguaggaaauacgcugucccacaccaaaugagucaacacugauagcugcagggcucaucuuucucuaauaaugaucaccauuuacaaauacaucaucacauuauccaaugcagaggcagcgggcaacaacgaacccagaucucauggugaggacgggugucuugucuccaggcaccugugcuccaaggucggaacccagagauuccgagugccauucccgaccagcgaccagcuaauaaccgcaugcuccuguggcccaaaccuuuccgcuguuuucgaacccuuuccucccacgcagcgcuugccucccgggcacugagcacuguagaucacuggggcgggaggcgcagcccggaucgaguggggccgcugugccgcaguguccagagcuccgugagugcccgggaucugcgccucacccuccuuccccuguuccuuccucauccucguaccugcgcagugaauugcgccuucugcuguucggcggccaccaggcguuguaacuccgcuucguccgcuucaccaagcucggccauugucggagucaggcgcuucgcuggggugcgcacgcgcgguggcagcgcaccgucuccugccuuccgguucacgcuucagguugccuca

SEQ ID NO: 5089 - RNA, 12536 nt, Mus musculus
uauauccaguuccgguucucuucuccggguccggacuggcuccuccgcaggccgucccgcuugucucucgggagagcgccgccuuccuuccugcacccgucagcuuccacggcgaccggcgagcccgcucugugggagucuccggugggagggaagcguuucuccggagcacgacuuccggcccggaaggaagccgccaccuuuucucccaccccgccacgcgaggcugcggcgcacgguauggguguguguguguguguguguuugugucgggagggcguugcgagggaaggccgccgagagcgccggggcugcggcggggcagggagcccgcugacagacaugggggcgcuuucccccacguccccuuggaaaccucaagcuccccccgaggcacucuagauacuuccuggggcccaacggaaggccgugcccaagcccuguguccccauucugucccgggagugaaagcgagccgccgggcgccggcccagcccagcgagagcggggaaugccccgguccgcccgcccgcaggccgcuuuccgcgccugcgccuccucuggccuggguccccgagagcgagccgccgggcgggcucggcugggggaaggcagccguagccugggccucgggugaggagggcacaguaaccggugggaaggcugcguuuucacgaaggacucgggugaagcugcagagcugccuuucagcccugacuccuuggcuuccugggucggaggagaucuuguaauggagugguucuucgucucacacuaacaggaugccugauuuccucaggaucgaggggugagugagcaucgggacaguggcaccaagccccugcuagcuacacaugugaauaucguugucuucuggguuuuggaaaguuccguacaguguaggaaacaaaauguccugaguagagauauuuaggucaucuaaaaacuuuuuuacaauucaguuuauuuuuuuacuguugacauacgugguguuugaugccuucaaaucuucguguuuauaucuuugcaagcgaauuuuggggaguuuugagauuugauuucuagccgggacacuaacacacccguugccugaguccaugcagccugggggcagguuacggcuuuaaggaauuugauuuugaggaguugggguagaguccaaacucggggauccccauagguuaaaaggccaaccgaaaaugucuggggaaucauauuguaucuguaucgaucacguacagaccuuucccacuuuggucauuauuuuaaucuccaucguaacauuuacauaacauuugcauaguuuuaaguauuauaauuaaucuaaauacccucacucauccuaacuggaagagcaugucuguuggcaggugguggcaguaagaagaugaguuaagggcuggccgaggccacuuaagaaccugacuaaaaaaacaguccuauuuuaaaauacacaggagcauaguuucuauacaaauauuauacuagucuaaaagaggaaugagcgcccuaggauugcuuugugugugcauggaugucaccgagggacuuuauccaggguagcucuuaggcuaggcaaaugcuuuaccaggccauacuuggauuuaguaccuuuaggguccuggaacugauccgucauggaucuugacuacuugacagagaaucgugaagacugaauaacauggugcucauggaaaacaaauuuugagcagcuuugugcaauuuuaaagacuaauguacaucaucccuucauccuuacaugcaccauaguuggguaucauaauggugaaaggaaaauuuucccuucgauuuucuaaguucagugauuuuuuuuucuuucuucacuucuuuguuucuuuauaauuuacuaaaaauaaauuuauugcauauuauugguucauuucagauuaaagaaugucccggguuccguuggggaaaguccucuugaggaaugucauccggcacacagaugcucacaauaagguaggcaguaccgccuagugacugccagcauuuccugagggcacacaguaaaccaugaauuauguagggaguuaacaaaggugcauaagaaacaaccauaguuugaaaguacuguaacaugaagauacuuacaaaaugcuuuaguguaccaaggaaggaauaaagaaaucugccuugggaaaauuagaaugauuucacagagugaauggucuuugauauuugaauugguacuugauguugauggauaaauguuuaccaggugcauugcuugcuuuugacugagaauccucuguacaaauacagagcaacagagcaagggcucgugauguacuugagugaugaugucuccuguaugcaaagccucauuccauccugcccucuaucagucaucacuuggggcaaggcauuuugcuucuaggaagucagagauaggaacagugauagaagauaagacgcaaguggcaaauuagaguuguuuucuugacacuuaggagauaaacuuucucuucugagcaauaaagaagacaucagcuaggaguggugucuuacauguuucauaccuguaagugguguuuuacccuugaggaggugagguggugugacugccacauaugucaguuuagaccgaugauuugucagugugguagaagauagaugacggagaggggcacuggggaggaugaugggaugagugguuucgaggagcuuagagacagaaucuaggagacuuugugaggcaaugcugugaugagaguggaguccagcagaaccgccuucugugacuggaaaggaaguaaugaagggacaacaaugacaaaggacaaacacggggacauaaaaagaucaggaauccuuugucccguuuucuucagcacacuacuccuggcuugguuguucuuaucacugucagcaucauaguacuuagguguuaaguacugggauugaaccugugaaucacugagaaucacuaagcuuacugucuagcuggccuugaacuuaucacuuccgcagugacugauuacagaccugugcccagcuguuaccugaguaacuagaggauggaaguguaaugguuacucuggcuacuuacauagacaguuauguuaauucuacuugcaguugcauaggguccuuggauuugagagugacagcuaaaaacaaaguaguucuagcguagguuuaaucaaguguguacgaggacuuagaaauaaaaugugcuuuugcuuuuggcaguugucaucugcuuucuaggauauuuucugguagcuauguugcuuuguuucuguuugugacaagaauuuuaaugugagccagguaugauguacauagcuguaaucucagcacugaggagauagucaggugguuugcuuaaguacacagcuagccuguuguguguugcaaaaaugcagaaaacaaaaagcuggagagguggcugcuuuuccacagggucuggaguuugguucucagcuccugcauggagcucacaaccaucuguaauucuguuuccagggaauuguugacucucuucuggccucugugggcacugcaugcacaugguacacagacaaaauaagauaagacaaaaguuaaaaacaaaacagaguaagugggaagauagcacagguaaaaacauuugcuacugcaagccugguaacccaaguuugaucuccagaaccgagugagaagccaggugcaaugaugcaaguauguaaucucaguacucguacagcaugguugggguagacacagaggagcuggccagaagcucaagggccagcuagucuggaguauguaguauaauaacaggaaacucaguaagguagaaaucaagaacuaacaugaaagcugcuucugacccaccacaugugugccauggcaugaauguuucuccaucucccucccuuucuuucccucucuugcuugcucucucacugucauacacacacaaaauaaguaaauaaaaaugcauaccuaucuaucaucuacuuaucugucuuuucuuaauauaaaaagagauuaugccuagggaauuuacagacuuguccuacugagcuauggcauaggcaucuaaucucagccauccaggagggugaggccaggcuggaggaccacaaguugaaggccugccuaaguaauuuagauuuuagucucaaaacaauaacaccacaaaauaaaaauucuaccaccaccaaaacacaauaaaaacuaaacaaaaaccaacaggcagggauuuggaagggguaccaggccagcgguagaguguguacugcacugagaagaaaaaccuaagcaaaccuguuucuagccuggagguggagaugcacaccuuugaucccggcaggaggcagaggcagucagaucucugaguucuaggccagggguuguaaagaaacccaguugccaaacaaaacaaaaaaacaggacaacaacaacaaaacccaaagcaaaaagaaaaccugucuaauuguuuuaagaauauugguaaggucucugagguuuugcaguuucuuuguaaacuauucuaauggugccugcuuugcuuuccuguaagaucacuuacuguugugauuaagaucuuaguguagcucagaacaauguaggguuauuuucugguugcaguaggacuguaaaacuaauaaggcgaucagugugucucugcagggcucaaaacccguuacugcagaauuguagauuuacugcauuggacugguuagucuguuguuuuuucuuuuuccauugagacaggguuucucuguguagaccaggcuggccucgaacucagaaaucugccugccucugccucccaagugcugggauuaaaggugugcgccaccacuguccagacagauuuuaaacucuguagagaaacuagaaguuacuuuccagaucauauccuagucuguacccuaauaguuagggcagauuguacuuucaguuaguuuguguucuguaaugcaaagagcuguuuuagugguuggguuuuguuucuuuuuuuaaacgucuagauucaggaggagucugacauguggaaaaucagagaacuagagaagcagauggaggaugcuuaccaggggaccagaaggaacacagugcccagcagcucaaggugaaguaugcuucugagagccaaaauaacucucaucuucuuagaauuacuaacuuuagcuuuaaaacagucuguuaaggguagaugcauucaguucagcaaaucaguaagccuuccuuguuaacuaaauuuagggccaagcauaacaguggcagcuguguuagcgugacuagccguucuaguccucgguggggaauugcauuuuaaauuuuauagauuccaacuuugucuaauagcuuguaacuuaagauuuucuauuggagaaucuuuuguucuuucuuccuccuuucucucucccucucccuuucccuuucucccuccccccauccuuuccuuucaucuuauaagaauuguauuugcugagcauggugugucaugucuuuggucccagcacucaggcagaggcggauagaucucuugagucagagaccagccugaccuacauagugguuuccaggccagccaagacugcaaagagagacccugucucaaaaaacaaaaacaaaauuaauuucuuuuauuuacuguguuggcaauauuuuguaugaugugugaauguauaugggugugccagugcacacuugaaagucagagcauaacuuucagggauuuguucucuuaacaacuguagguucugggaguggaacucaagucaucaggcuugccaggcaagcacauuuaccucuagccaucccuggagucuuaucauuaauucagucagucauacuguuuuuccuuuagucuauuacacuuuuaaaaauuuauuuuauucauguaaguaugcuauaugucuguugguggucagcaggggacagaagaaggcauuggaugcugucuuagucaggguuucuauuccuggacaaaacaucaugaccaagaagcaaguuggggaggaaaggauuuauucagcuuacauuuccacauugcuguucaucacugaaagaagucaggacuggaacuuaagcaggucagggagcaggagcugaugcagaggccauggagggauguucuuuacuggcuugcuuccccuggcuugcucagccugcuuucuuauagaaccaagacuaccagcccagagaugguaccaccuacaaggggaccuccccacuugaucacuaauugagaaaaugccguacaguuggaucucguggaggcauuuccccaacugaagcuccuuucucugugauaacuccagccugugucaaguugacacaaaacuagccaguacagaugcccugaaguuguaagcugccugacuuaacaugggugcugggauuugaacugacaucucccagaagagcaauaaaugcuccuaaccauuaagccauagcuccauccccaugcaucuuuuuaaaagccacacuaucuuugccagguucaugggcuuuuauauuuccuugguaauaguuugagugugaauauaaaggauuuugcagccuugacucuggaagguguaggguauauuaugaguaauuaggaauaucucuagggcuucauaggcuuuuuuuuuuuuuuuuuuuuuucuuuugagacaggguuucuuuguguagcccuguccuggaacucacucuguagaauccgccugccucugcuucucaagugcugggauuaaaggugugcaccaccacugccugguucagugcuuuuuaaggauaagagauuagguacaugagauagguuagaauccagauuucuaaagaagaaaucuaaaguuagggaacuauuagaagaaaagaauuacaagugagcgugcuuguggaguauguggacucuggugcaguacaaagcugagugugacuggugucgcaguguuacauggugcaaagguagagucucagcauguuccauguauucuguucuugcugcuccauaaagugauaucacagguugcuuauaaaucuaaaaguuugucuguuuucauuuauagucggaugagaagugaugguuuugaugaagaaagucagagagauuacuggaggucaaagaaugaaauuucuggggccuuggaagaugauuuucuuaagacuaaguccuggaacaagaaguuauaugauuaugaauccaauauaccagacagguuugugacuacaugcuugugaccccuaaugguguuuggcuuuagaauauguguuuguugaaauuaauuuuccuagggcuggagagauagcucagugguuaagagcacuuguugcucuuguaggggacccauguuugguuccuagcacauacgaggcagcuuacaacugcccauaacuccaguucaggggaucugacacccucugcugacuucugugggcaucuggcauacauguguaggcaggcaaacacucauacacaaaaauaaaaguaaaucuucaaaacagauuguucccauaaaagcuuauaaguggauguacacagcaguauuuacaauggcuaagaaauggcuaccgccauuuggaugauuguguuaaacaaaauguagguuuuccuuacaguggacuaauacuugugguaaaagggauaaguacuaauuauucgugcuuaaccucaagaaugugacaaauguuaaaggaagucugaugcaaaggcagcauguucuuuguauuauguaguauguccagaauggaaaauccagagagacagaaauacucaggcuucuucugggcuacagguucugcaccuggcaugcaaaacacuuuagaguguuccagaguagauagcguguuauaaaguaguuuggggagagaacuucacugcuaaagaaaagagauauuaauucuuuagugucugguaaagaacaguauuuccugugucugauaugauaguaguauagaaaguagagcuauuacugagcuauugugugguuuuacugugucccuuuuuucucucuguuuguguauacaguauucauguaauccaaaaacaauaugcauuguuucauaaaauacauguauuauguuaacuuacagauggggucacagugguuauaaagaguuguauccugaagaguuugaaacagacagguagguaaaugcacuuacuggaacaaaaccaaacaccucagaugacaaaauugugccaucaguaguguuccuaacauuuucaaaguauuaguuugucauugaaaauaacuagaaccuggaaugguagugcaugguuauagucccaguuauucaggagccugaggcaggauuucuagaguucaggaguuugagucuagcuugggacauaaugucuugucuccaaaacaaaggaaacaagcagaacuuaguuguaaggcaaugcugaugugacuuuccagacuuguucuguaagccuaaggguuuaaaaaacgauugugcaccaucgucugcaguaaacguguuccaagaugccccagaccuuagauauuuuauaaucuauuuuacagccugucuuccuauguuccauauuguuuuuuuaaauuauuuuuauuaauauaguaccuauuaaaaccuuugcucuguaaggaaguauccuguuucuuuuagccauauauaaauugugagaaucaugauugugcuuuggggucauuguuaaauaaaacaagcuauaucaaacaauggaucugauaacccagauggcuguaaaugacccaagaugguuagaaguagacacagggaugauucagauccuaggugggacacaguggaauagugaggauuuucaucuucuuauucaaaaugauaugcaauuaaaaucuuaccaauuauuucuggcauugacccugguuggcaggaaucugcgaaaaugaaaccaugaguaagggagccgugguguuugguauuucauauguaacucaagccugccaggucagggauuugcuuuuugacaggauuucaagauggccuugaacuccugccucuccugccucuaucuaccaaauauugggauuauagauauauaccaguaugcuuagcccaaguucggguuuuaaagaugaggaaauaaaaccuuuguaguagaugagucacacaguaacuaucagagcucucauuugcuggguauguauguauguauguauguauguauguagacggugucuuuuuguaguccuggggguguagaacuuguuauguugaggaagcuguccuuaacuuaggagguuuucuugcuuuugcuuuuuuuuguuuguuuguuuguuuguuuuguuuuuuguuuucaagacaggguuucucuauauagcccuggcuguccuggaacucacuuuuguagaccaggcuggccucugccucccaacugcugggacuaaaggcgugugccaccacacucggcuugcuucugcuuucuaagugcugggauuauaguuguguaccaccauacccaacucaaagucugacuuacaguucagauguuaauaauuuacccagagugcagaauaugaaauagaaauguacuuuuucuuuccuccguaaaaguuuugccuuuucuuuuuauuaguagugaucagcaagacauuaccaauggaaaaaaaccaucuccccagguaaaaucaucugcccgugaaucucgaaaacauaagaagucaaagaaaucccauaagaagaagcagaaaaaacggucacacaaaaaacagaagaaaaacaaaaaggaaguuacggacauaacagcagauuccucaagugaguucucagaggaaacucgagcuucuaguacuaggaaaaggaagcaaccacacaagagcaagaaaaaguccaggaaaaagucuccuaaaaucacuuucccuuuagggggagaaagugguacuucucagucagaggauucugcaucuagcaguucugaggacaucgaggaaagagauacuaagaaaaccaaacggaaaaagaaagagaagaguguccauguccccaugccugacccugagguacaggagaggacaagcaagcgcaggaacuggaagguggcuaccgacgccaggucugcugagagcucggaggaugacuaagugggagagcagcaguccugcuucccacugacucguuagggggguugccagugacuccugcagcacaggcaggcgucugaggucagaguuguccugccccagauaccuuuuuuccuauuuuggcuuguuaaucuccauccucuuuuguuaauagggaaucugguauuuuauuaagguuucuugaaaaaauuauuuuuuucaauuaaucacuuaggguagaauaccuauacagcaaauuaaagaacccagaaagcugaacucaguaaugaccugggcacaccaauugcaauguuggauuugauggaaucaagaguccaggauggaggaggaagacugaaguagugcuaaauagaaugguuugacaaggagaccgugcuauucauacaggaggcaugcugccuucagcuuuggugcuuugguucuucugcaguugggcccuauaggcauccaguuuacugagcgaggaaauaguuaaaagaacaaaccuuuucccuucaugguaaucucuacagaugacugcuaaggaaccuaggguuuucagccuaaucucccugcuggccagggucuacagcuacauuuagcauaacccaaacauaacaguaacuggauaguaaauguuuuucuaguuccauugcuguauacugccuaaaugggcuuguauuugaaauuguuugguuguccuaucuaucaaauggaaagaauuaggaaguaguuauguugccaugaugcuuucaaagagauucagggcaucagccaucuaaaugucuguuuuuuaaaaaaauuuuauuauuauuauuauuauuauuauuauuuuugcugaguuggggauugaaccgaaggccuugcauauacuaggcaagugcucuaccauugagccauacccccaguccuguuguuuuccuuguucauuucuaauucuauuaauggauuuuagauuuucccugaaaccaguugaaucaauuccaaaaugaaacacacuucucagggacauacccacuucccagucugacuuuguguuuugauuaucaagaacauauuauuucccccugcuauauacugugauccugauauuaaaagaaaccaaaauaccacuggaaaguggcugguagaacaguuggcuuuucauuaagaggaaagauaaagugacauuuaucaggguuuuuguuuuugagguugucacuuugguacugagcgaaugcaugaaaacucaagacugugggccaugguucugccacuaauugauugaguucuagagcagguuaaccucccuggccuuacucuuugcauguguaauacaaagauacuucaugguuagcaugacauacaccagcaauagaauaugauaaugcugacaucccaugaaguggcauuuuauaguaauaacuaaauuugugcucuuuauggaacauauuucuaauaaaaugcuuguucuuaaaauauaugguuggccagaugugcccuaucccuugauuaugagcaggugccgccuuuugggguacugaaacacuaaugauuuuaguacucaaaugccaauauuccaugagccuuuugggguacugaaacacuaaugauuuuaguacucaaaugccaauauuccaugauauauucuuuuccuugggucuaguggagggagagucuaguuacuaccucauaaccuucuagaagcaagugauaucuuuguuggaaguaguuuugggcaugcauucuuaaugcaguuuugugcuacaaauguacugauucuaagcacagacucgggaagauuguccugcagaauaaggcacuuccaaguuugaguuuugaccuuaccuuccucccauacaacagacauaucuuuucuccagggaaagcacauuuugccugauuuaacaccccugccccaccaccccgcacuguucuaucuuuucuuggucacauaagcaauaaaauuguuucuguucuaauccaugccuuaggcuaaggcuuugaugguuccucuaauccccuuaacagugguuuaggacuacuuuugaaaaccugucucucccauuuccacgaucagcucuggaacauguauuaguguuccugagagaugauuauguugaauccuaaauugggauuuagaagaacaagaauuggagacuucacauuuauuaacuggugugauacaaguuggaauuacugaauucccauaaauaaaauuucacuuuugaacauuugcucuguuacuuuuuaacaccaacagacuuuguaacugccugacgcuaaccugacagguuggcaggucuuucaccacuggccauucaaucugcuugguaacaagucuuuuggucuucugucauucuaagguauggccuacugcccuccuuucuguacgaucugggcaaaccgaccggugauggcaagaguagugucaaugaagcgauccacacagcuagagaggcaguuuucagugcgggagucuagccgacuuccuggcuucuccacacacuuaucccaacauaguuccaugaagugaugcaccua

SEQ ID NO: 5090 - RNA, 25336 nt, Mus musculus
cuuuccuuucuccaacuuuccaaggugcgcccgcacccaucgaccuaaagcuuugcauuacugucagcccgggcucuuuuccccagcuuuuucuuaaagcaaaggcggucguucccuuuggcaccgccucccugcccucaggcugcagccgguccgacucucgggucccuuagagcggcccugguccguacuucccauccucugcgacaccucuccuagggccuuucccguuucucccaaacgugcaccgcccccgcacugccucgcagcgccuucgucaccgcagauccuaagcggcagccucccgucccucucgggugucuccgacgcgucccccccgcagaggggcacggaaacccuacguuccggucgcccguccaagcagccgcuuuuacgacacugcgcgaccgcagugcgcggcugacggcagagccgcgcugcucuuggagaggucacuccggagacggcggagccuuuggggcgugggggucgguggcaguaauguggcgcgucugugcgcggagggcgcggagugcugugcccagggauggguucagggcucggugggcggccuugaaggaaggccccggggccccaugcgggagcccgcggauuggccccgcugcgguccguugcgguagugggaucccccgcuaugggguccgcuccuugugcggcuggagcuccggcuccggcacugucccgcguaaccgcuugcugcgacaacuccuggggucgcccagccgccgcucuuacagccucccuccgcaucagaaggugagugacccacccuggagccuguuguccuucagagcccgcuccuuggcguggggaauccuccuugagaggccuccgacagccagcucccucccagaucuauuacggucccucgcccaagaccuucccagugggcaucuuuucuauugaaagaggucuaagccugcggcuaugggcaaaaggucugagaagucucacgugcuuucucagauccacuagacugacuggaggaucaaccugccucugaaagucaugaauuucuggagugcuagaucucccuuuguaucuccagugaacaguuugaaaugugacucaguaaauacucugcaugaacuuggguggaaugaaagcacgccgagggcuaaguaugccuguuuaaauguaugcuucuuuuucugcagguuccauuaccuucccuuuccccuacaaugcaggcaggcaccauagcccgcugggaaaaaaaagaaggggaaaaaaucagugagggugaucuaauugcagagguaagucuuaaaacacgcagauuuuaccuaagggaguggcuuugcugaauagacuaaagcuuagccuucugguagguaguuuccucuuucucuuuaagaagcagcuccccucccaccuccccauuuauuagagaugauugguuagcuacguugucagcagcuagcuaaauuguuuuugagaucacgguguaacucuggcuggccugcaaugcucagagauauccccccccacccccaauguuacaauguuagcaaugccuagcuucuacccaaaauguuuuuaaaccguucuuucaagucugugguaguggguuuuaucuucguauggauuucuagacacauuccaguuaacugccucuuggcaguacaaaccuaagccagugcuuuugugcuaacagguugaaacugauaaagccacuguuggguuugagagccuggaggagugcuauauggccaagauccuuguuccugaagggaccagagauguuccaguuggguccaucaucuguaucacaguugaaaagugaguaaaaacaaaaagaaaaaaaaaucuuuguaauuugugaacauuuguugcuuuuaaagcauuucaacucagauuggaaguuaaagacaugugaggacucgcugggagguuagggauuggauuugcuuuauaaauucuauauuuauguauucuuuuucuucaggccucaggauauugaggccuuuaaaaauuauacauuggauuuggcggcggcagcugccccacaggcagccccagcugcagccccagcuccagcugcugccccagcggcaccuucugcaagcgcucccgguagcuccuauccuacucauaugcagguaagacucagccucugagugccggcuccuggugacuuguuauuaauuauuuuauugucauuuuucucuauggguggcuauuguacucugaaaacgugucauuaacuauaagugccugucauucagccguauugagagauuuuagcugugaaaauuauucuuguuguuucuaagugugugagccuggacaguuucuuuaaccuuucucggcuuuagcccaggauacaggauaaugcuuggcuuuucucuuucacaaacgaugugaaagguuucggaaaugacuuuuuccccuaugcaaguagaauuuaaguagagaacaggugcuauuugcugaaugaaaguccccagaugaaguuuuccuuugguuuagagugggcuacuucuaagcauagaugaaguauuccaguaauagucauuagugaaaaaauaacaauaaagaauaaguaugauggugauggagagcuggcucagugguaagagcacugacugcucuuguagaggucucagguuugauucccugcaaccacguggcagcucaccacugucuguaaguccaguuccaggggacccagcacccucacaaagacaugcauacagggaaaacaccaacgcauauaaaauauaaauaaaucauuuaaaaagaaugagcaguauggaauaagucuacaggauaacauucuaacagugcuguuggccauaaaugugauuaccaccaaccuagaucagcucuaggaaaccaucuugugcuuuuucuuccuaaacacaaucuaauuacagcuucccaccccagguccucccugcuucccuaccuacccaugcccuuuccuucuucuuauuagacaucuaaaaaaaaaacaaaaaacaaaacuagaauagggccaaacaaacaggggaaaaagagccaaagaaaaucauacccagacgccaaaagccugugcacuuaaucacaguauuagaucuuagaguuuuccuuuguuuaucuuucuguggucuugauguuggaaguaaguaaaaucuaaaggauuaagauuuggccuuuccuuaacuuuauaagaaguuuucugggugagucaguuucuucucuggaaaucacguuccaagucuauugguaacaauuccuuaugaugaaauuuuuccuggucuuuagcuuucaugaugauuucuuucaguucagcaaccuuauuuuguuacauaagaccucuuuucuccauuuuauccugcucuguguuuaaguguuagaauuggguccuaagaauccuuugagaugguaaagauaaauaaaugaguguauuucucuuucuacugcccccccccaugcacacucaaacauacacauucauacuuuacuggugauugugcaacaaagaaaagaaauucugaacaagaaauaauuuuuaaagaguuucuaagucuugcagacaugguggcacacaccuuuaaucccagcacucuggaagcaggggcaugcaggucucugaguuagaggccagcucagucuacaaauugaguuccaggauagccagggcuguuauacagagaaaaccuguccaaaauaaagauauuuguuuuuacaugcauuuagugugcacuuaaauguguagaggucauuguggaaguaaguuaguugucuucuauaaccagagugcgcagagaagggggagcuggaaagcgaggcuuguuguugacuucagugagagacucucaaguaaaugagggagauagcucaggauaccuuacauccuccucuggcuucuccacugcacacuuauauacaccugugcaugcaucacacacacacacacacacacacacacacacacacacacacacaucagaaagccuuuuguuuuuuaacaguuuaaaaaaauacaauguauuguuccucuaucucugaagaaugguauuuaguuuuguggguuuucccucuaguccugccucaugcaugcuagucagcuacucuucuacuacugaaccucauccuuugcucccagaauugcucuuaauguucaguuuuaaaaauuguguguguagacaugugcaugcugguauucccggagacaggauuggauucacuaaagcuagaguuacaggugauugagaguuggcccaucgggaaccaaacuaagauccuaugcaagagcagcaaguguucugaaucacuuagccauaucuuuaguccuuaauuuauauauauguauauauauauguguguguguguguguguguguguguguggugugaaauaaguaugguuucucaugagugaaaagaugcuuauugcagaacacaguaaauucagcaguuugucuagaccaagaucguucuguaagaaugaaaaggauccaccucacacagucagaauggcuaagaucaaaaauucaggggacagcagaugcuggugaggauguggagaaagaggaacacuccuccauugcuggugggguugcaagcugguacaaccacucuggaaaucagucuggugguuccucagaaaauuggauauaguacuaccugaggacccagcuaugccacuccugggcaucuacccagaagaugcuccaacauauaacauuccaacauauaacuaggacacaugcucaacuauguucauagcaaccuuauuuauaauagccagaagccagaaagaacccagauguuccucaacagaggaauggauacagaaagugugguauauuuacacaguggaguacuacucagccauuaaaaacaaugacuucaugaaauucuuaggcaaauggauggaacuagaaaauaucaucccaaucauaaaggaauacacaugguaugcacucacugauaaguggauauuagccuagaagcuuggaauacuaaagauacaauucauagaccacaugaagcucaaaaagaaagaagaccaaggcguggaugauuugguccuucuuagaagggggaacaaaauauucacgggaggaaaagcagagacaaaguguggagcagagacugaaagaaaggccauccagagacugccccaccuggggauccaucccauauacagucaccaaacucagguacuauuauggaugccaagcagugcaugcugacaggagccugauauagcugucucccgagaggcucugccagugccugacaaauacagaggccacgcucacagccaaccacuggacugagcacaggguccccaauggaggaguuagaggaaggacugaaagagcugaagggguuugcaaccccauaggaagaacaacagugucaaccaaccagaccucaccagagcuccuugugacuaaaccaccaaccaaagaauacacauggagcuauccauggcucuagcugcauauguagcagaggauggcaucagugggaggaaaugcccuuggucaugugaaggauugaugccccaguguaggagaauguuagguggagaggcgggaaugggugggugggggaacagccucauagaagcagggggaugggggaagggauaggggguuucuggaggggaaacagggaaaggagauaacauuugaaauauaaauaaagaaaauauucaauaaaaggaaagaaaaaaaagaaugaaaaguauuggugguaaccuagaucagugguucucagucugugggucaagugacccuuucauauaggucacaucagauagcugcauaccagaaacuuacacuagauucauaacaguaacaaaauuacacuuaugaaguagcaaccgaucuauuguuaugccuggggguaacaauaacaugagaaacuguauuaaaggguagcagcauuagaaaaauuaagaaccacugaccugguugaaaagauacuuugugugucugugcagagaggcgggugggagagagguuuguuuugaccaucuggaagaaaucuuuccaucuuccuguugcuuuucacuuuggaggauggguuagggugucuaaucacucuuguuuuaaagguugauuuaacugggaaagcaauuaguacagaccuuugugaugggugacaaggucucacuguauaguugguaagcaugcgcuuaccugaaugcuuuuaugcguccugguuaagcagugauguguggcauuugucuccacagauuguucuuccugcccucuccccaaccaugaccaugggcacgguccagaggugggaaaagaaagugggcgagaagcugagugaaggagacuugcuggcagagauagagaccgacaaggccaccauaggugaggaggauggccaucaguacauuuuuuuguacugagugagugguaaugugacauuuacaguccugagauuugcugccugggucauauuuuauaaaaaggucaucacagccacacgugucaguucugagcuguacucaucaauggaggauaugucagggucuauucuaaggccuggguucacucucuuggcuuuauuuuuaugguacucagaaguuguaccagcacugccauugucuaaacaugggaaaagaaggagggaggaggaagauagucaugcccucuagggcaggagaauaccaaagccuuucaggugccucugagggaaaacaguacccaggguguagauuagucucauaaucugaaagugccauggaugucagucuuuuucucauuuccaugugccccuuuauugacuuauucaccaugcagucauguacugugcuugugucuauugauaaucccagguguucugaaccuguuuccacucuuccgugguuuccaggagcagaaggcccauccacgccauaguggcagagcaggacauaggcaucaggcaguagugggcacagacagugcucgucaccauucucuugguagccugggcaagugauaucaaagaguaaggacccccccuuaacauacuauaccuuuuuuauaguguuuuucuuccuccuucuuuucuucucccucuucuuccucuuccucuuucuccuccucuuccugcucuuucuccucuuccccuuuccucuuuuuucuucuuugagaugagacugugcuaggauugcaggcuuguaccaccgugccugguucuuucauagcuauuauuagaagaaaugauucuuccuuaaggaaaaagcaagggccagcagggugguuuggugugggguaaagggugcuugcugccaaaccuuagaugugcccuaccucuguccaucuucagcacagcuucuauugaguauucccgguugggaaaauggaagaauucauuagagaugugucuguccaucaagaagcauaacugcagagagcaaguucugaaaggcagaacuugcccuuaucaguagcuugguuuugcuguuuuuaauuaaauuaaaucaaucaguaaguuucugagacaggguuucacucacccuagauggucuggaagucacaagagaucugaaugcuaagauuaaagucaugcaucaucaugccacgcugcuauuuccuuacagagaacuccuugcuauauaaucucguuugcucuugaacucauguugcccaggcuaacuuugagcuaccauccuccugcuucaggcuccugagggugugguuacaagaaaacacucagcuuuggccuuuacuuuguaagucuucaguguugagagaaacaguagcggaguaacuucuugccugcugaugcagagacccccagugauacuguauuucauaacacuggaaaauguagcguaaugccaggcauagccuuugaggagcucugagaacacuuuuacugcugagaucccauguuaccguccugcugcuaguucuuguaauuugacuuccauguaacucugacuucuagcagucuagcugauaccaucuuaguguccuguaagugccacauaaagccacccuugaggcguucucaguaacucuuagaaugugccacugucugcagucuugguagaacagacauagucaguguccacaagggauuggcuccagaagggcauucgugcgagcucagcacgagugcaggguuuuguuuuguuuuguuuuuuuucuuuuuuucccaaauuguuuugaucuuauagauuuggagggccaacugcauuuuucauuuauacuuugugcaggguaaguacuuaaaaacauuaauugacuuaaauccauuaacauuuauguaaggauuauauggucagccauuccuugguauauguguuggcacucugauuuaagucuauagauucaaguucccuaaauaaguggacauaguauuuggagggugggucucaggccuugaguauauuaguaagcccuguauuacugagcuaugccucuagcccuguacacuuuaaucaucauuuccagcuacuuguaaugcccaguacaacagagcugugugaguagcuguuacacuggacuacuuaggaaauaguugcaagaauaaaagugugcgcuaaguucagaccuccgaagccuaacuacauaguacaugccagcaacaauguaacauucaccuucagccgaauggauuuuagggaugcaggaccuguggucagaggguucacugugcuauucuuguucccauguuaaagacagaaauagaggcacagaaaaguuaaguaguuugucaaaaacaaaacaaagccaaaaaacagugcuaguaguuugaauaugaaaauguuugggcuggugagauggcucaguggguaagagcaccugacugcucuuccgaagguucgaaguucaaaucccagcaaccacaugguggcucacaaccauccguaacgagaucuggcucccucuucuggagugucugaagacagcuacaguguacuuacauauaauaaguaaacgaaucuuuaaaaaaaaaaaaaaaaaaagaaaagaaaagaaaauguuuuaccugaaacacuagugaggguguaggaaugguggaggcuugagucccauaaugauuuuccuucuacuuaaggcuuugaaguacaagaagaagguuaucuggcaaaaauccuggucccugaaggcacaagggauguuccucugggagcuccacuauguaucauaguagaaaaacaggaagauauagcagcauuugcagacuacaggccaacagaagugaccagcuuaaagccacaggcagcaccaccugccccacccccgguaggugugguucugaacuggggaguugucuguucaggcagauaauagcucagguuccuggguguccagauccuacacgaaggaaagugacuggcgguaccuguuaaucugugguguguaugugugcgagugagcuugcaugcgcgugcgugcucgugugucacgugcuguccaccugauggucaguaguuuacucugccgacaucuuaagccuugcugagaacaaagguaaauuacaugaccugcuagugguguguuaucauguccaugggaggugaugguuucaccccacauuuucuguugcucaacuaacgaccuguuuccacucucaguucugguacuugugguuguagcugaagaaguguguuuuggaccuugggcccugaaguggcaugacucguuguagcaucaugcacuugcacucuccaguguacuccuccauggguuuagaagagcugcacacuuccucagaggaagcuugcauucacagucucgcauugauucggaugcugucagggaacggggugguccauuccuuaagauacuugaaacgugggagcugaugcuaucauuuuccauccugaagugagauuaaauaaagcagagcucagguuaauauaaggaaauaaagaauggacaggaagcaagguauuugugguuuggguacuugggaggcuguggcaggaugaucacuguggcuugcauagucucaaagggaaaaaugacaagaaaugacaggcagccaguauguuauacauaggucaguuuuaguuccacaccucucuaguuagcaugaacuguuuuugacucugucagaaaauauucuugccauucgucuuuuauguuagucaagccaggaaagugcauaacaucauuuaauuauaaagaguuuuccauuauaaaauaugaaccuguguucugucagauuaucuuugcagugaugaauggauagaugcucuguaacuuuuuucccaaagguggcagcuguuccucccacuccccagccuguagcaccuacccccucagcugcuccugcuggaccaaagggaaggguguucguuaguccucuugcgaagaaguuggcagcagagaaagggauugaccucacccaaguuaaagguaagugucuuucugaagaaagggguuauccagguacaguguaguuaaaugcuguguguaaggccagcaccuauaccuguguggaaggagacagacauccuugcugccuucacggaaggcaagcaucaccguguucuauucgaucugccuaggauugccuauguaagcugugugccuuuucaaacucuccucuauucauaggaaaucuucaacagcagugauaagggaaggaagcgucccucacauuuccccugagagcucugaggagcuccuguaaucuuaggaaccuggacucaggcaaacccagguuuuguaccuuuggugcagacaagaauuucaggacuuguuagaaugaagcugaguugggguuuuauuaaaaauaaaaagguguuucugagccaggcaugguggcccacuccuaucuuugaguacaaggcuagccuggucuacagagugaguuccaggauagccagagcuacacaaagaaacccuguucuuuaaaaacaaaacaaaaaaugaaaagaagaaacaugcucacaaaaacaucaaaagcacaucaaaggacaguguuguuuauuaaaagauacuuuugaugaagauuuuaaggauggacauuaagagaaauauccucugggaaauaauuuauacccaaguuuggauaugagcuuuuuaagaggcagucagagaaggucagacauaacccaaguguaauagugaguccgcggggagaguugcaauuagaugcuccauuuuagccauauaccacugugguggcucucuucuuguuccuucuuccucuuggugagugggcuuguugggguggcacuggagguguuguggauggaauuauaaucuauagauaacaccaggagccauaagggcuacauauaauacaagucuucuauuauaaauggggcuuuugaugagcuuccuaggaaauuguuguuuuaucacugggaggagaaacaccuuuaacagauguggauguuggaauucuugcuucucaggugcugagaggcuccgucuacuucaggaugaggaggaguuccuuucccuucucauagccccacaauuuccuugucucuauccugucuuacuuaaguguuggcaaaagcaaauguguuuguugagcaguguugaguuauaagacgugucuguguaauaaaucccaguguuagguuaacugaguguagcaguaagcaaaacuggcucaucagguaaaagugcuggcugcugcugaccugaguacugucccugggacccacagaguagaaacagagaaccgacuccugucauuugucuucugaccucuguguacagugugacaccuaaugcauaaggguugaacucaggucauuaggcuuagcaguaacauccuuacacauugagcuuucucaacagcccaggguuuuuuguuuguuuguuuguuuguuuguuuuuuguuuuuuaaacaggaaccuaguaucauaguaggcaggcacuguaacacucauauguauuccuaccccucucuuuacuuuguacuguuauagcaucucaaaauuaaaaaaaauugcccaagcuggcccugaacuugcaauguucuuucuucagccuccugaguagcuaggauuagaggccugaacaucagguccuauuuuaauuucuguauuuuccccauuaccccgugcuguccucagaucugcaauuguugcccucagucugguucucacucagcaccaagcugcaguuuguuggugcauucuuuauacaucugugcuuauaucagacgaguuuaagguauuacauagagcagaggggcugaguuaguaauugugccugcagaaccuggacuaguagggucuuuuguucgagagguaguggugcuggauuuugguagaggggugaguugaaggaccuugguauuguuuuccugcagguuggguuaaggauuccuuuaugagcagcuaagcacaugguucugagaagcaccugugcaucagguccuuguuuguaagguggggaacguuccgaccucacuggccggcaggagcggaugaaguaacaaaagucuagcgagugguaaggaugggacccagagcuagaaggcucagguuugaaugugagcucugccuuacgcuaacagugucaccuuuucuggcucuguuacuuguauauaaaaauaauacuuaaugcggugugaagaugaaugagugagcagugcuugcgcagagaaagcauauuagcuauccuggcucuacuguuaagagcuggggugacuuaaggauggauuaagaaagacucagggacagaugcggcgacuuuuaggauggaugaggggaccuuucugaggagugauacaugaucucauguccagacaaggagucaucugugcaccagcccugugaaaggucagagaaaagcauuuuggcagagggcgcuccacccguagcccauggccuggagucaaacaaagccugacugaggaccauacggagcaugggaggaaagggagggcagggagcgcagaaacaaggcugcucggccugccugugucuagcuuccccucucccuguaggcgggauuggugcaggaagcaggggagggccaauggaaagaagaucgaaaggucccacacuaaccaaguguuuggucuucagacaacaagugaugucccuuagccagaagccccacccucacucaccuuguuagcauaaacuagugugacguaaagaggcuugauuggagaaagcaaauacuuaccacauggggaauuuccuagauuuuggaaggcccaagccaaaagccugggacaaagaccaaacuuaccuguguaugacaguacuagaaagagaagacguguuucuuguggauuucagggacuuaaauuuauuucuuuauucauuauuggggcuguggaggagggagcaagagaaagaaaaacauaaaacucuauuguagaagaaaaaaaagucagauagaggggcacgguaauuaggaaauuuagccaaaacguuaacuccugaggaagaaacugaggauucugguguugagagcccaguggucgugugugugugugugugugugugugugugugugugugugugucguuguucucacaguauagcucugaacaagggcugccacugucaucuccacccuacagauaagacaggugacugucgucagcugcguaaucccacagagugcugcgugucucuugccagccagcucuucccuuuaccccuacugccuuaugaucacccgugugcuuuguuggggagcuggcaaagcaauuaaaaguguuugcuggcuaacacacuaacuguaaugggguauggcaucaagcucugucccggcugguggcaggggaggucaugguuucucucugcuuaaaggguggggaaucuaacagaggucccgccgccucuguucuagagcucccggugaagagagaguucuagccaacuguguuuucauaacgaagggaaggaguugggaagaagugcacacagcgggaacccuuuaaaaggcugccgugggggaaggugaaucaauuugaccaauuuuuuucuagaagugggccaguguaaaagguauuauaauaacuaaauucugaauuugcuucaaggucaggcugauguacuugggccuaagccuaaaccugagacccuaacccugagguaaagaugggaggaaggaggggaguguguguaaacaaagccugugggagagccugccggucucagagacagugugguguuuccuccuugcuuugucacauggguugauuuaguuuugguuggggugaaagaccugaaaauuguggaaaaugaaugauucuaaggaugagaucauugcaguugcacaucauucaugcuauucugaaguaaaaaaggguuauuucuucagaaaauugccaaccuuacacaaagauuguaccuuauggucaaauaagaguauuucaagguucagugaguuggggugcuguuugguuuuuguuuuugauuuuuuuuuuguuuugauuagcuuuuuaagauaaccacagucaacagcuaauuuuccuuuucaauuauaaacuaugaucaguauuauuaugucuguguuucacaacuuaaagcaaagaaauaaacaaaauaaagaaaaugcaagaaaauaaagaauuuaauuuagcuagauaaaacuuugagagaaaaaugguuacuauuuacaguaguuuaaaagaaucacuguuggcagggguggggggauugggggucaaucucggaaggggcgaaguaggagaggggggcagucggaucucuuguguuggaggcuauccugaucuacagagugaguuccaggacagccauggcuauacagagaaacccugucuccaaaaaacaaaaacaacaaacaaaacuaguauuugucuggggcacuugguuaaugagcaguuaacaaagcugauguccugagggagauggggucuuuucagggucacagugcugaccuuggagauccagugggaugcugccacauaugcgauauuuauguguuucuucagggacgggaccagaaggcagaaucaucaagaaggacauugacucuuuugugccuucuaaggcugcuccugugaguuauuuuuggcuuuuuaaaauuguaacuucauuucauucauucauucauucauuaaguuuuagccacagucagcuuaaaauuauuaucauuguggggacugaaucuuggggcccuauacaugcuuggcaagcacugggcuacauccuggcccacagccuugcguuuauauuuucuuucuuuaauucuucaauuaaauaugcuuugcuuuuucuccacccccacaccccaccucuucugguuauauugaggaagcaggcuaaccuugaacuugaaaucuucccgccuccgcaucuugagugcugggaauucagguacacaccagcacuccuagacugguguuaauaaagagucuaauccgagucccuuuugcucuguggagauugaaccagcuacuccucagaccuuugcucuuccgcuuuggcauguaguccuccacagcaguagcaugucccagguggucuccagccagucacuaagugcuuuuucuuuucccucuuaggcugcagcagcugccauggcucccccggguccaagaguggcaccagcuccugcaggugucuucacagacauccccaucagcaacauucgucgaguaagggcaccaccaagauaugcagucagagcugcuggcauuuccacucugguuguuugguugucugugugguaguuuaaaacaccaaaaaggaccuugucaguuauuaauuuaaggacguuugauuuggucaguugaguaguugggguaaagaaaccucugcuuuggccagucuaggaggagcaguccuuugucuuacucuggcgugugagguaagcuaccagggagccgaggaagaggcaagcagacugaguuagguaccgucuggagucagcugacacugauguuggacucucucugguuucaggugauugcgcagaggcucaugcagucgaagcagacuauaccucauuauuaccuuucugucgauguaaauaugggagaggugcuguugguacggaaggaacuuaauaagguaaaacccagaaauucugucuuucccuagaaaccuuuccaguguugccaugugcuuuguuauuagaagcugguuaugauagaaaauuacugccacuugaaacuguuggguagggacuauccugggaaacuucauuucacuucuuuugauuuguugcaacuaucuggacagugucucacuauguagcucacaccuggaacuccauagaaccaaggcugcauugaccuugcaguucugcuguagccucuaaaauguugggguuacaggagugcaccaccuuuucuggcuuuucuguuaacccuugauuagaacacagcauugaaacucacuuugccauggauagauguuagucuagcaaauugucuaugauuugauacucgaggcugcucugguagcuuagaaaugauacucauguucauagucagauacuacgugugcacucuuggggauagagagcaagagcagucugucuucagcacgaguuuaugauggaauuggggcacuacuaaaugugacaggaagggaagguguuuuacaaagguggcgggauucauuuguagaccgggcucuuuaugaagcugccucucgauuguuuccucaauuacacuguguguguucauuacuggaguucagcacaguguugaaggagaccagugauagcuggggaauucacagugcuguaagacaaauguggccaaacuaugggaaauguacccuguuuggcagagaggugaauaaaauucaugcuaaugguugagaauuauaagggucaagggcuguaagaacagaaguaagacugagagauguugauccaugaaguacuuguagcacaaguauaaagcuuccagcacuaacauaaaacagcagguacuuggauaugccuguaauucaguacugggagguagacagaaucccuggugcuggcuuaccagccagucuagcuaagucuguaacuuacauucagcaagagacucugucucaagaaguaaggcaaaguggggcuggagaauggcuugguuaagggggcucauugcucuugcagagaauccagguucaguucugaguacucacaugguaacuuaucuguaacuccaguuccaaagacuagaugcuucauagguguaggcagaggcucacaugggaugcacauauguacaugcacauaaaacaagucuuuaaaaauaaauaaagcagagaaugaggaagauacucaaccacauaaaaugaauaauuguaaaagauuuaaaaaaaauaguagaacagaagaaccccaucagcuccuuagcguggccuccggggccuuucccagggucuucgagaucuugcugagcuggauucccaccacugaaggcacacuggcugucuugcuguuucucagcagcucuacuuuacccuccguacuuguguuuucuccauguagacccuacuguguccuugugcuuuccucccugaccuccuuaaggacuugacauguauugccuugacugcucuuccucagucuaaauuuaccaccuuuuccccuucccuguucacacaacacuuuguaagaugcugugugacggacgcacagccacucccuuuacaaggucugcucccccgagcucagacuuguugagugugggugcuucauccguuuuguauccagcacagagcggacaggugaggcacaucacuaauugcaugagugaaucagcagcgcuugucagucgcuacagggaguaaagaugacggcauacaguuacuguccacauucucaaguggggcaagagagacggcucacguuaagaacacuuguucuugcagaggacacaugcuauauucauuucccaacauaaacacaucaacuuccaguuaguugucuagaacuguacuuucaggggaucuggcacugcuucugaucuccacaggcuccuuuuugcauguauguacauauacauacauucauacaugcgugcacgcguauauacacacacacacaaacacaccuacacacacaacuaaaauuuuuuuuugcuuuguuuuucaagacaggguuucucuauguagaccuggcugucuugaaacucacucuguaccccaggcuggcuuuguacucacagagauucuucugccucugccucugccuccugagugccagcuacaaagauauuugauuuuuuuuuuuuuuuuugguuuuccgagacaggguuucuuugcauagcccuggcuguccuggaacucacucuguagaccaggcuggccuugaacucagaaauccaccuaccucugccucccaacugcuggaacuaaaggcgugcuccaccaccgcccgacuacaaaaauauuaguaaaaaucaaaguauugaaacagauaaauguauccaguguauuugguguauuauuuugaaugacuuuuuugagauauucauaucauuuaaugccauguucaauucacauauuugagguguccuacucaauguauuucagaguauaaccacaauacuaaauuuuggaucauuuuuaucaccuccaaauagcccuucgccauaaucccaucaaucuuuccacucuccucagucuuacauuuuuguuuuggaagguuuaccaguaggcaaaauggaauucucugccuagaaucauaugaaguccauucuuuaucaaaugcuugucauuuaucauagucaagguucagcuauguuguagcauguaucaucuuuucuuccuuucuuuuuccuuucugucuuuuuuuuuaaagcuuuaucauuuaugugcuuuguaucugugcaaauguguguguguguauguguauguacgcacaggcacacacacguagguuccuacagaggcuagccacaagagggaaacauccccuugaagacaucuugucuugugcucuuagggggaauaacuuuuugaccaugaaguaugaggcuagauaauuauggggguaacagaucuuuuucucaucaagaagcgcccuccaaguuccguaacuguucuguuguaaaaagugguacugaauuuucuugugucuuuuuguggcucuugaagcaggcauguggccuuucuguucuguuagggcuucccacaguagcuguucuuuuucucuuuuaagaagaaagcuauuacugugaugcccaugacucuggaugccaaugauucuccuuucuaagccuccauaggagacaagagaauagucacaugcugcucugcacacuguaauugaguuuuagauguuaccaccucuugcauuccugaaacaaaaccuauuuggucguagcuaaugggcuagauucugucugcuaauaugucguucaggacguuuuugguuauauuuauaagauaagcuguucagucuucuguuccuuaggugucuaagggacgauuuacgguagccuauaagcaugugcuaggaugagcugcuugcuggguggcuguggcgcacgccuuuaaucccagcacucgggaggcagaggcaggaggauuucugaguucgaggcaggccuggucuacaaagugaguuccaggacagccagagauacacaaagaaacccugucucgaaaaaccaaaaaaaaaaaaaaaaagucauuacagccauaaaucacaauguucagcugcugccaugccuccguucaacagaggaaagaaccugcuucuuguugggagaggagggcuaauaaaaguaguugcuuguuguguuuaacagaugcuugaagggaaagggaaaaucuccgucaacgacuucauuauaaaggcuucagcuuuggccugucugaaaguucccgaagcaaacucgucuuggauggacacaguuauaaggcaguaaguugcuggagacuccacagugaccugcgcuagcucaugucugcugaccgcagcuagggaugaggagacugugcccguggguaaauggguuugaaacagcacggagcuaucugagacuguggacagcuggccagucuaggcugcgauuccuuauauggacucaguaaaaggaaauugguauaagccacaaucugguuacacugauaaugacugucagaaggaggguagaauccguucccuggucaccaggggguucugucagcgugugacggcuggguacagcgcguuaggucuucggaaccacuuucucaguuaggcguuuucacugauuguuuagaugaagaaucagaggcucagugagcucugugguuuguccgggguuaguaaguugaucagugucaggauuccaacucaagcccuggccuuuucuagaauguagguagguacuuuuauacuauaguuuuuaauuuuuuaaaauuaugugucugagugugccuguggguauggggaugugcaaaugagugcagaugcccaaggaggcccgaggcaccacaucccucagagcuggagcugcugccugacgugggugcugagaaccgagcucgggucucuuccucacccagcuuuaguacaguuauuguuaaccccuuuccucugcacaugcgcacacaaugccccuuacacacggauccucagagaccagccagggguaggcagcagcuagagccuucauucuguguaccuggagauagucuuaggucucagggauugggccuuagucccacauaaguguccccucuuagaugcuauucucagaucuaacagcugacuacaaacagauccccaugucccccucagcaggaccagucacagagcucagagaaaugcucauguaguggugucuuacuggggaaacuguacaaacggaugacauuuaggccaucuugaccuacagagugaaacacguuucaacaaauaaauaaaagccagagaugcugaucuacuccagaaaagacugggagccugucuuaaguuucuccugaggcauggccgccucugaguccugggcacuggugucucucucauggucccaugguaucucagguuuuuuguuuuguuugucucccucccucccucccuccuucccuucuaccuaccuuucuagccccaucccacuuccaccccccccacacacacacacauguacaugugugccauggccaacuucaggacagcuucugggaguccauuuuucuccuuccaccgugugaguucccaggcuuagacugaaggugucagcuugaccgcaggcgccuuuacccacugagccaccuugcccgcccccauccccacagugucccucccuccucucacucuuuuuuccaugugcucaagcuuuguggccuucucugcuccagccaauguacuuguacuuacagcccagucaguuuguuuccugcugauuaugaugguguuuuuucgagcuacuugaugcguuaaucaagaacagcaaggaaaauaagugugaaagcaacuuucugauacauuucuuccccugcccccuucauuuaaaaaaauauauauaagugaaagagaagacacaucaagauguuaacauacaggauagacaucucugaacaauagcacaguucuuucuaaaaugcuguguguaugugugugucugguuagugauacuggguaucagacuuggaacuucgugcauaggcaggugcucgacugccuaaacuccauccuaagcaccgaauagugugugaaguaaauauccaagauccguauuuucuuuaaccuggcacuuuuuagugguuccgcccccucuuccuccuucuuuuggcaaggcagaggauggaggauuugggggagacacuccagcuuuuuuuuuuuuaagauuuauuuauuuauuuauuuauuuuuaugugcauugguauugucccugcauguaugucugagugaggaugccagauccccuggaacuggaguuacagauagcugugagcuggaaauugacccuggguccucugggggaguagccagugcuaucagccaugagcccucccucccccgugcaucucucagucuuuuaugauggugaguuugacuccauuuucuuuuuuaacagaaaucaugugguugacgucaguguugcugucaguaccccugcaggacuuaucaccccuauuguguuuaaugcacacauaaaaggacuggaaaccauugcuagugauguuguuucuuuagccuccaaagcgagagaggguaaacuucagccucaugaguuccagguagggugcuguuccucggcuguauggcuuguauuacuccggagcucagccucguucucuuguugcauuuucuauuuugauucugcuauaucauaugauacuuggucuccaaaacaaagcaauugaauuacaugggaaaaacuaaaagacacauuuucauaauugcaugggaaagccaguacaauuaguugacuuugguuuuuaucauguguccuagucaagacuuucuuaaauaaaaggcuuucucauggccucuuuagagaauauuuguaauuuuauucuugguuauaguaacaauguaaucuauuuuuauacucuuuuccuuuaggguggaacauuuacaaucuccaacuuagggauguuuggaauuaagaauuucucugcaauuauuaauccaccucaggcauguauucuggcaaucggugcuucagaggauaaacugaucccagcagauaaugagaaagggugaguggggaaguggagaggggcugggaaugcgauugcauugugucauuacagauuuuacauguggcuuuuaguggcaucaguaaaugcagugugagauacaauggaagccacuucgauuucacuaaggauuuuaugacuuucaguuguaguugagauguggucuugcgauuucuagaugacagguuggcuuuuuuuuuucuguuucuuuuuucuuuucuuuuuuuugagacaagguuucucugugcugccuuggcuguccuggaaccuacuuuguagaccaggcuggccucgaacucagaaauccaccucccucugccucccaagugcugggauuaaaggcgugugccaccaccacuaccuaccugcauguuuuuucuuagagucagauaguaaauauuuuaguuuucugggccaaaugaucuguucuugaguccuugccauuguacugugacagcaagcaacaacagaauguuaaugacugcuagaaagguagaucugcaucauaucagacaaaagcagaauguuggguaguuuggcggcccuuguuccccuguguguauuaagguuuugacagucugagcuaaagauaaacaguggguggaaccaguuuucauaugcagaucuauaaucacagcuacuugagggccugaaucaagaggauuagaaagcccaccucaacuacauggcaaguucaagaccagccugguuaacugucucagauauuuaaaaauuaguuuuuuguuguuuguuuguuaguauagcauauaagugaccuuaauucugucaucugaaugauaaaagggaaauaaucuaccuggguaggagucagcucguggguggcuguugccuugggcucauugguuuccuucagaauacccacugauguuuuucuuucuagcuuugauguggcuagugugauguccguuacacucagcugugaucaucgaguuguggauggagcaguuggagcccaguggcuugcugaauucaaaaaguaccuugaaaagccuauaacuauguuguuauaauuuacccaagaacuucuacucuuucucugcugacauuauauuuauauguuauuaaagaggugguucuuuuaaaguuucacuaguuaauuuuauuauucaguccagauaauuuauuuguaauagacauaaagaaucuuuuguaaaugccaguuacacccaaauauuguacccuuuaauaauuaaacaucaguuuaaagcuggacacuccuagugcaggggacauguggccuaacucuggugagaaggccuuccuaggggcauaggaugggcaggcucauaaaaguaaccuggaugagaccuuggaguuuagaauuuaauugauucaacuuauuuaagugugaggaguuugaacaaaaguuuuucuuuggaaucuaacccuaguuaaagucuccuguuacaugaucuaaguuuaucacucaaggaaaauaagugaaacuuuaagagucaucauuuucuuagaccucuucaaccaacuguuauuuuuauaugaaucucuaaauaaaauagcuuccccucaagauaaagauauaagcccgcuucuugguauaagugaagauuuauguauuuauuuauaaacaauuucaauguauaacuugagaauucugcaguuuccuccgaauaaaagaacaugcauauugaagugaacacguuguagaaguggagcuuugcuucugagaugagccggauggugacuguacauggacccgagugucacguuauuacuguuaagagaacucggugggaugacuaugaaauguauaugggagaaguguacauauguaauauaugguuuuauuguuuuauaugugccaaaguucacuuaucacgagauacugccugaaaggaaauggaagagaggauguuugugggcauuuugcagugcuacaugcaaugcccagaacaggcaccuggugcugcauccgcagcuacucaaaacgauaaagccggaggauaguucaacaacauagcaagucucugucucaguaaaacaaacaaaaauaauaccccaaacaacaugacaaucugugguuggagaaaguuuuugaaaaaguguauauucaagaguguucucucaccccaguccuaucccgugugaaauaagagcccucagaucccacuggacagaaaaacuuagauaguuuuucuaacucccuccagccugagugcucuuuuguuuuauuauguuucacccuuccguuggagggaagcaggcugacaugcaggauaguaaaaauaaauugggaacagacuuccuguugaugugauguguuuucauaaauguuugggguuacuugugacuuuaaaaauaacccugaccuuguguauaauauggggggccacccccugaaauuugaaguguuucaucgguguugagucuguuucuaaguguucauuaucacauggugcacgacgacacuccaaacuguccacaagccuccaauggccguguuucuguaaagacagucccaugcaggggccugccucuucagcacugagguacugaaaacugcagaaagaauaugcuugcuuaccacaagggcacaucauuagcaugaggcaaaucugaucaaaugugaaauugaaaaaugacuccuucuuugcuaaugcucuuuuguucucuugaaagaaaaauaaaagguugucaucugacaaacauguucucagguaagacugaaucucaccuguaaucgaaaucuggacucagaauaguaacuaaagacguuagaaacaguguuuugggucaagaacaauuguuuaaaaauuaaacauguuuucagugugucugaacuaau

SEQ ID NO: 5091 - RNA, 1594 nt, Mus musculus
aaacaaggcccccagguuuugguuuauucagccccacccagaauuaaaucaaaggcuuugauacaucaagggaccaaaccauacacuguggaccaugcaccgaugccaucucccagggaugcugcucccucuggggugugguggauuuauggaaucaccacgggagguagacaggggauucacugggugcugggucuaucgcuggcagucagggcucaacucuggcuaucucuuccucuuccucggggucaggaggagcaggaagcagggagauguagacuucauugacuuccguguccaaaugccggccaccccgcggcgccuccaaguuaaggaugccaucaugggauagagcagcucgaacccgccagggguccacaucugcaggcaggacauaggugcgacagaacucucgggacacgaagccguggcgauccagacgcugggggugucgggcagacaccuccagcagguuauccacaguccucaccgucaccucaucugggguaaaguggcucacauccagaaacgccuggaacuugccuucacugagccugagcucugaggccccugcccuggcgcccucgccagcucuggcggcccgaggccgaacauaguagccgugauagagggugggggucaggaucucuucuggcaggaggccugguugggggguugggggugcagagagagaaagagaaagagaaagcaagaggcaggaugaggguggaugcagugggcacagggaugaaaggcgauaucuggagacaugggccagaagagcaggugggaacugcugaagaggggcugggaaaggaaaggagauagccauggaggaagcgagcuggaauugggaggacagacgcgaaaucagaagguacucugaagccugcaaagcccaguuacccaaaacccuaccggucuaaaguuuauccugaggucuguagcaagaccagagagagucuugcuugacgggggaaucuggaaugggagaugguucaccucaggaguucacuuaagccccagguagaguggaggccaguaaagcugggcagugagcccagaauuucaggaggugggggugggaggcagcaucugaguccuaccuucuccgaagcgcugcucgcccagacggcugggguuggcaaauucguacucggcaguggcugggugggcguguggcacugugcggcccgacaugacugcuguugcgacuaguagcccugaucccaaguacugccccaacaagaucaaggcgaccccaccggcuucagggagagccagggcucagucagagugggggcggggucuacaccacccaaaauagugcagagccucugggggugggggagggcugggagccuaagucuagagugcagcuaugagggugugaucagccuggacccccuaaguccccuccucugcacacccuucagcugucgcaggggccugguaggacagcugaggguccugguccuggagugagcuccugcucugcaggagggcaaggagaggccuaguugggccuucaccaguuguacauuccacaucacccuuuguccuucucagucucaggcacugugcacauuacuua

SEQ ID NO: 5092 - RNA, 5477 nt, Mus musculus
uggauuuauggaaucaccacgggagguagacaggggauucacugggugcugggucuaucgcuggcagucagggcucaacucuggcuaucucuuccucuuccucggggucaggaggagcaggaagcagggagauguagacuucauugacuuccguguccaaaugccggccaccccgcggcgccuccaaguuaaggaugccaucaugggauagagcagcucgaacccgccagggguccacaucugcaggcaggacauaggugcgacagaacucucgggacacgaagccguggcgauccagacgcugggggugucgggcagacaccuccagcagguuauccacaguccucaccgucaccucaucugggguaaaguggcucacauccagaaacgccuggaacuugccuucacugagccugagcucugaggccccugcccuggcgcccucgccagcucuggcggcccgaggccgaacauaguagccgugauagagggugggggucaggaucucuucuggcaggaggccugguugggggguugggggugcagagagagaaagagaaagagaaagcaagaggcaggaugaggguggaugcagugggcacagggaugaaaggcgauaucuggagacaugggccagaagagcaggugggaacugcugaagaggggcugggaaaggaaaggagauagccauggaggaagcgagcuggaauugggaggacagacgcgaaaucagaagguacucugaagccugcaaagcccaguuacccaaaacccuaccggucuaaaguuuauccugaggucuguagcaagaccagagagagucuugcuugacgggggaaucuggaaugggagaugguucaccucaggaguucacuuaagccccagguagaguggaggccaguaaagcugggcagugagcccagaauuucaggaggugggggugggaggcagcaucugaguccuaccuucuccgaagcgcugcucgcccagacggcugggguuggcaaauucguacucggcaguggcugggugggcguguggcacugugcggcccgacaugacugcuguugcgacuaguagcccugaucccaaguacugccccaacaagaucaaggcgaccccaccggcuucagggagagccagggcucagucagagugggggcggggucuacaccacccaaaauagugcagagccucugggggugggggagggcugggagccuaagucuagagugcagcuaugagggugugaucagccuggacccccuaaguccccuccucugcacacccuucagcugucgcaggggccugguaggacagcugaggguccugguccuggagugagcuccugcucugcaggagggcaaggagaggccuaguugggccuucaccaguuguacauuccacaucacccuuuguccuucucagucucaggcacugugcacauuacuuaaaaaaaaaaaaaaagacuuaauguucuaugagccacauagcauccacaaugcaagaaacauuuucugucuuuguaaggucagugucuucugaaccuagaucagcucaggguuccagucagacaccuaguucugcucuccucuaggacuccacaaagaguuaaugucccuggggcuaagccuaggaagauuccagucccugcccaggcccaagauaguugcuggcucaauuccccuggcaugcgagacuggagaggaggaggggcccaccagcagcugcuugggauuccaggcuccguccuagcuccagagaacaaggauggggugggugccacuggguguggacagagagcuagugaaacaagaccaugacaagucaccggucagcucagcccugccuguguuucucuuuucuuagcucagugaguaccggguaugugucacccugccaaaucccugaucacaagucuccaugaacuggcggugagcugggauaauaaaaccccugaccucaccauuccagaagcuucagaagacugcauauauaaggggccggcuggagcugcugcugaaggaguugaccagccaaccgacucugcauucaucuagccacaauggacaucgccauccaccaccccuggauccggcgccccuucuuccccuuccacuccccaagccgccucuucgaccaguucuucggagagcaccuguuggagucugaccucuucucaacagccacuucccugagccccuucuaccuucggccacccuccuuccugcgggcacccagcuggauugacaccggacucucagaggugagucugccuaugccagggcaggggugaguguccguccuggacccucagucccuuuucccuuucacccacccccaagccauuuuaggcaucugugagugugugcuaagguacagaggggaaaugaagcuacuguuuucuucuuucuucgggcaccuguuucuguuugaugcucgguuuccugguccauuuuucugugcauggugagggucauagucugucuccuaaugauggagcaggaugcuuauuucuguuauuucugguuugcuucagcuccuuuacuuaccucuucaauagucauggucugggaggauuuuaucaucucaaacuguaaagaucagauagaaacccacucauccuggacuuuuucugcucucucucucucucucucucucucucaucccuugucuaugauuuucuggguuccuuggggcugagacagugcacuaacuucaguccaugccuuaagaggagugacuguccgaccacucucgggaaacccugacuuauccuaacugggugggagauaagauuaacagagcugucacagauaacacucugguuuaaaaauauucgagugugaggaaacaggagcugagugagcaagggcuuuggaaggacaggaccagcagaacauuccagaucgaguggguuggaaacuuggcagggagcugaacaaggaaaagggggccuuugucuuauagacaaaugacaaagccagcauuggggagcgaggcagcagaugccaugcccagauccauccuugugacuaguccccuaaugaccugucuucuucccugugccucuaagaaaaguuugggacugaugaccaagaggcguccuuugcauaucacuacgguagcucacaugcaccagagucgcuauucaaaggggagggggcguguuuucccccagcagucaaguggagcaugaauuaccuggacaggaaguaaaucugcugaacgaugagccuucuccagcuuaauaaacguucuacuaucuccucuccuccuccuguccccuuguuauucuagaugcguuuggagaaggacagauucucugugaaucuggacgugaagcacuucucuccggaggaacucaaagucaagguucugggggacgugauugagguccacggcaagcacgaagaacgccagguguguggaccucuccguccucuuuugugaauccacuuugugcacacugggugccagguacugccaccagccucugaggcuggcagaauuccaggccccaaacauaagugacuagaucgggaguuacagaucaauggcugggaagcuaagcuagggcucgcugugcugauaguguugugguugugcugagagaaguuuucccuugcuguuccuuuugauugccuugucuuguccagugacacuaggauaucagaacaguucccaaaauuccaaagcacaccuuaggccaauuaaaucugaaguuuuaggacuauaacucaagcaucaacaugaaaaaacaaacaaacaaaagcccaaaaaacuccuuggguccuuucaguacuacaaacuggcaaccguugaccuaggcacaggauguuauagauaaugguuguugugcauaaugaccauaaccgcaggguugaaggcaguaagucuguggcuuugugauguucgggauuccauguugcuucugcucaguuuaaugcuaagcuacuugguuggucugcuuuucagagcuucuucagucuuauggcugugaggaagccaguuaauugagauuuguuuguauggauccuugggauucagaaggcaucagaauuagcaucaacaauucuucuugcauuuuuggccauuuuuuuccuugacucccuaaaaagguguuaugauuucuucuuaaaaauuaaugacuugggggcuggagagaugacucaguaguuaagagcaguuaagacugcuugcucuuccagagguccugcguucaagucccagcaaccucauauugguuuacagccaucuauaaugagaucugaugcccucuucuggcaugcagguguacaugaagauagagcacucauauacauaaaacaaauaaauaaaucuuuuuaaaaaaaucaauagcucacccgggcagugguggcgcaugccuuuaaucccagcacuugggaggcagaggcagguagauucugagcuugaagccugccuggucuauagaaugaguuccaggagaacuggggcucaacagagaaaccauacuuaucucaaacaaaacaaaaaacaaaaauuaauaacucaauuuugcucagaauuuaggacuggaccacagugccacacauagagucaucuuauauaauaucagcaaccccaugggcuaggaacauuuggagacauuccugcacaauucggaacauuuaugggccuccuaaaggauuuuuggcaucagacagauccucaaugccaaagugggaguccaaacucuauggguccagccaccauggauucauuccuuuguggaaagugccccgaauuguaacugugucucgagauaggaagaucaaugaaguucaggacuguuucagauuuccuagacucugauuggacaguuuaugcuagccuuaaaccuggacaaacagcucuagacuuagcuaucugcauauuuacaguguuggagaugaacucggggccuuucaccacuagacuguauccccagcuccggauaucucuuuuuaucuuagggccuuuugaucuaacccaagggagagggaugucugaacuuggggcaaauggugguauuuccuguucuuauuucucugcuuuguccuuuauucucuuggauuaggacgaacauggcuucaucuccagggaguuccacaggaaguaccggaucccagccgauguggauccucucaccaucacuucaucccugucaucugauggaguccucacugugaauggaccaaggaaacaggugucuggcccugagcgcaccauucccaucacccgugaagagaagccugcugucgccgcagccccuaagaaguagauccccuuuccucauugaguuuuuuuuaaaacaaggaaguuucccaucagugauugaaaaucugugacuagugcugaagcuuauuaaugcuaagggcuggcccagauuauuaagcuaauaaaaauaucauucagcaacaaaccugccucguguuugcaaacucaaguguguuuuaaauaaaucugcaaaugua

SEQ ID NO: 5093 - RNA, 5115 nt, Mus musculus
uaagaaaugugcgccccggagagcgccggcagguaagccggaggagaccaugcuuccccggcgccuccuguuggucggggaggggaauuucuccuucgccgcuucucugaucgacggccuggaucccagcgucaguguuaccgcuaccggcuuccagcaccgggcggcucuggagggagauccgguagcgcuagagaaccuaaagcgccugcgcgaacgagguagcaagucccagcccgccccgagggcccgcccggagcguaaggguguggcucgcgcggggaacucgagggcgccuccugggggcgcucaggcggaugcgcgugugugcucaggucugggcugggcugcauuguuggcaacccaaccaugcauugaguggugguguuuguccagguuuacagaucuuaagacgucuuuuggucucuauuucacgccuuuaaaccuugccaggugucgaagugcguuuugguguggacuguacccagcugucacaugccuugccagccgacgauagggauuuugaucgaauuuauuucaacuucccgcacuguggacgaaaagcuggaguagcuaagaacagggaacugcuugccaaguuuuuccagaggugaggcaagacgaguccuggcauagaaaauguuuccagguucccauaaccaaaucacugcacacaaacuuugucguuggggaaauaaguugcuagaauacacgaggaaagaagauaaaacccagagaaaaccauaaucuugucuuaaagauuuacguauaacccuagauguuaaaguauaaauuacaaggaaaaggcaaguuuauuuuucaaaaauuaguguguguaugaguguggcggucagagaacaacuuacagaagcggguccuccuuccaucguguauccaggagauagaacuuuggcuacuaggcuugguggcaagcaccauuacccaaauuguguguguguguguguguguguuuuuaaauauggauauggguguuuugucggcaugcaugucugugcaacaguugugugccuccuuagaggacauugguuccccugggacuagaguacugauuggugucgccaucauauggguacugaaaauugaacuuuugaacagcuagugcucuuaacugcugaaucuuucagcccaccucaaaaagguuuuaaaaaaugcaaaucguaagagucaguauagcuugaugacgacaagauuggauuuaagagucacauggccuagguucaaauccuagcucgcugcuuaccaguuaaaacugucgucagguguagcccuuaccugcuucuccucccaccccaaucuauaaacuggcuauuaauagcagcuuaaagugauuaugaauuuaaaauaguacuuuaacaucaguauuccaaacuguauucggcuccacugggcuauagguguugagaaacuuuuagcaaaggcaguauuuuaagugggaguugaaguauagaugaguguguauggugauuauuagagccagagccuugugcauggugauagugcucagcccagcccugagcuauagaauaggcagagagcaguaaggaaucuuuucaugggaagaagcaacgcaaauagugaauuauauauaggagcuuuacggauuuuggccuuucuguggcauacaggaaaacaaugcaaaugccaagcuggugacuagugcuguugugggggcacugguagacuuuuuauaugcuauagguuuauagagcacuauagguauagaguucuauagguuucauagagcacugcaaauaagauuaauuuuaauuauuucagaguuacaccaugugcauauuguugauucccuugguaguuucugucucugauacacuucuggugucugucccccuuaagcugugcugauguccuugcaaaggcaggagaaguccaugugacacugugcagaggacaagguggaacgccugcugacaagccucagagagaguggcacaacaguuggcaaguaguugccauggcagcccugggaggguucauuuuaagugaugugugucccuuuagcugugaggcugugccaggauacaagugcacuggguauagguaaguaagaccaugggccuaaaccuucuccccuuucgucuuuugcaugaaguauuaaaaaaaaaaaucaaaagccagacuuuuuguuuccaagauucuaauguaguuucaaaaauacuuguuuaccaguggaagccuucauauauauacauauauauauacguguauauauauauacacacacacaaacacacacacauauauguacacauuuguauguauuauaaauguauauggauguauauuauuuauguguguauaguuaauuuaaacuaagauguaaauaauauuuaaaggaguuauucguucauuuggcaggagccaggauaggcccuuucacauagaaggugcuuugaccuauaucuucacccagagcuuacccuuugagagcugucagcccagaacuuucagagucagacuggaggaccggugguuuuacuuuacagaaccagaagcacuuccaggaaagcugaacagguaaucuuaccuguguugauggucugccugcacgucugucugagggugccaguccacuggaacuggagugacagauaggugugagcuggccuguggguacugggaauugaacuccgguucucuggagaagcagccagugcucuugaccucugagccaucucuccagcccugcagauaaucuuucauuuagcugggacucucuucugucccuagcuguaccaugauugucuuagugguuacugcauuuugaauggaugauggaugauguugguacuguggguacuugucaggcuguuagaauauagggggugguggcagauuauaugcuaauucccaggccuggaaguguagaguaacuuaccuagcaugcccaagacccagaauuugcaccugucauugcagaaaacaaaacaaaaauuaaaaaaacaaaaacaaaacaaaaccaaacccaaacaaaaaccaagcccaaaccaaacccaaaccaaacccaaaaauguccaugcuauuucuucauaugacagaugacuuauuuucagggucaguuuaaggauacuuguuuucuguagaagagcagaugacuuuaauucuagcaguuguaauuauuauugucagugagaaguuauuuuauguguuuaaacaggagguuccuugaagcaucuuccugucauccuaucagaaccaucaaugagaaacucauugccgaauugggcaaaacuuuucccuuaaaaaggcugaaguguccccucccuuuguugucacggggaggccccagugucuuccuaccagcgaccugugaccuccugccuaccuuuuggauucgucuacaugaagauaacucauguucugaguuccagaauggugaaauaacacaagaaauggaagaaauuccugugucaguuucagaauguacccuuccggagaguccugugagagauggcugcaaaggugcucaggagggaaucuguggccgggucaagcuuggccucaggccuucucuucuuguucauguugaagcugucauccauuccccagacuuccucccagccucucugcauguccucaguggaccugucuuucggaagugccacaucuuaccuuucaugaugccagcauuucacgagacuuuauucauccuuggauuugauaacaauaugaaggagaguugccuuccgucgcugcugggucaccugaaggaugcucuggguaaccuucugacucagacauugcaggagggcucuaguuugggcacuucgguggaauuuguccuucaaccaaacggaaaggauuauauaauucaugugaagucucuuaauuuuggcccagauugugcugagaaucugauuauuggaucuauucucacaucuaagauuguuaaacauaagcaucaguguuucguguuuguuucuauaaacuuggacuuauuaguuaugcuugccuaugguauuucugauuggagaauuuuguggacuuuugauaaccguuuccugaagagauuugccccugggaaaauagaacacuuuaaaagcuauucucuguauccgcccugcuaugugcaugacguuaguuucuggguagaugaaaagaaagcauuugaugaacuggaguuucacacuguggcccgagcggugucucaggacacugucgugucuguacaguaccgugaucguuuucagcauccagagacucggcaggucagucucugcuauagacugaccuaucagacuugugauaaggcucucaccccacagcuggcagcagcaaugcagucccaguucagaaaagagauucaaagacagcuacauguuucaccucgauagguuagugacagcuuucugcaguguuuguuguaugugggugaaaaagaacaacuugaaacuuguuccuuucuggacucuugugguuuuguuuuguguuuguguguguguguaaaaaaguuuuguuuuuguuuuugauuuuguuuuuuuuuuugugugugugacccaaguaguguugauggccccuaaagaugccugugaacaucauuuaaugcauaggcuggcuggccguggagguagugguggugcccuuugaucccgaugcuuaggagaccugccaaggcuacauagugagaccuugucuuaaaaaaccaaaccagguggggcagucucuggauggccauuccuucagucucugcucuauacuuugucucuguaucuccucccauggguauuuuguucccccuucuaagaaggacugaaguauccacaguuuggucuuccuucuucuugaguuucuuguguuuugugaauuguaucuuggguauucugaacuuugggcuacuauccacuuaucagugagugcauaucauguguguucuuuugugauuggguuaccucacucaagauaauauccuucagauccauccauuugccuaagaauuucaugaauucauuguuuuuaauagcugaguacuccauuguguaaaauuuucuguacacauuuucuguauccauuccucuguugagggacaucuggguucuuuccagcuucuggcuauuauaaauaaggcugcuaugaaca

SEQ ID NO: 5094 - RNA, 1001 nt, Mus musculus
uuuuuaacauaaagauuuuuuguaucagucguuaaggauuaaggugaaacuucucuguuaaauguugaccuugccuuugccuuuugcaucugagauaguuucauagcugaaggccuuuugaggauuaucuagaugaagacagucuccuaguguuuuccugguggaugucccguuacuguuuucugugcaccugaguggggaguuaguggcauucucacccucuuuguucagggccaucugcuugcaaguuuccaagcugagacuugaguaaagggauugagagaccuuuaguuauaaauuucuugcuucagacugacuugugaccucugcuccugcccccaacugaaguucuagcagaaaucauguuuucuucaaguguaauguuuuucuggugaucuggggugaaggguugucuguuaagcaacagguccgccauguguucuuuucauucuucucgcuugugucucugacaguuggcagcuucaguucauuccaucagaguucagaggucagcuaccaaagccuuucgcagagggaccacuggccaccaggacuguucccacucacaugaacgaccagaaccgagaggagccuuccagauacguaagggcugccaaucuucucuugcugcugccuagagagacagucaccccagaucacuaggcauuguuccguuggagcauuaaccaaacgagugucucagaaagcuauuucucagagagacagagagagagagagagagacagagacacagagagagagaaagaacgaugcaugcguggagggaguggcagcauccccucuucccaauuuacucucuuaaaugucuguggaaagcacacaguugaguuaacugagaaggcugagaggggcuggggucuucucaugagagucuugagcagucuuucugaguacauugaaacccacagcauuccuuguucuguugaaacgccugcugguacaguucuaagugagcgguucuaagugagcggguuaccuug

SEQ ID NO: 5095 - RNA, 1001 nt, Mus musculus
caagguaacccgcucacuuagaaccgcucacuuagaacuguaccagcaggcguuucaacagaacaaggaaugcuguggguuucaauguacucagaaagacugcucaagacucucaugagaagaccccagccccucucagccuucucaguuaacucaacugugugcuuuccacagacauuuaagagaguaaauugggaagaggggaugcugccacucccuccacgcaugcaucguucuuucucucucucugugucucugucucucucucucucucucugucucucugagaaauagcuuucugagacacucguuugguuaaugcuccaacggaacaaugccuagugaucuggggugacugucucucuaggcagcagcaagagaagauuggcagcccuuacguaucuggaaggcuccucucgguucuggucguucaugugagugggaacaguccugguggccaguggucccucugcgaaaggcuuugguagcugaccucugaacucugauggaaugaacugaagcugccaacugucagagacacaagcgagaagaaugaaaagaacacauggcggaccuguugcuuaacagacaacccuucaccccagaucaccagaaaaacauuacacuugaagaaaacaugauuucugcuagaacuucaguugggggcaggagcagaggucacaagucagucugaagcaagaaauuuauaacuaaaggucucucaaucccuuuacucaagucucagcuuggaaacuugcaagcagauggcccugaacaaagagggugagaaugccacuaacuccccacucaggugcacagaaaacaguaacgggacauccaccaggaaaacacuaggagacugucuucaucuagauaauccucaaaaggccuucagcuaugaaacuaucucagaugcaaaaggcaaaggcaaggucaacauuuaacagagaaguuucaccuuaauccuuaacgacugauacaaaaaaucuuuauguuaaaaa

SEQ ID NO: 5096 - RNA, 49195 nt, Mus musculus
aguacgugugcugacccaaucuaggugguaggaaucaccuagauucaagcucugacucuuaaacaacuucauuaugugauuuaaaaagaagaagaaaagacagguuagucuaaucucuggggagaauugcagagaauugcagccuguacuccuuauuacugaauucagguuuagcagcgggcacgcuuuuaaaucaggguggugguuggucacaaucuuuaggucauuuuccuagucuggcauucugggaaagacauuugaacuccuccuguaaguuacuaggaagccgcuccaccagagggaaccuucuuacguguugugccucccagggucggguggaugagacucacugagguuccauaacaaccugccuaauaccagucugcuaggcuccucaggcaacugaggaagcuggagugggcgugugcucagcuuuaaugguccgugacaggaagaucaaggcuucuguaaggcgaugacuggguuuccuggcuucgcuggcgugucuguaaaucuuuaauuaucccagccucugagagcagguaauuccuaauggaaaugacaucaggaaucagcagugugcugcccgacaccagugccauccaguucuucccccuuccugguccuagugcuuuauuucaugugucccugugaaagaaaacgucaauacauuuugacaguuuaauucuuuugagacaggguuucucuguguagcccuggcuauccuggaacucccucuguagaccaggcugccuuaaaacugagagaucugccugcuucugccucccgaguguuagaauuaaagacaugcgccaccauccuagguuuggucuuccuuuucucaggcaugggccaccaccgcccuaggcucaauuucccuuuccuuaaggugacuccuuuugcauucagcuucuagucuucauugggaauuggaaacagagcagcugcugugucccccacugcuggcucaguucauagaugugacacuacaggucaaaggacucagacuuuggggagacggcuucuggaaucagugaaguuggguuuacuccucucaggagaagcggagcacaacaggaaugcauuuuugagccuugugcuggaaagagacugugccguaggccccgcuuaccucaccgcaugggcaucuggaguacuugagucuaguuuucauaaaaaucucaauccaguuacagccaccauuuggauaauuuccccccuggggaggugauagaucuccuuuuauucuuuauuauuuuuuacugccauuuucuugucuugcucuucacauccaaacuugucaccugguucugugucauuacuuuuaauuucucuucucucgugaccccagguguccugagguuuaauuugauuuauuccucccauguuacuuuagaugcuuuuauuaauuuaauuccaggugugaacaggccacugcucuguguuguguaggacaccacccuucuccuuucugucagcuuccuuuucuguagagcgaugucuaagaacccucucuagacuuaagaccccugugaggacuuccuuuucugcccuuuacuaggaacagacagcuuuaagcagaacccuuguaaaccuguuucaguguuaauuggcccuauggugcagacucaaugcuguuguauuccagagcucaggggccccaacauuuucaucucuuguauguuuauugacaacugagaaaguaaaauccaccuuuucacuaacuaacaggcagcucuugcuuucaacuuggcacagauuuuuaauuuucaguuuuugagacaggguuucagucuauagccuagacuggccuggagcucagucuguagcccaggcuggccuagggcucacagcaguccugccucagccugccuguguggccaucagcgugagucaccaugcuuagcaucuccauuugaauucuuagaacagaaaaugcagcaaaucagaagucuugaggacuccaagggcagcucuuacuuaagcgugcauguguguguaugugugugugcguaugugugugcgugugcauagccuagcaguuccgaacuccagacuuugucaugagagcacauuccccaggauugcaucugaaaagcuucacgacauauuuacauuuguauguuuccugauuuuggagggccagacuuggcacagaugaccuuuugaaugagucuggcuuagcaaaccuguccuguagguguggggagccauuagguccucccuguccccuguccuuuguagaagauguccaaccgcaaccuggguuuguauucacacauucaggccagauauuaaguggcaaauaauauuuaaagcugagaucugcccugggucucccagcuguggaauuccaccuagaccugaaauucaaacaaacuuaaacagacacaugugagcaacggaaggagggaaacucagagaggggaugugaggguguggagggggagugcaaggacacgggacauuuccuguuggagcuuucuaaccugaauaguguguguguaaacgagcaacuuggguguaaguggccauuucacuugaguguguggguauuuuuuuaucuugaaaucuaagugcaucuugaaguaucuuuaaaaucaaggaaaguggggagggacuuuuguuugcuuuugcuuuuguuugcaauuucuuacaugcagguaagaagcauaaacuagguaacuuuuugaugggccuuagagcaagccgaagggagaagauucaggcagauuuccucaccguggggcuccucagggaccugccuaaccggguccagacagcaccugcggugagaagggccccaucuacauuuauagaacuggagcaacuggcccccugaccuucaaccuucggccagucauuuaaccagccagucauuugcauugccaaaugagaagaguggggccucuccauuuauuuaccgacuguuuuagaagccuugugcccagcccuggagaaaacauaaccaguaaagcagccauagcuggccagaacugcgcaguccucucucgggcgugucagaguuaguggccugggugagcacaggccccaucauccuuagaaagcucuggaugguuuuucuagugugaacccagaauucagcaccacugcccuugauaaagcccagguaagccucacacugaagaccacagcuaauguggaaggcagagugcuaaugcucuuuucuaauuggcaaccccuagucuuuagcccuuaucugggccucucccuucucuaggccuuaccugcucugucuucuaugcccucugggauccuuuuuuuuuuuuuuucuggacaacaguugacuaaugugacacugauacauacuaauggaugcugcuugucuccuguaagguucauucuuuccacuuaacacuucuagaaaaaaaacaacaacauuuggucaucuauggauuuauguauuagauaggaaaagaaagugugaguaggcagacuccaccuaccccagggcuuggcccugcuuucuccuucaggcaaggcccugcgugagcaagaccguuggggugagaugugugcagggacugagcgucuucccuucucaggcucagccuggagccagcuuuguuugguugucaggcacaguuaccuuuccuguggagcugggaagaccucacuuccuugucuugcuacagguugcagacauucuuuuugcagcugcugcuagcucccucagucucgagagcaaagguuaaucccauuuugccaggagugaccugaaguguguccacucaaccaccaagaagacaccacguaccacucugcaugccaccucuuucuugucuauaacagcgugccucuaaguuucccuggaauagccuguaggguguuuccauucucuuuccagagagauacagugugccuuaguaggccauuuagaagagaaucuuagaaacuuuccagauccugccuggucccauuuucuugggcuucuauauuugcaacgucacgcuugugaugacugguauucaacaaugagugucucugugugugcaugugguaccgagauuaaagguguggcaacaccuuugcuucaguuuuauccuucugagggcuuacuuacacaguccugucuauguagccaucauggagacucaauuguguccagcagagggcgcccuuucacuuaaaaucgcagaguuccuuuuccuccaggaacuuaguugauuuggugguugcuguauucccagcauguguugaaauauccaagcugagugcuuugagauguguccuuauauugccucgugcauuucuacagaugcagauguuuacuguguagaugaauugcccacuacaccuccgauucgauucccuaguugguaggcaaucuuguaaguugcuacuucucuguuaguuucaauuauauuuguuauguccuugauuguauuuguagguaauaaaagacaguguucuugaagagggaggucucuuaaggggcaaugaccugauaccugcccacuuuuaagcauggacauagagcaaaccuuuccacauacacacuccuaacccuaccacuguuggcuugcugauacuggcacgggcagucuggaggauauaugaauauccugaguucucgccuucuggugccgacaugucguuuacagcacaguagcucagugcuuagcagggugugagcuuugugcaguaagaggccuuagaacacuuuugaugauaacuccucacgccuagcacacaacgcaaaaagcaaacauuugcagaaggaaguaguagucacauuuuaaacgugcaggugacuguauaggcagauucaggacuugaauagagucagcugugccagauacggaaugaggauccgcuccuucaggugugccaccugauauuuguuuuagcuuaaccccagagagacuguauggauugaggcugguguuuucugugugguuuggggaaggguuuuuuguuugauugguuuuuuuuagaccccucuagauugaguuugugggaaaacaucugaagacuagcugaugguaaagccugggauuguagcucaguucagagcccucgcagucccugaccacugccucuuuccuuguggauggggaagcggauacucauagacuccaucccccucggccauuccuccguuugucccuccccuuggaauccaacucgggaugucagcuaugguagacagcgcucggcugcugggcuccuccccagccagugcgucaggaccugcucgaagucugcuauccuucaccuccuuugggaugcuaggauggagagcccggaagaguagaugagcaaaagaaagaucuagucaaggccaguacgcuuuuguuuguaagccacuuuaauccccuucaguaaccccagccuggaguuugcagacagcacccucagccuuuguugggggcuuuccuagagcacgcggaccccagcuaaaucgaaucucauagucagaucagagcaggagcagacuuccugaaguccuagaaauuaguauacauuuuggucugugguuacaagucucagcuauauuucugccaaguuaugagaggcaugugcaggggagcuuggcacagguccuuuuuuaugacuggcgacucuccuaacaguuccccgagcagcucugaaaaggaaguaagaaggaacaucacccggggguggggcaggaggguggcaucaggcaagagcacccuggagagcaggaacaugugagaguaagucucgcuuuugugaggucaaaucucugguugggaacaauagugcagguugcugagggucgcugcuuaagcugacugggccuacuaucaguugugauaagacgcuucuaagauaagaguggggaaggaaagcuaggcucuaccccgugggcacaguggaacugagcagagaauagcugggcauguauggaugccauaggugaggccagcucagggaggcugcaguacagugauggagccccaaauguauguaacagucuuuauguuucacauucuaaaagcuuagcugcagugagucuagugacaaaagggggggggcauuaucugaaauacagaaaaauggaugauauuugaauaagaucuagagagagacagagagggaauguguauguguguauaauaucacugacuggcuucaaacuuguagagacccucgugugcccauucuuucugagugagugcuaaggugaaaggggaacgcagugacuuguuuuuccuuaagauaagguuggcuggaacucuuuuuuaaaaaagaauuauuuauuuuauguauaugaguacacugcagcugucuucagacucaccagaagagggcauggaucccauuacagacgguagugagccaccaugugguugcugggacuugaacucaggaccucuggacaggcagucggugcccuggcuggaacuugaccuuccuauuucuacccuccgagugcugcucuguaggugcucgcugccguacccugcucugagcauccuaugaauguaaucuucugaacaaccacacaaaguaaagcagacagacuauagauacacaaaccaagacucagagagaguaauuugcccugcaccauacagcuggcugugguagaaauggcaucgcagcccuacagugucccuggcucccagaauguccucucaguggucauagguaguaccccaaaccugaccuaacuaggccaguucuuuuauucuucuuaccaagaauucaagugguguuuuacucuagacacccaggggaugaggggcagaagaacagcugccacgcuccugaguccugaaaccgucccaucgcugggugcccucagcuaaguccucugcucacuguuggaguacugcagucuagagaagguggggagggggacuugccaugaagagaaaagagggaaagaaggugaaaagaucgauaugaaacugaggggaagauauucgcauuccuuaggaugagacaguguuccuguaacacaagcguaagccaccaccagagccaccauggaaaaugcuauguuguaaugaauuaagcauggacaugggagucaguuuacagagucacccugcuaaaugaagguacagaucuguuuauccauaggucucauauccacagauccaaaugagaguuuacugaccacggacagacuucuuuccuugucauuaugccuaaauagauaguuacagcauugacuguguuaggggaaaugaccuggagaugguuuaaaacacauggcugggugcagacuguacacagguucugaaccauuuuauagaagugccgugagcaccacuggcuuuuggcacagaaguguguccugcaaccaagcccuugacugaugcuaagggaugccagucaugggaaggcaccgugugacucagcuccauucacuacccaagagagucaucccuuucuuguuggugcuguuagugaaacacaagucuaggggcgcuguaacccacaggucucgcucugcccuagccagugacugugggugggacuggcauuugccauugugccuguuuguagaccucugucuguggaagaggcaaagggcccacugaagaugaugaugucauucagaguucccuaggcuugguccuuugcugugugacggagagagagcugugaaggcugcggcuuccuccagccugugaauucauauucuugcuguguuauuguacaggaacugggcaagucuaaucuugccguccuucacuucacaccggcugagugaagggccguguggguguggagcucugcuuucguacugagaccgucucguuuccgggggcuaccuucgguccucgguauagacucagcugcugccccugggcucccuggucaucaguuuuuuuguagugugugugggauguggagaggaagcugagcagccuuggagaggagauggggguauggaagcaguucaacgccacaggcuguguugguagcgcauggcaggcugccaggaauuaacuucuuaaucaggcaaagcccauagccaguaggaaagaauugcuuauugauuagcaguuagcguuaguacuugcuuuuccuggacagagguggacucugaagaguuuaguucuuuucugagccggugcuuguugcuugaccugguaauugucuuuccagauaaaccuuuuaauuaguuucaaacaucugucacauuaaagucucuggagaguccuggaagaugucugacuccaggauuagggacucugacucaguaagucugaggucgagcccaggaacugcacaggguguuacuguauagcccaugcuggucuggagcucacagaauccaccugcuucugucuccuuagugcugggaugcauuaaguuauuauuuuuuuucuuuuuagagagcacaugugugugguagggcaccugugagggugucuugcuucaucauucucuaccauguauucccuuaagacagccagcaucgcugggcgugguggcgcacgccuuugaucccagcacucgggaggcagaggcaggcggauuucugaguuugaggccagccuggucuacaaagugaguuccaggacagccaggacuacacacugucucaaaaaaaccaaaaaaaaaaaaaaaaaaaaaaaaagaagacagcaucuuucacucaacccagagcugggcuggcagacaacaagccccauguuauguagccauugcucuuucucacccacugaaccgucucccuaguuaacuuuucauuuucauccuguagauuaaguccaaagccucgagcauaugacguacaugcucuguugcugagcuacauccaugggcccaggaauguacauuugugacccucagucgaaggucaguaggucagauuuccccagugucugccucuggacugggccccuuucucccugcuguggcccaguuucauuguuugcggaaggguuuauuagcaucucugcuuuauuaccuguucuguucucauagcuucacagucacuggaguaggaaccaggugcuuagcuccguuuuacaggggugaggggguggagaguugaggcguggggaggagguaggucacaaugaaucagagacagcugggaauugaagucuggccucugugacucucaaaccaggcaauuucuaggcccuuguuuccacgguuugugauuucacguuugaucauagucauucccuaggccuccgcucaucgugcuugggcgagcagguuacagcugacucugaagcagacuaccuuagugccggugugucaaguuuaugagccugucacagugugggacugacuaguccucuccucucugugcuugcuugcuucuaucacuuuggaacacauuuuagauaagggccuagagggggacggaguagugucugcagcaugcuggacauguacagacaggaucacaggcuggagcaucccgugccuggcuggacccaucagggucucucugugaacccuggccagccuagagcugucugugcucucuugccacugucuccuaagcacugagacugugagcaugcaccuggguguacuuuuuuggggaguugggggacagggucuuacuccaaggucuguagccuugggugaccuggagcucacuauguagagcaggcggguuucaaguucacaaagcccccaccugccucucugucuuccucgugcugggguuaaaggcaugaacccuuaaacauggcuggauccauuuuuaaagacaaaaaaaaaaaaaaaucccgagaacucagucaaauuauuaaauguuacuuaaauuuucaaauauaaaccaacauuauguucucuuaaaacuagucuuuauacagcuacaaaaccagauuuacaaguuaaauauacaugaagccacaaggccaauauuauuaaaaucaauaauguugauauuuuuguaauuuaguaugacaaaugugucugacacuaaagccaagccacgcuuugggagucugggcuugcuggcccaagcucagcuucucuaggcuuugcucugcucaugccuccaguuucucccccuuuuuuuuuuuuuuuuuuuuuuuaccuuguuuagagccauugagacuguaauugcaugguacccucugucuuccauuuugugcauaaaaacauauuuuucauuuagcuuccaccucuguucauuucuuaggagcccagaacaaugaaagcugugcugaaacucacgcaaauacgggugcugaaauccugugcagggcugauucagguagucccugggggccagcuagauggcucaguggauaaaggcaugugucaccaaaccugacaaccagaguucaguuacuggaacccacuugguagaaguagauaacccacuccgcaagcuguccucugacuacacuuguucaguggcucauguguguacauaccacacauauacacaguuuuuguaauuaaaaaagauagccaccccagcaguccagaccaugccuuaaguaagugaaucuaaaaauuaucaaaauaaaacgagagucuucaagcauucauucguggacagaaguugaaaaaacaaaaaccgcaaacugaagucuguugguucucaagcuuugacuaugaaaggcuaucuccuaguaggcaucccaugcuuuaaaaagaaaaaaaaaaaaacuuaccuccuaaguugcauuuauuaaugacaauuuccuuaaggcacaaaauagugucaucugagaacuugugacagagcuaccaaucuaaguugcuuauaucuaagucgaaaggagagauaguuacuuugugccauuccauagggcaaguggaacauuuuccauuaaguucuguguaaaaaggcccaggcccaccuccuccuggaguccuuuagggggacuccuggaggucuagggaggccaguuuacacccgcaccgaacuggggugaguaaaacugggcccaguuauguuagguuguugugcuucuugguaaagaaggaaaaaaaaagagaagacaauacaacagaaggcgccauuccaguaccacacugaaaagaaacacaaaaacaagagagcagcauguuuugaacagcuugcguggaaaaaauauugacuggggaguuuggacagcacuguucauuuucucucaccgcccucauuauuugucuuaaggagcaggagccagccacgauuuuggcaaacaggccagaggaaggugugugugugugugugugugugugugugugugugugugugcgcgcgcgcgcgcguguagaggcuugucgcccaaggggaaauuaagaccaagacccaguggcucagggccagcaugaagccuggggguggggguggagguugggguggagggggagguguuaaagcuucuuccuccuggccugucucugaguucuacuugaggcucggcauccaucauuaaggcccgucuccuucagagcacagcaaggagacgaugaaucccugcccuuguuucuuucggcuggggaaaggaugcagggguuccauugguuuuuucggcccgcccuucuucuggaguucagaccuccaguuccagcaaugggggucaggccggagccuccacgcgcagggaaaaaacuugauuccaucaguuccucggagccggcugauuggauuuagccccgccuguuuguguguggggcguggccugagcgcggggcguggccugagcgcggggcguggucugggcacggggccuucggcggcgaccagccagaggaggaagaacauggcgggcgcagcagggccaggguccgguccgggggcagcggguggagauggagacgauucgcucuacccgaucgcgguuuuaaucgacgagcuccgcaaugaggacgugcagguacuaggcugggcuggggagccgaggcgagggcggaagcgcacaugguagggaagcggaaaggccggcucagcccugggggcgacccccgggguggcagagucguauucagccccgggacggaggcguggggcggcgggugcgcggugguccgucucagcuccgcugcccuccuccgacccucuggggugguggcguccaucugcucccggcagugggcggggaaccgguucgcaccucggguggaccagcgcaggcgggcugcggggccgccgggagcggaggagcggcccccggcccccguucccuuugaagugaugcggaguguccguccccgggcaaacuagcugggcugguuggguggaaagagcgcggcggcugauuaacccagaugaguggugcaucaguugugauagaacuuuucccugaaaagggaggaguugugcuuaaccguuucuuucacccacuucucuccauccagaguucucucuuuucagacccucucauuguccgcguguuuucauucauucguuucuuccccggcccuucaguguucucccuaagauagcuucuggcuaaugacguguuaaacgguccuugaguuuuccuaggauuaagaucuaagugaaaggcucauucaucauuauacugugucccaguaucucaccuauuugcuucuuugaccagaauugcaaucaucucuuugcuuuguucucccucccacuuuguuuuuaaagcuccgucucaacaguauuaagaaguuaucaacuauagcucuagcacucgggguagaaaggacucgaacggaacugcugccuuuccuuacagguuugugucccuugaaagauacacgcuccauuucuauuggcuuuuaaacuauuuuuauuuaauuuucuuaguuuguuaccuagaguagcgauaaguacuagacugagccuugccuucugcaagguguauagaaaugcuacauauagucagacauacucaaacauaaaccguguagcuagugggaaggugauugaugugaaauauggauuucuuuguaaaugauuuauuuuauaugcauugguguuuugccugcaugugaaagugacagauccccuggaacuggaguuauaggcaguuguuaaguugccaugugggugcugggcauugaacgcugcuucucuggaagagcagccagugcccuuaaccacugagccaucucuccagcuccaggaugugaguuucuuaauaauugugugaaacauucaggaagacuugugguagucaucuauaagauggaacacagcuccaauauagcuccaauauaggagcuagagaaagcacccaaggagcugaaggggucugcagcccuauagguggaacaacaauaugaacuaaccaguacccccggagcucgugucucuagcugcauauguagcagaagauggccuagucggccaucacugggaagagaggccccuugaucuugcaaacuuuauaugccccaguacaggggaacgccagggccaagaagugggaguggguggguaggggagcagggcgggggugggggguauagggaacuuucgggauagcauuugaaauuugaaauguauauaaagaaaauaucuaauaaaaaaacugacaaaaaaagacuugugauuuagagagggaugaaaaugcuuuuaggauucuaguugcaaccgcucugugagagccagcgcaguggcccuugccccugugguaaccagcuguuguuguuuucagauacuauuuaugaugaagaugaggugcuguuagcucucgccgagcagcugggaaauuucacugguuuggugggcgguccugacuuugcccacugucugcuggugaguacuuuucuaucgucuaugcuccuucuagaacuuuguaggaucaacagugccuuuauuaacuggugauaggcacauugcagcauuuuaugcagacuucuuaugggcagaugacaauaauaauacuaacaagacuuagaucuuaccagccgaauguaagcuuguuucugccucuauagacuuauuauuucagagaugcggagggaaagaacuugauuugguuccccuuuuucuuuuguuuguaauuuuuuuuauuagauauuuucuuuauauacauuucuaaugcuaucccgaaaguucccuauaaccacccugcuccccugcucccuuccuccccacuccugcuucuuggcccuggcauuguuuguauuuuuugaggcaaggucuuguuuuguagccuugguucuauauagaacaggcuagcuuugaacucauagagauccuccugccucugccuccagagugcugagauuaaagguaugcaucacuaugcagaugaacuagaccuuaaaggaugacuagaagcugaccagcugacaaggcagggcugucuguuuagggguuuaagcacuguguauucaaugcuggcucccaugguuccuagcucuaccuugaugguucuguagaacuccagacauagauggagaagagguaaguggacacuuguagaaaucacaacagauuuagauacggguugucauuuuucccucaaaacgugccucuuuuugagucauaucacuagcuaccuagcuauacaaggccagccuagaagauagcuuugaugucaaauuacgucagagaaguugaagccugggccuuugcaugcuaggugaguguuccuucaccgagcuacagcccagcagaggaaggccuccuuaaauccucucccccuucacgccuaagcuauuagucuugucgacugcauccaucccaguucagucuucauuugugcauucaugggcacuugugccuggcuaguagcauuguuguggggcuucuguccuuggacucguuugcuuccuugcagugagucagaaaaacucuucugccacacuuuauuacugccauguuguugugcugaggcucauguuguuucuucugguagcuauuuggauucacagcagugaaaaacucauuauauauacgcauguuccucuugguaacuucauuccaugcacauuggucuuuccuuauaagcccaggucauuguugcccagacguuggcuguagauguuaucuucagagagaugcuauuuagaguuuucuauaguggaguccguguaagucggacaacuccauuuuguaucuugagaggccuugccugucacaaccaccccuugcccgucacccuguuguaauuugacaucucccccauuagaauguaggcucccuuagagcauccuguguguucauuccuucuggauccuuggcguuacugcacagcaguauucaucgauggcuugcagcugugaagcuuguuggguucagagcugcgugagugaaaagcuagggcuggugacgcacucaccagggcucagagaagggcacugggaauaggcagaauucaaaugaagggacaacucauaaggcauuugccggaguuuggccaucuccgugguagugcuagaauauguugcaguaggcaggggacagaucaugaaagacugccuaguaagaagccaugucuuuucaguggaccuuugacccacccucuaggaaagcuacaaagcucucuauuuuuuugaaugguauugagcggcacauuucuucucuuggaguccugauccucuuuccugguuagccugccguggaguucuguucugaucucacagcuuuagcuuaugcugagucaccugggaccaaauacaaauguuuagaagggcagcuagagguucagagaagcagccuguuucugcuguccaccaggcugcgucacaucggcuuacugacgagcucgaccuugaaccucuuugucuuuuaugucucuggaucugcaagcucacccccaucucugcauuuguuuuugacuguucuuuggcucauggaaagauucugaauauauuuggggaaaaaaugguguuguagucagcuuuuuauugguugggaaaauugcguugcuuacaccuccaggaaugguaggauggugcaggaaagggcaugaacucuguagccuggcaagagaugaucaggcaguguggcccccacgcuuggccauaguuuuggacuuguuccuaaggaaauagcacauuuguuucuugguguggcugcauaucauuuaaacacccccuccaaauaauaguaauucugugucaagucucuuccacagugucauuuguagacaccaucugggaauugccaucugggacaugcgaucuuggcuuuucuacagaagucgugucuucagguuggccacaccauauguuaucacugugugaauugaaaguaaccauuugguaugauguaguuaacauucugguuacauguacuguuucccuucagucacauaaaaggugacaaucgguguccaaccugauuuaauaaguugucaucucugguuuuccuuuuugaucuugcagccuccuuuggaaaguuuggcuacgguggaggagacugucguucgagacaaggcuguggagucgcugaggcagaucucgcaggagcacacuccuguugcccuugaagcucauuuugugccucuggugaagcgccuggcaagcggggacugguucacgucgcgcacgucugcauguggcuuguucagcguuugcuaucccagagcuucaaaugcugucaaggcagagauucgacaguaagacaguaguuucuaguguuugggaugacuggggacucacagagcaggguuuacccggugcucagcuucaugugaggccagugggguugaugacacuuuuccauguagcuguauacacugauggcuuauuuuguucgugugugugugugugugugugugugugugcgcacgugugcgcgugcgcgcguaucgcaugugugcauguguguuuguauuucaugugaaagccucugguguugauccccagguaccuuccuucuuuccuuugagacaagcuuucucauuagccuugaauucacuucauagacuagccuaccaggcccgccgcacacuuuggggaucugccugccucugccucccaacuugcccccucugggguuauaggcacagccacugugcucagcuguguacauagguccuggggaggguggaaggcaggcccuuuccugacuaagcuguuuuuccaguccuuucuuuaccacugugaguagaaaccuagucccugauguuuauaagagagagacuuuaaaggcucuguguugcacuuggugcacgcuuacccauguguuugacaggaagcaccuuguuuuaugcugcaggcacuuccguucucucugcucggaugauacaccaauggugcgacgugcugcugcuuccaaauugggugaauuugcaaaaguuuuggaauuagacagugugaaaacugaaauugucccauuguucacgaauuuggcuucagaugaacagguaacuggaggccuuuggccuaaugaagggucguuuugcaccauuagaacuuaguucugaccuggggcuucuuucuuagcuaggccccacguuucuuugugcucagagggagaguuggagaugaauuggguuccauaacuaggaagccagggcugccuuggggacaggugccuuucagaauuguggccuguauuauguauggagaugaagcauuuccuggaauucugacuuuguuaauuucugcacuaaaguaugguuguacuacacacaauagcgaucuuaaagccaaaggucuggguuuccuugguguagagaugauaaaaaccgggaaccccuaaauuacuuacuacaguuguuucucuguacagaguuugggggugauccuaggaucagguagggcuguuucucuuagaguucaggucccauauguaaaauggugugcuauuugccacugcuuguacacauccuccugaguacuuacucuaagucaccuaaguuagauaacuugcaaugccuaauucaaugucaacgaggguuggagagaaggcuaaucuuuaaaggugagagcugcccaugccugaggaccugugucugacacccagagcccacggagaagauuggauguagugguucucaucuguaacccagccuuccuacaguaggugggagacagagguaggagagucacccugagacucaugggccgucuagccuggguauacagggcagcagcagcagcagaaacaagggagacccugauucaauaagguggaaggcaaaaaccaaaucccgaaaguugcccucugaccuccacagaggugcugugguaugcaugacccacacucucucacauaaacacaguagauaaauaacaaaacaaaguugccuguaaucccaguacuugggaggcagacacaggcagauuucugaguucgaggccagccuggucuacagagugaguuccaggacagccaggacugcacagagaaacccugccucaaaaaauaaaacaaaacaaaaacaaaaccaaaacaacaaaaaaagccaaaguauaguguaaaugaccuguaaauaguuuuauuauuuuuuucuaaggaauagugacaagaaaauguuuguauguguuugguacagauuagaaaacauuucccaaauauucgugauccacgguuggaauacauugaugugggggaaccaugggcaugacugacuaucucuugcucgaagcuuguuuucaguggcuacguguauuauagaauuagguucuccuaggagcccaugacacagauacucaggggaauggaagcccagcuaguuuuugaggcuugugcaaggcuauauuuagcuaguugaguguacauaggcuccagccacaaguuucuaaguuuuauaauuugaacauuggcaguaguguugcugagcacggagaugccacgugugcauggcggguucucuguguugggcuaggcaggcuuagcauccuuauuuggaauuuagcugguuacauuucccaugacauaauuugacuuuuucuuuugucuucuauacuuccuguuugcagauuuuuuugaugaaggccagccaggaaauacuuuaggcuuugagggucauauaguuccuguaaaacucagcucccgugcuccaaaagcagccagaggaugggaaccaaugggcaugaaacuuaacuauguccuagguaggagcuggcugugagcuuuggugcucagaaaaauuucagugcuuuguuaagaaauacaaauacauuguguucccucugacuacuuauagaagaccugcucauggcuuacucauggacagaaacauuuauuaaguaccuacauagaauuccuacauauguaaggcacaguucuaguguuaagugagguguuacagguauacagggauccggcucucauggaacaugaaaaaaauuuuuuuuaacuuuuuuuuuuuaagauuuauuuauuuuauauaugugaguacacuguugcugucuucagacaccagaagagggaaucggaucccauuacagcaaccacaugguggcucacaaccauguaguugugagccaccaugugguugcugggaauugaacucaggaccucuggaagagcaaucagugcucuuaaccucugagccaucuccagcccggaacuuauauuuuaauggagaaaagcaaacaugauaaaaauuaggcaugaauguuauacaaauaaaugaaaccugauagagcacuggcugcuaggcggugcagaacucugaagaagggaccagcaggcgagagacaguguugucgguaaagagaguguuguugggcuagaaacaccaaccuuagaacauggagguugaaagaagccagugaagacaggaguggagaaggaaggguggaggagaccauuagccaggaaagacugcaguuuugauuuucuacucuagauucagugaggcucuaguagaucuggagaagagguguggcauguaauuuacauuucugaaaggucauucuggcuuguguguggaaacaaacuucucggagggauaagaauagaaagagaaggcaguaagguaggugacauugauaggaaccaggcaaguggugagggcgcuuuguucugugugugugucccguaguauuacauagacagugauuucuugccccgggguuuuuuugaugcucauccgauuauaugucuaaaguuucucuuuaucugauuuuccuaagucugaagucagaacuccuaaugucuaacugagcuuuaaguuuguguguccacuuacucagaagacauucaagugucccacuuggcauuuggcagcuuuauaaacagacagcaaguuagcuccccgccuuuccaacuccccacugcugugucuuacgaggcuuccuuaucucaguaucuugagccugacuuuguuauuuggcggcugucacccugucccguucuguguugucccuuacugccccaucucaugcagcuguggucagugaugagcuggcaagagguuucaagaugaucuccuuuguccuuuaaauucuucaaauguguuauuacguacguaugcaaggauaauucuucaacuccucauuauaauaaggcuuugaauauagcauuuuaaaaaaauaauuagucuuuauaugagaugugaguaaaguguuugcuucauuucaaugcucagaacccauggaaagguggaaggggaaaccugacuccaggauguugucaugugcugaccccacacacauuauuuacaugcaauaaauaacauuuagaacaucuuuuuuaaaucuuacuuaauaaaaacuuggugcuguagucaagauaauuuaaaugaaaugccauuugugguuuucacaugccagucugggcaaagcaagagcugaugcagccauuugaagacauaaagccacaccagcgcguguggcgggcagcugucuuaguuaggguggcugcugcugcaaugagacagccacgaccagaagcaagcuggggaggaaggggugguuuggcuuccacuuccgccuuaugguuuaucauugaaggaagcuggaacaggagcucagacagggcgggagcuggugcagagaccuuggaggggugcuugcuccccucccugugggcuugcgucccacauggcuuauccugcuuucuucuagaacucaggacgaccugcccugcccagguuuagcacuguccacaaugggcuugcccuuuccccauaagucauuaauuaauaagguguccuggaggcuugugaauagccugauguuguggaggcaucuugucaguugaggcucccuccucacgaaugacuucagcuuaugugucgcuuucuccccugcuuucugaaguaguaccuguggcagcagucucucacugcacucagugugcccuuucagcaaacugacaaaugggauguuuuucucuuuaggacucugugcggcugcuagcuguggaagccugcgucagcauugcccaguuacugucucaggaggaccuggaagccuugguaaugccuacacuucgacaagcagcagaagauaaguccuggcggguucgauauaugguggcugacaaguuuucagagguaaaaugcaccggcauuucaaguguuaaaaaccucagacacacuuacccuacagaguuucugucggacacagcuuacaaauccuacugagugguugugaacuuaaaaaaagugagagagccugcuuaaucuuuccauuuugguuacagcaugcuuuugaugauuguacuauuuucuguuuuuacuauuaugcuaguauacaguaaaccuguauaaauuguuuucuagcuccagaaagcggugggcccuaagauugcacucagcgaccucauccccgccuuccagagccuccuccgagacugcgaagcugaaguccgagcagccgcugcccacaaaguaagaggugagacuggccgugggguccuuugacuuugguggugucagcucgcuauaguuugguuugguuaggaccgaaaacauaaaccagggagagaugaguccacgcagcagcauuuccgcccacgcugaugcauuuguuguguuaggaaguuuggcaugguuuugauuuauaagaugcugcagacggauggcaccagcauggcagguggcaccgucagacugucccauagguuaggucaggagggccuccaggcugugcuguguggaccaggcuuacugccccuccacacuuuauuugcucagacugacuuaacuuggacuguugggaagagcuggguaauugucuuuggcuccuugacagcauugccuuuucuguuucuguuucagagcuuugugagaaccugcccgcugaagguagagagacuguaauuaugaaucaaauccugcccuauauaaaggugaaugugacuucauuuuauuuuguuuacucuaccuacgaagcucuuagcaucuaaagaaggaagaggcauaaauuaaucaaauacauaauaacauuagugcaaauguuuagaguugauuugugcgcguugcacuguagagcuugugggcgcauagcuguuacuacagacggccaggucagcugugcuguuggcuggugcugcuguggacuccucgggaggugcuguagaggcuuuuguugucuuuaauuuuuauucucuuuuaggaauuagugucugauaccaaccaacaugucaagucagcgcuagcuucuguaauuaugggauuaucuacaguuuugggcaaagagaauaccauugaacaucuucugccucuauuuuuagcucaguuaaaggacgaggugagucuggguaugaauccuuuugcuuugauauaauugauuugauaugauuuuguuucuuuuuuuuucuuuuggguuuucugagacaggauuucuuuguguagcccuggcuguccuggaacuugucgcuuuguagaccaggcuggccuugcacuuagagauccaucugccucucucugucucccaagugcugggacuaaagggacuguaaagcuuugguuuggugauuuuacuaaaauaggacccaaaguguaaagauggggaaaaucauagucuagauauuugacaguccuucuguuuggguguagggcuacagguuuccccaaaaaugggcacaaggacuaacuaaaaacaaaccaacugggugugguggagcaugccuuuaaucccagcacucugaaggcugaggcagggggaucucugaguucaaggccagccugguccauaggucaaguuccaggacagucaggguuacccagagaaacccugucucuaaaaccagaaucaaccaaacaaccaaaaaagaggagcuggagagggagggagccucguagcaaacagcacuggcucauucuugguuugguucccagaacccacauggguuccucaacugucaguggcucuaguucagggaucugaugccucuguggucacccgcaggcaccaggcacacaaauagugcauaaacauguucaugcaaaacagucaugaaauaagucuuaaaaccauccaagaaaugccuauuaaauguuuuauauuauagucacugauuccuuauauuuaaagcucauauaucuuugcuuaaacugugucuuuuuauuuaaguuuaaaguguagcuucagauacuaacauuuaguggcuggagauuuggcucagcaguuaggaggccugucgcuuguagaggacuagagcuccaguucugguggccauguugaguggcccucaacuguucauaacuccaucuccagagggucuggucccuugcuggccuuugugggcacacacacacacacacacacacacacacacacacacacacacacacacacacacacacacgggcacaugugcacguuacacagacaauacauacauucggauaaaaauguaacagguagugccaggcauggucugagagcuuuggauaugucauuaacuguaacugcugcagugggcucugggcuugguuccucccgguguagaggaaggagagaccagggaguaagaugucugcggucucccugcaguggcagagcugagucccagggccugggcccuuuacaucucauagacucugugcuuacuuauuaauuaaaagucugaaaaucuuuauuauuaugugagcgagcguacacugugugcacauacagaguucagaggcugucucuguggaguccguucucuccauccacuuuauguuggauguucuggggauaacucauguucuggggaucggauccuggcugcuagguuugugagggaagccccucuuucugcucagccaucucgccugccaauuuguuaauugauuuuuuaacuuaguguacaaucucccguagauggaugguacaggcuuuuuacugacguguggcuaaggucagugacauuguaucugugcacuuaguguuaaggauuuccuucugcaguagcuuuucuauaguucuggugguugaguccagggcucugcaggauggacgaaugccuuuccuacccagccacaccacagcuuacccccaccuuuuaaagccugagccuuuucuuuucuuuucuuuucuuuucuuuucuuuucuuuucuuuucuuuucuuuuucuuucccuuucccuuucccuuucccuuucccuuucccuuucccuuucccuuucccuuucccuuucccuuucccuuucccuuucccuuucccuuucccuuuccuuuuccuuuuccuuuuccuuuuuuccuuccuuccuuccuuccucucuuuuucuuucuuucuuguuuuuuuugguuuguuuguuuuuguuuuuuuguuuuuuuuuaagaugggagucuaucuguguaucccuggcuguccuggaacucacguuguagaccaggcuggucuugaacucaagagaucugccugccuccacugcccaagugcuggguuuaaaggugugcgccaccacccagauuaguacuuuuuaauuugaaauucuacuuagcacuuuuuauuuucucaugccaggagacuacugggcaaaagaguuaauuuucacauguagucucuggggcuuguguguuuauaguguccagaaguucguuuaaauaucaucuccaauuuggauugugugaaugaagugauuggaauccgucagcucucucagucucuccuuccggccauaguggaacuggcugaagaugccaaguggaggguccgccuggcuaucauugaguacaugccgcugcuggcuggccagcuggugaguaccugggcuuugccaugguuugagggugguuuugguuuucagugaucuauuauggccuaacaggaggguggugcagaaacacagucaccuugcugccuccucagguugaagguguagaaugugcuucugugauagcaauguuguauuauuuaaacccuauauaauuuaaggacucguguauggaagggaaaauacaguuucaggauaagucgguuuggcuuuuuguuugacucuguccuaagcaaaaugaauuugggagcaauuuuuucugcauccugaugaaaaguugaagauccacuacacagggcuuauaaugugcuguucuggauaaagguauuacacugccuauuucucuggguucguuauuaguuuaguucugguagauaugacuaauuaaaaugucaaagcagacuuuauugccacaccuuugccuuuuucucaguaggugaagauggcgacaagcuugauagccaugccccugugguagcuaccuguguggugugguuuccagcggcuucguagcgcuuguuauuagacacuuagcauuuucuacuagguggaugaaggggccugagugauucucagugcucacauaucaguuugcugcugacauuucuguacuuugcccccaccccaaggccccaccccgcccaaaggcccauucccacucuuuugaggucacagcaccaugcucauguuuucuugaccacugcaccauauuacuaauuuggguggccauugagcaugcgccuguagauggccauagcauugcgcuuuaucagaucagaauugucugugucucaaaugaagggcaaagauccuaacuuauccacaugucaagugacaucaccaugcuucuccaccauccaguccaaguggaggggucauuuucuguuccuuagucaucuucugugccacugucuggaguagaaagcagugguggcuaaugauggguuugcuaggcugggaagcagcuguguggaaggagguggaugguauuuaccgucucugggaaaucuccagggcugccagcaguauacagaauagcguggaaagaagacagacggcgucuuggcugguuuacaccuuucuggcaggggcaacaucccucagucauggacacuggcugagguggcaucugucagucauggacacuaucuuucuugagguuuacuuuuuaagauuuacuuguguguguguguguguguaucuuccaguaguacuauguccaauuuucugaggaaccuccagacugacuuccagagugguuguaccagcuugcaaucccaccagcaauggaggaguguuccucuuucuccacauccuugccagcaucugcugucaccugaauuuuugaucuuagccauucuaacuggugugagguggaaucucaagguuguuuugauuugcauuucccugaugacuaaggauguugaacauuuuuucaggugcuucucagccauucgguauuugucaguugagaauucguuguuuagcucuguaccccauuuuuuaauggaguuguuugaauuucuggaguccagcuucuugagcucuuuguauauauuggcuacuagucuccuaucagauuuaggauugguaaaaauccuuucccaaucuguugguggccuuuuugucuuauugacagugucuuuugucuuacagaagcuuugcaauuuuaugaggucccauuugucaauucuugaucuuacagcacaagccauugcuguucuauucaggaauuuuuccccugugcccauaucuuugaggccuucccccacuuucuccucuauuaauuucagugucucugguuuuauguggaggucuuugauccacuuagacuugagcuuuguacaaggagauaagaauggaucaauucucauucuucuacaugauaaccgccaguugugccagcaccauuuguugaaaaugcugucuuuuuuccagugggugguuuuagcucccuugucaaagaucaagugaccauagguuuauggauuaauuucugggucuucaauugaucuguguguguguguguguguguguguguguguguguguguguguaugugugagagagagagaaugguuuccuuguauagguaugugaagcauauacacgccugguaccuguggaagcagaguaauucccuagaacuggaguuacagaccuuugcgagcugccauguaggugcugggaaccaaacccaggccucguguaagagccucaaauguccuggauggcugagccaucucucuugccucaauagauguagucuuaguuuuucuuuuuguguaaauuuuuggucaauuuauaaaauguucucaggacuccccagcccggcucguaggccugaugagugaauagaguuaaacugcagacugucugaggagaugacagaaacuccuuagccugggauacaauaggagucugaggacgaaaugccugccaggauuggucaggcagggugaagccguccuggguaaagcacagagcccuggucauuggucaggaaggucucagaauugacccagaagaauacgcauaaugaaggcaggcgugguggcucaugcguuuaaucccagcacucaggaggcagaggcaggugaauuucugagcucgaggccagccuggucuacagagugaguuccaggacagccagggcuacacagagaaacccugucucaaaaacaaaaaacaaaaaacaaaaaacaaaaacaccaccaacaacaaaaaaaaacugcauaauggccucagaaggaaggcacccggaaaguguauccugggcuuaccuguguggugugugugcccuguggccagaggucucaggguuuguucccagcuuguguggacugaccagcaggcuggggagccaggcuccaacucuuacuucugccuuuugcccuguacacuggugccuccucuuuucucuccugccuucugccaugcccuagaaacacuguccucuguuggugucacuuggaguacccugccucgugcucaaggacuuguuaacuagaaaggagagaggacgacccccaaagcccucagcagcuauuuuucuggguaacuggcuuucccaugaugucuggauuuguucugcagacuuccuccuguguugugcuggccuguucuguucugcucagcccugcgcgugcgugugugaguguguggguggcucagucccaucuucuguaagcgcggcccucggcgcucacucccuugguuuugcuuucuaugauaguguaaugguuuguaauuccaugcuacuguuuuuauggcuuuugugguucagcuugugugcaggugugccuuuagcucuuaggugauuacugugcaguguaaauagaacaucuuguccuaacuuuggaaauuuuuacuaauggaaucuucuauauccauaggguguggaguucuuugaugaaaaacucaauucuuuguguauggccuggcuuguggaucauggugaguagacaaguuaaacacagagacuguggcgaguccaggcuucugcauguuugugguguucacacauacuguuuacagaggaacccugugggauacuccuuugccuugacaauguaaggcggaagaaaggauggugagguuccacuggcuuccccuuauuacauaaacauuucacguacuuaauuuggacagggucucauugugcagcucugccugucuccugagugcugggacuaaagcaggugcaagcugacuacaggcugacauuuguacuugcguuauuuucuguuuuaaguguguuuucugugcugaguaagucuguccucuucuacuuccugcugccuuugagcuucagauucuuagcuggacauuuccuccagcgccaggguuugcagccgaccugcugccauuggcgucuucaguaucugaagagcaggcugagacuggacagaccuggcuggaaagaauuggcuccgugggcuuucugagaugaggugcaaagguccaguaguaguggggaugugugcugcacccugggacagagccagagcuucgggguuaugaaaggaaagcuuauuguuucuucuuugccugcugcugcugugcuggcggauguaagcucaggccaguugagauuggacaggaaugagcaggugccuuccuggugaugccucagggcagugugugcacaugucuaucucccuggcagcugaugacagaggggcccucugugccagguccuagccuuagcagcuucaguaucagggagggccuucaauuuucaugugcuaugucccgugggcucuggguccguguuuuggugggugugauaagcagccuguuguggucccagugugcuguguagacucuauagauugcuugcauuuaucuuuggguacuugugacuagguaguaggaaaagaauaagaauaucugugucugcuuacacuuguaggugguuuuguuaaaagcgcauuugcaucauaugucuaagaguguaaagggagguuaugaagcuguguaugucaguguguuagggcauguauggauacaucuguacuuuaaauaacaguguagacuucuuuauuccuuuuuucucgaguuaaguuuuuaauuaucauuuauuuaaaaaaaaacuugguaaaucauaggaaagcaucuguaaguauguauaaguagcaugccuguaugugcaaggagcgugccuguaugugcaaggagcgugccuguaugugcaaggagcgugccuguauguguaaggagcgugccuguauguguaaguagcgugccuguauguguaaguagcgugccuguauguguaaguagcgugccuguauguguaaggagugugccuguauguguaaggagcgugccuguauguguaaguagcgugccuguauguguaaguagcgugccuguauguguaaguagcgugccuguauguguaaggagugugccuguauguguaaggggcgugucuguaugugcaagguaaggagcgugccuguauguguaaggagcgugucuguauguguaaggagugugucuguguaaguaguguaucuguaugugaguuugugcuugugcucggguguacucuuggaggccaaagagggcaucggauccugcuugggagcuggaauuguuguugugagcccucuggcuuagguacugagggcugaaauccagucuucuguaagagcaguauauauuuucuuaaccacuaaggcaucuccccauccaagagacuuuuuuauuuaaccaaguuuacuuuggguguaaguagcccugucagugguguucccagagaccuuucuguuacuuccuuugaaagcaauuaaggauuaagacuggccuuuuucuguccuucaaauuaggaaggccuguuaagguuccagucuuccacaaguugagaaaugacagcuguucuguguaggugguggcucuaugugacuuaagcaucccgccuccugaguuccuuccagcuugggaguuagcagguuggaguucauggacugcaggaucccugaugcauuggguggcuggcagcugagagcgggccuuugccaugggcuuccucccagcuuuuguaguuucgguuagauuuuuauaauuugaagaagagugauguuuugcaccguaggugguauacagugaguggugagcagguuucuugggaacuaucccuuuaucccucccuggcaugaagcuucucugcuguaagacuugaggagucuggagaagcuggggggaggguaugaagguuggguuucuguccgugggcagugugacaagaaggcaggggggccaagcagugguggcgcaugccuuuaauccuagcacuugggaggcagagacagguggauuucugaguuccaggcuagccuggucuacagagugaguuccaggacagccagggcuacacagagaaaccuugucuugaaaaacaaaacaaacaaacaaacaaaaaagaaggcagggcucagugagggaaaguuaagugguggguaccucauaaauuuaucuuuuauaggauaaagauacguauccagucaaaguuagugagaacugauagaauuagauauguaaagaaaccuuucagaucagccuaaccuugaagggaaagacagacacagacaaaacaaggagugagaacuugggaaaggcuugcauuccucugaaaacagaauugagaggugcuagagacacaguaggccucuggccaaguagaguugagugcaguugaggucuuggucaaagcucagucucuggguacuguggcacuggaacccugccacauggccuuguaguaagacugaucauucaaaaccaguagcuaggagcaaaacacaggugcugcccuuagcuccccuuuacguccgugugugugugugugugugugugugugugugcauacaugcgaguauucugucuucuuauaugucuacaggacagaagagggcaucagauuccauuauagaugguuguaagcaacugugugguuacuaggaauugaacccaggaccuguagaagagcagccagugcucuuaaccauugagccgucucuccagcuucauuagcucuacuuuaaaggaagaauggaggagaggucuggagcacaaauuauguacgagaugaaaaagagcucguguguguguguguguguguguguguguguguguguguguguguaaggcacuucugggcaucuugguguguguuucucugcugacugaagucugagcaugggcugugcgaguagagcuccuugucuccugucucuguguuuuccguucuuagucuuuagagcaggauuugaguuggggaaaguuggcucucaucucucuggaagcuugcaggauugccaaggauuggggccuuggcuugggggguuugugcuugccaggugagaggaggaggaggaaccaguaacccgaucguucaccuugauuuguuaucuaaguccaagguuugagucuuacugagucugaagugaaggcaccagaccuuucuguguucaggccugcacagaaugacuaauuuuggggguauaauaacccagacuucauuguuuaguuuuaugaugucguugauaaauuauuuugaaugggauuauuauguguuggugcaggcacauguaucagcuugucuuaauuaacacaagcauuuucaguggggaacaacugugauuugcagcuguguaggugacaauggugaccuguguaggauuucuucaauauuuuucucagcugcuuucugaugccacuugaauaaucuugcuaaaaucucuuuagaugcuuuugaaaccuguuuguguuagaaaugcucuguggucagggcugucccucaagucucauggguuuggcucauucccuuggcccucacgcuccucgcugcagcugcacccagagcuccucccaguugccaaaggccaugcaccucucuccuccuagagucccuucuuuccacucagccuucucuguucagugcuguaugugacgauugguccucugccaugugacucucugagagccuaguuuucauucccugauaagaguauuuggucuuugagggaaggcaucugcugucuccuucuguagcacauacuacuagcaggcagcuggguuuacuaauugaugaugcauagaccaagucccucccauccuuuuccuugguugacauggacauuuagaacugcauuaggugugccucagugugauuaucauguaagcuacaguaggcuugcccagaguuuguuuugggugugugugcugugggugaaguagaugguguguaaagcaagcauccucuuggacucuccuacagucuaugccauucgggaggcagccaccaacaaccucaugaaguuaguccagaaguucgguacagagugggcccagaauaccauugucccuaaaguguugguaauggcaaaugacccuaacuacuuacacagaaugaccacgcucuucugcauuaauguaaguauuacauguguuacugcucagcuugggcguuuuguuuuauuuuuguuuuuuugguuauucacguucuaaauuucugugugagcuaucuuauguuagagguacauuucuuauacuguucaauuugaauagagaaaacauugauuuaaaauuuuggagcuggagagauggcucagugucacaggugguucacaacugcccagagcucggcugguggugagaacaggcagaccggacugucucuaagcaucaccccuccccacagucacaccaauagugagaugaaacaguauuuaaacauuucauuauuuuaaaaguugcaauuugcuguauguuuuggcagaggucuuccaucuuuugagccacuucauguucuuuagaugcucaaguaggaaacaguuuucuauuggccaauuaccuucccuuuauauauuaguuuguuucucuagauuuggggugucuuaaggaaguguuaaauguacugucuuauuuauuuuucuaggcacugucugaagccugugguaaggaaauaaccacuaagcaaauguugcccaucguguugaaaauggcaggagaccagguagcaaauguccgcuucaauguggccaaaucacugcagaaaauuggaccgauucuagacaccaaguaagacuucaguauugcuguugauuugaaaguauaacuucauggugaggaguagccucuaaaauaaguccagaauuccuuucuuuaucuagaauccgggcuuauucagagaaaauaauccagucuugagacuguccaguuugacuuuuacacuuaagcucuaggcguguaaagcucacugcccaaaagcgaauuucaccaauaacuucuuuagaaauuauuugaugugcuugucauguuuguauuuaaaaguaauuucauuuuaaauauaaaacuugccaucgaugaaacccuaaguuugaugcagacuguaucacguugcacucugccugcccagccguccuuuucacagugacuuuugaauuucagcgccuugcagggggaagugaagccggugcugcagaaauugggucaggacgaagacauggaugucaaauauuuugcacaggaagcuauaagugguaugccuuguguuuugugcuaggcucggguugcuagggugcuuucuuuuauagugugagugucgggggagggggcagugugcugagcaugaugggagaugggguggcaagugucuguuacacugggccuguuggguuagguuaggaauuucuuagccccugcugggcuuggcagcacacacuugcaaucccagcacuugggagacugaggcaggaggaugucagaguagaggagccugggcuacguugugagacccuaucuaaaauaaagaaaagucuuggcccacuguucucagcugagugaggaggccauguucucagcuccuguguagggugcugauuguuucuggcaagaacaguuuaguuugcacucgaguaagucuuuaauuuccagucagccucacugacuaaagcagcaggugcaggcccacaguaggaccucagccuccugcuuugccauuguuacaugcuaaauggugaagcgaucacucaugaaccuucuguaccacuaaugugauuuuguuuggaauuuuccaguucuugccuuggcauaaagaugaacaggagggaaaagccuuuacuaaauucuuaucacagaucucuagucaauguguucuugcccuggguggagaaaaauggaaaccuucaagaucucauccaagcaaauggcaacaacauagaagaaaucagauuucagugacuugauucucucuacacaugaccucagacugacuugacuucucucuguugggauaacuguacgcucuucuucugcccaguugcugaugcuccucauacagucaucucuugagugucucccaggguuucucuccagcaccauugaggcuccugccuccucccuuuugaaucaggccccagccacuuacgauuccagacagacccuggauggauuuggaccccgacacggaguggagugaaucccuuauuguuuacacaucucuguguggcgcuccaucuuuccaauguuaagaguaaaugguuuagaauaacuuauuuauaucugcuuggagcuaauauugagauuugacuguagcgaaagccacaugcuccugguuucgaugguccgcaucagcaucucacaugaaggagauguggaaggcuaacgaauggcuggucugguuuucauuugcucaguuugacuguaaucaugucaugcaggagcuggaaguggguguaucuugcugcuaaugugugauguugaaagaaaacaauuucaacggcucagcacugugacugccuucaaaaacucagaagaaacuuuagugccuccuacuaaguugugguucuacuguuucauugugaaguguuguguuucaaguaaguguaggaaccaguggccccaggcucugcucccagcacuguuagugagcauugugcuguugcgauaccgugcaguaccaaacugaagcuuccuugcucaguguuuucuuguggugugggugaugcuagaacuuuuuucuacuuuugcaguaaaauuucauuaauauguccagaaauuuaaggugacaggucaagcugaaggguuugcugaagcaaauuaauugugucuauggaaggcugcuggacacuaauuuuaggaaguacccccuucucagugggugugccugugaccagugucccugcucugucauaacccagcccuuccaggagcagcgcacacaucacacuuuuccugaauaucccuguggguaauuuaaauauuuucaucugacuccuugucucggguggacucaaguuaaugaggcuuuacugcggccuguuuuacucaaugcaucauaccauguaguuugauguuuccauuuugguuucugaauuguugauuuuacuuacaaauccuuuuagauauaacaagcccuguucuguuuugugaaggcccaaagauaccuacaaaucuuuguacauuaaacauguuacauaaaaccaaauuguguaaaugcuuuuaaguuuaucauaccuuagaaaaacagaacagaccguuucuaucagagaccaugugccugcauuuuaaacugcugguuacuucuuaguaaguuuucauuuuuguguucuagggccaaaguuugacuauuuuccuaagcauuuuagugccuuaaauuagucugcuguaaacauuuuaauuucacaguuucuuuuucgucaccugcaggcuguauuccucuuuaaugauuaguuuuauauuugagagagauaauugucuugauuguggaaaugugcauugggacagcugcuucaccuuugguuggaaaugccacaugguacacucacucgggaauaaaccucuaaagugucucugcuccccuaccccccagccuugugcauuuagcuuucugccagcaacuacugaagggagagacgguggacccuugccuucucaaauaagggucacauagcaugcaggaucuguuuugagaggccagcagagucgucacuguucuuucugguggcugcagugaacucccuugaguuaaccugcauagcaauugcucuucagcuucacuuuggccauuuucucuacauaguagcuuuuauacuugaugccuucaagagcucugugaugcaggcuuggucucuucugucuuguguuguaccauugacugggccagugucugggguauauuguuggugcuucauaaaaccgaguucauugugugauuucuaaaggauguccucuaaugggaacaaagucaccagacugucucacucuuucauuaauaaaauuagccacuucuuugcucuuaggaagcaagagccucuagccuagaccaguccccagcuccaggauuuuuuuuuuuuuuucuuuuugagacaaggaucucuauggaagguagcccuggcuguccuggaacucacuauguagaccaggcugguccugcgucugccucccaagugcugggaugaaaggcaugccacuaccucuggcuugaggaauuauccuuuuggaacugccuaguugccuugaacauaauauugcuccuguuuuacaucuaagcagcuuauaccauuguucaacuuguuaggaaagggaaaagccaagacaaacaaacacauccugugccaauuaaaagugagccauuaacaguggaguucauuuuagugauucucuucaacauauuguuuggggugugcccaucaggagccaaauauuagauccugugcgucuacuguacugccaaugaucaggagccugaagauagauguuguucccuagggauaaacagauuaaugugggauuuggaaugaagcaaccuucaguucauggcaacaccaagcuugacuguagugaugugggccuugaggugggggcugggaggaguauguuugcuccuuauuuaagagacagcaugacaggucucgucuaagcauccagaaugcuugcauaacacccaggaagagcaggguuucuuccugacaccacugagcuguccagaguuguauuaaccuccgugucccuuguguccaucacaggaguccuuugggccaucacacuggggaugguaggucagggccucugcucacaucccugcaugcuaguuuuccuuucucuggaaugucagcugcagagaaagugucccaccccaccccccggccuccauguucuuugggaacagaugaagugguugcuagccuuuuggcucacugcucuccucccuguucuacccauuucccugcuugucuuuucucuuuccucacacaucuucaguccucgguaucuagaauagccuuuacugcuccucauccgccuccacaggccugccauuuccaggaaauuacgucagguucaguugacauggaaaucuuuugagggggauaaaguacucaacugggaagaaaagccaagccauuucuuucuugggagugguuguccuuaacugcggugaucaggucugaaaggagcuagguucuguguuggcucaggguucuacaggcuacccauggccaagaugugggggaacccccaguuagaucucgggaugacuggagcaaaaaggcacuggugauggcuggcuuucucugcacagcugcccaggaccugugcugcuggcccaucagaguugcuagggcagcugagggcaucccaguugggaagcacagguggcuugggagggaugugcccuggucagggacggucacauugcugucuauaucucuagugguggcacaaaggcugaggaagcuagauuuuccugugaaggacagugaagagcccagcaucccugggguugacaagaaucucuuccugagaccccgagggccuggagaggacacugggaagguaagugcccuuggaacuuggggccagagcccuguccuuucuggggcugaggguagccagcagagcuugcugcugcuauagggagucacagcaaagugggcagagaaguaguucccaccacacuugcccaggcgagauaccuggcucuagagaaguguauuguaaagucuugcucuguucucccuuuguagagagugguggucuuuuccagaucugugacuugaggucuuuuaaaucuuccacagucugagaugagacccauguaacacaaggguagacuggaagagcuggucaacuuucuucccgggcugguucuguuuagggaguugucucccuucaggacgaagaguccaugccugaugguuuccaugcccaguuugcuuccuacaaccacauggagaagggaugcagaauccuaguucagcagucaccggggccagugagagaagggcgguuaugauuuaaauuaaauaggaauggagagccuggacugccuagggcugacgucaggguagauacaguaacugcaagaggcuggugcucucauagccacuccagcagauuuuaugcuuaaaccacugacagacaaaaggggcugucuuuaaauuaccgggcucuucacuugaugucaauggaggccacgcaaugucuccuguucugaacacuuuucuuucuguggccaagcccacucuuguucccugccugaguugccagcugccucaguucaggcagucccaggggugcuguguggugggaggaaguguugcuuccaaagucucagcagccuaggccuggcagacaccgagaugccagcccuucauguuccuucgacugcuuuguacaauuucacugaaagagacguggccggagcuguaagagcugggauucuucggggccugagccacaccuuucuuaaaugauaauggaguuguucuguuuuucaacauucuuagggccauuuagcuuagcccugaccacuucaguggucaucuguccccugccacagcugacuaggucagcucugaagaacucuguccagcugaggacagcauuaguggucauuucuugagcuugcuuuacugccauaccucgucaagcauuuacccacacaccuuugcaguacauguuuaccuuggacacauuucaggugguuggguacccuuccccagaagccagcugugcuauuucucugaggcugcaguucauuugauccacaaaacccccuucucugugagucagggugccugccuugcuuuuguuucacaaaugcucugggguugaaauggaaaggacuuuugcuguugcugggcaguguuucaugucaggggccuauagccaagugagugagccaggaagucauccaguugcaaaccagaaguuguucuuaacccuuuucugugguguguggccagcucacugauuugcccucauacggagaacuuugggaaccuauuucuugacuggucucaaagcccuaagggaaucauuugacgucuuaaggcugugcuugcugcuucguccaagaaggcagcccaggcuuccuccuggugaaagguggguguuguugcuucagugccauggagagagaggcucuugaagucugcauggucuuugugcuugaugaaucauguucucaaaugcaagaccugcuagggaacagccuggaccacgggcacgggucacacugcuaccucuaggguggcacagccacgcucuccaggguagagguugcccucugaccacagcugcuggcaaggcugucaggcaagaguuaacaguggauuuguuuauugaaucaugaaguagcugucaugugauuuuaaucaaaacacgauuucccugacaacagugacgucagucuuguuguugcaggaaggagcagcugugagggacauucagucucccugagcccagguuuggagacucaaaccaagcgcaacauccauaaauccugggugcagacgcuggcuugacaauccacacucuucuuccucuucuaucucccuggacagucuguccuggacagacacagucccugcauggagucucagcuaagagcucccugccccuggcucccccacccucgcuucuacagaugcuuuuuauugcucuuuucccuuucugccacuuaauuucugggccccuaaggucucuggucugugucuucuggcauuugucuccucugggaucuaagccagcacuugcuggugaccugagauguucugguaggcaguugguuuauuccucagacuaagagguaccagggcugccagaagaugugaagggcaacucugaggagccuagcucugggugcuugaaggguagggcuuuaagagccuaacugccuggccagaggaugucuugaacccuaaaagacuagaauccaggaguccccaguccagucagaggacugcugcacaugaugugugaucgucuccagagcacuccagcuaagggaguugugucccacaggcuacugagaggucagaagcagggacagaaguaaagggaucacagcccagcuagagcaggucccucccuaggcucuggucuccugugguucccugaggacugagaccugucugugcagaaagacucccccaggcccucuacacccaugaguuuaauuacuucaaagauggggaggaaaaagcugccuagauaggccuuguuacugugacaaaaaaaucugaccaaagccaccuggcucacagcuugaggggacaguccaugguggauagucacacugugucuggucagaucagaugaaugcugaucgucuacuuggcuuucuuuucucauuuucuuuaucuaagacaccuaccuaugguguggccacccaccuucaggaugcuuccuccauacuuaaacacuucuggaaacuuccucacagacagaugcagaguauuucccccaugauuccaaauccagucaaggagacagugaagaugaacccucagauucuuagggcuggacuuaaguuguggcacucaugaccaguguuacccagaacucacugccaaaaauucagagaucucaggacugaguuaccagugaggguaaucaccuuucaguuagugagaagagacuucacaggcaccugcauagccauuuccuagccuagugucagacagaguaguggcaaguggucaaggggaguugguccaaucauaauguuuccauguuaaagggaggugcugagucaggcugcucccaucacggguggggacagugagcccuuagagugaccugcauagguuaguggcaggucuagggacuaaggauugaguucagauuuguugcugccuccugugcuaucugacaggacggagugguacuacucaccuguagugccugucuagcuacccacugguuuggacuggggagccagccucucucuucauuuccugguacccuucugacugccugccugcccuuuggccuucacuuugaugaguaaacuucuggguuucuguggugacuuguaguuccagugggucucaggugaggcacaggcaaugagcugggucccuugcauggugugcuuugccauccucauagcucagcugaacccaucccaucagcuugguggggugucuugggggucagaauucucaggcccucucuugggcagccaaggcuuuguuauuccaucuuugaggaauaaggaggaggaagacggaguaagaggcuuucaaaacuuaucuguggagggagugacucagcuccagagguucaacacucagcugccucauuuucucugggcuuugaaucuucugaccuuucugcccagccagcuuuggggguuuggcuccaggguagucugcgccucugcagucagucguuacucacccacuuaaguguuugcuuguuuuacccccucacugccaguucagaucagucuagcaguacuugggaaaucccaucagaagcacauacaaagggagggagcagggcucccuggcucuguaaccauagauacagaggaauucagccaacagacuccuuaggacagggcaagcuccccacucugccuggcugaccucaggcucagggaucuguggucacgucucugugccuggauuguggauaggugugucacugaugacagcuccacguuugaugugaaguucuauccacucugcuacauucaagacccauauuuauuuccucuuucuggauucugcccaaaaauaaucuauguaucaaauucauugcucgagagcuguuuagccuuugaaauucuuggcuggagccaaaguggaagagcagagccaugcuuuacugagcccaaggugggacaacuguggucugugagauuuccuauguggcacauagccccagacacagcacagugcuugcucaggcaaaacaguucauaacacuggaacaauacagggagauuagcauggccccuacacaaggaugacaugcaaguucaugcagugcucugcacaucaugggagggcagaaggguaagaggguggguaugaggggagaacuggauauguagguaggugugaagucaucaaaauaaaacccauuauccuauacacuaaaaaaguuaaaaaguauucauaccaagauuaaaaaaaauaacuuuaguguacaaagccagucuugcuccugagaacugcaggcugaucuuggguuccuccuuuccuggacccacuuggagguaugagcaccccucagaugccaagugucacugucugaacuuuuaacucugaaggcguagaguaagggcuuuucccauuggcccagggugagccucuagauccuggaugcauucuucuagaaacugagcugcuuucuguaggugagguuucuggagaagaguccagagaguucccugcacacccaaggacucugauccuacaauggacagcauggggaggaaaggaaagggccgcucccaggagggaagccucgucuguuagcacuggccacaggagggcuagaggcuuuggaaaugugcuuccugcuggccugcagcguuccgagcugcucaggcagaggccacaggguagugcucugcccucuguggccaauucuuuacuguucuucauaggguuuuguacuugguauggaagugaaggguguccuuagacucggggaggccugggugguuaccuaugacaacuuuacaaugauggagugauuucaaugggcaaggguaaaguuugcuaagcaagcacugacauggggggggggggaagaaacuuguacuuuuccaaggcuggcagagcugcgcacaugcacagugaggguucugugcccccaguccuauacauaccacauacccucagccucacagccacugggcuugccuccuuuugagagcugcugcaguucuggucuauauaauauuggcccaggggaauguccuaaguaauggaaaccaaaucucaucugcacucacugccagcaagcgggauuuaguccugcccuuuacuuagggucuggccccugcaaguccagcuuggcaaagggauucuccagaaccccaagggcaaaagaauguaugucuuugugagaaguucuuggugcgcaugcaugugugcauuuugugugcauguagcucgcucaugucccauucacagaccccagaggugacaaggugacacugacuaauaacagugcucuuugcuggccuuccuguauuacuuguucugggggagccgacuuagagcacggugugcuugccuuugucuucuuccugugcagaugcagugaugggcucuauuacaccaggagcauuagccaggcucagagaggcccugacugugugagggcugugcuuagcaguguuuccaucggccaucuguaguggcuaacguguacucaggcaauuuagggcgagguauuauuuacccugcugacgucaaugagaacauauuauccagugucuuuucuguaguuugaaaugagcaccagagcucagagaacacagccaccuuccacagucugaaaacucuacucacugcucaaugagguggauggaguccugccuauaaucucaugagucugauauucauaucaccaggcuuuuagaaaacaagguguuuuuauuuuaauucaggagaguuggaaacauaaaaacaguacauuuuccuggcagaaaaugaccccauuuacauuacaauuugguacaaagaucauuuauuaaacugcauuuuaggcaauuuucuaacacugagugacaggugacauuuugauuuuuucacacuggaucuauuaugauuugcacacaaaauaccaaagcuauugaagucgccaaauuucucuuaguaauuaaaaagcaugaaagaaaaaaaugacuacagucagauuaaguuuauggaaaguaacucacagagcaagcugaauucagcaagcuguucuuucugcaauaagcaaauggccuugccuuucuagaaagugcaaauaguuucuaccacucuucuucaacugcagucccccagaggcagacuggcccccacuaggcugcccccuccugcugcuuucuucuucuucuuuuuacccacgagaacugaggaugcuuugccacuugaauuuccgugacuuagcaauccugucggguaggcaucgguuaucugcacuugguaauguaacacuacuccauccaccaggguguuguuuguauuucuauuuuuaaagcuacccuuacucacccauuuugguuaugaaaaaugguagcacucuaccaucaaagcauauuaccauuuuguaauccucaaagugucuaauaagccuuccuacuugacaggacuuaaugguaaagaaauucaaugggcauagugacacacuccuuuaaccccagcacuuggaggcagaggcaggugcaucucugaguuugaggccagccugcucuacagagugaguuccaggacagccagggcuacacagugagacuguguuuaaaaaaauuaaaaaaaauuuuaagaaaaaaagauguucuagugccuuuccuuuaggguaaagguugaguucauaauuucuagucagucucuuggguugacuguguugacuaaguagugggcccuuuuggcccuuuggcaaucaaggaggagguauguccuucaaauauauacuuauagagaaaaguacuagauugcauaacuuugaauaagcaaacgucuuugauguaagcccaagcuuuugcaacuuacuggacauuaagacggccaaucuguggugucuauguuucccugugcagugcagucccccagagagcuacagguaucauuuaagggcacuuagagccaggcagcugucaaauggaggcugcagcugugggggcagggcuccaacacaagccaaaagccaaaagccaggcaaggaagguguguaucccugccauccccacuucugagcucugugaccucagcuaagucgugcauccuuaagagcuuugcuucccucagaaaaaugggcagaaucucucuagcuaauccugcagagccaaugugggggaucuaagcaagcacucagaagugccugguacauugcugagaacacggacggcaggcugaguaaacaugacuuguaagacccauccgugguuaagcugucugucaaucaaugcagccagccacaugcccaaaucugcucacauaguauauggacauaugauguguggugcaacuaggaaugcugggagucuucuagaaucagcuagguuguuguaacugggugaaaauggcucaacaaaucagugagaagguguucggagaggagauuuuagggcccaaaggaccuuuuaaggcucaauaucucauuucacaugccacugaaguggugcaaaaagccaugaaaucucucacuucucugagcccccaagccagggaagacauguguguguucugaaguguguuuuuguccaguguugaaacagguugacucugcucuugucucccacaaaucauucugaagguaaguucuauaaaaaguuuccagaagcaacaaagugaugaagauccugccugggcagcgacuccaacuuacuaccuguucuccaguuucuaccuuugaugucuaggcacagagagacggagcggcuccaguggcuuccgaggaggcaguagaggcagcccagcuuaggggcacaaacacagcaaaggucagcccagcacagggacucuguaagacccacugugaucgcuggcaucaagugacacuccauauugucugucucuaagugacacuucauacugucugucucuaaggagaagggguguaaaaaaguugccuggacuaugaauuuucuguaaacuaacagggaacuuaacucacuguugguaugaguguaauccagaccagagaaaguccgauccugauauauuuaagaagcaggcuugauuagagacuggagaaccugcagaggaaggagagcccacuggaucccauguccugagcugcuggcacaccuggggcccuugaucaucuggccuagaagcugcuacuuuuagcuccuucaguuucugguucauccccagcugagaacagccuuuccccagucccuuagguauaauggcuccugggguauagguagagaggucugugaugaaugcuugcugaguacucuauuuaacagagcucucgggagggcagagggugcuacuccacagggugcacuguacggggggggggggggggggcaggaacucaguuauaaaaguuagggagggcacaugagagggagaggcugaaguccucccucccugacaccaggaacacaucucuaagauagagaggccuuggcuuccgcuuuccuaggaugcaaagcaccaggaagggcuuuguucagaccagcucucauaccucacgucacucccaaaggcuucuccuggguccucacuaucccacuggguagauuuagagggcuauggacauaaagaacugcccccacccccgaccuuuguucccaagguggcaguucaggcagccaugcuggggcaaguugagggcuggugcuggucacgcagcucccuggaauagaggagugggacccguaucgguugucuucuguugcauuaacauccucuauuugccuuacagggaccagcaugucaguugcauauaaauacuagagacacacuugcccaacuggaaauugcagaagcaaugcauuucccccaaagcagagaguaauaccccuggauaacaagaccauaaacaaaaaaauaaaagaguaccacacauauugcacuuuuugccgaauggaaauuuuaccucauguuuggaucaccagucucuuuggagaggcuaguuuacaguaacaaagcuaaggguuacuauacaguaguguacacacugcugaugugaaccgacaggcagacacgucaguauuacaaagcugccucuccacgagagagccuaagccuucuuaguguuacuuuaguacuugugaggagaaaaggcuuggaagcuuccaugagucacuaggugggggcagacacagaagcaaucagaugaguggagggcccauugcucucaccagcuuccaccucaggacauaaagguagccguggaacuagggaugucuacuugaaaggaaggaaggaggaaaugggagcuuacgacagguuccggcaggaugguucucggucuucacaaggcgacuguccucaccuccucucugugucagugccuaacaggcuuggccgcugaugagcguucccagcuucucucugcagccuuuaaacuucugacagccucuccgcagccccucaucuguugccuaacuguccugccauagcugcuaggucucccgggcuaagcagcucacaacccuguugggggacagggguuuaugccaaucugcuguggucugauccugcaguccugaaaugagcagcccccauuuucaaucuggaaggcauuuucauuuugucaauauuacagcacuugugcaguaaaugcugggacaacauucuccuucagucuaaagaaaucaagccccacuuuauaacuuggcuuauuuugcaaagcuuuaaacauaucagagaucuuaaugaaaugaucucuccaaugaaauuaucaaucuuaaguacgaggaggaauagaaugaauaaaagaaacacaaauuauccuuacuggauuuuuaguuauuaaaucacaaaaugacagucccuccugcuaucuacuccugcuguaacccacagcccaauuccaagcagagcgcauuuccaaagcagccuggcaccaguggggagcccaacaacuacagucucuggccagccucaaggacugcuugagucaccaacacuggcaggggcugagcugggcugggcugcgggccaggauggcucuccggagacuucccaugccuagucuucccuugccugccuggacacuuacuacagagaggaaaggcaacuuauagguguuucuagaggcagcaucuguggaguagcucucuucuugugcuuuaaggaagacgcuuugugcuuagugcauucaucugcugauuggacaagccacucuaaagaauagaaauuauaauuuuauaaacaauacugagccuguaacaccuggaugucacugugcaaacaacagauuacuaguuacuuuuagauaucuguugacuagguacagcaucuauuuuucaauuaaaggguuaagcuuuucucauaaauggcuaacacaucugagauucuuugauauugcuauaauacaugaacauuucauacaaaucaaaaguuuaaggaauggagaauucagaucccacaugguggaaacagauucaagaaccuuuggguuuagcaggacauaacuggaaagcuugguuccuagagaaaggagugugaugagcuggggaaggcacacacuacacagggcaugugaaaguuccuuuguugugcgucuuuaaaaugucuaagcccuguaugaaacugccugc

SEQ ID NO: 5097 - RNA, 22502 nt, Mus musculus
ggguggaugggcaaccaacgacucagagcccucccggacuccgcccagugcggggucuguggauccuugggagaugcagcugccuugguugcaguugcucaaacgcagucgucuacuugcccacuucucugccuuagucccagggugucgggaggcacuggaguccagccaugcagccgggagcagcgcugcaggcuauguugcuggcggugcugcuggccaaaccgagggauucgaagggucgccugcugagcggugaguguguguccugggggagagggcuggugccagagcaccugggguugaugcacccaguaaaccucagcaguugaggacugucuucagggucacugcacccuggccccuuuauguaguggggcaauccccagauccaaccccggacccaaucagccuucuugaauucucugcuuccagggagcaaaaaugcaaccagcuccaguuccuggggccacccuagguauccgcaacgcuggaagucaguucucuccccgggguuacuaaggggugaggaggauguagcuuggguggggcaguuggcaaacuucuuccagugagugccccuugagcgccaugcugccuggacccuucuaguggaggcagccgauccuggauccgcagggcuaugggaacuguaccuguuacucuccucugaggggaggguggcuggccuggaaaugcuuggagauugggaaagcgccuaguuagccaggaaccagcccugccaggcuccaagagugacucucugcuuccuucccugugugugugucacugcagccucggacuuggaccccagaggagguacagugguccgacuucuuucuuguuccacuaggucugcauggggcgcggggguggggggggggguuggggggugggugggaggagcgugggcggggagcgaucgguaucuuuuuaucagguucccuuuggccaagagggauggaguagaauuggaaucuccacuguauucuagcuugugggucugguuuaagaaaucuaacuuugguuucaggauugggaggggguguuuggcuaagcagaggagcugcugacgccacugggaggguuagggcugcauggcucugugcuuggugacaggagaccuccugccugcccuuccccuuccugcaaaugagaaaagaaagacacuuccugaaggcaggggaaccagauggguccugggccuccuuccagcucugguacucccuagaacucacuagcauacacuagacauaugccgccagccuggaccauacaggaaacucuaucaagguguuaagcuuucucuuggcagucuggccuggaaaggcaggcgggaccacuaguaaaagcaacugcagcuucucuuguaccagguuuggggguguucagggcucuuugcaguccuccaaugccugcauucuccucucuggaacacuuccccggugagaagcccagcaucugagcacucucauccgcugggagccuguucuguuagaaaccucuaacaaggcaggcaaguacaggaugcucccagcuccuuguccacugagaguuuaucaaagcauggagauuuggggagaaucuuguauagcucccucauagauagcacugucuguggccuuuugguuuguaugcuggacaauuaauggacauaaaaaaaaaaaaccaucgucuggcuuucuacagagcugaaaucuuggggauauuaaaacauuccagaaagucugacaauauaaaaucauuuacgccuucuuccauggcagcaauucacaccuguagccugaaguuuggcucuuucauuacagggacugguuuccuuguugaaauuugguuuuuauuuuguacccuuacauccagaaucaugcugugggcuccuguggguuaggaauuggcauuucuguauucucaauaccuagcacaccaagcgagggggauuuacccaauaaaugcugacugaacagaggggugacugggauggguuucagcugcagcaagacuccagucauccagauacaagcuagggcagccugugcuagugaacagcuugcuacuugcugcucaguggaaucucauccauuuuucugaaacagucuucaguccuucaagugucaaucaaaugagagaugggcucccagugcaagcugagucuguaggggaauguggagccaucaagacaguucagugguucugguaugacucaauacucagaucuggauucugccucugcuaaugcucccgauaguuuaugacaaaucacuuacuaugagcuucaguuuucucacuuauaaagugagacauaaacaguccugacacagaagacuguuaugagaaccaaaggaaauuauaaaacuuugaccauagccuugggacauggaaagaguucaauaaacucuagcuauugucuuuagguuagagaucugaccaucaguagcagaaaaccccacaaaagcucuuagcuucugcucaccagagaugagcaaguuaguuccacugcauagacaggggauuucaggguagaggaauccacaacugacgucagagugucccucuacacugaaggaagcacuucacagcaacucuuauucuaagucccauaauuucacaagacucccuaagagcaugaacaucaucuuuguacacaucaagugaagccguaauauuuuccuacuuauuuuaaaauauagaaauaucuucaucaaucugcacuggaacaaaaacacagauccccuacacaauacagacaucagcauuuaaaaucacuuuaacuuuguguugcaaagaguacuaauuuucucuagaaagccugagugguaacaguccaaagauggacaaucagaauuccugcccagaggaagcuucauugagauguuucuaaguacaucugcucugguauacuuuaauggagaacugagacagguugcuuucucuuuccccuaccuccccgaccucucucucucucucucucucucucucucucucucucucucucuagggcagcuggucugccgaggaggaacacggaggccuugcuauaaagucauuuauuuccaugacgccuuucaaagacugaacuuugaggaagccaaagaaaccugcauggaggaugggggacagcucgucagcauugagacagaggaugagcagagguugauagaaaaguucauugaaaaccuccuggcaucugauggugacuucuggauuggccucaagaggcuggaggagaaacagagcaauaacacagccugccaggaccuuuaugcuuggacagauggaagcacaucacaguuuagguaagcauguggaucccacggcggcugauucccuuaacauagcucagaaaagagaugagcaggacccauggugucagaaucacaagaaaguccagacagagccaugguggcaaugccaacagaaugaccaugaccaccgaccagggcaguaugacacagguggcaaacucagcauugaguugggcccaaagugcccuguucaggcgggugaagcccagccgaauguuuuucaauagcaugccaugugugagggccugugguucuggcucucugacccuuggagauaagauaagacuguauugagaaacuaaagguacauaaagaugggacaagggaaggacuccagaccacaggggagagugauaaacugaaaaaaaaagaaucagagccaguauuuuacucuaccaacugaccaaggguggagacuuuaagaaagcugcaguugggcuggagagauggcucagccaucaaaugcuaggcucacaaccaaacauuaagaaagcagcaguuuguaggaaacaaucucacagcaucaagauccugaugaacacugauaacccacuguccacaaugacauugucaucaucucuuccuaaaagauacagggacauggaagaacauuuuuaaaaugucaucauuacaaggccacauaggaaaggggaaacaaucuaucaaaaagcuaaucucuguaugauaguuguaagccaauuuaaauacauaaaugauaaaauacaaaggccucacagacaaaaaggcaaaauaccuaaacagugguucacaacagagaaacugaauugccuguacaauuauguggaaaacauaucagauuaaaagauaaucuaucugggcuggggagauagcucagcaguuaagagcaauggcugcucuugcagcagacccaggcuuagucccuggcacauauauggcaggcucacaacugucuguaguauuucagcuccaggggauuuuaugcccuuuucucaacuuugcaggcacugcaugcacauuguacacagaugugcaagcaggcaaaacacccacacauauaaaauaaauaaaauauuuuaaaugauaguuuaagguaguuucucuguugcguuaagacaucaugccagcucucgcuguauacuggcuauaguuaucagaucuuaucuucauauaaauuguaaaagaaacucccccaagauucuuacagcuuucucuuccuugaagauauuuugaaagacaagguucagagugggaagaauauuuuucaucaaugaagauggucauagagcuagccacaacugacacugucugauauuacaccuucauuguuccauaacauacccuaacccuuuugcuggucucaguggcuaaguagcauaagcagaccaucaucucugaagaaugugaggcgcuagucaacuuacacuucucagcccagaguuaauguauuuucucauugacuuucaaaagugggaccugaaaaaugaagauauucccaaguacauaauguagaagcuucauccuaccaauagcauacagcagcaagccaccuccugccugagauacugacaucuccccuugucugcugaucucugaacacacacacacacacacacaguggcaaccauggaucauggcucaguuagauuauugguaugucuccuagcaaaaguagucuccucugggaacuaaguaccuacagacucccagaucauagcacagcagagauggaaaguacaaacuccacaggagaugaugguacccagcggaggagcugcugccuuuaucccuuggcuucagacccaggaauaucuuagagauucagaguuauggaaccuguugcuauaaaguauuuggagagugccaucccucuccaaaguucaguuaccuugaggcagaugcuucagcuguauucagcaagcucauccaugagccacgcuggcaguuuugggaugcuguuguauguaaucugacauguaauucccaugaucaggggcuuagucucauaccuucuuugcuacaaaauaggucuuuugccugaugcuaccguacuugcggucuuauuuugauaggcaaaauacuauuuacacccuuggguaauggaucugacuaaaacucugaggcagaaaaagcaaacucggugcuuuuguaucuauucucugaaucuauuucuaugaauauauuguaucuacuucuaugaaaaugaguaacuaucccuuucagggcccaauguagcuaauuuaccuccaaguaucauguugucuccuuaacuacuagugcuguauuaaucuuuccuuauucuccccacccucucuugguuucaguggcugaccuacuggcauugccagaccaucucuggagucaccgugaacuuauagggcuggaguuagggucggucuuaauuuugcucuguugcuggaaggcuggguccuugucaucagucacagccacaacacucaugcuaugugcaaaccaaacaauugagcccuucagagccuccgugguuauuguucuuauuuaucuauugagcuaccagggauguggccgagagaagcugguugccaucaccugggucacucauuuuuugacucccugguuguuuaaugccaauucuguggcaggugcucccuggugagcucgguucacuguaugggagauguuguugucucccaucuucaucuuuuuucuuuuauagucucauuaguuagcuguauauaugcuuuccccuccccccaaguuucauaugucugaaacuucuauuuccauauaaagugacuaacgaaguaucauaacuaaagcucuagccagcgggaggcuguccccuuaucacugaccuucaaggccaccucccagugcagcugcaguaagcucacggacaucucagcuugucugauuucacauggcaaacguacccaugagccaagcuugagcugacuguaucagccaguuacagggacccuuccaugcacuggggugugagcagagcaggaagcucaguuggaagaaaugccugagccuagaccagccuuaaagucccuuucugcucuuaaucccacucaaaacuggucaucuauuauggagaccacaggugaggaauaugaagccucuaggacucaaagaccugccaagugcuacgcuuccuuuaaauuauuguaugauacaguuguuuucauuugaaaggggugcucuggcacucccagaucacuagauauccauacaguccaauggaaugacagguccugacuguucacaggguuuucuccaaccuucuggaaaggaugggcuuuccuaaggucuccacucuaccauccuuuguaaaaaaaaaaaaaaauuccuccucgcucaccuggugcagcuggcacacuacucagcagaauaaugggcuggugugauuuucuucacaauuauaggaaauccagguaucacaacugaguuugagggaaaaaaucaaaaucaggcaaaacuauaaguguauacuguuguccauucccaaggaauaugggcuguuccagagucucuugaaggugguaagcagaucugcacacuucugaagccaggauaucacauauagaaagaacacuagccacaugugaagcucugcaggauugaguguguguuccucuuauauaauccuuugggaucugccugggcuuuucaggagucagacaaugaacucggcagagauaugaugggaggcaccacucuacuuuaucagggcuuugacaccacugcuuccugcugucuaucucuggacaugaugcuauuggugaggggaaaugcuucucagagguuuauguuugguguucugcacuaugcuagccgaaggagccaguguggaacuauaccagcuacuaaacaggucuauacaggcccuggauuccauccccccagcagccccuagaaauaggauaauggugcuacacagacacauaagaggauccuuccuccuccagagguagaagcuagaggaucaggacuccaaguucauguuuggccucagcuggcuaaaggaucaacugaauguacuacacagacucggucucacaacaacaaaugcaaaaauuagagccaauucacacaauuuagaacugggccgacgacuacugguuaggccccacugugagcugacugauugaauaccuugccccaaugugcucccauucugauaugugacuuugaggccaucagugccuauucagaccccaucuuuaacaauucuagcaauauuuagacauaccccuuuaacaggucgaugguuauuugguuaacuugccaaaaguccucuggggaaaggacagaggaauuucuuaucauaugcaccugccacacacaucacuguaggauuuucuuccuagguauuuggccucucccuuuaucugugacuugugagucugaaaaugggcucaaauccaaaaauaugauucuaggaaucaaaaaaaauccucucucuucucucuucucucucuuucucuucucucucucucucucucucucucucucucucucucucucucucucucagaugaagcaccauaaauccauaacgcugcagggagggccagcugggcugcagguaaccaaugagacacaaagcccauuucuaccaagagccccuagaugcuccggcauaauguccauaguuuuauuguaaauuucauugucauucaagaaacucauucaacacagaaggugcaacagggaucuucuuuugggcagacugcaacacaggaccaaagcagagucauauggggguacuaccagaagagaugucucuuagcugauucuccugcggugaggcucgggaagacauaggcagagcaacacugucuagagagucagaaguggagcaagauccuagcccugggcagaagcagaacagguucuuaggcagcucacaaagcccaacccucagucggcagaugggguaagcgcuugcaaacuuagagucucucagacuacuggaucauaaaagcuaaagcugcaguggaccuuuacagagaguuaaaggggcaaaagaacgauaucucauaguggacacacaaaggggcuuguuuccaugacccugugcaugugacuugaaaacuaacaaaaaccaagauggccccuguccccuuccccagccucucuccuacuuuggcagccucuauaguuuggaaaucucucuaagauucuucaucuucucauuggacuucuggggcgggugugacagagguagauugaaaagcagcuagauggagauagggcaagcucugagugacauaagccaucucucuccucaguaugucugaucucuguaaaaaacagaaacaaagccuaauuaacauaaagccgaaaaagaagacaagcauuaagaucuuccagacuagcucugugcuagcugcuaucccucauaauuauucugcagaccugagagcauaauauauucuucccuaaaaagagguuguggcaaaugucagaugauugauugugacagccacacuagaucaacagcgugugucucuacuuguuggcagugcuucaauuccuccgucucucuguaucauguucagaagcagaaucugacauuuaugguucagugaaaccugaugagaaaaagccaaagggcaugcaagucuuaugguguauuucuccaguggucuccauuguccauccuuuuccuucaggaacugguauguggaugagccuuccuguggcagugaggucugcguggucauguaccaucagccaucagcaccacccggcaucgggggcucguacauguuccaguggaaugaugaccggugcaacaugaagaacaauuucauuugcaaauaucaugacgguaaugacucuuuucccaacuauacggcuaauuucccaaccucuuucuccauuucaaaaacagcugcugguaccaagaacuuauccuauacucauugaggaagccuguugcaaaugccagaaacguuaaacuuugagaauucuuguacauggaaacguaacgauacuuccucccugagaaauaguucuagcaaaggagaggcuagcagaugcaaaagaagggcugagaaaggaaaggaucuaauuuacuuaggaugagaagcaagacuuaugagaacacccaguggaggcuucuguugugaacaggcacaaaugcucgcccauuuccuguguagucggcugugggagccuggacuaugcugacaguuacucuagcagccacgggagauuauuucuuagaguuuaaagaaacauacuaaugacaaggcaagugacaaagaaucccaacgucacuggcagucuuacacagcgggcacuucaauacauuuaaaagccccuagccaacugccaucuuuauauuugccuugcaaauuucacuugcauuugcuccaagaucugcaaagagaguuggagcugaugagaagccuauacauagucuuacuccgcugaguucccagacgccuuuauuaaaauugacuuagaauuaaauguaaacucauccuugaucugucccugaaguuucucacuucccugaagccgacugcuuagccccacuuccacagucuuucccuacaggaguagaaugacuugcuaauuguauccauuaucauuggggaccgaauacuauugccauuuuuaacugcuugaacuacauggcacuuugaugauaauauugugcuggaagauguccuuccucacucauuccagccuccgaugaacucuucuuccccgugcccugucucuccccaccaaacagcugccucaaguagagaggcugcagagccuugguugaggaggucaccuucucagagagcaaaaggaagcacugguuaccauuagcuuuccagucuccaucauuucuguuuauuaaauuccauuggcuucaugguuuaaaugcuucuuuaacaguuuuucuuuaugagagauuuugaaauuugcuuucauauccuuuaaaaacaaacaaaaaaaaauugguuccuuucuaauaagacacaaauugccucuagcuuguauuauuaccugaauuaguuugacugaguucuugcaugaaaagaauagcacgugcuaagaguuuaauaaagagaguauaauaaaaggcucuuggcagcgguauaggccaggagcaggagaugauaaaguaccuagggauuaucugcaacuggaagcaauaacaccccuaagcuuaaagggccaaagcaagggaaccaucauagcagggaccucaaaagagaagcagaagccacagaagggagcugcugaaaaagcaucggacaggaaggugaacaugaggaacacgugccgugagcucuaccuucugaccucagccuucgcuucccauuggcuaagaccaacaagacaccaaagaacagggaugccuggugaaacaguccauggagaucagccucccaggacauauagcugagaucuuaaacagggcagggggcacaugagacccacaagaucaaugcauucagcuuacuauacagggcaaagguccucgugauaaggcccugccucguuuuccauccuccccucucagcacucucagcgccuccccucacuccuuucaaauacuucugaacucagugacguuucuugaaagcucuuaucugguacuuccugugccugaaacauuucccccucgcccagucaacucaguccuaccuucaagucucagguuaagcaucaccuucucuccugacaacuaaacacaagucacccugguccuagagggcguagccucgcccaagaggauggugauagcagugaugauaacgguguuccauaaguugcauaacugugucaguuggcagugaauaauuaaauagcagcaucuuaucaaugugcacucccuggcugugaccauuauacuauguuuauauaagagauuguguucuauuuuuaagguuaaagucauuaggcguaaaagggucccauaccauaucagcaacuuacucuggaagagaaguuauaugugugcauguaugcauguaaacauauguauauguuuauagauuauaaaugguaaauaggcaagauggcaaaaugauuauaaaagacauguucagauucuuuguacaaucuuaaaauauuuuuuuauaaaucuuuaaugauuucaaaacaacaauuuuaaguccuuuugggagccucugaggaccagacugccucacauacagaguguuuauaugccuacuuacuuguuuguuccuuuccuacaccgugucaucaagucuggaagcauacauuucuagccacucaaugaauuaaagagacauccguucugucauucccacaggguggcacaacacccuacuaauauuaugaaacacugguaagggacugugagagugagugaucaugucuaaaacuggauuucagaaugugaucauguggaauugguggcacacuagccggaauguauguuaaagagacaggaacauucaaugggaaugaggcagaaaccaucugagguauggcggauacuaugcacaaacuaauggccucugugcacugcugugcugcgcccguggccacuaugcacuagugugcugugcucauggccacugugcaccgaugcugugcucauggccacuaugcacauauauguacuaugcucauggccacagcaucaguggucagaacuacauacaggaggaugaccauauacggugaucacaagauaucagaauauaaacucuucaacugauucucucacauuuuguuguucuaucuuuacuaaguagcacaguuaugucuucuuuauuuaguuagugaaaauaacucuuagcuaauuauuagcuauaaaauuuaagaagguuauuuaaaucccugcauuuuaauuuauaauaauaauaauccccuauagaccuguuaucaagauugaaaauguuuuuauaaaauguuuagaauggucucuaguuucacauaguauccuaugugguuaaguuuaacaguaaauaaauggagaucauuucugcacacacauauacaaagaaagaagauuuuaaaaacuaaaauaaaauaaaaaagaaagaagauuaaucauuacuucccuuucugaaugaaauuccugauaucuggaccugacaacuauaucacgaaaaccuccaugcuccuaugaauuucaggcaucucauuagcauaagagaccccaugcuaauacaaggucagccaacagcaaaaauaucugacuuagaagcucuuaggaauguucuaaguaucucaaggcuaaucaccagucucugucuugaaacuggacaauccuucaaccacuucuacuucuuacagaccuaguauuuguugcucucugaacuguucucaguaugaaccgguaaaauaucuugaaccaaucuuggaccacuuaagacaaucccagccagggacugccaugggggaguagggaucaaugcuggagcccaaguagcuccaugcugauaaggugggggcacacaggagcugaauacauaagcuuucuauuuucauguacauuugagagccuaagaguaaaguucuuaaauaguuuaaaacaaaacaaaacaaaacaaaacaaaacacugaauuaaaguuuaaggaaggcuaauaauuuuuuuaauuuuuuuuaauuagguauuuuccucauuuacauuuccaaugcuaucccaaagucccccauacccucccacucacuccccuacccacccacucccacuucuuggcccugguguuccccuguacugaggcagauaaaguuugcacgaccaaugggccucucuuuccacugauggccaacuaggucaucuucugacacauaugcagcuagagacacgagcuccgggggguaaugguuaguucauauuguuguuccaccuauaggguugcagaucccuuuagcuccuuggguacuuucucuagcuccuccauuggggguccugugauccauccaauagcugacugugagcauccacuuauguguuugccaggcacuggcauagccucauaaaagacagcuauaacaggguccuuucagcaaaaucuugcuaguguaugcaauggugucaucguuuggaggcugauuaugggauggauccccagauguggcagucucuagacgauccauccuuuugucucagcuccaaacucugucucuguaacuccuuccuuggguguuuuguucccaauucuaagaaggggcaaaguguccacacuuuggucuucauucuucuugaguuucauguguuucucaaauuguaucuuauaucuuggguauucuaaguuucugggcuaauauccacuuaucagugauacauauugugugaguuccuuugugauuggguuaccucacucaggaugaugcccuccagguccauccauuugccuagaaauuucauaaauucuuuuuaauagcugaguaguacuccauuguauaaauguaccacauuuucuguauggaaggcuaauauuuaugugcaacaaauucuuugacuuaagcaaccuuccuccagugucuguuaacaauuauuaacauggugacaauaaauagaguuuauuggaauuagaugcuacacucuagcugauuucauuaagguggaggaaaauguaaguauugaguuuuuuucucuuuugcugcagauaaaccaaguacaacacccucuauuuggccuggagguaagucuaucauaugaaauuuggguuaauuugggacauuucacagacuucuuuauagauuuagaaccaugccuuuagaacacauuauucagcaggaacaccacugguguuuuccugggcaaguuggacagauaucugucacaucgcuagcucauugcucucacucuccacgcacacuguuacccacaucagucaaaacugaaaaguaaugguuugaaauuuccauuuuggauguaucaccaucaucuucaucauccucacugaugccuaucaucaucauuaucaugauuguccauauaaucagugagauaagaacugagucuaccugaucacuuaugauccuagcagugagucaucguaccuuuccccagguaauuuaguccuuuauguugcucagcuccagcugcuuguuggcugcuuuggugccuggucauuggcaacaaaggucucaccaaaacuaugaagacaugucuggggagauggcucaguaggugaagugcucacugugcaaaugugaaaaccugaguuagaacuacagaauccaugucagaaagcuuggcacagugaugucgcccuuugaacucaaugcuggggaggcagaggcaggguuuauuucccagucaaucuaccugaaucucaagcucuauguucagagagucucugucucaaaacgcaagguggggaacaguaguggaagagauuugcuaucaaccucuauccuauguacacacauaaaacacacagauacacagucuuucacacacauacacagaacacucacacacacacacacugaagacaaaccucuauugcaacaaaucuaacacuugguacuuugcuguuuauaaaugacauuggucaaauuacuaauguuuucuugcaucccacuuuacauguugcaagaccucagagcaugccugaacuauagcaccuuucuucaaguucucaaguccauguguaucucucucaggugaagcaacugagccagcaacacccuuacuuccagaagaaacacagaaagaagacaccaaagaaacauuuaaagaacgaagagguacuugggaaacguagauaacaaacuccuuugacuacaaaugaccuauggcuacauuuccuacuuuccucuucagacagcuccuaaaaaaugaaauuaaacaaagcaucugugacauugcaaacacuguauuaaaugacagguuucauuggucaguugugcaaugggggcuauccuaggacgauugaggaaaagacuagacaggaggucaaagucugcccugucucuguaaaggcaaagacuaaggaacuuuccugaccaugggagguggauaggauagaggcugggagaauggauguagaaaaacaagagugaaagaacccaagccaugauacauaccaucugggaucaauauuuaucaguggaccaacugaagagaugggaaagauaauaccuaaaagccugcaucaucaaagguaaaagauaguuggggugauaaguuggagugcuaaugagcuuucgauuucacucuuacccugaguuuuaagaaggaaaucugugguuucaucacugggcaacuuaauuuuuuuucucuaugcuuuagucacuuaguauuuuucauaucuagcggaaaguauuaucauguccuuaaaaugaaauguaauguuuuccugggauucaguucugacacugagagucuacacacacacacacacacacacacacacacacacacacacacacgaacgcacaugacuuaaaaggcacauuccacaacucucacaacagacagacauaaaccacaagucuggaaguccugagaccaccugcacuaauguucaacuggcuacacaucgaguggugccugccaguccuguuguguucaguaauucacuagagcucacagaacuuagaaauacagugucuaugcacauuacuaucuagaauauaagcugagagcaaccaaauaaagucacagccagggcagagucuggaaggguuucagaugaguccuuauguaucaucuuccagugaaaucaggacuaucaaccuccuuguuaugauuugacuauaaaauaucuucugaaugcuucgguauugaauguuuggucucuagguagcagugcuauauggaagauucuggaaauuuuaggggguggagccuugcugggggaagugggccacgggagcaugccuuugaggcuuaugcacagugccuagcauguuccuuuuucccggcuuccuguucaccaugaugugcacagccaccuccucuacaaucacuuaccuccaugauguuguugcccaccucauggagcccauccugaaacagugagcugaaguccaucucucuucuuuuaaguuguuccuuugaguauugugcucucagcuuuacaaagguaaauaauaaacuucuccuagcacaccgugcuacccacccagggaguuccauuaggcugugguguucggagguuucauuagguuucaucaccuaagcaagaaggagaugaucacugucaggugguauagggagaguccugguaccacccagcucaaagccucacucuaugaucaacugaugggucuucuugguguaaaagcacccagucuaagaaaucuccuuaccauaaauucugugcuguuuaagagguuugugaauaaaaauucacucuuacaugaaucuuauauucaaucuuacaucuuaaaaaauucagaaccuuucuaccaaugaucggagaugaaggauaaccaaacucuuuauuauccaauagauauaaauauguaaaaauaucuuuaaaagagaauaaagagcuguccaaaauaaguggcauuucuauaacuuaagacgggcauuuuaagugaauccuccauuuuccgagugugucuguuguuuuugcuuguuuuguuuuguuuuguuuuguuugauuguugucaaguuucucuggauggucaggaaccuuggaucaguggaaaaagaaggguuagucucuaauccuugauuucucucacagccucugaagggaacaacauccaguucugguucagagauuacagaguuaaguggggaaaaagaagaccccuuaaauguucuucccagcacuuagggauuuagccgaugccacuuggccuuagucagaugugcugggaaggucugauagucuccucuaugugaucuuucucuucccugcaaaugauccugggacuuuuggcuugaucuuuuucaugccucuugccucuccaagccugggaauuucuguggaagcaaagacaucuacacugcccccaccaagcccuguuucacuaagaaguacauggaaaaggaggaucuuugaaaaagaaauuaucaaagaugauuuuacaauauauacaagacucuaaacuuuaaacuugcuuacauugccaccuagauuaauugguuagauagaaaaugcucauuuguugaaacuagggacucugcuaacuagacaacugcaucuaucuccuagaaugugcuguuuagaauauucuaaugauugugcuuuuuaaagccugauuugaaaacauacaugcacacacacacacacacacacacacacagagagagagagagagagagagaaagagagagagagagagagagagagagagagagagagagagagagagagagaucacugggcuaauacaugauauuuuucuuuuucagaggcugcuuugaaucuugccuacauccuaauucccaguauuccccuuuuccuccuacuuguggucacuucagcuguauguuggguuuggaucuguagaaggcaaguagaacucucaucaugcaaaccuuugcucccucugcacuaggauguugccuggcuggcaucauuaaaggccaugacaacuccaagagaaggaccacuauagaacugagaguaaauucuggcaggacacgaggucugcaugccaaacaagcagcaugcuucucugagcaucugugcugaguugugauuacgcuagcaguccuacgugcuuucuccucuguguguguggaagauuuuuaagcaaaguggaagguaaaacacuguuauucacuuccugugcacccacagaucacccaguaaaguguucuccuaaauguagguccucguuccaaaaauguuuguugaguaaggaaugacuaaugggccacaugaaaacuguguguuccaagggauucugggaagcaucugacacaaagccacuuuauucagaaugaaucagccaaauucuuuuaaacugacuuuucuuuuaaauuauuucaaaaguguauuguugcaaagaagcuaaacuagguagcauaggcagccucuguauguagucuggauggcgugcugguguauuuuaagugcaugcaacuguucucuguucacacuguuguucccugucaucaaggcagacacuaaaggaggagagcauucucacauuuacagcagaaaaaucagaguccaccuggaguugaacucacuuugaugaacauugagauacauuuguaaaauuccaaugcagaaccuauuucauuuaauaauccccucaaacguuuauuaugaguaugagcaguguguguguguguauagauagauagauagauagauagauagauagauagauagauagauagaucuuauauaaacacucaaaagaauuggccauuacuauaaucauuuuuguugguaauucucuugaauuuaaaauagaauugaguuaaacaauuacagauacauuuuuccgaugacuuaucuacaauugguucuugauugcuacuuuuaaaugcauuugccccuuugccaggacaagggaacauucuuucucuaucugucucugucugucucucauguguccguuuguccuucuuuccugcuuuucuuucuuccauauucauuuuuaagugguccuaggaacucagggcuucacacaugccagacaaguugcauuugguuggcuauauccccauauccuuaaacaauacuuuuaaguguuacaaacaaaaugcauugauagaagaaggaagcaguuauacuauuacagaauuuagcaaaaauauuucccaaaacgaauuguguuucuuuauuagugauuuuuagugguggguauaauuauaauauugaaguagcgguaagcaugaaauauuucaaagcaacucuaauaacugauaugguauaggaaugugauuucuguuggugguagagucaaugacauuauuaauccuacucuuguuuauugucuauacuuaugguagaaugugacuaauuuuguuuagagaugaguuuuguuuuauuguucaauugguuaagguuugguuugguuugguuagguuagguuuagucuaauuuuuuccuacuguuuucuggccccacauuuccgaaggaguccuagaacuaagacagugaaugguagguguaggaagaccagaauagaacaguuuccuggggugucuccuaccugacucacaaagccuguugguguagguaggugagaaacagagcaaggugacuuccugaggucacuucauccacuucaauagaacagggacauucucaggacccuggucucaaauacucagccugguucucuucuuuuagaaaacgagaacagacagacccuagcacaaaggagcagcacaccauuuggcccacuccucgccaagaaaacagccccaaccuagauguuuacaaugucaucagaaaacaaagugaagcugauuuagcugagccccggccagaccugaagaacaucuccuuccggguguguucuggggaagcuaugccugaugacaugucuugugacuaugaaaacauugcugugaacccuucggaaaguggguuugugacuuuggcaaguauggagaguggauuugugaccaaugacaucuaugaauucuccccggaccgaauggggaggagcaaggagaguggauggguagaaaaugaaauauauuacuaagacacaggaaaaaccuggcaagaaugcaaaaggagaagcaaaggccuccgauuucuuacaaggacaauauucagaaagcuuaugaaaaugcccagcucagucuuaggggcaagcacagcaucacaagucccuacuggguccccaaguucuggcuguacuucuuaucugagggccucauccugcugagccuucugagaaggcacuuugcccaggggcugcugcacagcagacucagugauugucagccaguggcuucuaacugauaucugagggcuggugcuuucacugcucagcaugaagggcugaccagggagcuuggaaagcccaccucuagguucuguuuuccuugcucuauacagcagcacaggcaaucacaaaaacacaaacuguggaauccucucaaagccucuguauggaugccucaggcuggccugcacaucaauaauuaauucccaaaccugcacccccaccccgccccugaaaaauauccaauaaaaagcaggaaguagaauguuagucagucugugucuacagccuuuccucugcauguggccucaggggaacucuuuuuuuuuuuuuuuuuuuuuuuuuucauucucccgacaucuaaacuuggaaaaauccaacuuggaaauacuuuagaaaguaaaaaugagcucuguguuugcuucagggcuucuuguucucugggcucagacaguaugugcuguucuggggauggguggcagcagccugggaacaugacugugugcuggacugguaaagaguagacauacuaaggauaaggagaggcaggcuucucacuaucagagaaggcagccacagcuaccagaagggaggaaacuggaauagguccuauugugugcaauggaaauagugacagugcugucacuguggagcuuuauguauugaguauccaugaauauguauauguauauguauauguauauguauauguauauguauacucuccauuaaauaagccaguacuccaugaaauuggaugacuggagggcagaagcagaagaaauaugaguuacuugaguaaugaaaaggaaauaauggauaccuaaacauagguagacuuaacagguuuauuguucuacaggaaccaugcccccccccaccccccaccccccgcacaucacaauggccuauaauguauuuaugaauaaauaugagaaaggagcucaaggguagcaaacacaaagucaugauagaauauuauaaaacuauaaaaaauuauaaaauuagaaaauguuauauuuauugccuugguucaccaguacacauuguauauuugugcugugaagugacauuauuguuaaaacuuacauuuaaagagacuaagaaugagagaggucauuugugaaacuuuacaccaccaccaagcaagaacgauugggaaucaauagaucacagaaaccaacucauaauggcccaucuucgguaauguggaauaauuuaaauauuaaaucgugggcuggugagauggcucaguggguaagagcacccgacugcucuuccgaagguccagaguucaaaucccagcaaccacaugguggcucacaaccauccguaacaagaucugacucccucuucuggugugucugaagacagcuacaguguacuuacauauaauaauaaaauaaaucuuaaaaaaaauauuaaaucguuaaaaguaaaagcgacaaagagaaugugacucauuagauacaccagaaaaacaugggcauaugcugacacaaaauaagugaauaaauuaaagcuuugauguagaaugggauauuuacaugauuucagguaaagaucauuauuaacaaaagucacccaacaggcaaaacgccaccucagucaacugaucggugugaacacuguggaugacaggccuguacugagauuguccaccucacauugugguguggugagagggacauggcaucacaucugcgcugucucagucaaagaggaagccuuacacaacaauaacuugauggacaaucuacaaaguaacuggaccuggauagcaagccugaacucugauggaggacaguagaagugauggcugcacacgcgacuugauccugaaauggaccccucuuuuccuguaacgaaaaauauaggaaaaauguggaugaagucugaggaugaaaugauaaaauguguagugcuaauuucuugacuuuaauguugcauuuaggauauguccucaugaugccgggaaugucuucauagaaaacacacaguaaguaauaaaggacaauggaccgucaggucgaccacuuucccucgugugauuuggggacagggaugcucuuugcucuguaccugcaaucucuucucuguuagaaaguauuuaaggaaaaccauuuacaaacaucacuucuauaacuauugaucacaucacuuacacuauacccauucaucugaagucaauacacaggcuaugcugacagcaucuaacagucuuuaaaccaagacaaaaacaaaugaauuucugagagaaccaucaucaucaguaccuagcuccaggugccggcccauuucucagaucuuugccuugcccuuacaggcagcagggaguuaugaugagcacccugcaaaagccaauucagagacuccuuucucccaguacugcccauauaucccccucuaga

SEQ ID NO: 5098 - RNA, 1288 nt, Mus musculus
cucggcucucugcuccucccuguuccagagacagccgcaucuucuugugcagugccagccucgucccguagacaaaauggugaaggucggugugaacggauuuggccguauugggcgccuggucaccagggcugccuucugcucuccacauggcaaaguggagauuguugccaucaacgaccccuucauugaccucaacuacauggucuacauguuccaguaugacuccacccacggcaaauucaacggcacagucaaggccgagaaugggaagcucgucaucaacgggaagcccaucacugucuuccaggagcgagaccccacuaacaucaaauguggugaggccggugcugaguaugucauggagucuacuggugucuucaccaccauggagaaggccggggcccacuuguuugugacgggagccaaaagggucaucaucuccgccccuucugccgaugcccccauguuugugaugggugugaaccacgagaaauaugacaacucacucaagauugucagcaaugcauccugcacuaccaacugcuuagccccccuggccaaggucauccaugacaacuuuggcauuguggaagggcucaugaccacgguccaugccaucacugccacccagaagacuguggauggccccucuggaaagcuguggcgugauagucguggggcugcccagaacaucaucccugcacccacugaugcugccaaggcugugagcaaggucaucccagagcugaacgggaagcucacuggcauggccuuccguguuccuacccacaauguguccgucguggaccuggcaugccgccuagagaaaccugccaaguaugaugacaucaagaagguggugaagcaggcaucugagggcucacugaagggcaucuugggcuacacugaggaccagguugucuccugugacuucaacagcaacucccacucuuccaccuucgaugcuggggcuggcauugcucucaaugacaacuuugucaagcucauuuccugguaugacaaugaauauggcuacagcaacagggugguggaccucauggccuacauggccuccaaggaguaagaaacccuggaccaccuaccccaacaaggacacugagagcaagugagaggcccucgguugcugaggagucccuaucccaacucaguccucaacacugagcaucuuccucacaauuuccagcccacagccccauaauaacaggaggggccuagggagcccucccuacucucuugaauaccaucaauaaaguugcugcacacc

SEQ ID NO: 5099 - RNA, 711 nt, Mus musculus
ggaugaagcgcucuuuuugccccaucuacugcgaggaugaagaccauucucagcaaucagacuguugacauuccagagaaugucgaaaucacucugaaggggugcacagucauugugaagggccccagggggacccugcggagggacuucagucacaucaacguggagcugucuucuugggaagaaaaagaaaaggcuccggguugacaaguggugggguaacagaaaggaacuggccaccgucaggaccaucugcagucauguucagaacaugaucaagggugucacacugggcuuccgauacaagauucagucuguacgcucacuuccccaucaaugucgucauccaggagaauggcucuuugguugaaauccgaaauuucuugggugaaaacuacauccgcaggguucggaugaggacagguguugcuuguucugucucucaagcccagaaggaugaguuaauccuugaaggaaaugauacaacuuguuucaaauucagcugcccugauucagcaagccacaacaguuaaaaacaaggauaucuggaaguuuuuggacggcaucuaugugucugagaagggaacugugcagcaggcugaggagugaggaggccucaguuccuggcuccagaaacgagauccugaucacaagaacaauuugggcucuuuugggagaauaaaagacuuauauguuaaaaauaauaauaau

SEQ ID NO: 5100 - RNA, 41592 nt, Mus musculus
ccuccaaggcgggagcuuuugucacuuuauuguuaaccaaccaguauuauccaagauuagagauggaauuguaauuuacuuguacaacauaaaauuaugcuaaugggaaauuaccaaauacucauuaguagguuuuuacauugcuauaugaacaugugcucucaacugcuaaugauaaauguuauaauugaugcaaucacuaugaaaacccauuuugcaaauggcuguuccuguuuagaaaaauucauacagcuauaaaaauggauuaaacccacuuuaauccuaaucuacaaauagacuauuaacagcaaauauaacugguagccuuucaacacuguaacaacugauguagcaaugauaauguacacaaugcaaagagaaaaaaauaaaucaguaaaacuccgagggaagccaaguccuuuagcaauaaggacuaucgcugugauguguuggaaaagugagcacuuauacguccaggucugagugguaaggccuaccgucucccucucauacagaaagcauucccucgcaaaugagucugaagcacgugcacagccacuguacaacagucacuucaagguuaaccaguucucuuuuguccuacagaguccaaaaauauauuaacccuuuccuuuuuauaaugucugcccaaauuaauccuuuuuaagucagcaaaaaucaaaaaacagcacaaaaaacaaguugaaucuacugugcgugaaaauugcuuaaugaaauggcaauuuuaauagauaaauguuaaguuugagugcauaauaccaaauggaaaguagcugaaccacgcagagaaaacgaggcuuucugcaucuucuguaaauucaggugcuucacgaucagacagugucagaacaucuuucuagcuggaaagacuucuucaguaagacguaauugaaauaaaauuuguuuuuagagauugcaaauaaaaauaagcagugauuuagaaaccaaauaugcuacaauaacgaccccuaucccaucaagaacaaagaaugggauguuucauguacugcaaaggcaacgucuuucucacaaagggucacucagcgucggacacagaacaccccccagggaacagcauaccagugagaauauacaauaaucuagacacaaaucagagccccacaguucaacagaaaggcaguuaaaacauuagcacugggaucucaaaagcacucagugaaggccaugauugagacugcguaugggugacagacaugcagcacagacugugcguacagucaccacguacguaaagagugagguaguauuuuguucucagaguugauguuuccauaugcugcccuugcagaaaggccaagguuuggguuuuuuucccccuucaacaauuagaauuaguuaucauccacaguuaucuucuauuggacauccuaagaacaaaacuugaauuuuuuucagagaccauguacuuacaaggccacuucaucaauaauuuucuuagaagcgacugccuaguggcuagaucucuaaaguaacaggcaaggaaagccaccauaggacuacaggauuugaaacaccaucacucaagcuaucagagaugacugcacuuaaggaaagcaaacaauacaguaacuaagggaucuuuguaauaacuaaccacuggcugcauacuacgcuguccaacauucuaaucaucuuaugauguagucccaugucugucugucugucugucugccucacuaucucauauuauacaccuccaguaagugauccgugugacaccagaauuacagcucuaucaugacagggcaugagaaggucacacugacaaaaaacaugagaaugaacauggagauguauguagccuacaacauggaaagggcaaagaaaacuaaguucauuagcuaaacaugcacugaaauguccaccauuauccuaagauguacacagugcucaaagcacauacacacauuugucagacguggccauuaguauuaauauucaacugaaaaagaugaaacaaacaaaaagugaaaaauguacaaaagggugggugacagaaugucauuauccauucccuggacaaaagaaaaaugaccaaacaugacaucacacugccuuaaugaugaaggacacccuucaguguccugcuagugagcacagucgacugguaugagugcuuuggcaaggugggaugcguuccauugcaucugcacugcacaggccugcuuuucucugguggugguucagcuuaugaaggacauggaucacaagaacagcucucacauggcuucaaacucaucgaugcgcugcuucguauugccuugucgaaucugccgaagggucuuguacuuaucacggccggccuugacauucucagcgugaagaacaucguucugugucuucuugguuucaucucuagcuugggcuaauucugaacucaaugccugcauuaaaaauauauauauauauuacucuuccauaaaguuuuaaaaacuaugacaauagguuaaagaugcaaaaauucauguuuuuuaauauacuaaucuuuccacuguggaauguuuuucuggcugguaugcaagcaucuuuuuauuaguuuuauuucaugugcauuaguguuuugccugcguguguguguguguguguguguguguguguguguguguguguguguguguaaggguauuggaucccuagaaccagaguuacauagacaguugugagcugccagaugagucugggaauugaauccagguucucugaagagcagccuuaaccccugagguguccgucucuccaacccacagcaucuuucuuuaguaacuuuaguaacuaugaugcuaggaaaggaugcccaagggcugucuguucuuuagucaucagccaggccauuuuauauauucugaauuacucuaacuucaaggucagugcacucauuuuaaaggaaagagacuauuaagauuuagaaacaauggacuuuuucucuagaaauuuuaauacacuuaauguaaccauucuucugcuuaacauuucaccaacugaaaaauuagauaauuuuuaaacuauugaguaacauuaaauuuuccuauacugaccuaguaaugcacacuuaauaaauugaccuuuuguaauuauaaaaugcgaauaauuccaaugguauaauauuuuaaaggaugaagcauaaaguaguacaucauuguuuuaaagacuaaguucauuuuacacagcacuagaauacguuuuuccuuugaaaaugagccaaucagcaaagccccuugcuaacaggguuguauaauagaagcacuaagggaaugucacacuacaggacaaacacaagccaaucacaagccuggaccauguuagcaggagcccaugaaggugacuuaggugcacacagccucagccaucaguaccuggagcugcuucuucacgcguucauucuucuggguuucggugacccgcuccuccucgcuucggugguucaucacccccucgcuggacagcucggcgcuggccuccgcacuguucucguccugcucgucaugcucguucuccgugggagggaugacuggaggagggggagguggagguggcgcagacaucacaguuuuuagcucuucuuuggucuuuuccaagucuuccugagcugcaaaagccugaacauaaauaugaauccagguuuauucuuuguuccuguaacaacuuaauggauauaaugcugggaaugucaugacagauuacacuugagccacaagcagaaaaagaaaacagccaauggagggauccgagugucguuacucuaacacaaugguugaaacacugaccuaaugauggguuaacuagacagugucaucucacaugacacaacaugaacuaucacaaagcacugauauuugggggacaacacuucccggauugccuggaaaagccccgcuuuacagucuuguccuguauccuauuaagaacacuaucuuacuauucucauaaggcuccuaaacuaugcaagucuccuggaagaacuccuuaagcuuuaagagucacaguucaguuuacaggaaaaacucaggauacagagggaugagaccaugagaaacccaagagacacacacauaaggaagaguuuccuacaggccccucggcaaaucagugucagcagagggucuauccugugcuaagauuuaaagcaaacagagacucuaaacuccugcuuugcacacggcagagcaaacuaccuacaaauuaccaacauuauugguuacauuuuaaaaucuaaucuaacauugagaugaaaauucgauaaaauugaauuauauacauggaaaaaauucauauauauaaaauauacauauauauguauguauguauguauguauguauguaugcaugcaugcaacuuauacauaacacauaaccaggaauagaaaaggauauacacuaauguuuuaaaacgacaucuuagcuuacaagacuauaauuuucuuuuuauauaaauuuuuguugacugugugcauuuuuaaauuguucauaggacuuguagcuguaauuuuuaagguuugcgucucuacaguucauagaaaguuuccuuuagccaggucuauguaauucucacaacauaagcaauauaauggggagacuauuuuacccuuuuucuauuuacauauauuauuuuacaaauauacacauggaauauaaaaugucccccaaaauugaacuucuacaaagaaauuucuguuguuauuguuuauguuuacggauuuauuuauuuuuauuuuaugugcauugguauuuugucuaugugugugugaggguguaggauccucuggaguuuaacaguugugacuacuaugugggcgcuguggauugaacccaguccucuagaagagcugccaaugcucuuagccacggggccaucucuccagcccucuacaaaaaaacuuaagaguagaacaaaaccauuuauacaguaagaguauuucuuuucuuuuuuuuuuaaagauuuauuuauuuauuauauguaaguacacuguagcugucuucagacacuccagaagugggagucauaucuucggaccuucggaagagcagucgggugcuuuuuacccacugagccaucucaccagcccccaagaguauuucauuauagcaaaagcaccacauauuucauguaccuuccuuggguauaaaaaucauaacuguauauacaaauugaugcuacugaauuaaacuccuuuuccuuucucucccaucccucuaauuacaagcuugauuuugugaauucuuuggaaaucuuagcagucagaaucaacugcucucuuaagcucugcaggcaguuaaugcucgcugagacagacacuuuccccagaagcguagccaccagcaagcuguccuugcuccucuaaguaagauuucacccaacagagucacugguccagaaaaguagaagaggacuaagugggaagacgagggagcaguggaaauagccggucagacuauacauaugauaugcauuaugaaaacgccauaacguccauguauaauuaaagcaugcaaacagaaaccaaaauuuuacuaguagcaaaaguauaagcccuaccucgaucucgccuccuguaacuggcaggcgugacuguuucagucuaucaaaguguuuaacucuuuccaguccuauuuucauugcuacauccuucagacauuuaagcaaccaacaucccaaauccauacuucaccuaaguuuguguuguuguugucuuaauaaacucauaccuaacugugcuaauuguguacacacacuccauccaauugcguaaguagaucauuuauuuaaaguccccuauaacucaaucuucuauuaucuaacuugucacaauaucuacuuuuuugacuuuuuacuugguuguuagcuauuuauuuacugacuguccucaaaucugacacauacacuccuacuucuuauacucacucaauuuuuucuaucuagaacaaccaucaacacuuuagccuuuaauccgauucccccaaaaccagcuuauuucaagacccaauguaaugcuuaugaaugucccagacagccacgugucugguucccacaggaacucaucugcucuuaugcauucugagcauaugcugaucucacagcaccucuaucaaaucagccaacggacugcuggcucacuagcagaguagcuggucaagaaaagcuagcacacaacaaaacagucauuacuuugugcugccacucaguagcuuccucuuccuuuuucuucuuggcuucuucuaaaagugcaaucuuggcagugaauucggcaaguucugcugccugaaauuaaaauguuuauauauuaucaaugcuagagacaauaacauuuuuaauauucuuuuacauuuuuuuagucaaaaacuuuaagcuugggcuguuuuaaguucccauuuuuuuaaaaaaggcaguauuuccugaaggucuuaaguaguuuauaguaggaacuugagauaaaaaggucauauaagguaaaguuaaaagauguuuauuuuauagauaaucgaugacuuacacuucagcagugagaacuuaaaauaucuaagagcuguguuucaaaccuuuaucacuaaacaaauaauuacauaauguuaugcagugcuaagggcacugucagcaaucucaucucauuacucagcaguccaauuuucaaaaagaaagaaccgaaaagcucaaagagcaacugauaggugugcuaugacacaccuggaauccaaacuugcuugguauuuaggaggugggaguagaaggaucaagaguucaaagccagcccagaagccagcccagguuaguagcaaaacucuguuuacaaacacaggauuagaagacguaguaaauaaacaucugcauuuauauucauauuuagaaucuucccugugucacacauaauuucauuauuuggaaguauguuaaauaaacaaaauuccaacaaacuaugguuuauagccaucauaaagaaagcaaacaugcuaugccaauuuaucuaaagcacaagaugccaugcggccucuguagagguucucaacuguggguuaugaccccucugaggauugaaaaacccuuucacaggguuaccuaacaccauuagaaaacagauauacauauuacaauacacaacaguagcaauauuacaguuauaaaguagcaacuaaaaucauuuuaugguuuggggucaccacaacaugaggaacuacauuaaagcaauauagcuuuaggaaaauugagaaucagugguccaaaugaaugaaacucuucugugagccauaggcuccauuuaagaggaaacuacaaacagaaaacauuauaugaaagaagguugucauuaaaaaaaaaacaaacaaaugaacuagaagauauaagcacauggacccuuuuauucuguuugguuuucaguuccauuuuuuuaaaaaauuuucuggcagaaauaaaaugaccaauuucugucacuuucccuguggcaugcucuugaaaagguauuggugugugggcacgccaugcauggcuuuccucaggcuuugcuuuuuccgagaaugagcagggccuuaccagcugcuccugguucuucaucuggucagcagcuugcuuggcgauugcagacuuggcuucuucugcagcccggcgcucccugucuagccgcucugccuccucuuuugcucgcuggcgcuccugcuccaguucuagagcuuuccgagucuguucuucuaguucugucaaauguuccacccagcccacaaacauggguuaacugcaaucauccucguuacagcaacauaccaaaauguguagguuuucaagaucacgugaccaaacauacaaauacuuuaauuuuaaccugguaaacaguaauaauuuuuacuaauuauguaauucaaaacuuggaggacaugaaagcccuuaugguucaaguugugucaaaagacuagaagaacacacuuaauuuucuaagucucuaauguuaaguuuugaccugaaaaaaauauaaaaguuagggaaguggguggacuaacucaggagagcacuugccuagagguacaaggccaggaugcaaucccuaaacuguccagaaaauuagacuccacuacucgucucaauagaaucucaauagaaaucuauuaaauuaauguaguuuaagaccaacggugucagcccugucuagcacacacgaugcuccuagguucaguccguuuuuuccuagccccaggacagaauacacugagucuuacuuaccuacacuagguacaggcagaggaacccucaucugaacugcauggggacucaaaguguuuuggguuuuuucaauaguuaauguauguagugaaagaauuuggagguaaggcucauucuaacgugagagucauuugcuucaucguccagaaccugaauguaaccggaugcaguaccuucagugugagauccgcuguaugaaguguguucuaaguucaaaacauuucagauuugggggcaucaagaucuuuauuucuuauuuuaggcaagucaccagcaagcgugacuggcuaauuguuugauauuaaauuugaaaaaacaacaacacuagcucuuagugacuuaagacauaaugaagugacuggcaagcguugugaucuguccauggagcagggauaaguuucuuucuuuucccaguaaauugaguaagaaaggaaaauaccacuaacaaaaccauuagacuccccccccuccccccggugacuuugaaauuuugaauuuaaguguuauuuugggaaagucuuacuaagaauucugugagacgauagaguauaauguccuaggagacuggcucucccuugcuauauccuuuagagagaugugaaaguagacugcaacaacaagauuugaaauuuuacuggucuugaucaaaacuagcauaaauauuuucaguuaagagauuuugaggauuagagaaaaaaaugacucuggcuaagcuuuaaauuuuugauaaaauagcauacaaauucagcauagcuaucuggcuacaaauuauaaaaguacacaauacaggaugcuaccacagcuuaauuauuuucauucaaaacuuggucgaguuaaccuaggaagaaccuucccucauccuccuuggcugcuagagccaagcaagcuccuggcuccaccacucaccuccccaaugagucaagaagugaaagcagggacauguaugcacauguauguauacccacggugagguauguuccaguaugugugaguacuguaggccuuaugauaagugcaaaaagccaggcacacaaagucauuccaugagucuacucacuaucuagaacagccaagaccccagacagagaaggguauaugcgggggugggggguggggggggguggaggaagggagcugaggaguuaugcuuaacaggcagaggguuaguuuugcaggcuguaaaagguuauaguggacucuugauagccuuaaaccauacucuugaaaaucaguagcacacuauuuuuuauguuugccacaguuaaaaaaaaaaaaaaaaucauagccgggcgugguggcgcaagccuuuaaucccagcacucgggaggcagaggcaggcagauuucugagaucgaggccagccuggucuacagagugaguuccaggacagccagggcuacacagagaaacccugucucgaaaagccaaaaacaccacacacacacacaaauuuuuagaaguuugggauacaaguuaaauuuuaacauaaauacuucugagucaacuauuuucuaucagcuuucuaugguaucaauuuuuaaaaagagguauauuugauagauuuuugugcaauucuuaaaucuaucauaaaaaagcuauuuuuuaaaauguuaaaacgaagcgagggcuugcucuggguuguagcugugcacggggcccuggcuaucuggccccaagauuucaugccggggauggcaggaaggacaacacuaaggagggguggcuucacacccuggagccauagccacguuccagcaguaggccucaacacgccugaucgccacaaucugggagacaagaggguuaggugggcagccuggaguuacuguaaaaggcauaaaccaggagcuggucagagcucugguagccuuccucaaaaugucugggaagcugagaguccccgaauggauggaugcagucaaggcuggccaaacauaaagaguuugccccauaugaugagaacugguucuacacaugagccucuuccacagcacggcaccugcaccucauggggguacagggcuugguuccaugaccaagaucuacaaaggacgacagagaaacugugucagguccaaccacuucagcagaggcuuuaagaguguggcccacuggguccuccaaacucuggaggggcugaaaaugguaggaaaggaccaagaucgaggccacaagcuaacaccucagagacaaagagaucuggacagaaucguuggacagucggcagcugccaacaagaagcauuagaacaaaggaugcuggguuaaaaauuggcucauucauaaaaaauaaaauaaaauguuaaaaugaguauuauuuuaaauucauuuacacggaaagaguuggguagucauaugaccuuaagagaaaaagcuguuuuuaucagagcacuagaacaagaguuaacaaacuuuggcccauggaccaaacccaacacuaauuuauuaauuuuuuuuuuuugagacaucaccaacacccugacucagaaauuaaauaggacuucuuucacacaacagccaacucuggcaagacucaggcuguguagcugucuaaacuauuacugaaaaaacucgaggaagcuucuccuucuuacucauauuggaaacccagcacuacaugauuuugcaagccaaauaauuucuuacugcagaaccaaauuuagaagcuguaauacugcaguaacagcauuaaaaacaaaacaaaacccuacaugccuuaauagacaauauagcccaaagaguagguuuuucuuucucuuuacuaaagcaaugguuuaucaacaacuacauugauuucuagaggaaagcacaugaucuuagaagaaaaaaauaacaguucaauaacaauuuucauaaaucauagaacacugugguuguguauuauuggcugacaaaaauuuuaauuucuauagaacaccuaagcaacgauccaguuacaugucaucauaaagguaaaggucucuaugaauaauguaugaagggauuuuuagauacaguaauuggaacaguagggcaaauauguacacacacacacacagaaccaggcacagugguaugcaucuguaguccuggguacuuugggaggggaaaucaaaaugaucaguugacuccaggagugcaaggccagccuggagacuaugcaauacaucuccucuuaaagcaaaacaccccaggaaauaugucagaggccucugugugugugacaaauaagaauacauuuuuauguguucuguauauauuuucuguaaacaaaacgguaucugcuuuccccaaaaguagaauaauggcaaaguagcacaccagccugggauuaguguucuacugggccagaaagacaaagauggagagucugggauugaagaaguaguagggacuaggagaaaaguuccugaaaaggggcaaacaaggucucuucaaaucugugugcuauuuuccuucaguguauuugccaauuccccaaugagcacauaaccgagauacuaggaaacaugaagacacuguaagaagcuuaagaccuagggagaggggccgcucucuggucaaauggcagcaucugaagcuaacacagagaagcccuacccaucauccaggccaucaucuccuugggagacaacauuuguaaaucaaauaucugauaaagaauuuguaucccagucauguaagaacccuuagaacaacaagaaaucccauugaccagugggcagaaaauuugaacacccucacucccaauaagcgcaugaaaagauguucagcaucauuaggcggagguaucuaagucaaaacccuaacauagcacuguaaaucauuuaugaaaaugauaacccaaaagacaggcacuaacauauccuggagaagauggagcgcucacacaguuacaggaacagaaagccacuuucaaaccaauuggacaauuccucaaaaaaaucaauguggccagcaauaugaaaauguaaaaagaaaucuguauguguacguuuuuaacuuauacacaauacagugaaacaguagaaacaacacaaaugcccaacaauugaugaauaaaaaaaauaaaauuaaaacaucauucaucaauuuaaaaagaaugaaauguuaauauauguuaaauagagaugcacuuugagaauagcaagccaaguaagggaauccagucaugugugcagaaaagaccaaucuguggcacagugcagagauuaacagcugcccgcccacagcugugagggauuacuggagauaucagcugacuggcugcuuaauuaguggguaugggauuucuuagagaugacagauuucaaaaacucacugagugauagcacagcacucaggacauauuaaacaccgguaaacugcaugguuuaaguggguaauuuuacagcauauuauaucucaacaaagccaucagaaaaaaaaaaagugacuaaaucuaagagcucaagaauuagaaugacaaaaauuauaaaugacaaaugacuggggaguaguaaauuaaagaaugccaguauuguuccuuaucuuguucuagcaagcuacaagaacaagccuguacaguucacaucauuuuaggaauaaacuucccugcaacaaacuacugccacuuacucccaacagguguauacagaccucuguaccaguacuucacuaagauaguauuuagguccucagaaaauaaaacuaauuaaaaacaauccuauuuuuuaaaaagauggcuuauuuccauuucagaacuuaggaaccuaagaugcuaagcugauguacucagggucaccguggucugcaaugacagaauuaagcuuuguuccuaccuguaaacaguauuaucuacuaccccccacauuaccaugcugacugucccuccucagaaguccaaaguauacaaaaugauuguuuaagcuacugcuccaucugccaucaguaaaccgcaugcugcaucaaagcaggguccuuccuuauccagcaccuuuugcccagugcuucuaugugcccagaaugagucaaaccacuagaccacaggucccuccuauagucugucauauggaaguccgacucauuuuaauacuugcuagaacaacaaaggaauggugggucugguaauagcaccuuucaggaauccccaauacaucuuccguaugcucaacagcaacugaucucuuuuuguucuaguuaaugaaucauuuguaauaacaaugccaauaaaaauuaaaagaauauggcaacaaaauauaaaauuuuuuccucaaaaaguuacagauuaauuuaaauaucaugaaauauggucaguuacugcacuugagugaaaauuuaggacaaauuacaagacaaccacauagguuuuaggccagccugggaaagcuuuauuagaaaaccaacaauuacacuggaugugcuuugccuuaagaugacucaucugcaauugucuugauaaagauguucuauauucuuuaugcucuaucugccuuauacucuucagugcuucuuucagaguuuuguauauaaaccauuaauacuuuuauuauacauccuaaauaaaugagauugaaagauuuaguaaguagcuauuccuucaaaacaguuauauaaacuuaaucuuuacuaugaaaguuccaauucuuuuuuuuuguuuguuugguuuuuuuguuuuuuuuuuuuuuucccugaggcagggcuucucuguguaucccuggcuguccuggaacucacucuguagaccaggcuggccucgaacucagaaauccaccugccucugccucccaagugcugggauuaaaggcgugcgccaccacgcccagcuucaauucuuuaaacauccuucaguauaaggcagaggucaggugugguacuaagaaacaaccugagggccucacacauguaagcaagcaucuggaccaaugaguugugcuagcuaugcccuaagcaagccccucaagucaaacuucuugccagcauucuugaaaggugcaacuuauaugggucaugagguccuuagcacaugacaugucacuaucaguuuuguucguguguuucuaucaucugcacagguuuuacugacauguagguucuaugucuguaaggauaaaaggaaccuacuaaagcagcacaaacagcaucaaauuuggaauucaaguaucauuuuguagucuauaaaccagugcuauacaacccuuuaguuuugaaguaaauuaauuuccagaugugagagguaagguuuagcuagaguuagaauaaaacucaauuuaaaaauugugcuuuguguguggggagagggagguaggaggggcagguaaguauaucuacaugcacggaggccagagggcuaccaaaaguuguuaccucccuuuuugagaugcagucucucaggaacugggucugacugauuuguugaggcugccugaucagucaacucaggaaucuacaugucucagcuuuuuccgguacuggauugcaagcuagugcuaacuacgcccaaccuuagcguaaguucuggugcucaaacacaaggcuucaugauugcacacgaacuacuuuaccaaugagucuugucuccagccuuaugcauauaccugguaagauggcacaggccaauuaucuuagcauugcugaggagggagccaggauuaucaaaguuugaagccagccugagcuauagugaaaaugugcuccgccccacaaaccacaacagucucuacugagauauagcuaauacucucggaauaacuguagauaaccugucauuuaggugaccacuucuccugguuacccacuagaaaaugguucuaacugcuucuaaaaaauaucuccuucacacaggaaaaugauauaaucaaauuaaaccugaacuaacacuaccauucgcaauaaaagugaauggccaauuuuacuaauugugagggaaggguacauacacaggaaguuuacacuacuggcuaagauucugcugcuugggaaggaacaauuuaacuugcucaaauaacuuuuuuuccuuuuguucuuuccacuaaugcucugccaaagcaguguaucccagaguuacucaauguaagcaguguccuuucuauagacugcagcacuuuggcuauaagcagcauagaaguucaucuaacuaugucagaagcaagcaagcagcauggcgugucugcgugugccugaccuugcucuggagcugcauaccuuauacaucacagucaccaucuugaauccacugcuuaaacacaaacccuuuaccuuucugggcuuucacuguuugcucuucgaucugccucagacgcuccaucagcucuuccuuuucacguucuauucuuuccuuuuccuuuucugcuauuucucguuucuucuuuucauucucuaauugugcccuuaaagaaauuacaagucauauguuacaaauaaauggauagaaacaaauugaugccauuuguauuaaucccaaaucaaauagaagugcagcauaaguauuuaaauguugucaacauauuuaccauguacacuucaguauccugaccuccacacacauuuaugcaugugcgugccaguaugugcauacacccgugccauguacaaauaugcaagcauguucucaaagccagcucaggugaggaaaagcccaggagauuuagcuccugcauauagaacaaauuauuuguaacaccuuaguaccuugccacaacucaagggaauucuuugaguuagcagaggcccuccauggggaaauaacaaaggcuuaaagagaacgcacaaguaccuucaauagcaaauagugggagagguaaaugauuuucaaccauuaaaaaaaggggaaacagugccaugaagauuuagcugucuguuaugaguucugauaucauuugggaaaagaggacuuggggauuaacauagccaaauuugucaucagacaucuagaaagagccuaccuuuggucaaacuccauguuggugaccaaaaccaaaaagaugaauaaaagacaccaaguuguuacuucauaugcuuaacuuucaaauuauuauuucaaugauacuauuuauucacuaaaguuauuccaucucugucaucuccuaaauauucacaaaacacuaucacugccaucuagugucuauucugaauuccaggcuuaucacagaacaguacuaucaagguacuuuuucuuaguauaaaagccugaauuuggaaacuugugcagaucuugagcauccaucuguuccuaagagagaaaguguggaacacuggaggagagauguucacaagacagcaaggcuugcuggcagugacuuucugauacacaaauucugacacaggaaguugaagggucaguaugccuccugcuaauuaauaaauuucaccccauuuaaaaacuaaagaccuggggcuacagagucuguaguggugaaaagcacuuguccuugaacccaaguucaacuggcagcauccgcaugguaggcagccacaacuguaauuccuguuuggggggguggggggagauaagacaaucuguggcauguaugugguauauauacauacgucuccacaaaacagugcacaguuuuaaaauaucaaaaucuuaaaaagaaaaacuaaaauaaaaauaaaaaugguaugggcuagggcuggagagguggcucagugguuaagagcaucgacuacucuuacagagguccugaguucaauucccagcaaccacauaguggcucccaaccaucuguaaugggauccaaugcucucuucuggugugucugaggacagcuacaguguacucacauacacuaaauaaauaaaucucucuuuuuuaaaacuuuaagaaaaaaauuauuuauuuuauguauauuauugcucucuucagacaaaucagaagagggcuucaaauuccauuguagaugguugugagccaccaugugguugcugggaauugaacucaggacuucuagaauagcagucagugcucuuaaccacugagucaucucuccaguccaaauaaaucuuacaggaaagaagagaaagagaaagagaaagagaaagagaaagagaaagagaaagagaaagagaaagagaaagagaaagagaaagagaaagagaaagagaaagagaaagagaaagagaaagagaaagagaaagagaaagagaaagagaaagagaaagagaaagaaagagaaagaaagagaaagaaagagaaagaaagagaaaaagagagagagagagagagaaagagaaagagaaagagaaagagaaagagaaagagaaaggaggaggaggaggaagaggaggagaaggaaagagagagagagaaagagagagagaaagagagagagaaagagagagaaagaaagagaaagagaaagagagaaagagagaaagagagagagagagagagagggagagagagagagagagaaagagaaagagagggaaagagagggaaagagggagaaagagagggagagagggcgagaaggagagagggcgaaaagagagaaaggaaaaggagaggcaugggcuguuccacucugguuuuagguucucuuugauguacuuccuuaacaccagaagagcuaauggaucugcccugggucucugcagcauuucucccucauuucuguuuauguaaaguauauuugggaagaggcucaagaagcugggaguuucuucaucucuagaaaaccuaaaugaggcggcaaguuggcauacucuaggcuccucgggcaaaagaaaggcccaggggccuucccuuaaaaagcugguugucuccucaggcuguuuguagaagcacagguaccaguuuuccaauaccugcuuuucuacagcaugcucuuuacaacucagagugguuguuaggcuauuccacugcuccaaggccucugcacagccaugccuaguaccacagcuccucaagcaccgagguccuuccuucuugaggacucaguauaaaccaaggcucaagaccuacagguuacaaccuaucccaaccuuuugggucccacucuggcacaaaugcccccuuuuaggaaaagguauuggcuucauuuagcuucucccuauugguguucuauuugcucuucuacagagauggagaaaaagaagauauacguagacagaaagaaaaaaaauguaaggaacauggcuauaaccgagcuagaaccaaaccuuauuuuauuacugaaaagucaagucugcacacaggagacagccagccugauucugcagcauugcugagauguucaucucacaccuuacccacagacacaccagaccucaacagcaccuagcuccccacaucacaugcacacacugaggguugcuaggccuuuucuuaccucacacugcucaaaaggaugaaccugguccacuuccuggucccuaagcacacccaacauauucuucucucuacacaugcuuaugcuggcucccccuucugaaugucuuucccacauccuauucaaaucacacuuuacccaggaagccuuuucuaauuacucaaauuauguaauuagauguuuucauuuagaguuucaguuucuaaagaguuauuucaaccuacuucuauuuugaggacauaaauauaguaaaacuauaaagucucugcaguaacauguaaaguuaaauuauuuuuggaaauaugccucaggcccaucaccaaaacuguacucaaagucgaacauuaaaguccaccaguaaaccugagcagucugucccuugcagcuggccugucccaagaguuaaaacugagcaggacacacgcauaccuuucuagcugcuucugaugcuuuuccucccgggccugagccuucaucugcuguacuucaauaguaucaggcuuucuccuucgcauguacaguucaugguuucccauacauaaggccaaaauucguuuauugauucucagacgaggugcauagaagacaaaauccuaaaaauagaauacucaauuuuaucucucagagugauaguauccuucacagcuacucaauuucaacaugaaguagaaaucugaugucacugcacauaaagucuagagacugugaaccucacauaccuccagcauuacuauuucccuauuccucuaccuuaucuguucuguaaagaugaacuaaaugucauuaauccuuuuuuuuauuuauucaaagaaacuacaaaagagcuauccuuacaccccaaaacuggucuuucuccaaggcuguuuuaaucuagaaauguucuucaaauauuuaucuuuuagauaaaaaagguagaauacuaaauauuauauaaacacuaaucuuugaaaaucuauuucaauaaaaaggaagccucagauaauuaaaaacagaaaguucagaguacaagacuacagaguuaauuuuaaaaggguuaccucuacuacauuuugcaaucaauaaguguuguuaauacccuucuaauaucauuuuaucaacauuacaaguaaaucaguuaaaacucuuacaucuuaaaaaaacuggaaauuuuuguauuuuuaauaacauuucgucacuaaggaaaauuuaacuaugggaagagaauaucucucagaugcaacuuaaagugaucagugcucuucuuuuaaguuauuucauagaaaguagcagaaauuuuuaaaaguuaauaaacaaaauauccuuacaggugccuuuuugucaauuggcuuuauaacgaauuuuuugucauuaaaugaaauauuucugauuucacuccagggaaaaccaauuuuagguguuaaccuagagggggaaaaaaagaauauugcuuuaaauuaaaggcaggaaacagugggaaaauacacagccuacugggacagguuacaugaaugaccaaucuuaagagcccaagacucucagaaccuaucuuacucacauaauacaguuggugcuaucacugaaagcaaaauuuaauuaacucauauaaaauaauuaccauagaaaguuuucauagauguaccauuuuccuaaaauuacccuaggaaaaucuaccuaguaaacagaguaacggacugagccuuguuaccagcuuucacucacaagggacaaagcggcacacuacaaauauagauucacccucucauuuaauaaacagacucagaaauaaacucgaaacuacaagguacuaggaacaaaacucauggaauuaacuacuccuuugcuguaaggacagaaagcaguaaggacaacggagacaacuuucacaagcagagcgugucugagagccacuggccacagaggaacaacuagcucaccaacacccaguuacuuacuugucaucauguucauaaauauucaggccuaaagcaucaacaccuagccacagcucaguacccuucuuauucuugauuucaaaguaguugacaccauacaucucuagaucuugcgcaaucuucaaguauuccaucaucgaaucuucccuauuaaauacagcucaauguaauacauuaaaggagacacaccuaaacauuaaauaaaacuaaaaaauaccuagggcuggggccaauauuuagugcuucauauuuauuuauccacaccagagguugggaaguguaaccuggucugguaucauaaaccagauuguguguguguguguguuugucucugguaucaucacaaaccuuuuaagcauucauucauucagagagaaagaaagaaagaaagagugugugugaguguguauguaggggaguguaacaauagcaugugugaaccauaguaaauguguaggcugugucagagucauuauccugacugaauacugaaguuacagauguuacuagggaaggcuuaaacaguuuuaaauagcucaaauuacuuuaauucaugcuuuaaaauggguauuauauagcuuacaagaagucaaauguuucaaaauggcuuccuaauuccuacuagaaaauuaaggaacagacaggaaaagacacaagucucacagguagguucucucccaucaugcgggcucuagggauucaacuugggucaucuaucaggugacaccuuuagcugcuggcugagccauucucacaagcccaaggagaauuuuaaacaagaugaaaaugcuuucaccuggagagaacuauacagaaaccugucaccagauaccuuagcaucccucuguguuccucaugccaguucuguauucucuccucccacugcucuuuggucaguuuguguuguuccaaaacacuaaaaggaaaaaaaaacauaguuaaugccuuuguaauuaaaaaaaacaaaguacuuucaaaguguagugcccuuuuguagcuugacugugauagcugugacaucuaacaugcuaacacgcuaacacugcacagaacuaaaaccacaacuuaggaucuaaaacacggacuagaacaugguggugugcugugucccagucaguauccuggcugaagacucaaaucauagaagucauguuacuagggaaggcuaaaaaaaccuuuaaauaauaguuuaaauuacuuuaguucaugcuuuaaaauggauacuauauaguuuacaagaacuacaaauguuucaaaugaaucauacucugaauugaaaaaaugguuuuaucauuacuaacagaaaauuaagaaacaaacaggaaaacagaguuccuggauccugauuaucccuuuauucuccauaucugguuuugguuuuuuccgagcugaggaccgagcccaaggccuugcgcuuccuaggcaaacucucuacaagugagcuaaauucccaacuccuguaucugcuauuuuuaugaguaaauuuaauauugucauuuuauggagauaauauuuuugauuuuaaaaaaagacauacauuaagcugaguauggugguaaacaucuauaauuccaguaauuuagaaacugaggcaggacaguucugaauuugaagccaagcguucaaggaccauuuguacugugcacuaauuccuaggucaccaaaggcggcguacucuguaucacaagugcaccccacgcuccucuccucuaauaaccuguauguuucaucugugaacaaguagaguauuccuauuuuucuauccuuaacaccaaagcagccagagcaauauacuuauaaugugcuaggaauaccauagacugauuacaauucuccuuaggucauagaguaaugauccaguucuguuuacaguagacccuuagaguuuacaggccucaggucauguaacuagcauggagcagauuagacuuaguucccaaaccucauucuucagccauuuaucucccaugcggggcuuugaacguuacaaagguacugcagacuauacacguuacaccucguugaaauucuuugcaaaauacagaaaacgucauuccauggaagaaauagcucuugccauuuaguauucucacaguauuauuacacaucuaugcauguguuccacucuuuacaaacagcaacaauucauagccuucccuaaagagcaaaucauaacuuccuuuuccugcacauccuauaggcauugaacacaauagagcggaguuacacaacacauaaaucuguguugucacuaagucaugauccaccuugcaacuuaaaaaucuguugaaaaaauuuagcauacacuucugaaauacaacauuagagacgauuauauaaaggcaugauuuacuuaccgcugugguaagagucugucauuagccagauagccugguuugugaaucucuuuauuauaaucuccauacuuggcuuggacagcauacgaagccaaaagaacugcaguuucuggugggcaauauaucucaucauuuaagauggcuucuuuaacuugcaagaagaaaagucucuguguuauuucuugaaucaauuccucagaaacaucuucaggaaagaauuuagcucuaaacuugaacuguaaaggauuuucuuuuuuaacaucuugcuguguuaccuagaauaguauaaucaacaaaacuuuuaauucacuguaaaugaauauguuuacaucauauucuuuuuggaagaaaauaugcaguaauacuauguaaggugguaaguuuauagacaaacacaggugcuaaaggagcugcugugcaguccugaggcugucagcaacucugagaacccaggcaucagcucgacugacugcucugugugcccaagcucauucuacagacauuuacagacaugagcucaguuuuaacacaugugacaccugcuucaaaguucuauuucucacaugcucagcucacacagaaugugugugauaaaaguugauggugcuucaaugacuuaaaugucaugaguaaugauuaagacagacaacugcagguuggagagauggcucagugauuaagagcacugacugcucuuccugagagccugaguucaauucccagcaacuacaugguggcucucaaccaucuuugauggggauccaaugcccucuuuugguguguuugaagaagacauugacaguguauucacauacaugaaguaaacaaaucaaaaaaauuaaaaagugauccuguaaaauaaauaaaugacacuuaacugcaccaugagcccugcaguuagucagaugccuuuucaguacagauuaauaaacacaucaaauuaauguuauuauacaaaucuuaccuuuuuauucaauuuaagccauguagaauauccuuugcugucuacauauugcagcccaaaaaaccagaccucacguaagccaacuguuuuuacaaccuguaaaacagauaaauucaguucaccauucacacugugauaacacucgauguuacagaucacaaggacaaaccacaccacaaguggaagugcaauaggaaagggcuugcuuuccuucaacacagucuuuucaacaugcucagggaacaauuccaaaacaacaauucagauuuucuugucucaauucuguuacaucacuucucucuuccuccuugacucaauacuuucuaacuuaauuuuguuagcucacaucauagccucaacaaacaaaagaacaaugugaaggcuagcagcacagaugugcuaagccuaaguuucuauuugauucucgcccuaccaguaggggaggcaaagcacaacacuuuggugacaaagucugguagcuucaauguucuaccaucacugagcagaaacaauucuuggaccaugcccuaaguuucacuaguuuacaucuaucuauucauuuauuacgccuucauuucucuugagcccaaauaacaacacacauguugaagucagaggacaauguucagguaucaggucucuccguccaguauauaggcugugggaacugaacuaaauuauugggcuuggcagcagguaccugugccuucugagcaucuuguuggccccuuuuaagcuuuuauguauguuuuugaaaauucacuaaagaguuauaaagaguuaacuauaucccuauaguuauucaaaaagccugaauauguacugccaaaauuccaagcaguacauguuuggauuaucaaggaagguauagaaaacauaagaugcacacaauagcacgcacaugaugguaucagaguuacacuucuuggucucugagagaugacucacugguuaacagugcuugcugcuaacauacgagggcaugagcucaggcucucggucacaugaaaacaagcugguccuggccagccaccccuguaacaccacuacaguaaggaguggaaacaggacugcuguggcuugcuuguccaccagccuuacuccaggcucaaugacagacacugucucaauacaaaaaugucucaggcaaagaugauuuaucuccucuggccuuagcauguucaccccaccaacacaacacacaucuauauaucacacaaauacacacuauuugucugacacauacacacacacacaaacacacagguugcaugacuugugggugaaaugauaccuggucaaaaaguuguuugccaguuguauugggcuggauggcaaauucuagcucagcguccauuguaguuacucuuacauugaucugaaauuaaaacagaauauauuuacaaaguaguaagcaugagaaaaauucuuugacuuaacaguauuucuguggaguaagaucaaauccagggcuuugugcaucuaugcaaaguuugacuacuacacuaaauccccagcacuugguuuuugagcuagucuucccaugggacucaggcuuggccuauugcaauguuccucccuaucagucccccuacugcuuggauuauaggcauaugcauggacagucaaaacacgagaggggacaauacuggggaaugaaaaaggcccucacacaugacacccaagugcuccacaacugauccauacaccaccccuaaccuuauuuaaagugauacagcuugauucuuauuacaggaaaucuuaaaaauggagagaaagaaaaucuuaugaauaccucauuugacuuacuagagggucaccaagaugucucagugaacaaaggcagacaccuacugaaagccucaugaccugaguucaauccuggaacccacgggacacauggguauuaaauacagcagagcagaacguaacuccagauucucugaaugucauccacuaccucauauuucuucauuaaaacauguauggugaugccauaggaagcuugcuacuuuguauaauaauuaaaugauauaacugaacaauaugcucugagauuccaaugaaaauagcaaucuuuaaggauaaaugauaacaaaugcuaguaaggcuuugggaaaagagcaaccucuucacugcuggugaagccuccaugaaaaucaguacagggguucuucaaaauauugaaaauacaauuuacgguccagcucuaucacucuugagccuacaaguaaaggauuacaaacugacacaccacacacacugacaugccagagacacuugcacauccacguuugcugcuauacagcaggcaggaaauggaauuagcuuagguaucuuuuaauaaauggauaccuccuacaaaaugccauaccuauaaacaaugucauaaaaaugaaaucaagacaucugcaggaaaauggaugcaacuggaaaccauguuuauuaagucaaguaagucaagacucaagacucaaauacccugucuucucuauaaugcaaaaacacaaaucugugugugugugagagagagagagagagagaaggaaggguggggggauaucaaacuaauaucacaagcagauugugagagagaaggaccuguaaggugggguagaccugcugaggaggagaagugacuguaugagaaaagagagacagggccagcaggugggaaacggaaggagaaucaaguacaacacaaaaagagccaugaggacaaaacuauuagcucuuuccccuuuuuuuuuuaaacaaacgacucauaauagcugauugcuugcauagaccaagccagucaacagucuagcguggaauggggugaggcucaugagccucccauuccugaggagcuauugaugguugauggcuucugggucuguuuucuuuaagggugcgguccaugauagguuagucgugauacaauggauggucccagcacaaacuggacuuagugaauuacuaaaaaaaaauaauaauaauaauaaaauuuaaaacuaggauguaaguucaaaagggaagaaaggaaaaaagaagguaaagugguucugggaaaaauuggggagccaaaauggggcagggugaauaucauauaugacaguaucaaaucauaaaauguauuuaaaagagaaagaugcauguauguacuggcguaugcccuauauaggugcaggugccaagugggucccagaagagugucagagcccugaagcagggcuuacaggaggcuguaacauggccaacauggaugaugggaacugaacucagguccucggccagagcccuaaguguucuucaucacugaguaaacucacuagcuccaaggaauuuccccccaguuuaugagaauguuccacuuuuuuauuucuuuaaauuuuguuuuauuuuacacccccaaccacaauuuccccucccuucgucccucccagucucuccccaaccgccccucucuuucauacccccauccacuccuccuccaugucucuucaggaaagggccugccuugauggauaucaaccagccaugguauaucaaauugcaauaccucaagacuagguaccuccucuucuaucaagccuaaacauggcuaaacaaggcaacccaguaaugggaaagagucccaaaggcaggcaacagucuucaaaaugaucacggguauacaaauuuaggcuauugucaguaucacugucacggcaucaaacuagaauuacgagaaaguuagcaggaauagguccugcauaccucucauuauuuucuccuaacaauaacuuacaauuauugagagcuaaauauauacuagauucuucuuauauaauccuugucuccuuucuugaguaaauaaaauuauaucccuauuuuauguagaggaaaccaagagcaaaauggguuaaacagaagucacacacagauuaaguaugaaagccagaacagaacuagacugcuugguaccaaaugccauuaauuuuaaccuaacuguccugucacccaugaucacucuucacaacccgcacaaugaacauuaagcaguaucaaaagaaucaaaacacacuuacuggcuucggcauuuucuuuuucuuguuuguuaccuucuuuagaaacucuucacuucuauaaacaauuauagccuguuaaagaaaaggaagcauacuuuauuuccacucauguuagguuuuaccucuaccuugcaggacuaagauggaaagcagguuacaagugacacuguguccucuuagguucacacucaaaagucuugggcgagcauuccacauccccuaaaaagccugguguauggcacuggaagcacugcacaucucaaccagcacagcuuaaaguauguuaaucuaaaagacagcaagaaaaccugaucacuauggacuaaagacugcuucugccauacaagcuccuccaugcaccagccuuguauggcaagaggcaguacuaaagaagaccagcagccucaagucuaagggaaacucaguauuuuccaaccuuucuguacugucaaaugaaaacuguuuuucguaaaaauuauuuuucuuuuuuaaauuuuaaaaacugggaaaaaacacaccagcuuacucaccuaaaguguggaaggcagcaacaucucuacauagcaacacaggugcuaguacccagcuagccagugaccacugaaacucagaacaguccuaagcuaaggcuggcauguaacuucuuccacugaggcaacacaucuuagcagggaaggacuacccuguugcccuuggggaaacauucuuacuaagaaacaucaacaaaaaugaguuugccuuucugagaaaucuaccaagccuuuaucagcugucuaggaaaagagauuccagcaucaaaccuuacugugacuaauguaucagagacauuaaaauuuauguagacacuaucacugccaagauaguuguaggcccagcuaaauuaacacacauucaaauaagguaauuucccuaaauuuuauucacacacaugccaauaaacgucucuuacacagaaacacccucugcagcuccgugggcuguguuucauguuuuuaucugagucacuggcaaugacauucaggagaaaauauaaaagccccauugcugaacuuuuucuagccuauucccuaucaccccuccuacauuuacagucugacaggccucauuuucucaauuaauucacaccuaaauuaaaggaguuucaagucaaacuuucauguucaaaaugaagguaagaaacgccaagaacacaguucccuuucgggaggaacuaucuugaggggaagaaaacauuugucauguauuuaagccaugucauuuuuauacauugcaaggucaagggaguaggacuuuuuugguuugcugcuguugucuguugguuuuuagguuuuuuguuuguuucagacagguucuaacucugcacagaacuucuugcucagguuggucucaaauccuggcccauucuccugcccaguucccaccaugucugguaugccucugauuuuuauauguucuucucuccuucauuauuaagcucuuaaauguucaguuuccaaucacaauuucuaauaacuuuuaaaauguuuuguuauuguguucccacuuuuaaauuuccaaauucgagaguuuuaggucuauggguaaaauacucauuuguggaguuucugccuauguuuaauauuuaaacuugagugcagugucacuuguuccagauauaaacaauacuacacggugugcguuggguaacauguuagaucaagcuaagcgcuuuuuuuuuaaaucucucauucuccucacuuuagucugcuuagccaaucuaacagaaauacauuuaaguuuucccagcugacuucugauaaaauggcaauuguucacuugcauaaauuuuuaggcugguaucagguaagcaguugcagaacuguuacaucuuuccaggaagaguccucuccuuaaauaguaauuuaacugcacagacacccaggugaacuguggccugcucagcauuggauguugcuacuucucuuuauucuggccauuguuagcacacaugagcagucagcugucaauuuaauucacucccccgugcacuaaucuuccuuuccacuuuaacauuuacucuuucgagucagauucccuacaaacagccagagaucugguaagcuuccucauuccaaagccucugcuuugcccacaucaucuuccaugcaaguauuuuucacucaguucuuucuggacacauucugacauuuuccuauuuaaucuuuugacuauguuuucaaauuuuccaccccuuuaacugagugauucuccucuagccaacagguuucuacagaugagcgacugucuugcauuuucaggcaaggucucacagaagcucuggcuggccuuggacucacacacuugagguaauccugccacuucugcucccagggugcuagaauuacaggugggagucagcaggcccaguuucuccacauuuaagauugauuuuuauuuaugugugcgugcgugcgugcgugcgugcgugcguacguggauguacaccaccugugugcaugugcuaccgaggccgagagaggacagcagaaucccuggcgcuggauuuucgggcagcugugagcuauuugauguguucugagacucaaacuccaguccucugacaguccucugaaagagcaagaaacccucuugaucacugagccaucucuccagccccauucucaguuauuuucaauguauuguauuauaugucuacguuauaaaauuuugguguuuuauuaauagaaaaauauuuuaaaagauuuuuaaauuuucauuucuauguguguaaagguguuugcugaggccagaagacgguaucaaaaucuccuggagcuagaguuagagguggcugugaguggcccaauuugagugcuaggaacuuagcuuggguccuuuggaagagcacaaugguuuuaaccacuaggcaaucuagaacauuccuagacagucuuuuuuuauuuauuuuugacugaaaaaaguuuuuaauacuuucaugauaugauguuuaaaaauucuuuuauucuuauauuuacuuuauaucucuuuaaauuugauuuuuagcucaaagaggcuuauuuuucauaccugaucauuuuagagagcuuacaacccuagugaacucuccaauguaggaaccuugccugccguacagcacuguauaucucuguggacgcgcuucugggauauuucuuuguggccagcaauauuaucucaguccccaucaaaauaaucacaauauucccuagagaguuucuuuuuguuuaguuuuuguaaaaauuauuuuauuuauaaguacacuguagcugucuucagacacaccagaagaggguaucagaucccauuacagauggucaugagccaccaugugguugcugggaauugaacucaggaccucuggaagagcagucggugcucuuaaccccugagccaucucuccagccccuagagguuuuacuuuuaaguguuuaaacgucagaugggaaacucugaagggcauaucucacuaaccggcuaucuuccauaaugcgguaugcacagggauuugaccuuuaaauuuuucuaggacaaacuauauguaaguagaauuaaaaucuaaguuuuagucaaguuagugaucaaugaacaauguucauaccaaaauacuauuuaccaugaaugguacacaucaagucacuucuaggaugauacacuuuaaauaaaacuagcaucugccaguagcaaaagagaaaaaaaaaaaagaucacaugaaaagccaagaaacuacuucauuucuaacgugaaacuacuuguuuucagcauccugucuuccuucucuaucuacauggcugccaaacagacaagcugguggcccaaccauugcugaauucauguuauauucauaaagcuauauucauaaaacauaaaguucguguuauagucauaaagcaaugacucuccuugccccuuuaauuuguuuaauguuucccuugcagguuuauuaaugugaauuuuugccacugcaguuucucccacuccugaauuucuuccagagguuccacccuauaugucuuuugcauaccaaguuccucagaagcacaaagguagcagcaauuaccuaguuaucaguucagaggcuucagucugaagagaugcugacagcagcugucucccaccucccaccaccuacccauaugaacaaacaaaaugccacaaaagaggaaacauugauauauagcauccucuguccuucaacucugaggcugaccuuccucauauaaguggcuuucugcugcacuggcacaacacaccaacaggucaggugcugcaacaggugcugccgagcggagucuaguaguggcuuacacugaagcuucaauaauuaacaccaaacuaauuuuacuuucaaguuauucuucucccaaggccuaacuauaaccauuuucagucuuuugggagucaaacuacggaagagcaaaguaguugucucuauauaaaauucuaaaagaacucuuggccaauuuucugggaaacuaggaaguaauacaauaaaaacaaguuuaaaaugccucaauuagguaaacggcaggcaaaucaacaguuaugacacugacaaagaacuuaucaauccuuuuuccuccaugugggacacucuagggagaccugugaaccaccucccagagguguuuaagcucauacaauaaauguaugaaguacauaaaauuauaagaaauguauagugcuugaauguaauuaucaaaacuuaaaauauacaaaucuaugucagauauaucagauacacaaauauauuugauucuuuuccaacacuuuaaauaacaguaguacuggauuuaaucaccagacuuguaaguaaagagcauuauaaacacuauacugagggcuggagagauggcucagugguuaagagcacugacugcucuuccugaguucaauucccagcaaccacaugguggcucacaaccaucuauaauaggaucagauacccucuucuggugugccugaagauagcaacaguguacucauauuaaauacauaaguaaauaaaggauugcuauuccucucugguaaaaguuacaaauauuuaaaaaaauaaauacuacacuaaaauaacuugaaugcauuaugaagaucccuaauaagucuuauggaaacagccucucugauacugcuacauucauaacagaauaugugacaaaggauacaacuuuauccaaguucacacacacucagguuuaaaaccuuaaaaauaaccaaaaaaaaaguuuauuauauauauuagcuuaauaguguaguaaucucucucucucucucucucucucucucucucucucucucucucucucucaacuuacgcaguucccaagugaagugcagaagacaagacuaucuuacaucugcaguaugcucacuuuaaaggcacuuacagacguggucuaauucuccuaacugccugccuucuccccagccuacuuuaguauuccaacuccuaacuccuauaccucuaaaaagaaaggaagaagugguuaagaggcuugccugaaggcauggaacuaguuagugaggucagaguccuucacagccuggguuuagguucugcugguccuauucgauuuucuucaugcaguccuaggcaagccagucccagacaacaaaagcugagaaagcuuucuccucuaccaucaucaaagcuguaaacugauagguaauucuaaagauaucuaagacguauucaugugguaguagucuauguuuuaaagauauuuuuaaaaaaauauuugcaaguugagaaaauuuuaauuucuaaaacaaguguaaaaugguacuaaaauaacauauuaucuugaauuucaauucugaccuaaaauauuuuuuaaauauauaguuacuaagguagucagaaagacaaaugaagcaucauuuguaaauaugugcuaaaauguaaguaagacagccaucuccaguucaacuucuucauuuuacauuuaagaaaacauuuuuuuagguacuggagagacggcucagugguuaagagacugacuagguucaauucccagcaaccacaugguggcucacaaccauuuguaaugggaucugaugaccucuacugcugugucugaagacagggacaguguacuaagauauaaaauaaauaaauauaaaacaaacauuuuuaugccguuagaaaugggaagagaaaagcagacucauguagcaguaaagaaccaaagacucaacauuguauucacaaauaucucuacaccuuauauuuuuugagacauuagacauuauuuagcaguagcaggguuuuguugcuuuugaugaggaucuaggcuauagguaauacuuuagcuguuauuuuucaaggacaacauuuucuuuucaucuuaauguuauaaaauggccaagcuaguaagaaucaaugagacaacaaacacaaacauaauaaagcuuacuauaucuuguucuaaaaccauuucaguuauuuuauugaauuaaagaauuaaaugucacauuuaauaaugacuauaauuaucaugcugcuuguuugagguacauauaguaaucuuuccaauauauacacuucuacuuaaaaccaaacuaaguuuguauaguuucuuuaaauauagaaccuaaaaaauuuaaguaucaguucucaugacaucgaagaaaauucaauccauuccccccuacaaugaguguccaacuuuugacacuucaacauggcacugucaucuauagauguguugggaugcacauagcuauccucagacauauuagccuacagacauaacacacuugaaaagacacugucaauuaacccuaagaugcuguacagcuucauuguccauuuuauaaagggggggauucuuuauuaaggacaaauacaucuacuccaccugucuuuuauucaaagauuauuaauuuacagaaacaggaauauuuaaaauuuuaaaaaaauagaaagcaagaaauauccagaauugacaucacagagaauucuuugaacuuuauacacuaauacuaauuccagcugacauacuccauaaucccacuuaauacacuuuuaagauauucaguauggcacguguuuuuuuacacugucaacaccucaggaucucuuccauccuaaaugcauaguguaccauaguguaacaauugccuggauacaugacugacacuuuaaaaaaaaaaguucagcaaacuuucucuguaaagggccagguaaauaaacauguuagauuucauaagccauagucuuauguugcaaucauucaaaaaaaacuuuacuuguaaaaccuggcaggaggcuggauuuaguccuguagaauaauuuaauaaagcauuuuuaacagcaauuaauguuuuucauauuauaauuuaaguucugaaccaagaauguuagcugcauguucauuuaagcauuacuaauauaugacagaucacuuuggcucuuuuuccacuuggggacaaaagaauucaaugcauuugguauauuacuaggaaaauaauggaacaaaaucaaaagaaaacaaucugaucagcaauggcaaauguaggagauauagaacaugcuacaauccuggccaaggcgaaaaccucuugggagaagcuucugaaaacgaauccuccccuauucccuuugauacuuuguaucaagacaagguacucaacucauccuacaacuaaccaaaggaaaaaaccaucuuagucuaagcuaauggagaaggccccaggccagaguugagaauuuacuauuacuuucacucaguguaucuuaaaugauguaaagacucaaaaccuuacaaauucacuuguagcaaaucucuuauuuaauuucaacuuuuuaaaaguuaaaagaaacauuuaagguccugaaagccaauaauaacuaaguuuagaaguaacuaaaauuuagagaaaaaaaaaauccucuagaauaucaauuacuaguaguacaauuuauaaaguuaguuaccccccacucucagagaaaauacuaaugugguacuccuuuguacuguauguaaaaccguacccauguccaccccaccgaggggacuggauccuauuagguacgcuaucacugaccucuaucugcugcccuguauuuauuuauuuuuuuauuuugagauggagagcuaaauuguccagacugaccuugaacaugcaauccccugccucauccaagggcagcuaggaucauagauuuguaccacaaggcccaguuuaaaacauucuuucaauacaguagagcuuuuguuguuguuuguuguuuuucuuucaaacuggaggaaagcuaauucucucugcagaaaggcaaagaacuauuucagguuuuguaagucauaugguuugccaucauggcucaagagaagccacagacaaacaaucagcauggacaaguuccaauaaaacuuuuaaguuuuuaauuuugggauuuucaaaacaggguuucuccauguagccuugaccaaccugcccucccucaccgccuaucuuugccucccaaucccuguugggauuaaagguaugaaaggccaccacugccuggccaauaaagcuuuauuuacaaaaaugugagcaggcuggauuuggccugcuggguuuaacuggcuaauacacaaaacaguucccaaucuuuccaaguaaauuaacuuuacuacucuauuauuuccaauguagagaaagcauaaagaaaaguagucagcacugucugguuauaucacucacuagauguacaaauuuagugacaguguuuacauacauaaaacuuaauacauauaaauuuagaauuauacuuaaaaggucaacuauaaggaaaaagacaaagcuuacucauacacaaauuuauagcaaauaccuacucaacaaaacuauguuauuuaaagguaugguggcuuauaccuuuaaucucagcauucuggaggcagaaaaccucagugcauuccaggccagccuggucuacauagcaagguauaggacagccaaggcuacccugacucaauacaaauaaaaacaaaaauucuaguuauuuuaaauuggugaauuugcaagcacuguuauacacauuguuguuuaguguggagaaaacccauauaacccccaccuuuuccacuaaucugguuacuagcuagagucuacuauuaaagacagaagaaauuaaucacauagacaacuauuccuuucuaaauaguuuccagguuuaaaaaaaaaauacauauaaaugcugcuauaaauaauaaaccuguuucaaaagacauucuaugcuuaugugugugugagauguguuuacaaauuuuuacugagaauuugcacuauacuuuagaaaggaaaaaaguaaaccuaaccacuaaucauaaaccaauguacuuacacaaucaauacuucugaaaauuaguauagcaaauuccauuaauuucauggugucuuagucaggauuucuauuccugcacaaacaucaugaccaagaagcaaguuggggaggaaaggguuuauccagcuuacacuuccauguuucuguucaucaccagaggaagucaggacuggaacucaagcaggucaggaggcaggagcugaugcagaggccauggaggggugcuacuauacugacuugauuccccuggcuugcucagcuugccaggggaagcaaggggcccuccccgcuugaucacuaauugagaaaaugccuuacagcugggucucauggaggcauuucaucaccugaagcuccuuucucugugauaacuccaaccugugucaaauugacacacaaaacuagccaguacacauugagaugaugagaauuugaaauauauaauauacuugcuguuuaauauaaguaaucccaugucaagguuugcuacagcacaaccuuauacuaacagacuugagacccauagauaagaauaggguaugcucauccuugcaggaacacuaccugccacauucuauacacaaggcaauuacuaugaaaaaugggccauggacaggacugcagaguuuugggcaugaagacaagccuuuuacucuaugacuuuacauauuucuggguguuauaacuuuaccaauguaguacaugauuuuuuauaauuuuuaaugauuuaaaauauacauccauaaaaauacuaagaaacacauagaaacuuaaugaaugcgacagagaggauagcuguaaaacacacgagagauagaaaagaauaacucucugaggucagacuggaugagcuuccuauuggagucugaagucagggcuuucccagaacacccucuagugacuccuauggucuagaaacuuaaaauaaccuuauagagcagcaacuuaagccagcucccaauucgggaugucaacaggguagaguaguaccagccaacuuuugauuugcagggagcccaagucauucaagagugauuuccuauuucccagauugcagcaauaagagacccaagcuauccaagaagagugacuuaaucucccaggcugcaccaauaacagaaaacuguugccuauacccuacagauaugcuuuaacaacacagcucagccuucucuaccucaauggaacaauauuuuaaaagcccugguccuuagggaaaaaaguuaagauuugccacccuguuuuuaaauggcucaauuuaaaguguguuaaguuuuaagugaaaacucugaacucucaucaucacucaacauuucagaucuacuauacuagacugcacauaauuuuauauuaagagauugaaaaagugaaaauaagucuuccaaccagucaccagagauuaaaaaccaguuaauaaaaauacauucugcucuugggaauggugaagcaaggaacaaaacucaguuggugcaccuaucucccauccccccuacccccaacuacuaacagcuacuaagagaaggagacagcaaaccuguuguccccacccauuacacagaaaugcugcaaugaagcuguguaauuacccagguaaucauaauccccacaaaauuaagauucauguguuuuuuccacacagcaaaaucuauuaaaucuacucuacaaacaucucuugagccccuccuccauucucucccgugugaagcuacagaugagcaaaugaguuuguagggcccacagagggcaacuccuccucacgcagacaagcuaaagacuuccuaaugacuacccgaguaauguuccaaaauacaguuuucaaagggaucuaugcaaugaaagccacugugguucuuuucacagcauacugacaaucugaaaaggagucugcauuuugucauauuugaagaaauuauuauuaugaaagauaaaguacacacuggugcaagugacagaauucuaaagauuaaaaaaaagcccgcaauccuaaacauuaggcucucuuuucagaucugauggggcaguuuuggcaagcagauuaagccauuauuuaugcagcaaaaugaacaaggcaauuguuuauucugugcuucgucacagucuuauaaguauucuauuaaaaaaaaaaagaugcucggucaacaauagauugcaguguccaaguauucuuuuaucacauaaacccuuguuaucuucggcuuuuacauuuacaucaugcaaaucuuggugccuccgcacagccaaccgggcaucucccucacaccucuuuuuacaaaaucucaacuguacuuuaaaaaaaaaaauuauaaacuugaccucuuaaaacacauuuccaaugaauaaccacucuucuggggagggaggaaaaaaaaacaaaaccacccagaauccuggcaacguuuacagaaacaucuguguaggaacggacuauucaacugaaauaacgcacuacucccuuucaaacuuggcugggcgaugggaguuugggagccccgaaaggcagaaaagcugaguuuccugguggggucugcucacugugcgccaggcgacuccgcggugcgggcaagccggggggcccggagggcgcgggccgugacugcagccccagguaagggcggccgggagcccgggccuggccucgcgggcuugcgcggcgggacccggcaacgcgacggccuuuccgcggcucgcgcguccgcacgcucucuaguaauccaacaccccgacuuucaaacgggaggccgggggagaaguucuagccucgcgguccccguccccggguugcgagagagcgugcgaccuacgcuccaugcggcccccgagggcgcgccgacccgagccccgggcccaguccacggcggcgggaacccgcaccgcccgacgcacggggcggccaggccgacggcggacggcgcggcgggagacuccggguaaguggcguggcucagccguuaacgaccacggcgccucuagggcggccaggcgcgaguccgucugugaggcgcgccaggccccgggccgcggcgccacagcccggcaacuucuggccgccaccucagcgccucggcggggagagcggcccccggggccugggacgggggagcgcgccgagcagggcuuaccccgaaaaugaguggcuccuucccugcccgccgccggcuggcugaggcgcggcucggcgggggcgucguggcuggcggcgaacgagcggagagucggcggugcgagcccugagccgccugagagaagacgcgccgcagccgccgcagacagcucggcaauauggccgcccggcgccuccucgggggggaaggcggggccgcccugcgcccccuccucccgcgggccgccaguggcggggcgaggccggggcucgagcgccaaccccgcgagcgugucucccggccgccccgggcggaaucgagugggccucagccggggguuggggggagaauacgcgcugcggggccuucgcgaagcuuuccccgcgggacgaggacgccgcgggccagcccgaguccgaagcccgcagugaacgaagcggagccgcgcggcccgaagcucgccgcgcgcccgccgccugcccccgccccgcgaguggaaacuugaaacucccgcuggugccagggaacucacggagggcguuuccagcgcccccgagguggagcuguucccgggaggaggggggauccccucggcagccgcuccagggugcaguucggugcuaggcugcaggaucccgggcuaggagagggaagugggcccaguguuuacaacaaaaagaacauuaaugugugcagguuuuuaaccagcuagaaaggcugguugguuuuaaauuuugcaguguuuuuaacuucccucaaaacgccaguggguaugacccuauaaugcgaucagguuuuuuguucuuguuguuagcagggauacuccuuccuuggcgguuagaaggaguaggcugagaaaggaaaaaaaaaguuggaaguagggcccaaagagcagccaaaccuaaauuauucuagacuuggaaaaaguuaccagucugaccauagucucacuguauccacucgcuagagagagagaccgaggcugcguucuggugggguuaccucggugcugccugcccucaguacuuucugcugggauuuagaguaacacuuggugccacuuguacacacagcaaugguucaauccuuaccugccuaccgcguuccguuuacucaauaccucuuucguaaacgaacugucaauacaaauauaacgcgaauguacguaauucuuacaggacaaauacgccaucuuuagggaagccuuagacuugccuuuccugagacaguagcucuuccagggacucugcagauccuuucucugagcuuccuccucagugagcuaccaccuucacccucaag

SEQ ID NO: 5101 - RNA, 157932 nt, Mus musculus
aaugggggcuggagagaaggcucaguggcuacgcaugucccgaggguggaacucaggcgugggcugcucagcgggcaucuucauggcuggcccuggaccaacuggugaugaggguaaauagucuuacaugagaacaguauuuuguguugaugguugguuuucuaugcaguuucaaagguuugcuuauaccauuucuauaaucauuugauaggauuacuuaccacuaaucaugacaagguugucugugaucgcaaucucuauuccaaacuacuguaaguuaucugaaaaauuuaccugcguuuauuuuuuaggggggggggaggguaggguagauguggucacuguuguaaauguccaaaaggaggaaauuuuuauguaauuuauggcuuuagaaguuuccuccaaagcgucugcucuggccugauaugaggcagacugucaugguggugggaccuacacagcggaggcugcuuacaucagagaggcuguggagcagagggaaggaaggggcagagacaagauggcuccaaacuuuccccuuccugcccugaguuacagacuucuuccagcuaggucuacguuuuuccacaaccccacaguuuaauaauauuauuaaauaauuuuaauuaaguaaguaauacuauuacuugcugugggccaagccuucaacgugugaaacugugggacauuucaaauucaacuuguaacaauggaacaauggcucuaaacauuuguuuguggauguuugugcagacauaagcuuucaaaccuguuggguacagugugguggcuguauguuuagagaauauguagguuuauaagaacccgucuucuaaaacagcuguaacacuuuguaguaucucaggagugaaugaagccuaucauucauuguccaucucagccuuuggugccauuagcaccuuuaaugcauccuuugccucaucauagccuacagcagucuccagcacuuuaucaaaaagacauuuaagaguuucuauugaagacagacccagcagugugggccuucauuuaucagguuguugauccucuugaauaucauucauccuucuuauauuggaggauuuuuguuuuguuugcuuauuuauuuacuuauuuuugagacagugucuuauguuuucuaggcuagucucaaucuuguuaugaagccaaggauggccuugaacuuuucauucucuugccuuucuaccuucccaugcuguaauuacaggcacgaacuaccacaaccaguuuuauguacugcuggggacugaacccagagccccacaaaagcuaggcaagcucucuguggacugagcucuaucaccucucagauuagcuucauccccuggaaaauagguugggagaugcuuagagacaguguauguaacaaacccagcucuguauggcauuuccuaacugcuguuaagaaaaacaguauggggcuggugagauggcucaguggguaagagcacccgacugcucuuccgaagguccagaguucaaaucccagcagccacauggugguucacaaccauccuuaacgagaucugacucccucuucuggaguggcugaagacagcuacaauguacuuacauauaauaaauaaauaaaucuuaaaaaaaaaaaaagaaaaacaguaugugggaaaaaaagcaacucagaacuauucuagacaauuugaagaguacuaacugcaaacaucucaaaggcucaaugauguagaagaacaggccaacucaccaacaaaguacuugguggcuauaaaaaugcauggcaaacugaaucuaagccccaggggaaaguggcacuuaaucuucugcugccaccugcuggccagaagugaacuaaauaaugagcaguccuaaguuuucauguaguggcuagugcuagaaguugaacgugauuagggaacgaguuuucaagcauuuuuagaauauuagaacucuuagguguggagacaugaggaggaaaagucgagaagacacgagaaaggaagaaugccccuccccuggaaucuaguuuacuuuuccugcugagaguaaagaaaugucaauuuagagccgggcgugguggcacacaccuuuaaucccagcauuugggaggcagaggcaggcagauuucugaguucgaggccagccuggucuacagaguuaguuccaggacagccaggacuauacagagaaacccugucucgaaaaccaaaaccaaaccaaaccaaaccaaaccaaccaaccaaacaaacaaaaagacccgucaacuuaauacauacagagauaauauguguuuuccuaaagaugucucuaacaaggguguuaaauacaacaauuaaccauguuuauuagcccuccuuuuuccucucuaaguuuaaaccucauaagaccaccuuacaauuucauugacacaagaaaaaaauaauaauauaaaauguaagcaugaggccuggagagaugguucgucagauaacagcacucccugcucuuucagaggacccagguucaguucccagucaguaccccccacagugauuaacaacugucuguaacuccaguucuggguggucagacauccuguauugucuucuucaggcacgaugugcaugugguuuauauacauacagucaggcaaaacacccauagacacaaaauaaaaaguuaaauaaauaacauaccaacucauauauuuuuauuuaacuuuaaucauucuaaaauuuuaaguuuuucuuaaucuuuaaccuuguaaauuccccuuuaaucuuugaugacuauaacucagaaagcuacgggaucauauauauauauauauauauauauauauauauauauauauauauauguauucauauauguauauguguguguuuaagacacucaaggacaucuggcucucaguaaaucuguaccaaugucuuugguuaguauacuauucaucuccuacauggcucuaucuaaacucacuaacuugauaaacucacuaacuuggcuucacucuggcuaaguccagaaucucacugagaaaaaaauccugaagaaguuuuugagggaagucgaggaucuggcauuaucugagugucucuaagugggaggaaauccuuaggcugcuaggaguuugcuauugucaccugcugcugcugauacccacauaaguuuuuauauaacacuaguaaguggagauaccuuugcuaagaauaucaauauuauuuauagaucauaugaauuaaaaucauguggaucauauggauaugucuuuucauauguuaauauuccagaggcuugucaauguuagugacaguaaacaugaacugauaugaauuauuuucuuaauuauaauuggauucacgauuaggaucuguuugaauuucuuuuagacaaucuguucacuaaacacauaauccccuagacacaacuaaaugggaagaggaaauaggaugcaugcauugauuuucccugagugccucuggcuuucucugagcucauggaaaggucuuacugugcagguuccuuuaaaaaacacuuuuccuuaauacaaaaaaauuuaauucaacaaaaguugcuggacuaccuggacuacauccuguaaaccaagcuaaucaauccccuuuaaaauauauaugcauauacguuuauucuaucaguuccgcucuuuuccagaaucuugauuaauauaauaaguucuaauagauguuuuucuuuuucuuuucuuuuaaaauuuuguuuguuuccaaaugggguuuuucuguguaguucugccugucuuggaacuagcuuuguagaccaagcuggccucaaacucagauauccuccugccuuugccuccugagugcugggauuaaaggcaugugauauuaccacccagcuuaaaagauauuuuucaaagugaauauauggaguucugagaagaaaaggguuuuauuuagagagugguuaaacuuuuaacaucauuaccauuuguuaaacauuauguauugcuuaauuaucuuaaauaaguauuauuagacuuguggauuucuuucuuucuuucuuuuuuuauguuuuagagcuuuauuguagaaaggcagggggaaagggauaagguagaaagagggagagaggccggccauagccacguggagagaggggaaagagagagagggaaggagggcuaaagaguaagaaaggugagagcuuaaagagcagauuguggauuucuaaaacccaacucaagucaggugucauaagacagguaggagauacaggcaggaggaugaagaguucaaagccagccuggauuacuugagaaccuguuucaagaaacaaaguccaaacaaacaacauguaaugccuucuucuccauaggggacacacuguacauccuuaggaacguccaaagccauggguaauuccaaacuguguagacaucaccagguacgugggccacaagucugccuucagaguuuccuuguauuaaaaaaaaaucaagagauagaaauugauaaagugaaauagauuucuuugcaguuugguucaaccaaggagacacaggcuucuagcuucucucucuuuuccuaugacaguguuauaauuuuacagaacaaaaaugaaauaaggagaaaauuuguguucuuguccucugucugugagguaagcugucagggcucagcugcuugagauugguccuccuuuggccucucucucagcacgugagagccaccaaguuuuaugauccaugcuacacuacuucauauauagcaugcuuacccuauacacucagaccucugauucaguguaacacauagauuagacacaguaauuacuaaucaaacagaacaguuauaacaauguacugaaauaaaguuccaugguucuacuauaugggagaaucaagacaaauauuaauuauuuuuggacugcaguugacuguugguuaaaaaaaaucacagaaaacaaaaugauggguggagggggcccuuguauuuaugugaacauagauguuauucugcagauuuuuuuugagggguggacuaagauucuuaaaccugauaccuuaguuuuuccuauauguuuuuucaaguguuuucuuguuuugcuuuuugagacaaggucuugaauagcuuuagcugaucuugcccuuggcauguauccaaggauaaucuuaaagucccaacggccccuaccuauaucgucugaguucugggauuacaggugugcacugugaugucuaauguuuauuagacaucuugugaugucuaauguuauucaauguuggggacuggacucaggaucuuguguaugauaagcaagcacucugaauugcaucuccagccaguuuuuuuuuuuuaauauuuuaaauaaggaaucagagacugguaaaggaaaaaccaggcagaagaagauccaggaucuguuuaccuucccuggaacaauguuauagaaaaacaaacaaacaaacaaacagucaggaaauaugcagcugucuauuuaacugugagguaagugucagaacucugaaaucuuuuaaaaagagauuuauuuauuuauuuauuuauuuauaagugcaugugaccuacugauucuauuuaguauugcucaucugugcauguguuuggggccgaccacuugggauuggaugaccuauucaggggcuuguuccuaaagaaaacugauucuccucucuuucucagcagcuauucauuuccuguagcucugccucuaguggcagggacuuguggaauuuccccaucuaugguggcaugucuacugguguugucauuaugcagggguuuuucaaccaacaacauuauugagauuucauagauccaauuucccuuccaugucuagaaaucaugauccugaaguccauguccugaucugguggcuuguacagucuuucuucuuccuuguuuacuucuuguuuuuguuuguuuguuuuuuguuuuucugcaauacuguuccaggaaagguaaauaaaaauuaggauuuucuccuccaugguuuuucuuuuacaguuucugauugcuuauucaaaauauagggaaauugacuggagaugcagcucagccuauagggugcuuguccagcauacccaagauccugggucuaguccccaacacugaagagaggguagaauccaucucuugccuuagucauuguugaugcccuuaucuaacuugucuuguaauuuuccccgagcuuuauaugugaaguugcauuguagauguaucaacaggggaaagcccucccccuuuaaaagcaaacaaauaaacaggcaaaaagcuggauaauggcaguucacccuuggaugucuucuguugggcagcucuggcuuaccaucuuuacucuguucucaggaccucugccuccuuaucaggauuuaaugaacuguucuacuuuugaacucacuuguccacuguuucugucugacuggguuucauugguaggaucugugggauaagaacucgauguuggucucugauuuugagagcuccaacauuuguugauuuuucuggcaccuuugcaucaauaccaaguccuccugaguuuauuggcuagacaguuauagcccucaaagagaauaucccagucacacuacaggggagggguuccugaggagcugagagauacauuuuuuuuuuucaucagugguggagcugccuaacauugcucauacuuuaaaaagaaaucucaauggucuggauaauuauacucauugguucucuaagggguagaauccauuccuugcuuuagucauuguuggugcccuauuucacuugcccuuggaaaaguucacaagacacaugguguuugugugugugugugugugugugcaugugugagugcauuuaaaaaguauagugauagcaggguuugguggcacacaccuuuaaucccagcacuugggaggcacuugggaggcagagggauuucuuaguucgaggccagccuggucuacaaagugaguuccaggacagcuauacagagaaacccugucucgaaaaacaaaacaaaacaaaacaaaaaaaguguagugauggaaaauaugaaaaaaaaucuugguuuaacuuauagcuauagucauagucguggaaauaaacauuuacuuaacuuaaaaaucauuauagcugggcagugguggcacacgccuuuaaucccagcacuugggaggcagagguagguggauuucugaguucgaggccagccuggucuacagagugaguuccagaacagccagugcuacacagagaaacccugucuugaaaaaaaaaaucacuauaaaauauacaaugugaauauucaguuaaggccacccaguuguuaaaacugagaguaaaugugaugguuugaauaagaaugauuuccauaggcucauauauuuggagucacaguuucaaaacuuuggaguuucaaaaguccaugccaggcacagugucgcuguucaugcgugcguacgugcgugugcgugcgcacgcaggugugugugugugugucugugugucuguguccugccuauggaucaggaugcagcucuuagguacugcuccagugcccaccuggaugcuggcaugccuucccugucaugaugauaauggacuaaaccugugaaacuguaagccagcccaguuaaaugaugcuucuuucuauaaaaguugccuuggucauggugucucuucacaguaauaguucagugacuaacacaguaaucaucucaggguuugguuuuuguuuuguuuuguuuuguuuguuuuugacacuuuguaagauaaauggugauugauguuuaggaugcucuccagaggcaucuuuacgaugucuauguguaaguguauuuuucuguauuauguaacuuuuuguuaauugaaaaguuugcuuuaaagcauuuugagucaacacgguggcauuuaacugaaauuagaguauucaggaggcaggugaauucuuauaaauuugaggccagucugaucuacaaaguaacuacgaccuacauacucuauaacguauagcaguguacucgcgaauguugggcacacuugaauccagaguaaaugaaaagcaguacuuuacgcugaguaugacuucaccauacuagcaauaagcaguguacuugcgcuguuuccggaagccccaagcacucucggaagcaguggagcacgcccaguuccuccgugcacgcuuuccccuggcgucuuaagaucgccccgcccagcggaagccaaaucaccaaucaucguccgcgcauugccugucgucauuaaugugugcccacucuccccagcuugggggcggguucccggacuugcgcgugcgccccugcgccuucuccacacgcugguuucgcgucuuccgugcugugccuugaggagcgaggaggcucccguguagcggcgucguggguccuggcagcccccgccaugggcaaaacgguugcuucucugggucagggaacccgacccgacccggugcggagcuuuaaucgcuggaagaaaaaacacagccacaggcagcaccaaaagaaggagcggaggaagcagcuaaagaagccggaauggcaggucgagcgcgaggggaucagccgccucaugcaaaacuacgagaaggugaggugggcucggggcacguucggcggggcucuggggagcgagggugggugcagcccggagguguugccgcugugguggacuuagggucaggguggugugggaaaggggcggacccggccaacggggccucacuaguggucuguugggugucgcuacccaggucugacucuucuacuuuccgcagugcugggaaaagugauagaaaugcggugacacuccggguagggacauguggugcagcaguggugacagaacagagaggcaauagugaccgcuguggaaagaaccuagcggauggagugagagccuucaguagagugcuagcccaacacgcaggaaguccuggguucaauccccagcuccacauaaaccgggcacauauugagcacuaaggagguggaggcagggggaucagaggugcaaagucauccaaggcuuuauagcaaguucgaggucagucagugauacgugaaacuuggucucaaaaaugaaauaaauaagcuaaaaucuggagugauguaagaaaacgcuguuguucgugggaaauguuuaaaauaauagaaauaucuuuaaguacucuccauguuuuauauucuuugccccuaucuugagguguggauggauccuaguaguccauuuaacggauaagaacuguagaguuuggagaggauaagaaacuggcccuaauuucccacaucuaguaguguggaauuggaaccuagaccugugucuguuuccacagcucucgaucuuuaaguugggaauuggcucugucccuuagcaucaucuuuuguucuuugucucauugucuucaugguuuucaccaagaaucaguggaaagacaauggaauguguuugccucuuccugacaucagcaucuuguagccaguguuccuagaugaguagucucauaguuaacacuuagacaagcuggcguguuuuccugcccuaggugucugccccuuaggaauguuacuucuauccauccucuuaaaacccauauuuuccagcauucaucuaccuuucucaccuuuccagugaaugccaccuuucuaguuugggauuuaauagguagaaucauccuggaauuaaaagucauuacuugcuaucuuguagcuuaaacagcaacagcaacagcgacaacuagauaaacuguucagaguuggcaacauuuaagaauuaguugggguuuugacuucagauaauuugauucggauuuggcucaccagcuauaugacuuugguuacuuuucuuacacuauucacacccuccccccuuauuuuaaaaggcuuaguaguaguaccugccucauaaguugugaggaauuaagauaaaguguggaaaacauuauucacaaugccugucauauagaaaaaagacaaauuaaaaaagaggcuauuauuaacaaauugcuuuuggauuuuguuuugaacugugacuagaauugcuuggagaauguagccuuagccugugcuugguuuacuuccguggagcugugacuccuuguuuuguucuacccagaacuuuucugaguucauauccuuauuucugccuaugcugaaugucuuaguuaggguuuuacugcugugaaugaacaccaugaccaaggcaacucuuauaaggacaacauuuaauugggccuggcuuacagguucagagguucaguccauuaucaucaaaaugggaacaugcagcauccaggcaggcauggugcaggcaagcugagaguucuacaucuucaucuguaggcugcuggcugaauacuggcuuccaggcagcuagaaugagggucugaaagcccauacucacagugacacaccuacuccaauagggccacuccuuuuaauagugcuacucccugugccaagcuuauacaaagcaucacauucuacucccuggccuccaucggcuuguuaaaacguaugagucuaugaguacuuggucguagcauaauaaagaaguacauuuggucccauuuccaaaguccccauaguuuauagcagugucaacaauuuaguccaaguucaaggucuauucugagauucauccaaucacuuaacucuaauccccaaagaaagacaggaaaccagcugggcaaacuccaaacucugcaucucaugucugauguuaaaguggucuuuagaucucaacucauuuucauuuauauugauugcaguaaaguucuuucuccugggcugguuccacucucuguuagcaacuuuccucugcagauaucccacggcucuggcauuuuuaacaucuuugggucuccaaggcaacuucaacaucacagcuucuuguuucagugucugggaucuauacaugauguucuggacuccuccaaagggcuuggguuacaucuccagcucauagcauucuaggcucugguugacuccauuccauugcugcuucuguucauggugaccaucccaugguacuggcaucuccaauacacaggggucuucugcugcaacuagacuucaccaauagccuuucauaggcuuuuuccauggugccaagucucaacuuugcaugaccccuucaguccucagcugucaauuucagcugaggcugcaccuucaccagucgcuuuccauggccucucacagugccaaccuucaguugcucuccaugauccuuuuauacuuucaaaauugauaccccugggugauucuuacacauuaccaaguacagcuguagcaugagggacaacuuugacuaucucugagaacauagcuucuuuguguucucagaaaacauuucccagauuucacuucagugaugcuggucucuucuuaaucacuguuaauuucuuagguccagcuaacuaacauuaguuaucccauuagucuccuucucaucuugacuauaaagccagagccaaaugagugaagcugcugaauucuguuuccuggggcuucaacauggcucccuuguucuauuauaguaucaccaacuuucuguuuucaaugaauuuauucucugccuaaucuugguuaugcuagaauuugcucuguagacugacuuugaauucagagaucugcaugccuauuucuuaagugcuggguuaaagauguccacuacuuacgcauuuaaguuuuucucuacuuggaacuuguucuguaccaggauggucuugaacucagagaucugcuugccuuugccuucugggauuaaagguuuguauuaccaugccuagaccugaauuuagcagggugcaaucuugucccaagguuaccauucccuuaauucauuuuaauaucccugaauacaagauucaguuccauuucacuuccuggugccccuuuaauacucaaaugauauauuuuauauuuuuguuuucuaagcuugguaugcuuguucaaaaugcucuuaaugagaucuaaccagagaacaaagucucugcugggcuuuuuugagucuuccuuugucaaugcaauuacuauaaaucuucuuuaccuuaaccucauguaggcuuuucagauaagggcaaaaaucagccacauucuucaccaaaauaccacaaaaacagucucuaggacacauacugaaaaucuucuucacugaaaucucuugggccaggucaggucuguacaguucaaaucacucucagcaacaaagucuucauauuccuacaggauagcccauuaagccugaauuaaaucauuccacugcuguccagauccaaaguucccaaauccacauucuuccaaauaaaagcauggucaggccuaucauacaauaucucacuccugguacuaacuucugucuucagguuuuacugcugugaauagauauaccaugaucaagacaacuuuuuuuuuuuuuuuuuuuaagauuuuauuuauuuuauauaugugaguacacuguugcugucuucagacacacagaagagacuaucagaacccaucacaaaugguugugaaccaccaugugguugcugggaacugaacucaggaccucuggaagagcagugcucuuaaccgcugagccaucucuccaguccccaaggcaacucuuauaaggacaacauuuaauuggggcugccuuacagguucagagguucaguccauugucaucaagacuggaacauggcaacauucaggcagacauuguucuggaggagcugagaguucuacaucuucaucugaaggcugcuagcagaauacuagcuuccaggcagcuaggaugagggucuuaaagcccacacucauaguaacauaccuacuccaauagugccacuccuugaccaaaguaugugcaaaccaucacacugaaugucuucauauuuguguuauacaacacuauuaaggcuagaaguuauuaucuucucuacuauaccucagccuuccuaaaugaaaugagugaucuaauuaauuuucuguugucuuuuuuuuuuuuuuuuuugggcagcaagaccacuuacgcuaccuuugauagucucucagugugaaucucuuccuuuuccuccagcuugaggguucuaauccuugcuugugacugucuggguuguaggagaauauaugugugggaacauuuguauuuugggaaugugugucugaggauaaguucagcucuuaucugugagugccuauaaaauaaaaacaaguuucauaguucuaguauauaauaacacaguaaguauuuucauuccaaaagggagcaauggaaucauagcaaugaaugauuugacaaaugaaggaaucaucugggcuccaaagggcuuggguagcuccaucucuguggcuuuuuuuuuuuuuaccugcaguacacaugcccuuucucuugaguuagcucccuuuaugucugaacuuuuaucaguggaugccccauugucuaguauuuuguggcucccaucauaacuuaggcuucaucaucacacauucaugugauggcuccuuagggccuucuugcagagacucugaccugcuacucauucaccuggccuuagugggucucuggaagcuuagcaugagccuccaugacucccugugccuguaagacuaauaccaugugggugacauugccaaacugcaaggucugcugucaauuugagauauagucuggcuucuuuuggauuacaacuucuuuauguugaccccaugaggcacuuccuaggugguuggucagagcagggagcuucuguaguggcauucuaugacuguauuuuccuuagauagagacuuccgugagaaaagucuugcucuugaggcuccuuuuccagcaggacacaggguucucuuaauggugccagucuuaacaauuuacaauuguuucucagaaaccauaguaccugaacuuuaaaaucucuucuuucuucgccaagugaaacaguuucccugacugucuguucacuuguuacauguguucaccauagaccuaguuaagagcaguaagcuguaaccaugacacuggcugacugccugcuacccuggcuugagauuuccuugacauauuaauccaauacuuuugaauuuaucuucucucauguucuaaggauguagguagaauacagucagauucuuggccagaauaugacauugauaguuucuagaguaggucuggauagucauuuuguccuucugaaccucauaaacuaugggccucuacuaucugcauuugucuuggcauucugaacucuuccccuggauuucucauuaaggugugcuuguaugcucuaagacuucucuagcuugaaguuccauucucuucuccaguccuuucacaaacaagugccaaaggcauauggaucacagcaucaggcauacagcaacagccccaguuuuuaccauuguucugcauuaguuacuugucucauugucaugagccagaauaucugacaggaagcuacuuagagugggaaggauuuauucugccauguaguaugcguggauccagucuguuuuggcagggagaaggaugguagcaggagugugagauggcugggcauguuuuguccacagauagggaacagaugaaugcuggugcugccuacacuaaggggucuucccgccuuaauuaaccccauuuaggaacugugacauagauaugccuaaaaguuuguuuccugggugaaucuauauccuuucaaguugacagucacuauuaccuaucacgcuuuccuccuuuagguauucucuauucuaugaaaguagcucauuaguuacugguaccccaaguaaguaaggaggaacacaucuaaguccugcuuggaagaguaucugugggaacuaaaaaggggguagggggaaagagcggggagggaggaggauagccugcucccagccagaguuccucuuaugcucuggguaggcggacgcgggagggcugccggaugcuuuucacucagcuccggguggacaucuaagccacugaccccacucgaugagggugggggggggcagccccugaccugggccccagggcgacaccuuguagcucugggguuauagaagagagagcauagggggagagguucccacgaaggugagaguaagcacagcgggccuugaugaacagagacagucuaugguuuuagagcuuuauuguagaaaggcaggaggaaagagaaaagguggagagagagagagagagagagagagagagagagagagagagagagagagagagagagagagaaagagagagagggaaagagggagagagagagagaagaaaggcuagggaguaagagggagagagaggaauagagugagaggagagaggaaaggagaggagaguuagagggaguaagaggaguaagaacaagagagugauguggggccaagcagcucuucuuauggugugcuguuaucuuuacuguugcuagguaacuggaggagucuagccugaaggucagaagcuugggacauugccuaugugacuacuaaccauguuucucuuguggggacugagagggugguaacuuugacuggagcuagggcccaggagacaugagagaauucuuuccgucccauguaggugaauuaucaccaccaggucccgggguucaacaucuagccucaacaggaaaccaggcugucugugcauagcccaaugccccacaaguaucugccaaaugagguugcuccaugguacaucauguuauuugaauaaauagcuuuuauuuagaagugaugguaugcuccuaauuuuguuauaugaaggaugaacuaggcaguaggggaaaaggggaguuguauugugaaacuaaugagucaucuaacauuucuugacuuaacugacauuauuuucuuuuuauaaucuuuuuucuccagauaaauguaaaugaaauuacaagauuuucagauuucccuuuguccaaaaaaacauugaaagguaaguauauauggucauuuuaggauagauuguuagauuuauucauaucuuuucagaauuaaagaaaaugcacauguguucauguauaugcuucuguguauaugcaugccuguguguggaggcuaguugacagcucaggaaaacuuuucaucucuuuuaaggcaggguuucucagugacuuggaacucacuaauuaggcuagauuggcugaccagcaggcuccaagaaucuuccugcuuuucucuccuagucuaguuuaacagcacacagaacuccauguguagcauuuuuuuguagguucuaaggauugacuuaggucuucaugcacguuacugauugagcuuucuagcuacacaucuuuuagagaagagaaagguuaacagaaaaaaaaaaaacuucuuuaauaccauaaauacaagguuugcuuuuuugaaacaaggguuuguuauguaguccaggauagccuugaacucccuuuauaguucagacuguaaacucagugauccucuucccaggcauguaccaucuacccaccucuaaaauacugaauuuuaaauuucauuucuuuuccuuuuuccuuuuuccuuuuuccuuuuuccuuuuuccuuuuuccuuuucccuuuuuccuuuuuccucuccucuccucuucucuccucuccucuccucuccuuuucuuucuuucuggauugguugaagauaaguuaaaaaggaccaggaagcucuggacuggacauuuugaaugaaacuuguugauucuguuaguuaaacaggagaacaaacaaaaguguuuuuuuacccuuuguguuaguuuuguaggguagacauaacaaacuaacaaucuuuguuuuguuuuguuuuuucuagacaggguuucucuguauagcccuggcuguccuagaacucacuuugucgaccaggcuggccugucgacucagaaaucugccugucucugcaucccaagugcugggauuaaaagcgugugccaccacgcucggcgacaaacuaacaaucuuaagcaguagaaaauuucuuagaauugguguccagaaguccaagguuaagauguuggcaggaguuguucuagggcuuuaagggcugggucuggaauauuccugccacuuugacuugaggauggccucuccuuuguagugaucuuuuugacaagauuauguauguuuacuguguacaauaguaugacuugaaauauggauauaaaucaagcucauuaguguacuuaccuuuccuucauaagaacauuuaagaucuacucuuagcaauuuucaagcauaaaagcauaaauuauaauuaacuauaguuauuaugauauugugauguacaauguaucuuuuuuuuuuuuuugaguuaggccucauauccucauauauuccagaguggucucaguacugccauugcuauguagcugaggauaaccuugggcuccugaucuuucguuuucuacauccuaacugcuggcaucauaggcauguacccaggcauuaaacccugggcuucacccaucuaaguaaacacucuaccaacugagcugucccgacccauaauaucuauccccagcccacaaucuagcucuugaaccuauuuuaaccuguguaccuuuguguugaguaacaacuuucuguauccccacuuccccaguuucuggugauauucuuucuguuuuuaggauuuauaaacaugagaucaucugguaucugucuuucugugccaggcuuguuucauuuaauauaauucauucuagguucguccauguugucaccauucuguauauugucuaaguccucaagcaagccucuaucuugaacagaagagcaaguagucuccagcuuaaaacaaaacaaaacaaaacaaaacaauuagcuuauuauuauuaguggaguguguguuggagggggugugagugaccacuccugugguggucagagaacaacuucgugaagucaguccucuccuuucauuugguccuggggaucaaaccccagucgucaggcucacaaagcaagcgcuucaccugaugaaccaucucaugcaccuguugccugcaacauugaaaguuuggaguuaaaagcuuuuaguuuucaggguauaggccucagugauuauggguuuggaagucuagccuaugagccaccagaccuucagaacuauucuuugacuauuuaugauuuccaucaggguagaacagaagaacuuuuagccaucuguuugugauggggacauacaaucaagccugugguguggcaucauccauuaagaguuuucuucucuuuuccaugcugccagguuugcaagaagcacaguaccgcuugguaacagagauacagaagcagaccauaggguuggcuuugcaagguaaagaugugcuuggugcugccaaaacuggaucuggcaagacuuuggcuuuucuuguuccgguaaguacauuuguuuuggaucagggccucuauuauaugauuuuaugacauucuauaccuacaacaaaacagacaguuauguagauagcuguuucauguuggaguucuuggccagacaggagccaugucuauugaguuccuugccugaucucacucucauuagcuuguaugacagugcugugcccauggaaggcacucaguaacuuacuuuggugaaugagucagucugcuuuauaagcuauugcauucugaaggagguggacaugccauugugguaguguagaauggucuuguucugucuuugugcuuggguuauuccauuugauguaauucccaggagaccugauagggaaagcuguuucugcuuucacucuugaaagccugcuggugguauuuguaguugccauuugucuaggaugaggcugaaauauauucauguugugagaauucuuuccucagggagauguaagcgaauauauacucccaccuuacagauacuaccaagaaaacaaagucugauuccacugaaguucaacauuacagguuacuucaacaggauggauaacuucaaaguaacugggccauugggaagucgaaccagcauggcuuagacauuuccauagcugcacugacagcuucccuucaguuagcccauuacaucucuauacucuaguauuucuugagacacugaggucauauacaguuagggaagaugauguauagaugacugggagguucaagagggagugaccagaaucucagguggggggucuagugaauauccauucucugcuauaaggaacaucaaaaaaaccauccugggggguuucuuggcaguaguuaacagcuguucuaaugagcaugaugauuguuaaucuugcuuacagcaaggggauuuagguauugagaaauuucuggaacacuggcagcugucuuuuacaguaguaggguaguagaacucuuaggaauuuccacuuacaucacaguugcuuaguugguuuucuaauuugguucuuacaaaaacaacuggcccugagagaaagcaaaucauuuguuucagaugccucaaaacuaguuuucuuuuaaauccuaguuauuguuguuguuauagcauuauuuuucuacauauagggaauucaaucccuguaaaacuauaacagcuauauagauuguaaugugguuucuguuuagaaaauaauuuucuugucccaguuucagaggucuggguuauacauguccuccaauagcuggucuccugauuuuuugacucugacaucaaagccuuagggcuucucuuuucccucugaauuggaguuggaugcuucuguuagcuggaagaaaaugucucuuucagauuggauaaaacuugugagaggaaugccuuuuguuugaugauguauuugauuugaagguaaagguugggacuuuagucaaagugaagauuuguuucuaagagauuauuaaauauaauuuuugucucaucuucaagguguuggaagccuuauaccgccugcaguggacuucaacagauggccugggaguucugauaauaucaccuacucgagaacuggccuaucagacauuugagguucuacgcaaaguagggaagaaucaugauuuuucagcuggucucaucauuggugggaagguuuguuccuuaucugcccuuuccuuuaacauuauucugcugaugaaagggguggggggaggggaggagauggaggacuccuauaaauggauuggucuuuggauggggccucagugugugucaucuacauagguccagaaaguccacucuugucagcaccugaguucaugaggcuuucagacagauggacaggcuaucuagagcaaaccuauuuguuugcaugcuuugggaaagagaacauuuuaguauguggacauaguaccuuuuaauaaaaugucaaagaggcugaauaauuaaaaaaacacugcuaugucaaugccacaugaaaggaagaugauggcuuugaggacuguguauuuaauuaugguguaugguaaaaccuggccaagguuguaucugcuaaggucaucucugggcugugaggauaaguaguucuugaauuucuauguagauguauacaagcaaggaagagguagcaucauaaacacuacuuuuguaccugcuacuugucuuuaacauuuaauagcauuuggugguucuugucucagggugagagccuguaagccguaaacuguagugcuuacucagcuccccccaccccaguaaaauguggaaguuguaucggagagccuguuuagugccucucgaccugacugcaagaguuggaguaauugcaauuuuuaagacuguuuacugacuuaguaggaaauuaagucuugucauagucauuuguuaguuuuucuuagccucagauuccuggguaugaugagcucugaguuucuucuucccuccccccccucauucuuacaaauuccuccccuauuugcuccaucuucucugaggacuuugauuucacuuggaaaugugggugugcuacagaacugaaagggaaaagugguguuuaaaucuaagcaucuaaacugcuccaaugaaauucugugugcaaguggcuuuuacaguugugcauagguugcuguaaggcauguauguguaaccaaagaaacaacuguuugcaggaucugaaacaugaagcugagaggaucaacaacauaaacauacugguuugcacaccaggucgacuucuucaacacauggaugaaacaauauguuuucaugccaccaaucuucagauguuagguggguauuaugauuucuguuacaaaacaacacaacaaccaaccagcaaaccaacaaacaaaaccuacccaaacucccccaagccccagcucauucccaagaaagcucuucugagcuuuaauaucagcaauguuguauuagauaacaugaugaaaacagucugagaaauaauuuguacuuuuauuuuggcauuugggcucuuaaacuaagaagaguauaagauugcuauuucuucuucaaucuauagggaaccuuuugggaauccaauguauuuaacuagguacuuaggcauugacagguuuuuuucuuuuucugguacaugugaguguacaugucguguguguucacaccuguguaagaacgcauggaguccugagacuacucuauugucacucugucaggugucuacucuauugcuuuccacuuuccucacugaggcagugucuuuuggugaacauagagcauaccagauuggcaaguagagcugaccagauuagcuggguuccaccucucuugugagugcugggacuuugccuuugugugggugcuggagaucugaauucuaguccuuaugcuuguugcauggcgagugcuuauccacugagucucccuagucaaauugccauuugguuuaauuuaauaaacuucuguauugcaucaaaggcuaguucuuucguuuuugaaugcuuuuguacuuucagaaaaguuauagugguagaguuucucuauaauucuucacucagaugcccuuaguuuuuuuuuuuuuuuuuuuuguuuuuucgagacagggcuucucuguguaguccuggcugauccuggaacucaaucuguagaccaggcuggccucgaacucagaaaucugccugccucugccucccaagugcugggauuaaaggcgugugccaucacgccuggcacccuuaguuuuaauuuugcacauaacugugauuuguuaguacuaagagauuaacaacauacuguguaauucuaacagguuuuauuuguuuagauuugaucaauuuuccauuauauuacuuuuuuuuuuuaaauuacgauuuugagauuucaacacaguaccuugcacauggaccuuucaaauguuaggcaguugagcugcuacugaacuguacccuuagcuuagccaguguccuuuucugcuuuaggauucuaagcaguacacuaaauugcuuuauucuaacauacuacuuaaauauuauagagcaacuugcacuuuucuuuuugcaguucuugaugaggcagauagaaucuuggauaugggcuuugcugauaccaugaaugcuauuauugaaaaucuucccaagaaacgccagacuuuacuguucucagccacacagaccaaaucuguaaaggaccuugcgcgcuugaguuugaaagacccugaguaugucuggguucaugaaaaagcaaaauacagguaggaauucucucucccugaaccauuuucuuaguucaagaauugauauucuaaauuuuaauuuuuuguauaguauguuuuguuauuagguacacagaacauacuacaaauagcuauuaaaauuacuuaaauucugcauguauguuuaagugugagaauauuuuaauguaacauuucugaaaauggggucuggagaacaaacaucuuuugauaagguguuaauaaucacuuccaucguaaaggagggagagaagaucaguuuaugauaguagcaauacugauccaaagucaaacguuguuggcaguggucuggguuuuauuagagaugucugcuuaggcaaacagaauucgugguuuugaugcagaaaauaguuucagcacuggauguuacaaagcaguuuauuaaaagagauguauaauauagauuuucaguaugagguuaagagaaggaggcauccaggaaaaauaagauauuaaaguguggcuuuaugugguuauuugggcuucucaaaggagaguagcacuucguugucuauacaauuugggugauuuuugaauuuauugucuucaaagaguuuccaagaacuuaaugaggucacaggguauuuccuaagguagugacagggguagagacguaacuaacuccucacugccacuggcacuaaucagaagaguuccuuuucuaauuaggaccuccauaccucacggaaaggaauuuuaggauaagcuaacaugacacagguuuuuuuuuguuuuuguuuuugauuuuuguuuuuuaaggcaacuuuaaaaaaccuuagcucuuaagcauauggguuaauagggagaugccuaguauaaucauaagaaacacccaacauggauugggcuucccaagagagagucauaucucacuguuaguaguuauguauauccgugcuuuccaaguuaaagugcucagagaguauaauuuacaauaaggcuuauaacagugguuuucaaccuuucuacuccugugacuuuuuaauacaguuccucauguugugaugacucugaccauaaaauuauuuuuguugcuacuucauaacuguaauuugcuacuguuauaagucacaguauaaauaugugauaugcaagauaucuguauauaaccccuguaaaagguuuguucgacuccuaaagggguuuugcccauagggagacuaagaagguuuuuuuuuuuuuguaaacagaguaguuauguggcuuuguagggcugucguuuaagucuaggaaugagagaggagugccgggggugggggugggggugggggugggggugggggugucagugcaagugccacagcuggcagggagaugaacuguaagaggcaagauggaaguugguccaaccuaacuuagcugauacuaguucaaacuucuagagacucuuacacuaggugguuuauuguaagcauauuuacuuaagcacaguacaauuuuggaaaaaagcuuccugauguaauacaaucccuggugcaagagggugccuccuuccauugaaacuuaaaguauaugugaccaugaagcugggugcuguagcuuaagggcauaggaucugauguggucucugacgaagaccuagauaauguagagguaggucaacaugcuauaaaguacaugugcugucucuccuaaugauggaguccacugacugagaaacaacguuaacaauaaaacuauagggagggagagucugggauaaacauucugggggauuugggugaggucuagcccuacagauaacaaaggucaccaggucauuaacagcaucuacucccagccuucuggguggaaaagaaacacuccuuuccuccuuugaggagacaaccuugugugacuaagauuccugauuucccuggugaucugugggugcaaggacuuuugugcucucaacaguucuaagaaauauaguuauagaucaucuugacuuuaaguaaguaugcauacauuuguuaguguguguaugugcguguguguuugugugugugugucuaucugucuguguguuuaggugcuuggaugucauggugugcauauggaugucagaggacaauuuugguuguaccuuguuugaaacgaaguccucuuaauuauuuuuugaugcuauaccaggcuaguugaccugcaagcuucugagaauucauugucucugcuugacaucuuguuguaggagcacuaggguuauagaugcucucuuguuauguggguucagagcucagguucucaugcaauacagugaaugcuuuuaauuaaugagccaucuuuuugucuaguaaguacaguuaauuuucucuuugacauuuuugaccaagcuaucuuuugugaaguauuuauuauuuuugucuaaguaagcgugauuauuuugucuuugacaugauagcauugggacaacauguauuguucaguaggcaguuugaccuuuaucagugguguuugaagguuugaagugcugagaauugaacccagggccuugcauguguccugcaaguguucuuccacugagcuauacccuuaguccugaaaauuuuagugcugaaauuacuuuauuaucauauacaaauaguauagauaauacagauaauaauaaaauguauuauauacaaguaccuuuuauccauuuacuuauuauagaacaucuugauugauuccaaauuguagugguuaggaauaaaauuacuaaacaucugagugcaguugucuuuuuuuuuuugguguguguguacacugguuuuucaguucuuuuggauaaaugcuggagaguaugauugcugggcuagaugacaagaaugguuugggaaucuucaaaaguggcuguaucauuucucaaaaucugauauuguagggucguaaguguauaguggaguguauaguuguauuaugucuuaaauuugaauuuuccucauaagcagcaaguggcgagcaucuuguaugcuuaugacguggaauaucuuuuauguucauuuuacaucugaacauuugggcagcugacuguuuugagaacuuuauucuuuucucccuaaauuggggauuuguguuuucccaaguguuauggagagcaguugucuaaugaacguugaguuugcaaaauucuuuuuacauccuuuggcuuuucuuuucuuuuuuuaacauaaguguuuaucacgaauuagaaaauuuaaauguuaauaaauucuauuuuaccauuucucucuuuuggaaucugaaagcauuugacuuacaguuuuugaauuaucugccccuuuuccugaaaacaauguggcuacacuugguugugcaagcauaugcauauauaguguguaucaccagucucacaggcacugaaauguucuuuaccuauuccagaagucacuccagagugauauauauuacauuuuuuuuauaguugcauaauaccuuauggugguguguuuaauaguucaugccacaaguucauuaguaauagagguuuggguugauuucuuuuuuaaucacgugguuacgaaugaugauauauauauauauauauauauauauauauauauauauauguguguguguguguguguguguguuuauauaccccagacuaauuauaagaguaaauccauagagauuuuucacauauuguuaugaauuuucaaacauguaacaaauugagauuuuuauaaugaauucuuaaaaauuguauuuacaacuucauauguauauacacauauauacaguauaauauagucauguuugcaucucucucucucuuuuucuuuuuguuuuucaagacaggguuucucuguguagcacugguuguccuggaacucacucuguagaccaggcuggccucgaauucagaaauccgccugccucugccucccgagugcugggauuaaaggugugcgccaccacgccuggcugcauuacucucucuuauccccucucuccucccauugaaccuuuucuuccuaacaaaacccucuuccugucaugccuacaauaaguucuuuauaccuguuagaugugugcucaccacgggccagugauuccuuuuccuagcuacuucuucauaccuuugugcauuaacccaucuuaauguuggaugacuuugaaguaacuugcagauaaccuuucucauaaaugcuucagcauacaugaucacuagugugaguucaauauuuauguguguucuuguuuguaaaacuuuauaugaaauauacauauguuaagucuagauugauuagauggauguuuguauuuuucuaaucucaaaccccaauaaaguuguaggcauuaacuaccagcccagcaaaguuuucccaugccgcuucucacagaugguggccauuaccuuccuucugugguugacucuugcuugaucuuguacuagcauguguguguuucauauaacuuuuaaaggauuuucaagauauucagccaugaugagcuuccuuuauaggggacaacagagaaaaaaaacauauguguacugggagaauggaccacugauaaguuucuuuuuuuaguguugauuucaaagcagcaauaugacauuguuaaaagaauuuguuuuucuugauucuacaagcaccccugcuacguuggaacagaacuauauaauuugugagcugcaccaaaaaauaagugugcuguuuuccuuuuugagaagccaccuaaagaagaagaguauuguguuuuucuccaguugcaaagagguauugauuuuuuuaauuguuccuuuugaaugcauuuguguuggaucacucuccuugaguugucagauuucaguuagacaaauaaugacuauucugcgcagugcuaggagacagagcuguaaagauugaugaucccguguuuuuguuggaaaagaaaucaugacugagacuugaagccuacugaagguagagcccuugcuguccucugcucagcacuguuuuagauguuggugacucugggaacauaguacucuccaccagaaguauugguagaggaaucuagcuaggccaaacugaggcuuucaugauggagcaguucuccuucccuccaagugcauggaacugaguauuccuuuuuuucugugccucaaauuucuguucaugcuuauuucuuuuuggaaugcuugcuguuuauaccuuuauccugacucuggguaagucguuggugcuuuuuaaggaaaauuuaaauuguuuuacgugaaaguccuuuuuagaacuuuguuguugggaucaguuguuccuuaaaaaaaaaaauccugcuauaauacuuugucuacauccuuacugaguuaauaaauaauugaugaauacuagcccuguacuaggaauaagggauucagagaaauauaaggauauuuauuucucucuuaaggacaggagaucaugguuaauuuguauacuauguucucuguguauuuaagauuccugaugauagacuuacaguaaacucuagauuuauuguccuuuuucuagcuuagcauguuaagcauucaggugaguuucuuucuaccuuguaguaagguaagaggugguuuauuucuguugucuauugaagccuauaauuuuuuugcggaaagaaugauuucagauauucuuaguauuccuuucagaguuuuauacuucuuagggaggaguuggguuuguuacuagaaaauaagaaguaauauacagaauuguuuuuauuccaacuccuugcuuuucuucuugccauaguuguuugccugugcuggccuuucaguguguuagucagacuuuagcacagagcggaaugcuugacagauuuaccuuaagggaaaggcuucagucugucauggggguauguguaugacugagcagagcagcucaugucaugauggccagagagcagagagagaaggccugcucugguuguccccacauucaguccccuaccucuuagccaguccuuucuggaaaaguccucuuaagauguauccaguggguauacaauauuuuuuauuagucuucucucauuuaucaaauugauaaucaagauaaucuacagucacagugaccaauucuguguguucuaagcuuugucuucaucugcuucaaaaguauucuugcuguauauagcaaaugucccuuugucuugcccuuuucucucucucucuaccauuugcugauaauugcccauauugagaaugaaaagcagacccaaugcuccugccuuuccguucuucacaacaaugccuucuaaagacuuauuuuacuaguugaaucuacuucuuuuccuuuucuuuaccuucaauucaguuaggucuuaaaggauacagauuuccaguuacugcucaaauaucaguucuuccuuguccuaucagaagcccuuaccccccuugcuuaaucuuuugacuuuauagccauuaaccuguauuucuuuuaccuuucugacugaucuauuauaauuauuuugcuaggucuuuccgguuugacuguuagaauauugaguacuucugauuucuccauucugcccccuuuucuuaguauguuuuguggguaaccucaugauuuucauggugugaaugcagucugauugaacgcugucaauugaagaaucuaaaucucaaguccugacuucuuuccugagcucugcuugacuacugagaauaucagguuguaugaagagaccacucaaauaagaacacuucaagaauugcuguccccagcugugcuuugcccaaguuucucccuuuuuguaacccuuaauuccugucuuuucauccauaguguuauucuuuguaauuuguuagcuuuguaacuucuugucgucucccguguuccagaacaguuugcaccaugcuuaacuuucuauuagcuuccuauuugggucuccucuaaugacuuucugugaguaagaguuaaauuccaugcuuaaacucuuacugcccaccucagcuguuaacagaaauugaagucccuucuuuauucaaaagagucauauugcagaaaguuuucaugaugucuuuuaauugaauuucuguauauucuuuucccccaaacuaauuugccucagugcaucuguggccugcagauuuauuuuuaccaucuuccuuuucaugauaccccuuuguguaucuuuacaauuaaaaggcagaaauccauuauuucugauuuugcugguaaagaaucagaacuucccuggcuuuagaguguuaaagaacagaaguaauaacaaaacagcagugauugguccaaaaaggaaggugacacauaauucgcuucagaaguaaugcaguuuauguguuuaggggcagaccuuuuuucuaauacagaguuuugcuguuuagaaagcaaauaaccuuuaugacuaguaauacauuguucaauuuaagcuuuuuugcaguauaaucaccuuauauugugauuuuggcauuuuuauaguccaaaagguuguuuccucuggguccaaguuuuaaaaaaauguauguacacaaauuuuauauauguuagaaauauuguugaauucuggcucugucuaaugguauccaguuaggagcaaguccauaguaaagaagaaacuaaaacaauaacuaacuccuuuaggccuauacauugaauauauuuauaauaaaauuuuaugucuaaguuauuuaaauucuauuuuuugggaaaggggaugagcuaagugcuaguaugauaaauucucaguuugaggagaauguuuacacugccuguuguuauaggaaauuaaauguaaaacuuaagaucauuuuguuguagaaauuuaugaauuauaaugugauuaauaaaagacuuugaagcuuaaaaccuaagcugcaguugugugaggucaagagauagaagugcaauuuaaggagggaaggagggaaagcaaagcuuucuccaucacgaguucuccacguaacucucguagcuuucuauacagaaucuccuggguauuuauaugaaaaaacugauuauuuuaaaauaaaguuuuauggagauuaaauuuuuauagccauucaaaaauuggaaagaauuuaguagauuuaaaauguaagaacuguuuucaaauuuuauuuuuagcaauugagauuuaauuuuuuaaaaucaaaauucuuuuagaaaauacguauacaaaaauguugcaagaccuuaauuuuagauuacauuucuuuaaaaaacccggcagucggugaaauuuguuuucucuccugaggcacuaacuucuacccuucugcuugugcccagguucaguaucuguauaggguguucugcaggcugcgcccagggaucucgauccuugcucuccauggccggcagcagcagaugagaagaauggaggucuacaaugaauuuguccgaaagagggccgcaguacuuuuugccacugauauugcagcuaggggacuggguaagucaccuuccuggaagaccauucuugauauaggaaauauauuuacuacaggguguuuuuuggaaaucucagaucuugugagagaaaaauaguaaguuguuaaguugaugaacaugacagaugauggugaaacauuguguaguauuugcaucucugugagcuuguuucaugauaauuaaauuauaaucccuaggagccuccacagucaucaaagggaaaaaaaggauuacaaguuuaaagaugagaaaaauucuuacaacuuugaaaacugaaauuguaacucauuuagcaagaaaaaucaugaaaucuauuuucaugaccaaucauucugacuauuaaagucacuauauuuaacauacuuuaauaacacgugccuuauagcuuugugggguaggaugagguagagguguuuagagaacuaguaacuugaacacucuagcuguguuugguuauuuauaguauauuuuaagcauacguaaacaguagguaagcccuacucuagcaguuacucuuuugagaugaucucacuguauaguuccuagcuaguguugacuugcuuuguagacuagauuggccucaggaucacagaaauccaccugccucugcuucccaagugcuggggcacaauuacuucuagcugauuuuuuucccuccccuccccuccccuccccuccccucccuucccuccucccuccccucccuucccuucccuuccucccccucucucucucuuucuuucuuucuuucuuucuuucuuucuuucuuucuuucuuucuuucuuucuuucuuucuuucuuucuuucucuuuuaauuauucuuugucauccuggcccucuuagagugauuuuuacuuuuuuucuuuuguaauugucacuagaaauccuggcaguagacuaugaguguguagagguacuucugagaaauugagaacaguuuucuuugaaaaugaguaaggccuguaguagucagaaauauaaacuguauaauugcuuaucaguuuaguugaaggcaggacuagccggaaaaauagacauguguaaauuuaaaaucagcuuacauuuaaaaaaaauacuuauuuugauuauuuuuaaugugucuguguauacacgguggugugcaugcaaaguguggaggcuagaggugaugucuaaugccaucuaugcuuccuaccuuauuuugauacauaguaucucacugaauuuggaguuuacagagucugcuagcuuagugagccaguaagcucggaaacccuuguguucccaucucccgggacgggacaggagucagaggcaagugcuuccaugcuugacucaguuuuuuuucuguuuuuuacaugugagugcuagggauucaaaccaagggccucaugcuuguguaacugacacuuugccgaacuggaccaucuccucagaccuagacaugagcuuauggcugcuggaacccuaugaagaggcugcuuuuagaugauuaaccaucuggguacuucauugucagucacaaagcaaccaucuucucugcuucagaugugaagcaaucuaauuuuaguccacugugucaaauucgagaaauauaauuucuugguuaaugcaacuaauuuuauuuuaaauaaaguuuguuagcagagaugugauagaaaaucuugacacauaauacuguaaaauaauaauaguaaagcaggcuagauauugaaauugucucacccaugcugauauuucuucuauacagauuuuccagcugugaauuggguccuucaguuugauuguccagaggaugccaacacguauauucacagagcugguagaacugccagguaggugugugggcuuauuuuuuuacuuuuuguacuguuuaauaacaaaaugugcuuuugcugcagcugcagcugcagguaacaaugaauggaacaguuagguguuguuaauaccuaauuugcugugaguuuauaauagccugaugggcuagggagauggcucaguggauuaaagugcuugucauacaagccuagaaaccugaguuugaucccgggaauccacuuacaaagccuaauauagugguacuuaucuuacuguauuccuauggcuagauaggagacaaaguuaggggauuugcucuuaaguuugcaaaccugguagucugcaguaauacugcaucagcagaagcaagagagagacacuuccuuagcaggagggagguaagaaccaccucagagaaguuggcuucuaaccucuacagaaacucuguggcauguaugugcucgccuucucauacaugcauguacaacaaacaaauagauaaaauaaaaauuguaaccugaaggcugucauugagaacaaucccuaaagauuugaaaccuucccaagaacuauuuacugaacaucaucucacugaaucuucauaacuucuguaguuucaugugaagauaucaauuguuuaaguaguuaugcaguaaguuugaagauacaaauagccaagauuggagcucaggcagccugaauucucuagucuaggucuugcacucuuacauucuguggucuggggguuaauaagggacaggguugguaggcaucauagauuucuuuuucugagugagacuuaaaggugaaggcccagugauguuuuuucauuuguuuguuuccuuuauuuuauuuuauuuuauuuuauuuuauuuuguuuuauuuauuuuuuugguauuccauuugaaguaccuuauacuggccaaauagauauaggagaaaugucuagaauauaaaacaaagucacaguuauuucuagcuaaaugaaaaauguaucuaaaugaauaaaaaggauuauauaauuguuaguauuauugagaauucauuggaacuuauagaauuauaaaugguuaacagcuuucugggucacagugcuuuucaaaagccuuacaauacguuuuuuuuuuugccuuaauaauucuuuguccagaaguugaucuuaaacaaguauagagaugaaaucuggaugugguagcucuuagcugaggauuagaaggcugaggcaaaggaucuuaaagucaaggcaaacggaggcaauuuagauccugcuuuaaaaacaaguuaaaagagccgggcgugguggcgcacgccuuuaaucccagaacuugggaggcagaggcaggcggauuucugaguuugaggccagccuggucuacagagugaguuccaggacagccagggcuauaugcagagaaacccugucucaaaaccaaaccaaaccaaccaaccaaccaaccaaccaaacaaguuaaaagaggacggaggauauacucaguggaagaauucuuguccuagcauguguaaggucuuuggagccugccauucauucaguaugagcaccugaguuugaauuccugguacccaucuacaaacacuuggaaagugacaugcaucuguuuucuuagcacuguuggguugagacaggcagauccccagagcuuauuggccagcuagucuguugaguagaugaguuccagguucaguaagagacugucucaaaaaguaagauggagaacagguggugaggaaucuaacagcaaccucuggccuucacaugcauacucacaugaauauguacauaugacauagaaacuauaaaacauggaaagcagaugaauaacauuucaguaaacuguuguaauaugguacuuguaauggcuaagaauuguaaauaacaaauaguaacuauaauaggguuaugcugugaagagcuguauuuggauuauuuggcuuacaguuccuuccuguuuucccugucaucggaacagugugauuuggugcuuuuacugcauuagcaucugcuucggacuugcaggcuuugccguggaggaacaggucuucaggucucagggcuaaguucuugcugcacacagacugcuucucuagcuggcuuugucuuuguaccugaucugugcccguuccuugccccuuucauuucucccuccucuccuuucccuuucuuccauccuuccuucuucuuugcaaauuuucugguccuuuccucucuucauuucauucacauucaguuuuuagcuaauuuugaauaaaauaauggauauuuuuauaugaaagacauuuauuuucagcugaagugaaaaguuuuucauguuuccuaauuuuucuagaaugcuaagaaugucuaaguguuuucugacugaucugaauuuauaccaugggccaccaucaaacaugacuaauaaaaaauacucaaauguguuucuuuuaagaacaaaagaaaggcaguguaauggcaaacauuuuacaguagguugauuugcuacaaguuacaaaaggaagucuuggaguuggaauuaaugacauauuuuaaauaagcagugagaguugaaacuggguucugcaugagacagacuagccauuuaaauuuguuuucucuugagagcuaagagauaaugggacacauaguaucagguguuguauuuauaauuauuauuguguguguaugugugaaaagugugugguauaugugugacauggcagugaggaagaggacaacuuuuuguggucagcuuucuuucuccacucacuuggguucuagguugagcucagguugccaggcuuugguggcaggagccuuugcccaccaaaccaucucaucagcccuguuuccagcuucuuaagguggaccuuaauauucuggguucgcauuaggauuauuuuucacagugagaucuucugagaagucuuaguggaaguuggugauauccuuucuacaguuccuuaauuuccuuuaguaagcuugugguuuguaaaauuugcugcaugcacccacucacaucugcauuuuugugguccuuuaggucuugaaaaggacugguuauauaugguaucuuguaaacauuuuggacuagaaaguggcuuacaggcguuuaccugguccaguggcauaauguggaaaguggagacugauuucuucauagaaucuguuuaguuguauuuugaaauuucucuaugugagauaauaaguguuucaguauaucaauaaaugauucaagaaaagaaaguguucagguuuuuaguuuuggagaaguugguagaaauacagcguaguaaguagaacauguuauggugagcauuaaacgggaucauaaugcuuguagauagagacuuagaacaacacugcaaugcugagucugaagagaaauauauauauauuaaaauaguauucucauauauacuuauauaugagaauacuauuuuaaagacuauuuuaauguguuuuuuaaacacagucauuaacuuuuaaaguggaagugugacccuuuauacguaaguaacaaauucugaauugacuauuucagauguauagucagugaaaagguuagcauauguaauguuagauuugguuuaaaaugaccauuaauggucuuaaagauaaugagaaagcuucgugggccaugagacugaauaauugaguugaacaaaggcuaaauuaaaaauggaaacuaauuaaaauccuguguuaggcuguaauuaaaaccaaguugccagaaaguguuugcuuuuggaauugaacauaaauaaauaaauaaagaaagaaagaaaguggauuuguuagaaaaauuacuaaaguuggaggaucuggcuuauuuauuuauuuuuuuuuuugugacucaccaaggagaaauaaaggaugguccagguguuuauuucuaucaagcauuuacuguuuuacugaauucuuugacuuuuuuuuuuuuaaaugaauucacuggaucuauaacaaagaaaaguuuuccuuaauccacuuaacaaaugaaguccuuuuugagacaagugagugaagauaguuauagggaucuauccugcaguacauuugccacuuaaaaacaauugucuuuaaggcuugcagguuuugguacuaaaaagccugaauuuuuuuauuuuaaauuaaaaauuuacaguuggaaauacagaaaauuuauaauuaaaaagaaggcacauaccagacaagggaggcuaggguagaagacaggagauuuuguuuuguuuuguuuuuaaauuuaaucauucaaucauuuauuuauuuuauauuccagauuuuauuccccucccgguccacccucugacccccccccccccccccccccauaucuccaugaggauguccccaccagaccucuaagcuuccugaggccuccagucucuugaggguuaggugcaucuucuuugauugaacccagaccuggcaguccucugcuguauauguguugcggggccucauaucagcugguguaugcugccgguuggugguccagugucugagagaucuuggguccagguuaauugagacugcugguccuccuacagggucacccuccucagcuucuuccagcuuuuuccuaauucagccacaggggucagcagcuucuguccauugguugggugcaaauaucugcaucugacucuuucaggugcuuguugggucuuucggaggacagucauguuaggucccuuuuugugagugcuccauagccucaguaauagugucaggccuugggaccuccccuugagcuggaucccauuuugggcuugucacuggaccuucuuuucuucaggcuccucuccauuuccaucccugcaguucuuucagauagggacaauuaugggucagaguuuugacugugggauggcaaccccucccucucuugaugcccugucuuucugccagauguggacucuauaaggucccucucccuacugucgggcauuucaucuaaggccccucccuuugaguccugagagucucucacccccuuccaggucucuguugcauucuggaggguccccccaccccccaaucucuuaucucccaagguugccuguuugaauucuuucugcugguccucagggcuucaguccuuuuuccucacccaauacuauucccccaacccccucacauccacuuucccucccaggucccucucucccuacccccaccccuugugcuugagguuuuauauaacuguuucuuguucuagaguauaaaaaguacuuguaguucucaaaauauugucuuaauuuagauagcaaagugauuccacuaggggacagcagaaccaagcuuuuguauuucacaugccuuugauauacaucuuaacaagaaguaugaagcuggaaauugguuaaaauuccuaaauugggacgaguucgugguuugcagaaaaugcucauauuuuaaggaaucauugagaauuuuuuuuagaaucuuuaacuuuuugcaaucugaaauaauagaaaaaacaauuuccauaagaauuaagccuaaugugaauuuauuagguauuauauuuauuagguaacaguauuugcaagugaaauuucuucuuaaaaauucacuuagcuggaaauuuuaaacuucuacuagucuguuucucccaaagaggaaacuguuuccuuauguggccuuuggcauaugucuguugauaacugugcuuuggaggcuuagugaaagggcagagagaauccuuugcuuuguaacuugcagcauugaagagcugggcugcagcagcugguacagagguucugaugcuucucagcaccuccucugcucguagucuccuaugguccgcucagucuagcaggcaggaggaucuuuucugacuccugugagggcuucucaguucagucagugauaggccuauacacuuucuccauccccuacacccaucuuguuccaggccagauauauaugugccagacauauuguuaccuuaguaucuuuuauguuaguuucugguaaaauguauuucccacaguuaucuguguggcuauuucuguccuccuccucaaguauuuccacuccuuugugcccuucucuuuucuguaucguuuaucacauuuagauauguuagagcaauuaguugguuuuccuuuuauucuuugcuuuuaucauuacuagacuguuuuauaaagguuuuuuuuuuaagguuuuuuuauuuuuauuuuuauuuuuguuguuguuguuuucuacauuggugucuagugagcccaagagauuguccuguuucccuuucuucccagcacuuggguuacaggcaugcauuuuuuuaauuagguauuuucuucauuuacauuuccagugcuaucccaaaagucccccauacccccccccccuccccuacccacccacucccacuucuuggcccuggcguuccccuauacugaggcauauaaaguuugcacgaccaaugggccucucuuuccagugauggccgacuaggccaucuucugauucauaugcagcuagagacacgagcuccgggggguacugguuaguucauaauguuguuccaccuauggauugcagaucccuucagcuccuuggguacuuucucuagcuccuccauugggggcccugugauccauccaauagcuaacugugaguauccacuucuguguuugcuaggcccuggcauagucucacaagagacagcuauaucagaguccuuucagcaaaaucuugcuaguguaugcaauggugucaguguuuggaggcugauuaugggauggaucccuggauauggaagucucuaggugguccguccuuucgucucagcuccaaacuuugucucuguaacuccuuccauggguguuuuguucccaauucuaagaaggggcaaaguguccacacuuuggucuucguuuuucuuuaguuucaugaguuucacaaauuguaucuuauaucuuggguauccuaaguuucugggcuaauauccacuuaccagugaguauauaucaugugaguucuuuugugauuggguuaccucucaggauuaugcccuccagguccauccauuugccuaggaauuucauaaauucauucuuuuuaauagcugaguaguacuccauuguguaaauguaccacauuuucuguauccauuccucuguugaggggcaucuggguucuuuccagcuucuggcuauuauaaauaaggcugcuaugaacauaguggagcauguguccuucuuaccaguuggaacaucuucuggauauaugcccaggagagguauugcgggauccuccaguaguacuauguccaauuuucugaggaaccgccagacugauuuccagagugguuguacaagcuugcaaucccaccaacaauggaggaguguuccuuuuucuccacauccucgccagcaucugcugucaccugaauuuuugaucuuagccauucuaacuggugugagguggaaucucaggguuguuuugauuuguauuucccugaugauuaaggauguugaacauuuuuucaggugcuucucugccauucgguauuccucaggugagaauucuuuguucagcucugagccccauuuuuuaaugggguuauuggacuuuuuggaguccaccuucaugaguucuuuauauauauuggauauuaguccccuaucugauuuaggauagguaaagauccuuucccaaucuguugguggccuuuuugucuuauugacggugucuuuugacaggcaugcauuuuuuaacuagcuuuuuaccuggguguuggaggucugaacucaguuccucccucaggcuugcucugaguucacucauggugucaccuccucagcuuguccucugacuuuuuuuuuuucucccagagcugaggaccgaacucagggccuugcgcuugcuaggcaagcgcucuaccagugagcuaaauccccaaccccguccucugacuuuuaacaugucuucagagguguuacagauauggcaguuucaauggcugucagcuaucuuauuuuguuaggaugucaccuuuuuaucuuauaugccaauaaagucugccaccauacaugguuugguuuaauagcuaaagggaaugcauuaaaauuuauacuguuuugcaguaaauaaagaugaauaacuuugagucauacaauucugcauuuaaacagugaggaagguauuuagauuugagacccaacagauaauuagauaaagaaguaucuauauauucauauuuccuuuuuguuuacaagaaaguuaucuaaaaauaaagacaaaauauucaaguauucacuggucucugaaauacugucuuuaucccuuaugaaacuuggcugucccuuccauguuucuaucccuaguguuagacuggcuguugauucuucaaguuucacuuaaagugucauuauuucuggguaguugucuaaauauguagacuauuaguuugaauucucugucaugcucuuaugaauacauauaaaauccuauauuaugacaaccccugcuccccaccuuccccuaagacaggguuucuuguauagucuuggcuguccuggaacucuguagaccaggcuggccuugaauucagagauccuaugccuccugagugcuggcauuaauaacuguuuuuauaggcacucagcuuuguuaguagcaaggagaaugucuguuuucucaccauuucagcaccuggcauaucaauaagauuuuaaaaaauuagcuuuaguaaaacagguuaacauuuugguauauuuuauuuuauuuaaucucuuuuagucugugcauacaaggaaugcauauauuuuuuuccuuauuagaauggaguuuuaaaauuaauaugcaagguaaaaugcuuucuuuuaguuguuacaauaaaaaauucucuuagcuaaagccaguuucccuuucagcauucagugauaaaaugcuauaugcaguguuguggaaucucugcagaggcauugaaggcaguggcaaucaggcucuaagcaccuuuuuagucaucuuuguugcuguucauuuuuguacuccugcuguggacuuccccuuguugauuucucuuuauucaaucagucuuguauugucuguuuuccuguauggugacauggcauucuuuuagaacaccuuaguuuuucccuuucuaucugccuuaaaggccuuccugaacuucugucugcugugucauauucuuucucuggcacuucugagguggugcguguugccucuggcuguccuuuggcauucuuugauaguugucuugagacucuugcuuguauauguuugucaguucugauuaggaugaguguuacauugcuugaagacgugcuucuugguguucuuuaguuuauuccugaguuauagcuucugaguaaauaguuauuuggucaguuauaaaaauguuccccccagauuuuauagcaugaauuuaaaaaaugcuuugagauuauguuuucuucuguguaccugaaaaauuccccaaauauccaauuugauucuguuuuguuacuuauguguaucagcugacucugacacguuaguaaacuguacucaagcagcccaaacaacuugaguccuuuaggaaaccuucggccugugucaguacagauuuuugaagguaugguauaaauuauggcucggcuuugggugaaggaagaccaauuacaaggaucgacaauguuuaccugaguaggcccauuucuuuacacugaucugaaaaguuuuguuuuaaagguaucagcaaaaucuguaggaagaugaacugauuuauuuauuugguuuucuaagacaggguuuugcugcauaguucaaaguugcuuugaaucuguagcaauucuucugccuuagccucauguuuucagaaauuacaggcaaaugucauuauuccugacaaauugauuuauucaguguacuugguugccauguuuaauaaauaauuuugucauaauacuauuguggcuugguugaaaauagucucugugauauaucuguaugcaccuauuuuaaaguaacccuuuuggagcugguccuguuguugccugaggccagcaugggcugcauacaaaagcaagggcauucugggcuacaauauugagacccccaucuuaaaagaugaaaucuguucaacaacuuuguuuuagaugcuagcucuacuauugagguacagucuuaaaggcagugggaauuaaagcaggugauuggaauuugaaacaaggcagccagaacaccuacuuuacgucacagaauauuaaaaguagacuuuucuagcauuuacuaauuaagugaacuugauuucaugucaucuacucauuuuacuguuaaaugugaagcaaagauuguauugauacguuuuaaaaacuuuguuuuuagguacaaagaagauggagaagcguuauuaauuuuacuaccuucagaagagcaaggaauggugcagcagcuucuccagaagaaaguaccugugaaggagaucaaguaagagccacuuguucagauaucuguggcuguuaggagugauagcaugacaucauugugcuuauugccugcacuuccuuccuucuuccuccuaagcuauuuggccaucuagcuucugauuuagagggaaaaauaaaggacuuuaaagaggucguaugaagaaguuuuaugaucacagcgaaauugaagggaaguacaguugcuccacauucccagccccauauaugcagucuccuccaguaucugcauccaacaaauuggagacuuguugcaauuuaggaauuauauugacaucggugucacuuaagagucucgauuucauacgaaggucucucuugugucacuguaauuagcauuggcgagauccaccuuagagaggaaguacuuuggcucaugguuucagagguuguguuggcaaagagguauggcagggcagagcagcucuucugauggugggcuagggagcagagagagaaugccugagccugaugcucccgauucuaaugcagccuagucuaguuaacgaaaaauuuaacauauuagcccuuuacuuuugcguguaaugucauugccauacuugaagucaucuacauuuucuccuauguuaguugcuagaaaguguguguguguguguguguguguguuugugcacuagagguggaugucaggauaucauuuucaauggcuucuuaccuuauuauuuugagauaagaucuuuaacugaaccugucugucugucaagcuccuaggaucugcuugugucuuccccaauuccaucccuaaauuccaagcuggggcuucaggugugcaugacuggguccauuuuaucaaguuggugcuggagauccaaacucagauuuuccuccuuguguaauauuuugcccauuuaaucaucuccugagcccuuuucugccuuuuauuuacaucugugauucaaguugaaauaaaaguaugugcuguauuuauguguuuacauggccaguucuaaugccauuuauuagaaagacuaacuuuguuccauuaugcugcugugguuccuuugucaaagaucuguugauuauaccuguggcuguauuuuucugggcucuguucuucuugguuuguucuuuugccaguuacuguccugucuugauuauuauugcuuuauacuaagucuugagguaggagcaugacagaccugcagcuuguguuuagaaucaguuuauugauauucauaaaauagcuggcugguauuuggacugguauuacacugaaucugcagaucaagugugaaacagauugaauccuugacaagauagaauuuuccugaaacugaaaaacugugauucuuuuugauuucuagcaucagaguuuuugguuuucuuuauguagcucuuguucauauuuucuuagaguccugucucagaagcucuucuucccuuacagcguuaguuucugcugucucugucugguaaacagaaagccuuugcuauauuugcauucugaaggcucauuauaauuuuuaucaguuccacgagcauuuuguuccuuucuuuugauuuuccaagcaggucgucaaucauuucaccuucaaacaaguaucguuuuauuuuuuucuucucccaucaguaugacuuuaguuuucuuuuuuucuucugauuuauuacauugaaaagcagauuucucugcuuuguucuuauccuuuaucauuuuaugugguuggguguuucgcuugcauguauguccuuaguuuugugugcuucuggugcuagugggaaccagaagaguaugucacauccccuggaucuggaauuacagaugguugugagcugccauguguguacugggaauugaaccuggguccucuuaaagaucguuuauugcuuuuaacuguagagcuauuucuccaguacccccugcuuuguucuugauuuuagugggaauacuagaaguuccuauuuauauuaaggaugauguuagcucuagccuguuuuuccuccucuuccuucuccuccucuuucuucuaaagaaaagacauucuuuauugaaguuuuuuuauuucuaguuuauaaauaacuuacauuuuguuaccucccuguccuuaugugaugcauuauauugucuguugaaugaauguugaacccaucauggucauacuauagaauuauuuauugguugguugguugguugguugagauaggaucucauguaacccaggguagcuucaaauguacuguguagcugagguagucuccaaaugcugagauuaaccuguguauguguuguuaauguuguuuauacgugugguguauuugugguaugugccuaugugccugucucccucucauccugaaguucaucaauuuggcuaccuuggcagccuagccagugagucuuaggguaccaccugucuguaccaucucucuguaucuuccucaaaagggcugagaauacaggaaugugcuacagugccucugaagagcugaacuuagauacuuaaaguguggcaggcacuuuaccaaccaggucaucuccccaguccugacaucuuuaaaaaaaauauugaaauaauuuugcagaauacagcagagaaaaaaaauaagagaaagaauuucuuauuaauaaggggcauuguggauugaaaggauaucucuugacuguuuuuuggguucuuucauuucaaaggaucauaaccucuuauugaugauguaugcacugggcauaguggaaucuaucagucuuccuuuuauuggagacuuugaaaaaaagcuuaauuugucuaaaaguaauuuggacuaagauacuagcaggacugauuaaaaauauagaagauaaaaauugaccauaaauugaauuguugaagcuaguaucuuuguauguuuugaaaauuuucucuaauaauaaaggaaaaacugcucuguuuauacuuuuuguuuccuuguuacaacucuagaguuggaguaauauaauaauucaguuugaaguuaggaaaaaaauggagucucuugugagauguagauucuuugcuauauauagccuaguuaagcaaaauuuaauguuucugauauauuuaauuuuaacuagguaaacaguuuuuaaucucuuacuugaaauagauuuuauauaugauuuaaaaagaagcaaugucauuugcaaaaaugauauugaauuucaucuuauuaauuuauguccuaugggugucuacuuucuagcuuuguuaaauuaagaaguagccugugccaauaauuauguuaauauagauggauaauauagauagccuucucuuccucaucauuugguuaaagaaaucuacuguucugucauuuucuucuuccuaugguuauucuugguccauagaugagaaauauguuaaacacuuaaaagcaaaugagggggcauaagaaaauguuauguauuauuuucuguuuugaaaaaugagauugccuuuuuaguuaaccauuauuuuuuuuuauuaaaaagaaucaauccagaaaaacuuauugauguucagaaaaaauuagaaucauuuuuagcucaagaucaagauuuaaaagaaagagcucaaaggguaagucacuuuuaaauucaguauuuguuuuuggaauggaauuauauaaggaaguuauauuucaucaauuucugcuacuacuauauugcauggccauaacuaaaugguuuaaacaauauaaguuuuacauagauuacuucuuaauuuuauauuugaagcagccuggaaucuaguauacuuaauaaaacuuaacuuccuuuuucaaugaaauuguuguaaguucaauugcauuuacugacuagaagauucauauucucuguguuaggcuaaauuucuagaugguauagcauucuuguaaauuaucuucagaaauaaaauuugaaucuuaauauucuuggaauucuuuucugaauuaaaagucuuaagaaauugccuaaacuuacaaauuuuacuuaugauguacaucugacauauuguaaugugucuacauucugggauggccaagucagccuaauuaaucuuuagaucaggagaaaugcuggaaauuaaaauccauaugaugcugaaaaugcugguaguguugugaugacuagcaggccaguuguuugcagaccaggaaauacagaaugcugaaaggacauuucaugguuugugcauauggaaagugauccucuagaacaacaguauagaauagcacacugaagugagcagugaaacuuguugcugucacacauggguuagcagaauggcuguauuccuggcaccaucaggcuauuugguuucagaaaagugacuuucuagcuuuugauuauaaucuggguggaacaaaaccuauaauggugcuauuuccuguggaugcuuacaggaagaauacuauugaaccaacuccauuuuuuuuaaugcuucuggagacagaaaaugguuuguugggagauuuguuggggagaaaagauuaauuucuuuucuacauuacauuaaguaacuguagagaugcagaagaaaauguaaaguuuaagagauauggacagaaggauuagaaaacacuuuauaaaaauuaugugugaacuguauauauuuuuguguaugcauguguauguauaggugugcauacauguauauggaggccagaggucaauuauggaugucuucuucaaacauucucuaccuuguuguuugaaacaaggucuuuuauuguaucuggagcuaugcaucaggcuagacuuagccuagcuggacugcguguugcagggauccuauuacagggauccuauucuguuacuggcuccccagugcugggaauuacaggcccguuuuguuuacauggccuuuuaauguggaugcagggcuuucagacucaaguucucaugcuuguguggccagcacguuacugacugaaccaucuccccggccccauaaaaauuaucuuuaaaguaaaaguaauugcuuagauguauuuguuaucuauuuauuuuauaaacagauaggaacaagaugacauagcucugucauaagcauaguucuagguaagaaaaaaggaaguaagaauuuucaggaugauaguaauauuuauaugacauauauguauauaauuauuugaaauuaaagggaaaacaaucugucauaacuuggaucauuuauuauagugaaauuuuauuuuguugaaaacuuaacuuuugacuacuacaguaauauaaccaacaaaaagcauuuauuugugucuacucuauuucagcagauauucugcguguucuguauaaguguucucauuggcauaacagugaauuaggagacacuguuaugguuuugaugagaaaauugcauuuagaaaaugguguuugcucagcuaauaacauacacagucaguauagauacucuaucuguauuauuccauugcccguguuguccucauugcaccuuauuauaauuacuacuaauuaauauucaguagauuuugagaagccaaguaaaaauaugaauuuucuccuugcaguuaagacuucauauagcccauucuggccuugaauuucuaagucucuccccucucccuccuaaguccuggaaucacaggcagugcaccaccaugcccagcugaggugguauuucuuauugucuuggauugguggaauaaaacgaaaaaagucuuuucuaauauuauaguuguaacuucuauuacauugugcuuuuuaucuuacaguguuuugucuccuauauacgcucaguauaucuuaugaaggauaaagaaguauuuaaugugagcaaguuaccuauuacugaauaugcacuguaaguauugauuacauagcugaaauaaagcuagagggacuguccauagugcauucucuaagagcccuagguuagauuauucugcuuuagaacaguccauugaaaauuugcagagaagcauauuaaaugaaaucuagaaaauuagcucauauuuaguuguugacaggaagguccauaguuguaaguucugaauauuuuuuuuuugucuugcuacuguuauguacucuugcaguuccuuuugcaagauuagugagucaggaauggccaccugauuuuguuugaguaauugagagauuauaaaacaaaaauaaccuuuuaauguaaagguagaaucagcucuauucgagggagucuuaucuugacaaaaucuuuuggaaguacacuugagcgucaacauacuucaaugucuaucuuagauuucccagauaaaguauguuuuagccaaguccucuguguuuagcuuguuuucuaggaauuugaguaccuuuucuugcaaauuaaguuuuauaaagaaaacuaaaaaaaauauuuuauuugaggauuucauaccugagagcacaauauauuuguauccuuuccacuuccccuucauaacaaaacaauugaccuugguaagcugcuguuuucuauucuguguuagaguauaugcuuaguauaguauaaucugucaguuguaauauuuuaaaauccuuguguuagauaacagugcagggcaguguuagacagcacuacuguuuuaguaaugcguggagaaccacaugucauggauaacaugcucuuguugccuuagguuuauuuaccagcuccuaguuucaucauuuuuaauaucacccaaagguuaggcuuuuuaguuacuuuuguauucugugugaacuuuaauguuuucuuccuuucuuucuuucuuucuuucuuucuuucuuucuuucuuucuuucuuucuuucucucuccuuccuuccuuccuuccuuccuuccuuccuuccuuccuuccuuccuuccuuccuuccuuccucugucucucucugucucucucucucucucccucucugucucucucuuucucuuucuuucuuuuuuguuuuuuuucgaaacaggguuucucuguguagcccuggcuguccuggaacucacucuguagaccaggcugaaaucagaaauccaccugccucugccuuccaagugcugggauuaaaggugugcgccaccaccgcccggcuuucaauguuuuuuauuuuggguguugcagcuagaauauucacauaugaugggcacagguucgaauacuguggggacauaauuagaaguuguuuugucauaucauacuaguaaaugucaugauugccauugaagacuugcuuuuggugagguuuagagaagguaaacaauuauguuacacuuaagugaugaguauaauuuaacuauguuuuuaaguuuauguugauauucagauguauaauuuucuugagguguauuuccucuugaagccuaugauagcuaaagcaguugcuaugucuauaaaauaucagguuuaaaaaaauguacuaaacaacuacuuugagugcccaguauauguaggucauuguauucaaugauagaauuacacacacacacacacacacacacacacacacacaccccacacacacacucuaucugucugucuaucuaucuaucuaucuaucuaucuaucuccacucagguuuuaguuccugagaaguauaaaucaaaugucacuguacuauauuaugagaaaucuucuaguauauacaaacuuauugucccaacccuccuguuacaaagguaauacagacaguaauggcagaaagguuaccacuauuguacauucguuacuuuaacuucauuguaucuguuuauuaacucgaacaugauucuguuagguggacauucucaguccuuccauuuuucggauaagauaacugucuagagaggagacuaugccugagaucacacgacuguuaaaugacagauuugugcauguugaacuucagcaguucuguuucugagcuugugcuccucaauauggaacuucucagcuguugugcauuauauaggaaaaaaguggauaaagcugccauuuauuuauuuauuuacuuaguuuauuuauaagcauugucuuggcaaaccuggagaccacuauguagcuaaggcuguccuuuaacucaucugccugcuucagccuucuuagggcugggguuaaagagcaaugguugugcacaaugccuggcuucaccuuugcuuuuuuaaguuaauuuguauauaccagugggaguuuaguaaaaauuguugguuuugauuguguaaggaaacaaccaaucuuaaauagaaucuugcucugaggguggaaaauacaaacaaaaaacaguaaaauuuccuucuuuuagcuccuuuaaaaagaaaaaugcauuuuuauagcugugauuaugccauauucuuuuucagaagugggauuugaggcagggaugaugguauauguauugugcucuagucuuugaaaauaacuguuuuccauuccucagccaugucuuuuccaguuuaugcaguagcuuauguuuugcaaaguaccuucacgcaguuaauuggcaucucuguucuguguugugaggaagcugagaguuggauuugaaauugggucugguacaugaguguguucaucuuguuucuauuugagugcucuuuauuucauacuauuucagcucuggaaggggagugaggugucuaagacauuuuccggacaaguacucaguucauuuuggcuugucuuuuggaucauuuaaucugucagaauugauguaucuuagagggauuuuuuuuuuuuuuuuuuuuuuuuuaaaaaaagccuuggacauagaucuguggagaaacuuucauaauaccacaaacauaccaucacuauuuuuguucuuugcauuuuugaaggucucuuggucuugcuguggcaccgcggauaagauuucuucagaaacuggagaagcagcccagcacagaauugguaaagaauccagucacagaagcaguuccgcccagggcccccucccuccccaacgaugaagcagacgaaucuccagcuuaugucagugagaagauguccguccuucacaaaaguggggaaagacuggaagagacagaacacagacuggcuaguggugacggugacgaagaacaggaugaagagacggaagacgaagagacggaagaucaucugggaaaagcaagagagccucacacugaaucuguugucaguauugaggaggcacagaaggucaaggaaguuucugugcaguucuuaaacagagaugaugaugaugaagauggaccugaugcugacuuccucacagugaagcggcgggauguguuuggguuggaucuuaaagagaaugaagcacugucgguaagugaacuccaaauggagucuucauuaacauugcauugaacuuuuaaauguuuggagcuaauugacaccucaauacuaagucuuuugauugcaugaguaugguaaguuuuuuauuuauuuaggucucuuuuacuacuuuuuagcauuguuauacauuuuacacacauauuuuguuagaguagucuuuugcuauuugguacucuuuaguacuaucuuacgugaaccuuaaaguuuaauuuuguaguuuuuccuggccaguauauagcaauacaauuuguuuuuauguaucauuuuauuuagacuggugauacuuuugggaguucuuugaagucuucuauauaauugauuauaucaacuuuauuuguaaacacuaaaauaauaauuauuuuuaccuucuauacaucucuuauuucauuuucuugccugauuaugacuuaagagugugagaaguaaggacagaugccgaucuguuguucuugauaguaggugggauaaacauuuagauauuauucuuguaucugagguuagcuuugcaguuguuuuuguuuuaucagauugggaaagugucauucuauuccuaguucauguagcuuuuuuuuuuaaccauaaauggaugguucuuccauuuacucaugucaugggccauuguguaucauuugauauauugcuaauuuaauggguaugaaggauugucacauucucucuguaguguguguguguguguguguguguguguguguguguguguguguguggugagcuugcacacauccauuuuucuuucuuugauguguggugaggccuuuguuuauaguuugguugaugauacaagagcauaaauguuacaggaauaccuggaaggaggagaguauauaagggccuaugaagacaggacuuaagauuaaaaaggguuuugcuaaucauuguaguuauaagaacuuuuaaggaagggaaugucauaaugaacaaggagagacuugaagauagaaauguauuaugugaugauugaaagcuagcuugguuguuaguuaugccagagauuccaguguaucaguuuaacuugacagguucauaagugucacuuaacuuuuuaucuauaaagucauuuacaauagaucagucuaguccauguuuaaaugauuaauagcagauagcuucuuuuuuaugugcagagugaucauuuauuugauaguaauuccuagauuaucuagaauuauuagccagauuaauaaguggaacuucaguugaauuggcaaagugcaaugauugcugagaccuaugucuuauauguuuuugaagaauuuugacaugauuacuuauuucccauuuuaagaguuuaaaucagggugauaguaagaaauguaagaaacauggcagagaaaugccauauuuugagauugaggauuuuggaagcaaaauguuuuguggcuucuccuuaagcauugcuuuuaauuucuuuuuuuuuuuaauauuuuuuauuacauauuuuccucaauuacauuuccaaugcuaucccaaaagucccccauaccaucccccccccuucccuacccacccauucccauuuuuuuggcccuggcguuccccuguacuggggcauauacaguuugcauguccaaugggucucucuuuccagugauggcggacuaggccaucuuuugauacacaugcagcuagagucaagagcuccgggguacugguuaguucauaauguuguuccaccuauaggguugcagaucccuuuagcuccuuggguacuuucucuagcuccuucauugggagcccugugauccauccaauagcugacugugagcauccacuucuguguuugcuaagccccggcauagucucacaagagacagcuacaucuggguccuuucaauaaaaucuugcuaguguaugcaauggugucagcguuuggaagcugauuaugggguggaucccuagauauggcagucucuagaugguccauccuuucgucucagccccaaacuuugucucuguaacuccuuccauggguguuuuguucccaauucuaaggaggggcauaguguccacacuucuucuucauucuucuugaguuucauguguuuagcaaauuguaucuuauaucuuggauauccuagguuuugggcuaauauccacuuaucagugaguacauauugugugaguuccuuugugaauguguuaccucacucaggaugaugcccuccagguccauccauuugccuaggaauuucauaaauucauucuuuuuaauagcugaguaguacuccauuguguaaauguaccacauuuucuguauccauuccucuguugaggggcaucuggguucuuuccagcuucuggcuauuauaaauaaggcugcuaugaacauaguggagcauguguccuucuuacugguugggacaucuucuggauauaugcccaggagagguauugcuggauccucugguaguacuauguccaauuuucugaggaacagccagacugauuuccagagugguuguacagccugcaaucccaccaacaauggaggaguguuccucuuucuccacauccaugccagcaucugcugucaccugaauuuuugaucuuagucauucugacuggugugagguggaaucucaggguuguuuugauuugcauuucccugaugauuaaggauguugaacauuuuuucaggugcuucucugccauuccguauuccuuaggugagaauucuuuguucaguucugagccccauuuuuuaaugggguuauuugauuuucugaaguccaccuuuuugaguucuuuauauauguuggauauuaguacccuaucugauuuaggauagguaaagauccuuucccaaucuguugguggucuuuuugucuuauugacggugucuuuugccuugcagaagcuuuggaguuucaugaggucccauuugucaauucucgaucuuacagcacaagccauugcuguucuauuaaggaauuuuuccgcuguacccauaucuucaaggcuuuuccccacuuucuccucuauaaguuucagugucucugguuuuaugugaaguuccuugauccacuuagauuugaccuuaguacaaggauauagguauggaucgauucacauucuucuacaugauaacaaccaguugugccagcaccauuuguugaaaaugcugucuuucuuccacuggaugguuuuagcucccuuguggaagaucaagugaccauagguguguggguucauuucugggucuucaauucuauuccauuggucuacuagucugucucuauaccaguaccaugcaguuuuuaucacaauugcucuguaguaaagcuuuaggucaggcauggugauuccaccagagguucuuuuauccuugaaaagaguuuuugcuauccuagguuuuuuguuauuccagaugaauuugcagauugcucuuucuaauucguugaagaauugaguuggaauuuugauggggauugcauugaaucuguagauugcuuuuggcaagauagccauuuuuacaauguugauccugccaauccaugagcauaggaggucuuuccaucuucugagaucuuuaauuucuuucuucagagacuugaaguuuuuaucauacagauguuucacuuccuuaguuagagucacgccaagauauuuuauauuauuugugaauauugagaaggguguuguuucccuaauuucuuucucagccuguuuauucuuuguguagagaaaggccacugaauuguuugaguuuauuuuauauccagcuacuucaccgaagcuguuuaucagguuuaggaguucucugguggaauuuuugggguuacuuauauauacuaucauaucaucugcaaaaagugauauuuugacuuccucuuuuccaauuuguauccccuugaucuccuuuuguugucgaauugcucuggcuaauacuucaaguacuguguugaagagguagggagaaaguggacagccuugucuagucccugauuuuagugggauugcuuccagcuucucuccauuuacuuugauguuggcuacugguuugcuguagauugcuuucaucauguuuagguaugggccuugaauuccugaucuuuccaaaacuuuuaucaugaauggguguuggaucuugucaaaugcuuuuucugcaucuaacgagaugaucaugugguuuuugucuuugaguuuguuuauauaauggauuacauugauggauuuucguauauuaaaccaucccugcaucccuggaauaaaaccuacuuggucaggauggaugauugcuuuaauguguucuuggauucgguuagcaagaauuuuauugaguauuuuugcaucgauauucauaagagaaauuggucugaaguucucuaucuuuguuggaucuuucugugguuuagguaucagaguaauuguggcuucauaaaaugaguuggguagaguaccuucuacuucuauuuugugaaauaguuugugcagaacuggaauuagaucuucuuugaaggucugauagaacucugcacuaaaccagucuuguccugggcuuuuuuuggcugggagacuauuaauaacugcuucuauuucuuuaggggauaugggacuguuuagaucauuaacuugauccugacuuaacuuugguaccugguaucuguccagaaauuuguccauuucauccagguuuuccaguuuuguugaguauagccuuuuguagaaggaucugaugguguuuuggauuucuucaggaucuguuguuaugucucccuuuucauuucugauuuuguuaauuaggauuuugucccugugcccucuagugagucuagcuaaggguuuaucuaucuuguugauuuucucaaagaaccaacuccucguuugguuaauucuuugaauucuucuuguuuccacuugguugauuucaccccugaguuugauuauuuccugccgucuauuccucuugguugaauuuucuuccuuuuuuuacuagagcuuuuagauguguugucaagcugcuagugugugcucucuccaguuucuucuuggaggcacucagagcuaugaguuucccucuuagaaaugcuuucauugugucccauagguuuggguauguuguggcuucauuuucauuaaacucuaaaaagucuuuaauuucuuucuuuauuccauccuugaccaagguaucauugagaagaguguuauucaguuuccacgugaaaguuggcuuuccauuauuuauguuguuauugaaaaucagccuuaguccaugguggucugauaggaugcaugggacaauuucaauauuuuuguaucuguugaggccuguuuugugaccaauuauauggucaauuuuggagaagguccugugaggugcugagaagaagguauauccuuuuguuuuaggauaaaauguucaguagauaucuguuaaguccauuuguuucauaacuucuguuaguuucacugugucccuguuuaguuucuguuuccacgaucugucuauugaugaaagugguguguugaagucucccacuauuauuaugugaggugcaaugugugcuuugagcuuuacuaaggugucuuuaaugaauguggcugcccuugcauuuggggcauagauauucagaauugagaguuccucuuggaggauuuuaccuuugaugaguaugaagugucccuccuugucuuuuucgauaacuuuggguuggaagucgauuuuauuuguuaucagaauggcuacuccagcuuguuucuuuagaccauuugcuuggaaaauuguuuuccagccuuucacucugagguaguuucuguauuuuucccugagauggguuuccuguaagcagcagaauguuggguccucuuuguguagccauucuguuagucuaugucuuuuuauuggggaauugaguccauugauauuaagagauauuaaggaaaaguaauuguuccuuccuuuuauuuuuguuguuagaguuggcauucuuuucuuguggcagucuucuuuuugguucguugagggauuacuuucuugcuuuuucuagggcgugauuucuguccucauauuguuuuuuuucuguuauuauccuuugaagggcuggauucuuggaaagauaaugugugaauuugguuuugucguggaauacuuugguuucuccaccuaugguaauugagaguggccggguauaguagccugggcuggcauuugugaucucuuagugucuguauaacaucuguccaggcucuucuggcuuucauagucucuggugaaaagucugguguaauucugauaggccugccuuuauauguuacuugaccuuucucccuuacugcuuuuaauauuuuaucuuuauuuagugcauuuguuguucugauuauuaugugucgggaggaauuucuuuucugguccagucuauuuggaguucuguaggcuucuuguaugaucaugggcaucucuuucuuuauguuugggaaguuuucuucuauuauuuuguugaagauauuugcuggcccuuuaaguugaaaaucuuuauucucaucaacuccuauuauccguagguuuggucuucucauuguguccuggauuuccuggauguuuugaauuaggauccuuuugcauuuuguauuuucuuugauuguugugccgauguucucuauggaaucuucugcaccugagauuuucucuuccauuuuuguauucuguugcugaugcucgcaucuaugguuccagaucucuuuccuaggguuucuaucuccagcguugccuugcuuuggguuuucuuuauugugucuacuucccuuuuuaguucuaguaugguuuuguucauuuccaucaccuguuuggauguguuuuccuguuuuucuuuaaggacuucuaccuguuugguuguguuuuccuguuuuucuuuaaggacuuguaacucuuuagcagugcucuccuguauuucuuuaagugaguuaugaaaguccuucuugauguccucuaccaucaucaugagaaauguuuuaaaaucugggucuagauuuucgguuguguuggggugcccaggacuagguggggugggagugcugcguucugaugauggugaguggucuugauuucuguuaguaugauucuuacauuugccuuucgccaucugguaaucucugaagcuagcuguucuaguugucucugguuagagcuuguuccucaggugacucuguuagccucuguaagcagaccugggaggcuagcucucuccuuaguuucuguggucagaguauuuucugcaggcaagcucucuucuugcagggaaggugcccagauaucugguguucgaaccugccuccuggcagaaguuguguuccacucaccagaggucuuaggaucacguggcgaaucuugugugggcccuugcggguguggggagacuccgcuggcaagguaccccggugcucgagucugcuuuuaauuguuuguuuuuuuuguuuuuuuguuuauauuccuguauauucagugcaugaguauagaagccagaagauaagcuugggugucauuccugaggagaugcccaccuuguuuugugagacagacucuuacuggcauagugaccacugauucagcuagguugacugucuagcuagcaagugccaaggauuuucccuugucuuccaaucccauggauuacaugaacaagccaucaggguugguauauauaaucuagcuaucuaucuuucuuucuuucuuucuuucuuucuuucuuucuuucuuucuuucuuucuuucuuucuaucuaucuaucuaucuaucuaucuaucuaucuaucuaucuaucuaucuaucuccccuccccuccccuccccuccccucccccucccccucccuccuucucucucucucucucucucucucuuaaucuaacuuguuucaucauuuaguuuuguuuguguuuguauuuguauugauguauguaugccaagguaaacaugggagaucagaagacaaccaccugaaggagucaacucucuccuucuaccauguggaucccgugaauugaauucaugugcuuaagcuuuuuuuuuuuuuuuuuuuguauguguguguguauaacauuuuauuuauccauuuucuuuuuuuuuuuuaauuagguauuuuccucguuuacauuuucaaugcuaucccaaaagucccccauacccaccccccaauccccuacccacccacucugccuuuuuggcccuggcguuccccuguacuggggcauauaaaguuugcaaguccaaugggccucucuuugcagugauggccgacuaggccaucuuuugauacauaugcagcuagagacaagagcuccaggguacugguuaguucauauuguuguuccaccuauaggguugcaguucccuuuagcuccuuggguacuuucucuagcuccucaauugggggccuugugacccauccaauggcugacugugauauccacuucuguguuugcuaggccccggcauagucucacaagagagagcuauaucuggguccuuucagcaaaaucuugcuaguguaugcaauggugucagcauuuggaagcugauuaugggauggaucccuauauauggcaaucacuagaugguccauccuuucgucacagcuccaaauuuugucucuguaacuccuuccauggguguuuuguuccuauuucuaagaaaggguaaaguguccacacuuuggucuucguucuucuugaauuucauucguucggcaaguuguaucuuauaucuugaguauccuaaguuucugggcuaauauccacuuaucagugaguacauauugugugaguuccuuugugauuggguuaccucacucaggaugauacccuccaggucuauccauuugccuaguaauuucauaaauucauuuuuuuaauagcugaguaguauuacauuguguaaauguaccacauuuucuguauccauuccucugguugacucccauguaucuucaucauugaaagcucucacuccaacauaggugacacucuaccaucagcugcauagauugaauccuccuuuaaccuucuaccuuugacauauucuaagucuuccagagagagcacauagcuggacagaauucuguauagcugagguauaggaagagagugacuauaauaucaggugaggugauagugacauuucuccaucuccuuugagauauguggaguuaaccacagcugcuuugauuaagguguucaugguuggacaaugcucuggcaaugugacuauuucugaugggagucacuaaagggauggaaaucgcuuugguauuuaguucauguguuccagcuuauugacaggucuguguuuuauagaauaaaaacuuaaaguguuuuugguaguuaaaggguauagauugacucacuuauucuucaaaaagugaagauuuaaguuuucaauuaaauacuuuguauucuguccucacacuuuuuagagauguugcugcuguccuauaaaggccagcacaugcaagacacuauaaaguaaauucagugaaucauauuuaaaguauaaaauucuguuaaugacauucuacacaaaagaguucauaucagaacuugaguauuuaaucauuuaaagaauguagcauuuuaacuaguucaauuuuauugaaacagucagaagugcucuugcaagauuauuauuauaguaaccauuuauaucuuuguggaacgucucauugguuaaaaaaauaagguaaaacaaaauuugagaaguguaguuugcugaaaguuuacauagaaccuuucauuuacuauauuggguaauucuguaaauacuguauaaaaaugauuucggucuuggacuuguaauuuauuuuuaaaagauugauuagguccaguuauguuuaaaucuaacauuuucaaaaucuuuaucaaguacagcuguuucugugaaaguuauaguugaugaaaagugguauuaagauucuauuaugaaggaguccaguugagagggucauuuauuuacuuauuuuucucuugggaaacaauuaugagagcuaaacucaaagaucuucuuuuucaguaguuuuagcaaugaauggugcuguaggaacuuguuucaucuuucauuauggcaggcauaguucaaacugaaagucauauaguugcauauauuauacuuacauuaaaaguuugcuuuccaaauguacaaauacaaaaccaaugacagaugugaauaccaaauuuucuaauaauuugcuaaaauauguugaguuacaucuguugggauaucucagaagguaaaugcuugccacucagacaugugacuugaguuagaucuccaagacccacauugagugaggaaggagagaauagacuccuuuaaguuguccuguaauuuccacauggaugcacugggacaggcauauacauccauaauggauaaauaaacguuuuaagauuuuuuuuuaaauuucaaguuuuaaaaaaugauuuauuauuuuaugcauauguauuuugcuugcauguaugucaucuuugguuauauaaugacuagccugggcuacauaaaauccauucaucaccugacugaccgacaacugaccaacaacccuccuacucgaaggugcaaauuauuaaaauuuuuggaaacaaaauaguuggguaagagucuacauuagagugguaacauuugaagcuugagaaagguaauaagucaagguauauuacacaguuagccacaagaaagaguugggucuuguuuauaacugcuaaccuaggaaaucugugucgacagaaaacaaaccuuauuccccuuuaugacccuuuuaugugguaaccaggagaacagccagagugucagaaaggguugaauuuucauagacacuuugguuguuuguuuuucaaacugaggucuuacuguguagcuuggcuggccugaaacuuacuauguagaucaggcuggccucaaacucaaaaagaucugccuaccucuuccucuggagugcugggguuaaaguugugggucaccaugccuggcccacacacauauuuuuuacucaguugaguuacucuuauguuuucugauuuuagacauugauuuuuuuuggguguuggccagauaccagggacuccuggauagcaauggguguugcugaugaggaauaaaugugaggcagaagcaaauguaggcugugcagcaguccugguauuucuguucuggggccauguggcgggacuggugcugcugguuuccuuugggauuuauaaauucccacagguguuaggaaagcuacaagcuuguuaguuaacaccaaaccaaaugaguuuuaacaauauaauuaaaaacauacaaauucuuacuguauauagauggaaguauuuauuguagagaaagaccucaacauuucuuaggucuucuuaguaauguuguauaauuuauguaggaauuauuacauuuuauaguauaauugaaauauuaaaauauguuuuugguugugaguuagccuugggucagcaaacuguuguacauccgugggacaaauuaguuugauuggaacacagccaugcucuguuuggcuaaugauucuuuuuagacuucagcaaugguugacuagguaagacaaagaccccauggucuauaaugccuaaaauacuauuuuucucuuuacagucuuauuuauuuauuugcacuuauuuaagcuaauauagcuuuuagauauuuaugagaaauuuucuuuuuugucccauuauggcuuuucagguuauuacauggagaagcuuauuuuuaugagacaauauagggaaauaguuaauguugacucgggaguaaaaugucaaggguuuagaucuuaacucaguuauuuauaaacuaugacuccuaagaaauacugccuuuuagauuggcaagagggacuaaugauaacacuagcccaaaggauuguucagagaguuaaauaacuauacuugacaaaugcuagcuguuuucaguguaggguuuuuguuauguuuugucuuauuuuuguuuaauucugaagugaaggaaaacuauuucaagcccuguuucaugggaagcaccccccccccccacuuagcuucaagcuaugcugauuaucuuuuuaguaucccuauaguuuucugcuuuaaauguguuuguugaaauaauaggauugguaauuuacaguaagcuuuauugaaugugauuuguguuaauugaauuuuuuaaaaaguauguugacuuggcaauaauucuaccagagaguauuuauuauaaugcucauggaauccuggaugguguuuauguagaagcuauaucagugcacauauagucuaacauacauguaaaugucaaguucacugagaucaaaacguauuuuucaacugcauuccucagauuacaaucauagugaaaucuuacauuaauaauugugagaaugagcacacaggauagguuagagaucauuuuaaauugguccuguguuuuuacuggguucuuuauuccagugcuguguauuuagguuuuuauaugaaguugaauuugucuguuggguuuaagaaacagacuuuacuugaccuuuguuuuacauaguacuaaguuuguaaauugguuccugaaucuucuuuuauaggucugcuauucuaguaguauacuguguaauuuuuuuuucaguauucagguuggcuucuuauagaggccuccaucagugaagccuggcuaaagcauggucauguccucaaguugcagaauauuuauccacauagucuuucuucauggauucuaaugacuacuuuucccccccucaucuuacagugaagaaaaugugauuauguuuuaguaaauuacagugaauaucuacucugucuuguuucuccaauuuucuuguucuuacuugaaagaugacuaaauuguaacgucauugauuugauagaauacucucuuguacuuccucacauauuuagacgcacauucaaugaucuuucuugauagauguaaaaguuuuggacaaguacagcaaauguagagcauuugguugcagccaggguaugugcugaacuuucugugaaguaguucaucccauggugggcagagaaggcagcugaagaagauguuguguugagccaggggugugaucuuuuaaagcuuguagucuguuuaucucagguaaauaacagcauccuaauuucaguauaugucucucuugucuuucucucuacaaagacuuacucacuuucugucuucugucucuuuuccuaucuauauacaagauguuaaaucuccuaagauucauguucuaugucagaaugucugauuuauaaaaacucaguugucccucuaucuauuuguaugaauuacaucuguuaauuauaacuuuaugcacuuauuuggguaaaauauuuucugauaaccauauuuuguucaguuggagacuauuuugggauuugguggcagauguaugcacuuggcacuuuucauuaugauaauuugcauauuugucaaggcucuuagguccaguugccaauaguuuuguggccugcugugccccucaauuuuuugucuaaaggguauuuagcuuuguuaauaccagccuuaacauuuuuggagcuggagagaugguacagcaguuaagagugcuuccugcucuccuagaggaccugaguucaguucacagcaccaugucagacuguucacaagugcuguaacucuagcucccagggaaucugguaagcucuucuggccucucugguguacacacacacacacacaccacgcagacacagaagacauaugcacauauaaaauaaauaaaaucuuaaaacaaauuuuaucugcuuuaacaaugcaguuucucuugucuugugauccuguuuugauuugacuaaacucauuaaugcuacucccagaacuaugucuucguagaaacugccauucucccaacucucuuuuuuguuauuaauacuucuuaccuucaugaagaaaccauuauuuaaaaaagaaacuuagucaauguauaauugcacauuuauaagguauaauuuaauaucuuaauguauguaccuaauauauuguagggaaggaggguaguuacacuagccacauuucaucaccugaauauuucugacaccccuccccuuuuauuucuuuuuuuuucuucccucccccuucccccuugagucacccaccacugccccuuccauuggcuuuguggccguguuuccccaggcugcucuccacucacugcaggagaaccgcauggucuaagaguuuucauuuuaaccauuucuaagcauacaguucaguggcauugugugcuuucaugaauccaaccaaauccacucuccaucccccaaacagaagcugagcugaggggcacgugacaaccccaagccagggagcaaaugacauccauguuuucuuauaauugucagggggcuuuauuaucuuuuuuuuuuuuuuuuuuuuuuuaaugguggaagaaaacccuguuaauuuauugaauagcuuuuuuuuuuuuuuuacauuuuauuagguauuuucuucauuuacauuaccaaugcuaucccaaaagucccccauuccccccccgaccccucccacuucuuuguuucuuucugacccuuauaagucuuuuucaugacuuuuuucugaucaucuguuaguuucagucuucuuccuauguucugcuuucucuguuguguguauauuucuucaaaccccagccacaaucaguacacuuaguuacauuguguuguugccuuucugcuccauauucuuagcaggcuucaagccagguuuaauuggacuguccaccuuccuuguguuuaugcaugcuuaccacacugugcuccucacugcuauggcugccuuuuacaccauguggccgcaucaaauugucauuauuucuuaguucccugucccaucacugcuaggaguaauguauaccauuuucuaaaccaacuagauucauugugguuagugguggauaacguagugaauggauauguagaacaaguucaugucaguggguauuuaagaucuuugaugauguuuguuucauuuuaaaaauuuauacuaucaauuuauaagggacuuaaauaccauaaguaaaugcauaucaaguauugaaacaagcuuagauaaguuuugguuuuguaaaauauuaggcugggguaagugcaguaauaggaauauauuuguuuucugcgguuucuguaguaaugacauaaggaaguaagaacuuacuauuucacuuuuuccuaggccacaguauuaacuaaaacucacaugguuaaaagcaaaggaucagcaguacugaacuuucuguggggagggggugagacauuuucuuauucuuuuuuagccaccagaggcucucugcuaaccuguagcacaggugugcccagaggcucuuguuccaaaugaagcuaaauucuuucaaguuaauaguaacaguaaccacuacagauuuuaccagugcuguauauucuuucuguaauggacagagccauucacugaaauuuguugaaaaugaucaggaguagaaaauugaauaaccaaaguaauugauucacuaaagguguguuauuguacuucuaguuaucuaacagguaaucauuuuuauauccucuacuuaccacagcauguucaauuaaacaaaugguagaaauaaaaaguaugaaaugaaaacuuuccaaauguuucccauuucauuuuacuauggcauauaauaugauuucaaagaacuugguucucuuuuuauaauuaggagaugcugugaacaucugucaaagaaauagauccagugagccacuggaucucuucaacuucacugaguacuaaagcagggaugcuuuucgggaauucuauguuuuuagaucuguucuauauacacguccuucucuuuuuuuuggagaaaaauauucuggagguaaccuuucuuuuuguggucugagacuguuuauuuugcuugggaguaacuguuagaacuggaaucauguuuuugaucuucugauucuaaccuaaguggcuguuaaugcccacuaucuuccauuaaacaacuggcuuggugagccggccucugcauuguuguguuguuuuguuucugacgagagcuccuuguuagguggaacauuugcaaaaacuguggaccauggauuaucaagaugaggacuguagagagagucaaguaugaguugagaccuguugucuuuguaagacauuucagcagcucuagugcuguugguccugcuccagcuuacguacuuuugacuucugccauuugggguaggaauaauacugaggaagcauaagaaguaagaagacauugacugcacagagaucuauacauacaaauucgcugcaauauauauuugguaaaagcauaauguagaaaccaugagagauguucuaugaauaggaaaaaaauauacaucauuaaguaaaucuguauggcauuuucagcaguaauauauuaaaagucaaaguuugaacuaguacacucauuaaaagugagcauuauugacauuuauuauucacugguucuucugaguugccuuucuagcaguuggaugagaauaauaguccuuuuggauugaacuuacuguucuugauuuucuuaaauuauuuaaaaaaaugaaggccuacauauauuaagaugaaaaauuaacagcaagucauagcuggcagggcuuuugacugucccaguaguauacacggguaaugguucauuuacucggucugaguaauuuacugaaucucuuaacuauugagaacauuaauacugcagccuaccaggugugagucagagguaaccuuucuuuaaccauuuguuccaaacucuuaaugauuugccauaaucauuucauaaaagauauuauaacgcucuacugagagcaaacaacuugaccuuauuuuaagcauuagacauauucauccaaaguuaaagaaaggaacauuuugugcauuaaaaacauuucaguuuugaguuuuauuacaagugcugcaguaguaggaaaaguuuucaccaaguaacuacuaaaauaaaucuuaauaauacacuucggggauuuuaaugguuugaaauaugugggcaucuuaauucuccaauacucuuuacaugaaaguauuucauucaguaggagucuguucuaccuagaaaaaugcccaaauauguuguauuuuaguuaggguuuuacugcugugaacaaacaccaugaccaaggcaagucuuauaaaaaaacaacauuuaauuggggcuggcuuacagguucagagguucaguccauuaucaucaaggugggagcauggcaguauccaggcagguauggcacaggaggagcugagaguucuaugucuucauccaaaggcugcuaguggaagacuaacuuccagguaaauagggugaggaucuuaugcccacacccacaguuacauauccaucccagccaggucacaccuauuccaacaaagccacaccuccagauggugccacucccagguccaaggauauacaaaccaucacauaugucaaaaugaaaguuaauuauuagugaauccuuacuuccuagccaauuucaaauaaguugagguauuuugauugauugaugcauuauuccaagaguaauuuucuagcuaugcaucaaauauggauuaaaacauuucuccuuuuuaauaccaugugcuucucucuuuacaucuuuauauaaaauaaugaagaguuaaauuuagugucagagaauuguaugcgugguuucuagagagaacaguggaaacaaucauaguuacugaauaauuuaagguuucaaaaaaccuuuuucuaagaaguuagaaaaaaaagguaagaaguguauuuuuuauaaaggguauaucguaaauucugacaguaggaucugucaagcuaguuuagaucuuugguaaaacuuguggaguuugugaaccagaugugaucagcaugugugagaaaaggaguggacacuaguucccauugcaagcuacuuuaacucucccccgugacauuuucugaauaggagauugccagauuaggaauuccagaggcuaugugaaguguuuccuggguuccucuuuuaacacauacugccagugugauuuuuggcaguaagauggaaaaaaaaaaaaacccucacaaauucuaaaagcaguguuuucuucuaacccuguauuuauauauguauauaugaaaucuaaugguaagaaguccauaaaccuuuaugaggcuuugaucagauuuucuuuuuggacaaagucagcucauguagcccaagcaggccuuugacucaagguuguuacccuucaaccucagccucuggagugcugggauugcaugugcguaccaucaugccugauauguuuccaaacuuuaacuuguuuuuaaaugcaauuuuuaucaaucaaaaauuuuauauaauauauuuagaucauauccaucacuacucuuccuccaacucacagauccauccaccuucuuguugacuuauuuucccccuuccuuuccaaauauagcacaucaaaucuaaccuguguuguccauauauuuguguguguggggggcauucucuggaguaugguugaucuaccaggggucagacccuuacagaacucccgauucuuuaaccccuaggacacuaucaacucuccauaguucuucaguuacgcaugggggcuccuucuaccauccuagaauauugauugucaggcaacgcaggaguugugauuuuaugagugugucagucuugucauguucaaaagacauuguuuuguuccaguucuccccaaccccucgcuuuuaacaaucuuuuuucuucccuuccacaguauuucccaaaucuugggggagggguuuauauagaugucacauuuguggcugaaccuuuccuccuguuaaguggaccuuaagucuaacuagacacguguuuguuacugcuaagauagaugucagcauuguaccuuuagggacaucuugcuguacuggucauuguuacaguucauuguugucacagcuagauaggauuauugauugcuucacuuccuuggcaguuuacauaguauguuuugguauuaugaaagcuagacuguaggaaggaggcuuucuggauuuugaauauauuaguuuuuuccagcuuucuaaaagauacuucuaaaauaucuuucuaaaagauacuucuaaaauaauugaguuaucagguaagacagaucccaugucuuaaguaugcagugccuuuaggguugagcaguugaagauaggugccuauuguugaacauaucagaauuguuuucauauauauaaaauaugugucucugccuucauguuacauaauaaauauuuugucauuuuccuggaaguauuuguugauaugguuccaguaaggccuuuuucuuuccuuuuuagagaacugacauuauucagaguguuccuuauauauugacaauagguucugcugguuuucuuucuuugaauauaaaauaaucugauucccauauuuuugagucaugccucaaagaaauucuagucacaauacaacugguauaugucaaccuuuuuuucuuaaauuugaucauuuuucuuuuuuaauuuuauguuuuuuaaaaaauacauaauaguuguaguccuaauuauuuuuaaacagacuacucuauaauacuuggcuggguaacuaauacaaauuuaguggccuuauaucugacugugacuugcggaguauuuaaguuaaaagauucaaaggagagucaauauuucuuuuucugauuucauuucauugcauucacauuagaaugggcacuguagacguacuaagguugaugcugucugagggaggauaguguugcugcucucuuaauuucauaggcuucuuaaaugaucacucucacuugggcuuugucuguuuacuucuacuaaugucaggaagauucauagugcauacacuuuuucccucccaaaacuaucuaaaagauacuuguaaaauaaucaaguuaucaggugugauggcuuguauaugcuugggccauaccuaccaauagaauaauaaaaaaguacauuuaguccaacccccaaagaccucauaguccauagcaguuucaacaauguuaaaguccaaaguucaaagucucuucugagauucacccagucacuuaacuguaaucuccaaagcaagacaggaaaccagcugagcauauuccaaauugaccacuucuaugucugaugucaaagcggucuucagaucuccaacuccuuuuucauguuuguugauugcaacaaacuucuuucuucuaggcugguucugcucucuguuagcagcuuuccucagcagauaucccacggcucuggcaccccuaacaucuuggggucucuucagcuucacaguuucuuguuccaaugucuaagauccacacaugauauucugggcuccuccaaagggcuugcacaacuucuucaacucugcccucuguagcacucaagguucugguugacuccacuguacugcugcugcuguccuuggugaucauuccauggcacuggcaucuccuauacacuggggucuucugcugcaacuagacuucacaaauagccucucauaggcucucuucauuuaauuggggcugacuuacagguucagugauucagaccauuaucaucaaggcaagaacauggcagcauccaggcaggaauggugcaggaggugcugagaguucuacauuuucuauuuuauuuuauuuuauuuuauuuuauuuuauuuuauuuuauuuuauuuuauuuuauuuuauuuuuugagacaggguuucucuguauagcucugacuguccuggaacucacucuguagaccaggcuggccucgaacucagaaauccgccugccucugccucccaagugcugggauuaaaggcgugcaccaccauguccggcuuuuacacuguuuuguuuguuuuugguuuuuuucgagauggcugcuaggagaagacuggcuuccaggcaacuaggaccagggucuuaaaucccagugauacaucuacugcaacaaggucacacccacuccaacaaggccauaccuccuaauagugccacuucugggcccaagcauauacaagccaucacacuugauaacuugauuauuuuaaaguaucuuuuagauaguuuugggagggaaaaacaacccuauggaggcuagggaguagaaugggaugcuuuguauauacuuggcccagggaguggcauuauuaggagguguggccuugauggaauaggugucaccuuugguguggucuuuaagacccucauuuuagcugccuaggagccagucuucugcuagcagcuuucagaugaagauguagcacucuuagcuccuccugcaucaugccugccuggaugcugccauacucuugccuugauuguaagacagccccaauuaaauguuguuuuuauaaaaguugcuuuggucauggugucucuucacaguaguaaaacccuaacuaaggcauuagguaagacaucuauggucacagggauguugggaaugacuuaaugucugaaaguuaguguguguuauguacuauaucacuaaguaccauggucuuuuauauugaauguuuuaggcaacuuuuaaauaugugcuagaaaauuuuguguuuuaaaacgaucguauaguuacucuaugcuauacuguaaccaaaguaguuuucuaaagaaggaaauuuuauaauuaaaccaggggauuacauauauuuuaauugugguauuggagagaaaaacauauuuuuucaaaauguaggagaaaaagugauuacagguucuaguaaauauuaugugaacugaaaauacaauaaacaguucagguuuuuauuuuuuuuuugguuguuuuuacaaaauagcugacauucaaagagaaauucccaugcuugugcaugcuucccaugcacagucccaugacuguguucugaggaagcuagggccaccugggaagaugagaccucaguugaaaaagugcuucuguuagauugguuguaggcaaaucuguuggaacacuuuuuuguuuuauuuggaagggaccagccucuguagggaaguacuacuccuggacggguagccuugggguguauagcaagguugucagagcaagccauggggcaagccaguuaagcaguaugucuuccaugggucucuacuucaacuccugccuccagauuccugccuugaguuuugcccccagucucccuguauuaugaacuguuauauggagguguagccuaauaaaauccuuccuuccucaagugguuuuuggucaaaauguuuuaucacagcaguagaaagcaaacuaggauacaucucaaacauagaacuuucauuuuauuggcuaucugcaaagaaaaacaauccaaaauucugagaauuguguaaaagauguuuugcuucaaaaagagaacguuaaaauuuuuuaauagauuauagguuauuauauuucuacaacccagauucuuauuuuccguaaguauuguguuauaucaguagcaaaacaaaauuagcuuucauuaaaaaaaauguuccucccauguuggacacauuguaucacaccuguaaugccaguacuuucaaccuuagagcuauuucuccagccucuaaaaaauauuuuuaaaacaaaaauaaaagcaaaacucaaaaugaucuaaaaauuaaucauaacaaaugagaaaguacuuugguaaagugacuuuuuaauuauuguaauauggcauaaauuaaaacuugggaauuaaaaaaaaaaccuuacucuuuauaauuacuuucuaauauagacuuucugcaagauuuuugccuucaucuccgaaaugcugggguuacagaaauguggcacuagauccaucuuacauaagauuuucaugguccuucaaauuaauguacuaaaacaaaauuucacuguaaaccugaaacacaggcagaggaauauaugauaaugaugcucugucauguccccaagaugaaugagcaucuucacucugagucugugagucuguaaguacaauaaccuauuaucaauuuuagauuuggcaaacaaauucugguaguuuucacugaagcaacagacuacaguuuuaaagaagugauaacuaaagcccaaggcuaaaacacccuuguuaaaaaucuccuagcaaaaaccaaccaaccaaccaacaaaccaaacaaugaaaaaccaggcacacuguugagcaaguuggauaauuaaaaaucauggagagacagaaugaauguacagcauguagaacuaugggauauuucaguacaaauuugguagaaacgacacuuauuuaaggaccgugggcuuauauucaaugauucuuuuucagggguuuuguucugaauuagauauuguuagucaguaugggugguuucucuuacugguuaucuuagugacccuuucaguugagaaagucaaaauuaaugccaaaaaauaucauuuugacauuuaggcuaauguugguaauuuuguucaugccuuuugucuugccacaguguguuuuguaccaugugcaugccagugugauacucaggcaggcauaggccucacuuaugguuccuugaggcagucucaucuugucauugugguuugccuggcagcuccuccaaggaaacauggugcccagucucccaaguaccuuuucuuaagauaaauacuccagaaaagaauaauuaauaauaaagaccaaagaaacaaccccaccuaugucuaguuuggugagauagugggccuguuggguugacaacaacaaucuucaacuucaaggcaguuaucucacuaaauuauccaucacgcuaugaguaaugacuaaugaaagcuauacccugagcucucugcccagcuugcaggcagcuccacugaagaaugucagucuccucuuuuccagccauuguucaaggcuuauuaucucagagagggccuugccaggcuuguaaacuucugagcuuccucaguaguuguacuugcuuauauagaaaaggcaugauauuucugcuuguuccaaauauucuacaauauuugguauugagagaauggacagagauaguuuguauauuuauuuauuuccaaucuaguucuaguugugaccucuauagaaaugaauugggacagaaaaggccaaacaaaagaagaauuucuuaauuuaggauuaauaacuuuuaaaggagaaaauuagugucccagaugggagugauaacuugaaagaacagacacauuugaacucuuuguacacugugagcuagcuacagcugcuuucaguguuauagcucugagaaacaucacagcucguagagguuucagaccaccaggguuuuggaccagcaggucucgagucacagauugguggagcagcaggcuggaggcacaggucucaaaaguggugggucuuggggaguaagaagcaguaguagggauggauuccuuucuguagguagagcauggaguccuggaaguugaggccagauggauucucccugccuacaacugcaagucacuuuuaaagccuggcugacugcccuguuuuuggauucgcaauugaagggugucuccuuccaccaccaccucugauaagaucucagcagucugucuguucagaguuguacaagcaccauuauguggaacuaugugggucuuuacuggcuaaauguauguauguaaaugagguauaaagugaagaaacaccuguuaagauugggggaagauaggaagaaagcugagcacuuccaaugugcuccuaauuaaguguuucagagucuguuucguguuacagugguauggaagccaggcacuuaggugucaaaaggauguuucuggagaguuugggcccaggaguuucuguuaguuugcagcuaccauagcaaacuugccuuuacuaaauuuagcauccagaguugaugucaugauguauguauguauguauguauguauguauguauguauguauguauguauguauguucugggccuauuaugccaauucucauccaaccccucuccccuaaaccccauuugguucucagcugucguuuugcugacagcugggacuggccagucucuguccuggcaguggguuggccgauucaggcuccuaccccuagcucugcuuuuauagcuugagcuccuuauuacagugcucuagaucugaggucccuccuacccuuaguaguguuaucaaacuuuaaaauuuuaaugcugucccauuuggguuuauuuuauauuauuauuauuauuauuauuuauuauuauuauuaaauuuauuuuguguguauguuuguguguuguauaccacagcacagauguggaggucagaguacaccuuuugggaguucauuugcuccugccauguggguucuagacauccaacucaggcuggcaggcuuguggaaaaguaccuuuaauaucugugucuucucgcuggcccuauuuuguguuuuuuuuuuuuuuuuuugaugacuagaaauaauuaggaauuuuuacauguacuuuuguuucauuccauauuucuggcaaaggacuccaguuaaauucuucccucccucccucccucccucccucccucccucccucccucccucccucccucccuccuucccucccucccgcuguuaagagugcuaauucuuuuuuuuuccaugucaaguacagucuuacuaauaguugauugccuucugccaauauucuucauuggguucucacucagcagugaguuaaaugaauggucuugauuuccuggagagcuguguauggacauuauucugaaaguuaauuuaguacccucucuccccguggaugcucauggaauuuccuugggaaaccucuaguggagaaaugcuaccaaaaauuuguauccuuugucccuugcacagauuucucacuccuggggcauuuguaucauaguaaucauuuauuuguauauucacuuucucaguaggauaguuaucaaaaaaaaccggaggcuaugucuguuuuauucucauauuacaggacuaaguaccauaccugacucagagcugauguucaaaaaauacuaguggggauauugaucacuuaguaugcauaguucagcuuuauuuuucauuguaguuauagcucugugguuuguuuuucauuuaaagccuuuuuuaaaucuauuuuuuauauuucuguucuguaucaaagugaacacguaaauauuuguaauacuguucuucacuuggcuguguuucccuuuggcacuguucuucuuucuuguuauuuauaugugugcuuugucugccuggcuagagcuaauacacuuagugacuaccuaacgauagguguauuuggaacaucuagugcuagacuuacaguacaugaaauccuugcuaauuaauggacaguuauagggaugcauggggugguacuuuuaccuaauuuuauuggacagcuauuuacuugaagaauguugccuuuguaguauuuauggucauuuauuucuguuuuuuucuguugaucauuuuauuauuuauuaucauacucuuuaauauuugauuuauuaauuagcuuuuucuuagaaaagugauagaggaauuguuaccuucuuuucguaucccugucugucuacuauguagaaauggaaguaugcauugguuguuauuugaaauugauuugccaguuuguuagguguuaaguucaugaaaaguaaucuuuugauuugguagcacaguuguuguucugugcaguuagcacauugucagacugaggaauagaugauggcgcaugcugucugcagggagaaggcccuguaguucuuaagaguauguuccaggcugucauaaucggcgguuugaauaccagaguaugauugacuuuuguuuggucuaaauguuuuagaccauaguuuucuaacaacauuaggcccaaagaauuguuuguguuuauuauuugucucgucaaaggccauggcuuugcuaguuuguaaacugccauggacucaacaaguagguuuguaguauguuggccugucuuuucccguuuuaaagcuagguauuacaugaauguuacagaaauguuuuaaaguguuucaacuugugaaaucguuguuucaagauugguggcagcaugguguuugcaaauauguuccuuauagguucaaugcuagaagaccuauaggcucugaauucauauuacaucguauuaaauuaucauauuguguuauauuuuaucaucacuauagaguuuccucaucucuuuuguguugaauauucugguguacccuacuguaaaauuaaaauaacaauauaaauggaaguguuuguagcuuaugugguacaaaugugugaaguugcuagauuauguguuugacaugacauuaagaucagcuucuaggacaaccuccucuuaucuucuuuccaacucuuuaugauucauucaguccccucaagcaggaacccauuccccuuuuauaaaaugaccuuugagguuuucuuugauaucuuuguguaugcaugacccgcgauaccuauuaaauuaaaaacacaaaaguaauggacgguagagugagaauuagaucagguguauuuuacuguuaugcaacauacacgcugucaacucucuuaucacaauaauagaauugauacacagggaauuucacuauuuagagaaagcuacuaauuaaaaguagcuauaggaaucuuuaauaagaaaagauguguauaaaagugcuaacgugacacaguuucagggcauuuauuuguagucaggaaaacagaauuuuccuucaccccucugguguguguuugaaaggcagugagcucaagcuauuagcaggaacccacugaaacuuagaaucacagaaguaugggucuagaaauuucuaacagucaaguaguaaugaguuuuuauaaaguccgcuaaauccaaccauaucauacuucuaacucaaaggauaucugguguuggcuauaauuuucuuucacuccacagccuuuuauuuugaauaauauuuuucuuuaaauagccuuuuauuaguauacaaauaaauaaccaaauaaaaguaaaccauuugauuucuccuuuuuaguuuuauaaauucuaugauuuugauugaucuguccacaaauuauuucuacucagggcauggcauuucuuuugaaacugguucugaugcauuucuauuaaguugcuucucuuuaguaauuuuucucaaacucucaucuugaugggauuucauuuucugaagcaaacagaucuuccuuucccugacuaaaacaaaaaguaucacggaugcauuuacaugaaguugaaagauacauauguauauauuugggaauuuguucucuuuaguagaaauccgcuccaucugcugacaggguuuugaaccgcagaguauagauauaauugaaugacaggugcccaugauuucaccuucuuacauuugaccaaaaccaauuuuguaugugcaagguguauucaguuguuaucaguccuuccugaaauacgaaugcagcauugaaauauuuucacucaaaauaaccuguuaggaucagaccuucaccuguuauuauaguacagcuuagcagacaacaaagcguuguucccagaauagccaugaaauuugaaguuauucuguggauucaguauuaagagaccuguguucucucagcaucuccuccaauguuuacuuccguuuccucuuuacuuuguuuuccuaauaaaugauuuuuuuauugcuugccaauagucuuuuucuaauccauuagacuuaauucaauacggcaagguaucugcuacauuuguuaccuuuguuuuaaucauugcuguuuuuacaucucaaaggcauacacuauaggucuucuauaggucuucuugaguucacauaaaaaauagacuuaauauauaguuuuauguucucguguguguguguguguguguguuuuuuuuuucuucuucaaaucuauugaguccaguuagugcugccuauuggaauguugagugucccugcuagcuugguccugcguagcuuaccacagccgcagugaauucacaaaugcagauggccugccauaucuuuaaaagacagcauuucacagcacccuuaauguccuauagcauucuuuccacccuguccuucugugauacucccugagccuugaggugauggugcuggugguauaaaaguuucauuuagggcucagcacucaacacucacuaauuuacagccacuugaccaguugagacuguuugaacugcugcuuaacuguagacagaagcuucucuggcugagauggagugcaacaccaauugaugaguauaaacacagauguuuaggaagcggucugauaagcuguccauuuagcaagcccacaguaguaaguuccucuauagugccuaugcacucuuaugaccaaugcuuuuccuggccaccccaaacaugaauucuggagauuugaauuaagauucucagcacuuuacugagugaacgaucuccccagcucccuuauucaaaaauuaugagcaaauuucauauuauuuuuaacagaaaauuacuuuuaauuuuaaaaaagucgucuuuaguaagugcaagguagagaaacugggcaguagaacagauguucaaguguggggaugaggaucuuuguucguuaccuucugagcucguucccuucuccagcuugugagaguuaugugaaaucuuauuccucugacucuuggguucuauaucuuaauccuuuuuagaacauggcacuccugcuggguuaauuuugaagauaguuugggcuguuacucuuuuuauuuuugcuugguuuuaaguuuuaggacuaagauaaaaauggaccauaaauaucuguccauuauaucuuaguaaacuuuuauagaggauauuacauauuauauuaguccagauauaucagagaaauuaaaaucgaacaagagagcaguucaaagaaguauauuaguuucauauuguauaaaaaaaaaaucacacgccggguggugguggcacacgccuuuaaucccagcacuugggaggcagaggcaggcggauuucuggguucgaggccaaccuggucuacagagugaguugcaggacagccagggcuacacagagaaacccugucucacaaaaaacaaaaaaccaccaccaccaccaacaaaaaaacccaucacaaacuuaacaguauuaaaugacauguguagacgucucagcagguaaaggaagugcugcucagagcaagugaugaccuauauccuuguaauccacaagguggaaggagaaaacuggcucccacagauuguccucuaacauaugaaacauaauagguggugcacauacacacaggcuucucugucucucugugucucugugucuguccguuucucucacauacacacauuaaauauaaauaaauggaauaauuaaaaaauaaacaaaugggauaauaaaauaauuuuaaaaauggaauaauuuaaaaaaccucgguaaagagcauaauuaugguuuuauguuuuuuguaagccagaugguugagcaugguuuaaguuagucuucuguuaaugaucuuuuaacaagguuacaucaagcacuagccaugagauauucugggcuuugauuggcauagagugcagguuuuuuuuggagguguagggggagcuguuuggcagcugcauaacugcauguuuuacuggcuguugacugcuggagcgugcuuaagacugagugcaugauugagugcaagaaagucucuguuuggaauuacagugaggguuuucacaaggaauugacuugcucauuaguuuggucucuugugucuuauauuuuuugguugugugcuuagcauuuaagauuugagacauuucucuauccuggucuauauuuuuauucuagaauuguacaaaguaaaauccuguugcuuuaacaacccgauguguaaugaacuuuuuguuguugcaugauauuacuuuuagcugcuaacgacugauuuucaacauaucaguuacuccaauauagcuauuaauuucauaaagucuguaggggauuuaguagcccucagaugcuagucaaauagaguuguauuguugcauaauacaaccagagaagugauacacaucacuuuaguaauuaaguguuauaaucauugacguauuucauugaagagaauaaaauuaugagcccuguucacacagaauguaaggauauuauacaagugcauuaauauagaggcaguaucauuggggugucacuuuugggcccuuuaggccauagagaagauauaaauuaacaucuagugguuaaagugguggguuucauugcuuaugaauuguuuccauguuaggaccaagcuguacaguauguugaagcauagcuucuguuuuggcuggaugucacccaagcgaaugagaagguuuccuagcacugaacuuguccuuuuucaagaugugcacuguggaaaucaguuccaccuucuccccagauuguauucauuaacauuuucaugcaacuauugauuauauuguauuuauuugcuuuugcuaaauguagcaagaaguauauaaauaucacauuucuaguuuaaauagaaguuucauuuaaaguauaauuuuggaagacaauaguuuucuauguuuauuuggucuuaacaguuuuauauuuucgauuuuacaauaacacuaguuuuuauuccucuagaauuguuugugaagucagugaguuuucuaccauagaauauuuccauuuauuugauuuccacauauuuaaugcuaguaucuaaauuaaaaauaacuaggcucucaguugcacuacugauuugugcuuaaaugaagagaacuucauguuuguuggcaguguucucuuaccauagaaaugauuguuuuguacugguguuucuuagguauaaaccuguuacuguguuccuguucuucuuuuaggaaagugaucacauauuuuguauuaauggugcauaaccagccugcccauuaauuuuccuguggcucagccugaucauuaauuuuccuaaggcuguugccuauagacauugccuaauauacuagacauuauuuguggaauggcaagaaaaucaauaacuaagacuuuaagacauaucaaguuauuuuccagaguuuguuaaaucauuauauauugcaacuaugccuuugaaauaagcuuaauuuugccauaguauacuagcaaacucuacuguaauuaauauuacuuauauuuaacaaauaagcuauauuuauuuucaauucaguguuguuuuucugaauauauuuuuuaaaaauaguugcaugucucagaaaguugcacuugaaggagaauauuaguauuucauaguuuuuuuuggugauguaauaaaugugcauugauuuauaaauauaaauauaguaaccagcacagugauauuuuaguaguuuuagauauuacccuguuuaugcucuucaaaaauuuacugagugcauuguagcauauuucaaaagauaaaauggcaauauuugaaauuguaacagaaaguagucauaaaauauaaccguuuauuguuuaugaacagguuuuauaaguaauuaauaaaauuggcuuaaaaugcaugauacauguuuuuauaaacagccaaccaccaaaacucugcauuuuugugauauuuaauacguuuaagauugcauauuucucaucauuuaagugccuggcaaauacagaaguggaugcucacagucaccuauaggauggaacacaggguccccaauggaggagcuagagaaaauacccaaggagcugaaggggucugcaacccuauaggaggaacaacgauaugaacuauccaguacccccagagcuugugucucuagcugcauauguagcagaagauagccuagucugccaucaaugggaggagaggccccuuggucuugcaaacuucauaugccccaguacaggggaacuccagggccaagaagugggaguggguggguaggggagcagggcagagggagaguauagggaacucgggauagcauuugaaauguaaauaaagaaaauaucuaauaaaaaggaaagaaaaaugaagcaagucaaguugaauuuuauuuucucauuaguuauaguuaauuuuuagcaaauuacauccuuuuaacauuaccaugaacauacugauuggcuaaaucucacuuguguuguacaauaagauuauauuauuguguguuuguauaaucucaaggguaacuuucuacucauccauauguaauauuaaaauuagauuauucuugaaagugugugugugugugugugugugugugcgcgcgcgcgcgugcgcuuuccuguauuccuuaguccuguuuuccuuauuuuguugcuguaaucaaaucacuuggggcaagaaggaguuuauuuaguuuauuuucuaguucauagucugucauugagagaugucagagugggaaccauggaggaaugaagcuuucuguaucacacucucuggcuagcucauagacucaaguuucgcuagccuuccuguacaaccuggggccaucucuccagggauggcauuguucacagugggcauuuauaucagcuaagauaguucagaugagucugggcuauaucaaguugaccauuaaugcuguuuagaucuaacacucacucucucucucucucucucucucucucucucucucucccucccucccucccucccuccaucuccauguaugugugugugcacauucuguauguacauauguacaugcacugugucugugcaugugcauauucuguguguguugagccaucuugcaagcccuccacuauauuuuugagacagaucuuugacagaaccuugaguuccaucauuuucugauagacuggcuggcuaagaagaccacagacaguccuccaaguuuacauuuguguggcuacucagauaagcuagacaaagaauaugaaaugguggccuuuucuuuauaucauaaauaaaauauagccucaucugcuuuuuucuuuuugcuuuuuggagauggguauuagagauugaaccuaaggcuuuguacacucaaagcaaucacuaccacagauaggacuacaucucuagcccuuauuugguuaaaacuuuaguaacuguauguuuuauauguauaguauguaaauacauaugcauauaugcgugaguggauguauauguaaaaguuagacgacaaccuuaaguguggucgucuccuaucuuguuugaagcaggguuucuagcuccaugcucuuucaccuagcuaguuugcuggcuucuagacauucuccugucuugcuguaggugcacuggguuacaguugaccguuacugcguuagcugguggggucaguggauugaaauuggcuccucauggcagugauggcaguguuuuaucaacuaaggcaccucccuagcuccuuucugauuuuuaauuuuacuuuuaauggaaagucuaucugcagauuaaucuaggggguagguacauuuuuaaauuuuuuuuuugugugaguguauuaguauacauuuuuggugaguguaucaguauaaacaugucaguuuuucauuuuaaaguuaacaagauuuaugaauuguugaacuuuguuuauggcccaaaucaguuguuacuauuauauauccuugaagcuucauaaauuucaagauauggagaguucguucuaaucucuagcaauuuaggacauaucaccacccugucacaucaugaucuguaucuuuuuaauacauugaaaauuaccauggugcugugaacagaauaaaaaugcaauaaguuuuugauaaguaguaauauaacauccaauuuucuaauuuaaauuaaauuauuugauauuaggguaugaaaagcucucaaaauuugaaaugacucuucuaacacaagguuaaagaagaauaaucucuuggaauauguuaauuuaaugaucauggaaggaaaaaauauaauaacaaacagugaauuuguuauagaaaugaauguaaccauccaaagcuuuacuuaaugugcacagcuucccucauuuacuuuugauaucagucuuauaaauuauaaaccauaaggaacaaacaggugagcaauaccauauuucagagaauaaguaaaggucuuucacccuuacuguacugaugaugaugaugagacaggaaagacuaguugguauuagaguuaucuuagcauggguaagaaaacuuuuuuuaaaacucuuuuucuuaaaaacauuuucccccauaaaauaaaccuuaauauacugugauuaguaauuuuuguuauuuauuuauuugcuaaaauuaaaaauauaagggaaggugugacaaagcaauuaaaaauacaucaugauccuaucaacuaguacuucuggaguuuuucuguauauauucaaacauuccuacacuucuucccaaugcuuuuaaauuacaagcugcaugugauacugucauaguaauuuuuguuuugucauauuuaucauauuuacuuuauacauuuacuuuaucauauuuacuuucugaaaauuuaaauaagaucaggaaaaaacuuuuaugcuaauaaauagaacuuuuuaaugccauaauuuaauacccaauuauacuguuacagcaguagaaauguuuuacuaaggcaaauuuuauuauaaugccuuugaaauccucuuuucuuuccccuuuacccaccccaagauaaaugcaaugauuucaugagauuuuuaguuggugauuuuauucaaccuaaaauuggagaaauuaaaauguagcccuugauauagcugaacaccaguaccaacaugagacucaguuaugaaucuuucacuauauuaggggacaaggaagaaaacuuuuuggaagacuuaacuauacuuaacagguuuuagguccuaaccucaguuuuucgagagauuguguguguguguguguguucuugcuauuuuaaacuuacuuccugaagucaguagucacuccuguuggucgucuacuaggauggugguaaucaguaccucagcagcauuuuuuaaaaggagaccauugcuuuuuugcuuaguuuuuuauucuauuuuuuugguuuuguuaguuuuuauuccaguuuuuuuuuuuuuuuuuuuuuuuuuuuugguuuuguucaugcuuuuacuaguuguuucuuuuugcuuauaucccucuagucacaucuauuuuccauguguaauugaugaaguauccaaaugcuuugccuucugcuuuauucuccauguacuuuauaucccaaauucagcaaguucuuaaaaacugugauaauaaaucaaaauuuguguccuaaacccuucuagcgucuuaaauuuuuaacuauccauuuauauaucauauauauuuaauaccauuaauucaguaacugagggcaggaacauagacauugucuuugaauuguacuuuuacuaaaaguccuuucuuuucagaguguaauuuaaucuuucuccagaauguaucuagaacuuauuguuuucuuucugccucaguuaaacacucugucaucuugcauauagggcaauaggauaauuuguaauuaguuucuuauguaccauguuagaguuucuuauguaccaaguuagcugcugaaaaacccgguagccagcagcuuaaaacaauaagugacauuuugcuccaaacuuguauuuuguguccugcucuggguuagauccagcucuucaguguguuuuaaggucuuugguaaucuagaaucaccuugugugcaugaugagguuuacuacguuuuaccuguaaucuuucuaaaguguguguguguguguguguguguguguguguguguauagaaaaacucguuucuacuuaagaauucgaaccuuuagcuaaauuuccucuuucaacuuuuuuuagauuugagccuuacaauaaauaguucaaaauaacaaagacaauugcuuauggacugaaacugcucaaaaguaaggcauggcacagcuaacuuuuuaaaaguuaauuuuacauauuuguuauaguaaugaaaagcuauaguaggaaagaucuguugaauauaugauuugaguuuuuguuuuaauucauauuuuauucauuucuaaaggauuuugaaauugcuuuaaaauuuuaacuuuaaaaauuucuauuaauuuuuaaagaaaauuaauuagucaggacaacuggacguuuaaucccagcauuugggaggcagacacaggaguuugagaccagccuggucuacagagugaguucuagggcagccagggcuacaaaaaaaacaaaaaacaaaaaaacccccagucuugaaaaacaaaacagagccaggauaaguacaauguagacagaacagaaaugacuggcaggauacauaaaaugcagaucacacaguuuucugucauucuuaaauauggaucaauauugacucuugaagucuugaauguuagaaugaaaagaguaaacauuguugguaagagaugccauagauuuagaauuaacaaaccaaauuaugaguaucauagugugguuuaagauagcucaguauguuaguagagaguuaauuuuauuuuaauagaaguucaaucaguuuauuuuguuugacuaaacuugaguaucuuaaaauugguuucagauaaguuucucauuaggaauaugguuauuuauuauuuuuauuuauuaaugacucaucuaaaucugucaaacuacuaaauggcuuagauaauugaaauauuuggaauaagcugucaacaauaaugaucaguggguucauuuauguucuaguuuccauuuuuggacuuaguacucuuaguauuauaccuaaaauauuacuuauauaaaaauagagacgauauuuggaaaguggaugguaauuuuugaauccuauuaguauuugcuuaugacauuuucaguuuuccauuauuggccuaauugauuuucuugaccauuaguagauaguuugggagucucuugggucgggacuauguuacaauaauauguguaggaaugguacagugguuuuacaacacaucauaaucacaaaaggaauuuuuuucccacaauuucucuucccccuucuucuuccuucucugugauuuugauuuccagcugucuccuuuuaucauuguaacugucucgguucuacagagcuguccuuccccuguuuauuuuguucugauguguugucucuuggcuuuuauugugcuggaaacuaaucaaguuuccuaucccuuacaacuuuuuuuuuuuaugucugucuuuaauuaccauuauccuuucuugagugacagaagaaaauuaaacuugucuuuguuuuugguacuaguguagauguuuaaagggcaguaguggaucuugaaaaauucauuuaguuugggauuuuagucaauaucauugccuguuuuguuuaaagauggcaaauauguaucccccaauuuugcaaaaagaauaguuuuccacugauguaauguucucuuauacacaagaaaaauagaaauaaauguccagacgaccauguuuucucuuuuaguggauucucuauugaauuggcucaaauacauuuagaaauccuaugcuugucuccgaggaaggugguaagcauuaguguuugugauguagaauaaauuuuccuauaaacaauauuucuggaauuuacuuuguaucaguaaaauaguggacucaagaaagaaacauaaacuucaaaguuugacugcacaacuuuagugucuggugucaguuuuagggugauuuuaaaaguugugggacacaacagaaacauaauauagccaauuugggcauaaguuagaauuaagaucaauauugucuaugaagcaaaaauguaucagguucuuuuucucuaaguugcuucuggcugccugccuucuaauaugaaacaguuuauuaaaaguggcaggcuuaaaaauuggauucguaaaacaaaauaucacugguuucauaauuuuaucuacaagcaaagcauucugauacuuuuaucacuuuagugcuuuuuucuuaggaauauaguuggagaacagauacaugcauuuuaccagaaagacagaauacuaaacaaccuaaaaaacuguucugaaaaaauucagguccaaccuaugggaacccgcugcaaagugcuuugagaaagaaucaagucaggauugcacaagaggauaaucaauugggggcuuagaaauagaaauaugacucuguguguguguguguguguguguguguguguguguguguggugugauguguggugugguguggugugguguguacaaugaacuuuacugaugguauacaagaauagggcucccuaggcugcuccuguuaucaugggggucugggauggaaauugugagggagaugcucaguguugggggccaauuugggacaggaacuccucagcaacugaggcccucucucuugcucucaguguccuugcuggaguggguguuccaggguuucuuacuccuuggaggccaugagguccaccacccuguugcuguagcuguauucauugucacaacagaaaaugagcuuuacaaaguugucauugagagcaaugccaaccccagcaucaaagguggaggagugggaguugcuguugaagucucaggagacaaccugguccucaguguagcccaggaugcccuucagugggcccucagaugccugcuucaccaccuucuugaugucaucauacuuggcagguuucuccagguggcaugucagauccacgauggacacauuggggguaggaacacaaagggccaugccagggagcuuucuguucagcucugggaugaccuugcccacagcauuuacaguaccaguggaugcagggaugauacucugggcagccccacagccauaacaccacagcuuucuagaagggcuauccacagucuucugaguggcauggauggcauggaccauggucaugagcccuuccaugaugccaaaguugucauggcuggguggggguuccugcaucccuggguccggagggagggggucccaguuacaccggguauuggagcagauguuguggguuuaccugagauccuccuccuccuccuccuccucuuccuccucuuccuccuccuuucucucucucucucucucucucugucucugucucucuuuuuguaaaaggaaguuauucaucuugcauauuuaucugaguacuuacugugcuugugauacaauaguuaguguucaguaauugcuuaauaucaucugugagaacagguuccuagaggccugagaaaccaccaaccuugcacuacuagacccugacuauaugcucugauaaaacuauaauuuguauuuuaaaaaguagucuugcccuuauuaugguguuugccuuguccaaagauuggggccaacaucuuggacugaaacuuuuuaaaaaacuguaagcccaaauauaccuuuucuccauauaaguugauuaucucacuuguuugauauauccaggaagcuaacugacauaaaugucuugucuuguauagucaguuguacauuuuggagugauugaggguguuagaggcaagucaguagcuaugcaggauaauauaagccucuucucagccaguuugaaacucuguugcuuuuuuucagugacuuuuuaaaaauauguuuuauuucauaaagggaaccuuuuuuuuuuuuuuggagaggagcaaacuggaacaagaauuaucccuuuuagaaacuaagaaaccauucaauggaaaaaccaaaaauaccuccagauuuuuccuggaauuccacuucacugaauucaugagcuagaccuaugucacuggacuguacuguuucucuuacugacuuuuagugcaguugguuaguucuuaguauuuggaauauaugcuuugacauuuucuucuguucauaggcacugaacucuuguauuauauuaagaauaguuuuaaauaaacagcaaaguuguaacaacuauauuauuggaugcaauacaccuacucccaaauuuuauaacuaaccauuuacaagguuucccuuaccauguuacccuuuacugaacauauuucugaguacauugcuaaugucauuacauuucuuguauuaucagauugcauggucuuaguuggaguucaguauuuguugccaauaccuuuagaugaauacauuuucaucauacaaggaagugacaaaucagaacuauaaacauuugauagguuugcucaaauauauccuuguguagcucaaacuuuuaucaaaguagaagauaccaucacccugaaaaguuugcuuacacuacuucuuaaugauuuaacuuauuaguucauagguguauguuuauacuacagugaguauaucggcuaaucuguuugauuccuucuauuauuacacaauguuugauggcagaaacucagccaauccagaaucuuuaagaguuuaugucaccaagcugggcauuggugauguacaccuuugaucccaguauuggggaggcagagguagguggaucucugugaguucaaggucagccuggucuacaaagugaguuccagggcuguuacacagagaaacccuuccuaaaaacaaaaagaaauaaacaagaaaguuuauuucacuauaaaacucuaaagaucuacuuagaaguuaauaaugacguugcagacucuagugcuaguuagaggagaucucugacagggcuuugugaggaaaaguugcauggcaauucugaauggguugauggaaggaggaacuuauucuccauuuguaggccuuuacauuuagugucuuaagguagauaagcagauugccuugccaaucuagucccuaguuuaggguuuuuuccuuguucuuuuuccaucugauugcucucugaaguaagauaagaaaaugagaaugguaauauuuacaaagaaagauacacacauaucuuagaggcaaucauagagaggcaaucugcagguguaagucuucaugccaccaguuggaaacauccacaaagccauagguaggguugaagaguaguuguuugucccaaggaaaaaauaauuugaaacauguuuuuacauagaaauauugugagauagauuguaguauauuaaugcuaacaucuaucugauaaacagaucuucccauaaaccuuuuauggauuaaauaugcuuguuucauauuuaaauauacacuguuuuuuuuuugccagaaaaguaauauaaucaaauacacaaauggcccaaaucaagaaugaggacuauaaaaagaaacaucaaucaacacaacuuacuuguacuuaaaucauaacuuuauuguauacauuaucuacuuuacauaacuauaucagccaagaguuucucuugcugugauaaaaaccacauucaaaagcaauauggagagggaaggguuauacccuguaguccagggaaguuucuugagggcagaaacucaaggcaggaaccuagaagcgggaauugaugcagaggccauggaaggaacacugcuuacuggcuugcucauggcuugcuuguuguuuguacaucuugcuuucuuagaacacucaggacuaccagcccaggggcagugauacccacagugagcuugauucucaccuaucaguuaugaaucaacagaauguaccauagacuuuucuguaggacaaucuuauagagacauuuuuuucaauugaaggauccucuuuucaaaugauuguagcuuguguaacguugacauaaaacuauccaagauaauaacaaacaugaaaaacuaucuaaaaacauuuuaacaccauaaacugucuuaauaauuugguuguuuuuaauuuaguguguuuaauuuuaauuuauucaacauugacaaugucuacguaaaauguuuuguucauaccaaacaucauaauguaaaaguugugcaucuucccaaaacuuaugaugauucuuauuuccucuuuuuuggcuuuguugaauaauucacugcaguacagaauuaaaagcuaggaaggccacaguuuaguaugcugugaaauuagccuguaucuaccuuacaugaaccuaucauguaauguuuuaguuuauuuauuguuuauucuuuuuacagucuguuagaugguacuaagugcuauuaguauucuccuuuuauagaggauaaucuucacaaaauuuauaauugcagaguuuaccucaaauuugcuugacuaguaugcccaagacuucuuuaaauuauuucuauuauuuuaagcugugaacuuauauauguauguggguauacacaaggaugugcugguacccuuggagggcagagcugaagguagagggaauugugaacuuucaaacauggguguuaggacugaacucuggucccuuagaagaauaauacuuauucuuaccuguugagcaaucucuccaguucuauacugaaaccuacuuauucuguucauucauguaacagaagcugcauuguuuuagccaaguacugucaauugcuaguggggaauuauccaacauuucaaaguaugauggcacucacuguagaagccaugcugugaucuuucuuagcucuuuccucaguagcuuaucaauuguuuauuucggguaaguaagaaggagcuuuggauuuuuaguauuaugcuaugguggucucagagcauuaguuuuauuccagugaaugcacucaguuaaguacuguuaauucaucuugucuuuagacucaguuuaauugucauaggauauuuuccagcauuuauauaguaaauuucuauaguugacugaagaauguuaaguugcaaacacuguuuuagucauugucucuauguuuauaguuuccuagucuauacuuaaguuugcacuugguaauauaacaauguuuguuuuaccugggaaacagauuugucuuaugacuguuuauugcuuuaucucauugucuuugguguagcagcauuuuaaauaguacaauuuuagcaauagagcaaaaugaaaagguuugucuaaugccugucacauucacauuuaaaacccuuuagccuugagguagcuguuaguuaaaaugccauauaacucagguucuggacaguguuuuagguacuuguaauuaccgugagaauagaaaguauagucauuuugaauuuuuuuuuuaucuugcagcaauucuucuaauuuuuuuuucuuuacacagaaaaaagaaccuucuaaauccagugucaagaaaaaauuaaccaaaguugcagaagcaaaaaaaguaaugaaaagaaguuuuaaagugaacaagaaaauaacauuuacugaugaaggggagguaagauucuauaaguauauuauuucugaccuacaucucagggauuauggagauuggcuuugaugcugccuggcaauucauuauuaaaaaaauaaauaagugucccuagagcacacugcccgcuuccuguuccuguuccuguaagccuuucgucagcuguguggcuguggacaaggauuucuuauguaauaaacugaaguccuucuuggugauaccugcagugaagugauguuagauuccauucuuuauugaaaagauuuucucaucaauauucaucaguguguucucugggaacaagcacaagaauacuaacacagcuacuuaccagaacuucuguaacgugacucugggagcugccugguuugcacuucucagaucuauaugcugugcuugcaugcucaucgcucagcaggcucaugggggcauucucugccuuuagguaauuucagacuuaggugcuuccuuuucguuuuugccauuaucugagcuuuauugcaaauauuccaucauaguucucagaagaagucauuauuuuaauaauuacuguuuuguuuucaaaugagcaaggaaaguuacaauaaauuacaucaaauaaauuacccaaagaaugaaaacuaauuccuugguagaacaaggucuguaggauuuuucucuggugaccucauucucaccagccuccacguucucugaccauccugauauaucacacaccaccauuauaaucucaugacuuucauccuuccuuauccauuuauuuuuacagaaauuguuauguaaguucacauucuuauuugaugauuauaacuuucuuugucauuucucuacaaagaaagguauuuuguucacuauuggauuccuagcauggugcauaguaucuaacauguacuccuaacacaguguuauuccaguaacauaaucuguuacuccaguaaaaugaguuuuccauauugauguaaaaaaauccuaccguacacuucaccaucauggcuguguuguugguauuugcuguacguaugcaaaggggugugcuucuuuuucauuuugaaguuaaaaaacuugguguuauuggggguauaggaaggagcugaaaaauaacaaaauauaagguauuucagaguugcuagaaguggaagaugaagccaacauaaaugaaaaauuuaauuguuauaaaacuacuuuagagaagugagcuggaggagaacgcaguccuaucuagugcccuguaaaaugagugcucuuacccuaaugagcuuagugugcuacagaguucagcugcacagauuauaguaauuagcuccaggauaauuauaaaucucuuaacuguauaauauugcaaauguguucuuguugcuaagaggagcuguuuguggcugugcaugauacugaaacuucugaaccuccaaaagaugggcugcuauuuguucaacccacagaaggguauacuauauuaauuucccucugugaaucaaguggggugagaaguuugagcaauugcuauuaucuguucaucgccguggaucccuuuuauaguuauggagcucagugguuacugauauaauuugucggugcaguuacuuuugccaccaccauugucugucaaaagaauaagauugugugcaucucaccauguagaauggcuuggguagcaagauguaugaguacccgugagauguuuaucugaagauuucuguuugcaagauuaauuagcauacuuucaagucagagauacagauuuuaaauccuuuggagcccagcuauuaaguuaaagcaugggaacuauuugucuaaauuguucagagcuuauacuuuuauagugugagacaacagaaauuacuaagcugccucuuaagucugcaagggacacagguagccacgagaauaauacauguauauagaaugacacacuaaacuagugaaauagccagcacacucagccagcuuugcuguuggauucagcugcuuguuacuuuguuccuauccauaaauuauccguuagaaccaaucaggagcaguccaugaaacccaagccaacucucuccuuuguaguuauuuuauucuguguaauacuagcugucaugggacacauugaccaguuuuaauuauuauauacuguuacgggcucugaagaugaaugaguaagugauauagauagauaaccauaaaauauuaguuuuaguaaaacaagaauguaaaccggcacauuuugaugagcuguguuugaugauauacaaggcacuugaguguagcuuuaaggagauagauacauugucaccuagggaucugauccacacagaugauuuugagcuuaguuguauggggaacagaauauuaauaccaguuuuggggaguguuuucauuauguaaucaccuugacuaaauaauuuugugagguagucuuuacuuaugaucucacaguauaauggcaguaguaccuuggcugugagagucuuuucuaugacaucuuacuuuaauuaugaaguuuaugagacuguuuaagaaauaacucauuguagaguuucugaagacaugcccuucaucuuacucuuugcccuuuucugucuuuaguugguucagcaguggccacagauucagaaaugugcuauaaaagauguggaggaagaagaugacacuggugguaucaaccuagacaaagcaaaggaaaggcuucaggaagaggacaaauuugacaaagaagaauacaggaagaaaauuaaggcaaagcaccggguaagcuuuuagaagugcaccgaugacauuacugaucccugcuuucgcugacacuucuuuuguggcugguuaggcacugcauuuguuccuguuccucucugcuggagacuguaaaauacugauuugcuacugaaauaugcuuuugguuaaguguuuuacggcuaguuacaguuuguaugccaguuaauagugguuaccuaagguuacauucuaugguuaugauguaaccauagauuguagauugcacucaguguaugaugugugacaacagugaagccauugacacccaaauguguuugaaauucuuauuuugagauaauugaugcuucacuuguaauuauaggaauacagaugagagaucccacauucuccauuucuagaauuuuaucaucagaauguuuuauaauugaaauuauacaauccuuuuucauuccgcauuauauucuagaaguucaucagauugguguauaucaaagcauuuucuuaaaaaaaaaaaccuuaaaaauuugcaugaauguguauauauauauaccacauaugugaauaguucccgaagaagccagaaggccucugauaccguggaguuaaauaacagacaguugugagcugccuugugggugcuugcaaccaaauuugggaccucugaaaguagcaagugcucuuaacuauugagcuaucuucaguccuccuuuuuguauuuuuaauaacaaguaguagucuguugcuugcaauuggaagugauccuuugaucacuggaacuacaaaugugugcuaccacaccugucuagaagaauguggcuuguuuucaucuuacauaaaaaguagccuacugucucuguauaugcuguguuccauacuuuuuucacuuucuuuuuuuuaaauauuuauuuauuaauuauauguaaguauacuguagcugucuucagacacuccagaagagggcgucagaucucauuacagaugguugugagccaccaugugguugcugggauuugaacucaggaccuuaggaagagcaguuggcacucuuaaccgcugagccaucucgccagccccuuuuuucacuuucuuuugagcuuuuuggguaauuuuuucuguacuuuugaaauagagcacacguuuuauauuauuucagcuagaauagaacaguucuggguuggcaaaguugaacaagauacagcuagagcuuuauauccuacuguagaggcugauagcucuguaaggaauagaauuagucuuaaaaacaaacaaacaaacaaacaaaaccugaauuucauguuccguuuguguucuauagaggaugccccaugacauccuuuccaaacagaagcauggaaauugccauccuacugucucagcauuaugauaaaacuagaauggucauuuucuaaagcagaauuuaugacuauacggaagaugacugguuucucaguaguauuuucaaugguaaaauuauuuuacaugcauacauuuuguguuuuagaauguguuuauuuugagcacuuuggauuuaguguuuaauccaauagcaugccuaaggcacuauauagauuuuucucaguauuguggagaauauuucugcuuagaaaacacagaaauaguuucuuaacugguacauuuuaauguuuggcugagagaguacuuggcaauaaauggaagaugcguuauccuaaauaugcauugcuuugucuaauuggaaucagcaguagcaguuuggcuucaguuuccuuaucugaaaaaugagaagacauuuaguuaauuucugaugauaagcacaguuuucuagauuuuuagauuuaguugagucucuaaguuggauaauagaauuuagauuuguaauuuuuucuuccuggcaaaucagguuacuugcuacuuggugauuauuuccuucuuagucuuccauuuuuuaggagccacucaaaucuauuguaaaaaucguguuccuucuaagucugaaauguuauuuuguucuaauuaauuguugauuuugagcuaguauuuuuacuuuauauaauuuaguauauuucuacaaugucaauuuuauucuucuagcauaagauuuugacuuuguuuugccauuaugucuccauugaggcugucacugaaguuaauucugugguaauauagugagaagaauuuuuaucuuacuaaaauuuugaaaauauuaacuuuaaggccuauggcuaaacuuuagcucauaaagacagaaaaagauggagaaacuuuugauggaaaaauagaaauguggauuuacaaaauguugucuuguagcuggacaaauucauugcagugaugaacucacggccuauugguacaggggcugcaugggacuggcugcugauugugguggaacucacaggaucuacucuuacugcuaaacuauugacagguucugagagaugaguauuucuugucuucaguuguauacccagcauugaacauagcaggcucaauggagguccuaaacccacgaccacacagaagaccaugguuaaacuuaguaggucauauaugaaaccaaaagucauaugugaaacauguuuauagacaaagguuacuacugugugggagucagaugagagaaggugagugugagaguagucaauaugcguuauacucaaguaugaaacuguuaacaaaaguaauuaaaagguagggaaagaaauuauacaauggggcuagagagauggcucagcaguuaagaauacuggcugcucuuccuuuagaccaggcuggccuugaacucacagagauucaccugccucuuccucccaagugcugggauuaaaagcaugcaccaacauagucugaaaaguaaacuaaauauuaauaagauagaauaucaucuaguaacaguagugauuaauuuugagguuuaaugaugcuauauauugaugcuauauauuuuucuguuaugguuaauaugguuugaucaaaagcccaaagagucuagguuuauguaaaagaguuuuucugaugcacacauaucaguguuauucuuugauaucuuugaagguccauuuuuagauauucuuauaugcuagaaggcaagcuacuguauauuuacaguaaauuuuguuugccuguuaaauaguaacaucuuguuuuuuuuguuucugcaugaagagccugacaaaaauuaaauaauaaaacauuaaaacauugucagggaaaguaacauugaaaugaaaagacuuuauauuaauaaaacagugccauuuguacauauugauaagagaagacacuacauaugacccuacagaguagauaauagaagagcauggaacauaauaacaugccagaauugacagugguuucacagauucaggagccuuaggcucaucgcucgcucaguauguuauguccuuagucuggccugacuguaacgauuacccaucuuuucaccuguagagcagggagggauuuauaaguucugacauaccauuuaaaagugacacauacaaacugccugacauguugugauaauuuugagguauuacuuuuggcaagaaaauauuaguaaugugcaaauagacaaacauuuuuguggauguauaaugcaguauuaggugcauuucauaguuauugaauaugauauagcuauaguuuuacaauuagguuaagcaaaacaaacaaacaaaaaaaccuuaaacuauuuugauuauuauagaguaauauaaaacauaaguuauuuuacuguaagccuuuagauuggaaauacuuuuuggguagguaguaagauuaaauugugcuauuauuuagggagaaagaaaaaagacaauuauagaugcauacgucugcaaguuaaagacagcucugaaacuaauauaaagcaugaguuauuucaaauuuuuucuuuaauaauauuguccacauuuagucugcugcuggucaaagaaaaucaguaacuaguacaaacuauauaaaauuuuuguauaaguguuuagaagcuguguuuauuuucuuucucuuucuuuuuuccaaacccuuagaaaaaaaugauauucuuuguauucucaguaggggagcacgucagugacauccccacaggcacccgugugugccuguguguguguguaugugucuguguguauauguacgcacacgugcguacguguguaugugugugcacacgcacguguguguguguuuggcugaguuugcuuuucugagaugggcucuguauaugaggcuagcugagacuugucuucuagucuucuagcugaaucaucuccucuggagcuuacagacaugaguuacuguaugcaacucaaggauagaauuugauaugaacucugcaguuuuggugcagucuauaguuauugaauauccacuauaucuguaguuuuuuaaaaaaaauuaaugagucagauuuauauaucaauaaauucuaaauucacaagaugcccauacaauaauuucagagccaauugauaaugauaaagcugcccaccuagaucagacaaguuaucucaauuauucuauaugauauucauaacuaccugaggccauuuaaaaccacacaggaucaggaucuucuuccugucuguccuccaucuuguucccuuguccccuucuucugagugcucucugucucucuaagucuuagcuccacuucccuuuucccuguccaaucacaggccuccuggcgcacuaauauucaaauugauuggacagggaaaauccugccacauaucacccuuucuguuuaacuaaaaaaaaaaaacaaaaacaaaaccuuuuuuaucucagauauaaauugagcacaacuauuaccauuuuguaauuuauaaaguacaagauagacccaacacacgguccaucaguuuuauuaauaaaacagaacauugccaucuauccuagcuuaaaggacuuauaauuuuacaccugacuuauguccuggcuuuaaugucauuugaaaaucauccucugaaaucuguucucucaaaguuaaauagccuggguugaugaugagacuuuaaguacccuuucaacuccaucagacaucugagaaugagcaguguuaacugcaaauauauaggaagccuaacacugcuuccagaacugagagaaauuguagaaacagcugccuaccuguacggccccaguaagucaggaaguuggagcauccaucugucuucagccuucuggcccagaauuaucugacagaccuuagagaaacaggaaguuaaggacuagccuauucugucucggcagaacuaagcuguccuaaccuguaaauuguguccuuuugagaacaguacaggucugcaggagagauugguaauuuucugcccagugguagccacaaauguacagccucaccuugagguaagaugcucaguugcuucuuugaauccaugaauggggaagcuguuaggagcagauuugucucaacaacaagugaauaaguaacauuaaaugucacauuuuguggauuucugauguuuuugaaaaccaacuaucuauguaaaguaauauucagcuugaagaaguuaugaagauucauugccccaguugccugggcuuuggggcuggagaggguuauuauaaauugucuuucuagggaaugcagaaauggucauaauuggaacagggaggaaauagcuagaauugauugcauagccauaaucucaaucgguagaaaucauuauaauuguuacuacguugaaaccguaauuucuuauuuugguacagaauuuauuuugaugcaaaaucuagguuuucauucguauaaauuucuucuauugauacaaaaaauuuaagagcacagggcuuagacccagucuuucuauaacuuguuguuauaaacugaucugagauauuuaagccugugaguuaugggccaaauaacaaauucauggcucugagcuuauuguuaggguguuuucagauauuuuaauuagaaauagcuaagaguaguuaacagggaacagucuagauuacuuuacauagguaucuauaguuuuaagauuagguuaagcagaaaaaaacuuaaaccauuucguuuauuauagggucauugaucagcugccuuacaaaauacuguucauuuucuccuguuauuaaaaucauauauguaaauacuucaaacagauuuaauuuuauuuuuuagcacauauagaaaaacuccauagagcuggcacaaaaauauuauuguuaauaagaucaaaucuguuuaugagcucaugauaauauauaaaucaaaauuuucucaguuuuuauuucaucuuagcuuuguuucuuguuucuacaacuuccacauaaucugaaauguucuuuuacaauuguacaguggcccuacuaguuauauuuuguguguguagaggugagagaagaaagaguaaucaggcacagaagcagaguaaugggaugagaggcaguaggggcguggcuuagaaucuaguuuaguagguucucauuuucugguagauuucaucugugauguaaucagaagcaucuaaaagcuccauggacucccuuuaguauuaguuaguauuuaguguccauuuagaccuuagcauuuugguuuccccuuuaucauaaagaauucuauaagccuugucaagguaaaugcugaauuccauuaucagaauauccauuaaagcuuuuuuuuuuaaacuugaagaaagccaugcaugauaacgcagggcacagauagaaaaguacccaccagacagcgugucucacuuucauauugacaguggauuuaguguaauaaugacacaugauagaaguaucuccauacuacgugggaggaaaacugcauuuuuacauggacuuagucauuuacccaaauuaaaaacuguaaguuauuaccuacagauuuuugguugagaauagacuuuuuaguguuuguagaagauuggcugcuuuuguaagcuuaaaaugacauucucuuuuacuuuagugaaucauuuugucuugaacuuuaauacuguauguccccccacccccauuuuuuaaaaaccuauuuugugaucaguggaaaacuaguggugaaauuauaaagcaauuuaauaaaauguuucauaagaaugacccuuuauuguuuuugaauaaauauuuuuccuaagaaccaaaggugagaauuuugucuuuaauauuuuguaauuucuguucagacugaggacaagggaaacaaucaugauuguauuuuuccuucuuuuuuauucuaguagaugacauuguguacuaguuguguaucagauauuguacuuauaaucuauauguaauauagauuauuaaauacaugugucuauuauuuuccuuuuagacugaacaaaaaauuguaaguaacuaaagaauguguaguauaugauuauggauuuaaccuauuuuuaguuauuaaaaauuauugccaggugguggugguggacacuuuuaaucccccccucuggaggcagaaccaggcugaucucugaguucaagaccaguauggucuacagagaguguuccaggagaaacugugucucaggggaaaaaaaaaaaaaaaaaagucagguuagucccauaguauuuuguuuacaauguaaaacuggagagugugugcugcuuaacaucuacugucuagaaguuuccauaccucuaauucaucuuuucuuucuguaggaaagacggcuaaaagaaagagaggccagaagagaagccaacaaaagacaagcaaaggugaggaggggcuuaugugugggugugcaucuucauaucuauggucuuuugggguuuuuuuuguuuguuugguuuuuuguuuuuuaaaaaggguuuuuaagguauuugucagagaacuuuauauaaaauaaaggaaaucuuuguaauauugaaauugauuuaaaucuguauuuugccauauauacuuacuuuguguguguguuuuuuguuauauauauaccaggguauucuggacugagcccuuguagccuagucuuuacuuugucauuuguuuucuuuauaaaguguuaaaaauucuaagcuagcuugugaucuggacuuugccugacccuucugaccaccuuuccuauuaaacacagaagacaaaugacuuugugggccaacugaaggauuugcauacuugucauuuuuaggcuaaaaauauggcuuauuuguacucaauuggauaauuuaauaauagauuacagugagaacaucaguuggcuuugcuuuaccucugaugaucuagauggaaacacuauaagcuucaguauuccccaaaacauguaguuucccuggaauguauguguaaaguuguaagcaccauccauaugcaacuguuacuuuuaaacugacaugcuuaauaucgagaagguuuccgaaagcuccugcauucugagggcaucugauagaaaugacuucugggacccaggggcaaacacugaauuucauuucacauucuauaugugccaugccugacuagccaugauugaguuuuucuuggcaguuagcaaacgucugacucacuugagcaaguccaccauguucuuugcucccccaccuuuauacugguuguagcacauaggaagcaaguuggagaugauaccgcugcuguacuuuggaaguggaaaccaguuaauuacuuuaugguguaaaagaaaaagagugcuuacauucacuacuaaauccacucugucuugugucaugaccuggaaauuggaucauaggaacaguaauggauaaagucuaagaagaaaaucuuaaucuuaaugaaaacaguugaucuuuauggguauuucauggucaacauuaacacaagcauacuuuguuuuaauaauaagcucucaauuuccagauaguaaaugucauguuucuauauuuccuuuguguuuuuacauuuguuuguauagucuuccuuuguauuugugggucucuuaucuguagaguaaucuaucuauagaccagaauuguagcuaagccuacauuuauagugaacauguacauauccuugcauuaauuuuuaaagaagauuuuauauuuaauuauguguucuuguuuguggcgguguggggcuauguguauaugacugcaggugccuguggaggucaggucucccuagaguuggagcuauaagugguugugagccaugugaugugggugccgagaacugaauuuggauccucuggaaaaguaacaaguguucuuuuuuuuuuuauuuuuuuauuuuuuuuuuccauuuuuuauuagguauuuaacucauuuacauuuccaaugcuauaccaaaagucccccauauccacccacccccacuccccugcccacccacucccccuuuuuggcccugguauuccccuguacuggggcauauaaaguuugcaaguccaaugggccucucuuuccagugauggccgacuaggccaucuuuugauauauaugcagcuagagucaagagcuccgggguacugguuagcucauaauguuguuccaccuauaggguugcagaucccuuuagcuccuuggcuacuuucucuagcuccuccauugggagcccuaugauccauccauuagcugacugugagcauccacuucuguguuugcugggccccggcauagucucacaagagacagcuacaucugcguccuuucaauaaaaucuugcuaguguaugcaauggugucagcguuuggaugcugauuaugggguggaucccuggcuauggcagucucuacaugguccauccuuucaucucagcuccaaacuccgucucuguaacuccuuccauggguguuuuguucccaaaucuaaggaggggcauaguguccacacuucagucuucauucuccuugaguuccauguguuuagcaaauuauaucuuauaucuuggguauccuagguuuggggcuaauauccacuuaucagugaauacauauugugugaguuucuuugugaauguguuaccucacucaggaugaugcccuccagguccauccauuuggcuaggaauuucauaaauucauucuuuuuaauagcugaguaguacuccauuguguagauguaccacauuuucuguauccauuccucuguugaggggcaucuagguucuuuccagcuucuggcuauuauaaauaaggcugcuaugaacauaguggagcauguguccuucuuaccuguuggggcaucuucuggauauaugcccaggagagguauugcuggauccuccgguaguacuauguccaguuuucugaggaaccgccagacugauuuccagagugguuguacaagccugcacucccaccaacaauggaggaguguuccucuuucuccacauccucgccagcaucugcugucaccugaauuuuugaucuuagccauucugacuggugugagguggaaucucaggguuguuuugauuugcauuucccugaugauuaaggauguugaacauuuuuucaagugcuucucugccauucgguauuccucaggugagaauucuguaacaaguguucuuaaucauugaacuaccucuccaaccuuugccauuauuauuauuauuauuguuguuguuguuguuguuguuauuuuaaagaacuuaacaauugcauacaacuuaacauaguacuggguauuauaacuggugugaucuagaguauagggacuugggcaucuucagguuuggguguuugagaauggauaagaaacuugucuuguuuugagggaagacuauguaguauaguuuauuuuuuauauuuguugaugcuguguucugagucuuucauaauaguuugaauuguaagaaguuauucucacuuacuagacugcuucuaaauauucuuuccuuaguuuccccauaggugggcgucuguguuuaguuuugauccucuuuuuguuggggaagucgauuuauggcccaguguuaaguuuuuccaauagggcugaucuugaaugugaacuuguugaugaaaaccucccuccucuccucccuuuucauguuuuugcacaucaaguagaggacguccuugucaggggaaggucuuguaacuguaucuguguagccauggaggagaaugcugaggauaaaugaaagaaggcaaggcugugccaaugacaagguugucuacucuggaccuuuaauagaugaagcuuugucuuacagcugcugagcauaguugagaaaccuccauaucacagccccuuucugggggugcagaaaugagagcugucuccuuugagaguguuaucgugggcagaauggccaauuuuuaaccaguucccugacauucucuguauacugagguaaaaugaaagccuagugcaccucucagaaacuugauauauuauuuuguuaaaguuuauaucugugaucuguugaaagaaaaauaugagggugaaacuuucaugauuuccugaguacccaguauuuagugguuugggagauacggguuucuaaaauccauccauccauccauccauccauccauccauccauccauccauccauccauugcuuguuuuuuguuuaaguauauuaaccgugugugugagugugcauguguacacauuacagugcacauguguaggucagaggacaacuugcuggaguucucuccuuucaccaugugugucccugguuuaaauaaauacaggcuuuccggauuggugucaagcaugcuuacccacugagcauuuuacuggcuccaagauacagaucuuuucguuaaugaaaacuuucuaaaguaaagaaauaagcugaacaggaggacugcuuguuuuucagcuaacaaaaugaaauauaguugucaugaugaucaauagaguacauugcuuuuggaguuaagaguuguuagucuuugaaauaaagcucauuauuuagcucucauuuagcuagguuuccuaaggcacuggugguuggucacacaugcugauuauaagagcugauggcuggaaggaguuuugcaguuauguaaagaaagaaaaaacagugcaaaaacuugagauacacccucagacuugucagggcucccauaacuuugaaaagaaggaggauuuauuaaguagaaguauauugcugaugaaauagaauauuguugauaaaggaacaaagagaacaacuuagaacugaaacccuggaaagugacauuauauugaaauuuaaaacaauuuauauauuuugagguugaaaguucuauagucauaagucuuucuaguuuuauugcugggauacuuaauuuacuuugacaauaauggucuuaagaauaguuuacucagcagauaaaggcaaguaaaagagggaaauagaggagaaacaaaguaagggcaggaguagagaagaauauuauagaagaaaaaagaaagcaguaagaggcgaggagaaagaaaaagauuuacuaagaaugagagugcaugcagcaguagguucagcucagacagaagauaacacagggaaaagcauucccagacuuguguacugggagcacauuucaucaacugauaguaaggaaccuucucuugauggaccugggccugaacucaaaucugugcagccacacaucugucuuucacugcgauagaacacggaaaccuugaagcuacaaccaucuguuuuacaccuacuuugcuauguuacuucagcagggugauuaacgcuggggagucuuggaaguaugaaaaaaaggccccgugucccuacauaccucagugguugugguugcuuccuacauuccuggcacaguugggaagcaccccucaucuugagcagcuacccuagggauuuugagcuggggaguuuuagaagggugagucaaccugucuagcccacagauugcaaagcuaagcgugaccacuagaggccucugccacacaagggaaacuauuaaugugaaaacagucuggcugacauaauaaaugcaaacaccagcauaugcuauagaaaagaagagguggcauccuacuuagguuucuauugcugugauaacguccacgaccaaaagcaacuuguggaggaaaggauuuauuucugauuauaguuuuguagugcauuuggaaggaacucagggcagaaacucaaggcaggaaccuggagacaaaacugaagcucaggcuaugaaggaacugcuuacuguuuuacuccuaauggcccgcucagccugauuucuuaugcaacccaggaccaccuacccaaggguuguacugcccaaaaggaucucggcccucucagucauuaaucaagacaauaccccacagguuugccaacaggccagucuuauugagucauuuuccucaaugaagauuccuucuuugcagccaucuagaucugucagguugacuaaagcaaccagcagaacuggcauauuuaaguuuagcucccacuauacauaugauuggcaguuucuaauuuucaugaacccauaaagaagcuuuauguaaucuuucuguauguguuuucccuauuaugcuucccuuuuugcuuuuuauuuuuuauuuuuuguacaagauguuagagcaguucacuuaaaaaucaaaugacucauuuagagcaaucacuauuaguaagugaauauauuggaaugagguauuucugcuuccccaaaugacaaagcucuuuuacuguauugcauguaaaaguuuugcuuaauuuuuguuuuucuagucugcucaauagauuucccaaauagauaaaugugguugcaaaugcccuuaaaucccagacgggguucugcguuuuaucuuuaaaggagaaaggagucaguggguaaugaaaacagacaggugaacacagcuaacaaagaauaagcuuugcacugauuauuuaaaaguguucuugguuuuagaagugagugauagggcagugauuuccuauuuuuaagaauuuaugguaucuacuaucucuuguauuaguggcauaaggaagacuuuugaggauacauuuuuauuuuuuguuuugcgugggcuuuagaguuacaaagcuuuauuguuucuucuuuuuaagccauaaagacuuuuguuggagagcaccauaaacuagugcuccaaagaaucuaaaguuagguacuagaagaauuuguccuugcaaguagucaugugucucuaaaauaccacuaagaagaauuuguuuuuucucucugauacaguuuuuguuuguuagguuuuuucuuuuuggcccuccaaugaaaauacuuggaaacuaaaauuuuguugcuguuguuauuauaaccaacaauaaguaauuuaucuuuacucuauuuucuugcuuuggggaaaagauauugccagguauuuauaauauuucaugcauaaagauuuuucucuuccauguuuuuuuuuauuauuauugauauauuacaggauugaaagauuucuuuacuggaagacaacucuugaauuuguuauuuuuaugguguguugguguagcuguucuacaacaucaucuggagugccuuagccuuucagaaugcuuucaucaagauaaucuuuaagcaaugaguuuaugaaauaaguggaagcacuauagccuuaaaacuucugaaagaagcuugccucagaauaucugcucacugacuuggaccaggucagauuuaacuggugaaaugaaagcauucucagguuucugucugacucaacaaaggucuuuuggccuuauucaggacuuuguuuugucucuaaagucccuggggccuucagucucuugaggguuaggugcaccaucucugaaugaacacagaccuggcaguccucuacuguauguguguugggggccucauaucagcugguguaugcugccuguuuggugguccaguguuugagagaucucggggguccaaauuaauuaagacuccugguccuccuacaggaucauccuucucagcuucuuucagccuucccuaauucaacaacagggggucagcugcuucuguccauugguugggugcaaauaucugcaucugauucuuucaguugcuuguugggucuuucagagggcagucaugauagaucccuuuuugugagcauuccauugacucaauaauaguguuagaccuugaguccuccccuugagcuggaucccacuuugggacgaucgcuggaccuucuuuuccucaggcuccucuccuuuuccaucccugcaguucuuucagacagaaacaauuaugggucagaguuggaacacagcauacuucaaucaagauuuuuuuuaauugaaaaugaagugguagguuagauuucuauaagaacugucagcucagauguuuaaguuuggagauucuugaauauaagauuuuuaugaauaacuuugguaauaagcuauaaccccuauaaaggggcuuaaaugaaagcucugaaaguuuauauucuuuauuauuuauauucuucaaauacauaauuuuaauauccccauguuccaagaaauguagugauucaccuccuaaaauuuauacauuucucucaaauaagaaaaugaauaguucuugugguucuguagcuuagaaaaauguuuccuaaagugcucuuacccuuaaauguuuugcccuugucuguacaacugcuacuuggugguuuguagugcuccuuugagaaaaacaaaaugaaggaagaaaaagaacaaauauucccuaagcaaagguggaaacauuagaauggaugaaaacauccacacugugaauucuucuccauuguaauuaucugguaauagguuaugggucuuccuuaaucaguaacugccaagcucccuaguugcucucagaagaacaugaggucucaaaguucauuucuggcccauaaguuuuguggcccaggauauaucuucuuaacucuaguuucuucuucuauaauacagcagcgauguggccugcauugucagccuuccagggcucuuuucgaggaugguacaucuauauagugagcugugaucaccuuuaaagaugcaaauuauugcagucagcacauugcauauguucuuuaagauaaacuuacucugaggauuaguggaagcuggaguguguugucacuaaguggcucaaaggugcuucagcuguagacaucuagcaccuuccuuccuucgucucucccaucuaaauauuuggguggaaggcguauaaauuucuuucuuuauaaauucuuuauauuauuaaaaccugagguacuuuaaaguccugagguaagaaucccuuuuugguuccauuuaugcuucuauaggagagugucuaugugaggggaagugugcucucgugagucauucaagcucagcauccccggcucuauuuguguuucggaguacuugccagcaucucguguuuuuacucuguaaacuuucaaaccgcaugcaaaagaaauugcccuugguacuuuacacuaaacugguacuaaccuagucuguuuaauggucugagacucugaucucugguuuuuggugcccgcagaggucaguguggcauugaauagaucuacugugacucagauguucuggacuagacagaugucuuauagccucccuuucagguuuacaauucccuuagguaauaaaauauucacugucaguuuuaugucccuuucuacauaacauuugcagguguguggguuuauucuauauagcauuuccaacaguaguuagaauguagaagaaaucuguaaucaucacagggcguuuuuuuggacuuuauacgaguuuuuagagaaugguuuugagaauauagaauauaucagauuuuacugucaugcaaaagggaaacaggagaccuagcuaaauaguaauagaggcuauuagauaccaaaaggagggaagauccuaaaaggauucaucuuuuugcucuacaggucuuaaagugccuaucauguguuaauccugauaauggcaagauugaauuaaaccuguucuugagcaacucacaguguaauaaaagaaacuugccuuucugauccugccugauuucacuugauaugaugaucuuuaguuuaauucauuuuugcagguggcauaauuucauacuuuuguugcuggauaaacuuuuauauuuguaucacauuuucuuuaucuguuuauuuauggguauuuagauuaauucuguaacuugguuaucaaaaaaugcuuaaguaaacauagauuacauaauuauuucuguuguacauugaccuagaucccuuggguuauauacucagaugugguaugguuuccuggaauuuauguucaugugaacaugaaacagugaaaaaugcuuucccagucaguucuuuucaaugaaaaugagcucaauugggaaagcacuuuuuuucauuauuuaaugcucaaaucugaaaauauuaauauuuaaaugucagagaaaucucuuagaauaacauauauuugauguucuugaaccuuuccauuugacuauuucaucacauuuuuauugaguaaauuuuuauuaguauuuguuuggugguggcggggucugguacccuucugaaggucacuuaauguauaaacagugcccuaaauaugaacagacugugugagucaucacggugaguaucaaaaagaagacugaaaaaaaguguguuuaaauguauuuacagaucacaaaaucucaauuuuguucuugcuugauauucuauaauuuugcaaaaagauuuuuuuguauuaagaaaaauuugguaguuauucuaguuucuaaaauuaugcuuuuuaugaaguaugcuaaaucuguuaaaauauuuuuacaggcauuuugacaguuaauauuuuuaccuucauuguagagaauucugguaaaauguauauauauauauuagaagacugaaauucaagaauuucuauaaucauugccuagaaaacugggaauaauuuuuaguguuugcacacuuacauaauugugucaaauucuuaaaauucuauuuuaguagauuaucuaaacuaauaaguauauaucuaacagaguaccuuacauuucaaaacuauaacauggcauugucauguaugaauguguugagcuagaaucauagcuaccacaggguuccuguggccucugggccaccucuuggacacaucuggcuagauuccuuugaugaauauauuccuauaggcaguugccuauuugacaucuuuauuugggguuuaaaaugacaaucucaauauauuuaaaugcaagcuucauaucuuugugacccaaauauguuauugccaugaucuuccuuaucccagaagauaauaacccaucuuuccaccagcugaacagaaaucuuaaaaauacuguugacuuucuguucauauucuuccagggcuuaucagaaagugcuauuuauuuuaccuuaaaaauugaaaauuugcuauagaucagaugucugaaguuauuauuaauuaauagugacauaacaugguuaggguuguuuuuaauaguuuucaaaaauugcuuuauuuacuuucuaaauguugccccccuucccagcccuuccuccaagaguucuucaccguauucccucucccccuugauucugaaugggugcuuuccccuucuguggggcaucaagucucuacaguauuaggcacauucuaucccacugaagccaaacaagggaguccucuacuacauaugugcugagggccacagaccagcccaugugugcacuuugguuggugccuuagucucugggagcucccaggaguucagguuaguugauacuguuggucuuccuauaggguugcaaucuguuccuucaauccuuuccuuaucucuuccauaugggucuccaaccuuagucuaaugguuggcuguaaguaucugcaucugucuuagucagcugcugguagagccucuuagaggauagccuugcugggcucuugucugcaaacacagcaugguguuaucagaguuuggugccugcccaugggauggucccugaguuagucuggucgcuggauugcauuuccuuuaaucucuacuccauuuuugucccuacauuucuuuuagacagaaaaaaauucaggucaaaaaauuugaagguaguuggugaacccaucccuccacugggaucccucuaucuacugaaggugaccccuucaaguuccaucuccacauguggcuaaggucauucccauugaguccugggagccucucacuucccaggucuccagaacuuucuagagguucaccucaacccagcccccgcagcuacauacuuccauucauccuuuuguuccucugggcuucucuccuucucuccauaccugauccugucccucuuucccuuccuucuccccucccacccaacuccuucccucccucugccuccugugauuauuuuguucccccuucuaaguggauugaagcacccucacuugguccuucuuucuuguuaaacuuuuuauggucuauggguuguaucauggguauccuguacuuuuuggcuaguauccauuuaucagugaguacauaccaugcaaaucaaucuggcaguuccucgaaaaacuggaaauaguucuaugugaagacccaguuauuaccacuucugcgcauagacccaaaaaauguuccaccauaccacaaggacacacgcuccauuauggucauagcagccuuauucauaguagucagagcccagaugucccucagcugaaauagggauacagaaaaugugguucauuuacauaauggaauacuauucagcuguuaaaaaugagugcaucaugaauugugcaggcaaauggauagaacuagaaguaccauuuugacugagguaacucaaacccaaaagcacaugguuagguuuauuaauuaugcuaaguauaucaaaaaauauuaccuauaagaaagaucuauuuaagagguaaugguaauuauguaucugcaaaguucuuauaaaucaaaauuaucuaaaaauuaaacauuaaaauuuauauacacaguccaauuucagugucuuuuuacugucauugugcucaucaucucugaucguagguugucaguguuaagaauccuguauucuauucauagcaugcuacucugucucuuccuuuaauauagugaugagaacaaacaauuacaaguaagcugcaguguguuacccuucuguucaaaucccaacucuuagagggcuucuaaagcuuaauuauaguaauagcugcaaaguucuaaguccaguucagauuuuauuuccucuguuuugccaauuaauuaacuuuaauaucagauuuugugauuauuucucaugaacaacaaggaaauucuggcccuuguccugguguacugccagauugcuaugucagucgcuuccuuaauaccuuuggauuucugcccaaaaugccacuuuccuaaugaggcucuccugaucaccuguuagagaauacuaaccucauccucccuuguacucuuaccuaauuuuuucuccuccguauuugccccuaucagaagaucuauaacuguguaccuggguguuguuguuugaccuccucugucguggaaaucuguucacuuuucugucuaugccacauaggcuggaacccagcaaauauuaaguguucaguguugcagugaaggaagcuuugucuguuuaauuuacuugauuuuacugugaaaaacauuaguuuccagaauuacuuggaacuguccguuagaaggcagaauuuuguggagaugugcuuuacucuucuggagacagaagaguaaagccaaaugaggugaaagggggugaggagaggaaacaguguuagugcagacagacagaaauugcugccuuucagcagucuucacugcuccugccccaugguagcacagaggaaaaaaaaaugcucuuuuccuuuacuuuucuagaacuuaaaauaaaucgcagcuuuuuuguuuuaucaacuuuuuccuuaccagucuuauaaguuaguaaaacaaagaagcacauauuggcagcauggcucucucccccuuguugguauaguuagagguugcauuacaugugcauugccucauuaauucucccaaacagugcuaugaaaugggcauggcuaccauuaccguagcaguggggacacagggauuuucaagauguacaagaguucaaagccagacaguuauuauauaugcuagguaagugcuuuacaacagagcuacauuuccagacccaaacuacuuguuuucaaaccucuucucaacuggucuccugcuagguguggccacuaaggguuccagguaaaauguguuucuaggcauugggagcugacacguagaaauggggucuggaggaauagcuuagggaauucacaugauaaagcacggucuuucaggauuugcuuaguugcuugaggauagagagugaggagaggccacagcaggcauacugcuaagaugcuggggaugggacugggguuagauuugaagaagaggauggagagugaagauccgaaacucuccuaccuccuccccuaaccuauuggcuuuucuggcagaguucaccagagggauccuagagaaugauugcugcuuuggggggauaagacaaggggaugagugggaaggaagguggaggagaugugcaugauuugccagagauggggcagagaggaagaggagccugcaggaagugaucugcuauagaguuugaagugauacuggggaauuggauuuggaggaaaaaaaaaauaggugaagauguacagguaccuuacuugcuuccagggcugugugugccuuccagggagaucuggauucuguuuuaaaagaauagacuggcuaacucuucucuucucuucucuucucuucucuucucuucucuucucuucucuucucuucucuucucuucucuucucuucucuucucuucucuucucucucuuccucuuccuucccuccuuuccccucuuuccuucagacuaugaugguugucucuugacacaacuauuuucuaagcucccuauauugcaugugagggguuugucucuuuugauagcauuguuucaaagugcuaauccuuuuagaaaccagagcuacuagugggucacagcauuugaaugauugugaguaguuuaaauccuguuuuuagagcuucugguccuuuuuuuaucauuagagcagaccccuuuuagggcuggguuguaaacucagaagggucugagcaggaguuccaguucuguaguucucaucaagacagugugaagaugcagaguagcaccuguacuaucccagugcucauucagagcaagugaguagguguccaggagagcagcugcaggaaagagguuuucuguuuuuacagagaaaaugcuguaauagcagaaguggcucagggcuauaccagccuccaagccucugaggcacuuugaccugucaugguccuguuguuuagcuucccauugcuacccucugcaaugagguagguauguuuuacuguucuguuagagggauugaagguuggcauucagauuggagaggccaaaugaauuuccagaugggacuugcuuucuuuauuuucauaugugugaucuauauguacuggccuuaggcaacugccuuagcacaacugaaguguuauaugcucugggucauauaaugcuuucagcauuuuuuggucuccauguuuuuugugcauggagauagcagagccuauauuaaauauuagauugaugauuuauaagucacaaauauaacaguuucuuaacaacaauaccagagcacaagauaauuuuauuuuuguaguuggggaaucauacacugcuugaagguggccccauaccucaacugggggcccugucuaucuacuggaaguggucucuucggguuccaucucccaaccugcucccccuaccccugcggccuuuuguaauuauuuucuuccaucuuccaugggaaugaagcauccucacuugggccuuccuucuuguuaaguacauaccaugcagguccuuuugggucuggguuaccucacuaaggauuucuaguuugauccauuugccugcaaaauucaugauauauucacuuuuaauagcugaguaguauuccauuaaaugaaccacauuuucuguauccauucuuugguugagggacaccuggauuguuuccaucuucuggcuauuacaaauagagcugauaugaaacaguggagcauguguccuuguggugugguggaccaucuuuuggguauaugcccaggagugguagcugggccuucagguagaacuauuucuuaguuucuaaggaacugccaguuugauuuccugagugguuguacaggcuugcacucccaccagcaauggaggaguguucuuucuucacauccucaccagcacgugcuguuacucgaguuuuuggucucagccacucugacuguuguuguuguuugucucaugagaucccauuucacuuccauauuccuacuuagagucuaccugagccuauguguugaaacauaacccuuuucucuaguuuuuucagaguauuuggucuuacguugugauaauuuccauuuagagacuuuugugagguaaaacagacaaagaucuaguuucauuguucuucauguugauauccagauaucucaacaccauuuauugaauaugcugucauuuccccaaaguauauuauuuaccucuuuucagaaauuagguaguugaaguuauguggacuuacguaugggucuguauucuauuauacuaaucuauaugucugcuuuugugccagucaugcugucuuuauuacugugguuuaguaauauuaucuuggaauugaguauauuugucuuauaauauucuuuuuuucuuaaaaaagaagccccacaagacaacacacuauuuaaaaaucuaugaauacuuacucauugauucugauucaguaaacauuuauauaauaugaccuugccugacaauccaaauauaaauguguuuguuuuuuauacuaaguuauaaucuguagaggacucgagaaacccaugauaacaauuguguaagucacaaguaaauuaauauauuuacaaaugggauaccauaaggauacugagugaaucaaagaguaaaaaacccaagaaagaaaagugagauauacaugcugugccuuaggugggacauguuaaaguuuaguucugaccugguagauaugacagucuccucauuccuucagacacgcaucugcuuagucagacuucuuccugacugucuuuuaugguuggggacauuucuacaugcaguuuucuuuccauguuucugucuacuauucaguauucaaaggucaucugacucaugcccugccuuucaugaagacaccccacauacaccaucuucccaggaugccuccugagcucuucugacucaugguaguuacuggauugcaggacauugcauucuucauuaccuauuucuugugguggcaggaauugcauuuuaggccagcucugcucugaaaucaacuuuauguacuuagagaaauguuuuaaucuuaaaaucugguaagaugguauauuccuucauucucaauccagcagcucuccugcaggccuucaaggaugucucacuuuccucaacuccucacagggacuuacauaauugagauuagacuauagucagugagaucagaauggccugacagauugaagucucuaugugaaaagaaucaugaaggaauaaucuuuuuuaauacccagaaucuucuaguauagacuuuuucaaguuccauaugguucaguugauaacuuaaccacuuucucaagaaaauguagacuuccacaaaauguuccaauuuuguacuuucuuaccucaaaguuuagugcgagucaguucucaucauaacaccauacuccuaauguuauauuccauauuauaguuugagaaccucaaggagucccaaaacacaacuauuaaaacauacuguuccauaaaacugacuauauaaucauguaauuauaauaauuuaugcuuaggauuauggugcuagucacuugaauuuggcauacuaguagguauggaaucagaaauguccccaauacuuggugguaggucucuaggcagagagaagagugaccaggacaauuaaaacaaaaacaaaaacaaaccaaccaacuagccaaacuaccgaaaaccuuguaaaaugugcagauaugaguuucucacauacccagaagcaguuguauauguauugcaaauuuaaacauauauguguuuuagaacuagaaaauucaugcauuuuaauuaaauuaaaaauauuuuuuagacaauauauuuugaucauauucuuccucucuuccauaugcuucccaaauucuaccuaccucuuuacccacacaaguucacccccccccaaaaaaaaaaccccugaauaaugaaaaucaagccaaccaaccaacgaacaacaauagcaacagauccacuaagaccaaaaacaaaccaaccaacccaccuacccacccaucaaacauugaguccauuuuguguugucagcugcugccagccauggggccugccuggagcaggcuucguauacccagugauacuccauuggagguaauggauuuuccuuucccggcaguaucaauuacagauagcuucuugaauuaggggugagccuuuguguucacuucuccuucuccaugaugauauuuucugguuugaacuugugcaggcuuuguguguucuguuugaguucauauguguaucagcccuauuauuugugaaagauagaagaucuguuuccucggagucaucuaccaucuuuggcccugacaguuuuucugcuuucuuuuuccaaauaaauccccaagccuugaggggaaggguuugauagagacauuccauuuaggacuggauacuccaaaguuucucacucuguacucuuggcaacacuguucaguuaacucuauguuaauuacugucuaccacaagaaacuuuucugauaaggguugaguacugauauagcacuauaucacuagaagucauuuuguugccauguuccuuuagcagaauaauaguaguagguuuuuuuguuuguuuguuuuuugcuaggacccaugaccugucuagucucagguucuuggcuacuuuaguagugucagauaugggauccauuucauacccagcgugggccugaaauuauuuuguaaaguuacugauuacccaccccuauagccuuggcagcacuguugcacuaguauauuugcagguaggucacuguugcaggucauaggguuuuuaauugggugauaaugauuacuuuucucuucugguagcaugcaaaguaccauucagggccacgaagacugucaguggggugaagcuucuaguugggcuucagcuuaauuucuuagguuugaugguauaguaaguggugucuucagcuuaccaucaaacuguggagaaugaccaguauaagauauguaauuggggcacugucuccuccacuaugugaugacuccauuuaaauuccuuuuuuuaaaauauacauauauaauuuuaggaagcuuuacaguaguagguucccuuuagcuuucaaaacguccuuagaauuaguuuucccaucccauauucuguccuuuucuugcccuccuaucaucuuccuuguuucaucuuauuuagcuuuuccuuuaucacuuuuuaacacuacauuccauuuccucuuucuuggaagauuucuuccucucauauggccugcaguuaaccucugugguuauucugauugaacacacauagcguaauaguucuugucauuuuauauuauuucuguuuuucuuucuguggcugugauaaaaugcagaacaaaaacaacuuggggaggaugugguuccuuggcucaagccuaucaucaagggaagccaaggcaggaaacccagagcaauaaccugggaaaguuaaugaaagguaaaagacuucaugugccagguggagaggcagaggcaggaggaucucugugaguuuaaggccaggaugguuuaaaagcagguuccaggacagcuaggacuguuauacagagaaacucugucucacaaaaccaaacaacaacaacaaacaaacaaacaaacagacggaaggaaggaaggagagagagagagagagagagagagagagagagagagagagagagagagagacaaacagacaguggguaaguuaguuaugauuuucagauaugcccuucagaguguguuucuccugugugagcaaaacacguauguuuauuuguuguuauuauuuuauuuuguuuuugucuuguucaauggaaaauuaucuuuauuguaucccuacuagaccuguucauaaaagaucuauggaaaaauguaaaaugaaggauaggaaaacuuagcacuuggucaucauuauacaaaugaauuucaucaaauccuaauuaccugguauuaaaauuagaaacuggguuaauugauuuuuuuuuuuuugguuaaaaaaagauacucuaagugugaacauguuuuaaugauaauuguaaugagcaguuuuauaaugaacaagacugaaaguuagaaaaugacacaaugguauguuuuaaaguauuuguguuacauuugugugugcauauuuauguaugaguguagaucucuguacaggugugcacagugugcagaaccugagguugacacuggcuaucuuccuauaucacucuccaucuuaguuuuugaguuauaaccauagagguuagguagcuaguaaguuuuuaaugugcugauaggcacgugugauugucccugccuguguaauugcaggugcacugucauggcuggcuuuuaugaauacuggagaucuaacuuaggcccuugcuuuacugagucuccuguuguugacuuuaagguaaagauaggaauuugguacuaauugaaaaucacaucuguucugagugugcagcacuuaaggugaagaaucuaguagaauuuuaaaugucuauuuauuacauucuuaaaugagacuuauaagucuuuuuccaauuacaagucauugguuaucaaacuaaagaucaugggauuuucugauuuuaauguuauucagaucaauuaaauuugaaaauuucagccuaaaaugaauaguggaagagauuuaguaaagcauuaagacugaauagcaaaguuaauaggauucagaaugcaaaauaucuuagaaaauguuguuuuguucauguaggcauauuguuuuauacaauuuuuuucuaguaaaggcaaaugugauauuuuaguaaaauaguugugaaauuugaaaggaaguuuaauuuuucucuaaaauccuuauuuuugagcaagagcaguuuuuuucuuuuuucuuuucuuucuuuuuuuuuuuuuuugcuauaagaauguagaaugaucugucccuuuugcuuuuuaggauuuacuuauuuuuauuuuauauauuuauauauauauauauauauauauauauauauauauauauauauacacacacaccauguaccaugugcgugugugaugcauguagaggucagaagagggcguuuaauccccugauacugcaguuacauaugguuaugggucacuaugcuggugcugggaacugaaucuggguucucuuucaguuccuaaccacugaaccaucucucuaguaucucccuccccacauacuuuuuauucgaaaccucuuacuuacccuagauagaaaucuuguugaaaaauucgauuuagaguuguaauuuauauuuuuucaauuauuaauuuuuuacuuuuuuguuuguuguuuuuucauuuuuuuauuggauauuuuauuuauuaacauuucaaauguuauucuccuuuccuguuuuccccuccagaaaccccauccccuccccccuccccccucccucugcuucuaugagggugcuccuccacccacccaccuauucccgcuuccugcccuggcauuuuccuacacuggggcaucaagccuuccuagaacgaagggccucuucucccaucgaugcccaaaaaggccauccucugcuacuuaugugacuggagccauguggugguuuggucccugggagcucugggggaagugggaggaaagguuuugguugguugauauuguuguucuuccuuaugggguugcaaaccccuuuaccuccuucaguucuuccccuaacuucuccauugggaacuccaugcucagucuaaugguuggcugugagauccuccucuguauuugucaggcggagccucucaggagacagcuuugacaggcuccugucagcaagcgcuucuaggcauucacaacagugucuggguuuggcaacuguauaugggauggauccccagguggggcagucucuggauggucuuuccuucagucucuguucaacauuuuaucuuuguauuuccuccagugaguauucugucccccauuuuaagauaaguguguccacacuuuggucuuccuucuucuugagcuucaugugguuuaugaauuguaucuuggguauucagagcuuuugggcuaaaauccacuuaccagugagugcauaccauguguguucuuuugugacugguuuaccucacucagggugauauuucuaguuccauccauuugccuaagaauuucaugaaguuguuguuuuuaauagcugaguaguacuccauuguguaaauguacuacauuuucuguauuauuuccucuguugaaggacaucuagguuguuuccaacuucuggcuauuauaaauaaggcugcuaugaacauaguggagcauguguccuucuuccauguuggagcaucuucuggguagaugcccaggagugguauagcugggucuucagguacuauguccaauuuucugaagaaccgcuagacugauuuuucagagugguuguaucagucugcagucucaacaauggagaaauguuccuuucuccacauccuugccaguaucugcuaucaccugaguuuuugauuuuaggcauuuugacuaguaugagguggaaucucaagguuguuuugauuuguauuucccugaugacuaaagauguugaccauuucuucaggugcuucucagccauucgauauuccucaguuaagaauucuuuguuuaguucuguaccccauuuuuuaauaggguuauuugauucucuggagucuaccuucuugaguucuuuguauauauuggauauuagcccucuaucggauauaggauugguaaagauuuuucccaaucuguugguugccguuuugcccuauugacaguguccuuugccuuagagaagcuuugcaauuuuaugagguuccauuuguugacuguugaucuuagagcauaagccauugguguucuguucaggaaaaauuucccugugcccuuguguucgaggugcuuccccacuuucucuucuauuaguuucaguguaucugguuuuauguggaacuccuugauccacuuggagcuuuguacaaggagauaagaauggaucgauuugcauucuucuacaugcugacugccaguugaaccaguaccauuuguugaaaaugcugucuuuuucucacuggaugauuuuagcuccuuugucaaagaucaagugaccaugggaguauggguucauuucugggucuuuaauucuauuccauugaucuaccuacuugucucuguaccgauaccauugcaguuuuuaucaguguugcucuguaauacagcuggacuccagggauggugauuccuuuagaaguucuuuuauuguugagaauaguuuuugcuauucuggauuuuuuuuuuuuuguuguuguuccaaaugaauuugagaauugcucuuucuaucucugugaaaaauugaguugaaauuuugaaggggauuacauugaaucuguagauugcuuuuggcaagauggccuuuuuuuuacuauauuaauccugccaguccaugugcaugggagaucuuuucaucuucugagaucuucuucuauuucuuucuucagagacuugaaguucuugucauacagaucuuucacuuguuugguuagagucacaccaagguauuuuauauuauuugugacuauugugaaggguuucugccuuaggguuuuacugcugugaacagacaccaugaccaaggcaagucuucuuaaaaacaacauuuaauuggggcggcuuacagguucacagguucaguucaucaucaucaucaaggugggagcuggcagcaucuaggcaggcauggcacaggcagagcugagaguucuacaucuucauccaaagacugcuaguggaagacugacuuccaggcaaccagggugaggcucuuaagcccacacccacagugacggucacaccuauuccaacaaggccauacuuccaaaugaugccacucccugguccaagaauguacaaccaucacauuccacucccugguccccaguaggcuuguucaaacacaugagucuaugggggcuauaucugaacauaacauaauuaaaaaguacauuuauuccaacuuccaaagucccccuagucuauagcagucucaacaaaguuaaaaguccacaaguucaaaguuucuuuugagauucauccaaucacuaacuguaaucuccaagacaagacagaaaaccagcugagcaaauugcaaaaaucuccaugucugaugucaaagugguuuucagaucucuacuucuuuuucauuuuuguugacugcaacaaacuucuuuuuccugggaugguuccauuccguuagcagcuuuccucagcagguauuccauggcuuuggcaucuuuaacaucuuuaggucuccaaggcaacuucaauguuacaacuucuuguuucaaugucugggauccacacaugaucuucugggcuccuccaaggguuugggucacuucuccagcucugcccuuuguagcacacacccugucuucuaggcuacccauacuccacuguugcugcuguucuugguggucaucucaugguauugacaucuccaaaacacugcugucuucugcuguaacuagacuucaccaaaagccucucauaggcucuuuucauggugccaagccucaacuccuuugcaugaucccuucaguccugggccaucaauugcaacugaggcugcacaccuucaccaauggccuuccauucccucucacaaugccgagccucagcuguuccugccuucaaaacuugggugacucuuacacauuaccaaguccugcugcaguacaagguauaaccuuggcuuucucucgaacacagccucugugcucucagaaaacacuucgagaagauuucauuucaaugaugcuggucucuucuuaaucacuaauuucuuagcucuagcaaaccagcaucaaagucccaguaacacaaaguuuugguacccaauucauucuaugaagccacaauuaugcuuucagcuaaaccacacagagacccaauaaagaaggagaacuucagaucaauuucccuuaugaacaucgauggaugcaaaaauacucaauaaaauucucgcaaacugaauucacuaacacaucaaaacgaucauccaucucgaucaaguaggcuucaucccagggaugcagggaugauucaauauacagaaauccaucaauguaauccacuauauaaacaaaggaaaaaaauaccacaugaucaugucauuagcugcugagaaaguauuugacaaaaaguaaacaccccuucaugguaaaagucuuagaaagaucagguauucaagacccauaccuaaacauaauaaaaauaauauauagaaaaccuguaauuaauuaauuaauuuauuuauuuagguauuuuccucauuuacauuuccaaugcuaucccaaaagucccccauacccucccccccauuccccuacccacccacucccacuucuuggcccuggcauuccccuguacugaggcauauaaaguuugcaaauccaaugggccucucuucccaaugauggcugacuaggccaucuucugauacaugugcagcuaaagacaagagcucccggguacugguuaguucauauuguuguuccaccuauaggguugcagaccgcuuuagcuccuuggguacuuucucuagcuccuccauugggggcuauguguuccauccaauagcugacugugagcauccacuucuguguuugccaggccucggcauagccuugcaagagacagcuauaucaggguccuuucaacaaaaucuugcugguguaugcaauggugucagcguuuggaggcugauauucuagggucuauuuuacuuuuuuuuuaaaaaacacuuuuaaaauuaggugacaaaugaaacuuuagacaauuuguaauuuaaguuuaaccagaacugaaauaguuacuuuaauuaacagaagaaauaguuaauuuaauuaccaguggucuaauuaaaguauguauacuggguuaauuuuacaaaacacuagauauuagcucuguuuugaaauguauacaagcacucuuagccacugcaguacuguuuuggaacuuuuccaugguacaaaacccaaucuuuaaaugaauaacuucuauuucauguauguacaugacuuauuucccuguauuauuuaguuauguucagaucucuuuggaauauaaacaugaugaaagcuuacuaguuuuaucaaacaaaauuauuucuuugcaacagauaauuaauauucacuauuuuuguuguuaaguguuauaaggagguugaaaccaaauuuagcuucagagcaaauauauaucuuuguugagauuucuuuugaucaaauccaaauaauaaggcaugcugacucauuguuaucaccagaaauauuucaagggauuacaguuuucacuccaaauccauuaguucugguuaacaacacaaagaagaucaaagucuuauucuaauagaguagacacucaguugugaacuaagcgcgaugcuucuguuguaccuguccugcuuucagccuuauaacacuguagaucaauguuagccugccguccagaguaccgucuccuuuccuuccugggugauguaauacuuuuguggccugaaauaaaccuuuuguacccaaaagacaguuacucaguuuuuguuuagcugcagaucaccauuuacugagcaugacuagaauguuuuuagacaucauaucaccuaaauuuaaugauccagagaagugauucagagcacuaauguccacguuaauugaaaacgacuugagguaggucugaagagagaauaagcagcgugcagcucuuuuagagaguuuguuuucaguucucacauaagguagcucauaaucacguauaagugcagcuccgggggacuugccauccuuuuuuguccuacaugggcacauagguaccccucauuccuuuacaggcauaaacacauacauaugaacacaaaaucuaaaacaaacaaaaaaaccacacccaaaaccaaccaaaacaaacaaacaaaaaacaaaaacccaaaaacccaaaacagagugaaaguggcuugcauagaucuauuugacuaugacuuuuuuuuaaaaucauaaagccauaugcauaaaaaguaaguacuaagaaugauggcuauagaacaauucuuguuaguuauuuauuuuuaaauguauagauguuguccacaccuacauuuauuuaaaagguaaaacauauuagcaguuguauggugaaucaaaccucaagaaucagucuagucccuugaugauauuuuccuuguguauuucagcuuuuguauguccccagggagaguuugguuuaaguguauuccuugugguauguugcuguaaguacauaccacacaauacacugauucaaauguaaaugcauucuuaucuguuuagccaccagacuugcuuauuuaaacacuaagauacauagguuuugaaguuaccaucucauacuagaguauaaaguggaguuggguuuauugcagcagcaccauagucuuuacuagaauuaucaacaaguucucuuuaaaucuuaugcuauaacugauguauaggaaaagacaucugagccaguuggugguguaauauguaguugcuuguuugaggauagauaauuuuugaaucccuauccuuaccaaauaugcaguagucauauaaucuuaucacgagaauggugucaucugaccuuggcuggaagacuuauaaagacugaaguucuuaguuuuaguuuuccuaguaacuugcucuacaaccuauaggaauguguuuuaccuugccuucccaagaccugcauguauuuccuuacuugugugcguggcuaaaaucuguaaaauacggguuuuagcuagguauuuuugugugcauuuaguaaaaguacguaaaacuuaaccaguauuuagcagacagcaugguaguuuuaaaugcuguuagacaacagauccuuuucaucuugcagaacuguacccuagauccacugaccauauccuucacccccauauucagcccucuggcauuacgguuuuaauguaauguccuccaaaugcuugugaguuguaaacuccacagucgcaguguuaggaaguggcuuuagggaaguaauugaacauugguuuuuauuuucaugacuggauuaauccauugagugugcauaauuucaugaacuauugggagaugaugaaaacuuacaaacuuggauuacagaaauuuggagaggaucaaaauaaugcaagcugcaacagaauauucagcuuccuugcaggauauaaauaaauaauaaauaauaauaaucuuaaauaaucuguaugauagcacuauauauuaacaguauacacagauaguguucaguucagaagaacaaaaaguaaaagucucuaaccaagaauauauugaagauuguugggcauacaaagauaugaucuacaagaguuuuucuuuuaacacugcagacagaaacauaaacccagauuuuucuauguaagaaucgguauuggagacaaguggucaaacuguggcauguuuguaagaugucuucacaguauuuccuauaaggauuuguauuuauuuuugaucugauauauacaacuauguuuuaagcuuauugauucucuuaaaaguaaauuuuguaccucuuuagucacuuugggaugguaaauuaaaacuauagguauucuaaaaccaauuuuuuuaagaacuguugagauuggaaguccaauauuaaggugcuaagaacauugagugucuauuguugaucuaguuauugcucugaauauaguuggccuuuugcuauaauuuuacauggaagugagagaguaggagugagaucaaauaggcagacagagagggagaagggccauaauauagcaagguaauaaagauacugaacuucaaagaugccugucuucuuccucauucuuccaacugagacaaaaaucuagcagauuaaaacaaaaagccugguagacuuuuugucaagcugacaagauugcucugcugauggacuacccaagcuuagggaugacaguuaaggguauguuugccagaguugugagccugucaaauugaugaacucuaauucagggguggaaggcagaagauccucagaagauccuuaaaagccccaguugucaaggagaguccuggaguucgagguccugauacuucagcugcuuuguagaaggucuuuguguguguguguguguguguguguguguguguguguguguguguguguguguguguguguguaggccuuagcagugcaugcuuccucacaccucauaaaagccuuuuugucugcugcaucucagaguuucccugcugccuguugugauuuagguuuuccccuccuuuuaguuuguuaaugagcagagaaaaugaaccugaucuagauccuuaaaugguaacaguaaacacauaaguggaugcucacagucagcuguuggauggaucacagggcccccaguggaggagcuagagaaaguacccaaagagcuaaagagaucugcaacccugcaggugcaacaacauuaugaacuaaccaguaaccuggagcucuugccucucgcugcauauguaucaaaagauggccuagucagccaucacuggaaagagaggcccauuggacaugcaaacuuuauaugccccaguacaggggaaugccagggccaaaaagugggaauggguggguaggggagugggggggagggcaugggggacuuuugggcuagcauuggaaauguaauugaggaaaauacguaauaaaaaaauuuaaaaaaaaaagaaagaacuugcuaguucucaggucuuugguuugguuugguugguuuugggagacaggauuucugugaguagcuuugccuacccggagcuuacucuguagaccaagcuggccucagacucacagacauccaccugucucugccucuugagugcuggcauuuaaggcaugcacucccacuguccuguuuucuccucuuaaaaguguuuuacaaguacugacgucaucgucaaauuuuguauucuucagugaccuucuuuguugcauuucuguuguaccaauuuaguuaaucacuucccugauacaacacuuaagugcguucccucagagagcuucugcuaacacagugacauuuuacaaucaguugugaguugaugcuagaugcacaagaguauacuuguguugucuacaaugaaaaugagucuaaaaggaaauacagugaugguauuauauuuacaaacugucuuuuaaacaauuuaugaaaucacaaaaagauagaacagcuagcauauacguuuuuuuugucauuaugaucagagagaguauacauccaaguuaaaacuuccuagaaauuuaugaguaacuuguagcaucuuuguuuuuaugguaaaaauaguguuuuuaaaauaaaagcauuguaugugcagcuuaucuuuucguaauacagguguuacacauuuuguuguuuuauauuuccaauccuccuacagaaacuaagaaaggauuaauauuaaaauguuuuuuauucuaauuuuucuaaauugauaguaguuagaaauuguauuucugaaaagaauugcuaccuugaauuuauuugucauugucauaaauggaggguaguacagaacaggcacuaugguggguaugaucugacuggccagaaaauaaguaagaccuaaguauugauuauuacaaaucuaaauaauaccauuugacaguaaaauuuuauucugaauuaccauuuucuuauaaauauuuacauuggaauaucaagugaggucuuauuaccacagcuuaccuacuaauauauuccuguuuuauuaaauuaagauaaucaaugcuaaaaagccauacuaaaugauagauguuauguaguugaacaaaauaacuuauuugaacucuuaagauuauagauaacucucaaagccaaaagaacagcuagaaauuagagaaacccccaggagccaguugaggagguaggaccaacugccuaaauauuugguuaaguuccacauuuuacagacucaagcaggacccuuagaaaacuuuacuuuaaaagcacuacuuagaagcuugagaacaaaacagauaagcaucuacauacauaccauugauuaauucauuuuuaguauaaauucagcuauucauagaaaaugggacaaaaucaaguuucuguaguauguucuuugcaguacccuauaaaaguaucagauguauaauuaauaucauguauguauauaauucauaaauaagaaaaggcaaucaguagaaacugccucuuagccaucuugaaauuuagcauagacuuaacuuaaagaaauaaagaaaaagguguucaucaaaauaaagaaaagugggauacuguucaguaacuguuaaucuccauagaccaauucuaacuguauaaaaaccaugaaagaaaacaacaacaacaaccaggacauccuagaacuaaauguguaauuacucauuuauauuugcuagggagcuuguagcacguuaucaagagaaaaggauaggucaccugaagaucucguacaaauaagccuauucaaaauuagaaugaaaaaugaagaaaaaugaauagagcuuaggagacuccugaagaaguccaguacacauuuaugcauaauccuguuuguacaggugagaaaguagcuuaaauauguaaagaaauaauggccaaaaccuuaagaaauuuagugauggauuaauuuauucguuaucagccuuaaucacuugaauaaaaaaucauuagguuugucauacuuggucuaaaaagauuuauaaagauguuaagugaaggaagcuuaguaggcuuucaaauuugaauccuauuuacauguauuuuuuuuaaauucauguagcagcauuuuugucuaaauaucaggugaucaaacuaauguuucaaaaaccaacuugauacaagugaugccgucgcaggagacucagacugcuacuuuuccuuuccuuuguucucugcuuccccaaugcuccuggucacauuauuucuacacuuacauuccagugauguaaagacacuucuuacagaucuaauuguauuucaaaauuuagacauuuguuauaaaaaucagacaaauauuucucauuacugguuuuugauacuuucaacuaauacuuuugguaguuuugaacucucugucuucugucucugucuuucugucucugucucugucucucucugucucucugucucucucucucugucucuguuuccuccgucucucccugucucugucugucugucugucugucugucugucucucucucucucucucucucucucucucucucugcauguguguguguguaggagaauuagacauugugcuuuuuugauaauuaaguuacauggaaaaaguaaaacugauaacuucuuguaaguuaaaggaacucaauagaguuauacuuucuggauuauauuuguuguaauuuugaaauaauacagauuuucuuugucuuuagaaauguugaaauucuaagucuuguuuccaggccuuuauaaugaauuguucuaauuugggacuaucagaggaguauuugaaccuguacugaaacuugacuauugucagcuaaccuuuuaugucgugauugucccauuaucaguugacuuuuuacaucaugauuuuccuuguguuuucuuaggccagagaugaagaggaagccuuucuggacuggagugaugaagaugaugguggguuugauccaaguacacuuccagauccugacaagcacagaaguucugaagagucggagagugaagauacaaaccauaagaugagguauguucuuacccuuagccucauuaaguaugaauuucacacauagacccuuucuauuuuaaugaguccagugaugacugaauuauuacuucaagagauuuuuuuuuccucuaaugcccuauaaacuccaacuuguacuuguuuugccugcaucucauacucuucugaucauuuuaaggauuuggguuaauuuuauuuuuauaauuccuguuaucauaaauaacuaugauacaugaguucuguuuucucauucuucccccuuuuuucuucucccucauucuuaauccuuuauacaugaauauauaaauuacacuaaauaugaacaggcaagguuuuauugauaucaauggauuuugaugagaaugcuacuaaaaauuaucucugacuaccagauucuggugguacauaccugaaguuccaccacuuaggaggcugagaagggaaagucaccauaagcuaaagaccaucuagggcuggacaagugacuucuaaggcaacacauaaagugaaaccuuauuuuagaaaacaaaaaacuggacuagugagauagagcagauaaagguacaggcagucaugcacgggagaacucgauaccggacucgaguaaguuguccucugaccuugacuacaguaaaaucuucugacuucuuacagagaacaaucuacaauguuauuucugacacucuucuuuaaggcagcccaaugaagaucccacuagggggaguucaaagcagagcaaagcaccccuugggcuguauaaaagaacaaauagcaacagacaguaauagcaucaccaagucugacccucacaauguccagcagaaacaguugacuagggaaauuuggaguuccuaguuguccucucucucuguggaugagcuucuuugucuacugcagggguuuuuauaucauaguuauaaacacuacuagccucuguuggaaauuguucaucuucuaccuguucucaagggcacaauaguuuuucucuugaguuuuuccugccauccuuuccugucacagaauuaugguuugggguacccaucaccagacaagggguguuggaggacuccugacagaaacaugccugggugugaagugaggagaccagauuacuuccaucggcucaauaaucucagacuguaccggacaguuuuccaguauaauguauguuacagaucucuacacguggacacauccucuauaaccccuauacaaauauaugaaugaauggauauguaaguaaauguaauuuuuaaaaaucaaaaguuacggaaaguuaagaggaaauuacacuuuucuugcguguaaugauuaagaacauucaagccaugcuauugcaggcuacugucuggcuacucucugacugccacaguuuuccugcccccagggcagaccccauauggcaguccaccaaacuuccuguaguucccuugccgcagaaccacuguacccagucacccauggcuagcugcuauuacacugaucggcagucccucauuuccgugcuucgcugggggcgcacucucgccaacccuugcucagcugcgguuaccuucaccuggagcucaauugaguugcaucgagauggaaaacaccacacaaucuuaguuuagaaucaacagauaacacaaucgaugggugaggaaucuaucauucuaaauucaccaacuguucuauguuagaaauuuuccaguggcggauccugguggauuccagaucaaacaguucccagucaacaucugucugcuuugcucccgcugcuccuuccaaaagggcgcuuuccuuuuccugcauucccucuuccucucucggacccagaagguccgccuccuccuugccaggugacuggcuucuugucuucuucauuacucaaucaggcaauuagggaaaaauucugcuacauacuuucauauucuuuuuucauauuagccaauaaaauaauagaacuuuucuauguaaacaaccaaauucuuuccauuuauaaucuguucauuugucuaucuucuauuugccucuaugccaaaauuaaaugaaaugugguaaauugaauaauaauaugaguuaacuuaguaauuuuuuccagaguaccauguaucauaauaaccuuguauugaguauuaaguuuauggauuuucuaaaucacugaauagaaguuagguagcaaugauagauaguuaauauuuuuggcgugaagacaaagguugaugggaccccucagauagcccauggagucuagaguugaagaauaaauaguccacagaaaauauuaaaaaucucaaacaaauuaucuucuuggaaaaccaaguagauagacucugaguuagucuuuauauaaacugugcuuauugguaaaaggaaaaauuuacuuauccaaaauguaguuauguuaggaccuucaacaacuuucuauuagguucaggccauguuucuaauauuuagaagugacuuauaaaaauuaaucagcacacaaugcuuuauaaagcuccuugacgcucaugugugacaucugaaugguccacaugcuaccuuaaugcucauagugaaggcugucccuacccccauccauuaaagacuggauaugggaucucucuuuugauaacuuggcuuacaacaugaguucagauguuucuguauaauuuaacucuguaggagcauaucauuugguuucuuauaguuuguucugcagccauaguuuguuuguuugcaugauacugcuuuaacagguagaacaaaccuuuaaaguaucagcaauccuucuguaucugauucugaccuuuuguaucuuauauuuugcuaauuuuuuuuagacauucuaagaaacacccuggguagaaauaauuuuauuaggauuuuaaaaauuauaugcauguuuguaccacuaaaauaugugaucuagguucaguuucuaagucaucauucacaaggcauuguauuacauguuucugucauuguuaccacauaguagcacuuccuacuuccuacuacagcuaaugcgguuuguucucuaauagucucauauugauuuuuauaauaguuuuaugcuuuuaauuaucuuucagaaagacuugacuuuacaugauuaucuauaaaagauaacacuugcagcuccaguuucuguucucacugucaguacuaaugacaugaauauuaaggccuuuaaauauuugaauucuuaaucgauugauauauaaguauacaucaauacaagcauaaggguaagaugugcuacucuuuacaaauacaucaauaaaaguagaaguauaagagguuauauauuugguccuaagaguuugaauaauauaagaaacaacagaauguagaugauuauaagaagcuaggaguggauagugauaaaggagauaggguaccuugaacaauaccaaaacauuuuaauauaagauaggguuucagauggaagauaguuaaguauuacaugaaaauuaagacaguuucacuucaggggcagcuaguuaacucuggaagauuaagguuacucagguugcuugauaguaaagaaauauucuuuguugaaaagaguguggacagauuuuauuccuucaauauauuuaagagcucuguguguguguggugcgugugcgugugugugugugugugugugugugugugugugugugugugugugugugcguguguguguguguguggugcuuacuacucugcugcagagccguugcuguuacccugagaguuggcaaggaagccugcacccaugcagccuuuucuuuucucagaugaagaaacaaaacuuuuaaauaauuuauguucauggucacagaaaauaucaguguaaaugaaacugauucccuaguucuaguccucaugccaaacuuacagucaaacugccaugacuguaagagagauugaucaggagaacugaagacacauuugaugaugcuugacugaagaucuggguucaugucccgacuagcuuuaggauuguggauauucuggcuuagguaauagggacaguuggggacuauagguaauuucacauuauguguggcuaccaggaguagcauaucccccacccucugaguugaaaccaaaagugucuuuagcuauugcuagguguuguugggaguuggagcagcaguguuuauaguaauucagagucacuguacuagauucuaguuggcaaauaccauaccacugcuguuucauguccuuauggaagauauauuuuauuuauauuucuuuccaaguagcccaaaucaugcuucuuaacauauccucuguuacucaagaugaagugagacacaagguaaacccuauuuaucaucccuagaauagaaagcaggauuuaugacaagguacaaguaguagucgucuauaauuuagcucaaauauucagaagaccaaucguaguaaauuuuaacaguaguaauugcugcaccuacuacuuuuuacagaaguaauguguacagguguccuguguuguuccaguugggcuacaucuuuucuuugcauguugcagacuuaaugauuuacuaagguuuugagaugucagcuuacugcauguuuacagauuuguuugcugugcucuuucuggguuccauuuaguauaaacuauucucacgcugaucccgguuaucauggcucucccagaagcauauucuuugguuauaaacaugguguuuccaaagaugaguucagucuuaagggacuagauagagcaauuagaaaauagcagugagucuugaacuaguaugaauugguuucauuugaaaguuuucuuuguugcuguucauaaacauucaucauaaauaacacuuuccagucucucuguggaaaaacacuuugucaguaagaaggugagccugauuuagugaagaaugaccaaaucuguggugaguaguucuuccuuagggaagucugacaggauuuaaaaaaguuuacauuucugucucuucaguucauuacacagcugcagaggaauuugaaccacccucaggccucuggaguuauccccagggcugccucucucgugcugagguuccagaggguucaggugcccaucauuuaacccuuuuacuuugcacagcagagacagauuuugucuguugugguccuugaacauuauuuggccuugaguucucuuuaagacuccugcauagggggggagagggagggggaggggcagggggagggagagggagaggagaggagaggagaguuuggcagggauagaaaugaugaaaauacaguguacccaugugugaacuuuaaacaagaaagcacccuaguuuauccccagaaacagcugaaaagggggcaaggaccaggaaaugugcucauaauccaggaggguuaguaccgggucagacaaaaaagcuuguuuucuucgaaucuuuccucauuuucaucuguuuaaaaaaaaaaaaucaguccaguuuucucuggcuuuucuuccaucucuuuccuuuuugggccuguggaauagaguucauagauguuaggguuuuuuguaguuauuacuaaaauagaggcaaaacaaguucauaggaaaaguggagcuuugguugguugucuuuguggcauuguuccuuggucuguugagcaguacauagucauuguucuuaucgccaacgaauuuugaaguuuguuuaucuuuaagcaggaaaagaugugcaauugccuucgggaucauacaugauuucaaguaguccauguauuguagucacagugcuugaaugauaaaaaguauuuaucucugugguagaaacaacaacaguaagaauguuuugcauuauuuaaucuacauucuacuuaauuuauaauaucaaaagugcuuguaauuccaguucuaggauaucuguugucuucauuuggccucugccagcaccugaacuuaaauucagauaaacacacacacacacacacacacacacacacacacacaaagguaaaauaaaacaaaaugaaaugaaaugccagauuugcuuguaucuugagugacuguaauuuuucuuuauucuuucuauaaagaaugauuuaguacauaucaugugcuaucuauaauaaauacaggcacagaguacaaaagauuaaacagaaaauagcauuccuggcuuccacagagcuuuuaguucaguugugguuccaaagaguuaguacaugguguugaaacuugcagaggaugaaugcugugauuugaaugcccggagaugugguaggaaggucagacauaggaaaugaugggucucacuugaaccuagugggucaggaaguuuccugaagagaguaacagcuaagcuacucuugaaaucugaaccagacagggguggggugacaauuguccuuuuaaagucuuucaauaagauuguuucuuuuaacugugucuuauaagcuaagagauuugacacuuuacauggaguauauuaauuuuuguauauacagucccauucaucauguuagguuuauguccauccuuaugugaauuauaaaugauguaaaaguuuuugaaauauuaauaugauuaacaagaaauaccuggauguucuagacauuuauuauccaauaaaauugaguauuuaauauuuauaaccuuaagauuucaaacaaaaaagaaaauauuagauucuuucuaucuuccuuuauucuuuuauuuauagacuacagccuugaaccaagauugaucccuuuauaagaaauugccagguuaaaggggagugcuuuccuagcaugcgcagggcucugacugggacuggcagacgacacaggaauuguuguauaguggauguuugauagguuguucuaaguagcauaagggcaguuagauuuauaccuugugcuaaggcuaguguuacaauuuaaacaugauuucucuacagaucauuucuguguuuggugacaccuuagccuguacuaaauaaauggauccaaugauuagcuguuguuaaccuguucuuaauacuaaucaauaugugcuuuugucuugggguuuuuguuuugucuuuuguguguuugguuuugccuuaaaacauguuugaugcuggcuuuauuuuugaguagauuugauugucuuuguuaaugucuuaguaacagaauuaauuuaaccucuguaguuucucuuaguauugaguucuguagcaucucuucagucauuuuugcucagcaacugcuauuuccagguuuucaguuagccuuauaauauaaagaggacucuugcaggcaggguaugauuauugugauaaaacaccaggacagaagaaacucagggaagaacagauccagccuauguguguucuuugguugguggaaagaaggggggggugguuauuaacuacaguuuucauuuaccuggaccucugcuugcugauuaaucuuauugcagcuuggcagauacagaaaaaagucaagucuaccuuauaauauaaauaauacauuugcuucauuguaagccugccauccuuucacuuuaucugucuucugucucugaaauauuuaaaaacaaaacuauuuggagaaacuucaaagacagguuggagguuuaugaaacugcccucuugacuuucucugugucucaguaauguaauaguccauuaauauucuuucccuuuuggaauuuuaaauuguguucaugcauuugauuuuuguuuggcuuaucaguguaaguaauuauuuaauaagcaacuuugaagacuugaguuggcucucuuuggaagucauuugaaaacuaaugaaguuaauaguaaauugugagacuuaauguuuucagauagugggaacaccaggaguauguuugggugcaugcuggucuuuggugugaaaacaaaucaguuaaaguaguuugagauggaagcugacguuuuucuguggaguauaaauauucuacauguagauuaguagcaagaagauguucuagcuuaagcugagauauuuaaauuuucaguaugggagaagaaauaauuacauguucaaauuuuccucagagcaaaaauuguuuuuauucuugacuccacaguuaaauguuagaggauucucagaaaucuagaaacaccauacaaaauuaugguguagguauguuugucugucuaaaagggggauccuggcucuuuaccaaauucccaaauuauuuaugaacaacaacaacaaaaagauuuugauaguuucaaauaauguguggauguuuaaugaaaggaaauguaaaugaggugugguggggagaggggaacuucucaugcccuccccuuuucuuuuccccaacccagagcuugucucauuauuagacuucugaucuaagauuauuuuuuuuagcauuuucauuuauguuuauaguaaacgcuagacaucuuccuguacuacauuuuuuccaugauucuuuuuguuccagcagaauacugagaguugagguguugagaaugcuaugcauucuucguacuaauuccauaagcauuaauagucuuugccauagaaggaaagaacugauuuuaugaaauacacugcagugaucauucuccauuaggucuguggccauggucuuauaaguuaaaauuuauaagaggaaacaucucugacacaauuuuacuuuaaaauuuaaauuuuaaagugccaauauuuggggauagguagaaaacuuuugaaguuuuuuaaaaaaugaguuagcauaugcuaacuuauuauuaauuguaaauuauguagagaaaauguccaagcuguauuuuuugacugaaggguacaaauaaagacccaaacugggcauugagaugcugaacuuggccugcaguggcuuaccacagacaauuuaagcaucagggauuuuuuuuuguuuugguuuugguuuugguuuuuuuuuuuuuuuuuuuuugguuuuucaagacaggguuucucuguguagcccuggcuguccuggaacucacuuuguagaccaggcuggccuugaacucagaaauccgccugccucugccucccaagugcugggauuaaaagugugcaccaccacugcccggcuggaaguuuuucuauaccucuaaauacccaccuuaucaucuuggcaauuagaccagucugcaauuuuaccuaauucuuuucugugccuucuaaaagagagagaaaagaggaaagucagggaaguugaagaucgguacugucacuacaauaaaaucuguuccuucagcagcccuuuguguuagauuucuaagguguacagugauguugauauucuguuuugugcugccacacacacacacacacacacacacacacacacacacacacacaccccuaccuacgccuuuccucagggcaggaaacauucucaaggcuugguguaguaguuuuaacugcaacaacuuuguaccccugauaguauaguuuucaaguuaaaggauguucugauguucccuucccacaaaucccuauauuauuuuaaaauaugguguuuaaucugagcagucuacuacucauagcagguacuaauuuuuguuuugaucuuguuacuauauaauuauauaauugccucccuguucugaaauuguguguuggcuaaagcauccuaagaacugcacuguaauuagaccugucucugauugauagaaaaauauaucauauagccaguuucuuuuugccuuuucccaugaauacauggggauuuaaaccucuuaccugagucugcagaaugaccucgagaagcauugauaguugcucuagcaacugccugagcuacacgagguucaugagcugccugagguuccgagaaucaagagacuacugaauguuuccucacaugcagcuuuggaauauugacauaaacuuugcaacaugagaaguauggguuugagaaaauuaagucuauguuaaagccaaacaaagcuuggcucugcugcagucacagcuuugaauaauuucuuuuacaagucauggagcauagacauauuacuuaagaucucuuuggcaagauagccauuuuuacaauguugauccugccaauccaugagcaugggagaucuuuccaucuucugagaucuucuuuaauuucuuucuucagggacuugaaguuuuuaucauacagaucuuugacuuccuuaguuagacucacaccaagauauuuuauauuauuugugacuauugagaaggguguuguuucccuaauuucuuucucagccuguuuauucuuuguguagagaaaggccauucauugacuugaguuaauuuuuauauccagcuacuucacugaagcuguuuaucagguuuaggaguucucugguggaauuuuuagggucacuuauauauacuaucauaucaucugcaaaaagugauauuuugacuucaucuuuuccaauuuguauccccuugaucuccuuuuguuguugaauugcucuggcuaggacuucaaguacuauguugaagagguagggagaaagugggcagccuugucuagucccugauuuuagugggauugcuucaagcuucucaccauuuacuuugauguuggcuacugguuugcuguagauugcuuuuaucauguuuagguaugggccuugaauuccugaucuuuccaagacuuuuaucaugaauggguguuggaucuugucgaaugcuuucucagcaucuaacgagaugaucaugugguuuuugucuuugaguuuguuuauauaauggauuacauugauggauuuucguauauuaaaccaucccugcaucccuggaauaaaaccuacuuggucaggauggaugauugcuuuaauguguucuuggauucgguuagugagaauuuuauugaggauuuuugcaucaauauucauaagggaaaucggucugaaguucucuaucuuuguuggaucuuucugugguuuagguaucagaguaauuguggcuucauaaaaugaguuggguagaguaccuucuacuucuauuuugugaaauagcuugugcagaacugaaauuagaucuucuuugaaggucugauagaacgaagaccaaaguguggacacuuugcuccuucuuagaauuggaaacaaucacccauggaaggaguuacauagacaaaguuuggagcugagacaaaaggauggaccaucuagagacugccauauucagggacccaucccauaauuagccuccaaacgaugacaccauggcauacacuagcaagccuuuguugcaaggaccgugauauagcugucccuugugagacuaggccggggccuagcaaacacagaaguggaugcucacagucaacuauuggauggaucacagggcccccaauggaggagcuagagaaaguauccaaggagcuaaagagaucugcaacccuuucgguggaacaacauuaugaacuaaccaguaccccggagcucuugacucuagcugcauauguauuaaaagauggccuagucggccaucaauggaaagagaggccaggcaaacuuuauaugccccaguacaggggaacaccagggccaaaaaaugggaauggguggguaggggaguuggggggggggacuuuugggauagcauuggaauuguaauugaggaaaauacguaauaaaaaaaaaucucuuugguuuucauggucaaccaaaugauaauguacaacuuguaagacucuuuuugaagauguaaugaaaguaaaaagaaagccagauaugaaacacaguagggucagugauguuagugauacagugugauaauccuuguaauuaguaaagguggugcugguaggaguuucuaaaucagcauuagcugggcaguagggcagugauggcgcaugccuuuaaucccaacacuugggaggcagaggcagggggaauucugaguucgaggccagccuggucuacauugugaguuccaggacagccagggcuacacagagaaaccuugucucaaaaaaaaccaaaccaaaacaaaacaaaaauccagucaaccaaacaaaaagaauauaaugcuuucuggaaugucuccuucuauuacuccuucccagaaucauuuauuaagugcuuaauauucaaaauaucaguuccuacauuuggaauauucuguaaaaguguuauacugccuuuguuuaaaugaauaauguagugaaauuagugccaugugaucuguuugaauacagagauguccauaauauaaaacuagagcaugggaaguguccuucucuguugguucuucagcauuuacucuaugaauguagauaguugguuugcugagaauuggcucuuuggcagugacaaggagaguaaaccccagcucucauagagcauucacugcuugcugguagauaaaccacaaggaaauaagcagaagaguaagacacaguugaucaugaucuugaaagaauugguagaagcagaauugggaacugacuucaggugaaguaguuaagaaaaaccucacugaacaaaggccagaaggauuguuaaaaagccuucucuaagaaaauaaguacuuuauccuaguauuugaaucaugaauacuuuggacaaucauuacaauuuaauaugugaccuaauagucuaguaguuaucuauauuucugucagaugagauucucagcuacuuuuuaucccaacacucuucuacccauuuauguauccugacugauucuagcuuuguagcagguuguggauauaagaaucuacagccauucuacucuaucacaggauccuauuagaaagaaguaggcuaaauguggcaacaggaagaagaugggagcaggcccuaagcaaagucugggagguaacuuagcuuauauuccggcuuucuccuguuguuuacgaaacagaaucucaguauguagcccagacugcccuccaccuugcaaugcuacugcucuauccucccaagugcugagguaugaccacaggggugaacugcaaccccuugcuuuuuacaacuacuuaaaauaacccaucacccauauagccucaaccaccaagucuuagccuuucccuguuucuguguuaagugaggcuaucaaugggaacaacuuuuuuuuuucacacugugugcuuugaaacguguggagguacaaacaauaauuaacaugaacuuagauacuuacgacuuugaauuuaauuuuuauuucaaagacuaauauagaaugguuacagaaauagcagaagauacaugcauuagcaaaaagaacauuuaaaaauaaacuuccaaaucuuuuuccauauauauauauauauauauauauauauauauauauauauauuuaaauguagauggaucuucauuuuguguugcuuuuuaaaauuuuuuagcauucaugaagauaaaaauucagauaauuaauaucuuuugucuaucuuuauaauguauuuaaugauuuaaucuuuuaaaucauuuugggguuuuuuaacuuucugaaauuaaaaauagcucuaucuuaaguaucguucuuaagaaaucuuugagcaugucuuuaauuauuuucuugggcaagguucccagaagaaaaguuucugggcaugcuuacuuuaaaauuuuuaaauggugcugccaaauaggauacaggugagaaaaaucauauugguaucaguaaguagcaauacuaaguucuacaugacuaauaaauaauuugagcuguaucgaauucagagggaaaagaucucuauugauaggccagcuguguaccuuuuaggacauauaauaagcagagaugagucuucuaugcaagacacgacagcuaggaagagauaccuuucucccaucagagagacagucucgagugucaugcccaucuuuuguuccucuugaauuuaaugcagaagcuguuuuuguugugagagacacagacagacaauuaucugaaaauaauuuaaauguugaagucagaaaaucaaaauuguagaaaaaaauucagcuucugaauugaguuugggguucggagauucuaggagauaagaaacuaugccccacuuaaaaaucaguuuuuaacauauuaacauuuaauauuucacauuccauuuuuucuuuccuucauugcuuaccaguaaauacuuggcucagaucuuugcuuuugauacugugaugagguuuuguauuacuguuuucagugaagucucagucauugaauuuuccuguugcugucuauucacauuacaucuuaaagauguuuucaccuguacuuagcuauaugauuuauucuuuaaaugcacaauaaugaagucucuaugguuuagauuauuaaaagauuaaaagucugaacuuuugacuuuguuaguagggggacuuuuggugcucuuaguuaagcguugcuuuuacuuuuuaagauggugcucuaucaauuuguauauuguuguugacuuacuguaauauggcccuuucugaaacuuggcucaaacauuugaagacugaaaagagcuuagcacuuuagguccuacagaagugcugauagauaacaccaaacccggauggauauuuuacacccugaagccccuaccucccugccagcucugugccacuuacccccuucaguucauugggguucacuuacuuuaugaagggagcucaucacugugaauuuguauuuugaggugaguuauauuucccuuuuccuggccucagucucuucaguguuuugccaucuacuugcuagauaucacugaugauguguugcuggguuaagcugugguguuuuauuuuguguucuucuuguugcugugaccaaaugagggauaagaagcagcguaaaggaagaaugguuugcuuuauuagcuuagguucuaagggacacagucaauuauggcugggaagagauggcagcagggucauuggaagcuggucacauugcaucaguaguuaagaagcagugagcuaugggaauacugaugcccagaugauuuucacaguuguauucaguccaggaccacaacccaugggaugcuacaguugguguuaggguagauccucccaucucacucagcuccaacuagaggcuugcagauaugcucagguguuugucucauaggugagucuaggucuguuaacuugacaucaguauuaaccaucaccacuaccucgugguagauacaacucuugaucacaaacuaaaguucuagaauuuguaaaaaauaauuuaagaaucaagaaauaaguuaaacauggccuauuuuagucuguuaacugaugaagauuucccagucccuccucagauccagugagcucccacagguaccaagugcacagaggacagaagcuauuagcuuaaugcagcaggaugugaaacaucggagggcuucuagcacuguggcauuggaaagaggcuuuuucugauggaaccagaucauugcuuuucugguuacuuuuucuugggucuuaaauugcggcaguuaucuauaaaauuccuauuuuauuaccagaugauucguuauucauaacacuacuuauuugguuucuauagaaaguagucauaaaacgccuuccuaaaauuucaguugguaauugaacauaagcaagauuuucuuugggggaaaacaucugaagcugcuauuuucugcagagaauauaauaugcacaagcacauuaacagaggaagaugcguuuacagagagccuacuaauuaagcuuucugugagccucuccaaggugcacuugaugugcaagauggacaaaacccgugucaucuucuccaaauauuuauggcacucuacccaguggguuuggcacagaauuagccacacuccuaagcauauuaggaccaaauaucuuuuuuaaaggcuuaaaaaaaguuugcuggcugaauuccuuuagaaaagucauucauguucauuguuacgggcuccuuuucaaaauucagcaguuuguggcuuugaauaaccacaucaugucaucuaguuugccuuuccucuauuggugaaagaaaauggcugagucagagcauuugggcacuugugggaaguaaaugggagaauuaucuauaguuuugcuuccagcugguuauaaguggauaugcugauuaggcaucuucacuuuuauaucaggcuaucuucucaacaguaauggaguccauucaaacuugaacaauuuguucuuuuuggauauaucauacauaugguuggaaaaauaauguaauauugauguggcuuuuuucuuuugcugauuauuauauacagucaguguuagaauuuuuugaaaugguguaauuuuuaggcagaaaauaaguuaguguguaaagagcuacuguguuuuauuuaucugguuucauuuaauucucagaacaauucuaaguaaauaauguaacuucagaguguaggugauuggcuaguguuucucuccucugucccuccucccuuuccauucuucuuuuacuccuguucucccgucucccuuccaucagcccuccccccuggucaucuggguucacauaaauuuuaggcaucuuuuccugguuccauauaaguuuaggacugcuuuccucaugucuguacagaauggcauugauacuuugguagagauuguguugacucugcaagucacuguaaaccucuuuaauaauguuaauuuuuauagucuaugaauacagaauauauuuucuuuuugauuuccucuuuaaaauguuuuaaauguuuaaaauuguugcgcuccuucaccuaguuauuagucuuagauuuuuuauuuuuauaauuacuauaaauaggauagcuuucuugauuuuuauuucagauaacuuacuguucggcauaguaauguuauugauuuuuguauguuaauuuuacauucuguaucuuugcugaauuuacugauuaguuacaauauuuuauaguuauuugggggauuuucuguauaaaauaucuaguuuuacugucuuuauccucugucucuccauucucugugucucucugucugucuuucugucucucucuuccucucccuuuaccccccgucccccgucccccagucugucuugguagguaaggaaaccacucuauuacugguuuuuuuuuuuuuuuaauuuccuguuauuguuuggcauuugucaguuacugaugucugccuugugguuauugugacuuuuuacuguauugagcucuuuugaaaugauaacugacuucuuuaguucuguucuaaucaguuuguaaauagcuguucaacuugauguguguguggugggggagauuugucagccguucuuucucagguggugccuugguugugcuccccaguuagccaucuugaauaugcuaucucaaaaugguuugaagauuuuuaaaaaucauuuauugauucaugaguauucguggccacuuguagaagccagaaaacauuucugucaugugaguucucaggauuguacucagguacccuucucaucugcccuguuuuuuuuuuuuuuuuguuuuuguuuuuuuuuguuuuguuuuguuuuuauugaaugcauuuagugauuuuuuuucccucccuucuuagaaguuaguucugcuuuaauggccaaugugcaggguguaugcaggcugagucaacaguaauuucuuaagacuguaugugcauauuaggucuacauuuuuaaagaaggaaaaauugauacuuuuugaaauuguagguuuuuuuaucauaacauaaucaguuaauauuagaauuaguacaagauacccuuaucuguaucuauaaccuucauaaccugcuaccuaaaggauagcuuaacuuuaaauggagguaauuugauauguuaagauaccuaaaggacuuuucaauguccucauauuauaaacaauguauccagagcuccuuauuauuauauugaaugccauacuauuuauacagugcccugcacaugccugguauugugguuacuuucugucucacaaaaugucauuuuaccaacuaccugcucuacauuuggguuauuuugucccauuauaaauguuugacuucaugcuaaugaguuaauuguuuaugaaaugaaucauuggauuuguucccaccagugacaccaagaagaagcaggaaacaaggaagagaaacaacacugaagacgaugauguaagaccaagaagucgucauggaaagaaggccaagugggaaacgguagaaccuuuggauacaggccugucuuuagcagaggaugaagagcugguguuacaucuccucaaaagucaaaacuagacauucucugugccuuccuguacuuugauaccucuggauauuacuaugugggcaagaaauugaaaacagcuuuggaaaacaguuuugaguuuugaaacaucaaggaacguacucagaauaaggacguauuguauacuguuagaauuuauguauagguucuuauuccccaccauuggaaaugcuuguuuuguuuauuuucacacuguugaagauuaaaccaaggccuuguacaugguaaauaagagcucuacuccugagcuguguaccuaguccuugcuuguuuguuuuacaggcaagguucuggaucuguuguucauuuguuauuguuaaguauacauaauaauuuuauguauauuucauuaucuccaaagaaagaguauaauagacuagcccugacaaagaauuuuuuuuaauugaguucauaaaaaaauaaacuuauuucuuacaaaauacuauuguuuuuauuguauccagugauaugaaagacacucaaagauagauucauaaaauuaaaacgugacaaauuccuaaaacaaguuuuuuguauuguuaauuagccugcucaaauguaacacaucacacucacauuuggagauugcuggcaauuauuuauaaaaucucuagacaucuga

SEQ ID NO: 5102 - RNA, 17848 nt, Mus musculus
cucagacacagaaaauauauuuuuuuaagaaauaagcaagccuuagagacauaucagggugcaggugguaugaaucuuaaaguacauggaguucccuuucuuauuauaaaaaugugcuuuauuuaaaaaaaaaaagaguauauaauaaaaccacaggacaacauucuagacauggauucuuaauauggcauuguggaaaacauaaauaucuguuucuuuccccuucuuaucgucuccucugugcauuuauuuauuuauuuuuuagcauguuaacacuuauuuuacagcuugauucuauauccauaguuuaaaaccaauuuggauauuauaaaaugguauaaagcgaaaauaaaaaucccccucucucuguacucuucccaaccaacccuuucuuuuaggaaaugucuucacguucuguccugugccuuuggucauggaaagcuuucauucccgcauaauuaaaacugguuucuucuuguugaugguggugcucaauuccuccacucgucaguagcuaugcgagcaaugucaguagcuaugcaagcaaugcgcucacaaccgaugggugacggccaguguuucaagccauaaacauuguugacaguuuauucaaauaaacacaccuauaucuuuauagccuuacaucccucccuuuuuugaaagucauauaaaacuuucuucuauugaaauuaagguauaauuauaucacuguccccuuucucccuccagucccucucuggggguuucuccuuauucuuaacucaugggcccugaagccagauauauuuugauaaauacuucaguauuaaaaguggcuaauggacuauauggacaauugguuaaguuggaagggaaggaauuggagcuuaauaaaccagcugguuccccuaagguaugugcaaguuaaugaaccauaaagccauguaaaacucauuucaaaggcuacggucaaguggaguuaaccuagauuucuugauagacuuguuacgguuuggauguaaaauguccccugcagguuugugugucaaagacucuguguccagugcaauguuccaaggugugacuguucaaaaugagaaucggacaagucaauagaaacugccuaguuuguuucaacuucuuuuucuccuaguucugcuaggacuauucagccucaaacgacaucaauuuaaaaaaauuaaugugucucuaacaaaauaccuuuuucuuucugaaccugugguuaaagagguagaagcgagggaggcagucuuucuucucauguccauaugggauauuugucaugcugauauuucuaagaucuaguuaaagauacaaauucuugccgggcggugguggcgcacgccuuuaaucccagcacuugggaggcagagacaggcagauuucugaguuugaggccagccuggucuacagagugaguuccaggacagccagggcuauacagagaaacccugucuugaaaaaccaaaaaacaaacaaacaaaaaaacaaacaaacaaaaaaaaaaaaaccaaaaaaccaaaaaaaccaagaggagaaacaacacagggaggagacagucgagccuccccaaacacuuugcccuucauaauugaauauaaaaguaagugaauucgacuuuuaucuuggauaaagacagaagcaagccagugcaccugagcgugccacccacggauucccagugauuuaugagccuuuuauccacuagggugcacaaacaagcaacuccaaagauauuucauaauacugaaauucaugaucuuccugacuuaggcucucgagugugggauuaaaagcuuagcauuucucuacauuucuuuuuuguucuggucuuuugauaagauccaacuggguaagcugggcuggccuggaagucaccacaaaucucagguaggcuuugcacuaaugaaauccucuuguucugcuuccauugugccaggauugcgggugugagccuaacccaccaggccugguuucucugguccuucacagcuuagcaucuuucacaagucuuaaagaugcagcuggcauacaaaggaguauggagcugggucuccucaaagcucuucccucucaggccuccuccgguggcacuggcagauggaugugccaucauccggcuggggaacaagcuccauuccaucacgaaucaugggcuugcuggccuggcgcucggcauauuucugaaauauguucggaaggaacagaagguuuaguucaugcuucauucuagucuaaccucccccacaccuccaccuccaaccauggcgcuucaaacccaaaccaaagaucuggcucauuuuaauuucauucauauauauauauucaagacaggguuucucucuguagcccuggcugcccuggaacucacucuguagaccaggcuggccucgaacucagaaaucugccugucucugccucccucauaguuguauuuuaacuuuauuuacuacaaaugcuaguacaacaucuccuagucugccuucgaauccuaaucuauacuucuguguaaaugggacaauucuagaaaagauagaugccccuaguugaaguguguguguguguguguguggccucuccccuuuauccuguaagccuggagucauaagcauggcaagaggcccaugcaacguucuucuacucuggccagaaauaucccuaugugccaugucuuucauuccauucauucugcgcccacuugguuauauauuccuaguaucgagcuaauaccaacaaaacaauaauauagccaagugagccuaauuaacauguuagagguagggcuggagagauggcucagacaguuaagagcacugacugcuguuccagagauccugaguucaagucccagcaaccacaugguggcucacaagcaucuguaaugagaucugacgcccucuucuggugugucuggcgacagauucaguguacuuacauauaauaaauaaauauagcuuaaaaaaaaaaaaagaagcauguuagagguagaaaccccuaccaguaaaauuaaagcuaggcauaguggcauaguggguaaagcugccugcugcccgcccaccgucgaagccccaguuaacccugggaucugcagguggaaggagagaaccaacuuccgcaaagcauccuccguccuccacaggcacuaugcucucccuucccaccgagcucacacagcaaauagauaaaauguaauuaaaguuuaaaaaaauauuagaacuacauuagaggaugaaacccaucuaaggauggcaagaggggcuuggcuuguugggggcggggaggaggugguggugggacgauuugccuuuauucuacccacagaaaaggaaggacuuucuuaacggaucaaccagcagggggugcacuuggacaagaugggcggaaccucaugagcucuaaaccuccauuccacccccacacccccaaugcagaacggagauuaacaaauuccagcacucaggaagcagaggcaggaugauauuuguaaauucgaugccagccugguuuauagaacaaguuccagaacagccaggacuacagagaaacccugagauggggguaagggaagauacgggguagugugggggcggcuggcgggugguggugcacuccuuuaaucccagcacuugggaggcagagguagguggaucacaacacugaguucaaggcuagccuggucuacagagcuaguucuucaacagccaaggccagaccucaacacugguaauuucuucccacaagcugcccccgaucccccuaguaagcaugguagugcaaaguauccaagccacacacgugguauagggaccccagagccaucaggauggacagacguccgaacggaccugcaguacucuguaauaguagcaguaaagccugggcggcuggagcaggucccuggcaguuaacugcccuucuuucgcaaucuucuuugcuucuucaucauuuuccuaaaagaugaaagaugaaaaugacugcugcagcccacaaagaaagcuuggugcaagcgugggaggugugugacaggaagggcgaugggcuauaacuaacacaggaggccaugggaguacaguuagcuguuugccacaagaaagggaugagggguguguggacugauuccaagccucacacacucuucagugacuauuuugguacuuucuuagcuacccauggagaaagcuuggggucugucaucugccuccccagcacuguccucucugccuaagaacagaauaaauuaaucuucauguuaaaaugucuuuuaaaagccaggcuguagaucucugugaguucaaggccagucuauucuacagagcaaauucuaggacagccagggcuacacagagaaacacuuucucgauaaacaauaauauauuacagggaaacagaauuuauuucugccuauacucugucuugagaaaccaaaccaaaccaacaacaacaacaacuaagauucugggcuagggagauggcucagcaguuaagugcucuuacagaggaccagcauccaccuuguugguucucaacuccagcuccaggggaucugaggcuucuagucuaugagagcaucuuugcucaagugcacagacuccuacacugacacauguguaaaauuaaaauaauaaaaauguuuuucauagccgggcgugguggugcacgccuuuaaucccagaacucaggaggcagaggcaggcggauuucugaguucgaggccagccuggucuacaaagugaguuccagaacagccagggauauacagagaaacccugucucggaaaaccaaaaaaaaaaaaaaaaaaaaaaauuuuuuucauuaggcuucauuuaaauacacagugacagagaguuucguuaaacaucaguagccacaaaggacuguaacacuguaauaaaaaaguuacucacuuuaguacucacaagcuguggagccaggaauagcuaacacuccuaauuauacucagagaaaugcuuauuuuguacacacaacuggcaggaaaagccauuugcuagcaauuguggaucuuaggaaaagucauuacucugacccauuauguccacaaacagauauuacuucucaaaaguuaaaacauggacaaaauauaauggaaggauacauuuuauagugucauaauaaacccaauaguuuuuaauauuauuucucaaaaaaaaaggaaccucuguuuuauggggucuuguccuugggaugcuauggcuugugugggggaaggacuugggaguuuuuuguuuuuccuuuuuucccuguauggacgagaucauaguucccugaaaguucuccugauacagaaagccuuucaacucuggccuuuuugaucuguaguuugcauucuguguguucuuguuuuacauagaugagugcaaauggggacucauuuagauaagaugaauuacauccaacacuacacuuaaaaucuggccuucaacaucauggaccgaggcuauacaaagugacugugaugucuuucucuuuuauaugugcacaggugaguacguguacaaguaccgagacagaagccagaagaggcccuucccucccugaagcugggguuacaggucauugugagcuucuagugugagcgcuggaagccaagcuaagacccuucagaaaagcagcaaguguucuucacuacccagccaucuugacaacuuggugucuguuuuuugcuauuuaaagggaacacauuuuuuuuuucagaaaaucauaguucccuugaugugcuuugauuaugauacacuauauccuaauggaacucaguuucccauauuaauaacuuuguuauuguccaagaacauaauaauugcauggaaccuaccuuggcccauuucacuuucucuaguaaaucaccgagguuucucuuaaugggaacguaguguuuccaaggcuuuagugccacauagaaauguucguaguauggugacuccugcuugaggaccaggcugucgcccagcaugagguacggauaccuguaggcggccacagucccguccacguucacuugguacuuguacuagaagaguaaagccaaagagccucaugaagccauuuacuuuccuucuguuucucacccauuuuaaaauuaaguacagagggauuauuuuccacuuucucacauuuguguuuguauuuaauuuaucuuugauuuuuuuucuuuguauaaaauguuagccagccuuuaacagcucccucauaggaaauuuuaggaaaggagcacgugcuguuucaauuacaucugugaaacagagagucuagacuuguguaaccaaagcaggcguuaagacuauugucaaaguucuaaauuuaaauauucuggagugagaauaauuaucaauuuucacguauaaacuauuucauuuguuucauacccuaaacccacaauacagaaaggcauuuucucuauuuuacgguuuaaaaagaguuuacguauaauagaguuuacaucuuaccagcuuguaaacuguacguaagaugguucagugaguggaggauaacccaaguuuaauccacagaauuuccaggauccacaugguagagaacuaacugacuuacacacacacacacacacacacacacacacacacacacacacaccacagagagagagagagagaaacagagagagggagggggaggggggagcaggagagagauaaauaagcuuaauaaaagaugacagaaaccuggaaacacagcuacuuuguuggcauacauuggauuaacauuucaaaaucacuuaucaaaggcuugaaauccaauuuaauuauaauaugaagcauuuuuuuacaagugagaaaacugguauacagagaaauuuauaaacuuauauccuaaaugcaauucacuguucuuuucaccauaagcaccccacucccccaccuccaagaugaaggugguccauuuccaaauauagugacccgcccuuccucccauuuccccucucuuucuuuuucaauguuggggaucaacucuaugccucacauaugcaacagaagcccucugcuggacuacacccuaacuucuuaauaauuucuuaaauaaccaauaauguguuucccaaccuaggugugggucucauaauaacacucuaaagaagugaggggcacacacacacacacacacacucgugugugugcauguaugcaccauacauacaugcacauaucacacacauacaaauucacauacgcauucaugcagaaaugaauagcaaaggagcauggcaggccuaaugugucacaggacacagagacacuaagggaugaggggccacagacaguggaagaaagacuguaggcaggaaccgaacuccagcuccuacuuauauauuuugcauauguaaaaaugaauacucuuuaucaaagaugcuugagaucacuucauguaaaagacacuuaucuucccagcuuauuaaaccaaaggagaaaagccacaauaaauacauccaaacuucauguuaacucuuguauguagcauuaaauauaguucuacguuauuugguaaacaaaauuaacagagacaaaacugucagaguucuaugauucugucugucugucaggaaagucugaaaguaguguucacuggcacacugaggcaaccugcuccaagccccuguuugguagacucuggacacaguguaucacuucauagcuacaggaagacucauaccuuaaagaaaucaauggacacaguguaucacuucauagccauaggaagauucauaccuuaaagaaaucaaagaaacccaucaacuuggcuuuuccaagcucuuuuucuuucucuuggaaaaagaaauauccuguaauuccugcaucuagcagcuguggauuuucuuuggacagaaguaccaacugcagccucuccucccggcuaucucuaccucggaagaaagcuuucucuguuuuauugauccaugaaggcccuagaaguuugaggccauaaaaaauuaugauuaagagucugaaaccauaagacaguauaacaaccuuuaguucacuauugucauuuaacacgucaacacucuucgagaacucacuuuguaacuuaaaugcucuucccaaaauaccuggggcugagugucacuuugccagagauacuuucugagagguccuucuguuugcuccaaccccucccauuuaccagcaagggcagcccacacaggcacugcucuuugcugcuguacaacacuaggaaguagccaccacacaucagaccaagcuccagacagaaggagguuccaugguuaguuccacucccaggccauaccuucuuccaucucucaugucucacaaagcacacaugaguuagacuuuuguucuuaugaggccaccagagaacuguauaacucaguagccccaaaacauuuuaguccauauuuuuccuuauuuuuauuuuauguuuaucucauguaugucugugaacugugugcaugaaggucccauagaggccagaggauggagccagaucccaugggacuggaguuaacauauauuugugggucaccaagugggugcuggguccucuugaggagcagcaaguacucuuaaccacuugaccaucucuccagcucagcuacucauaauuuuuaauccagggaagaauacauuuuucuuugauauuauuaaaugcaauuacauagcucacaacacucacaaagguauauggggaacuugagcuaggaacuuggcuguucugcugcuuguuauguagcccagaaggaucucaaacuaguaacaauccuccugccucagggcuuccacaugcuaggaauauaggcaugagcaaccaugccaguuacagaagggaaaugucuuagaaaaauaaauuccaaucucugacaaaauaucuuacuauucuaaaagaacgauguuguuggucaaauacuugucagcgccucagagauaucauaagaugaaaaugggagggauccagucuucucagcuuacuugucagaaauucacugucaucaaauugaaaguaggcccacuuuuauuuccuaucgucuucaucuuauuuuuauuaccuuuucucaccuuuggguacuuugcccaaaucucugaucuugucccccaaaugacaugaaagcaacgaaaggacaaaacaaaguguggugcagcccagugaguucccgaaaagggggggggguauuguaucaaaauggaaggaaccguaaacagagagaaggacuccaguucuaaagacucgggaggcacagauguaagaggauuccuuacagagcgauggaggauggguuccuaaugcccagagcacaccauggucacaagccucuuacgcuuuuuggaauuugcccucauuuuaugcaauaauaaaaagcacuggagucagaauuaggugacaaguuuaccaaauauacacauuauuuaaauaucuuuaauuuuugcuguaaauuuucaugcaaauauaaccaaguguagagcagauugaaagauguuuaaaaauggcuaaauucaaaggagacuccaugaauacaggcuugggcauuauuaucccaaacuauguguuuuuaauuuucaaauugggagcacccuaaacauucuccuucagccguuuuccccugcuuugucuugcugggaauggacccugggcccuuagacaugcuaggcagacauuuuucuugguuggaagaaagacugauuaagcauaugcauuuauucuuucugauuaaacacuccuuucaccuuuuaagauuucuucccugaacuuaccuguguuucccugaacggagaggagaucauuugugacaccccucauugcuucgaguguggagugggugacaucauauguuggaaggauaaugucucuugaguccaaggagccacaccaggaaaugauagguauagggccuggggugucauugacuuuucgaugcuccaagggccaaucuccaagguugauauaaaauucuaaaucugggagggugaccuacaagaacaaaagcacaaagguuuguggcugggaggcaccuaaugccucagucucgugugugugugugugugugugugugugugugugugugugugugugugagagagagagagagcgagagagagcaagagagagagagagagagcgcacaugcgcacacaccuguggguggagggcaggggucaaccuuuggugguuuuccucaagcgccaucuaccuuguuuuuugagacauggucucucucuggccuggaccuuucugaggagauuaagcucugagccuuagggaucugccugccucugcuucccgugcacuggacucacaagcacacaccaucacaacuagccuuuuucacauggggucugaggguuggacucagguccuaauauuuacagagcaagcacuuuacaacugaaccaucuccccugcugggcaccagaaguacuuuugaucuagaggaaccuugcaagcagugggguaagggagaagaaagaucguuggucacuguuuguuagagguccugggugagagugguacaugcaaacucacuugacuggaaguuggcuaccugucuccagaggugaccuuuaaaauguaauguuacagaagugggcaucuagagaaaagugugagugugugggcuuugggagcccucaccagcugcucaugcaauagucugcagucaaaccuaagccauggcccuccuuaccacgcccucuuccaccuuugccucuagaauccuucacccuguuucaguccauacccacgacugaaacucgugugagauccuugccacaugaguuuccuuauuggaaauccccacacccccaacuugagccuaguuauuuucuauuuagcugcccaaaucucuaccccccacauuaaucuccugacugagcucuccagaaccuuuagacuucuaaacaagaccugugcucuguccuggcguuccgccucacucucguauucuagcuuauucugaagccuuaugaaccugaguucugggauuccaccucaaccuaaaucuuacagcaaagccaucugcaaagguaggagacucacgcucguucuggaacacauuucugagcccugaaaucuguucucaccagucuuuaucguccuaaguauguaacuguugccacaacaacacaaugauaucauuucuggaagcaguucauuuguuucccuaccuuucuugccagugacagcaaaauuucaucagagaacauuuugaagucuguguauuuccccaaagaucuccgguagaugugguuauugagaauuguguaaugaacaacagcaccccgcucguccccaaaucuuguggggaccuccuucagcaucugcuggagauuaaugcuggggaaggaaacaaaauccugcucgaucugugguucacuggcuggacaagacaggguuuccugccagaccugagggucaucuuccgggcagucacaguacucgugguacacggguccuaaggagggaacacacacacagugucacccugaguuaacaaacaccaugaccuaugaagaagugagcaccggauggcagcuuggcagaucuggaaacuccugacagaggugaaccuaucuuaggucaauucguaguagagugaucaugugagagccccaccucugcccccaacuaggcccccuggacagacuacagagcacaugcucacuuccaaacuagcacacuccagucacguggaugacuccuccacuucugcugagguauaaguaauaaaugcaaagugacuccauuuuagcacagaaaaauucuugauuuucagacauucaaaugcagaaauaguuaaguuuuugagaaaauggagggccuuucccucaaggucccuaaugcccccuuggucagcacaucucagaggaaagaguaacccagaggggucuaucaguguaaguggacagcugaacuuuucugaagacuuuucugaagacacauuuagaaacaauauauacaaaucuaacauaauuucagcacauguauuuaacugaauauauuuucuugaugguuuauuugugaucuuuggaaacagagucuuauauagcccaggcuagucuuaagcuugcucacacagagauccuccugucucuacuuccccagugcugagaugacguuaggccucauuuugcuggaguuuucuacuucagacacagacugggaagaggcgcugacuuuuacuucaaaccugucauguggacucacaguuucuagauuauggacacgagagagggaaggacagugggucuuggaggugacacuagcaagggaaaccucacaggucacacagcuugcugcuuacuguagcucaggaagagagugugugcaggacugagcagucucacuguguuaaggaagagcugagcaugccagagacccaggcagcugagccugggaacagaguguaugaggggugagaacuaaacacaagaaagccuaaaagccuucaggacucugagaaggagaguccagcccagccuguaaccagggcaucugugaguggaauccacccagugcagggaagaccaucagagcaacgcugguggccagugcauagcgcuccugcaaggcugggucaagugcuuguguccaguacauagcgcuccugcagggcugggccaagugcuugugucagccuggcuggaaagccuccucauucuugggacuuggggugugugcaccucaguugcugagaguaauuagccccagauuaaacaugacucaauuucaucuaacacacuguaaaaauauaacaggaaaaggucagauuaugaccaauuaacucugccacaucccagagagaaagcuuaggaaaauuaaaaauguuaccaguguaauuaaaaaguuacacuggaggggauuaauggcaacucuggcagugcaggacaaaagaugaacaaacuuagagauacagcaauaggaacuauacaaaaugaaacaggaaaggauuuuucaagagguuucuuuguuuuauguguguguuuugucugcaugcauguaugugcaugucacauguauaccugucuggucagaaagggacauuggauccccuagaacuggaguuacagcugacuugugagccaccauguggugcugagaacugaacccaggcccucgguaagagcagcaagggcucuccaaacucagaaaaugaucauuuuuuaaaugccaaaaaaugaaguaaaauuugaacuuccagaaguacauauacaauguuuacucugucacauuugacugcagggucauuacagcccuucugaaaagcaaguaucccauauaugccuagggucaggugaguaguaacacguaccuuuuaaaauauagggagagugagccacauguucacugccaugaaggaucucuaucuugagcccuuuaugggccgucucgugcauccuguaucucaccaaaaacguuccaucauuucuguccaaagguuuagggacauaaauacggaccagcucuuuaggugaaagggauuuuaccacuacuuugaacuguguuugaccuguaagcaaacgaaauagaaauaacguugccauuuccugaucauuaugucucagugaaaguccuuuguccugcaguguucaugguaaaccaugcucauuucagccuggaagauccuugcagacagcaacuaugugugguccauccuuaaggcaaggaucugacuuaacaugggacucaucagucauucaauaacaguggaugagaaaauuaauucauugaagaaaguaacauuucuccuacuuggucuuuucuccucugaauaacauucaagcaguaacaguccacauucuaaagaugauggcccuguggcaauucaacuuucucccuguaaaauacacacacguuauuuaaugccauugaagugucuaguaacccucauuucugagaaaaaugucccuuuuucauuagauuuguucuuugacaauuucacaccuuacauaauacaugcugaccacccucacccucuccaaaacccucccaccuuugccuaucccccucuccuuuuaugcaaaucacuuuuuaaccuucauguguauuugcuucauuuaugacccacuuggucuaaccagggcugucugugugacagugaauuuggaaugauccacaggagccucguggcucagcaguggguaaguggcagguacaacaacugcaggcaacucucccucugccagaacuuaacaagaauugggaagugagggacaggguuccauaagauccuccccauucugugauugacuguuggaagggccagucaugugugggccaagaacaguaaccuugguuaugaguucaugguugcaaaggcagagucuacagcagugucugaggaaugacuuuuucacagggggucacauaucagauauccugcacugcaggauaucugcagauccuugcauuaugacaguaaugcaagacuacaguuauaaaguagcaaggaaaacguuaugguuggguguuaccacaacacgaggaacuguauuaaagggucacagcacuaggaaggcugagaacugcugcucuggucauuuugaagccagucccugugucuucuggcucugagaugccuccuacuuuccuacuuccccuucuacaaaguuccccgugcuuuagagagcgugacauuuuucuuuuuaaacugaauuuucaaaugcuuuguguuucaucuugcugacaucagaaaggcgaccccaggaggagagauggcccaucaguuaaaagcacuagcuauuccuccagaagacccagguuccagucccagcacccacauauuuauuuuaagugcuucguugccugggccacugauagcauaaaaucgaagugagagucaguggaaaauaacccugauugggucuggcagagaaauaaguaaguguaagugagcuuuauaaggaagaaaaggagaagcgugaaauucuaaauugcucaaagcggaaggaauaugaauucccauuugcccugauggccuuuacaauggaacggaaucaaagaucacccuacaguuuccucuccauaaauucaaauuuaugaaaaagugaccaaugagaagguagugacacaaaaggagccugguagugucacaccuuacuucaaagauucugaacacuuaguuuucaaaacaaccaaaagcauaaaaaaauuuacuuagugccuacuaugggcuauauguguucauagcuaucuauauccaucuaucuaucuauccaucuauauacuuucuagaucaugcucuuauuacauagucaaggcuagccuagaacucacaauccuucuguuccaaaugcuuggauuauaggccugcaccaucauacccagcucucauaagcauuuucuaucuguuucuuguaagaccuguuagguaauuauugaucuaccccacuguacagaucaagaaaccuagcuccaaaaaguagcugagggucauauuuaaaaaaaaaaaaaaaaaccaccaaaaaacccagcagucaguaggcaaucauagcuuugcauuuuaaauagaauauaauuuuaaauggaagagaaucucuggcaaugggaaccucgccugccaugacugaaggggcucugaccaguaagcauggcucuggcagaccuugguuuucucucccauugccucugcuuugcuuaaaaaaaaaaaaaaaaaaaaaaaaguuggauuacuuuccuaaagcuacgcaccaaggucuauccccucaaauggccacuucuuccuccuccugaagcugacuaccaagguccagcuaucaaaguauugaaguccaacaaucaaaaguccccuuuggcucaccuaauuaaucugcccaauuaaaauuaaacaccucauccuaacacaagguuuucccuuguaccuuuauauuuuugguugugagccuagccuguaacagcugagccaucucucuagccccucuuauaccuaacugccauuugccuccgagccaugucuguccccucucuauccagagacaguccuguguuccacuccaggacaaacacccuguccccucucguuuguucccuuccccuucuuccucaacccccaucuccugucugucacuuauucccugcccucuguaccuaugugcugagaacuuggucuuggggguccugagucgauacuuuuccuuucaaugaccauuuaguaaguuuaucaaugcucacggcagcuagagggaaagcacugaucuuacauuaccaaauggagcaucccauaagaccaaagaguuacacccuaggacuacauaaucauccaaacaggucugacuuccugccacggacacaccaggauccacucacgcacugcaauuucuaaaagauauguuuuucucauuauaaaaacauuaugauguauuggggcuagagagcuggcucgguggugguuaggagugcuuucuauucuuccagcggacucauguucucagcaacuauauuagguggcucacaagugucuagaacuaugguuacagcagauccagugcucucuucuggucucuauaggcaccagcucacaaguggcauauacaaacacacacauauccgaauaaucuuugcagaacauuuuauuuggggaaaaagauuuuuaaaaugggggggggggauccuuacucuccugcuguaaccacaugagugcuuaucuggguucauuuauuuauuacagaacugcagauacaccauaacacgguuugaaucugaaccauguuccacagacuccuguucucaacacuugauccucgcgcucucugcuuuugcgcggcugcaagccagucuagaaaccccucucagccuccaaacccgcacuccugaagcuucccagacucccuuggaccuauuggcaguucuuuaauguuuacaccaggcugcagaaauccaauugcagcaacugugcuuugcccugauaggcagguugcuuauuaucuauuuucucagcagagucuuaaguuuucgauaggcagacauugccauccucuuuuuuacuccaggauuaccauauacacgugacuucuaaguacgugaaauucccguuugcucgguggaggacgccaaggaguucucugccucuuugcaggcaaaacaggacgccagaugggagcagccuuacauuuagacacaaauuagcaaauccugacuggcaacaaguugaaaccagcuggacaaguccagagaagcaaucagaugugggaggagggcccugcugagauucaagacaagcgccucccuucuccgguucuaggaaguuucccugcuucgcguggucugcacugcgggccuaagaagagugggcugcugagggagggaggaaggcgcgcccugcaggccaggaagggccaucugcaucacgugauggcaccacugcgcuccgugggaccccacaggcgccguuuacucuacuuacccuuacaucugucaccgggcgggaccuguggcccagccuuuggaguuagucacccaacgguccugaguggcaccucccgcccccgugggugucagggaggagggaagggacgccgaugggaggggagagaagacgacacccgcaguggggagauggccacguguggggacagggacgcgcggggacggcaacgggcgcugaccuggcggcgagcuagugaaguuccggccguccgaguccaccgacugcaggaagaaguagcgcacgggcaggacggcggcggccugcaacccagggccccacgccaggcuccgcggugcgcucacgcgcgccccggcccccgccgccaccagcagggcgagcugcagccccagcggcagggccugcauggucgccggcucucagcuccgcuggccagggaggagcuggagcgccgggccgaggggacacccgagggcgggccucug

SEQ ID NO: 5103 - RNA, 99787 nt, Mus musculus
caagcgcagucgugcggcggcgcaugccgacuucuuccuuuggggcacccgugccuuaccaacuugcugcuuuauagagccggaagcgggaaggcgugcguacagaaccagcugcuagauccgugcacgcgggaaaaggcgaagcgaccuggguuugcauuggcaggcagaaugcagcgguaggagcgagggacgaacgcucggggacuucugugaggggaaaauucucuucugagcccaucuuuccucagcuuccgaauggcucuuaccccuucucugcagaacggccgucaucuucucccucuuucugcagacccuagauggagugagccuaaaucuucccuucugcacgucccucuuuccuaucugucaucuuaaggguucuggucgaucuagauuuuuuaaaucucauacuuuagucucagagcguuuauuuauauuuaagcuacagguuugcacauguucguaguuaagagcacuggcccuuggaaaucacagucucguauucucauugucaguuguauugccuguguugucuguaguagguaaguggcagccacucugagccuuugaaaauguuuaaccugcgcuccuuccccggucccacccccgccaccuggcacagauaaguagacagcuacuuuuucaaagcgacaaugugauaggaaaaacuguguuagccgaggaaggacugguucuguggaaacugagccugaaagaaucgacuuugcugcuagaucuugccggguguaaauucuucugcaagaugguagcgaagcuuucagacagaaggaagugcauggaaaggcacaaaguguaacgagcucuuguuauugagugauacagauuuugcaaguuuccaguguauugaagccagaggaagggaugagagcaagaagaggaggaaaaaaacagucaucaaauagauuuauaaagcgaucguaagagaagacaguaacaggaugacaguuauacugaauauuugcugugugugugugugugugugagagagagagagagagagagagaaagagagagagagagagagagaaagagugagauaguaagagagagaaagagaaaguagguguguggugggggagagggaaacagaaacggaaacgaacuccuuaaaguagauacugguaucauuuucucaucuagcauccagaaaacaggugccaguuuaaccaacauguugcagguuggauaacuguuaauugaauggaccuggauccgaacaauacagccugaccauagaacccacccuuuugcaacccaggcuagccccuaacucacaauugugcugccugagccuccccuaggccugcaauaccugacugagccccagugcuuuuuaccacuagccaagacuaacaugccacaggugggguuauuucugggaaggggagauguaauuauugucaaaaugcaucaacuugacugaacccucaaaaggaagauuugauuugucuguucaggggcuguugcuuaggaagcuuuuuuaguugaauguugggagcugaacuauguuacuuguuuuaaugucucagcauuuguucacuugauagcucucuucaucuaguuggauagcuuugguucugccacccaccacuauuugguugguugguuuguuuguuuuugagucaggguuucucuguugcccuggcuguccuggaacucuuucuguagaccaggcuagccuugaauucaacagaucuaccugccucucucucuuuccuucccucccccuccucccucccuccccuacucccucucccucccucccuuccucucccucuccucucccucacugccccccccuuucugccucuuucugccauucaguucauucagaucuugcauuuacuuaauucauaacaauuuaaucuaaaugauaaacuguuguaauuuggggggggguaugagcuucuuuagcucaguguggcauugaucucacugagggugaccuuaaacuucuauccuccuuucuuuaccuucccacugguauugggauuacacuaaugugcuguggcacucucuguucucuucuuuuguuuucuacuguauuuugauuuccuuugaggcauaaguugcaacuuggaacuauggauuaauacuuguaucaucaccauugucaccagaugucuccaagaggguaggcuguguaucaguaugguucaguuauuuucuagcuguccauagcaugccuaaccugauacacuguacaugugaaacaaauauuguuugcuguuaucaaugaauguuuuccuuuuuuuuuuuuuuuguuuuuugagacaggguuucucugugaagcccuggcugccuuggaacucacuuuguagaccaagcuggccucgaacucagaaauccgccugccucugccucccaagugcugggauuaaaggcgugugccaccacgcccagcgaauguuuuccuuuuauagagauaauacugaacuguuucauuuuauucaaaauaauagauuaccaugcuaggcaaagcacacauuugagaauuagagccuaauuuugauauacuuuaagaaaauguccuauagaaauguuaagaaaaauuauugugccuuugaucacagugugccucugcauguauaguuagguuuaaauguguaguuaaugucuaaaauaguuacguacaggucuaaaguacagcuuacuggcacaucacauguuuaguaugcuuaaagcaccaagccaguccuuagcaaaaaaaaaaaaaaaaaaucaaugaaauuuguauauuucuuuuuacaggugaggaugcauguucugaaaucuuaaaccaugagucuagcacucaaugaucugcucauuugcugccggcaguuagagcaugacagagcuacagaaagaaggguaauauaguauuugaaguuguuuuucuugaagcaaaugugugauagguaacauaguauguuauuauuauuauuauguuuuuuuauuuucagaaagaaguggauaaauuuaagcgccugauucaggauccugaaacaguucaacauuuagauaggcauucugauuccaaacaaggaaaauaucugaauugggaugcuguuuucagguauccucuuugaacuuguguuucuuuuucuguuuugugaugccauuuuacucuuuaauuuuguuugcuguauaucauuauguguuacauaggaaguugacccuuagugguuaucugaaaguuuuaaaaacauacauaacacuggaagguuuaugucauuucuuugauagaauauuuuagauguauauccuguaacaacaagaaagaugcaucagggugcuggcgagauggcucggaggguaagagcacugacugcucuuccuaagguccuggcucacaacuaccuguaaugagaucugacacccucuucuggcaugucugaagacagcuacaguguacuuauguauaaaauaaauaaaucuaugggccggagcuagcagggaugagcuaguggggccgaccagagugagcagagguucuaaaaauucaauucccaacaaccucaugaaggcucacaaccaucuguucaguuauaguguacccauauacauaaaguaaauaaauaauaacuaaauuguuuuaagaaaacaagaggcaucauaggauuccugucauacugcuuucuugaggcugaggcaggaggccaggccagucuggcuuucauagugaguucuuguccuaucuggucuauauagggaaacucugucucaaauagagcaaaaacaacaugaggauucuguucauuuuuacuauaagaaucuguuucaaauuuguuuuaaacauaaguuacaguagcugggcgaugguagcacucuggagaugaggugggcaaaucucugaauucuaggccugccugagccauaaaaguuccaggacagccagggcuaacagaucuugucucaaaucaacaaaaaaguaaguuauaauauaaguuuaucauuuuauuauugcugauuauaaguaucuggcauuagcuugguauaaucauuccacccuggaucaugacaucauuuugcgcccuauaaacacaugcaauuauaaaucgucaguuuacaauaaaacuuuuaaaaauuaaaaagagaaaaauacuagccaggcggugguggugcacaccuuuaaucccagcacuucggaggcagaggcagaggcagaggcagaggcagaggcagaggcagaggcaggcggauuuccagccuggucuacaaagugaguuccagggcagccagggcuacacagagaaacccugucuuuaaaaaaaaaaaaaaaaguuuaaaaauuuacuuuuuuguggcagacuugauacgugucuauauugaaacuaaauuuucaaccauaaguucauuuauaauuaaaaacagauauuguaagacuuguuggggaaagaaaaagggcuuuauaaaaaauauuauuuauuuaugugcuucuguagacauuggauauccuuaaacuagaguuauauagagguuguaagcucuccuccauggaugcuggguagugaacccugguccuuuggaagagcaggugaggacccuugaccaucuaacagcccccaaacauuuuaaauucauguagaauuugaccugaagcugguucauugguauauaugacaccuauaaccuuggcucuugggaaggugauagaggaagauaaugcccauggguggguguacaauuacuguuaucuguuuuuacaagcugauuagauaggcuagaugugcaaccauuccugaccagcuuucaguacuuuauaagcagcuuucauuuaaaaacuagaaauauaauaaacugcucauaauguaaggaaaguugaacaagagauuguuucaugugucugguugguacaacagugugguuuaaaagauguuuugggggaagauacacaggaguuuuugaagugauaaaaguauaagcauuaaugaggauaugauuuauuuuuccuugaagguuuuuacagaaguacauucaaaaagaaauggaaagucugagaacagcaaaaucaaauguaucagccaccacacagagcuccagacagaagaagaugcaagagaucagcaguuuggucagauacuucaucaaaugugcaaacaaaaguaaguaaccuuggcugcgugugguggcacacacugcugugguggcgcacaccuuuagucccagcacucaaaaggcagaggcagguggaucuauagccuagccuggacuauagagugaguuccaggacagccagggcuacacagagaaacccugccucaaaaaacccaaagcaacaaaaaacguaaacaacaucauguauuacacacaaaugcuucaggaguuagcguagcauaaauuugaucuuaauacaguagcauaaaaauuaaguucuccuugaaauuccuagcauuacacuggcuuuucauauaguagguccaaaauuuagaguaauuuagcauaaaauguuuaaucucagaaguggaaagauuaaaaauuaauguuucaguuccccauucuuguauucccucuacguguuuuuauacaucagcagaagugcagucuuaaggaggcugaauaacuuuaaggguauaaauugcugucaggccagugagauggcuugccagguaaagaaucuuugccagugccgggcgugguggcgcacgccuuuaaucccagcacucgggaggcagaggcaggcggauuucugaguucgaggccagccuggucuacaaagugaguuccaggacagccagggcuacacagagaaacccugucucgaaaaaccaaaaaaaaaaaaaaagaaucuuugccagcaagccugguggccuccguuugagcccaagaaccgaaacgauggagaaaaccaacgcuuccaaguuguccuaugaccccuacacaggcaccaaggcauggcugauuuagugcacgugugagcaugugagugcacacaaaguaaauacucagaaaauguguaaaaaaaaacauuguuuuuaaaguuuacuuucaucgauuacugcucuuuuuauuuuuaaagauuuuuuuguuuuauauaugugagcacacugucacugucuuccaacacaucagaauagggcaucagaucccauuacagaugguugugagccacccugugguugcugggaacugaacucaggaccucuggaagagcagucagugagugcucucaaccguggagccaucucuccaucuccuuuuuuuuuuuuuuuuuaagguuugcuuauuuauguguaugagugguucugucugcauguauguaaauacacuacauauuccaguucuugaagaagucaggagaauccucuggaacuggguaguuacaugugagugcugggaaccaaacccagauccucugcaagagcaucaaaugcucuuaaccaguaagccauaucuccaccccucuagcugcauaaauuauacacagaaaaccugguauuuauuuccacaugauaucauuugauguauuugaaaauaaccauagcauuccugagugaucuuucccuaaauuaaauggaccuaauuccuucagcucauugacauaguuuuaauuucacuuucucuuuaauauucuugaguuuguuauuucuuaaagaguggcaucagucuuguaguauuaucuaguugguacagccuacagcauauuuguuucaguuuuguuuuuugaaauagggucuuucaguguagcccagguuggccucagauaugugauccuggugccucauaucuucuucaguuccuggauugcaaauaugugcccccaugcuggcucuguacuuacucauucauucauucauuuucgugcucacgcauauauguggugggugcacacggguauuuugguaaaugggaggucugcuuguguuuuggagguugcuaaauaguccagguuuucuggucaacaagccccugaguccugucuuuuuugugcuaggauuacaagugcaugccacaaugcucaacuuuuuuauguagggucuggcaggucaaauguagguccucauccuuguaagguaagcauuuuaccaacuaagcuaucaccccagcauuuauucuuuacauuuauuauuuugagauaacacuagccucuuguagucaaauuuagucuauuuacuuguuuuuuuuuuuuaaauguuauuuuuguuuguucuuuugcaaugguagguacaaaaacccaugguuuaugcaugcugggcaguacugugcuacugaguuuuaaucucgacugagagaauuaggaaauaaaaacauaaauuuuaaaacaauuguguuuggcagagaaagagaauguucugggcaaaaggagacagaaaauuaagauuucaucuuaauauuuaugaaguuaacuuuauuuauugucuauuguuggucuugggcauuugugguaaauuauuccuuuccaaaaucugacaguacaacaaauacuguauauaaaaaaguauuucagaaacugugggagagauagccaaggacuauagaaaaggaucaugcagacgugggcauugucaugggucacacgcccggaaucauaagccaugagugaaagcugcuauuuauacugugauagcauugcguacuuaccauagccugacccuccugaguguagccagucucaucauuaagaaaaugcuaaucuaacacauuuuacuuaugcauauugaguuucauccuaccuguaguucaauuucaaaaugaagucaguacugaagaaaccauggucuuuuaguuucgaugucaguaugauuuuauaaaaagcaagccaguaaggaauaucccuccauggccucugcaucagcuccugcuuccugaucugcuugaguuccaguccugaccuccuuuggugaugaacagcaguguggaaguguaagcugaaaaaacccuuuucuccccaacuugcuuuuuggucaugauguuugugcaggaauagaaacccugacuaagacaaauuggaaacuacaaaauaaacauuuuaauuucuguagccuuggcuauagccuuuaccuggaguuacaggcugacacacccuaaagguaaacuuaaacccugcccucccuuuucuuuagauaggguuuccuuguggcccaagauggucacuuuuauuuuuuaagauuuauauauuuauguguacacuauagcugucuucagacacuccagaagagggugucagaucucauuacggaugguugugagccaccaugugguugcugggauuugacucaggaccucuggaagagcagucagugcucuuaaccacugggccaucucuccagccccaccaagauggucuuaaacuuacuuacuguauagugaagaaugauaccuuaaccagaaucuugcccuaaccaaggacuauuuggauuauugguguguaauacuguuccuggcauaauuuuguuuuuaaauguaauuuugugaucuuuaaaaauauacauuuaggggugggggagauuacacuggcugccuuuccggaagacuuggauuugauucuuagcacccacaugggagcucucaaccauguauaaauucaguccuuaaagaucuggagccuucuucugauuucugaggcacugcaugcaugcagugcacagacauacauggaagcaaaacacccaugcacauacccauuuuagaagaacauuuauuagcaaugaauuuucagaaucuaaacuauugugcuguuaaaacuucagccuuuucuauauguaugcuauuugucuucuguuuagauguaauggaaauaaucuugcuuuuuagaguagcuaggcuauucuuaauagaauauuucaagauuauuuuaauaaauuuauucauaaagcugcucagugacuuagaauccuuuuaauuccagugccacaaauugugaguucaguauaaaaauuaaucuauuuuugcuguauuuuuagagguugguaaauuuaaucuuuaauggugcuaucuagcaaauguuuucuuuuucuuuaacuuucugggucauauauuauccauugcagauacucauuucuugucauuuacaguauuaaaugcagaaaugugauuguguuccaguuaaacuuuauuaacaaaauggccaaccaguugaauuuuacuuaggggcuacccuguugagagaaacuaugagagugaguuaagagaaacuugcugaauggaaucacuuaaagaaguuggcacuuagcugggcgugguggugcacgccuuuaaucccagcacuuuggaggcagaggcagguggauuucugaguucgaggccagccuggucuacaaagugaguuccaggacagccagggcuacacagagaaacccugucucgaaaaacaaaacaacaaaaaaaguuggcacucugaaggagucuuuauuuuuaugaucuauacauuuuuacuauuuuguuuuauuuuuaaauaggagcacccaggcuaaaaugucaagaccucuugaauuaugucauggauacagugaaagacucaucuaauggucuaacguauggagcugacuguagcaacauacuacucaaagacauucuuucugugagaaaauacuggugugaaguaucucagcaacaguggcuagguauguuuugaagccugugauuuuuucccccccuuauaagaugaaauuucaacaauaaaagcagucuauaucccacagacgacucagaguuuaauauuauauugaugaaauuauaucauuguaguuucagagccuucauuuucuuccuuuucaaguaacaucuugcuauauaucccauucuggccuucaacuuguaauccucugcauuggucuguuaaggcuggaauuauaaauauggacuaccaugcccaguucuuaauuuucauuuauuauguacuuugaaaagcauuaagacaagcuggugagauggcucaguggguaagagcacuuacugcucuuccaaagguccugaguucaaaucccagcaaccauaugguggcuuacaaccacucguaaugaaaucugaugcccucuucuggugugucugaagacagcuacaguguacuuauuuauaauaauaaauaaaucuuugggcgaaagcgagcagggacugagcgagcaggguugacugaagcgagcaaagauccaaaauuuaauucccaacaacuacaugaaggcucacaaccaucuguacagcuacaguguacucacauacauuaaauagauaaauacaucuuuuuuuuuaaaaaaguauuaagucacauuguuuauaguagguguuuaccacuagaacuggaauuacagauuucaaagauuacugcucuguuuucaaauauucagccguccagugacugagaaaaauagucagcuaaaaauuaccaugccauucacucucuccaggcuuguuuacaguguguacacagaacagcgauaccuuaacugagccauaaauaaaggaggaaaccaaaagagagaugucacagagguugaaagcaaggguucugaguuaaaaggguugugguagauacuuuaaaugucagaggaaggauaacgugcaaaaguauucacuguguuaggcagagguagauauuagguaacuaguaagggaaugaaaaucaaaugcguuaaaauaucuuuuacucauugacuuacuagauauucaaaguacuauucuuuuuaaauuucuauuuccagacuguucacugcugugauacaaaauuauuucuuccaccuggcauccuggucugagcacuugagagaguuguuauuaaauccuaaucccaaaucacugaaaguaucacuucucggaucauugugaugcaguguagcuuaaggccucaccagagucaaaccugcuucuauagcauuucagcacuacacuucagucagggcauuaaaccgaagcacacacaggucugaaugcuucauaccguuuaguuccauugacacgugacagaauugcucacauauggugucugaagaaccuuaccuuuggugauauuugagauuuuaucuuuuaaacgccacaaacaguuuucacauaugcaguuuuacuguucauggaggagugcauacauugcaccuucugugaagaagcaggauucuacucuucugagacuccuugaggugucucgugcuguccuucaugcccucucuugagcaugauggauucugaaaauguggaccauuccccucgagaaacaugaagcuugaugugcuauaaugagaagcaauggcaguguuggcccuugcucuuucuuuucugucaguaaaagagaaaauuguuaaagaggauucuuccacuucaguaugugugcaugagcauuuuuaccaugcuguggcuaucugauacauugcaaacauguuaacauaauugauagaguuuuaugaacucuuauuacacaguaugauuaaaacuacaauguuugauuuauuuguauuggccauaucucuuguuugauacccaauuuuaagccaauuuuauccacuuuugcagaagcaugacaugagcaauucaaaaggaagauaaagacaguugauauucuucccugucucuaucuucuaguggggauaaagucuuuugccacuagcuuacuuuucauuaagucuggaacaauucucaauagauuauacugcauaucgcugacucuuguuacuguuuuucaccuaaacuacuuucuucaaggguguauuguguagugaaucacuugagagagucauugccuuccuucaaacaaagaaugguuuugcuuuuagccuuauuuauaaaagggcuacuauuuucauuugggugaaccaucccucuucaugaugcuguugagauuggggaccucaugcaaagauggaaguauucugcuuaccguuacugcugugaggaauaaacuuuccuuuuuucuuuuuugagcaagaaccuuauguccuuuacuaaaaauccaagaaacuguccuguuguuguuagguuauauacaaacagagcaaacugugaagccauucauaaagggugauacuuucuauacauauuuuaaaaacaccauugauaggacaccaaaacuuagugacuuuguuaguccuagcuaaaacagcauaggcauggagacagauauuaaguagcuuauuugagguuuaaguacauuaauaaacauugauguauucuauuaaacucaagguuaucuuuaauacuuuugucuuggagaauuguagcauacuuaaguugaauugugauguugaacauaguuaauuuuuaaaauaauuaucuaauacuuucuuuuuucaauuuuuagaauuguuuucacuguacuucaggcuguaucucaagccaucacaggacauuaauagaguuuuaguggcuagaauaauucaugcugucaccagaggaugcuguucacagacugauggauuaccuucaaaguuuuuagaucuuuuuuccaaggcuauucaguaugccagguaauuagaccacuugguuucauauuguaccauauucauauuagauuuucuuuccaucaccauguuuuagauuuaauaacuaaauaauacuaccuuuucaacaguggguauucaguugcucacauuucugauggaaaaugugauuauucagaauauuucuauuuuucuaaauauuaaguuuuuauuaauacauaauuauggauagucaugguucauugugauauuucaauuuugugugcaucuugaccucugcuuuuuauccuauuaaaagcgaaaaaaaaaaaaacccuuaaaacagaccaaagauuugcaaguuagaaacuugaagaaagcaaacagaugaaacacuuggagauagugacacaagggucugaggaggcgacuuaguggguacaaacacuugauguguaagcaugaggaccuggguguggcuccugagcagccaaauagaauagccaagguaacugggcaaauuuuugaucccucgcugaguugaaguugaagauagagacagaaaauaauugggguuugcuaaccaccauuguuauuccacaauggcaagcuccugguugagugagagaccuuguuucaagggaauaauguggagaagaguuggccauccaacauccuccuuuaggucucuucaugcauacauguaugugccuaugugugcauacacacucaauuuuuuguaagauaaaagcggugaucuuuugggacuaaacccccaaaacagaagcaaaaggaaguagguggguuuauauaaacuguaguuucuuccuagaaaggaaaugcugagcauagugaaaagauaccuugccaaaugggagaggcucuugcacacuguggauccaacuaaagacuuaacauccagauuauauaacaacuuuaugaaacuugggaacaaaaacuauguugcuggggagauggaucaaggcacauuguaugaaauucucaacaaauaauaaaaaauagguuacuuaaaauuuuuuuuaaaugcccuagguaaaaaccuaggcaaaggguagugaugcacuucugugacuccaggacuggauggauauacuauaacccuaguacuugggaggcccugcauggcaugauucugaguuuaucgucaucuuggucugcaucaugagaaaauaaaugagaaaagaaaaauaaauaugcaaucaauuaauuuacgaacacauucaacuuccuuagcuaucaaagacaugcaaggaaagucccagugagauaagugguacugaaguuaaaagagcuguguugcuagaaguaaacagcagauacuuugaacagucuggagacaagacuucucacugcauuggugggagugucuuucaaaaggaaccauugacucguaauagaacccguaguuucuugaaggaucauuuugaaccaaauguucuuaaugugugaacacuuaagugacacccuuuaugugugagcccuguggucuuucucaucugauaaaaaggaaagcuggauguugcuuaaguaauaucauucuuuccauuuuaaggauagacguaguauaucgagagcaaaguagugagugggccuggagacauggcucagagguuaagagcacugaucuuccagagguccucaguucaauucccagcaaccacaugguggcucacaaccaucuguaaugggaucugguguccucuucuggugugucugaagacagcugcaguguacuuauauaauaauaaaagaacaaagugguaaaauauuuuggaagcauugguacacaucuguaaggcaaaauucaguucauguuaaaacauguauuacuguagguauacaaauaaauuguguguuuuuagacagugguuuaguagcaaagagguuuaacaggaaaaauuucuuagccccaagugagaaucaguggaguuuuuuuuaaugguuagaaauguuguguuggguuuuuuguuuguuuauuuuuuuuuuauggagagauuugaacccagguuaugauucuguuugaauauuagauuuuauccuuuucaacuguuccuguuacacccaguugacccuaucuucuguugcagacaagaaaagagcucuccuggcuuaagucacaucuuagcagcccuuaacauuuuccucaagucucuggcugucaacuuccgaaaacgggugugugaagcaggagaugaaauucuuccuaccuuacuauauauuuggacucaacauagacuuaaugauucuuuaaaagaaguaauuauugaacuaauucaacugcagauuuauauccaucauccacaaggagccagagcuccugaagaagguauaaagggaauuuuuccugauuugcauauguuucauuaaaauagaagcugucugagcguggcaucaguguucuguagaggaaugaagugucucugguuaggagugugacuaguccugagacggguuucaugcauucucuugggucugaaccagugggaguaaguucugacucgccuuuccauugucaauaaaguaucagaugaaaacuaguggcauuuccugcagcagccacucacccgucaccacuuccuacuaagaggggccguaggcuggagagcaagggguuuauauaaagugggagcuuguuuaucuccaugugagguagacuagccaaaccuggugccucacucuuacacaaggcucauuuccugggagcagaauaaacaguaaagcacugguggugaaugucuugugcucccugauuguuuugcaucccccuccccccuuuuuaaaccaaaaauacuauucuucauucuuuaagaaguguauugaaugagguaguguuggcgcaugccuuuagucccagcacuugggaggcagagacaggcagacuucugaguucgaggccagccuggucuguaaaaugaguuccaggauagucagcucucuacauauuagcucugucuagaaaaacaaaacaaaacaaaaccaaaacuggauugagugacaguugaccucgaugaacucucucguggauggucuuugauuaucuuugggcuuguacuagccuuuagacuaaguucaucuuggguaauagugaugauuuuguugaggugguccgagacauuaagucacaucagcaagaauggagaauaacuguuguaccauucuuuuuucaguagggauauguaucagcucuuugaauguauacauucagguuuauguaguuuaugaaacuacuauaagucaaaagaauugugacuucucaguuuugucuuucaucuuacucuaaccaggauaaagaugaggcugguuaaaaggugauguaauuuguuaguuaacugcauauuuaugguuaauugaaaauuugacaggguuaugagacugucagaaaaauucacauaguuuuagccuucaauauuauguuuuuauguuacuuuguuugugagaaguaauaacccuguaguuuuccaugaggauuguguuuaccagacucugcagacuaguucagcauuuuaagaggggcauaaauugacugaagugugacuugcauggugagauagccacuguaaacggagaacaguguaaguguacuaguagaaggagcaaugagggcagggaggaugggguagggguuuccaguggaggggaggggggccuggaaacgggagaacauuugaaauguaaauaaagaaaauauccaauaaaaaauucaaucauugggcuggugagauggcucaguggguaagagcacccgacugcucuuccggagguccggaguucaaaucccagcaaccacaugguggcucacaaccauccguaacgagaucugacucccucuucuggagugucugaagacagcuacaguguacuuauauaaauaaauaaaucuuaaaaaaaauucaaucauuaaaacagauagaaggagucauaauaaaaauuauacagaagcuggucccauguggaagaagggcauguuaucuuucuuaaggcacaucauacauuagaaaagggaaaguuuuagaugagaacgugaggacauuuauaacaaccacaguuaccugacuaugaagugaagaccaccaggaagugagucuucaaggauauugcccaaagggacauuaguacugaguagaccucggacugggcugccuaagaaggugagucauucugagagcuggcagugccaauggcguuugaauauaaauaugcuguguuucuggguuacaggugcuuaugaauccaugaaauggaaaaguaucuuguacaacuuauaugacuugcuagugaaugagauaagucauauaggaagccgagggaaauauuccucaggaucucguaauauugcugucaaggaaaaucugauugaccugauggcagauaucuguuaccagguauaguagcuguugucacguuggaaauuuccuguuaaccuucucucugcuggaugcuuguacuuugcauuaugacaagucuauaaaauuacucuguauaccuaacaguuauuuucaaauuauguguauuugaaacuaacccuuuucauugaaggaugacuuuuggacaugugucuagagcuaguggugacagucaccuacagggaaggugaaugcauccuagccuaauuuuuaaaaaaaucaacugggcagugguugagaaugccuuuaaucccaguacucgggaagcagagacaggcaggucuguaugaguucaagaucagccuggucuacagagcuaguucaggacagccaaggauacacaaggaaaaccuguuucagaaaaaaaaaaaauuaggauauucauguagcauaaaauucgcgaugauaaauauuuacaauaauuauuaucauugguuuguucugaaaccaucaccaaaaucuauucaaagccuucugucauccccuauagaaacuuuagaccucuuaguuuucauuuaucuuuauuuguuucucuuagccacuaaucuacuucuguuaucuuugaaugauuugucuguuugauacauuuaauagaaauagaaucauauguauguggauuuuugugccuagcuucauuuauauaguguuccacuggguacuauaaaugaguauuuuauucucauauugcccaaagggacauuaguacugaguagaccucggacugggcugccuaagaaggugagucauucugagagcuggcagugccgauggcguuugaauauaaauaugcuguguuucuggguuacaggugcuuaugaauccaugaaagggaaaaguaucuuguacaacuuauaugacuugcuagugaaugagauaagucauauaggaagccgagggaaauauuccucaggaucucguaauauugcugucaaggaaaaucugauugaccugagauuugauugacauauugguacuuauuuugcucucuuaaauguuaauauaaauuuaauuuuuauguaaucucauguaauuaaauauaaauuuaaaauuuaauccuguugaaaauacacuauuugcaguuuugguaaguguccccagaaaauaaauguaguacccuacuuauaaauacuuacuaaaaaugucauuacugcuauguaaaaauauuuaucucuuaaugucuuuagauauuucuauaacuuauuaauaauuaugagucccuauauuuucaguugagaaguauuuuucuccccgaugauucauuuaaaaauuguagcaauaaaaagguguuuuuuauuuugcagcuuuuugaugcagauaccagauccguggagauuucucaaucuuaugugacacaaagggaauccacugauuacaguguaccuugcaaaagaaggaaaauagacguaggcugggaagugauaaaagauuaucuucagaagucacagagugauuuugaucucgugccuugguaaaauguuguauuuucucauuuggugucauuucaaucauuucccccagaaagccuucuuugcugagaguuguuauuugacggugcccagaccugcuguuaguggcaggugaagugugauugcuguagauaaucccuaaaaggcucaucugcugugcuagacaaggcuaccuuuuuagacauguagacacgguuuuuguguuuuccuuuuuccuaacucuuauuuucauucauauuuaaaugugcacaauuccacaaugacagauuaacucugauuaggaucaguagacuguauuuagccaggccaguuuucuuugcugaaagggaccagcucuagaaauguuaaccagcaugccugaagguacuuagagacuuaacagauugugggagggggagggggaauauuuuucaccuuguugcuggaauauguauguuauugaguugugaagaaaagcuauauagacuuuguuaucuauugcuuaaguuuacauuuauucuaugcaguugacaguucuacuucagauuuuauuuauucuuuuuguucuacuuuauucuucucugguguaguacaccuugacuggaguuuccccucucuccgcucuucucacuuccuccucccuccccuccccacagauccacuccuccguucccuguagaaaagggcaggccucccagagauaccauccaaacagcaugacaaccuacaauaagacugagcacacacccucgaauaaaggccagaugaggccaccugggaggaggaaaaggguuccaaagcaaacaaaauagucagaaagaaccgcgcucccacuuuuaggagucccacgagagcacuaaguuacacaaccauaaaauguaugcaggggauccuagcuccauaauuacggcuucagucucugagccccuaugauucuccugggggugaugugcauaauguuuggcugcaucugcuccugucaguugcuggauaaagccucucugaugaucacgguaggcuuaggucugcauacaacagaccuaucacuaggaaucuuuucauugacucuuuuuuucucguuucucuucagauuauauaaaucuuccauggcuuuagauucuuaaucugucuauuuaaucaagaauuacuagcugggugaagguggugcuggcuuucaaccccagcauuuauuuaggaggcauaggcaugugagucucugaguucaaggccagccagggcuacacagagaaacccugccucauaaaacaacaacaacaacaacaaaaacccacaaacaaaaagaauuacugaauggcuuuucugugccacacuuagcagugaauaacauaggcuccuugguuuugauuagcacuccuugagcagugguucuuaauguuuccaaugcugcaaaucuuuaauacaguucucauguugcagugacucccaacagaaaauuauuuuuguugcuacuuuauaacugaacuguaauguuaugauuguuauuaaucacaauguaaauaucugaaauaggcaacccccgugaaaggguugucgacucccaaagggcuugugacccauagguugagaacuauuguucuggaauauucacagaacauuguguugaaugcuaaauuggugucaaagacaaguguuucaguuauauuuuucuaauaugaaguauuuuuggugccaaaagaucagaaaauggguuguuuuugagauuuuauguaaagacauagcuagccagaucgugugauucuuccuucuguaauuggcagcagggccuagucaguaucagcaguuaauuuacuuaaaaaacaauauugaaaagagugaagaugauacuguaguuaggauauagaaagguauaguauuugcaucuuuguuuucuuuuauguuguuaaagauugaaaagaauucacagaaauccuuuucuuuuuuccuuucaggcuacagauuacaacccgauuaauaucaaaauauccuuccaguuuaccuaacugugagcugucuccauuaauacugauacuguaccagcuucugccucaacagcgacguggagaacgcaucccauauguguuacgaugccuuaaggaaguugccuuaugucaaggcaagaaaucaaaccuggaaagcucucagaagucagauuuauugaaacuauggaucaaaauuuggucuauuaccuuucgugguauaaguucuggacaaacacaaacugaaaacuuugguuuacuugaggccaucauucaagguaguuuaguugaacuugacagagaauucuggaaguuauuuacuggcucagccuguaaaccuucuagguagguuguauaauauuugauuuuacauaaacacacaaauguauccuugauuauuuuuguaguuuguuauuauaucagcgaaagauauaauaaaucuuuuguguuuuguuggcccaaaauaaucaauaauacugagauuuuuuugugaaggacaauuuuaauuuuuuuauuuuucauauuuuugaguuaggaucuuccuguguagccuuggcuaacgucuaugauuggcugaccuugcacuuaagacauaggcugcuuaugcuuccuagaugcuagguuuaaagaugugagccauguccuaucuuuuuauuuuuaagaccaguuuucgguauaggauuauaaauuuuaaauucuugacuauaauuuauaauuauucaauauucauacacauucuuguagcucagugcauuuuuauuggacaguuauauguaugagugcucuaucuauauguuuaccugcaugccagaagagggcaucagaucccaucagaucccaagauauauauauaucuugagagagagagagagagagagagagagcaucagaucccaagagauauagauauaugaaugaaugauugugagccauaaugugguugcugggaagugaacucaagaccucugaaagagcaggcagugcucuuaaccucugagccauuucuccugcccccgggacaaaaauuuuacaucagaagaguuuucugaaauguaaucuuucuuucccagcuuuguuuacaaaauguuccucauauugcccugagcaugauagacuuagugagugcuaagcagcagagguaaagcgucugcccuccagagagcuugcugcuaacagucuccuuguguuucuuuguaguccuucaguaugcugcuugacuuuggcacuuagcaucuguguaguuccagaugcaauaaaaaugggaacagaacaaagugugugugaagcaaauagaaguuuuucuguaaaggagucaauaaugagguggcucuuauucuaccaguuagaggaugacuuagaagacagcacagagcugccuccaauucuucagagguaauucugcuuuuuuuggcauacuccugcauucuuguuuugcucugacucugcauguuuucuuguuuaauuuuauaaggcucucucuacauauuugauaucagauagcuuuauuuuaugcucacagugcagaauuuccuggaguuaucucuaaaauauuacaaaucaucuguaucuuugugcuggaucauuucugaaaugcaagguuaacucacuguaggauaugggagauuuucaugaaggauagacacauaauuguuucuuaaaaauuuaacauuuauaaaaaguuuucauauuugugauaugacaucuaguauuugauacacacaugcauuguaaaauguuuaaaucaccauuaauauauuaucuucuuaaguaguuguaaucuucuuaugaggaacacauugaaaaccaugguuucuuuuaaaagaaaaaaaaaacaccgaauuuuucaugauuaccuacuccauuguaggacacuaaaaugucuuucuuucauuaaauuuagcaucuguuuuuugggguuuuuuuccuuuuuuuuccuuuugccuguugguuuuguuuguuugauugguugguuugguugguuuguuacauggucucacuguguaacucugaucuggcuuggaacucccuauauagaccaagacuaagcuagccucuuauaggaauuccccuaccucugccuccugagugcuaggauuaaaggagugugcuaccacaccugcucuguaguguuucuuugugacacuauuguaguuuuacacucuacuggccuuugcuccaagagcagcaggcuaacagcccccuccuggcuucccauuuguucuacccaccuuugcuccaggaggugggcuuugcuaccaggccccacccacuuccuuugaauccuuggacaaaagacacacacaguuuuuuuuuccuuuucaacuugccuuaagacacaauugcugggcacugcuauguccugccuggaaaagcauguccuuaauaauauuuuuaucucuacuccucccaccugcccuaaacuucacuggcuggucucacauagccccuggccacccaccuguaguacugaccacaggcccagcucuucuugaaaccucacaugguuacuggcuucucccuccaaagcauagcaaaagcuccucuucuccuuccuugcgucugccuuuuccuccugagaccuccugagacccggaagucccgcuuguaccuuccacucagcaauuggccccuagcuuucuucacugacaggucaagagccaauugaggaacaggaccuuagcuucagguccgcccccuucauucuauaucuuaucuuauuccuuaaucauaauggauaucgagaaauuugauacaugaaugaugagaaaacaaaguagggcuuaagcccuaggacuagcccaguuuacuguuccccaggaggguagagcauaguguuuuaccuuuaguucauaaccuuuuaucucagaaauauuguuagggcagagggugcuggaaagauggcuuaaacaagaacaagcacuuggcugcguucaauucuuagcaccuacauggaagcccacaacugugagcaucuacuccaauuuauaugugucuauaacucuaguuucaaaguaucuugaugccuucuuuuggcgauuuugugcaucaggcacacaagaagcauagacauugaugcagggaaauucacauaacaacaauaaauaaacaauccagaaaaagaaauccugcuuuuaaaauuauauguaaccagcaguuuuagaaaccauaguacauugcucuaaccucuuuaauaaacuuucaauacuagugauucaggacaaaugaaagcauuuuuaguguggaaucugaauuuuaaggaucauaauugguagcuauauauacaugcauauuaaaguucuuuuuaaugguguauggucuuuuaaguaaaguuuuuuguuuucuuuuuuaguaauuuuccucaucuuguagucgaaaaaauucuuguaagucucacuaugaaaaacucaaaagcugcaaugaaguuuuuucaaagugugccagaaugguauguuauauaagaaaguaugugauguuuugagauauaguauuaauaguauuaauuagaaagauaauucuaucauggugggaguucaucuuauuaguaauuuugauauaaauuggucugauugaagaaauaucacaacagcuaagcagaaagaaguuuuuuauuggugauuauaauuuauguucuauuacuuuagaugaagguuaccauuuuauugcuguauauuauaacaugucuaacaaguguuaagagaaaaaaagcugaacagcuaugcaaaauuaagaacauaaaauuuaugugaagugaguuuuuaguagggacccacuguuuguauguugacuaaauuuuauuaaguuuuaaaacgugccagugagauugcuuagcagguaaaggcauuuuucaauccugauaaccugaguucaguccguggggccugagacucaccggcuggaaggaugaacugacucuugacaagugugacaagugcaucuggcgugugugugcacacacagucacucacuccaucucacuagcuaaauccauggcagaacaaaggaaaaacuaaugagaguuggcuaucauuauguucugugguccagacucugggaagcugaggcaagagaauuuugaaaucauaaguugaagacccuccugaacaguguaacuagaagcaauacugaaaagcaaagcuuaauuuuaauuacaaugugaaaauauuuaaaaacucguuuuuaauugauuggcucaguucauugccacauuuggcacugugacugaaaauagcucaaugauaugaggauauccagucucacuucuuuaaaauuaaaguaaaaucacuaauuuuggaaaucaggugagaagaaagcagauguuuuugguaauuacauucagcuaucuaguguuagugucuaaauauaucucugaauuuguauuuggaacugucacuucuauauuuuugugaguaaaauuugcuaccaauaaugaaauuauccaaugucaauucaauuugccauaaaagcccaaagaagagaagcauuucacagaauaacucaaaaaucuuauuagcagucuuugaaugguauaaauguuuucuugaugauuuuauuuguaauguguugugaacuaguugaaaaaauauuagaucaugguuuuaaucauuaaucucacuccugaagugaacaacacugcgaagauaaagaagagccuucauuuucagaaguagaagaacuguuucuucagacuacuuuugacaagauggauuuuuuaacuacugucaaagaguaugcuguagaaaaauuucagucuaguguuggcuucucuguccagcaaaaucucaaggaaucauuggaucacuaucuucugggauuaucagaacagcuuuuaaguaauuacucuucugaggugagauuucuuaaaacgaauucagguguauucuugagcauuuauggguuguuaggaagggaaaaugggagugugaaagguaugaaagaugagagaggccugguuguaaauaaacgguggcacagcccaacaaguaggaaaaauaggcagggaggaaagggaaacgauaauuuugagauucuuuguucaggaacucuguagacaauucuugagguagguuagugggaaggagugcuggugugagucuaagaacuucaugaugggaugaacauauugguacaaagcauggaaauuuagucauaggagaagagaaaucuaguuguugcauuugaaacaaguagaaugauuauaaagcuaugaaauggacgagcaaauacccagucauuagaagccaaaugauuuaucuuuguaacaucacaaauacagcuacucucuauaaaucaugcuuuccuagaugguguguauccuauuccauguauuuagauagccacauguugcauuuguuguaacaugugccuuagguucacucagccacaguaauuuuucacauacuaguuucaguuuuuggguguaguggcauauacuuuuaaugccaauucucaggaggcagaggcaggcagauuucugaguucaagguccaucuggacuaaaagcuaguuccaggacgucagagauacacagagaaacccugucuugaaaaacaacaauucauacuauguagcauuucaauuuuaagggcacuuaauuaguaucuucuuuguaccauggauccuuugcauaauuugcuuaaagggcauacuaguuuguuaaucuguaucuuccacaaaguggucuguuauguaaauaacgaaauugaaaaacacuuauaaacucacaaaggagugaaaugagcagcccuagaaaaugacccaagaaaccaggugggggcaguguggcuguugcccugucacugccacuuacuaauggggcuuugucagcuggagcuagcuuugcucuaacaugauucaguuuucuuggaauguuauugauuugucuacuugcuugcuugcuuauuuauuuauguauuuauuuaauuugguuggcugguugguuuuucaagauaugguuucucuguaguacccuuggcuauccugaaacuuacucuguagaccaccagcuucugccucccaagugcugggauuaaagguaugugcaccaccacuggguauucuugccuguuuuuagcauauugguuauauuucuacagugaucuuugagcuaguuuuaaagcaugaccuagaguaucccagcuuuaacucuguuggauuuuuauuucuccauauuuacggaaacuuguucuuccagggguaauuccaaacuccauagguuuauuuauaucuaauacugucuuuuuaaauuuaugauuuauuuuuaagauuacaaguucugaaacccuuguccgguguucaagucuuuugguggguguucuuggcugcuauuguuacauggguauaauaacugaagacgaagcccauaaaucagaauuauuccagaaagccaagguaggaaaacuuacucugaugaagguuuagaugcauuuaagugaacugacauccuggaaaaauuaugugaaauaaauuuuuuguauaaguugaaugucccuaaucugaaaauagggaaucucaaauacuuuauagaguuguaaaguuuuaguuacagcacaaccauaaaggugaacauuuccacaucuguccucauacagucaaaauguagacgugggucaccaucaggcauguacgagacagacgcugucuuuaguuuucuggugcuaugauaaagaccgcgaucaaaagccuccccggggaggaaagguuuaucugguuuacccuucaggaucguagaacaucauagagggcagccacgguagcauccuggagguggaaagcagaggccauggaggaaugcuguauguauauuggcuugcucccccacuuugguuuuuuaccucaggaucugcccauggauggcacugccuacagaggacccuccuacagcaaugaucaaucaagucccuacaagcuugucuaucaaccaguuucucaauuaagguucucuguucucauaugaguaguuugugucaaguugaaaaaaaaauauaaccaacgcagaguugaugaaacaaaugaguuuuguauuuagauuugggauagcccaaagagaccacguuguuaugugucuauaaauauuccagauucugaaacauuuuuguucucuguauuuuagauaugcucaauauguauagauuaacuuuuuucuuucacagucuaaaauaaauacugugcccuuccuuagaauaugaaauuauuacaagccaguaauuaauacauaugguaaaugaucucauaucacaauguaaccuuauuagaauacugguuuuugagguagggucccuaacugucuuggaacuugcagaauguuugccuuggaccuccuaaauucugggguugaaaguguguacuaccauccuuagcuauacauauugauuuuuaucuguacucuuaaaauuuuucccucagauaaucuauaauaaggaacucuuuauugaguauauuauucaaguauuuucuaagcuuaaaacuuuguuuaucuccauuuauuuauguauuuauuuauuuuugagacaagguuucuuuguguaacccucacugucuuggaacucggaacucacccuguagacuaggcuacuacucagagaaauccuccugccucugccuccccagcggaagaaucaaagccaugggccaccacugccuagcuuaaagcuuucuucaucucucaacacuaguguaucaguguugggauugcaaaggaaacaggauguuaagauuguggugggauuuuuguuguaguuaauuuugcugagacaaagucuuacuuuauaguccaaccuggccgggaacuuaauguccuuuauacucucugagcacuaagauuacagguucauugccacacauagcuuagauuugccauuuucuuuuuggauguuugucacuuguaaucuuauugcaugacaaugugcccuuuuuuucccuugguagucuguugcguguagcuuuugcuaccccgccuaagcucuugaagcaggcugagcuaccagcucccacucagcuucccuugaaucuaaggauaaaagacacacacacacacacacacacacacacacacacacacacacacacacacacacacacacacacacacacacacacacacaguucaacuugcccuuugacacaauugcugggcguuacuaccucccgccuggaaaagcuccacaccucccaccuggccuaaacuuuacucaguuacaucuagacccugcuaaacuccccugaccacccaccuguuuggagcggcauguguggccacuccguuuagagauuguacauugcuggucuacuuuucucagaagcauggccaacucuugucucuucucuccuugagucucucccuuuccuucagggacccggaggucccgccucuuccuucuguccagcaauuggcccauggcuucuuuacugacauaucaagaaccaauuggggaacaggaucagaacuagcaucagaacuagcccuaccggagucaggguuuagcccaagcaucagccuuucuuaaaugcuagugucagcccaagucccaguuucauauucaguuuguaaauauauugaauuuuuguccuuaaaugaaauuucaaaaauagcaaugcgaaguuguuauuucaacuggaauuugucuucuuuuuaucuucuguucuaaauagucucugaugcaaugugcaggagaaaguaucucucuguuuaaaaauaaaacaaaugaggaaucaagaauugguucauugagaaaugugaugcaucuguguacaaguugcuuguguauacauaccaagguaagagugacuucuuaguaguauagccuauucaugggacauauuauuuagugguguugaguuuuugguccauuuauaaguuuauaugcugaucuaaaauuaaauugaauaauaaagaagaacauucagagaauauugguuucucaugaaacaauuucauaacuuugauuuuuuuaucauuacauacacacacacacacacacacacacacacacacacacgcacgcacgcacgcauagaugagucuuuuauugugaguauacuuucauuaauuuguugauuauuaagaaguauguuuuuuuuuuucccauaacaacuauaccacaggagaugagugccacaaagauaaauaaugccauccuaggauggagcuuauucuguagagcgccaacaaagauaaaugacacaaguacaaaugcuacuuccuuuaacccauaucaucauagguaacauuugguagaaaaagugccucuguuagucauccuuuuuugguuuugccugguggaguaacuaaaccaugcuagaguguuaccagcaauuggaacaguauuuggaagcugguaugcaagcagcuugcucuucauaaaguaugguuuuguuuuccauuaucuuuccuguauuuauauaaguguagaaggcaugaaaggacagaauaaaccucacaguuaauugcuuauuauguuuaggaucaguagcugguacuuuagugaugcauaaacacaaagauauuuacuuuguuuauauuuccuuaaggaaaguaguuaggcuguaguugcuauucugguuacuuccuaguuuacugcccucuugaauggacuuaauaaguccuauucuuaaaaaacagaaagaaagaaagaaagaaagaaagaaagaaagaaagaaagaaagaaagagggaaagaaagaaagaaagaaagaaagaaagaagagggaaaggcaaggcaaaggaaggaaggaagauagauagauagauagauagauagauagauagauagauagauagauagauggugguguaucuuaacuuagaacuugaccucaguucugaacuccuaucuacaucucauucaagguagagaaaaugguacuacgaaaacuauguauuuguuuuauuguucacugcuuauaucuguuuucaaauuacagcauacgccaaacaagauugccucuggcuuuuuccuacgauuauuaacaucaaagcuuaugaaugacauugcagauauuuguaaaaguuuaguaaguaugaauccuuuuuuuauuaauaaauuucuuugauacuaagauguaguaaaauuauauguauaugugugaguguguauguauguguauauauauauauuguguguauguauguacgaauguaugugucagagaggaggggaggugagcaagcauaagcaagccagugcauguguacuacaauauauguagaagucaggacaacuccugggagugggugcucauugaucauuuuucggauccagugauugcacucaggaugucaggcuugcaugagaaaaccucuacccaggcuggagagauggcucagagguuaagagcacugacugcucuuccagagguccugaguucaauucccagcaaccacaugguagcuuacaaccaucucuaaggggaucugauacccucuucuggugugucugaagacagcuauaguauauucauguauguaaauaaaauaaauaaaccuuaaaaaaaaaaacaaagaagaaaaauaccucuacccacugaccuagauugccaauccuuuaaauugcaaauuuuuguugaaauaccuauugaguagauaagcauuucaugguauauaacauguuggauuuuuaaaaaauaauuguagccuuuaauaagcuuuugcauuuaggggcuauguauuugauuauugacuauuucuucuuuuucuccuucucuuuauccuucuccuucaagauuuauuuauuuauuuuacauacgugaguacacuguagcugucucccgacauaccagagaagagcauagaauccuauuacauaugguugugagccaccaugugguugcugggaauugaacuuaggaccucugaaagagaauagucagugcuuuuaacugcugagccaucucucugcccugauuucuucuuaagaucaguaccuggcggaguaguuuaguuaucuuuuaguuuccuacuaaauaauugaaagauugcuuuuauuguccaagacauguucucaguauacagcuuggcuagccuagaacuuuauguguagaccaggcugacccugaauucacagagguccaccucugccuccaccuucugggugcugggaucaaaggugugcaucuucauaccaggcaaaauuauuccuuuaaaaaaaaucccaaaguaggggugacaccuugucuucuaggaguauguguuuccugugguguuuauacuucaucuucugugacacuggacuuauacacucuuuuuuacauuuaauuguucacuucuaguaguucacugggugaaaaaauagccuguaacguuauuuuuuuauaucauggcaaauaauuuuccuuguuaguguauuucuuuaugaggcuuacacugcugugcucuguuuggcagucacgauaguccacucuuugggaauaguguaugccuaucucuaaaggaaugacacauuuuaaaagaaucuaccugcucuugcuuuuuuccuuugucagauuggcggugaaucuuugauagucauccugucuaagccuugcaggcagucugcuuggggcucauaccucugucaaucccauucccucuuacuuaacauuucaggucacuuuccccuccuaaccaagagcugccacaaagacgccugcauuuccgcuuugucuucuuguacuugugcacuugaagaauggaagagaaauuccagagagggacucacuuuuucaaaggaauguaugaaaguuuuagggagcauuuuuguuugcuuguuuuaagauaugaucuuaguuauguugcccaggcuggccuugaacucuaggcucaaaugguuccuuuguuucaaguauccaaaaagguaggagaauacaggcacaugccucugugccuagcuuuaauuuuaauuuugauuuuggaugugauuuggauguaggauauugcuauuguccuacauaauagucguuauaauugauacuuuuccuaugcuucugucaauuucucaugcuaacuuuuaacauuuuuauuaaauguugcaagguuuuauucugugggggggaggauacauaguggcauuugaauguguaaauacaguacagaaugacugcuggacuucguuuuuauuacauuuauuuauuuuauaucugugugugucugugugcgcgcaugugucacagugcacguguggaagucagagaacgguugcuagagguuauucucuuccuaaccuguggguuccagggauucaccucaggucaucaggcuugcagcagguuccucuaucccaugagccaucuugcuggccuaugcuacuuuuuaauaaaauaaauuauuuuuguaguuuugauauuauccuacuaucuaaacagauuccaguuuauauauccacuuccccacaaaauuaugaauuaagguccuucugaaagaaguugaaaacgucuuuguuucuccucucgaaaggcauccuguacgaaaaagccauuggaucacggaguacauccaggggaagaugaugaagaugguggugguugugacagucugauggaggcagaggguccaucguccacuggucuuucuacugcuuaccccgcuaguucugugagcgaugcaaaugauuauggagagaaccagaaugcuguugguaaauaaguauuuacugcucugaguuuuguuuuguguguguguguguguguguguguuuuuaaccauuuuacauuaauuuggcacaguaaggggccucacugaaaaaaccuuuaaugauaauuucauuucccauagguauagucuacuuggacugaucuuuuucuauacauuuaagacuuuuaacaacccccgcccuucuccccacccccagggacagaauuuuacucugucgcccuguccuggaacucacuauguagauggggcugaccuauaaacucacaaagauccaucuaccucuggcucccuugauuugagauugcaaguguguacuaccaugccuaggcacucagaaauauacauacauacauauauguguguguguauauauauauauauacauauauauauauauugguuuuaauucuuuucuguguccuuguguguuaauguggguacucacagagauuggagaacaguauucuaggagucaguucucuccaacugugcacuguggguucuggguuucuaauucaguuuuaucagccgucugcaagcccucuuacuuccugagccaaauucacucacuguucuccuuacuacacauucuaagcuacucucauuuuacaaucauauucauuaguuucuuauuuuauucuucaugggaggauuaaaauguaaaguaguuuagaagaaacuaaaggcuagguuauuugaacuuuggaaagcuggaaagcuguuugagguucuaucugucuaccgggucccucucccaguguuaauaagugccuuugauuuuuaggugccaugaguccuuuagcugccgacuaccuguccaaacaagaucaucuucucuuagacaugcucagguucuuaggccgaucuguaacugcaucucagagccauacugugucguuuagaggagcugacauuagaagaaaauuguuacuguugcuugauucuagcauacucgaucucaugaagccccuccaccugcauauggugagucagaagcuuugaguuuggcugcgguugccauuuucugcauguuuguguugcccagaccuagcugaagcagucucaccgaguacacagaguaagaggcccgugcuauuaucgugccuagacuucucagguuuucuuuugacaugcuaugagaagaauugaaguagaugcugaagcauuaaaacuuggauuauuuugaauauuauuaggcguaauuuuuaugaauuauuauagaguggaacaagaggcaucuucuuugagauagguucucucuguguagcccaggcuugccuguauuaaauaaauagucuuucuuccaagcugagauuaugaguguaauuaacauucagaaaaacguagaucuugaccauaaaaauaauuuauaacauggaauuugaggucugaauuuuggccuuugaacucugcuaguacauaccuucaguuccaauuuauaacuuuauggcuuauuucuuguuccucugcacaaauuuguagcuacuuuguuugucuuuauaagacaaaaugaaaaccuucuuuuucacgaacaaauaaugaauuuguucauucaguaauguucuaugaaacuaaauucuuaucauacggaauauugccuuaccucauucccuguaaacaguuggaaauagcuccuggccugguggaacaucaucuggguguguucaagguuauauccuugguucugguaaacuagcagacauaccuggugagcuccuaaccaugcugucuugaacacgcaaaggccauucccuaacaauggacauggguuucauuguguggucccuuggcuuccuucuucaugaacacuagcgagcuauuaccccugaccagucggagggcucauaugcuuuccuuaagguuuuauguuuaaaaucauuucacauucucaguaacauuacauaugaggcauuaaagaggauuuuaacuuuuuuuaagauuuauuuauuuuauguauauaaguauucuguagcuguacagaugguugugagucauuacgugguugguugcugggaauugaacucaggaccucugcucacucuggcccugcucgauccaacucugcucacucugacccaaagauuuauuuauuguucuauguaaguacacuguaucugucuucagacacuccagaagagggcaucagaucucauuacagaugguugugagccaccaugugguugcugggauuugaacucaggaccuucagaagaacaguuagugcucuuaaccacugagccaucucucuagcccgauuuuaacauucuuuauacgauaugagagagauaugaaaaauaucucuuaggauuuuuuugguguuacuagaaaauuucuuaaaccucugagaaauugauugcuuaguuauaacuaccauuauaaauguucacauagaacgcagcucuuugugcauaguaacgcauaauuacaaacuugccaugacgaguagguagguuaggauaguuuacuuuuaaggauuaaaagcuuugcuccccagaauucagucauuuuucaccuuugaacuuaccauagcaagcauuauucuggaacuguagagcuauaguauagucucauauucuuuaucuuuuaacugcauuggugacaguagugcucauuuauugaauuccagaaguugagauuauuguuucuacuccuuaguuacauagccagguaauugauauauccccgaugugagagaauauguuuuccauggcacauggucaagauuuuuuuuaaccauuugaguaaagucuguuaugcugaguuuuaaaucuaguauuugacuuuaaagauauuuuuuuauaugcuguguuuagaaauuuacagcuaugugcauguuugaauucguuuauauaugcuuuuaaaagugagugauuuguggauaaagcuggcuuuugcuuuuuccuucccuuuuuuuaaaccaccguaguacuuagugcuccugaaggaucucccuggaaacgagcacucauugccaauggaagauguuguugaacuucugcaaccauuaucguaagaagugaaagccguguguuaugcucacguugaauuauaaacugacagcgugguuguaagcuuauaaccuucaaccuuuucuaccacagccuuguguguucucugcaccgacgugaccaagaugucuguaaaacgauucuaagcaauguccuucauauagugacaaaccuaggccagggcaguguggacauggagagcacacggauugcucaaggacacuuccugacagugaugggagcauuuugguaggcauaagucucuuucucuaguuacuucacugccucuggaugcagauguaaacucuguacguuagagauuuccugguuaucauguauaaauaacauuuugcaucuuuuaacaauaauauacauaaucugucuuccucuuuuuauuuauuuauugguuugauuuuauuuuuaagauguauuuauuuauuuauuauacguaagugcacuguagcugucuucagacacacuagaagagaacaucugaucucauuacagaugguugugagccaucaugugguugcugggauuugaacucagaacguucagaagggcagucgguccucuuaauugcugagccaucuugccagcccugccuuccucuuuaacaugcauguuugugaaugaucucuuguaugaguauggguacacgugugucgcuccuguagcagucaaagagcaauguuggguuucaguccucagucuguaccuguuugaagcagguauaauguuugcuguugcacacaccugccagacuagcaggucuccaaguuucuucugcugcugcuucccgucucgcugucgacaucuugaguuuacacauaucguugcuacugcaccuuacuuuacaugaguucuggagagccagacucugguucucauacuuaaugaggggugcuuuucuguugagccauuuccccagcuaugucuuccauucccugaaaagcuacuuuguuuucuuauaagguuuucuuuccuacaguguuuagcacauggcccuguaaauuugaaucacauaauaacuugauauagauguugcauaaaaaauccuaaaaaucaacugaauuguugauccaaaugaaccaguugauuuugucacucuuaauuucauucauagucucacaguaacauuuuaaacagcuuucuaaccuuuuauuuauguuguguugggaagucaugcugcacacgggcaggucagugagcagcuagugggagucaauguuuuccaggaauugcacugagguccagcgauugccuuacccacucggucaucgcgauggcaggacaguagcauugggugguuguagauaaucaccugcaugccacuuagaugccaugucauuuaaaugccaugucacuuagaugccuccucauguuuuauuuguaagucaguuuggaaccuagauucucuaagucugugccauaacaaugaaaacuuaaaagauauucuguuuaucuuuaguuugcuauagcaugcaugcccaaagugugucaguuccaagguacaaaacaaauaauguacauuaaaaugauuuuucuaaauuuagcuugaauuuuaggaaagguaaaugcacuggcauuuuccacauaaugagaauuaauaaaauggacauuuuggaacuaaccugugauaauguuaguaucgguuggcuuucuuuuuugucuuugcuuuuguuugaauaauuacuacauugaaaaucuuaccuaauuucaggcauuugacaaaggaaaagaaauguguauucucuguaagaauggcauuaguaaagugucuucaaacauugcuugaggugaguuacuccauguuacuagaaaguucuucuuugagauuguuaaagcuaccucuauaucuguaugcuacucacaaauuuuucucuuaguuuucuuguauuuaacuuauuuuuuaauuguuauuuuacuauaggcugauccauauuccgaaugggcaauucuuaauguaaaaggacaagacuuuccuguaaaugaagcuuuuucacaauuucuugcugacgaucaucaucaaguucggauguuggcugcagggucagucaacagguaaugaguuagguuuucaugaagcucuuguauugcugccgacaucaguguggcacccucacuagcugugauggagcagugacuuacacuuaaucaguaccaggaugugccuggaaucuguguucuuucuuuagucugacaguucuuuugcuuagauagcauuauuuucuccaaguuacaagugaaaacucuggcuuugagagguaacuugccuaguucuauggaacuaauaauccauugauuugagugauaugugugugcaccucugccaccuaaggggguguagaauauuuggauauuaccauggcguuaugugagucaguaaagugguaguuucuucacuucauacagugaugacauaaucauugcuguguuuuaaccuaagauaauauuuggcuguuccaguuguucacugaugaugaaauagaugaauguuuuuggaaaagaaguuauaugcugcuuugaaaacaucaaagcugaaauugcauauuauucagaccuaaguggccaguaaaagaaggucaacauaaugauauuguccaagaagucacauacugaaccucggugauucucaaccuguggaucacgacgccuuggaggguugccuaaguccaucagaaagcaaauauuuacaguucauaacaauagcaaaauuacaguuauggaguagcaaugaaaauaauuuuauguuugaaagucaucauauacaugaggaacuguaugaaagagucgcagcauuaggaaggcugagagccacuggccugugauguuagaauuaaugaguccacacuuugccucugcgacagucauguuuccaugaacgagguguagucacauuccucauuuguuuuaauaagaaaguaguacguugucaggauugcuagugggauuguguggaaguucaaauccuuacugaacugagguuaaagcucucggguuauagaggauucuaguugaguguuauaacucaguguagugguggcauggggaaaaaaaucuacauuucaaaaaaauucaagaaugguuguuaaguaggauucauuggucuuuuugguccuugauuuguuagacauuuaauguugggcuauuucaagaaaagcuagcaaaauaaaggaaucaaaauaacaaauuauaaaaauugguuucuaagaaauaucaaggauaaaauuuaucgcagaguugccuuaaauauguagauauucucuguaagaggcacugauaaccuuuccccaccuaaaauauugugugaacugaacaucgaagcauuaagaugcucacuuuggggcugauuaaauauuagaacauaaugacagagaaguuuguggacucgugugauucauguuugcuaagaggacagugaaucuuucugacaacccgaguuuaauguucaaaucugaacaguaguucaaaaaucuuugaaaucuucuuuucuuacaggagacauugacuuauagauuaacauuuagcaggcugucugaacugcuaaaagagucuuucaaaccaaggccugcuaucuuaccucauggagggguuuucuuuuguuccauaagaugcuuuguuuugauauguaggguuuaaaaugaauuuaauuuuuuuuuuaaagauuauuucaggauaugagacaaggcgauuucuccagaagcuugaaagcacucccucugaaguuucagcagacaucuuuuaacaaugcauacacgacagcagaggcggggaucagaggacugguaacugagauaaccucacaccuguggucugucugugucguauuucucuagcacacuggagucgagaguuuguauucgguaguuuacacuauaaagccggucuaagucaaugguguggacugaauaaaauuuuucugaaugaauuuuauaggucagaaugaguccaauaauagcaauuacuuuugcuuuaacuuaucuaugcuguuuuugugaggacacuccaauuuaauggggauuuugauacauuagagaacuuuaaaagguuuguuuuuuuuuuuuuuuuaguuuaagaaaucuuuaaaaucaaaaagacaaacccaaaacacaacaaaaaauguuguguguguggugauguaugucucuggccuugcuauucaaagacuaagcuaaauuuggacuguagaaugauuacaacuaguuaaaaaaugcagauaggggcuggagaaauggcucuuaguuaagagcacugacuguucucccagaggaccagaguuugauucccagcacccacauggcagcuuacaacuaccuguaacuccaguuccugggggucuuguggcuuuuucugaucucugcaggcacuauacauagacuuacaugcaugcaaaucgcccacacacauaaaaauaaauuuuaaaaauguaaaugguucucuguuggggacuuuugaaaacuaauugaucauugaaaugaaagcaugcccuucuuuuugcaagauuuuguuucuuuuuauaguauagauggugauaaucuuuacagaagaaaacacuauaaagauguaucaguaauaaaaauccuccuagcaguagcagcuauagugaaagaacucuugauacuucuuguucucauuugcuguuugcccuuuaaacuauuuaacaccuuguuaaaaucucuuuuccuuugguaauucuuuccacuagaucuuaagaaauggcagcuuuuuuauuuaacuauagaaaagcuuguuucucgaagucauuuucucuuagcucauuauuauagaauuuaaacuuugcaggcugcuuagagguuagagaaugcuugaauuugagcugguuuaugauuuuaaaaauauuuaugccguucuucuuaugauucuuuuugaaguuaugugauucucagaacccugaucugcuggaugagaucuauaacagaaaaucuguacuacugaugaugauagcuguggucuugcacuguagcccagucugugaaaagcaggcuuuguuugcuuuaugcaagucugugaaggaaaacagacuagaaccucaucuugugaaaaagguauggugaauauguucacucuguauguggcuuuugacacuuagacacaaauauuuuaggcucggaauauugcaagcaagcuuaguuucugugugugugugugugugugugugugugugugugaguguguuggggcuuggacccagagccuuguauuuaacuacugagcuguauuccccuccacagccaaauuugaucauucuuuauguggcauauuaauuuguauucagugugacuuacuucuuagucaguuuaagagcauuuuacacagcacucacugagaauaaacaauaguggauggucugucuccacacagaccauauucucuggaauaguguuuauggagggagacacuuggagaugcuugguugcuuuugccuucuuaguuguggagaagcacauugggauuuaacauaguuaaacagaaaacagaguugaggacagcgugaccuuuacauuacauuuagggaagaggccugggcucagucaauuucaacaauaucaucccauucuuguagaauaugguagccuuccccauucuuccacuccaaguucauuauuuaggaaccuuuacagguuccuguugcauguuuuaauguggugaguauggucugaugggcaauuaauuaacuuuuuguaugagccuggguuccauggagcuuuauuguaggccagucugcagggaauugguccuaaaugaguuuaccuuuuaccuauugguauuaaaaugagaguuuuuaagaaguauuuuauuauacuaccugauuuugcaaguuguauguguugggauuuuuuaaaaauguggacacgaggcugaaaauaauuuuucccuagacuuuccuuugagauauagucagcuguguaaaauuaggcuauuauuuacuuaauguuuauaauguguuuucuaugugcucuaugcuauaccaguuauuaaauacauuuuccauuuucucauuugcuaucuuucugucauucauuggugaagaaaucaaaguagaaaaacauugagcgacugcucuaaaguccuauuauucccauuuucuuaaacaucauguuuuuccuuucugcagguuuuagagaaagucuccgaaucguuuggauguagaaguuuagaagacuucaugauuucucaccuagacuaccugguuuuggaauggcugaaccuucaagauacugaauauagcuuaucuucuuuuccuuuuauguuauuaaacuacacaagcauugaggauuucuaucgguaggcugcagcaguguuucgacaacccccuccucccuagcuucaaguaggaaguagccuaguuuuuuaaaaagucagauugagacgaucagagaaugugcuugaacuuaggacuguuagcacuauuaguaaucagcugugcaucuuugaguaggccaucaauacaucaugcaucuuggucuacacacaaguaucuucccuuuggaaaacaaucaaagauuaauuacuuagucgcuaauuauuuccugcuugcuuuucuuuccuauugcuuaauaguagguuauuuaaacacuaugagguuucaaaacuuacugcaaaguaacugguuuuguggggacugagaccuagcucaguugguacagugcucaccuagcacguucgaaguccugguucagcacugccuacgucaaccagggagaguggaguauacuguaaucccagcacuccgaagguaaauagaugcaggaaacucaguaguucaaggugaucuccaucuacaucgggaguucagugccagcuuauacuauagaagacccuguaauccaaaaaaaaaaaagagagagagagagagaaacagcauuuucugauagauguacacuugauggccuuaucacccauucuuuuuuuuuguaguaacuuguauucuuucaauuuauaaauugcuuuuaccuuugaucuuacaguauuaccuaaguugauuauguguaaaaaauaaaauuccuuagcuggguaugguagugcaugcuguaauuccugaacuuaagaggcagaggcaggaggauuaccacaauuuagaggucagcaugguuuauauaauauuuuccaggcuagucugggcuacagcaugauacuuagucucagaaaaaggggaggaagaauaaaguuacacuauuuuaaagugugauuauuuauauuuuacuuuaauuuccccacuuacaaagugagaaaaagaguauuuaaugaucuauggggcuagagcaauggcucaguaguuaagcgcacuuacuccucuucuagaggacccagguuaaauucccagcacccauuugguaucucacaauuaucuauaacuuuuguuccaagggagccagugcccucuucuguucuucagaggcaccagguaugcacagcaguacauagacauauaugcaggcaaaacaccauauucauaaaacguuuaauaaauaaaagauuaaaaauauaaaaagaauauuuaaagaucuaaauuaauguuuuaaacacugaauguuaaagcauuuugcuguuuugauguaaaauuuuacuuugaaauuuauuauaaccuaaauuuuauacuuaacauuuucaggucuuguuacaagauuuugaucccacauuugguaaucagaagccauuuugaugaggugaaguccauugcuaaucagauucaaaagugcuggaaaagccuguugguagauugcuuuccgaagauucuugugcacauccuuccuuacuuugccuacgagggcacgagagacagcuacgugucacagaaaagagagacugcuaccaaggucuacgauacucuuaaaggggaagacuuccuaggaaaacagguauggcgucaguuuuugucugccuuuauguacuggcaaaagaaguaagcuugaaccuuuaagguuacuggccuuaagcaugacaacuugcguucauaucccuacauccacauaaaagcuggagguggcagcucacacauacaacccagagucggggauccuggauaugcgcuggcagcucuaaagacuuccuguccucugugaggcuaccuguagcagaagcagauuggugagaaaucugccucuuagagaggagucauuuuaaugacuauuaaugaaaggugguacuggcuuccaguauccagagaaguacacaaggcaucuauagggaauagugccagucacaaagauuugcuuuugauaguuaagaucuuuaaagaucuaguggacaaauaaaagauaagaugcaauuuguggaacuuugcuaccuggagaacuuccaguuugaggaauugaaugcuaaauccaaagucaguucaaaucguucugaaaaauagaaagcuugaagugagguuuuccuugcagaacuugggacuuagauaucuuuauuuuguuuuugguuuguuuguuuuaaguuauaaaguaagggaucagcacaugcccuuugugcuguugugaaguucacagauaugaacguguuuguucuauuuuaauuuuguguccuuacagauugaccaaguauucauuaguaauuugccagagauugugguggaguugcugaugacauugcaugagacagcugacucggcugacucggacgccagucaaagcgccaccgccuugugugauuuuucaggguaugccggucucacacuuggagagcuagccgucgcugacgggugaccuuacucuccugucuccuucacuguggucuucugcugcagcuguucuuuccagcugacaucuaucucaucuuuucucucuuccguggaacuuuggcaucgagccaccugaugccuuuugaggcuguuuuucuuuauguguuucaagguguggcuuccuucccuucccacaccuugccuuucucugcuuccuuuuccuugugguauuccuagcugucuaguuuaauuuagaugugaaaucuguugguuguguaugaauauuggugaugggaggcguggcuugaccguaagguacuugaaauuucucaauuuuuaaaaaagauguaaaaauguuuuauuuuuauauguacagguguuuugccugaauguaugcgugcacgcaguggucauggaggccacaagagaacguuagaaccccuccauuccccacucccagcccuggaacuggaguugugguuguuggcuaccauguggguuaggaauugaaccuggauccucuggaaaagcugucagugcucuucacugcugagccaucucuccaguccccaaaauauuuuguuggauuuuguuucugugauacacgguuucacuauggagcgcugcuguccuggugcucuccuuguagaacaggcuggccccaaacucaggagcucugccgacuucugccuccccagugcugggauuaaagucaugugcugcucugcccugcugaaaauacuugguguuuaaauaugcagacuaugcuaagcauguaacuuagcaguaauacugagaaagugcucagacuuuauguuuuaaaugaugcuauuacucuaaugcaucgcccggcuuaagauacuguuggucucgcaauagucauaaaggagaccugaaggcaaguuuuacugagucccaacucuggggcugccauuaacuuuguaaaagguuacauaaacaaauuauguuaaacaaaacaucugacauuaauuccauggggaagaugccuaauuaaugguugugaaucauuuuauugucugugauuuaaaaauaauacaaaaaaacaaaaaacaaaaaacaaaaaaaccaaaaccuaguuuuucaguagaaaaccaguuuuguaacuugggagauauuuuauuuuuaaauaacuacauuucuuuucuucugcuucuuuagggauuuggauccugcccccaacccgccauauuuccccucacaugucauucaggcaacguuugcuuacaucagcaacugucauaaaaccaaguuuaaaagcauucuagaaauucuuucuaaaauccccguaaguacacauugcauuacuaauacaauaauuuauaagaaaaguccucuccgggucuuggaguuggggagaacauaaaauuaguugacuaauuuaaauaggaacgcacuugauuaacaaguuguaucuugauauguuagucgguguuuaacuaauaugcauuacauauuaggucaggauuuuaugaucuugccuuuauaauuagcucagagaacauguuuccuguuuaaucauaauauauuaacuuucaguuuacuuucucaaaacuaacuggcaacuuuuucaaaaguaaaauugggcugggugugguggcacaguccuuuaaaccuagcacuggagagguggaggcagguggaucucugugaguucaaggacagccuggucuacagagugaguuccagggcuguuacacagcgagaaaccuuaugucuggaaagaccgaaaaacaaaaagugaaauggaugcuaauaauuuaauguaacauuuuacaugugauaucaagcccauaucaaaaugaucauuuaauaaaguauaaacuauguugguuguagccaaauauauuuuguuuuaaaaauuucuucucaaugugugccuauuuuguaggauuccuaucagaaaauacuucuggccauuugugaacaagcagcugagacaaauaaugucuuuaaaaagcacagaauucuuaaaauauaucaccuguuuguuaguuuauuacugaaagauauacagaguggccugggaggggcuugggccuuuguccuucgcgauguuauuuauacucugauucacuacaucaacaaaaggugagugagacauuacaacagacaccugcauuagcaguccucuguuucucauaaauccauuugcucugucaguuuuuuuuuccuuaguuccaaaaguuugugauuuuucuuuuuuuguaugucuucaaugaaaaaaaaaauuaaaaaccauucaucauuuugguagaugaaaucaauccuuucuagaagauuuuuuaccuacguaauuguuuccuguugauucucacuuguguagcacacuagacugucuccucccccacugaacccuaguaccugcagaucuucccguucucccacauuccuucucgugggucuucgguaaccucuaucuuauccucaacuuuuaaauuuuaaaauuauuuugaauuccauuuuuaguaacccacugcagugccugaaguucuuuaggaaauguuucuauuugcuuccuuuuaauacuucaugcuuuauuucuuuacguggucuaaaauguuguugcuaaaaucuuaccccuucagcacacaauguggucaaguguggaauuggguucucccuaagguguggcuccgaaugcugcuucgcgcaugucaguaucugggugugcacauggaggccagagugggaaaugcugcaucuuccuggaucucccaccaccuuauuucacugagacagggucucuaagugagaaucuggccauugcagcuagucuagcuggccaacaaguuccuggcccaccaguccugugccagggacagccauggccgggucuuuaccuaggagcuucggauuagcauuuagguugucaggcuuucagaguaaacacucuuacucauugagccuuguuugaccuuuaucccuuuucuucucuguuccuuccuccuuccuuucuuuccucccucccucccugucuuaucauuuauuaugcuuaucuauuacugaacaccagcuguuaaccagcuccugcuuugucagugauuuucuugcugcauguauccaauggagccuggcccucuuugccugcuuuuggacagggcccuucagagguuacgugaauaucaguaguacuagggauguggagagcaugaaagagaauaagacuuucguuuacaaaaaagcacuguccuuccgugcuugcuggcuugcagugauucuuuaaaaucuuucuuccuuucuuuuuugaaugauugugacaguuuuuuuguuuugcaguaauuacaugauguaucuuucagacauccuuugucguuuuuguguuauaaccauugagagauaagcuaugacacuuuuuuugucaaauccuauaagaauuagagacauugaguaaaaaagaacuugaaauuuauuucagaguaguuuguuaggccuugcuaucauucauucauucauucauucauucauuuuuccuguuaggucuucucauuucacagaugugucguugcguagcuuuucccuuugcugugaccuauuaagucgaguuugucauacagcuguaacucaauguaaggaugcucuagaaagccaucuucacguuaucguuggcacacuuauuccccuuguggauuaucaggaaguucaagaacagguaauuucccagugcaucuacaacagaguauuugagacgaaagauacucuuaggaacugaaugcuuuaaguuuaccuuaaugaaaaugcuuuuugauaaaugguggagaagacauuuuuagcaaauuaauccuugaaaucaauuacuaccccuuggugguuuugaucuaauaaauccaauaguuucaucuguuacacugaacuguagucagaaguagagcuaacaguucccaucgugaugguccgugagaucuccuauaaauaacauuccaguaugaauuccuuaugccuccuuguucagcacuguaaguauuuuagaaguguuugaagccauaaccacuaauagcuggguaauacauaugccguuagaacaugucuucuggacuaggguagcagagguuuguuuuuauaaugucauaaugggauuuggcucuuuaaauauaauuaagacuucucugucuucguuugauaauugucuagguauuggaccuguugaaguacuuagugauagauaacaaagacaauaaaaaccucucugucacaauuaagcuuuuggaucccuuuccugaccauguuauuuuuaaggacuugcgucuuacucaacagaaaaucaaauauaguggaggaccuuuuucacucuuagagguaauaaacacuuuauuuauaauuuuguauuauagaacauaggcaaaaguauuauuuuaaaacauuagugcuucacuaauaaggacagaauacuuucaguuguaguaaaauuaauacauaagauuuaccuucuuaaauacaauacaaaucuuuuaaaaauauacauagauauuuuaaauguauacaucugcguguauauguaccuuacgucugcaugugcccaaggaagccaacagguuucagaguccccuaccacugaaguuauguauggcucugagucaucugacaggaguucugggaacugaaugcaggucgccugcaggagcagccagcucuuuuaaucacugggccaucucuucagccucucagaacagaucuuuuuacaucuucuugcauugcauuuaaaguacagauaucaaagcuuccugacagagauaaauuugaauauucagagaauaugauacaaaauaguauuaauuuuaacaugcauaagguccuaugguucauuaauaucucaaaauugccauguguuuuucuuugagagucaguaauguuuauauuagagaugauauuaagaauuuuaucuuuauaaauuguaguuauaucucuaacauuuuucuaaauguuauaauuuuaaaaaucauuccauuaagacuauaauaugaaaaccuuuaauacauuuaagguguacaauacuguuauacuaacaaguaaauaaauuuguaacauuuccuuccaauucaguuauguugacaucuaauauagauaacagaaucucuuggaauuuaagcucuuaaaacauugucagaauucaaguggaagaaggagcuuaguucuuccauguugguuuuaugggucagcagcuauagacaguacuuacuaucuuaccuuguauuguuucacucuucacaguuagccaguacauacucagcuaauauuaaauuaauuuggucuuuuaggaaauaaaccauuuucucucaguaagugcuuacaauccacuuccgcugaccaggcuugaaggacugaaggaucuucgaagacaacuggagcaacauaaagaucagaugcuagaucuucugagagcgucucaagguacuaguuuauuuguuuaucuuaauauuuauuuuauauguauggguguucugcuugcauauauauuaugugcaccacgugaaugccgugcacauaaaaggguauucagugcacguaagaggguauucgauucuccuggaacuugaguuaacagaugguugugagcugccgugugggugcuggggacugaaccaggauccucugcaagagcagcaagugcucuuaacagaugagccaucucuacaacccccuugcaggaauaauuuuaacaugaauuuuuuucuuccuguuucuuucucaaauauucuuugugaauuuuucuuagcuuaccaccaccaccauuugcauuccugucauuacagagaggccacuggauggcacaggucuaaguuccgaauacuaugugggaacaguccaagcaagguuccuucuagcuuuuguguugaacaauucuuauguuucaaguuauuuuuuauuuugcuaagauuauuaacuuuucuguucaacuuguuccaaauauuucuuuauuugauggguaaaucuugcuaaucauuucccugugauuguauuucagaaggaaguucaaauucugucuacauguauuuuuaaaauuuguuuaugauuuaaagccuuuuaaaaugugcuaguuuggggaguggauguauuguccuuaugauaauugaagcauuuuucucuaaauuauuucuagauaacccacaagauggcauuguggugaagcuaguugucagcuuguugcaguuauccaagauggcagugaaccagacuggugaaagagaaguuuuagguaaaugauguaggcaaauggucuucuuuaguauggucagaaugaguauaagcuccucauuugauucacuggaaaauuaaguauggcuugcuaaguuauauaucuguuuaauucagguaacccuggauagccaagugccuuuuguauuuccgaaauagacauuuaagauaaaguuagcaauuauaauuaauacuguauaaauguuaaccguaaaaugccauguaaauaugcagggaaaccauaaaucucugcuuaguuaaguugcgaauuaauuaacuucugaaauguuucauaacuaugacuggugguauuuaauguuuauuuuguuuauaacaagaggaacagagaugcugaaggauggcugucuuagucaggguuccuauuucugcauaaaacaucacaaccaagaagcaaguuggggaggaaaggguuuauucagcuuauacuuucacacuguuguauaucaccaaaggaagucaggacuggaacucaagcaggucaggaagcaggagcugaugcagaggccauggagggaugucccuuacuggcuugcuuccccuggcuugcucagcuugcuuuguuauaaaacccaagacuaccagcccaaagauggaugguaccacccacaauggacucuacccccuugaucacuaauugagaaaaugccuuacggcuggaucucauggaggcauuuccucaacugaagcuccuuucucugugauaacuucagccugugucaaguugacacacaaaaccagccaguacaaugguuaaacucagauuuuuuuuuauaauaccauuuaagucuuugauugcugccguuuaggcauagucuaaucuaagguaacuugcugacauguugaauauaggcacuuaagauuuggcggucuuagggugggagaaucacaugguuaacgcuagccagaggcuggcguggcagcagugcuuucugggaagaguaagugcugguggcgcccaauggugcccaccucuucucucggugggagccugcugcccugcaugccuaauguuuaggcugguuuuuauuuaaauuuaucuuauguauagacuugaauacagcccauguguuccugauuucaaguaucuguacacaaucaaagaauaacugcauucgcuucccagaucuagaaacugaaccugccucaucagaauccucaacucugcccgaccccagauuaacaucuuuguuccucaugcuguuucuggccauaaaccugagcugcucugggaucccucaguagcuuucuuauguaauauaaagugaaccugcuuugaacaugugauacacaucacacuucgugauagaagaaaaagccuuuccucuaacaucaggcaaagagaaguuaucccuuuacugcuuguauucaguacuguaugugaguuccagcucgagguaccaagcacggagcagaacgagaagugugcagagugaaaaagaagcaaagcugcccguguuuguagaugcaugauggccuaugcuuaaaacacucuugauuuucuuuuuaaauuuuuaaagucgauacuucaugcagugccagacauguuaaugcuuuugcuucuaauauucugugacuguaauuguuaacuuauuuccugucaucucuggugaaaaauauauuaccacacugauguauuuuguagcuuucuuuacucccaguguuagaaaacacugaagucuugaaacaugauaaagcaguguuaauacuuuuuaugacucgacuaaaaugagguuccuauaugcagaggcugucggaagguguuugggagaaauagguccucuggauuucuccaccauagcuguccagcauaacaaagauguguccuauaccaaagccuacggguuaccugaagacagagaacuucaguggaccuugauaaugcugacugcccucaacaauacccugguagaggacaggugaguacagaggaugccuuucaucugauagagacaucacaucuggccuucaggaaaaugacacccauacuucacucaaguguacacuuccuuuuucuuuuuuaaacgauuuuauaauuuuuauguaaaucaauguuuugugugcaucuauguaugugcaccacaggcacgccuggugcuccuguggcuccgaagaggguauuggauaucuuagagcaggaguuggaugaucgugaagcaccauguagaaucgagcccagguccucugcaagaacaccgaguacucuuaaccacugugucauacucuagucuuucaaguccuuacauuaaagaaaaaaaauguuguauauuuuaaugaaacucauuuaugacuuugugugaucaaauacccaauauuccugacacuugaugguggugaaguuugucuguucuaaauucgaguaagacgaaguuagacaggauaaaucaguaagcugcaggugguccacacagucaguuaaaauacagaacuacggacuggugggguggcucagcagggaaaaggacugccagcaggugugauagccugaauuugauccccaaagcuaaguggggcgggggagagaaccugcuccugaacguuguuuucugacccccacaggcgugccgugucacgcaccuccacccucacacacacaauaauaauguuaaguacaggaagguaaagaguguuuaaaauaacacuuaaaauagugauucuugcgggggcggugguggcgcacgccuuuaaucccagcacucaggaggcagaggcagguggauuucugaguucgaggccagccuggucuacagaaugaguuccaggacagccagggcuuggggggugguagggaagagugauucuuagaaccagagugcuuuguuccuucaagcuaaucuuuauuuugauuucucuaaaauaauccauggagcaaaagcuuuguaauuucaguccagggcuagaggucaucugaguagacaaaacguuccugaacaaaauugaaccauccuuugguccuugugcuuccuccagucucgggcccaguaacacacucucucugucaguugaccacauuuuuaggucucuuguagcccuccauuuccugggguguuuuuguuuuaguaaaaagagaguucugcuuuuuauuuagagguuuuaaaugcuaaugguuuucaacuaacugcuuugucagaaugaguguauguuccuucaaaaaguaucuuuccaauaguuuuaacauuuggaguaagauauuguacuucacaucaaaaaugauuuguaucucuggagaaaacaucagcuuauuuccucaggugaauuaggauuucgccauuuucacuaaucauauuuauuaggcuacauuauuuccaaacaauucuucuuaaauuuauggucaguguaacagucauugugcagaaugaagagaauugcuauugauuaguaacucguauuuacugagcgacuauuuuaaaaauccuuugacuuuuucucuucaguguuacagaauauuauagauaaguuucuaauauuuuaaauuauuaaguuuaaaacuuuccagucaaauuugcauagcauuccagauuaauaaauuaacuauucauguuuuucagugucaaaauucgaucugcugcugcuaccuguuugaaaaacauuuuggcuacaaagauuggacauauuuucugggagaauuauaagacaucagcggauccaaugcugaccuaucuacaaccuuuuagaacaucgaggaaaaagguauuuuaaguaacuaauauacugcuugcuagaaagacucagacugcacguucugaauucaaggcauuugugauuuuucccuaggcagauuagaaaguugaaauggauacguaaagagaugcuaauuuggggccaagggaaacucuuucccaauauaccugugauauuugcaucauugauccgggauauuuuagggguugugaucagccagcaagcaauuacugcuuagcauaccuuugauaaaauagaagauguuuaagcuucuuugacgcauguuaaucaucauggcaaucccguugaaagcugucugcagugucuuuaagagcuuuugcaucuuugcucuaagcauuucucucuucagaaagugacagagcaauaugcaguuuuuugguguuuugcuuuuuuuuuuuuuuaaccuguuugaauuuaauggaaauacgcaccauugaaauagucauuuuaauguaucauaguuuugguucccaguaaaauuaguaguaaaucagacuguuaaugaaguuaauaauguagccuaauguaaaguauuagguuuuuuauuugguugguuugaguuuuuguuucuuugguuuuuugauuuggggguguuuugguuuggguugggcuuuuguuguuguuguuucagucugggaguuguuguuuggucugguuuugguuuuguuuuuugaggcaggguuucucuauguagccagagcagugcuggaacucacuuuguagaccaggcuagccuugaacucagagauucaccugccucugccuccugaguccugggauuaaaauacguguaugccaccaccucccagcuaaauauuguacuuuuaacauguaauuuuuacauuuuauuuugaaaucaauuuuguguagauuugaaucaguuuuacauaugagccaggugaggcagagguuguggcuuguguggcugccagugaaugacagagcuaacagaggaauucagauuucccgcucccuacacauaauauuuuuacaguuucacucccucaguuuagaucccccaucccacaugugugcuccccacuucacuuguuuguuuuucuagcaaacauugccucuuagggccuugugcuugaccacugacuuguaccccuagcuccgguuuacuuuugagauaggauuccaguaagauaccaagcaggcugugaagguaaaauccucuugccucaacucuuaaauaggugggauuacagaccugaaccaccauuccugaucuaaucuguuuaacuuuuauuaaacauuuuuuucauuuguguguguguguguguacacauguacauguaugugccauggcacacauacacaggugaaagaacaacuugccagagucaguucucuccuuagaccauguacauucuugaaucaaaccuuggucagagaggguugacggcaaguaccuuuacuuccugacuuauuuugugugcacaggccccagguguaguuuaagugcacucaauuuuauuggaagcagauugacuguaccugguuuauuugacauaggaaaugacuuucugccucuaguuuuuagaagugccccgaucuguuaaagaagauguuuuagaaggccuggaugcugugaaucuguggguuccucaaagugaaagucaugacauuuggauaaagacacugacgugugccuuucuggacaguggaggcauaaacagugaaauucuccaguuauuaaagccaaugugugaaguaagagaauuaaucugacuuagagccuguguuuuuguuguuuguuugcuuuucccauuaauuuaaauucugugucucugauugugauuuacauauuugaaaauaacucuaaaugaugaguaaaccauccaccaguguaauguaacccacauccagcugccacaaguccacugaaguggcuaucuccguuuagccagaauaaacagcaggcuuuagguuuaagaaagcaacauacuaguuaaauucuacaaauugcugcaauaauuaguagugaugcuuaaaguaauugagauuauaaguuauuuacguuauugaaagucagcuccuauuucuucacugccauuuggcauucuccaguaugcuuucugggugaagcuauuccguuucacauggaaggucugggacagccaauuucagcagauccuaaguaggugagcuaauaguguuuggggccuggaguguggcucacgggagagcagguuaugaaugcauuagucagucccugggaucaguccuggugcuuugcugccuuuuuguuguugcuguuuugagauagggucucgugucuccugaacucuguguguaaccaggauaacugaccugguguuccugccacccucucccaaggucggaaacccuuugcuugguauugcuggguuguuuuuguucuguucuguuuuucuuuauuuuaaucacuacuagauacacacuuuugcuuguuguaguuuuuaauugaucugucaggggaaugaaccuuuucaguaaaugauguuacucuaauucaaacaauugaguggauauaugccauguccuaggugaaaaccgacuucugucagauguugcugccauacuugauccaugauguuuuacugcaagauacacaugaaucguggagaacucugcugucugcgcacguccgaggauuuuucacuaguuguuuuaagcauuccucccaagcaagccgcucagcaacuccugcaaauucggauucagguauccuguuuguuaguguuuauaccguuagcaucucagcucuagagaaagaugguuccguaaguuacagggcaacuuucugcacacuccuuacaccaggcauugugcuugcaguguggacgugaaccacacagcacucccauuuuaguaguggaaaaaaacauguaaacagacucguccacauguguuguuguaccauggaagaguugagauggaguuuuuauauuuuuagacgucuagccaacuacucuuuaaaaacuuuaccaccagccaggcguggugguacacgccuuugaucccagcacucgggaggcagaggcaggcggauuucugaguucaaggccagccuggucuacaaagugaguucuaggacagccagggcuauacagagaaacccugucucggaaaaacaaaaaacaaaaaacaaaaaacaaaaaaaaaaaaaaaaaggaaaggaaagaaaagagaaguuuaaaaauucaaccuuuaccaccaagucaugcauauuuuuguaggcaauaaaaguucuacaaauuuuuuuaauuacccauaaucauacccauaaccaaagauaucuacauuuggauucauauguauauaaauauaaacuuguauauuuacauauguuuugcauuuagauuauauccaucuaauuuuuuaauuauuuuaaagaaacaauuagauuguguuuuacuuaaucuucaauuuuacuuccauggugagaagugaguauuuuucaggccuuaaaagagcauaucaaauaaaucacgggagcauuuccgauauuauuuacuaacagaaguaauuacauuaaggggguuaggaagacgacucagcagguaagaugucagaguuuggauccccaacacuccuguaaaagacauguuacauuucaagaaguagcauuuuaggggcuggagagauggcccagugguuaagagcacugacugcucuucuggagguccugaguucaguucccagcaaccacaugguagcucacaaccaucuguaauggggucugaugcccucuucuggugugucugaagacagcuacaguguacucauauaaauaaaaauacaaaaauaauuuuaaaaagaaguagcauuuuaauaaaaaccacaccuuuuguguuuauuacaguuauuucagcauaauuguggcuauucaguugucccaguuuucugcuuugacuaugauggggugguuugaaaugucuuuggugcucuuuagacuucauguugcugguuuuauguauccgaguugagagcggcuggggcgaguugacuagugccuacugaguuagaguucuguaggauaagauccaauguccugcugaagaguggaacaacuccugacugugaucauguauggcauguaaaagcagauagguaaaagcagauagacaagccuuugagguacuggaaaguccauaaccugaguucaguucucagcuucacauuggcuggcucaccuauagcuccagcucccuggggaccugacacaccucuccuccauggaugccugcauucaccuacacacacauuuuaaaaaaucuuucuuaaaaaaaaaaaaacaaaaaccuauucuaaacaaauaaaauuuugaggagaugaacauauuuaaccugacuaaaacauuaaaaaauacauccuggauugaaacaucuaauggcaucccauuaauauguaugauuuaaguuaaaaguuuuaaaagaacaaaucuaucugaaaaaaaaaacaugcaaauauaaacauagacaaaguuaccccuuaggagcuauucaucuaaauagucuggaaugugcuuacgaaauuugggggggguugcugaauuaaaaauucuaaagcaugggcuaaggugagaaugguuuauggguaagggugcuugccaccaaagccugaguuucgucuugagaaucccacacagugaaaggagagauccaaccugcacacucugcccucugaccucugcauaagccccgugcagccagugcccacacacacacugauuacuguaauuauguuuauuaauaaauauaaucuuuaaagcccuaaauuaaaaauuauugcagacacucugcaaacuauguaaaauauaucaccuauguuuaauugggaaaauacagauguaaguccacaauuacaaguaaccauuuaaagucuaaauuuauuauaaguacuguuuaaaaccaucuuacuacucacauuuaugcucugaccacauaguagcaaaaucaucucguuucauuucugcauagaguaucaauauuuuuacuaccuuaaaugaaauacugaauuucacauauauaaaacucuuacugaaaaugacaauaaguguagauuccuauaaaucuuuuuuuuaauuuauuuauuuuauuuauuacguauuuuccucaauuacauuuccaaugcuaucccaaaagucccccauacccucccccccacuucccuacccacccauucccauuuuuuuuuuuggcccuggcguuccccuguacuggggcauauaaaguuuguguguccaaugggccucucuuuccagugauggccgacuaggccaucuuuugauacauaucuuaaaugcugugucucaaggucucacaccuuuacuggaaugucucaaacucagcugugugaauaaaaacaaacgcccgcacuaaaacacuuuaucacccaucugaaugcacauccugccaguuguguucccucugugccccucauccuuucugcuuuccagcucugguucagcaguagagauccccucacugucuucugaguucuacuugauacuagccaccucggauggacuucuuuuuucuuuuuuuuuuucuuuuucuuuuucugucuuucuuucccuuucuuucuccuuuugagacagcaacucaaacucagucggcaguacccuaauucuucugccuuugccucucaagugcuggcuauaggugccaugacacccaguuuacacagagcuggggacugagcccauggucuccugcaggcuagccaagcacucuuaccaaccgagcuacucucucagcuccaucacacccugcuaacguccccugggucucuauccucucccuuucccugacugacugguauuuuggcuucagauguaacuuucucuuucaggccuuucuuaguccaggugaggugacucuccugugacuucugcagcauucuuaccuuuucucucacacccuugugcaaccauguuaagagccuccaggcuagucagcaagcucugugcgcaggaacagucuugauuuguucaugguuguaaauguacuaagcaccuagcacauaagacauugcauauaucucaaagcaguagauauaccugcuucagaaacaaauuauaauuuguuuuuuuaauuggauauuuucucuauuuacauuacaaauguuuuccccuuuccaggucuccucuucagaaaccccuuaucccaucccaucccccucccucugccucuaugaaggugcuccugcacccaccuacccacuccugucuuccugcccuggcauuccccuacacuggggcaucaagcauccucaugccgaaaggccucuccucccacugauguccaacaaggucauccucugccacauaugcagcaaaugcccuuuauguauauucuuugguuggugguccagucccugggagcuccgggagggggggggggguucuggccuguugauacuguugcucccucuguggggcugcaaaccuccucagcuccuucaguccuuucuucaacuccucuauuggggacccugggcucaguccaaugguuggcugugagcaucuuccucuguacuugucaggcucugguagagccucucaagagacagccauaucaggcuuccaucagcaaguacuucccaguauccagguuuaguggcuguauauggaauggauccccagguggggcagucucuggauggccuuuccuucagucugugcucuacacuaucuccauauuuccuccuguauuuuguucccccuucuaagaagcacugaagcauccacacuuuggucuuccuucgucuuagguuucauauggucugugaauugaaucuugaguauuccaaacuuuuaagcuaauguccacuuaacagugaguacauaccguguguuuucuuuugugacugaguuacuucacucaggaugauauuuucaaguuccauucauuugccugcgaauuucaucaagucauuguuuuuaauagcugaguaguauuccaugguguaaauguaccacauuuucuguauccauuccucuguugaggaauaucuggguuguuuuuagcuucuggcuauuauauauauauggcugcuaugaacauaguggagcauguguccuuauuacauguuggaguaucuacuggguagaugcccaggagugguauagcuggguccucagguaguacuauguccaauuuucugaggaaccaccauacugauuuccagagugguuguaccagcuuuuaaucccaccagcaauggagaaguguucuuucuuucuccacauccuugccagaaucugcugucaccugaguuuuugaucuuagccauucugacuggugugagguggaaucucaggguuguuuggauuugcauuucccuguugaacauuucuuuagguacuuaucagccauucgaguuuucucaguugagaauucucuguuuagcucugcuccccauuuuuuaauaggguuauuugauucucuggagucuaacuucuugaguucuuuguauauauugaauauuagcccucuaucggaugugagaugguaaagaucuuuucccgaucaguugguugccauuuuguccuauugacaauguccuuugccguacagaagcuuggcgauuuuaugaggucccauuugucaauucuugaucuuagagcauaaaccauugguguucuguucaggaacauuuccccugugcccauguguuggagacuuuuccccacuuucucuucuguuaguuucaguguaucugauuuuauguggaacuccuugauccacuuggacuugagcuuuguacagggaaaaaagaauggaccaauuuguauucuauauguugaccaacaguugaaccagcaccauuuguugaaaaugcucuuuuuuccacuagaugguuuuagcuccuuuguugucaccuaagaucaggugaccauagguucauuucugguuuuccaauucuauuccauugaccuuccugucuauuuuuguacaagcaccaugcaguuuuuaucacuauugcucuguaguacagcuugaagucaaggauggcgauuaacccagaaguucuuuuauuguugagaauaguuuucuggguuuuuuguuuuuuguuauucuaaaugaauuugcaaauuguucuuucuaacuaugaagaauugaguuggaaaccaaauauaauuuauaacaaacucuuuacguuauauuuuuauauuuccuuugaaauaaaaauaaugccacuaaauuaaauugauuucuauuuuuuagaaagugauuuugugaugcuggugagauggcucagugguuaagagcacugacugcucuuccaaagguccugaguucaaaucccagcaaccacaugguagcucacgaccaucaguaacaaaaaucugaugcccucuucuggagugucugaagacagcuacaguguacacacauauaauaaauaaauaaauaaauaaauaaauaaauaaauaaauaaauaaauugaucaaucaaucaaucuuuuuuuuaaaaaguguuuuugugguggacaagccacccaucauaaccuuacaguguagaaggacacacagacaagaaaagacuuucacggcagugugagacuaagaagagauauuucuguuuucguuagagucagagaacuuucuccgaugcuguuuggauaaaaagucacaaagaaccaugcuugcuguugucgacuaucugagaaggcaaaagagguaaaaugauaaccguuguuucucggguuugggaacugggcacucuaacuucuucuaaugcuuuuuaaucugauuauuuuacaugcaacuuuuucagacugcuaaaauugauugguguggugcuugugcauuaaaauuuuaauuuaauaauccauaugcaggacugcaccugggcuaaguaugggagacugucaguuuuguuccagcugucccagcaggcauccugcagaagcuaagucaugcaggcuuuagcuuaucgcagcagggaagaugcgggaacugagcacaugguuuuccgagguuguucucaguacugcagcugcucaugaacucguucucagaguagcugggguuggucaucguuaucgucuuuuaucgucuaaagccuuuccugcucugugccaaacuuaccaugacaaucuguaguaaguuugugacauugucaugggggugauuuagguaaguuacuuuacaguauagugucuuuguuucuauuauaauuuuuuuuugagaccaggucauuguagccuaagguaccuuucaguucuccacguagcucagcauagccuugaauuccugacauucuuccacuuggagugcuggguuuuuaucaguguguaccauugucccagaccuucaaaggguuauuaacaaaguucagaaauagcucaaaauggguagugcaguugaagugugcugcuagcaaguuaccagaacucuggagaaguagcucagaguggucuaguccaucuuacgauuguucaacuuuacaucaauguguggcagcauucagagaaagaaagguggacuucagaguccggucauguuccaggcuggugaaaauacagcaugauccuuuuuucucuuucucaucuuuguagcccuggcuguccuuaaacucacagaaaucuacaugcaucugccuccugagugcugggauuaaaggaugcaccacuauguucagcaaucccuucaugagauucuagauuguggcucuuuaacagcccugugaugaagaggauaaaccauaauuggugcccccauaguauacuguguuguuaugauuuucuauagguuaugugcgauaaaugcauuuuuuaacuuaaaguauuuccaaccugggauggauauauuggccauacucccagcccaagugaaggaacaugcaugauuuggacacguaguuauuaaugccucauaugcuguguauggcgguaaugacagcuguuaguaaagaauggggugaugaacuggaagaauaauagauuauuugacccuacaugcauuuguguuguaagcaaugcaagccuuucauaacauucuauuucacaaacagauuucaucuugcauuuagugacuuugugauuagaaaguuugugacuuacuuuguuuuauuguagauccuuuucuaagaaaaccuuuaacuguagcugugaguaccuuuucuggugucgggagguaguuucaucuuggggccaauuauuucagacuucaugagguagaauaguauuagcaaggcauagagaagauaaaaauccuuuuuuuagagaacauuuuuuagugcugggaagauggcuccgcguggguaaagugcuucuggguaaaccuagcaugcugcacaagccugguggccugacuuuaaguugcagagccugugucaaagcugggcuuaauaacauaugcaucuaaccccaguguuuauaauagguuauaggaagcagagacuggagaaucuccaggaacuucugggccagcaaaccuaguauaugcagcaauaaacauaugaggcccugucuuaaacaggcugaaggcguggacugacccccaagguuguuuucugaccuccacaugugcuguccuuugcagccagugauguaaaggguggguacagagcccagauugguucggcaugaugccuaguggcuuucuuuagauucucugagagguuaugcuccgagucgacggagagccgcccuuguagccaugcugucucagaaugguucuugccauacacucaggaauuauggcuugcgaugaaacaguaccauuuugcuccuuucauuguuuauguuagaauggcaggacacccguguuuaauuccccuccagaccuuccucgggaacagcuuuugaugacgcuuucuggcuggauuugaauuaucuugagguugcgaagguggcucaguccugcucugcucacuucacggccuugcucuacgcagagaucuauucagauaagaaaagcacagacgagcaagagaaaaggcaaguggauuuugagguuuggguuuuguuuuauuuauuuguuuauucuuguuuuuuuuuuucaagaaaagguuucucuauauaacuacccuagcuguccuggaacucacucuguagaccagguuggccucaaauucacagacaucuaccugccucugccucccuagugcugggauuaaaggugugugcuaccagcuaccacuacccagugacauuuugguauauuaaauugauguugauacuguuuuccguucaaauguauaguaaagauuuauuuuugcuccauuuuuccauuuaaaggacauuuuagccagagauuuucuauaucaaagcaaaauacuuuuuuaagaaguaauucucugaaaauauagaaauuguaguuauauaauguguucuauuuuguauuauaaagacuagacauaggaagcuaaugaagagaaacaacauuugguuguuuguauauucccuauagcuaagcuagcauuuggaauguaaaccacccauacauguguucaugacugagugauuuccuaguuuugguuacauuagguuuaccucuaauucacauuucagaauucauuuuacucuuugacuagaaugugaucagucugugugugacuaaauaaguuuuauuuauguguuaccugcuuguauuucuagcuacuucaacucaauuuccucugauugaauuagaacuuuuauaaaaagcuuaaaaauaugaucauagaucgugaugaaaaauaaccaagaaaguaggguauuaaauuacauuauacguuuuauuauaugaaccuccuuuuagaucccugucugaaauagccuaguguuuguguuuauagauagccucacuuucuuaccaguaauucagccuuacuaagaaauuaaaaucacaaaugugaguuaugccaauacauacauuauuuuuguuauuaauaaugguagaugccauuaagcuggaaauguaauauauuuguuuagacuggaaaagugggaccagaauucucauguucuacaagucguuaacauagaucuagacuguucacuugugguuugauauuuaaaucucugccuuuugguugaaaaccauuagagauguacauuauguggucacuauagaacauuguaacccuguguguucguggucacuauaaauccaugaagacaagugcacagcacugaucgcaguuugagugaguuuuaguauuuuggguuuguagaacgguguuuuuuauuaaucaagagcaaauaguauguccucugaguauaaauagaagcauuuuaaauuugaauguuagccauuaugugaauggagcaaacuugugcagagcugcuugccuucaagcaggugugacugcauuugcuuugcuggucucuuugggguucucccccaacuuccagagaacugaugaaaaaaggaggacagacagacaagguguacggagacugagaagugcaggaguccacaguggcucuguuagaagagccaaccuggagaccuaagauaguaagcacacugcguuuguaaauagaauauaggcaagcaguuuaccuguacugucaaagaaacaaaccacaaguauuuucuauucaaguuguuuacuaggauucuucauaguauguacuugaaauaaaguacuguuuuguuagcauguuccugagacacugcaaucucagaguuaguguccucaaucuguguaaaacaaagucagcucaaggcuuaucaauaagacucagagaacggauuuuuacagccucagaugucuuacuguuccaagauccuaaaguaaugccuaacaguaguacgugcagcuguguuauaugugugaugccugacaguaguaugggcagcuguguuacacaugugugaugccugacaguacuacaugcagcuguguuacaugugugaugccugacaguaguaugugcagcugugcuacaugugugaugccugacaguaguacgugcagcuguauuacaugugugaugccugacaguaguacgugcagcuguguuacaugugugaugccugacaguaguaugugcagcugugcuacaugugugaugccugacaguaguaugugcagcuguguugcacauguguugccuugaugaauuggagcuagauggauauuuuacauguguaucauaucuguaccugaaggucacaaagcagaguaucgucaacagcauucugucacuaagugcgccccucccccccauaccagccuccugagacucucccagggguaaaggugaccuucaguguauguuuaucauuccuccagucuagcaaugucauauuacuugucauauuaguauggaucuugaaauacaguguaguauucucuauuuuugaguuuuauaagacauuuucuaugccacauuuuccacccaaguuuuuaauaucuaugcugccuauugcugucauucuuuacugccaugguacacuagagaaggcaccaguuuguuaccugugucagugacauauaccuuauugggagaacuacuggugugcagauuuucaacuuacugagguagugcugaauuguauuaguguguguacuuuauuaaacuguaguugguaagaaaauuaguuuguauaguuauuugcuacauuggaaggaggaaacaaaaguguaacuuuuucuauuuugagggaaaaauauagaaaacacaaaacauguuuuagaaagauauuagagggggcuaucauuuaugguaguauuuaauuuauauauuggauuauuauaggcacaguagcagugaugauacuaaaauugagucacuuaccaagcuauaacacccaaauauauaaaugcuuaaagguaaggucuuacaguggauaaaucugaguucucgucgcauuauuaccucuagauuucaguugcucucgcuuauuuucaucagauuucuuucuuuucaguuuauuggggguuaaauugugucuugugguuuuacuauauauaucuguaauuaucaaguuaaacuuuaaguaagaccacugguagaauacuuaggauauguauugcaaaacuucuguuuuuaaacaggccugucuuagcauauaacugcuguuuauacaauaguguuauuaugaauaauuuccgcauguagaauuaauauucucaaauuuuucuuuuuucaugccaguucuaaaugauauacuguguuaaaguauaaaugguuuacuguucuuuuugaaaccauaauuaguuucuuuauguugaaguauagaaugaauauauuuauaacauuggauaguauguucucauuaaaagagauguuuuuaugauaagcagaaguccaacauuugaagaaggaagucaaggaacaacuauuucuaguuugagugaaaaaaguaaagaagaaacuggaauaagcuuacagguaaauauuagaaacccugugauaauuuguaugugauauguuggauuaucuucucauagggauauaauugauuuuaaaacugaaacuagggcuggugagauggcucagaggcuaacagcacuagcugcucuuccagaggucaugaguucaauucucagcaaccacacgguggcucacaaccaucuguagggggaucugaugcccucuucagacaggcauauauauauguguguguguguguguguguguguguguguguguguguguguguguguguguguguaugcagcagagcacacauacauuaaauauaaaaaaaaauaauuguuauauaacugaaacuacuuauuggaccuagaauauuuauauaaauuuaugcucugauuagagaagugauuuccaaucucgacuccuccacuuguucuauaacacugcauaaauauguggcccuucugaccuugaauaaaggcucuuuuauugcugaccaugacaccaugaccaaggcaacuuauaacagaaaguguuugaucugggcucaugguuuuagaguuucauccaugauggcagagcaaaggcauggcagcaggaacagcugagagacagagacagacagagagagaccgucccaaagcucacguccuccauaagauugcagcucccaauccuucucagacucuuccaccuagggaccaaguauuccaccgugagccuaugggaacauucuuauucagaccaccacaucccauaauugucuuagucucccuaccucugcucuuguccuaaccaucucucuuauuaaacuaacaaacaccuucccuuuaucucgggguauuuguucuuguucagaaacuuuguuaugcugugccuauucuuaacuauaucaugaacauuucagacuucuacuguuuaaaucguuucuguccuuggaucuggaaggaguuucucucuucuguauucucuuaagguguugucuucuuuccuuucacguccagacuuucccaugaugucuguaguugcucucuccauuucuuuccuucauuccauuuaaauggcacuugccuaauguuuuccaugaacuauauauugcuuagucuauuagucaccuuucauuucuuucuccuuaacuuuuuuuuuaaagguuuauuuauuuuauguauaugaguacccugccacugucuucagacacaccagaaaagggcaucagaucucauuagccaccaugugguugcugggaauugaacucaggaccccuggaagagcagucagagcucuuaaccgcugagccauuucuccggcucucuccuuaacuucugacuccacaucuagucaugucuuguaugugugcuuguaugugcaggccauagguugacaucagaugucuuuaauaacuaucuuauuuuuuugagacaaguuaucuuauuaaauguagaacucacugauuuugcuaggcuggcugaugagcgagcucuagggcucugccugucugccucuccagagcuaggaucacacaugcgugcagcugcuuugaguuuucuguguguguccuagggaucuggacacacacuuuagugacuguuuccugagcuccucagcccugucucgggcuugccaugugauccucuauacuaacauuucucuuuuucucuuggaacuauguaguuucaccuuucuguacugauuuucaugaguauuuucuuaugccaaggacuguuagaucccuaguguuucaacucuuaagguuuuauuucaugucuaugaauagaaauacuugaauaagaguuauauguagacuuauaccaauauugauuuguaauuaggaaauauuuaccacagcaaaaaaauaucaaggcaacugacuugcuugcucaguuuccuauggaguguagcuucugguuuuuugguuguuuauuguuuguuucugcuuuauuucauugaaguuaaacaacacuaggcuuuccuguguaaauaucacuagaaguauuuuaagaaauugcugcuuuaaaugcagcauauuucuaaaacuaugggcauuuuaaagaaaauuuauagccuucauuugcuccaauuucaguaguuaagguuugcagaauuuuauucuuccauuuacaguuuuauuuguggacaggauuguuuuguuuugugauuauugcugaaugugauuaaaagucuaguauguugguaugcauaucuguuucaugaaauuccuuaguuuuauuauuuuaugcauaugaguauuuuguuugcauguuuguuaagugcaccacaugcaugccuaguuccugucaaggucagaacagugcaugggaucccguaguccuggaguuacaggugauuguaaaccaccaugugggugcuggggaucaaaccuggguccucuggaagauaagcacuuuuaacuacugagccucucuucagucugugagcauuacuucuaaaguagaccaaccauuuucuuguauaggacaagaccacuguccuauacaaugauuacagugauuaggauacuuucuauuuuuaucauuauauuuuacuuuuacagcacauuuaugaguuguaaguugugaguugauaaugauaaaauuuaaagcuuauaaaauccaugaacugauuuuuauuuucaagucucugccuuugguauuucuguuugcaggaucuucucuuagagaucuacagaaguauaggagagccggacagccuguauggcuguggaggagggaaaauguuacaaccccuuacuagguaaacugcacuuucuagauaguaauucuacuucucgaaggagcuauaugcauacagaaacagaagauguuuucaccaucuuuucuuacagaauacggacauaugaacaugaagcuacgugggagaaagccuuaguaacuuacgaccuggagaccagcaucuccuccuccacccgccagucaggaaucauccaggugcgcuucugucugugucugccaccgucagugcaccuguuagcguuaguucaguguaucagugaaguuuacgcaggcagcaaacuugagaccacuggagcugcacugucagaugugaggcuagcgccucaguacacacaggaaagcugcacgggucaguguaguuuguugauaguaccuuuauuacccgagagcagaagacccuuccugaguguguacaguaugccaggagacacuaguagugcuucauguggcacuucgaguuugcauuagaguuggucccagaaacuguuauaucuauuccuaguuaauaggcuuagguauuucuccaucaaacauuaacauucccuguaaauauacaugcuaagcaauauuuuagaauuuuaagugauacuguuaauuaaaauuuuuuaaauuauuauuauuauuauuauuaccauuauuauuauuugcuguuuucccucuccuaguccagugguucucaaucugugggucgugaccucuuugcgggcucacugacccuuucacagaaguuacacaucagcuauuuaaauuaugauucauaucaguagcaaaauuacaguugugaaguagcauugaaaauaauuuuuaugguuagggucaccacaacgugaggaacuguauuaaaggguggcagcauugggaaagguugagaagcacgggucuacuuugugcugacauauuugauuguguauuuaccuccuuucaggcccugcagaauuuggggcucucccauauccugucugucuaucugaaaggauuagacuaugaaagacgagaguggugcgcugagcugcaggagcugcguuaccaggcggcguggaggaacaugcaguggggccucugcgcuucugccgggugggagaaauggacuuuccaaagcacagcccuuccccaggggucuuucucugacucugaaacugcacauuugauugcuuucucuuaucugugaauauuaacauguugguuuuucuuguuuaauauauuucacagacaguauggccugacuucuuauuuaagauacaguaggcaguuaccacaacgaagcuugaauuacauucuuuuuuuuuucucauuagagaaauuauauccccugcuucaagcauuuugaagauagacauuuaaaaaaugucuuuuccuaugagaauauuguauguuggauugaggaaucuaaagacaaguguaggccuucucccuugcacuacuugcugcauuguagucauaugcacuuuuauuggcugggugauaaaauaaguuacccuuguuaauauuuuguugcugcuguuguuguugcuguuagaaagcaguacuaggcccagaaguaaugaugcacaccuuuaguccagcacucaaggaaucagaagcagguggaucuuugggcuugaugauagccaugucuacacagugaguacuuggcuagccagggcuacacaggauacagugccuuaaaaacaaauagauaaccaggcaucuuaagauguauugauaaaccaaguuaugcuagaagguaaaaguuuuaaccaguuugucaaaucacuauauuuuuaaaaugauaaccagaacaccuaggguacugaaggauuuaauaacuacauaaaaaucuuuuaaugauauaacacugaaaaaguaagucauuuuaauuaucuuaauggaaaaauauuuucauauauuggaguauuuaucaaauucuauuaaaggaaugguauaaaagcagaguuuuuuuuuuuaaagauuuauuuauuuauuauaaguaaguacacuguagcugucuucagacacaccagaagagggcaucagaucucauuacgaaugguugugagccaccaugugguugcugggauuugaacucaggaccuuuggaagagcagucagugcucucaaccgcugagccaucucgccagauccagaguuauuuauauguagaugaguuuguuucaggacagaguuccucuguguaauccuggcugucccagaauucacucuguagaccagagguagagcuccuacuucugccucuugagugcuggcacuaaaggcacugccgccaccucucagcuguucucauguuuucaauauucaucuuacauauaagauugggaaccaaacagaauuucuaagguuauuuuuuuucuuuaaagaauuuaaauggccuauaaaauucuuuccuuuuccuacugcuuuguuuuauuuuguuauuugcuuguuuguuuagauuuuacuaugcaaccauggcuggccuugagcucacuaagauccaucugccucugccuaccaauuaccagcuacauguuuuucuuaauuucugcaaauuuuuaugagaaaucuuaauuuuaguucucaauguuguccuuugaguuaguuaguuaguuaccaugacugucucggaacuuucuguuuuuaaauuuguuuuuuaaucaugucacagccaagaaguagaaggaaccaguuaccaugaaucguuguauaaugcucugcagugucuaagaaacagagaauucuccacauuuuaugaaagucuccgauaugccagguauuauaaaaagacaaauuguuuuuauauuuaaugcuguggcugcuauccucaaaaugaguaguuuuaauguaagcauuugcaucgaugaagggaugaaggcuugguggcuguguucagauauuugucauccuuugcucucaagaaauacuuucuucaggaccuaugucagcucuucagucugagcccucagggaaagugugauaguguucucuuuucguucagguauccuaaaagaguugacuuuugucuuuucuaguuucauagccuucacucucuuacugucauagcucuacuuucuaaaauagguuucuuugaggcauacaugaaaugauauaugauguagcaauuaucugcaacaaguuaaagaaacauuaauuuuuuuaaaagauuuauuuauuuuuuauaugcagugauguuuuugccuacauauaugucugugucagauccuuaggaacuggaguuacggacaguucuaagccaccauguaggugcuaggaauugaacccugguccucuuggaagagcagccagugugcuuaaccacugagccaucuaucuagcccccaaacaugaauauuuuaaacacuagccacugacaucacaaauccuauacauauuguuugguuuuagaccccagaacaggggacugcagugcauauuuuacacaccaaagcagaccuggccuccauguucucccagcaucccucaguuccugccuggaaugcccugccccgaauccugaacuuuucagccuaggggcugggcugcccuuucuccauaggauccucccuauauaauccaggcauuuugguuucuuuuuuucuucuccucuucucugucugugagcuugucccuuucucucugucucucccuccccuaccccuucccaguggugacuuucccagccuuggaccuuggggcuagugaacucggccaccagagagcugcuucccaauaagccugccuuuaauauaaucuaaucuggccugaauuggcucauucaccagugauggagaaauaaccuaugacagauggcagaaauaauauuucuacuuuuaacgugauuguauucuagaccuuuugucaggcucuuucuauacauacucuuuaacucuaaagguggaaaacaauagcuguggcaagauuugguagcagguucaaagccagacagacauggcagaacugggcuuuacacuuagaacuguauaaucccaaggcuggucacacugcuguuucaccacuguguuuguguguguguguguguguguguguguguguguguguguguguguguguguagucuuuacugcuguuucaccagagucucucucucucucucuguguguguguguguguagucuuuucaggucagcaacaaguguaugacaaguauugcucagccauagaauugaaccucuaucucccugaggacgugucaguuucagaugaucugcucucuuaccccuagggugaaagaaguugaagaguugaguaagggcagccuugagucuguauauucgcuguaucccacacuuaguagauugcaggcaauuggagaacuggaaaacaguggcgagcuuuucucaagguagguggcuugcggguuuugcuaauccugaagcguguugcuuguuguguguugugugucagcaauggaaacaugugaugggcaugauugauuauuauuugcuuuguuaagaaagguuuaugugggcucauggcuuccaaagguuucagccugugauuagcggcuucuguguuggccugaaugagagguuguauugauggcacacagcaggagggaaggggagaucuguuauaaaauaaacuggauaaauuuauuaauguguguguaguaaacacauucuagacauuuaccaacugagaaauguaaugccaguagguauaaccuaagaauugaaaucgaagcucuucagaaccuuaauuuuaagaguauauagagaugccuuugucuaaaauacuguagaucuguuguucuggggucguuugugacagaaguagaagcuugguuuugaugaacaugcacaagcaacugaaaugauuucucaucuuuacuucauuauucucuuagucucacuggaucuuuuuuuucucccucucaacacaaguccugaaagaugggauaguguaacauauuuuaggcaugugaaaggcaaaguauucauacaaaugaguuguuuucuguuuaauaauguuagcagaugaaauguuuucaagugcccguuguuuguucaaugaacugauuuuuuugacagcuauguauagugucauuuguagguaauuaaugaaaauuaauugauuuccuuguagauaugucugcuuucaccacaaugaggacuagcagaguagacgugucuuuaugauaggucugaaugcagcauucucguuucugaacaaaaucuguuuaaaggcuaccuuuuaaaguacccauuaucuguaacuacauguaacuuugcacuguccuaaguauuuuucauuugcucaacuaaguuaugugacuugacuuucaggucagucacagacagagagcgcucugaagcauacuggaaguggcagaagcacucccagcuucugaaagacagcgacuucagcuuucaggagccucucauggcucugcgcacagucauucuggagacccugguacagaaggaaauggagcgcucucaaggagcaugcucuaaggacauucucaccaaacaccucguugaauucucuguucuggcucgaaccuucaagaacacacagguaaaaagcuuauauuuauguuaccucacuucuugggcuuuuuuuauuacucagauaccagaagguauaaugaugugaagaagaaauaucacugaaaauuggaaaucguuguauauaaaguuauugaagauuuuagguugacuggggcuuguacuuaacuuacaauccuagucacuugagagguugagguaagaggaucacaaguucagagccuacuugcgaaagacaaugaguucaugguccccuugaaaaaccuagugggaccugucuucaauguauaaaaggguugggacuauggauguaugauagcacgcuucuuugcauagcuaauacaacaaggcucugggaucaaaccccaguaucgagugagaaaacaaaacaaagcuuucauacuggaauuagacaaaaacuugaguuuaaacauuggcaaggcaauaauuaucauuucucgcccccaauuuccugguuauaaaauaagauucccaaacuacuauaauguaaugguaacaauucagugaucucucucucucucucucucucucucucucccucucucucucucucucucacacacacacacacacacacacacacacacacacacacuugucagacuuuguggucugcagguugguaaguaagcaggaaacuaauuaagauagucucugaaaaaugagguucucaguggauaucuuaccaguaaauguauuuauuuccauaugcauuuucacuguagcucccugaaagagcaauauucaaaauuaagcaauauaauucagcuauuuguggaauuucugaguggcauuuggaagaagcacaaguauucugggcaaaaaaggagcagagucuugcucugaguauucucaagcagaugaucaagaaguuggacuccagcuuuaaagauaaagagguauguaugugcuuugugugcacgucggugggguggcugcauccgugauugaauguugucagaaagcauuucugcuucagaauaugucuguaaugacuacauuaagguuuugaaauuacggguccauaaauaaaauaauaugaaaagagacuuugaagauuaaugucagaaaugagacuugaaaacuuucuuauuuaaaacaaaucuaucagucugucuuguaguauauucauucaguuuuuccagaagucaaaaauaauauguaggaaauaaauggaaauacauguuauaacuuugaaguagcaaggacaaaaauagaauuagaaaugucugagagaagaaaaguaggaaacaaguuacaacaauuugucauucuuaaaguguuuuuuuuuuuaagguuuauuuauuuauuuauuuauuuuuuaagaugaugauaauuuuuuuaaagauuuauuuauuuauuuauuauauguaaguacacuguagcuaucuucagacacuccagaagagggcgucagaucuuguuacagaugguugugagccaccaugugguugcugggauuugaacuccggaccuucggaagagcagucgggugcucuuacccacugagccauuucaccagcccccagguuuauuuauuuuauuuauaugaguacacugucgcugucuucagacacaccagaagagggcaucgaaucccauuacagaugguugugagccaccgugugguugcugggaauugaacuuagaggaccucuggaagagcagucagugcucuuaaccccugagccaucucuccagcccauaauuugucauucuuagugcucugaaaauaucacauccaguggacaggacacugcagggucaugaaauauuaauuauaacaaagcauuaggugccaguagaauuugcuuaaauaucuccuaaaucguauagucccuaacauaugugguaguuuuauaccucauuuuuugcauggacaaauagguaauaaugauauaucuaauuuauaguauuccugugaaaauuaugcauuaauauauauaaagcuauuggaaaauuccuggcauuuuaaaauaauaauuaauaguauuaauaguaauagcaaauuguuaguaauaauaauaacaacaacaacaauaacuagacaguucacagugguuguuucaugaacuggcauacuuagaauuauuuauacgguaaaaguaugaggaaaauauuuuuaauuguuuuuuuuucuaucuacauggaagauacuuuuguaaucuugaaaaggaauuacauuuuaaguuuuuugcuucuugauacagaaugaugcaggucucaaagucauauacgcagagugucugaggguuuguggcagcuggcuggcagaaacuugcuuagaaaacccugcagucaucaugcagaccuaucuagaaaagguagguuguuggcacagcucugaacauuauuguuuaguauaacuauacuugauccuuuuaugaagaccauguguaucuuaaaagcaaacgcaagugugguuucaauccuucagcuccugcuggggcucuguaauccguuagagcagaaagaagcaaaaugccacagagggaggaacagcuuugaaugcaugaaugucuuccguccacucuuuauacccaccccuagcguucaagaagucauuucugauuacucugcuuuuauucuacaaaauguccuauuaaacauagaagccaucauugcuauuuguccaacuacuuacgguaaggguuaggacuucacuucuauaauccccauuggccuuccuguuucuccuucuuuguccuuuagucucacuaauuugggaaauaggaaguucaguaugaaaaguaagauauaaaugucgggcuggagagauggcuuagccauuauuauaucauaaacauaagauauaaaugucuuugauacuaaagaguucuuuuuugcacaguucauugcagcuguuaccugauaagguuccaugccauuaaguuucacauuuacauagauuugagugggcuaccuuggucugagagucuuuagcuauaucuaugcauguaaauaugaucuuaauggauuguguguuguugaaggcggugaagguugcuggaaguuacgauggcaacagcagagagcucagaaauggacagaugaaggccuuucucucguuggcaagguucucugauacucaguaccagagaauugaaaacuacaugaagucaucagaauuugaaaacaagcaaacucucuuaaaaagagccaaagaggaagugggccuucuaagggaacauaaaauucagaccaacagguaacuuuuagcugacgguuuauguucggcugaggggcugcugacgugaaaacugcccugaccuugucaucugaauuauaguuuugaaaacuuagcuuuuuaauaggcuuucucaguccucuaguggcuaaucacaacuucagucaguuaauacacugacauguucuucuaugaauaauuaaugucuugguuuagcucuuggcagaguacguggauguuaguuugguuuuacuagaagcugacauuaaguauagcagacuugccuacuuugauauugucacaguacuucuaagucugcauuggguuuuuguauguuuggaguaagcagaggauuaacuuagaguccacccuguccuuggguguguggaagaccuauuaauugcaggugugacaaguccuuuuauuauauuuagaauuuuuuuuggagugaacaccuuguauuucauugauguugucuuaucauguaugauuuuauaguuauguaaagguuugugacuguuauguuugaauuuaucaagauacacaguaaagguucagcgagaacuggagcuggacgaaugugcucuccgugcacugagagaggaucgcaagcgcuuccuguguaaagcaguggagaacuacaucaacugcuuacuaagcggggaagaacaugaucuguggguguuccggcuuugcucccucuggcuugaaaauucuggaguuucugaagucaauggcaugaugaaggcaagucuuacccaacccagcauuugagcauacacuuuaaaaacugaggccuaagccccugcagugugggauuuugcacaucccuguguaccccuccuaauggguuuggugcuccauaaauaaguacuuuauaaacucucagugauacaaguguguguggaggcgagagaauuucuguagguguuuuaccucugcagauaacacagaggaguccauaggggggaaugcuagacuggagaauaggaaacauaaaaauaaugugaugcuaagcaagaauuuuccuuuguuuuauuugugcuuuugagggauuuuuuuuccuaauacaguccuuuuacaaauaaaaaaaauucauaacauguacaggaguacuugaaaguuuucauugaaaaaauaucuuaagauguggucauaaaauaaauauauaaacuaaguauauauuuaguuuaaagguuaaagauaaaauguuucuccagaaugaaaagaaugguaagacucaaaaucaacaaaaccagucuuuucuacuguauguguuaaaccucauuacuucuggcauguagggaaaagaacuugauuuuguuaccccccccccaccccaucccccgacuucuugggaguugagaccacaguagacucagauucguaucuauccuccuuggagucacuggacuggaugugggguuagcauaccagcucuggaugcagugugacuuagggcuaaggauuuuuguuaucacugaaucacuagguaaauuuuauuaucaccgaggcgucgaauuagaaagacuuucagauaggccaagagguaagggaaauugccuaguuaguaaaguuuugacagccacuaggguguacuaguggaggaucauuauuuuagguaccauagauauaagauuauauuacaaacauguuucuauauuuuguauuuuuuuuaauggcagaaagauggaaugaagauuucauccuauaaguuuuugccucucauguaucaauuggcugcucgaauggggaccaaaaugacgggaggccuaggauuucacgaaguccucaauaauguaaguauacuugaagucaaaauguaauaacuaccuuuuauguuaguaaacaugugaaaucaaaauauuaaacuuucucuuucauugcagauaagcuugucucuuauuucugacauuccucuauagcucucucucacagauauacacacccacuacuuacuauacaaugaugacauuaacuugaacuugauguaaaguaaaauuaaaaauguauauuuaagguuuuuuucuauuugcacgaaacuaauaguuacuacuuuucugauagcuaaucucuaggauuucacuggaucacccccaucauacuuuguucauuauacuggccuuagcaaaugcgaacaaagaugaauuuuugagcaaaccagagacaacaagaaggagucgaauaaccaaaaguacaucuaaagaaaacucucaccuugaugagguauuuggguaaaugcaaguacccuuuuguguugugauggucauucuuccccagaauauuccuuuuuuaauucucagagacuuuaagaauguauguuucugguaguauucuauauccuuuauuaugaugaugccacccagaauugguuaacaauuucuaagcugguauuuuaaaauaccaguuugauuuuguuuucuggcagcaaugggcaaagaaaaagcagaucuuuaaaaugauuuauuuguaacauucaugagugguucucugcaccauauguacaucuggccccuacagaagccaggagaggguuuuggaugucccuggaccugggguugccauguagguucugagaaccaaaccaugguccucccaaagagcagcaagugcucuuaaccacugaaccaucucucuaggcccagaaaaacagauuuuugaaaaguacccaagucauuaaccuugaauuuuuuuauguguguauuucauucccugaguggguguuuuguuugcaucugaggaauuauaguccuuucguugucuagaucugugcauggauucucuuuguauagcuccaagaaacuuaaauguuuagugggucuuguucuuuguuguugaugguaggaucgaacagaggcugcaaccagaaucauccacuccaucagaaguaagcgauguaagauggugaaggacauggaggcgcucugcgaugccuacaucaucuuggcaaacauggacgccucucaguggagggcucagagaaguaugugugaaaguaccacugccgcuguccagcuugaccugcagugauaguccuccguuuacagcugucacuaaaaucuauuuauuuuuaacguagaaggcaucaauauuccagccaaccagccaaucacuaaacugaagaauuuagaagauguuguuguucccacuauggaaauuaagguaauuuacuauuaacucuugauuuuuuuuuaaagauuuauuuauuuaucauaucuaaguacacuguagcugucuucagacacuccagaagacgguuaacucuugauuuuuaauaagacuaaauuacgggcuggugagauggcucaguggguaagagcacccgacugcucuuccgaagguccggaguucaaaucccagcaaccacaugguggcucacaaccaucuguaacaagaucugacucccucuucuggccugucugcagacaacuacaguguacuuacauauaauaaauaaauaaaucuuuaaaaaaaaauaagacuaaauuacacauuaguagauuaaauuauuuguagauuuuuuuucaguccaaauggcuaauuauuguaguuucauaucuuucuaccuauagguuguccauuagauuuuuuucuuucuuuuuuucucccuucccccaccucucucucucucccuuccucccuuccucccucccucccucccucccucccuucuuuucuuuccuguuaucucuuauuguuauuuuaacucuagggacugaaccuauuaugcacuggggaagccuuuuuuauacguuuaaggcagggucucacuuuguugacuaugaaccugcucuguaauugaagcaagacuagaacuugaccauccuccucucugucuuuugaguaccugggacuacagaccugugucccguucacuguuuuucucuguauuauucuuucucaguguguggguguguuucaugcccauggugauggaacacucuaccucugguuugcgggugggcaacaccacuccaucauuuuuguugucgccguuuugguuuuuagucauucaguaugcacugggauguauuggcugugauguaacuauauuauuuaguaaaacaguagguguuaugguaccucuaaguugcuguguauacguacuaaacaccuauucauagugaucuuuuauuccuagaaguaccaugugggcaggauguguguaacacuaaagguuaccauuuuagaagcugaugcguuagguccaugguacagcucucuuucuccuuccaauguguacacuaagauuaguguucuuguuacugaguuugacccauuauugcaucaugcagguuaacagauacaggcuaugugguuuagcugaauauuuccucuuuuaaaauuuuacaugauacucuugugaauuaaauaauuccuuagauuuuuuucaacauauguaaauaacaacuaaguucuaguuuucaguaguuuuucagcaguacuauuuaauugacuuaaaaugcugaagauuuaugaaaagauguuuaagaaaguaaacuguguuauauguaauuuuaaaaaucugggcagcaaguaaagacacuugcugccaaucauuuaaaccagagcucugccuggguaccagcauggugacacauauguguggucacccaaauacacacacauacacaccaaguaaauaagcaaacguaauaaaaaucuaucagugucauuaauucuaacuugaauuaaacaaauuagaaauuagaaacccagcuguuaauuagcagaguuaucauuugugguuguuuacuguuuaucauuaguuauucuccuguuuuguuugucugaccuauaauaauuauuuaucaucauuuauuagguugaucccacaggagaguaugaaaaucuggugacuauaaaaucauuuaaaacagaauuucgcuuagcuggaggcuuaaauuuacccaaaauaauagauuguguggguucugauggcaaggaaaggagacagcuugugaagguaagacuuccuguuucugguauagucuucagaggauuaaugccaucaacaucaacagcaggauauuuaauucuuaccucauuugguugucuggaucuagcuuuauccugaauaaugacagguagaaaacauuuuugaaguagaaauacagugugauagaaucaaacugcuuuuuagaauugugugucuucucugaaagacuguaauuuuuguuuuuguguccugcuauuauggauuagaaccagggccucgcucaugcucaucugcuucugaguuacaucccagcucuccuuuagguuuuauuugacacagggucuugcuaagcucccugggcggggcuugaauuuaagacccucuuaccugagccucuggagaagcugagacuguaagucggcaguacugggcuuagcaggcucuugcacaguugauucaagagaaagaauugcacacgcuaugagcuuacuuguaaaaaaggcuuaugguggggauuagaacaauuuaaggccuguacucaauaucccgggccugacacagugccacuugcuccugagaaguagcagcacucccugcuuugcauugcugcuuaggugcuuuuggagucuugcugaaaauagaagagaaaugaaagauuacuuuauuuggguguuuuguauugugccuucaguugaaggaguuaguuuaguuauuagagaagcagcuaagaggaacuuggccuuuguaucaaucugcuucccaguuucauagguuuuguuuuuuuuuuuuuuucuaagugaaaaaugacaguagguauuaauuauucaagacauucugaagaugaguguagaaacucagauugacuaguucugccuuuucuuagaugacucugugcuuauaauaaaguaaacucugccuguucaugucugguuguucugaagggccgugaugaccugaggcaagaugcugucaugcagcaggucuuccagaugugcaauacacuacugcagagaaacacugagacuagaaagaggaaacugacuaucugcacauacaagguaacuugugguccugcaagguagcuuguguucugcagcuugcccaaggaaggugcacuguuuggaccaagaaugagcauauguuuucuguaaaagaacaacuaguaaauauuuuagacuuugaggaccauucaggucuuuuguauauuguuuaauuuuuacuuaugacuuuuuaaaaucucugucaucuuuugcucacaagcuguacagaaauagacugauacugguuuugcuucagaggcuauggauugccacucucagguuggacaacacaacuuuaauuuucauuuuaguauuauuuaauguuggcugccauuagacauuuucuacagucaacagcaauagucucccuuuauugugguaaguaaugugcuguagggauuaugcugcugcuuaucugugcaugguucauuuugguuauuucugggcuuguguuacugcacacggugauacucugcacugaacagaugaagugagcaugcaugcuucguucauuucacauucuggucaaucuauuggaaagauuuucagaaauuggauugcuaagugagaggacacugcaaccuucauuugguagauuuuacuguaggacagucaauggaguuagacccauuuccauuuucuccacaguucacuugagaaauccucggguccuguuauucuaucauuagcugaucuuuuuuccuaagaggugaagguuuguccuuuuccggcuuuguucccacauucucuuccccaucuccauccucugucacugcugucucagggcuucuugcugcuuaucuuuccccaggaagauaggaacaaacugaaaagcauuuaauucacgucuaguugagaaccagcucuuuuuagaacagucucaguggcuguuucuuuauuuucagaaggguaaacucugcaacuauuuucucuagacacucaaauauuuuacuagaagauaaacacuaguaaaauauuuuaaagugcauuggaaaaguguucccuucacaacaguuaaagaguauguaucaucauguucacugcagcagcacagauucuaaaauuggaccaguacaaagaaaauuaucguggucccuauauaagaagagggaaaagguaguauguauuauggaguguugggaccccacuugagguuuagaaauaaagaagcugagauaucuguauaguugaaggcucuuggcuuuuuugcuggggcagucucucagcuagcuucuaacuuaaccugacugccauccuguccagccauguggcgagcucucucuuucucucaucucucucuuuacaucccugcuucauuuuuguccaugauucugucuuucugccaagacguucugcuuucuucugccccgucuccagccaccagcucuuuauuuagcaaaagucacauuucuuucuccuaucaaaagcugcuagcacagugggagaggucccacagcuuccccccgcugagcagagcagcaggacuacaccacguucauagggugguguccuuuuggccagauugaaggcggugucaccuuccauggccuccuccauggcagcuugcuuuuuaucaugacagucuuagggaauccucuuuggugcaggugaggaagugacaaacauuuacuuacagaaaucagguaaugcaccauagaaaugacaauaccaaauauccugccagcacuuggcacugcuggcacagcaauugacaauugaaaauacaagggccacauuuacaacaccauuugauacaguauguguaggugcagaccaucccuauguaacaugaauaaacugccuaggagugguguugacaaguacaggaguggauuuuaaaaauuaggaaaauagaacauguaaacacaaacuuugauuugucuuaaaugggauagcauugaaaaauaucugcuuauuugaaaauaaugugugauaguaaaauuucaauaaaaauuuuuaaaauaaguauugaaugcuugccuaucagguauaaggcccagaguucaauaucccacacugaggugcgguguggaugggacuggaggaagucagaauacagaauaagccuuaaaacauuuucugguauacauuucuaaaaacccaguguauaugccaccgacugaguuacaucccuaacccaagacauccucagucagugcuaaaaacaaaaguuaaaagucgguaaaagccguuuuguuguuauuguuguuuaagauaagauuuauuuuauguguaugaguguuucccucacauacuuuguacuggcugaugaucaauggucaccgacaguucuuuaaugucuuucuaaucagagauauuugacuucaucucaggugguuccccuuucucagcgaagcgguguucucgaguggugcacaggaaccguuccuauuggugaauaucuuguuaacagcgaagacggugcacauagaagauacaggccaaaugauuucagugccaaucagugccaaaagaaaaugauggugagucggaagguucuucagucuuucacauugccaccugauguuauaaaauauaagauacauaaccucaugaggugauuguugacgauaauaaguaaaaacaagauguaaacuuaacaagaugagugcaugugugaauagaacagggcuguuuuuaaacaguaugaagagaggaggcaugugucguuacagaccacauaagcuugggcuuaaggagggauaggugaggcuggaguuguaaucgacccaaaaagcauagguuugcuguaaaauguuuacaagcauguauccuguaggugaagagagaccccugugaagaaucagggugucagauuuacuuuuuagggggagggcagcauugagccagagucucucuaauacuggcuguccuggagcucaggauguagaccaggcuggcuuggaacucagagauccaccugccucugacucuugagugcuaggauuaaaagcauggaucaucaugccuggcuucagauuuacauuuuaggaagauaauucugacaguaacguauguugugguuuugagaaaacagauuagggguauuauuugaauuaagacuaauuaauguuaugaaugaagaauuguggguaaauaagaaauacguuaaagaggcaagacugauagaauuugauugauuagaagugauaauauacucguagagaaagaugugaggaaaauacaagguccuucugaauagagcuugagucacucagaaaugaagucagcagucaacaaacaggaucaugugaaaugaaaaggcaucuuuacagcaaaggaaugagguaaucaaauguaaaggcggcuuccagaaugggggaaagucuuugccagcucuguauccaacagaaguuuaauagcuagauaagcaaagaacuuauaaaaaaaauaagaaaacacaugaccaaaucaauaaauaggcuaaaaaaugaacaguuagaaaggcaaagucugaaccaaccugugaauacgaguguucuacuucacuagacauugagaugcucuccuacccaagucagauugacaaagaaggagccugaagggauggcucaguggguaaaaagguuccugcugcuaagccugaccaccugaguucaaaucccaggagccaggugguggaagucaagcgccaaccgcacaggcucugcucugacugacacaugugcacugcgguacgugcauccccagcacccacacacacacaguaaagaaaauaacugggcgggagagauggcuucgagguugagcguacuugauacucuugcagaggaccuggguucaauucucagugcaugcaugguggcucacaaccaucuucaaccccauuccaggggcuccgacggggucccgaaugcugcacacacaugcaugcaggcagagcaucccuacacuuaguaaacuaaacuaaaccuaaagugaguaaugaacgcaacaaaugcuagcacagaugcccuuauauccugcugcugcugcuguaaaccaguccagccaccguggacguuaauguggagguuucuugaaaaccuaaaaacacaucuuccauaucacccagcuguacuguuccuguaccugaagguuucccagguagucaugguaucuaaauucuagaggcagucuaggugucaggcaauaggaaucaauaaggaaaauggaaauuuuuuaaagguuuaaaaagaaugaaguuacauuguuugcagaaaaauagaugcagcuggaaauaauaauacuaaguuaauuaaacaggcauuauguauaauuuuucaaauuuguaguuccuagauuuuaaaaacaauauguauauauagaaugaaagagagcagaacuguaauuuuuucaggauucaaagcgggggaggguaacaagugagaaaaaaagagaggaagcaggcuggggaguauacucgguacacaucuauaccuggaugaaguucuaugaaguagacaagaacaguguccggaagguguguucuucccagguuucuggaccacgaggcuagcugcgguguuuggauuuggaugcugagugggaaaugaggugggacuucaucacucagguuaacggaggugucugggccaggucaacacaccauccucagauggauggacaccgagcccacugaaguugguaaacucggcuucaggaacguaauccauggaggggcucuagaggacagaagucugaugccuccaucccgucacaguucuuaccccugcccugagauuacugggagauuauugggagcgcuucuggcauuucccaugccauuucuccaaaugauaagaaccuucaaauuagaauuuaguuaaaaagcguuccaacagagaggguccucagucgauuaucacuuggauuaaugguuuuccugaccagauugcuaauuucuugugaguagagugucuuucucaccuuuuauugccccuauaaucuauuagcuguuucguguacauguaaaagcauuguggaugcuagcugaaugaugugagcauacuacugaaaaaaauguuauaaauguucuguuuaaaggaagugcagaagaagucuuuugaagagaaauaugauaccuucaugacgauuugccaaaacuuugaaccaguuuuccguuacuucugcauggaaaaauucuuggacccagcuguuugguuugagaaacgauuggcauauacacgcaguguggccacaucuucuaucgguaauccuguagaaaauacauauugaucacauuacugcuucugucucacaaggagaugguaguggcaaugguaguuguuacucaaacuguccucacaaggagaccauguguuugcucaugcuaauuguuagcuugcaaccauuguuucagaggagaacucuacucugagguagagaaauagaaccaguuuggguuuaguuuuuaguauagugaaugugauuuauuuucucuccccucaauauacauuuuuugagauuuucuuuggaaaauuaaaccuuugguauugccauuugacuucuuagucuucuguacaaaaccacugauuuguucugcuuacuagaaucucagaacagaaauugugauauguguuuagauacuugauauacaacauauguuuugccuuuuuaacuuugugugagauuggaauaaaguuaguauaaagccauuaacaagaugcuggaacgugagaacugacagaaacguggagacuauccuguuaauucauagcuaaagcaguuccuucugccacugcuaugcuguauguagagcagcagggcaggcuuaggcgaggccucagugcuugugggagccucuucuuccaugaaaaucaucauuuggauuaaaggggcuuggguuuauagacaagaaagcaggcucagcuaacaaugaggccagucagacaugguggcauccuuacucccuaccccaugguuuuucuguaacacugcaugcuuucucuuaccagguuaaagguacuucaaggcaugccauuaucugucuuaaaaaauagaagugcaguucugccugcacaggcaccuggugaaauaaaguagcgaucaguuuccagucagcuuaguuuaucaggcagaggaaagucucacuguugaaugaugaaguuaccaaucccugcaucucuugguuuguaaggauacuuaauaaaaaucuugaguguacugcacugacccagguaaauuagggucuccagccuuaaccacacuaacuucagagaaaaucuaugcuuuuuuuuuuuuuuguaaagagaaaauauuuuuagcagcacaucuauuuguaaaauguaaugugccuuaaagaaccuggcuagauuugacuuaaacccuacacacuauucacuguauauaguuuccuuuaaguagcuuuaaagucuaaacuacguaaacauugcauagagucagugauacuaguugagauuguaguuggcuguguauuagagauuucacaugguugguuuuggguuuuuuucucuagucgguuacauccuuggacuuggcgacaggcacguacagaauaucuugauaaacgagcagucggcagagcuugugcacauagaccugggugaguaaugaaagaugcggaucuuucauuaauauuuugucaucagacaguucggaugucagcguguuacaaauaugaggaggucagacacaucagcaggaaaauacaacaagauuuuucuguaagugucagcaccagaggugagggaguggcugcaucuaccugugacagugaguaaaugucacuguaagauuggauggcaguugagucaaguucucaagacaagaaggaagggugacugagaagguggagaucuagaaaaugaggagggcugacuagcagccuugcuagaggagccuugccaguaauuaaguagcuugaggcagagcgcaguaguagacugaagagaugggcuacaggguuuucacuuuuaaucuguuggauggugggaagugaaaaauauuuaaccagcagacagugguguuuggauuuuagguaauuuucugagcgauuuggaccaggaaguugagagagaaaaugagaguguggacaugaaaugacgguugggacuagcguugggacaaggagcuuggauuugaggccguuuuuguaguaagcccaugccauugaagucaguggcacagagugggaggaggauuccagacauccaaagcaucuaacaaaggaauacagcagaucucauagacaacuaaaagacaaugaguuuugcacauuucaaaacauuagagagcuuuccggauagcagcagcagcucaauacacaagagagagauuggaugucauggccagcccagcucaucaguaguacaggcggcugcagccacugggcuggggcagacucugaucucacacugacacguuagcaaugcuaggacugaaaaacuaaaccagugugggcuuuguagcucaugacuauaaucccagcacuuaaaagacugaggcaggaggauugcugagaguucaaagacagcuuaggcuauauagggaguuucagaucagucugggcuacgaaaugagacacacacacacauacacacacuguuacuuucugggcuuuacaauguccauauucugacugugcuacuguacaaugguuuuccacugcagugggggaaauggguagaaaguauguagggugaucuuugugcaugaaaaucaguauaugagucuguaucucagaacuuuuuuuuauuaauuaaaaauguuuuaaaauguugguacauaagucuucuacauuuuaaccauaccaguuauccaguuuuaaaaucauccuuuaaugugccucccuucgccaaguagcuguuacuuuugcguuugguguggcucucaucgaugaugaagcugagauacgcagggaaagcaacaacaggauuauguauuuuuucaaucauccaggacuaauagagcaugaguaccagaugguuggcugccuuuccagaguuagcauggacuuacagagacagcgugucagcccgucagacucgcuugccucacgucucuuuuauuuuaggaguggcuuuugaacaggggaagauccuucccacuccagaaacaguuccuuuuagacucagcagagauauuguggacgggaugggcaucaccgguguggaaggugucuucagaagguaagggagggaaagcaugcaguguuugcuaucagaacuauucagcuaguagauuuaaagagaugaugcacagagacccuuggcacgggccaccuugguguuaauucagcaugacaucguguggucauaccugaccuccucuggaagaggcccacuuuuaugcuguuacucagucuuagcugacucacucuggucuuuugcugucuuauugaugcucaugguuggggguauuaaaaagguggugguuauuuugucugaaaaaaaacauguuucuauaucauguuuggcuggguauaacuuccaguccuuguaguucccccaguaaagguccacaaucucagcucggcaaaguaaauuaauacucgccucaguaaucaagacaaugaguauuucauaggaguacugucuuccuuguaagugcugagcuuaggagacacacacacacacacacacacacacacacacacacacacacacgugcaucuguauauauuuauaucaauuucuggagcaucucuuaaaugucuuagcgguccugcucuuugaaauacaauauggggaauugcuagcaagaauccucuaaguauguauuccuaagugcauauaggcaaagaagggcugaaauaccagcgucuacagaauccauaccuguaauguuuccccucgcaggugcugugaaaaaacgauggaaguuaugcggaguucucaggaaacccugcugaccauuguagagguaaagcgugcacagggcaucugcauuccuuugccaucggccugcucauagagagucacucaucugaagagcauugcuguauuucauguagagugggucucgggcagcagcagaaaggggaacagugagcaccuucauacaucagagucugggguuggaaauggcucuaguccccucauguuucuuggaaauaucauacauuguuaaguaaucuccaaucuuuacgaaauuaaugagcacuuuggcaucuuagacaucccacgugggccugaagaugacucagcuggcaaagugcuugccccaccagcaugaggaccugaguuuggauccccagaacccaugucaaaaccuggccuaguggugcaugcuuauagucccagcacuggggacgcagagcuggggcaaccucugggacucuuggccagcaaggcuagccaaaucagugaguuuccauucaaugauagacacugucucaaaaaauaaagaagaaaggugguugaagaaagcaccuggcauuaaccucugguuuacacacgcacgcacgugugcacgcgauuaugugcguacacauauagauaugucuguaugccucuuggauaguuugagauugguuuccgugaagaaaaaucaguaauaaguaucacuuucccuacaaaucucagagcuaguuuagauagaaaucagaguaucagucuuguuaguggcaagcguaacugaagagggagauuugcugcugaggcuccugccgggccuaguugcuuugggacaacucaccugaauggagcuguggcuguguacagguuuaaauccaguucgucauuucagcuugacccaagacagagagggaagaaagucugcaacgcuugcaacauuaauucuucccaagaauuaaugaauuguguggugcuggcagucaucugcaaccugguaagggugugugaaauaagagcucagcuguuuccugcacagggaaauacaugcaggaaguagagugcaggccugacuggcugcgcacagugucgucugcacuguuucuaaagaguagguguuaacuguguucagaccagauuccuagggaugcagcaggacccuguguuuuguagaugacucuuccugugcaggcacgguuaagagccauucauaucucacuggcacuauuaaguccgugauaacaagagccgagcugugucuuuuagaugacucaauaaacagucugccgcaguggucugagugaggggacugcaacugagaaauuauuucugucuccaccuacgaugccuguaucacuuuagaaccauccccacccccaccccaccgaccagccacacacacacagaauucuguauugccuucgguaaaucaguccaaauuucugacagccaguuguuuuuccuucaaacaguuaccuguucacuguugguugugacuaguauuacuucaugaugugguuacuauuguuuuuaacuacauaauuaaaaggcacgcuguuuuguuuuuucuauuuagguucuuuuguacgauccacucuuugauuggacuaugaauccuuuaaaagcucuguaucuacagcagagaccagaagaugaguccgaccuccauuccacccccaaugcagaugaucaagaaugcaaacaaagucuuaggugggauauuucaggaaggaccuguuguuacuuagauuuucuuguucccaggcccuccaugguugcaccucauuguaaucuuuguguucuuuuaucauuagugauacugaccagaguuucaacaaaguagcugagcgugucuugaugagacugcaagagaaacugaaaggcguggaggaaggcacugugcucaguguggguggacaggugaacuugcuuauccagcaggccauggaucccaaaaaucucagccgacucuucccaggauggaaagcuugggugugaccuucacccuuaaacucgaacuucagaaaugacaucucacccaccauauuuggacaggaauuacuuaagugaauaacugcuuuugauccaauuuucuacuugacugaucaccaccuaaauauuaguauuucuacucucuucuguuagagguaauggucacucaagauccauucguaggauacgugcugacucuuaggucaugcuugugcuacugcagcaagaccgccgcauacacacugaacugcaaauggugggggcagcagagugagcuuuacugcugguguacaugaagacaaguucguaacuucugcucuaaaacaaccuuuaauuaaagcauguuuuccagacugugugugugugugugugugugugugugugugugagagagcaugucacacacauuaaguaaugaagugcuuaauaauacuuuucaaaagggacucuuuaaaauuguaacuaucacuauaucaugggaaucccucauuagaaugaauguagguagggcuggaguguggcucagugggagaacaugugccuaaccuguaggaggccccauauucagaccagaauugcagauucaagagaaaaaaaaaaaaauagagcauguugaaagcaagcaguauaaguugagccuucuuaauucuuaaguccaaaacaugagacauuuucauguugaaaacuuucugacauauugggcucauuuuagacuugcacauuauauuaggcacacagcuagucuuagcucgcugucugcaugaaugcuucccaaccuggaaacgucuaaaacugaaagcaacucucagcacacauacacacacucacaacaauaaaguaaacaacuuuuuuacaaagggaaaaguagauugcauaguuucagcuaugugcccuggaacuaacagauccaccuccuggggccucccaaggugcggaaggaaggucgguguuaaaggugugccacaccauauuccacuuuauuaauguuccaaguccuggucugucacuaaccaucuuuaaacaccgcauugggaucgucuuguuaaggcaagggcugggugggcgguugguuguauuguugauucuugucucgggggcugauuggucauuuugucauuuugaaaggugugcucacucauacacacaagcacacaccgugugugggaauccagaguggcuugguuaagagggguucuuccagauaguuugcuucuguuucacccucagggauuuuacugacauuucuuggcuccggagcuuuagaucucaggaguaguguagauucccgagagcagcagagucuuucaggccgcaguagaccuguucucucuaaucuguaugcuaaugggcauaauguugaauugaugccccuuaaaaugaaagcucgaccugugucucacugugguggcaggguaaagggagauggcauuuaaugcuucucuugugcuguuugcaagccuaauaccacacgugugugugugugugugugugugugugugugugugugugugugugugugugugugugugugauuuguauuguauauacaaagccaaacuacucuuuugguuucuguaaacugcuaugaaacuguucugcauuucagcuuucuuguguauuuuguaagaauuguuaaauggauauuuggcaucugcuugacugcaguaaaucaggcggauguaaugaacuuagaaugucuguaagcaaguguugaugucuucauggauggaggaagaaaauuagcuaaugaugucuagcuaaaugaauuuguaauuuguuuuuguaguuaauccacugaagagguuggaauaguugauccauucuucacccuugaauaauauucuguuaacagaauauauucagauuucuucaguggcuuugauaaaucuaugucaaaauuuuucagauaaacccagaagcugcuacuugaaaggugaaaaagacugaguuagaaaaucuuucugacagguuugagugagacgggcuguuaccaggagcccaugagugauaguuagauuuauagguuacuaagaaucagguauuuucuuuaugcugaguaccugacaugucuaucagcagcaccucugauucuuacaacaaaacuuuguaauauuccugacggugccacagauuaucuggagaaaaauuacuugccugaggacagaagacauugcacauguguuccucacagaagcugcuagaaaagaaggaggcagcaugucugucugucugcaguaaaggaggcagcacuccucuuccagcccuaugcugcuguaccccucaaaugguccccagucagguccuaaggcuaaggucaucauagcguucaauuaaaacagggaaaaaagggugugucccuagaaauccaucucaacuuuagaugugauaaaaggaauaaacgcaaaaaggaacuuagagcaccuuaagguuuauaauaacugucuuucuuuuuaaguagaaggucaguaugaaauagaaaaugugccauaucaaauguuuuaguugcaccuuaguaaaauuauguauguuauguagauuuguuuagugcuaguaaauguuuuucaguuaugcuguuuccugaauuaucaguuuguuuuaaauaaagaacuguggaaguauaugcugacuauacaaccguauguccauuuuaugaaauacuugaguauugugugugccaggcauggggcuaguuccuagggagacaacagugagcucagaguccaggaaagaggcggguggcugcugcaguggaaucaguaggcaguccaggacauuacauuccaggcugugagucuga

SEQ ID NO: 5104 - RNA, 40285 nt, Mus musculus
cagcaccuccaguggaaccgggagaugcggcggcgccggggcugucgccguguuugcuuugaguugagucucgucccuucaggccgcucccugugcagcucggaucaugcuguuacccucggauguagccaggcugguauuggguaagcggcggccugggagggcgggugaucggacccgggcugaggggacggaaagaccaggggcugagggggagggcugcucgggguggggaagcucugaggaguggucugcucccguccaaguucagacuagcggagaggcucggucccucggcgccuugggacagucgaagcuccucgguguagggaugucccuucuccuccugcugcgcgaugggggcagccgaagggagaaagaagcucggcggggaacaccuggggccuggauuccgaggcacagccaggcccgcugggacaccugaaggagugucgccugcgugauggacgaggcugcguguccccuacccuuucccuugucaagagccgggacugauaaaggaaaaggcggggggacccccgcuuccccggccgcccagccuuguggaaagacuuuccgacgcccuuacccauaacccgaccuuagcacugggaauuugggacacagggagggccccacaccccuggcccaccauaguggcuugaaacgccaauugcauauuucagaacggcagcgugucguguucuugagcaaauauuuaggagguacgacgacugacuucugguugcacacguucuagcccucguuuuccuccauuuucgaaaaggguuuguucauagaccacugguuggucgggagauacugucucuggaaaagacuguuuucguuguuuguccugugaaagaauaaaagggauuguucuguagggaacaagagccucuuaggcucaaaacuggacagugacuuugaaacguuauuugggacaucucuaaaagaaaguggucgaaguaugaggacucauuccauaguuuccacagccguuacgaacauuugcuuugugcccagcccuguccaaaaaauaaaaauugcacauuaggcaggacuuauuuaagaggcucuguacgauucuacuguccauuuuuugagaaacuuaaauacaaaaacuaguguuuugaauguuuucaucuucaucagacuuggauaguuaaauuuauaccugugauuuuuaaacuuagcuuucuuguaauuuuaaaauuaggcucauacaaaauugguuaaaaguagacucacaugauuuuuuuucuccccaccuauacguauuguuuagguaagaacugcgacuuuuagcagucuugugauccauauaaaauuccaugaucauagccucaaaaguggcuuuuggaguuugguaguaugaacauugaaaaguggauaauuuuuaugaggauuuuuccauguuuucuuuccucagauuuuaugggaugcuuaauagcaacccugauuucauuagauacaaguaggaugucauuccuucauguaagaaaggggguggggaggggcuuuauauacugucagcauauccccugaagagaaaguccugccuuguuaagaaaaccuuaaggaaaugacagggccuuucuaauuggaauaauuauguuucugccccacuaacaagguaacuuauucucuugaugccuagaaacucaaguuguugcuuuucauccuuaaaaucaucuuuguuguucagauucugcuuucagugccaugaauuccagcaugccucccauucuguuuuggaauugugaugccuuuccucauacucuacuugcaauucauguauacucggguugcaaauauugcugaagcaucuaaaaauugaaccucuuuugaacuuggaauacaaaaaaagccucccacuauuuucaguucugugauuuaguacuaucuuuacacacacacacacacacacacacacacacacacacacuucuaucuacagguuuauugcuugcucaggguccuucugugguacccccuuaccaucuuuagccccucuuucuugauugcauauggucuuuguuguugguuguucuguugucuuguuccaaacacugccagauuuuuaagcauaagaggaaaaguaauuuuacuuaacauucacuucuuucuuucuuuauuuuuuuuacccuuuaauaccaaaacauuuuucucaacucccucucacauuguccagugcccugugucacccaggagauuacuaguaaaaccgccuguuacuuaguagcuuuacuaguucacguuccucuaacucuucagcuuacugcacugaauuauucaccuaaguguucucuacucagccagcuauuuauugccucgauggaauuuuucaaacucuuguagagaccaagauacauugcuugcugccucuaggucaucaguuuggcuuuuacuaauaugucauaggaagugcucuguggagcugguuucuacccagccucaucuuuucaauauuugcgcuaggcuacaguauacuaaaguacuuacauuuuuugaaauaguauauuccuuucccccuguguuccuuguauuaaagguucaaguuaaaugugauaucagaaaguucuuucaguagccacuguccuauuaaaguaacuuuguugguggauaagagauuuucuuggugagguacacauaacaaaauugauaauuacagcuauuuuuaaguuuaugguucuguaguauuaguuacuacugucuaccucuaaauuuucuuucuucuuacuaaacugaaacuuucuuaaucaguauucucuauucaaacaagaauuuuuggauucaaguuucagaguucuuaggaacuucaaaaauguuaaguucuauguauaaaaggagcacuuuuacgauugaaggguucagauuuuuuuucaauuucauaacuagguuaguuucuguaugaguugguguccauucagaaaacagaaacuaaguccuauguuuaaugugauaggauuuaaugaaggacuugguuacacagguggugccaaagcuucuuagcuuaugggaugaaggaacucagcacagcaggaagccaugcuaauccuggagacagggcguuauacagcaucccagagacaacuauguggaagaugaaacugaagucuugucuccuaagggacugucuguagucagagcaaagauucgugagacaaucagggaauaaggcuucuuccuucugaauuccagucugauacaagcccuuccccuuuuagaaccguagccggaagccgugauaggugaaccggguaacugccugcuugaagucuagcuuccaaaauagaguccuagaaaauaaagaacugguuuaagggcaaaaagaacuaauacuggcauauucuuaagagaucgggagccauugguuuuauuuucuuuuauauugaagacaaugauauaauaaacauuuaccaggaugcaauuguaaucauucuacaucuugaauaauaccuacacucacugcugacacuugaaguguuucauguuuguguuacuuuauuuuuaaaucucuguguguaugugugugcaugaaugcacaccacauuuugguuuuguggagcccagagauauuagauuucuuggagcuggauuugcaggcaguugugaaccaccuugagugggugccaggaaucauacucggguccguggaagaguaauauacacucuugacugaugagccaucucuccaguccaguuuucugguucuuaaccauuuugucuuuucauuugaagcuuauuaacuauucuuuuaugcagcgcucauacuaggcaugguccccaaacaaauuucuacauauaugccaucaauacuuuggagcauaucacccccuugaacagucauuuuccauucuugguaguauuuuuuuuuuucuccagagcugaggaccaaccgagggccuugcacuugcuaggcaagcacucuaccacugagcuaaauccccagccccguuuuuauuuauuuauuuauuuauuuauuuguaguaaauucuuaagucuguaucuucccauaaacuaagccacuccuacuuucucaguacuuuuagccuuuccuaagauaauuucuucuaacuccuuguaaauuauaauuuguggauugaagccauacauuuuauauuuguagaucuaguacuacaagacauuguuacuucucuuaguaagaccuuauuucuuauuaagaaauuauauucuuucagggauauuaaaccaucaguauugcuggggaaucaguacaugaaggagauauuuacacaaacagagcuuugguucuugcuuucuuuggacuccuuuuugucuuuuccuaaaaaggccaagcucuuagaauguuuccccaauuuaugaagacccuucguauaguuuagauuuuaucugucaugugauuaguugguuaugaucagaugguuaaugaugguggguaggcauuuuuguagcacauaaccaguuaaucauauaaaccauggcaucauugaacauuuucagguaauuucuacguuguuuuugagcucuuaagacaaaguaaagcagaacuuaccaaauuuaaccaaaaaauuaaagcucaaauuuuaccaaagcauauuugagaguagaacauaaugucucagguauuucuagauggcuaugcauuucuauaacaaguagcagugaugcacuguuuuccagagccuuuucucaaauacacuaugcaagcuuguacugauuuacaauguaucaugaacuaucauaucugauauucuuuucccaaggcaugcuagcacaauugaucauauuuuucauaggucguggauaaaucaucuucuuuuuguuuuugcuucuguuuuuguuuuuucgagacaggauuucucugugcagccauggcuguccuggaacucagaaauccaucugccucugccucccaagugcuccgauuaaagguguuugccaccacugcccagcaauuaucuuuuuugucuaaggcauugcuuuucaaccuucauuucacuguuauacccuuuaaggagacuuuguaaaguuuuucuaaccacccuucccacaaauauuuuuaaucucacaaaaaaacuguacaucuuuuuauauuagauguauauuucuuguauuaaauuuuccgauuucucugaggagcaguuucuacccucuuuuagaaugcugccacuucuuaggaaugaauguguguucuacaggaaggaaaaauguuuaggaguccuauuucauaccgaccaccugucauaagucucaagugacugaauauacaucuaggugauuaagcuuuuagaucucucuaugaugaaaaacaauuuauuugguggaucuaauccaaauccaaaaccugaagagacaguuccagcugccccuguuccaaggugauuucagugguuuauauauguuugaaauuuguggucacagaauccuaguggcaccucccucaauccaaauaauauuuugagaguacugaggaaaaauuuaaaagaugauuauauuuaacagucaggaaaaggcuuuuuuacaauugaauuuuuuuguuuuauaugagagaugaagauagcugcaugugacagaaaggaugugcacauguguggaagucagaagagaacuuuaaggaguuggcugcccccuuccacugugggcucugggguucacaccaaaucaucagacucaugaaguagaugccuuuaccagcugaagcuaucuugcuaugccagauguaucauuuuaauucauguaauuugcaauaugaucuucaaugauagcaauuuuuuuuuuuuaaagauuuauuuauuuauuauauguaaguacacuguagcugucuucagacauuccagaagagggagucagaucucauuacagaugguugugagccaccaugugguugcugggauuugaacucuggaccuucggaagagcaguugggugcucuuacccacugagccaucucaccagcccaaugauagcaauuuuaaaguaggaauaaucugaaauaaagaguuuguuuggagguuuugccugauuguuuugguuugguuuucuugguuugauuugguuucuaaaugcuucuuaugcuccagaaaauauuugaauauuuauuuguuuuucuucauauaaauuagaaguuagaaaaccuauuuguuaacauaaagguagugccuaaaaugagaggaccuuuuucuugcucuuuccuuuuuaaaauucauguguaauggcuuuguaggccuucucaucgggguuggguuuuuuauuauuuuauuuauuuguguguguguaugacugauuugccuguguguaugucuguauuacacgcauacaaugcauagggucagaagaagauguugaggcuccuagaacuagaguuaaaaaugauugcuagccacaguguaggugcuaaaauuugaacccaguccucuggaagagcagcaagugcucuuauuaaucaaaaaccccaucuccagcuccuguuuuguuuuuguugcuuuuaauuagaagugaguauguauagauuuccaagugaaaaaaagccuuaaaauuuuaaaauaggaagagacuuuagaagucauuuacuaaagcuaucaguuaaagcuucauauaguguguuaggaauuuauaguuggguuuuuuuuuuuaauugcaguguauaauugacacaauauaaaauuugggggcuuauaauauuucuaauauagaauaggaccacuaauuccaaaacauuugccuaucucuaucaaaaauuacauacugauaacaggcacucucaguuuccccauccuccacuuaaccuauuuuuauguaugaauuugcuguuuauggacaucacauaaaauugaaauauuguggcuuucauaucuaacuucauuuagugugauuugaagagugauucaggucaugauuguuagaauuucugucccaggguauaugguaaagugaaugucuuuucacaaguuguauuaucuucuuugcaaaccuuuugcucauuucuuaauuagauuguauauuuaucauuguccuuuucaaguucuaguuugguuucuagcaucuaccagauaggugauaugcaaauauuuucuuacuuuuuaaaaguuauuguuuuacuuuaccuuauccuuauaagcauauaaauuugaaauguugauauucagcuuaucucuuucuuugguugcuuguguuucagguguuauaccugaauauaucauuguuuaauuguuauaucuuuguucaauccaagaccaaaaaaaaauuaucucuuuuguuguuuguuuguuuuuccaaacacuuuuauaaccuuagacuuuacaguuagguauuauauuuuagggggguuaauuuuuuaauagagugggauuugggggccagcuucauuuuugcaagcagauaucaacuugcuacaacaugaguuauuaaaagacuauuauugccaggugguggcggcaugugccuuuaauuccagaaggaagaggaaggcaggucucuugaguuugaguucagccaggucuacagagucaguuuuaggacagccaggaauacacagagaaacccugucucaaauaaacaaacaaacaaacuauucuuucuuuuccuccagugagcuuuuuuaauaacuuuaauacagagccaagugguuaccaaccuuuauagccuuucuuguuaagguugaaguucuuauuggaauuaauaucaagacuauccuucugaccugaaacacuguauguauagaucucucuucuauuugcuaaaucaugaaguagcuagucagacacagauaagugauccugagagaaggugguuuuuggauaauccaguuagcauauauauucauccccucgccuaguuaccauggaagucauggaguaguggaaugcacuuacuauuucccugcugguuuucuccaaguuuauuaugcucugguugcacucugucaaagaucucuuuuuacaagcuuaacuagaauuuguccuaugaaagaacucgugaucauaaucauuaugcuuuauacuguaguacaaccuacugaaggcuguaacaugggcauguuuugccugaggcuccacuuauggcuuuccuacauacucuagcaguucuaagaguacagaguuuaaugaaaguauucaaacuucuauuuuuuauuuagguuacuuacaacaagaaaaccuuacaucuacuugccagacuuuuauuuuggaaaguucaaauuuaaaagaauaugcagaacacuguacugaugaagguuuuauuccagccugcuuacuggugaguuacuuacuccuuucaggaacuuucuacuaaccaacgcagaagacuguaaagcacagccuuaaugugagcuuuauaagggggcacuuugccauaugucuguuuuccuaugcgauugggaaccuaagauaauugcuggaucacuugagcccaggaauuuagggacagccugggcauccuagcaagacccuugucacucaucaaccaagucagcuuuggcaaaagcuacaugacuuaucacuguguguaguucacauaacugagaagcagagauuuagccagguaguauacaucaauaaugcagauuuuagaaggcugagucagggaugauuaucauuucuuucagaccaacuugggccacacagcaagacuuuauaaaaaauuaaaauuuaaaaauuauugucacagagcuagaaagauggcucagugguuaagagcacuggauguacuuccacagguccugaguucaguuuccagcaaccacacaguggcucacaaccacagcaaugggaucugaugcccucuucuggugugucugaggucaaugacuguauacucacauacauaaaauaaauuaaaaaaaaaaaugucagccaggaagugguggcacacaccuuuaaucucaacacuugggaggcagaggcagguggauuucugaguucgaggccagcugggucuucagagugaguuccaggacagccagggcuauacagaggaaccaucucaaaaaaaaaaaaaaaagauugucaccucuuuuuuuuagauauauaaauauaaaaagaauacucuggaauuacauguacuaguagguauauguuaaggauggccccuuagugcaauuuuaacuauuaauggucauuuuucuauaaaaagccuaaaagaaacuacaaaacugaaguuuaccaaggacauaggauacaaaauauccaaaauuccacucuacuuuuacauauuugcaaugaacaguuauuucaguuuuuaaauuacuuauaauaacaacaaacagaaugcuugaguaaccuaacaaaauaugucuguaacguuugcuugaaagaaaaagaugugaauaaaauaaacauuguauguguaaaugaacaguucagugguguugagucaguucucccuaauuucacuguagauugaucagucagaauccccacaguuuuauagaaagcaacaugcugaauucugaauuuuauguagaaaaaugauuggaauaccagaaacaauugugaaugaccugaaaguguuggggaacuggaaaagauggcucaagcaccugcucacacccagcaccccugucugcuggcucugacugggcggaccucacggcugucuuuuguugcaguuacuugggaucauacucccucuuuuggcuuccuuggacgcuugcacacccagacaaaaauaaaauaaaucuugaagagucagaacucucuaucauuuuaaagugucaagaucaagaaaaagacuagaaaacucacauaccagaagagacuaauaaaauauaaugcuuaaguauaaucuagaauuuuagacucacauuucagagaaaacuuccaaacugggaguuugaauaaguuccaguaguuucaugcuaauguuacuuuuaguguugauaaaaguauuuuguuucuauaagaugccagugcuagaagguacuaagaauggcuuacugaacucuaagcugucuuuaggcuccucauugaauuaaaauuuuaaaaacaaaaaucuuaaaaauuaaguuaaaacuuacaaaguacaaaaagguaaauacucaugucccauuuuuuaaaggcucauuccuuuuuugauuauguguauuugugcauguuugugugggaguauacacacaugacuacagcaacucugggaguauacacacaugaauacagcaacucugggaguauacacacaugaauacagcaacgcucagaggucagaagagggugucggaucuccuggagcuggccaguguuaaugcugggaacugaauuugggucucuaaacggguagauacccuguuacccucuggaccuucucucccuauaaguaaacugagauucuaaacaugaaacuaaaaugcacaaaguuauauuugcacagcaauagaucuuuacuguguuacuuucuauuacugaguauuuuuauuaguugaguuuuagaacaguagugaagacaagaaauaaaaugaguugauaaaaauaggaggggaagggauauucugugacuaugacuucauccuugugcugagaccaaaggaaaggaaugucugucccaccaaaucagaaguuuucagccaguagaucacaaccccugggggcugucaaacaaccuuucacaggggucaccuaagaccgucgagaaacacguuuguuuguuuguuugcuuaugauuuauaacaguagcaaaauuacaguuaaugaaguagcagugaaaauaaauguaugguccaagggucacuacaacaugaggaacuguguaacagcucacaguguuagggaggcuggaugccaguggagaugaguguuacuauacagaggugaaccguuucuccagucggucacugagcaauaacuaguuacuggucacuuacuacacaucacuauuagaaagaaaggaaaacaaacaaacccagggaguuacuuagggaaaucuccugccuucucaggcuuuacggugaguaaguagucuccaucggagcuaaaucccaguuucucuuuuacuuugaguugggaucucccugaguuacuggaguuguaacuuaaguaacuuaaaaguucuuuguaaaucuaacagaacuugaauuuacagcccuuuggcuuuacccuuccaaggacuuaggaauaggcccauaccauaugccuuaaucccaguacugaggaagccaagaccagccugggauuuauaguaagaggggaaaaaaguguacuauugaaaguuaagugggaaagggaauguaauugccugucauauaucuuucucaguauaugucuucaauauuguccaaaauaaaaguuuuauacuaguaugucugcagucaauuugagguauuuaaagaauuugcuacaugcuguuacuguuuugaaaucagaauucuugguuccaaaauccuugcucuuuucuaacuuuaagcguauaaucauacuguuauaaccgaguacucgugaguuguagucauaaggaaaggcauguagauauguugacaggaauaagaacaaauauccuuaggaaggauaucucauauacacuuauuuuuaaaacuucauuuuuauaugguuuacauugcuuucaggucagucaaaacagguucaauguggguccuuauucuuucuuuuaaacaguauaacaaaauacuaccuccuggcugaaaacugcuuuuuaugaccaugcuuuuuuuuuacacaaggacucaugucaccauucagacaggcagagagaguucuuucucucagaaguguuacauacacuuuagugacuguuggaauauaggcccaacaguccugcuucucuauccuuucucacaugauuuucugcagucuggaucuuucguuggcuuuuauggugggaaagugguaaauugaaugguuuugguaauguuugaucuuuuugccuuucaguccuuauuuggaaaaaacuugaccacaauuuugaaugaguauguagcuaugaaagcaaaagguaaggacuuggauauuuuuguuuaaagauacugucucauuaaaagccuugaaaaaacuuaaucuuacucugguaagacauauuuuacugagccaaguggugggguugcacaccuuuagucccagcccuugggaggcagaggcaggcagaucucugugaguucaaggccaaucugguuuacagagugaguacuaggacagucagugcuacacagagaaacccuuucucgauaaacaauaaaagauauauauacuuuacugggaaacagaauuuauuucugcuuauauugaguaaaaccaacucuaaaacuccagaugguaacuaagcaacauaagccaaaacucauguguuaaaauaaaauaaaacuuaacucuagguuauuuauaaugauaaacaaaucaguguuauuugcuaaaauacuuugaacugguaauuaaauuuugacuucuguguaauacgaaacuaggcauaggacuuggucaaaaaauuggcucauaguuaacaaaacuuuuucauauuucugaugaguuuagaggggaauuacuuauuuucuugacauuguuucuauaguucaugucaucaaaacuauuacuguuagauuaauugucauaagcuaauagccagaggaaaaguagcuuuacuuuuauucauaacuagauaugcaaggaucauguuaguugcuuuauguuguaucucagucuuuaacccaauaaaaaauauugcucauaguuauuuuuaacaaagauauuaaggauuaaauuugcacacauaguuuuuuaacuuucugauaauauuguuugucuuucucuaauacaaagaagagauaagauuauuagccuuacaaguuauuuagauauacuuucucauuuguauuagauuugcuucucggugauuuaaaaaauacagccaccucauuacacauuuacacaguuauaaauaggcuuauuacucaauuucuacuguaacuucaacaagagacaagguuuuuguuuuuuccuguuuauuaucuaugucuuuguucaaauugaaaaugaaguuuucaacugaguuuauuuccucuuauuuagaaacaucaaaugaugucccaacaauaaugucaucucuauggaagaagcuagaccacacacucucucagaucagguacugugugugccuauuaaggugugcugauuuauaaauguaaauacacuuuggcuauaggacuucuuaagaucuuauaguauauccuuguaacaucuuuuuaauuucaaaguuuucuagaggguaauugagguucuuacucuaaauuuaaaauaauuugaaacaaguugaauacuuuuaauagauuauuuucaaaugagggaauuuuaauauacaaaaauuuaaugacauucucaacuuugcuuaccaauuuagaaacaguuuagaccaagauacaaauuccuuuagacaaccauuucuucauuacauauucagagaauuguugacuucaugcccaauugguucuuucuggaauuuucuauuauuuuucauaguaugaauacuuauacugucuauguaguucuggaguugacucggucaauaauagugucugcuauacaaagaugaauagcugaguuuggcgcccccaguacuauauauaaaacugugugcgguggugcaugccuauagccccaggacugguugauagggaggagaaacaccugaaauccugaaggccauugaucagccggccagccuagccaaguugugaacuucaguuuugaugaaagagcugacucaaaagagaaagauaaugagaaauuaaggaacgagccugacauuuccucuacauuccauucauugagugugccacgcguguauacacacuguacaccaaggacacauacugcacacauauaacaaaaauauaggagacuuuuacaacucaagacucuuaaagucacugaguuuugaggguuuagugggagauguuuguuuugguaagcuguuagauaaaaauaagauucaguuuacacagguuuucucaaaacuucuguguauuacuaaaaaaaaucuuuguucaguucauuaaguuuuguggaucuuguuggaaauuugacaaauuucauaaaaacaggugucuaugauugcuuaccaaauauguuaaaaauaauuauaauuuacaguaaaagaauaagcuucuacagaauuuuguguacuucucuacauauauggagguucaacaaaguaauuucaugacagcaggauauccuugaauucugagauccuaaaguauuaauauaugugaaucacauuuuuuaggaaaguuucugucauuacaaaauugaauugagaaugcuauauucauucauauguagcuuacuuaaacgugacaaguuucuaaagucaggccaggcuauaccuuaauaucagagcauauugauuagguaggaauuugaucaccaaaauuauguuguuugaguguuuauaugguucuguuuuucuucuaaaagaaaucacaguugaauaccccaaagacauguagacucuuuaucugaggaaaauugccuuuuaacuaauaauuuacuucaggucugguaacuaagccaaaacauaucucaucugaaaguaauacuuuaaaaguaacuacuuuguuucauuguuaggagcaugcacaguucuccaggguuugcugcccaucagagagguugguauuuaacuuucaucaagguacaauauacuucacacucugucucuugaacauuuuaacuaacaauauacauccauguuuucuuuaaauuacucuuguuuuaguacaaucauuagacauguucauauaucauaguugagggaguuuaagguguggcuuaguaguagagugcauguauauggcccuggauuuaaugcucagcaauauaaaacaaaguuaaaacuacuuguguaugaaugugcauauauucaaauuugugauuuuuguuuuuugugugugugugcauauauacauuaaaguaugucuaguuuaacucuugcaugucaagugguagcauccuuaaucuauaauuuugaauaucuuaauuuuggggggacauuauagguuauggaaaaacaguuguacuuuggguuauaugaaguuguaauguuuuuauuuuaguuuguuuuccacgaaauaguuggauaaagcuauuuuauguuuuucagaguuaucuuuuaaucuauaaaucuaacaugauacagcauauaggccaugcaacauagugucuuggucagauucuaaaacaccucugacacuguuaauuuuguaaugcccauguguuucagcucgaacgagaaauggaauugcagaaaucaagcggcagcgauggcuagcaucucaggcagcucccgucaguucagaguuacugguuuuaccuuaugcuucaggacaguuuaccacuucuccuuugguagccacacaagcuguuaagccaacuggcccaauuucaacuccagugaggucaaauauugugguggucaaccagucacagccacaaaguacuguaacuaguaaguuuaaguuuuauucuuuaaauucaguucauccaaguaaucauaacuuaauuuaaaauauaaaaucauggcccaagggcgagaugaaagaacuuauaaaaagaacagacaauuguucagccacaagaauguaaacauaaaacuggauuuuuuuauucacuguuauauaaaacugacucaccuguguaaucccagcagccaggagaaucagaaauucaaggucaucugcuacaugccuucaaauauaaguauuuauuuauuuaaaaacuagacgucguuguggcugcagucuacaguucuuucuguucuaacugaacugcaggccgaccuugaacucaccucauuuucuuuuuuuucuuguuuuuuguuuguuuguuuguuuguuuuguuuuguuuuuuguuuguuuuucgagacaggguuucucuguguagcuccuggcuguccuggaacucacucuguagaccaggcuggccucgaacuuaggaauccuccugccucugccucccaagugcugggauuaaaggcaugugccaccacugccuggcucgucuaacuuucaauuuugggcuaauaauuggaaagacuugauuauguuuuuaagcagaauguacauuauauuucaccaucucuacuguaaaugucagucuguccuggaauauauucccaauauaccaccaucuuucugugcugaauauucuuuauagucucagcugagucuuagagcuagaaguaaaguuggagauuguguucuaauccagaucaugcuuguuguauguauacuuguuguauguauacuuguuguauguguacuuguuguauguauacuuguuguauguauacuuguuguguguauacuuguugaagugaaaacaggguaguaagaaguaggaaacuguuuuaguauguucuuugggauuagaauucaggguucaucucuuauuucugagucgaguaauuuugccacccauuaagacugcucauuuuaggcauaguggagaugccauuaaucccggcacuggggaagcagaagcauguaggucucugacuucgaggccagcugggucuuuagagagaguuucaggacagcugaggcuacaggcagaaaccuugccuugaaaaauaacaagaagaagauuguucauuucugucuuucuccaaauccuguauacuaagagcauucaguugauuguuuuuauacuuuuuuuuuccuuuauguuuccuuugucuugugucaaguguccaaccuuaaguacauagggaccguauugauucaucuuacaaucuuguacacugccuugcucauagugguacucagaaaauguuuucuagguuuuaauauacaauaauaguaucucauuacaaguuaauaaaauuucuguuucuuuggcuuacucuguuuucuuaagauacagcuggagagucuuugaauaucauuccugguccucaggaaaggaaaacucaaaccaguuuaaugucuccugguagacguaaaagguaauuacuuuauauaaucagcacauugucaauagccacuuaaaaacagacaaacgauaacuuaguaaguguuugcauugugaauaaauuaauaagacuagauuaaguuuuugugacacauuccaaacacaucuuuuccaauauuguaacuucacugaauuugaguuguguccuuuaaucaaugguguguaacuugcuguucaguaacuuugugugaugaugugcagaauaaugguagagcuuaugacagaucuuagcucaucugucgagcguuucuugaaugaauauaauguuaauguuauaauccagaagaguacauggagcuaagucaugacagccuguuuuuaggugugcuaugguccacaagaaugcaugaaguuuuaaaucaugaaagcauguucucguuuuuuauuuucauauguauauuuuuccuguucuaguuaagcuucuauuucuuaaaaaaaaucagcggucaggauucuaaaugguuuuuaucugauucuucaucugccaacaauauuuuuuucuuuuuuugauuagaauuuuuaacuucucaaacacauacaaugauaaaacuuauuaauaacauuucagaaacuuuuauaauaaaaagucuauaaauacuuaaaacuuuuuucauaaagccacuaauaaaaugguucacauuccaucauaagauaggugguggaguguagauuguagcuuacuggaaaaacacaugccuaucauauaugaggucuugggauaaauucccauuaccacuaaagaaagaaagaaagaaaaagguauaaaaguacagagcuuguacacuuaggaccacagagcuaauuuuuguuuugggcgugauguuuuuugauuguuuuguuuuuccauucacuuguuuucuuucucuuuucaucuuuauuuuuguuguuuuuuaauagaacucauuacaucugaauccaugcuuuucuguucuucuggcuuuguucuuaagaaaagaggggggaaaaaucugccuacuaccaugaugaucucaaaauguguacucauacuaucauugaucuguuagauacuaacaaacacgcuuuauaauuuauuucagugaaucacaaaagaagagucucacaucaucuggaccgcauucaucaaggaauuuucaggauccaaaugcauuugcaguagaaaaaguaagugaccuucucaaaauucaguuugaaguauucucacauuuaaaaacacugaugugccgggcgugguggcgcacgccuuuaaucccagcacuugggaggcagaggcaggcagauuucugaguucgaggccagccuggucuacaaagugaguuccaggacagccagggcuacacagagaaacccugucucggggaaaaccaaaccaaaacaaaacaaaaaaaccacugauguauuuauaguuagguguguuuauguguuugguaugaaucugagagcaagaggauuggcuauggagcaggggacaguaacugaaaguagcaguuagagaacccgacagagccagaaacgucaauugaugaacugcuaggccuuccgguauggguagauguguguggggaugagugugagagagugugagcgaaguagagucagauugaaacaaguguuuugguuuuguuuuaaaaucauugccaaaaaauuacauggguauaaucuaauuuaaaguaauuaaaauagacuguucauucaucacaaauaugaucuguuucugaacacauuuggauagugacaaaugcaccaaguaaaagcuauuugugauugccagcuccugggguuuagcugaacauuugaccaggaucaggucauugaagaccuuguguaaaacguguagaacugcauucaggauggcgugaagaccaaguuggugaucuggacaacacuucugaauugcaaaauauuuuguucagaccugaaugcagauggaggcaccagaacuugcauuucuuucuacuaauguuuaucaaaacuagccacuugguuuugugacauuuuggggguuuuuugguuuguuuugguuuuuuugguuuguuuuguuuuguuuucgagacaggguuucucuguauagccuggcuguccuggaacucacuuuguagaccaggcuggccucgaacucagaaaucugccugccucugccuucugagugcugggauuaaagccgugcgccaccacgcauggcugacauuuuguuuuuuuaauuauuuauuuagaauugaggucuuguccuguguuccagauuguacauaaaauccugacuacaauuuauaauuuuaucucagcuccccaaauugcuggaacaaaaaaugugaucacaaaaagugauuuacguuugguuuggcggguuggguuuuggggaaugacguaauaugcuuuccuaucuuuuacuaaucuugauuuucuuuuucagcaaaugguuauugaaaaugcaagagagaaaauauuaagcaacaaaucucuucaagaaaaacuagcagaaaacauaaauaaguuuuugacuaggugagcuguaugauucaaauuucugauuguuuuuaccuaaucccccaacugcacuaacaguuucuugguuuuccuuucuguuuuacagugauaguaguguugcucaaguaccuaagcagacagacagcaacccgacagagccagaaacgucaauugaugaacugcuaggccuuccgguauggguagauguguguggggaugagugugagagagugugagcgaaguagagucagaaugaaacaguguuuugguuuuguuuuaaaaucauugccaaaaaauuacauggguauaaucuaauuuaaaguaauuaaaauagacuguucauucaucacaaauaugaucuguuucugaacacauuuggguagugaauacaguguucaagccagcagaugucuuggagucuguugggaguuugggaagcacacaugguacugagauuggucuaagugcacuagccuccauaacacugaaaauucuauagacauuaaauaccuuggcaaaggguguggcaguggacaugaaguaauuugcugaaacuucaggcuucucaguucuuacaacagugaacuuaaaagcagacagaugguuccagagagcucagcucuggaguucagguaaugguagacuugccuagccacagagaacaauuuauggaguacuguugccaacuauauucuguauaccauuggcuacccuagaguauaucaacugagagaguggcaaccuuagcaacuuacaaacugagagaugaguaaagcugaaguaagacggcucugucagauauaagacacuuacccaguauggauuaggaccagcagaaaucauaggaaauauagaaguucccaagagauucccacccugaaccuuuggacucauagauuaaaugcggcagauuuuuuaaaauagauguuuuuaaaguugcuucaauuuuuuuauauuuauauccuauuuuauauauauccuauauccuucacugucuaagccaagccguuuucaguauuucuuuaucuaucuucauuauuccuagaacuccuuccuacaguucucccauccuucauauaaguugacucuaggaucccugacuugugauuaucccucauuuucuggucucaagguaccucaucuuaauagacgccgucucaguuuugucuauuuauaacccuccaagacacagcaagugacaaaguaguccuucucuccuuacuggccugcugggcacaauggagcacucacuaucuaccaaaaccugcacagccuuugagaacuguggguuugucuuauggauguguaggacugcuggucucucuuucacuccugauacuuggcuuaauuuuugggcuggagccaugugcucauuccuuuuuacucugucaccaucuguuucuucacaccuaacaguuaccagauagccccucugugauguuggauauuguucuuccacacauccucuuuggaguagacuccgaucuguccuauccucacucuugucauuugcuacaguuuauaauccaccagcccagaaaccucuuauuaaaauuagaagaaaauuucuuguagggaaauauuuacguguaaaaggugaguaauuucucugguauuaaacacauacuaauucuaauuuuucauuccuucguuuuuaauuuagagugaaauccauaugucugaagaagccauacaagauauuuuggagcagacagaaucagaccccgccuuucaggcacucuuugaucuuuuugacuaugguaauuauuugguauugauuuaacaacuagauaaauuuuuuucucuacugacuugauugaguaaccuacccagaauuaaguaacaucacccaggacuucugaaaaacuaccuguuuccuuacagcaaguaauggacaugggaaagugggucuuuauuuuuacuuaggaaaguucaacucuaaaaauagagguuuucuuuuucuuucuuggguuuggguuuguuuuucuuuugauuuugugaguauuuugaccagucaacaugagcuguggugagucuuuuauaaugcagguaaauauaaaugaauccccaauauacaaaguagucggcauuacagucagaacagccaauggaaucagcguuaucuaagaacuuauuacauggacagauucuuagaagauuuuaauaaacauuaacauugacaaccaggugcuugucaugugccuauuaucucagucaaaaggcugagggcaagaggaucgcuugaacuaagaacuucaaaauagccuaaggcagcauagcaaaaccaaaaaaaaagaaaauuuggugagaaaagacucugaauuuguguuuguaaguggcauauaaagaagcauguuagcguuguuuaggagguggggggcauaccuauaguaauccucagggauuugaagguagaggcagaaaugucagggucauccuuggcuacaucgugaggugaggucagggucagccugggcuaccugagacccuaucuggaaaaaaauaaauaaauaauaugauugaaauaaaauuuuaacauguauuuaagaaugacaauacuugugcuuuuuuuuuccccuaguaugguuauuuaauuauuuuucuauuaucuuuuuaauagguaaaacaaagaacaauaaaaauaugccacaaaucucuagucaaccuauggagacuaauucuaauauagucuugccugaagaaacuaaucuaacaauuaaaaguucuuuugaaacugaagaaucagguaagauuuuuauuuucuuaaugucaucgaaaacguuaaaauuagucucaaaauuaaaaauauauauauauauuuaaauuggaaguuauuuaaauuauuauaggucuuuuuuuuuucuuuuuuucuuuuucuuuuuucuuuuuuuuuuuuuuuuuuuuuuuugagacaggguuucucuguauagcccuggcuauccuggaacucacuuuguagaccaggcuggccucgaacucagaaauccgccugccucugccucccgagugcugggacuaaaggcaugcgccaccacgccuggcuuauaggucucuuuuuuaugcuuauacuuuuauguccauugagaaaauuuuugcuaaaucucuagugucuuagucaggguuucuauuccugcacaaacaucaugaccaagaagcauuuuggggaggaaagaguuuauucaacuuacacuuacacauugcuguugaucacuaaaggaagucaggacuggaacucaagcagaucaggaagcaggagcugaugcagaggccauggagggauguuccuuacuggcuugccucaccuggcuugcucauccugcucucauagaacccaagacuaccagccacaagagucccacccacaagaggcccuucccccuugaucacuaauugagaaaaugccuuacagcuggaucucauggaggcauuuccucaacugaagcuccuuucucugugauaaccccagcuugugucaaguugacacaaaacuagccaguacacucuagugauuugauuaauacauuaauuuuucauauucauuccuuaauagaguaguagacacacaacccaguagaaaguaguauugcccaaaugaguaagucugcaccaaaauaauuuuauuagugcaccaauucugaggccugaucuauuggguucauguguuagaguuuuuucagccuucugaguugggugacggucgccauuuugggggggggauuauauaguauauacugauagucuugaacguucuuucauggaauaccgguguagcauagguaguccauauauaauaagcacuugugaauuaaaggaaagcaagagucagucauuaucaaaacaguuaaaauagagaauuaguuuuuaaaaguauuauuaaauauaacaaauuuggagaaacacauaauaaaaauguauauaguucucucaguuauaaaaucaagugaagaaauucucuugggaucagcucuuauguaagaaaaggauauuguugucagcacaggaaagauuccucccaguaacucccccucugcacccugcaucucuguucuucagagauagcugucaucuucgccuuucauaauaugguaaacuuuaugccccuuucaguaccacuuccauuuauguagucagucugcaagcugugccugaucaucauuucuccuuacuuguuuugauugauugguuguuuuugagucaggguuucucuuuguagccuuagcuguccuggaacucacucuguagaccaggauggccucaaacucagagauccaccugccucugccuccugggugcugggggaaaagguacccaccaccaugcaacuccauaccuacuuuuaaaugccuaauggcauccaguguuuuuacaucuuugucuucaaaaccuaguuuuagaguaucuuccuuugaguucauuguuaauagcaaagcucaauccuccauuucuuaggcugcacuguaacuuaacugagcacguguuugcauguuuguucacauccaguagauuaugcuuuaucauaaacaaaauaaaacuuguaauucuacuuucucagaaagucuugccauuuuauuuugaauuuaccuccaggcugagacuggaguucggaggcagagugcuuauguagcauaacccucaauuuaaucucuagcaucacauuuuuaaaaauaccacuucuccuguauuuguauaccuuaauauacacuaaucucucccucaauauagaauuaaugggcucuauacacaauaugauacuuacuuguuauaguugcagacaucuuucuuuauuuuucucuauuacguuucuuuccuuauuuguuuggguugucuagauuaugguugcuguaacauucacuauagugaugccacauuucaucgcccagcagccuguaccuuaucacaguuuucuguucuguuuguucuuuuuuagcugucuuaaucucuauaauauuacugagugaagcauucauauuugcauucuagagccauguguaugguuaaccucaggaaauaugucaaauguuaaaguauacacagaaauuguguuaauuguguaaaaugaucuuggucucauuucaccaugaaaaaaguauaucaaucaaaauaaggucaguagauguggcaaaauuugaaaaucccaucagccagggggcugaagcaugaucaggcucaaggccagugugggcaacaugcacagugagaccugucuuacaaacaccggaaaaaugagaaagagaaaaggucuagagagggaaacaacacucuuuccacuaggguuagagcuuagggcauuuugucucuuaguaagcauuggauguucuuaagccucuauguuuuccuucuuuguggcaucuguuuucguagaaacuugggaaacaauuugacaguuguuuacaaaacugucugcaauuagaaaaguaauuagauuuuuuugauacccagagaauggaaguaauuaugugucagucuuaaaauuauugguaugccaaagauuguuaugugcuuggcaaaauagguuguacagaaagugacugcuucggaagcuaagcauacucaacuuuccaucacacugguguuuuacagaugggcagucuggucagccuccauuuuguacauccuaucaaaaugaagauguauuauuaaaugauuugaagaguggcaacagccaugauguucuuccacaggaaucccaggaaaacuucucucagauaagcucuaacauucaaaaaaagaccuuuaaaacagccauaccugcugaacagaagugugcccuugacauuacccuugagucugugucuaacuugagugacuuuaaccaaagaggaagcucugcugaauguaaugaacauuguucugaguuauucgccagucagauacccacugaagcugaaguggcugugggugagaagaauucuuugucugcagauauacugagucaaucucaguaucagccugaucagcccagugugccagugacuucauuugugucucuugguggugagaccaaugacaaaaacuuaguucucucugggaaaaauucccagcuuuugucccaaaguacuccacuaacuacaaagccaucaaaaagccaacuuugugaaaauucuaacaauauaauaaaaguuaaaacuaauccucaggcuucugagucagcagacucuagugaaacugcaaacaggaaaacugagacuaacacuguaucgccagcugcugcacagccacaagcagauugccaagauaacucuccacugcagagcaaaccaccuccugggauuggugaaaguuuggguguaaaugugacugagaaaauagaaauucaucuugaagaaccagccccuucagauaaacagcucucuaaugaugcagcgucuguugacuuaaauccuacggaaagcaagacggagccacuucagucugccagugcucaagagcccgagcccccuucugugaaagauggagauacuauuuuucucucuuugagugaacauaacagcugugaagaaguugcacugguucuuggagaagguaauccuguaaaaaauaauaauucgcuuucuucagaaucuggugguucagugggagucucuccugagacccaaaauacugaugguaaaacuagcaacucaacagagguagaugcaucaaguauugucucucucaaaauuaucauuagugaugauccauuuguuuccucagaugcagagcuuaacagugcugugucuaguaucaguggagaaaacuuaccaacgauaauucugucuucuaaaucuccugccaaaaaugcagaauuuguuacaugccuaucuucagaagaaacugcaagugcuguuguaucuguugaaguaggggauuccggcuccauggagcagaaccuuuuagugcucaaaccugaggagcccaugguaaacaacacucagaaugaagauggcauugcuuuuucagccaauguugcaccauguguuccuaaggacggaggauacauacaguugaugccuaccacaagcacagcguuuggcaauucaaguaacauucugauagcuaccuguaugacugauucaacagccuugggaccaacugucagucagucuaauguagugguauugccugggaguucugcaccuaugacugcacagccuccucaacagcaguuacagacaccaccuaaaucuaacagugcguuugcugucagccaagcugugucgccaaacuuuucacaagguaacuuguaaaagcauaucggaggugagcugggguauaguccaguggaaaagcucuuguacagcaugugcaaggccauggacucuauccagcacugcacagaacaagauacauguauguguguauaauguauaugugugugcgcacauauuuuggagcuucucuggauugcaaucuuaauuuucuugugugaagucacagacuaggaaaauaauauagaugauucauaugacaaaauccucugaguaauugcuuaugccuuuugccaucuaauucagccagguuuuguuuuaaaucugguaggcuguagcuuuaauuuguuuucuuugaacaguuuuuuaaucuacaacacuaagcugugagaaagaaagccuaauucauuacauaacuguauacauacuuaaauucaauguuucaggauauuuauuuuuauuauaguuaaaguuuuuaagaaaguugucauuuagagaggcuuucaagaaaaaaaauuuuaaaagcccuuucuaauuucucacuaucuucugccauuuaaaaaugauuuaagucuuuagaggcuccacugggggcucuuccauucauuauaugcugguuuacaagcaauuaguaaugccgggcagugguggcgcacgccuuuaaucccagcacuugggaagcagaggcaggcggauuucggaguucgaggccagccuggucuacagagugaguuccaggacagccagggcuauacagagaaacccugucucaaaaaacaaaaacaaacaaacaaaagacaaaacaagcaguuaguaauugacaaacuuguaucaauuaauuuauguuucucagcgauaagaauucauacauguucaccuacauuuccauguguacugguucauagacauacagugaaguuugcuuaaauauuaucaacuaaguauuaaguuuagugaaucuguuucaaaugagauaaaggagaggccagaauugguacagaauauucuugacuuagaauaaugagguaagauugacaguuaaaagaagucaguauaaugccaagggaaguagaauaagcauucguggaugguuaggaaauugucaguuugcaugaaaauaagaucaauaugauaggagcagguaguauuuuagggaaaggcugauuuacagagcaggacuaaauuacuauugcuuugauucugcuuaacucaugaggaccauguaggcacuauaauuucccccaguaguuuaaucuaguuauaaaaguauguauucuuuuugaacaauacuuuuaagacuuaauacauugggaaaauucuuuggggcuauaaauauucacuuagaauuuaaguauucugauacaugguucaaacgugaaaccuucacuuuguuauuguacuuaaauuaauuuuaaaaaagauuggcuuaguuaugguuacuauuacugugauuaaaaaaaaaccaccaugaccaaagcaacuuggggaggaaaguguuuguuuauuucccucacaguucaguacaacagcucaucaucaaaagcugugaggacaggaagucaugcagggcaggaaccuggaggcaggagcugaagcagaagccagagaggagggcugcuuacugcuuacccccaccccccucccuggcuugcacuucaucacuugcucauccugcuuucuuacagaaccgaggcuuaccaacccaggaaugcugucuaucacccauaaugggcugggucuucccacauuaguuacuaagaacaugcacuccaggcuuaccuacagcccaaucuuauaggggcgucuucuuaauugauguuccuccuuucaaauaacuccagcuuguaucaaauugacacaaaacuagccagcaaaauuaaccccuugucacacuaaauacaucaguguuuaacacacaaauauaucauuguuaaaccauaaccuuucuuuucuuguuuuucacaagaucagacaucaauagcaacauuacaauauaaauauugcaaauuuuaaaagucccacugucucuaaaaauaaaaauauuuuaaaauauaaucuuugggggcuggagagguggcucagagguuaagagcacuggcugcuucuccagaggacccugguucaauuuccagcacccacaugacaguucacagcuauauguaacuccagaggaucuggcacucucugucacucuccgucagacaaacaugcaugcaaaacaacaucaaaauaaauaaaaucuuuuuuaaaaguuaagugucuuuaaaauggacagucucuuuuaaaauucaaagucuuucaauuguggucuccuuucaaaucaaaaaaauaaaauacuuucuucaaggggggagaaccaaggcacagucucaguaugaacaaagcaaaaccaaagucccaaaaguuuaaacaauucaguguugaguguuuggcugcccccaagagguacgaccucagcuguuucugagacaguuucuguaugcuggccccaaggaaacauuuccaggagacuucaccucagugaugcuagucuguuaaucacagcugauccuucagcaccagcugaccagcaucaacugugccagcacagcaaagguuuuacuuuaguaguucugguuuccuguuaaucacagccaguucuuaagcuccagcugaccagacacuacagcuucuacacacaaaaggcccaggagagucuuugcugcuuucugagauuuagaagccaggcuuccauugucugcacugcucucaacauucucucaagugcuuuuuuggcccaaguuccuaaguucuuccacaguccucccaaaaacaaagugggcucguaagucuucagugguaugcuccuaguaccagcuucuguuguaguuaggguuauugcugacauggaauggccaaaagcaaccugaggacgaagggguuuauuucgcucaggugugaggacaggaaccuggagcugaugcagaaacugucaggaaagaagauuuggucauagaauuugcuucaaaauacugauuuauuaccaaaauauuuagggaggaaaucugauauuagaauuguuuuuuuaggaucugccaucauaauugcuucuccaguccagccuguacuucaaggaauggugggaaugauaccugugucuguaguuggacagaauggaaauacauucucuacuccuccucagcagguagcauuuaugaacuaaaaauaguguggggaagcauuucaaacagcauaacuaauaguuuuuucucucauucuuucuccuagguccuucauaugccuuuagcagcaccuguuuguaauagaaguaucgcucagcuccccauuccucaaaaaucccagaaggcucagggacucagaaacaagcuuauuacagguacuuuuuaaaaaaaguuaaaaucaacuuuuuaucucagaaguaacaacugaauguuuucuucuugaauacauuguaccaucucuuuacucuugucaaaaaacugaguuauucuugacacauuucucacaguucauauauuccucauuuucugucucaguaguguucuacccugcuguccuuuuuuuuugggggggggggggauauccucgguucucuaauucauccuauauuuguuagcugagugaccccuuccuuccuacauauuagaauauauguuuguaccuaaacauuucaggaauucccuguuccuuucauuauaaaauugaagcuccuggcucugugugguggcaaauucugcauaccccauccauggcagacugaaauaagaagcuagaugaggccgaacaauuugaggccccuucuugagaaaaagaaaaggaagugaagcaaucccccugacccacuaaggauuuccuagggauuuuacuggagaguguuuguaagagcuccuucuaccuccagugaggucacugcagccuccccuccucucccucauuuucuugugauucuuuaccaucugccugcuccuucugaguuuguuugcugaaaccuugagaugcgugcgucauuguuacgugacacuguucuauggggaggugugagcacaccuguacucaccccagauaaggaaccagggaacugaccacagaucagucucacuuugugaaccaaugagcuuuauugaacguauuuacaggaauuugggugagagauuacuaacagcagaaaugacugcagcaugacuuuaaaaaaccacccaagccuggaugacagcucacaaaaucuagaaaccuggaguguacuguacagcucagcugguuugaggccuuuccagguagcucuguugaucugagacucuuccaggcaagugggcuaguuucuuuuuuuuuuuuuucuuucguagguagcuugggugauguaccucuucaggcuucugugcuggucugugacugucucuuugcaguccuuacuguuuauauaugccucuuggaggagggacuggugacugauuagccacagugacuuccugaaguuauugaguuguuuacuaacugaguuuaaggagcuucccuguaggaugcaguuuuacuucccugcuaacagccagugucuuaaggagccucccuacaagaugaggguuuuaaucucucucucucucuauauauauauauauauauguguguguguguguguguguguguauguguguauguguauauauauguauacauacacaaauaugcgaacaaauguauguauaucuauauagguauauauaaugcuauaaguaaccauuggauaauuuacuuaguaucucucugauaaccaucauucagaaauauuguaguaucugaggucaaccuuuuaaauuaguguuuauuauaguaaaauuucuuacaguguugguuugguuguuaacuaacuugugcuugucuuguagaauuuuacuuucaauuugagagguauaacaauugcaguuuugaauuauuuacuuucaggauuuaaaauauccuuuccugaacuucuaaauuaagggcuguugacaagagaucucaugucuuaauguuuuugccucuaugugugaauugguguuuuucccucacauuuuuacuguuuuuguuuguuuguuuguuuguuuguuuguuuugaaaauuuggcuacuguguuguaagggugcucuuuucugaucacuauuguuuugggauuuuuguuuuguuuaguuucuuuucuuuucuuuuuuaagauuucucuacauauguauauggcuauugugcaugcuugcugcccacuaaaguuaaaggaagccacuguauucccaggaacuggaugguuaugagccaccauguguguauaagcagcaugguguggcuggcuauaccagcuggcuucuuuauggagaaaagcccaccuaaucuacuccuaucucuaauccauguggcucuccccuuuuuucuccauuggugauuuuauuacuuugacuuuauuccauccaaacuccaggucucacaaacaccacuucuaauucauuauaacccuuuuccccacggugcuuuguuuuguuuguccuuuuguuuuuugagacgggguuucucuguguagccuuuuugcucuguagaugagguuggccuuuaacaaacaaaaauccuccugccucugcugcugugccacugucagacacucagccccaaggggcuuucuugaacagcuauauugaucaaaguacaguucaauuuccuucucaguuucauugacauuuguagauucagccagccacagguagaacauuucugaagaguuaaaaauuacauuugugccaaauaccuuucucaucauuuuucucugaacaguacaauauuagcuauuaacaugguauuuguauuguaucguaugacuaaccuagaugugauaaaaggauaugucucuguuacauguauaacuccaauuuucuguaaggaaccuggucaugugcaugcauuaucuaugggaucuauucauucagagacacugagagaauuggugcacuaaguacuaucuggaacauuaaaaguuguagcccugaagguugaauucauguuugccugaaauuaaagcaaaucguugguucuguaucuagauuuccucuauagagugugugagucuauuuuguaaaacaauguaaguauuaaaaaaauaaguauauagaagcaaauaaguugauuaacucauuauaaugucaucugacucauucucuuucagaagaauauauucuuucacaaagaauuaauuuauaauuucuaaugaauuaauuuauaauuccaggaaaacagguaaauaauuugacaaacuuguccagucuuucagaagcaugucauacgcagaggugagcauaaaauauguugcaucauaagcuauuaaaaugcuuaaaugacuaauuuugguugcuaaaaaugagauuuuuuuuaaauuuucguuucgguagaacugaagcuucugauaagaauauagccacugaacuugggaaaaaaauggaagacaccacgauuucccucucaggagagaggguagcuccucccagcaagccauuugaaagucauaggcgggugcuuuguuucgauaguacuguuucuucuguugcaaauacacaggggucacuguauaagaugaccuccgaaaacaaagaaaagaaggaagcauccuuuucucaucuugacucacccauucuguccucuaccuuaaaaccaccuccuaauaacgccaucaaaagagagagagagaaaaccgugcccaagauuuuaucuaaaucagaaacugccucuagucgacacaccacugugaaagaaguucagucugaaaagaaaguuucccccacagaaguggcccuugagucucuccauaaagcaacagcuaacaaggagaaugaauugugcggugauggggaaaggccgaagaaugcagacaccucaaaacugccuggugggcagcagaaugggagcuugaggaacgaaaaagccauagccucgcugcaggaauugaccaaaaaacaagccacacccucaaacaauaaaaaugccacuucuguagguggaacugugaaggaucaaaaacaagagcagaguaaaccugccaguucuuuaauuggggcagaaauacugcaggauguucccauccacagcccagccaauaggagugccgauacugacuugccaguaccccggaccccuggcucaggagcaggggaaaagcauaaagaagagccuagugacaguaugaaggcccccgcuaguagacgcuguggugaagaaggcagcaugccaagaguaaugaucccuccugucacugcagacuugccugccugcagcccagccagugaaacaggcagugaaaacagugugagcauggcugcccacacgcucaugauucucuccagagcagcaauugcuaggacuacagcaacuccucuaaaagauaacacgcagcaguuuagaacaucuucaaggagcacuacaaagaaacggaaaauugaggaauuagaugagugugagagaaacucccgcacgucugguaaaaaucuugcuaauucaucaguaccaaugaaaaagaagaaaaucaaggcaaguuugaaaguucucauuucaauucuacuccugucccuucaguaucuagagaguucaguuguguuugcugcagcuacauagauaacuauaccuccaaaacuauacacuuaguaguguuuccuagucacaaugauacaaguugucuauguaucauccugaggaaaagugaauguuucugucaugguaucacccaguauuuuucauggaaauacaaaaagugugaaagccugggaaacaaccauuaaaugaauuaccaaauaaaacaccucaugccgggcggugguggcgcacgccuuuaaucccaguacuugggaggcagaggcagguggauuucugaguucgaggccagccuggucuacaaagugaguuguuccaggacagccagggcuacacagagaaacccugucuugaaaaaaaaaaaaagcaaaaaaaaaaaaaaagaaaaaagaaaaaaacccaccuccuggucuccaucccuuccauagucuauaaugaugguccuagcagaggagcagaaaaacucauguucuuguuuuuuucuguaaccaugguugucuguaguaaggcaguacaaggaugguagcauugauaaauaaagugcauuuauuuaaaguuuguuuuaccaaguagauuaaacggaaagcaugugaauguccuacucacaggagaaaguauaguaaguuaggagugguuuuuagguuugguguccugcaagccugaguuugaauucucuuaucaaguguaugccauuccugugccugccuguucaugucuagucucuggucucuuccucugugccucaucauugaaccuaaaauugucucacccugugguuuuguagucuguuuuaggcuaacacuuuaaaaagcaucuccucuaucuuaacauuuggagcuuggugagugagugguauucuuuaauguguguuagcaaagggguccucuagcuucaaggcugauccacuauagaguucaauucuugagaaccaugaagaagcaaaaacacucccaaaagcaguccuuugacuuacacacauacacacaugcacacaauaaaucaguauaguauaguaaaacaguaucuguugguaauguuuuguaaguuuaugauuugacacaaaugaccauuuuaaaggaagcaugucucuugucugaacauucauauauauacucuagauuuguuuuuuugccuuuugcccuaaacuaacguugaauuggguuaauaaaaccugucugucuuucccuauggaaauaaauucuaacaaacucaaaaaugaugcaauuuuaauaauaaagagccuaauacgguguuuuaggugauuugcuaagaaaauuaucuggccuagaguuuauuguuuuuccuucucuucuuuuuuguuuguuuugacagaaaaagaagcuaccuaguucauuuccagcaggaauggauguggacaaauucuugcucucauugcauuaugaugagugaacgaacacccagacacagagaccaguagcuauuuaaaacuaguguccuucagauggcgaguaggaaacgggccagagacagacugcgaacaugaccugcacuuugacuguacugagguuucacuuuauaucuaagucaugcuguuucugaagcagcuuccuaguuuguaaauagacucucauggaauauuuguauucuaaaagaacauacgcagaaauguaaguaaacccaaucugcaaaacuguacagcuuugacacuguauauuguacauguguauauuguguaaaaauagagcuuaaaucaaccuaauauucccacacugucuugauugacuucgcccgaggcuuauucuucuggaguacuuucucaucuccuuuggaggaagaugauaauuauucuuacaaauuaccuucagccaauauuagauaagccacuaaguaaaaaauaauaaugauaaccaccucaacugguuaguaaaauaucuaaucaguaaacaacaguuggaugaugauuucccccuagagucaauauuuuaucacccuucauaaauuucaguaaaaacuauauuucugaaguuuuauacuuuauucugaucaucuauucucuuuguuuuaaagagauuuuuauaaaccauuuauuaaguguucugauauuucacuuacaacuuuuugaaaucuuuuacagaacauuaagugguuagacuauugagccauaaaaauuugaguuauguaguagucgagauuucuugauuauauguaaacuuucccuaagcacuggggauacaaagaauugcacuaauucauagacuuuuucacauacuagugaccaaugcacauuuaauuuaaaucuuguauguaaaagcuuauauggaggauugucuucuggugucuuugaaagucauauccaucauaagauguaaaaaugcaaaucauaguuauauuguaauuuaguuuacccugaaaugggauguguaaauaacuguguucauacauaaccuauagaaccuuguguucuuuaaaguguuauaaauaguuacucucaaaagguccuuaggggagugagaggugccuucucuguguuggacugacucauaaacaacagucaaguugaaaagcuggccuaaacuuuaaaggaaugacagaaauuaucauuaauacuugaccgauugugccuagauauugaaguguuuucuuaaguucuuacuguuuaaauaucagcauauuaggauuuuuuuuucuacggguguauauuuuauuaaaaagucacuuucuucaaccauuuuuuguacugggccuuuaagaaauaaauccauccuacuguaacaacaacaaaaacgucuucaagauguaaauuaugucuuuuuaauugcuagauuuuacuguacaaauuuauauuuugagaaauguucuaugacugagcuguucuacuccuaaggagcuaacuaagcauacaguuacuguuugcauaacucagucugggucuguccuacaguuagguuugaauaaauauauuuucauuaacuuuaccaguuuggauuuauauuuagaaauugguuaaauuucuuuguagcuuaguuaauucucuguguuuuucaggaauucauauaaugcaggaaauuacagauuuucuccuguaacucauaucuaugugcugcauaaugagaauucauauauaaacuaacucaugcucuuuucuauagcucuauguguguuuuuagucagugucuuuccuguaggccaggcuggcuuugaacucauuacauaguccagugacuuugaaguccugguccuccucaucuaccuccucuaagugccaauauugcaggcaugcaccauacacagagcuucaggauucuugucauuuugauuuguuucuugagaugguagcuauguaguucuuguugaccuguguagacaagacuaacgucaaacucacagagauccuccugccucugccucccaagugcuagggguuaaagguguauauuaccccuccuggccuucaagauucuuagugaacuagcuugaaaccacuagauaguccaaagacaguuagugcacacacacacacaaauaucagguauuuuuauauuucucugucauuuuccuuuaggaaaaggguucuucugcuggcuggccagcaagucccagcuauucuccuauguuuguuugccauaucugaagcaaggguaaacacagccauuccuggcuuuuacaugggucccugaaauccaaauucagaucuucaucugcugucuucauguuguggguuugguuguuugggggguuuuguuuuuucgcuguuuugggguuuuuuuugguuugguuugguuuuuggugguagugcugggguucuucaggauaggguuucuauguguagcccuggauguccuaaaacagaaauucaccagcuucagccuccccaguacugggcauaaaaguaugugcuaccacacguggcuaccacaguuuuuuaaauaaacuuuccuuucccaugcucacaugcuccucuuacugugagucacagucuuuuacaauucuaauguccaaaaacuucugacaaccaauucuuuguuauccaacuuaacauuaaagcucauuucauggcaaaacauuguuaaagacugugaggccccucuuacaguccuuuauuucauuuaucagaacauucauaauucauuauuaaaauagugugcuuaacuuguaugcuauuuugugauauaugauacauauauuacguuacuuuuuagaaacccaaaauguucugaauuguguauaaauuguguucauugguugcaucauaacucuagcuguuauucguguuuuuucaaguaugccuguuauacuuccuaauucagaauuaacacuauuucaaacuaaacuucuauugaaauaaauuuuugaaauauguuaagguuauauauagcuuaauugauacugaauagcaaauggaggucaagaugggggcacaagccaguaaucccagcacucaagagguugaggcaggagcauugccaugagcaaaugguaaaaaucaugagguaaguaucaauaaaguucuuuuggguuugauuugguuuggagguucugagaaugaaucucugaguagcucuggcuguccugucgcucacuguaggccaggcuggcuugaacugcaggggugugcugccaugucuggcacuccagagaacuuuguauguaucacuauccucgggauuucuugccaagcugauuuuagagaacccugcauuccagauguuauuucuuaauguaaauuucugcugacugugugaaacacuuuggcucggguuugacauguuaugaauugcaguguuuuacugacauacaaaguuuucugcucuuggggaaaccguggaaaccauguuucaguuauggaggaaaaaacauaucuuucauuccccaaucaguagguaucaaacugauacccaauguaaaguuuuuacagucguaugcuuauauacauaaacagaaaaugcaugaagucauacauuucaagggauuuccucaaacuacagaucaucccggucaagacucccaacacucuaaaguccuguaucccuccuaauggcucccagcccaaagggucaccacuacccugccuucuagacgcaugggcucagcuucuuguauuaguucuaaguuuccuaguuaguauaggauauucauugugaggguugcuuguguuuuagucagucuuccucaaucuguguauaggucugauuuuaaacaguggaucuaguuuuacaaauauuuuauguucgaaugauguccaguauggggccauggcugugcuuguuuauguuuggggaacugcuacacuuguucaguuaaguauacuguuuuuuaaagacaaaaaucccagcuguccaaucuuacuaacgaagacucaggagccagguccugagcugaaaaccuaauaguucagagaggcagagaaagcacccagcugaccuuccuacucccaccaguguccuggaaggcuaaagcccuuuuaccucagaggcuauucccaccccuuucuguugacuuguguccacucuguccgcugguugcuucuuccaccucuucaccuauggcugacuuuauuuagcuccuggauuaaauuuaggcgagugcuagagcugagccacaccacaagcuuuuuuuuuuuuuuuuucccagaaaauaacacaaucuugggguucagccugugaccaaauauccugcaacaguauauguacuuuuacacacccagugguauugcuggaucacagugucguuuauucccaaacauguuuaauuuauccugagugaauguggcugucuguaaccgcucagcaguugucaccagugcucacgguuuucauguuaaucauuuugaagaguauguuaguauacuccuugcuauugugaacuauccauaucuuuugccuaucuuuuuaaugaauugucugccuuuguaauuuucaguuuucuuucuauauucuagauacagguuuauaguugaauagauugaucucagaugucaauauuuucuguauuuuucuucaaguguuuuuguuuaauguccuauuuuaagaaaucauccaucuggaauugaugucccacuuauuaaaagacuauacugcaggagcuuagagaccuccaaaaacaugagucucagcaacucgggcaggcuucag

SEQ ID NO: 5105 - RNA, 541 nt, Mus musculus
ucugcaaggccacacagcacacaggccaaagaaccgcagcccuagcagguguguauacacacugcccacacagggcccgcucgcucgcacuggcugcagaccgccuucccauccacagaucucaugcacgaugaacaagcgaugggugcuguccugggaaggccaccuucugaggccugagcuuggcaccaugucaguuggccaucagguccaaucaacaucuguccccucgcagguugaggggcucccaccacaccagacuucagugacucccguaggugguucacagaacaaucuucgcucgauaugugaucucuauaggcccgagccccuuggaaaaggagcugcuugguucuuucgaagaccucgcgugaguagcgcucggcgaacacaccguggcucagcucuuucaggcccacguggacuuugaguuggagcagggcugagucugcaaacccgcagcuccgcuugggcaugguagcggguaucacacacagcccucagcagcgcgcagcgugccgcgcgccgagcacacgucacu

SEQ ID NO: 5106 - RNA, 853 nt, Mus musculus
cugggggcuggcugauguaggagagcuuuggcauguacagcuuggcuuucccuacaugaucuuuagacuuccagcucaagcuugcucuuguggcaguggccaagaucacgcagaagaacaacaggguauucaaaacaucuucaagccuuugcccgugucaaggagaacuugucuauuggucaacaguaaggcaccaggcaggccccaaaucacugggaagagcagagagauuacauuaagggaaagugaaauuugggaacgacugaucuaaucucucgaguaccauagcuauccugguaggagugaagauaguuuaaggagagacauuugugucccucccuuugcuucucagacugugauaucccaaguaggcuuuccccuaggaaucucauucuaggagaggggaaagcugaaugaagccuguagccagccugaggacaagcuugucucuacacacuucucagacuugguaucuugcagaucuggagcugagaccaugguggcucagugauuggcugggggcagaaggggaggaggaggcagcggcagagggagaggggcuacaucuugaccagggcuuuuuucacuuauaauccucuauuuaaauccaaaucucaucuuaggacuccaaagauagccuuggggggaaaaaaaaccacugaaccacuuuauuuguuccucuucuuaauguggccacgucuaguaacucuuccuucucuccuguucacuauuaccuguugaagaugaauggcugagcugcauuuguaaggacugccagcguccaggcucugacuaccaacugaggaacaacacaauaggcaaauuaagguugauuaaaacugucuaagcugau

SEQ ID NO: 5107 - RNA, 986 nt, Mus musculus
agagcccuggucugggagccuggugagcuggugggggggagccaggacgcuccuucuuuggguguggcaaaguuugcaagauuguuuaaguacaaaugcaccucucugcccacugaaaaagguguauuguuagguuuaagguugugaggcugcacgaguuuuaguuccacuucaccacuuggauccuuuuugaggaaaaucugugugucuguuaccucguguugggaggggagcgaacagucuugcaggaauuuugugggaaguauaaugccggcuccccugugaaggaacaagcagccagccugucgccuggugaggaaauaaacaacuagucagguagagauaacucccgcaguucagacuccucucgcugugggcguggcuuguggagcugguucugagagcugggugagcgcccagccugauuuggccuggaaggcuggacccgcccugccaaucaagcugccaagccaaguuuugccuccagcucaagaggcaugaauugauuuuuagaacguuuucuuuucuggggagauggccuaguggguaagaacgcuugguguuccagcgugggggaacugaauuaaaaagcccugcauggccccuacaggugccuguaagccccguggagggcagcuacaggaggauuucugggacuuacuggaugucagccuagcuccagguucaaugagagauccuaugugaagggagugaagaauguuggacaccugauggccuccucuggccugagagcuggagaggaaccguuucuugcugaugggguuaaaggcaaaguacaaaggcucucaacauccccuuucacuuucuuuuucacaaaagcaauuuauuaacuaaucaagcggccaaggcaggaaggagaaacaccuaaugggaaaguggucacuguugguuucugaguauccaugagcuuucauguauuccucuauuauaggcuuugaaauucacgaagccgcaagccugcuucu

SEQ ID NO: 5108 - RNA, 5142 nt, Mus musculus
uagggcuuucuaccuuuagggaggaaccaagggcaauaacaauaagcuguaugcuuuaaaugucuauuggauagcccugaccaauaacucaaaagaggucuuuucaugucugguauuuagauuuuugcuagaugguuauuaguuuuaggagggagcauugucagcccagauaagaaaagcucauuuaaaucauguacauguguuuacacauagaauuauguuuauuauggguuucucuuuguguaguuaguaguaugaccccuuauaacuucucagauguccuuauugcucuuuugcccuucucccuucuucuguauuuaccuuuuaccuuccugccuccuguuuuuauacuuuuauuuuauuuuuaauuuaguuuuuacacuccauauuccauccccccaauccacccuccuaccuccuccuuuccucuccucuccucuccucuccucuccucuccucuccucuccucuccucuccuuuucuuuucuuuucuuucuucuuuuugagauagauucacccuaugcuguccaggcugguggcugauuagcugggauuauaggagauuaguugggaccauggaaguguggcugugcaugagcucuugggaagaauuugucagucugugcuuugugucuuuggcuacuagaccuauucguaggucaacaucaccucccaagacugguuucugaagguaacuuguauaaccaugagacagagaguaacucucuucaguucuuugcuugguuacagaauacaguacaccuugaugaaauugccuaaggaggcauuuccuagauuuugucuucaccagcaauugacacauuguauuuauauuuuguacuuucuuagggaaaaucagauucauguaaacauuucaaacauuuggguuuuuauacucaauuuuguuguuacugguguuuugagacgaggucuuaaucuuuggcccuggcuggcaugggacucaaaguaaucuuccucccucagguucucaagaacugggacgccaagccugagccagcgugccuguuacuugacauuguauuuaguuuauuugaaauaucuaacaagugcaagagguuggauaaagugaauuagaaugcuagguuuuuguaauagaaauaacauugucagugcaauugucuaaaacugaagugagaaaggcuggaguacagacauuucaucagcuccagccaccugccagucuccaaagcaagacagugccuuuaucauggcaaugcagaaugcuguuucacaguaugguucccuuuuacuagaugauaguaacuuuuucaucaagaguugaaaacaacuuuuaaagugaagggagagggucauucuauuuuguaguccuagccauguggcaaggcugcagaaauaaucuugucucuccuuugcaugggaagcaucuccauacagugauaucagagccaugcccagugaugucagcugccucauuuaccuaguacagagccccucccccccauacgcccgggagcgaugcuagcauuugcuuacuacacgcucauuucccucuuguacuagaaauucuuccucagacaaaaccugagcucuugcagaacagagcaaaaucacuuuugaucucugaaauuuaaaauauuuuuaguaacuauagauuauguauagguuuuguagaugacauuuuaacuuuauuuuauuuuauuuuguuuauuuaucuuuguuuugagacuguguuucucuaugucaccuggcuguccugggacucacuuuuguagaucaggcuaggcuguccuccaacuccgagauccacgugcccuugauccacgugcccuugacucucagauuccuucuguaggcuucuguauccauuacaucgcucacuggaaauuaucagcugggaggcuaugcuaccuuucucagcuccacauucuuugaucaaaaaaauuuuuuuuuugauacuuaagaguuuuggaaccaaaaauuguuagguugccugucucuaccucuccuaagguugagacuacaaguuccuuacaccaugccuaguuuguuguuguuuuaguuuuggauugaaaaugguuucauuugacccugugucguucaugcuggccuugaccuuguggucauccuuccguauccacccaugcucuuuuacacaggaaacucagagcuggaaaguuugggaugcauuuuuaaacaguugucuuagguaaguucaauguagccagguuugagaaccauugcagaauucaaaagguauguuucccuuugaaucuuuucaaagguucaacuuuuaagaauucuuuuucuguuuuucucacacuuguccuucugccugcugacuaaccagaacucacuugacuuuuauuagcugucuugucuggcuucuugggugaaaacuuagcuuauuaauaauuuuuuuaucuugcuacuauaagaauuaaaagauaauaaacuucugugcauacagugcuuuaguugccugcccccuacacacacacacuuacacacacacacuuacacacacacacuuacacacacauacauacacacacaugcacauguuaaaaugucuuucuuauauggaguaccuguuuucuuugugauuucuuugucagggauguaauuuaguaguauauuaaauuuucuaaauacaugagauuuuucucuuugcuuagugcucacaugaucaguuacaugauuucaguccauucagauuuauugcucagugucuaguucgucuaugguccuaagugguagacagaaaccauagucaugauggcugugccccaguccuuaugaccaaaggaauuuugcagaugugauugaauuguugaucuugaauugggauaaccugggguuauuuguaaauuuagugcaugggaacgaggaggacuaaagugcucaucaggggcugagcaggagaggacugcuuagcgacgugagcagcgaccgaccuguuagagaggcagcugcacugauacuucuccggagaagcagcagucaguuugcccucccccucccagugucucucugcagaaagaucucaucuuuugugccuacccuugcaggcaccccagguuccuguuggauuugcuaugaacagaagccauuuuugaaguucccucugccucccacccccagcacauuccugucugaauaguauuuacuugacuuguaacucagggaagaguguaaggaucauaggccugaguuuggacacuuccuaguuaaauccuaggcacauuaaugaacucaacucuuuauauaauaguaauaguaauaauaauauaacaaaaacaguaguauaaauaucagccuuuuagguuuuuuuccccccggagauuaaagagaauaugaugucuuuauuaaguaguauagccucuaucuuuugccacugucauguagaucuaucauggcaguuaacuguuguuguuguuguuuuggaugggcuauuuaccuagcggugucuuaaguguguggcaucuugccuugugucuucguauugauuuugccagaucuucaacuuguagcuugugcuacaaagugcuucucugaugucuaucuugauuuuucuuaagccugguuugaauccugagacugcauugcuguuuucagugccuuuaguauuuucaaguguggguuauaugauuuccuuuagggaauaauaaaaaagagaugugcgcuagagagaaacuaaucagugauucuucugcugcagcaguggaagcugucguguauaaaaccggaagaacuuuugccuguugaaagcagcuuuugaaugauaaugcguggaaugccauugguuuauuuuuugauaugauuuuuuuguuuuuuuguuuuuguuuuuguuuuguuuuguuuuuuguuuuucaagacaugguuucucuguauagcccuggcuguccuggaacucacucuguagaccaggcuagccucgaacucagaaauccaucugccucugccucccaaaugcugggauuaaaggcaugcgccaccaccgccuggcuuuuuauuuguuucuugagauaggguuucuguuucucucuggcuguccuagcucuguagaccagacuagccuugaacucauagagauccaccugccucugacugcugagugcauuaaagggauuaaaggcaugguuuuuuugauaugauauuuaauguucuuauuuguguauuaaaguauuuuguaagauaaugucaaggaauaucuuuauauuaguaacagaauccaagauaaaauaauauguaauaauaacuaaaaauuauaucucuuacaaugucacacaacuuuuccuuuuuaggcauauggaucaggcugugauauuguuauucuggcgagugacuuugaaugugugcagaucaucccuggugcuaagcaugggaacauccaagucaguuguguggaaugcuccaaccagcaugggagaguaagugaccuaaucacuuaacuaaaugucauuuacaugcucguaacuggagaauacuuguacaugaacugugacgugcuguaaugcugaagaugugcugauaguucucccaguggacaugccauguugaaagggcugcaggccucgcagccuuaauucuguaaccuuuaagccaucgagggaggaggauucaguuuccuccaaaucccaaucccaucguuguuuguuuuugagaugaagucucacuguggcgugcaggcuggucuucacuccuggaaacagagugagcuuccugaugagcaucugcugugagcugggguagcagaccugagccugcaucugcagugacaguggcuguuuaucagggaguuuggggaguugugucuaauguagugcgugccacauagguauuuguauacuuguuacuuuaggggaaguuuguugaguaaauauuuaagaauuuauuccaacuuuggaacugaggauuuauuuugaaauaguuuuaaggcuucaucuaaagucuucuuucucagauuuucuuuuuccccuuuuuuuucaagcaauauacaaugaauacuaauauaguauauuugauauauauauauauauauguauucugugaauucaguaagagcaguauuguaugacaguuguaugucacuacaagguuauaaaaaggaaguuuuaaaacuauggcagauaaugauaguauuuaaauauucuucauuuu

SEQ ID NO: 5109 - RNA, 1671 nt, Mus musculus
uugaggagcgagcagugcgagcgcgccuaacggagaacggggagcgcagcgcggguagggggcgggcgcgcgcucccggaagccagccgagagaccuggcccugccaccgaggcugcuucccggagacaguuaguucauguuggcggcggcggagggcgacgggagguuguccacagcgccacgcuuagauuagcuguguuacucuguuaugaugccgucucauaccaaccuggcaacuggacuccccagcaguaaagucaaauauucaaggcuugccagcacagacgauggcuacauugaccuucaguuuacaaaaagcccuccuaagaucccuuauaaggccauugcccuugccaccgugcuguuuuugauuggcaccuuucucauaaucauaggcucucuccugcugucgggcuacaucagcaaaggggggggggggggcagaccgagccguuccuguccucaucauaggcauuuugguguuccuaccgggauuuuaccauuugcgcaucgccuauuaugcauccaagggcuaccgggguuacuccuacgaugacauuccagacuuugaugacuagccuucgccucagccuugagaagagucgcacacagugcaaccacuuuaagacaucaagcaagaacucuggcuaggggcugaagaagucuacaauuugcagauguuuagcaaaacaauggccagauuguaugaguccuucuccaaaacgcuccugcuuuauaauuagcuaauuaggacaugguauguuuucaucuccuggcccuggcuaagcuugacaaguuuuuccacaugagugugcaucauguaagaguugugaggcugucugggaaggcagccuguucuauagcggaagguguuacucuccuuagagcugaaccuuucuuuugucuuccauugucugcuugguuuuguagcauaaugggaaauguauugucuaguuucuuauuacuaaguaauuuauuuuuaaaauuaccuaucuuaucucucacccucuccucuaccauuauauccuaguaaaauuaaaguaucugucuuaccuucauaugcuccuccaccuucauaucccaguaaaaccaaauaucuguagauccaucucuaauuggcuuuuuuuuacauugacagcaaccuggaauuuuuaaaccaugaagcuggguauuaugaucccaguacuugggaggcagagccagguggaucucuaugaguucaaggccagccuggucuacauagaguuuuacgacaacuagggcuaccuagugagacccugucucaagaaaagggaaacuuccucugauuucuccauaguuugccuaccacaaagcucaggugaaucuguccuuuguaagucaagagauugugugaaucauaccucaaggacuagacuuuggcugcuucuucguaaaacuguagauaaguauacuuagaguuuauagcccuacugcuggcugguacuaugauaccauucugcuaaagauuacaagacuuggccaagaucccugaaaauguauuaagucaaaucugguucucagcuuauaaaaagugacaauuuuuccuaaaaaagaaaggaguuugaggccgggcagugguggugcacaccuuuaaucccagcacuugggaggcagaggcaggcggauuucugaguucgaggacagccugg

SEQ ID NO: 5110 - RNA, 20094 nt, Mus musculus
cuucguuagcucauccacgagcgccacggucgugcuccacugacgucaggcgugcugugcggcuggcuguacgguggugaguuggugugcugggcagaguuggggaaugguggucuuuggugcuguugccuacuagggcgagagggcgacugaaccgggagaguuggaggccaccacagcagguuuguucacggaggcuccaggaguccaaggguggcuuucgugacucuauuuaacuuggcuaguccgcgaggcacgagucccaagggcagacagaaggcccauagguggacuaauuuugcucccagauaauguuuugugcaucccggaaaugaggguuggcuucuuugcgggguggggaggggaguaguuuccccuuagauagaggacucuggggaggggaguaguuuccccuuagauagaggacucucuuaauaccaguccuauaguaguuagccacgcuguuagguagcaagcuucacgucauugaacacuaagcagagagugaguuccuuuuauuucaaguaccaugugguauggugcguuacagacgugccugagaaacuuucauagacgcauggguuagucucugggaagccugaagaaggaccuuuaaauccagccccgauaacuggaaauuuuccuaaagagagagauggcauagaggccucuugggauucucuugguucugaaauuaccugucaugagacaugucuuaguaguaggaacuguguauuuaccuacgcuuccgucagcugcucuaagccucucucuucuagccagaagaacggagcuaguaagagugccuacuaaacggcguuaaggaagguucagugagcuaaucuguauaauaguuaaaauaggaucugaugcaguacguccucaaagguucagccugauggaacugcacacccuauuuugaggguagcuuuuuaaaaguugacucccuauaaaccuucuuacuuguaaaauugucguuuuucucuauugccaagugugagguucguaugggcagagaggaggcaguaucacuaagagggcuggucuucaugcaguuugugucucaacuuguuugagccaaauugucaggagagcuuucuagucugggcaagguccuguucuugagucacaaaucaguaacagucacaagucagcacaccugauuaagaucucuuaggccaggacuauuuagaaaucaugugucugucugaguuucuguucuugguaaacauuuguuagucuuugguuugcauauuugaagcagguagcaugagcccagaugucugagcuguauguacggccuguuaagugaggauggaacugaggggcugugaacauggauuagaagacaauucacacucuuauauuuguuaauuucuaguugaaauuuagcauauucucccauuauguuauauucucacauaacaaguauuaaauaugacuuuguuaacggcuuuagcgaucacagguguuuucauaucagaauguugugaugggauuguuguuuguuuugagacagggucuugccagaaagccaggcuuaguaccuccaaacaauuaggauuacggaacugcuggcaggauguuguuuauguccugagguugcggcaucuuuuagacuugcugauucuuauagaaugugaugauaaggagccauguguguuuugcucucauaaguuugguuuucauguuuugacaagauuguuuuccacauagagccuaugccuagauucuguuugugaauuuucauacucgauuauauuuauuuauaauuuuagaagaugugcaggguguugaaucuuuugagucacgugaugcccaguucugaguucgcuucugccuuguuucugcucucacucuaugagaaagugucuuuucucugggguuuagugccaugccuucucauuuuuguguuuugguugcuuguuugguuuugguagugagcccguggugaagguaacccucuggcauggugccggagugauagcccauguucuugcccagugcaagaaagcuguaaugagucuuagagagaaaaauaaguauuuuagauaagcccuguuuagguugaguucaguauuagugaauuacuaauguauggucaaacagagucauaugcaaacaaaacaaagcaaaaccauagcaugugauuacauauugagcacuugacaaaaaugugucccagaggcuuucaguggccuaccucugagucuccagaggaauggucugauacugcccacuagugguaacuuuauagaacauaguuaccacagagagugagcacauacuagguuuucuuucuaaugcuguguauuuuauguauuugaaaacaaccagagagaagguuuaaguuuugcaagucuguuagcuaaguggugugcaaaacauaccaaggccuugggcacguaaaggcacuuacugucacgccuaacaccuaccuggggaagaacugaguuccacaaauugucccuugacaauuugugcaggugaauacacgaaugcacacauauccauaaacucaauguaugggcguauguguguguggauguuuaauaaaucuaagguuaauaaaauuuaaaaagcuuaauauaauuaagaacuuuaaugaaauuaaaucaguucauaaaauauguugagccuguucauaaaauauguuagucuuugaaaacugucaccaguuuguuaccuugcagccuuauuuacauaucuguaggucucgaaaggcaguuuuugauugagaccccuguguguguucuugcauguaagaauguuacugucuuggacucccuuguuugcuuucuaagaugaagaaaauuuaaaaugaagauggccuguaauucugucucuuagaaggagaagggaacacauacuggucacccucuucagauuuggggaaauaauccauggauggaggcaguguguauuucuugacccccugggagaaagaucacacaccaccacaugauaggacugugauggggccugcagggacugauccauagagagguaucagaaucuuauaacggugucaccauggugcagaggaaccugugcagccuccuugugcugaacacaucaucuuacugacggaaacccugguguuguuuccacagaacugucuggccuuuagcgcuucauccuugguuaaggaaaugaccaaccagguaaggucugcagugagagggaaagcuucaguuaguuacuggcaaauucagacuuaauagauugccugagugugugguuagggaaaugauuuuuuaauucuugcccgguuccuagaugccuaggugacuuuggguaccuccucaucauaggguuagguggcauuugaaagugcaccacacuaagauuacuucaugcuguugccacauuuuagagggggacugaggagguuuaaaagaauuuauagauaaaaguaaagucaguaggagguaggacagucaauaagcaccuauaggauuacagacaacgguauggacuguguugucucauacaacuguaaaaauuagauuucaaacaggacucagcuuccuccuaggucugaggugaagaaaguguaacuggucuuagauuggugaggguggggcacaccugugggggcaacacuuaggggaguggagcgggaaguuuuguguaagccuuggcuacagaguuugaagccaaccccagcuaccuagaaagccccucaccucaaagacagaaugaagaacugauuuuucucugguguagcuauacaaggguguuaugaguagguaccaaggauguguaggauggucagggagggggcauagggaguagcugcugcugcuguagugaacugucucacuuggggggggggggguucgagauaacugagaucuaucacugacugacuucucuucuuuuguaguacaguauucucuucaagcaagagcaagguaagcagccuaccucuucaagcaaauucuuuugugaaaaaaauguauccugguuucuuuaagauuuuaucacaccaaccugacacacagauccuagauacauuaacuuugcauuggccauggcagccaaaagcaaauauacucagugaaaaaguaaauagcuauuuugggucugguggagcaagccuguaauacaagcugccuaggaaguaaguagggucgugaguucaagccaaucuagucuuaauguaaaaagugaaaaggcuagagauauggcuugaugguaaagcacuugccucacaugcacagggccaaucccaguuuaaaaaaaaaaaaaauauauauauauauauacacacacacauacauacacauauauauauauauauauauauauauacauacauacacacacauauauacauacacacauacauagauacauaugcgugcauacuuacaaacaaacaaagaaaaguaggagucagauggcauaacugagaacucugugauaaagaaagcucuuccagggcuggagagauggcuuagagguuaagagcacugacugcucuuccagagguucugaguucaauucccagcaaccauccauaaugacauaugaugcccucuucuggggugucugagacagcuacaguguacuuacauguaauaaauaaauaaaaucuaaaaaaaaaaaaaaaaagcucuuccaccugaggaagaugaggaagauguaauacugagcuuuccugaugccagaguaggaggccauauucugaggcucagagugcucuuaaugucuguacucuacggagauggguuuaaaccugguccuaacuuagagcucauuguggagucuuuacacagcagccuccauuugcaaguaugguaacucuuuuaaaagacauuugucucucuauaaaagcagagggugaaacagagagaauucuguugagacacuugggugcaaggcuguggcuguggcagugacagugacagugacagugaugggaauagcagcagcauaggucagagaccacuguaaggaccaacucccuaaggagagagcccugcagagagcagcaucugugcauggacaagguaauucuguccaguuucuucucuguaaugcagaugggcuagcacaggcucuggaguuuguaagguacccaauaaaagcucuuccacuccaaauaagugacucuuagguagucugaaguauucucccuaguuaacuagugagcuguugagugugccaggcagcagcucugcaugaagcuaacaccaucagguccaagcuuagcaggcuugggucuggucuauguaaggaaggugugacacguguagccugguguuuuagaaauguggcucuggagaguuguaaccaggccugggugaagcuucugugcauacuuagccuguuuaacagaugcgcacuagcucugcagaguccacaguguagcucacacaguguguagcucucuaacuuagacugaauauggauuugagcuugaauccuaccucuguccuucuuagcuuugugccuucuggagaacaacaaggcaucccugagccuuacuuguauaaugagaauggucuuuuggggggaggagggaaguucaacacuggugguaaaguccagggccuuguccauucuagggaaguacuccaccucagcucuugguguuuuggaaaaggauuccccuuguaacuuggucuugcccugaccuugcugccuuaggcuuuugauacucuugccucuauuuccuaagugcugcagugacagacacagggaggccaccacccacagguaugauauuaguaggacuuauuucauaaggcagcugugauuaagacaacagggaaggauuaauguaauaagcagucuuaagcauaauaaagacauucauaguaaaauauaccucauacauuuuuagaccaguacuguuuauagaacuguauccugguuuccaaagaccucugaggucuuagccccaguuaaguugagguccuugggaaggggcgauuccucacucauugucacuuuggucaacugauggcugcugucgucugauugucaaauggauggcagauuauuggauuagucacuguguucugauucugcuucccuucuuggaaacuuguguuuuaggguauguggcuaacacuaaacaagaaccucugguuuuccuguguauucccacaaguccagugguacaguguucacugguacaguggggagaugcagagaagugggcauuacuucagaguugucagcuuguauuucaccugugcuuauuacauuuaauuugggaauugugugcauagaaacuuuaaaugaagcucuuuccauucuagcccaugaugaugccauauggucaguugccugggagacaaacaaaaaggaaaacauugaaacaguggucacaggaucccuggaugaccuggugaaggucuggaaauggugagcaccucuccccuuucaaaaccauggaaauuagggcaaaggguuuugcuucuggccucucaggugcuauaaguaaagcauugauuuuuuuuuuuuuuuuuugaucaagaaagcaauaacagcauaguagcuuuauaacaacagcuagcgcuugcucucucucucccccucucucucugucucucucucucuuuuucucuuucuuucuuguuugguuuccugauauguggaauuaaagcucuaugugauagagagccccagaguuaacucuggcuacauucuguguucaguuuucagguuucugcauuucauugaccauuuguugguaauguucaaggauguagaaguuuugaugccugugcagugucuuguguguaaagaaccauuuuucugucccuacuguaggcgugaugagaggcuggagcuccaguggagccuggagggacaucagcucgggguggugucuguggacaucagccacacucuucccauugcugcauccagcucucuagacgcucauauucgccucugggacuuggaaaauggcaaacagaugaagucuauagaugcaggaccagguaagaacucuacguuuaggggagaugcuaggaguccagagucuucuuucagacuguuaggauagaguguuucuaguucagaacugcaggcacucuaauucaacccagaugucacuuuggugaugaacaugcacuaaagacaaccuuacauaauuucaggccagguuuggcugccaaauggauuguagugcuguacuuaugggaaagccaaaccaaaccaguuuucuggauuugagaauugagaguuugguauuguggagcugugcuggccaugcuaaugggucucucuaccugacacauucugaggagauacauucacugcuuuccagaaggcuccagucugaauagugguuaauuuuauuaauuguggucaaagugccuggguucuagugugcggcacagagagagaaaggaacaaguuuguggaucuuuuuaaaaauacuguagaacagugcucuugcuccucagccucauuggacauuaucugagaugguaagggacaauuuuacuggacuagauuaguguagaacaaacaguaugacauuccaggauuccuuuuagccuccuguuuacuuaaaaugccuacgugauccucacuagcaaagccuauucugcuucagugggcagugaucuccagagaugcagagagcuugacaucacucugcacacaccuugugauugcagaagagcugcucagcugcucgacggagcugauuccccaauagacuugccucccuccaguuaucuuacagcuacugucagccauauauauacauacauauacauauacauauacauauacauauacauauacauauacauauacauauacgggcgggcaggguagaggaggcuuuagggcuuguaaggaggcugaguagucuaggacugagugccucucucuuuagaaacaguaguccuugguuuacuccuagaguuuuuguugagacuaugcauacccaguuccugcuugaauccucugaauuaccgguuaagaguguggggcugaaauguguaucuggaaaaagccacugggguauuuugugacuucccagaugguugucugugccuacgcccuucucuguuugcauuauucacggagaacagggaucugcagccauucugccaagccuguuaguacccgaacauaaggagcaucuagaaagagagaaguggaccuguugcugcuuuuaaaggauuauuuuauuacauguuauuuauuuugugugugagagcgccuguguguauauguguguuugccugcugagcagucuuucugguccugcugcugcuuuuucauuuuggguaccugcaccccucaggacagugacacugguuucuguguauuuguuguggcuuuauauacaucaugcaugaagaaaugagugcugcuuugguccuaaguaaaaggauucuaccugugcagcuugcuuuuccuucugcuggguuguaaagguuacuggguugcuuuugauauguuuuaggaguuggguuuugguguuuuaguuuuuugagacauggucuuacaguguagcucaugcuagccucaaacucauagcugcugcugcuucuuagccucccaggugccagaguuacagucacuuggcguuaaagguaacuguuauugcaaagaauaaagugguuaguugugcuuugcggggauagagguggaaucuauucagaacuagauaacggaagcaagccuuguugccaacagcuauuagcugagcgccuuagaugggucuagguuuaaugaagcuaaggacagcacacuuuccuugacaaugaaccaccacaaaaggaacagaaagaguggagagagaaaauccuaaucuugacaaagaaaccggaaauagaaaaagcaaaccuggaggaaugaguccauuguugacacuccacuggacugugucuggugaccacaggccagccgcugacacagcaagaccagagguggcaguguagaggucccugcacaucacaucuaaaaugcccacaggaagagaaaagcagcucuccgcaaggaggaggaauuuaggguguggaauaaacauucuacucugcagguauuaaggcuaaauccuagagugcagugcaguuucccugagagagaagcauggcuucugcuucgugccuggagacccggguaguaaaggaccugucuugcaaagacagguugugucagaauaacuuggaagaaucguucuauuuauuuauuuuuaaagauuuauuuguuuuauguaaguacacugcagcugucuucagacauuccagaagauggaaucagaucucauuacggaugguugcucuggccccgcucucugcccugcuugcuccgcccugcaagaaucauaagcuuugaaaaaaaaaaaacguuucuguuggucuuuuccccuguaaauaucuaauaggauuuuaaauaacauacuccuuuuuggaccugacauagauaggggguggcagaagcuggugugcuggcuucuuuaaggagcagaacugauagaauauacaauacauauaacuacauaacauauuaaagggggagauuuacuagauuggcuuacaugguugguccagguggcccagucacaccugucucgcauuagugaaccugagaauccagcaguugcucaguccaggaggcucagcagucccagccuggcccugaaggccugggggauuccuaaagagcggcuggucucagucugcagugguuugagccucagucugugugcucguuuuccugucccaggaguggacugcugagcacgguguuugcuuucaccuaagaaacugucaaacugguuuucagaguggcugucccauuuuacauugccacuacaguaugaagguucugauuucucauguccuuguuagcucugggcauuguucagcccuuauuuauuuauuuauuuacuugaugugagaaucucacaaaauuuaaacuugguaaagaaguuucccaaaucagguaacguuuucuccaaguuuaagacuguccauuugguccugaaucaggauucucucauuuaaaagacucuguguuugaugaaacuguaguuuguauuaaacucagaucuguucucacuggguacuucccuuuuguuucccuucuaguggaugccuggacuuuggcauuuucuccugacucccaguaucuggccacaggaacucacauggggaaagugaacauuuuugguguggaaaguggaaaaaaagaauauucuuuggacacuagaggaaaauucauccuuaguauugcauauguaaggagaccucccugucgagucuuauagcuauagcccucugcacagauccugcugugcucaugaggccccgcucuauugguguuugugcugacaguuagaccugaagccagcaggauggcuugcaucagaagagacagauuaaccguaucaucucaacgcacccaucucuccuugacagaguccugaugggaaauaccuggccagcggagccauagacggaaucaucaauauuuuugacauugcaacuggaaagcuuuugcauacgcuggaagguaugcauaacuccucauccuauguggugcucacugcauggauuagcuggucacacagcaagagugcuucuuuguuaaaauguuaaagucuaaauuguuuuaucucuguuggaaaacuuaagugucacuauguguuggacuuagaacuauggaguugaucuggacaaauaguucuuaugaugucagauacuuuuuuaguaaaguagguugcuuuugacauaugugucugaucucucucucucuuucccccuccauuucucucucccucccucccuugcucccuugagaccucccuccuucccucuucucuucuucaugagcuuugugauuggaaggcuucuccuuuuuuguguucacuugauaucagaugagaguauuugugcuuacucuccacacuggagaccuugggaggacagaacaagagagagcucgcucuucucauguaugauuuugaauuuaccaaguacacaaauuaucuucucaauuuaucguucacccaaggacaagagauuugauggaaauaucauauuaccauauuauuugucuaaccuuauaaaucagaagcagccuguauuuccauguuuggcuauauuuauacuugaguuuuuuuauuuuagguuuauaauuguguaugugugcgcacgugcucccaugcaccugccuacagaggccaggcuuuuuuaauugcagauuuaaaaagucugaauugcagauuuuuuuuguauauuuuaaggguuuuaauuauguauauguuugagagagaaagagagggagagagagagagauacuccgugugugucugcccacagaggccagacuuuuuaaucccuuggauucagaagugcaggugaucgugagcuguuagcuguugggugcuaggaacuggacuuggguucucugagagcagugcaugcugccucuccaagcuccggugguucuuaucuuagcaguggguaauuagagacaggaacuaagagacugcuccaucguccugugguaacgagaggaagggucuagucagggccacuccagcgcagugauuauuuagugugucacugaaagggcacagguagcaggaagcucauguagcagccgccauguuaacagcuuuucugauuuccaggccaugcgaugcccauucgcuccuugaccuuuuccccugacucccagcuccuugucacggcuucagaugauggcuacaucaagaucuaugaugugugaguuaccuucuccagaguaaaggucacagcaccaguagcaacuuguccccuuacugugaggagccacuguaggaauuugcuaccuguucauggccaugagucagcucuaagguuuugggccucccagucauuccuccucagccagccccuccugcuggagcuuagagagugucccugaggucucuacagaguaaaugugcaucuguguaguccuaguaggauuagauacugcuguucuugucaggcagccaggcguuuuggcucacugguauacaguucuuuuggguagaugugggcuguguuguauacaccugggaaauggagcucugggcuguagcuggccuggagggacagugagaaccuagagugccagggcccugcuguuauccaggcuagcgucuggucagggaacccucgguugguaagcugccucagcucuggguggggagccuuucgaaauauguccugcacgaugguguaggagugaucgggugacauauguccccaucuccaccacugagggccugcacugcucuccuucuguugagucccucccacauccucaucccacugcuauugcaguaaaugccgugcauugucccggguuucaugagucucccugcugagugagccucugguucuuuacuccccaauucuuuucuacucuguugcacacauuuuucacuccaacaugaucuuuauccuugacuguaugugucccuguuccucuacggucucugugagcuguuugagaguuguaacucugaucagaggggcauacugcuuuugacauuagugcugagaccuagagaagagacucuacaaguagcaugcgcuuguuagugacagggccaacuuaaauguggcaguuugcagcaggccuuuguuagcuggcauugcugcucuuuuauugaccucucaagagcugucgaggcaacauggcuuagugccuccauuuugcugaagaggaccuugaacagaggugauugcccuaaaaauaaugagccucaggauugcuuacccucgugggucuauagccuccuguccugcaaggggugccuccgcugucccuaacugaggcuuguuucuaggggcaaaacugcugaccucaggcccagggcacuucucuucucauagguauuugguuucccaggaaauaugguucagcaguuaugagcacuuagcucagaguuuaguucucagcagcacuugguggcucacaacugccuguaacuccagcuccagggaaaugucgucuuuuggacuccagaggcaccucuguauagaugaagcacauauguaaaauaaaaaccuuuuucaaaauaaaggaaacaugaaaccaguugcaggaauuaggccuaacauggguuuuuggcuuuuuaaguuuuuuuuuguuuuugaugggguucuggguuuuuuguuuuguuuuguuuuuuugaaagguaaucauuuuaaucaaagaauuuuuugaucuuguauuugcagcacaaauuauaaccaucuuagggagagugccaccccuuuaucucuccacucuuauuuuuuugugugugauauuuacauuucaaaugcuauccccuuuccuaguuuccccuccaaaaauccccuuuccccccaaccccccagcugcuccccaacccacucacucccacuuccuggcccuggcauuccccuauacuggggcauagaaccuucacaggaccaaggcccucuccucccauugaugaccgacuaggcaguucucugcuacauaugcagcuagagccaugaaucccaccauguguuuucuuugguuggugguuuagucccagggagcucuggggguauugguuaguucauuuuguuauuccuccuauggggcugccaaucucuucagcuccuuggguacuuucuguagcuccuucgggguuuuguuuuauuuuggguuuugacagggucuuacuaaaaaguccucccucccugaccuggaacucaauauguagaccaggcuggccucgaacucacagagaucuaccuauuucugccucccaaaugcugagauuaggggcgugcaccaccacaccggugcaguugccuccuuuggucuugacuagauugcagaugaucucuuugagccacauguucugugaaggauauuacauccugcugcuuuccugccaccaugggaagggccuguugcaggagggucuggcuagccugcucaccccugcugcuguguguccucaucuuggaguugccugagccaucucucuggccuccaagcucuugauauuuuuaacuuaaugcugcucuaaaaauuugucucugguguuugaugcugcuucacuaaaaauggaauuuuugacauauggucauucugauauuauuaguuauauuauuaguuagaacuacuuaguuauauuauuaauucacuaaccaauucaucaauuagaguuccccaaaguagcaucuccauuguuugaaaauuucuucuuucagacaacaugccaauuuggcuggcacacugaguggccaugcguccuggguguugaauguugcguucuguccugaugacacucacuuugucuccagguauguaggagucuuaaauuucuaaacugcuuggcagagggagcaguauucugggaaugugcuuuaaaauugaaagacuacauuacauacagauuuuuuuaaaauucugaggcuagagagauggcccagcaguuaaagauacguggcggcucuucuauuuccagcacccacauggcggcucaccaccaugugaaacuacucccaggggagcccauguucuggucuacuggaauacucucagacaaaacauaugcauaaauagaguuaaaaacuucuuuaaauuaaugaaguacaagcuucccaggcuaggcaugaugguauaaucccuuaaccccagccuuggagagguagaggcagguagacuucuaaauuaaagagcagacuaaucuacauagugaguuagagccagcuagaauuauguagugagaucuugucaucucccccaccccaaaauucaaauugccuuuguuuacucuaguuuuuaaaggguuuuguuguuuuuaaguaaacuacugaaaucuuagauuuuuucuuagaagucuuuuccacuuaguauaacucugacauaucccuuagaaucuaaucugcagaucuguguguuuaucgaugcuagugauguucaggccccuggaggccaaggugauugagaaacguggacuggagcugaugagcauugcucaaugguucuaagcacuuuugacauuucugcagaccucccucucauccaggaauggguagauaggcuuaaggcuccugaugacaguacuuggcaggagaauauuggcugcccagugaggagauagucaucuggggacaccuguaccccagcucuguagcaacaagggacccuguaaaagcagaagugugugagucugcagaggaguguaggauaacucagaguucucauccugacguuugcuuuugaaacaguucaucugacaaaagugugaagguuugggauguuggaacaaggaccuguauucacaccuucuuugaucaccaggaucagguauggaauaguaagcauguaaaccccucccauuuacguuucuuuuauagucuuuguguuggaguuaagagugacagauaugaggcaagccccccaacaugugccaaaacacaggacuuagccacacuccuccuuugaagucacacaccuaugccugggauccuuuucuggguacuuguagaaggccuucuucuuugggugguuccacggcuuaacguaaucaucguuuacacuucuggaguuauccagggauaugauuuaauauauaggucagagaauguuacagguuguucacuuguaauaauaguacuaaaccugguuuccaucuuuguaaggcaaaggaaaugguaacaucuuuguaggauucuucuugguccuuacuguuuauaagagucuccugggagaucuuaacaugccacuuguucgcugagggcagugguacaugcugcagucugccuuggaggcagaggcuggaggaucuacauugguaguuccuuaccuggcaugugucaggugccagcgucagccuuccauacugaagaaaauggacucugacccaccuggugccucaugggccuuucuugaccaagggaaggggauuuuaaacagucuugcacuggagcccagacuggucuugaacuuaguguagucugccugccuuugucugggacugcaggugugaaccccuggcccugcugagacuauguuucagccucuccugcauguugccaucacugcugauuccagccacuacagguagcaaagggucgagagccagagccaugguucucaaccuagaagucaaacaacccuuucgcagaggucacauaucagauauuuccauaacaguaacacuuauguuaacacaguaaccauuaugaaguagcaacuaaaauaaguuuaugguuggggauaccacaacaugaggaacuguauuaaagggucacacauagcacuaggaaggcugagagccauuggucuggaggaacuaggcagcauaaaaauuaaagugcucagagcaacaucgacaagaaaaaaucagcagaugauuaauuugaaugcuuuuacauaucuuacacgcuucuggguguaucuuaugcuuaaccagcguaauuacuauuuauacugcuuuguguuuguuaaauuauugcagugaagcugaaggguugaaucuugguaguucacuacugacuuuaagcauuuuucuuagucaguccuagcuguguugcuuauuuuguggguuuguugugauggugcuucagagaaagauguuuggaauggaagugaagcccucauauggccuaaaccaagguuagccuccaaucucaaggcaagggcacggccugacagugauaauuccuaguaauuacacaguuaacucagccacguucauugugagagagaaaauuggcuguauccaguucagugcacagccaaggaaaugaguggugcucaggagcucuuggcucuuugggaaaggguaaauauugaccuuguuggggguaggcaugagugguuuguauugcaguuuucccuacaggcuccuccuggaagcauagugcuggcccaggcaggaauacacuucauggcaggacccuggaucugaaucuuugaaaggguaguugauugucguuaucuuagagagaaguacuauuccauagccagaggaagugguccacuuagagauuaggcuccauccuuguggaccuugggcuagucuagauucagaaggaagaguacucacuccuuaagcauuccuuaccaaaaaaauacaggaauuagaaggcuuuauggcuuuauuucuuuaauuugcagguuuggggaguaaaauauaauggaaauggaucaaaaauuguaucuguuggagaugaccaggaaauucaugucuaugacugcccaauuuaaacaccagcauccucggggcuagggccucagacuacacaggguugaucaugacauuccucagauuuuuuggcauacuuaaaguacagcauauauuguagaacuuuuguagauacaauauaaauuuuuccuguuuuauuggaaauguucuucauauuuuaauguaaauaaagcauucuuaaugcaaccaccugcauuugugaacgugcuguucuuuuccuaggagagcaauugacgguuagugaaggagagugccugccugagagcggagauccaggugcucacuggguagaaaggcagcucucuguucccaggugauaccagccuauuucagaauggaguucugaaggaaacaggcugagugcacuggaacuuggugucauccuaccugccugagcaucccuccaugugucuauuuacaaugcccccuuuaccacacccucucucccuguucuuuuuagagaggucugaccuacuggcagccugccuuagcccuugugggcucaagacuaguggacagggcuaaacacugcugugccucagacugaguuccagcaccuuaggucuucucugcagucaccucuggacugggucugcaugguaauggggaagguuucagacauuaacauccuagugcuuguugcuucuuacugaaacucugugccuggccacauugugccuguccucaggccuagcuccuuagaauaguccaggcugguuucccaccucccuugcucacuccccuguagcuacacuguccuuuuucccuggccucagugucucuuccucagacaggucuacacccucacaguucagaggcucuacagauggcagcgucucagaguccuuguuccccauccccuucugcucuuccccacuacuccagcucucuacuguccuucacuccgauuggaucgcugcauucaucccaagucagaguuccccaagagaaagcuuauucuaucaaccagugugagauagucuagcacguuacccuguuaagugcuaagaaaagaaaaagcaaagccauuugucucauaccaguucaauuuuaauuuuaaaguggaaaguguacaggugggacaguuaagcaacacucuguagauucauaacaaagagcugagucuaguuuuauccuacacaagcuaaguaguagcucuccaacagugauuuauuuguaagucacagcacagaaacaccacccuggaguugugguccacuuauuaauuggaggaagcaguuuuaagucugucauggccuguggucaaagugagcacuguacuuugaaaacguauguuuuacuagccagcaguguucuucaggagccugguccugcuagcuggcuuacuugaccagccacaggucucaucugcccuuugaccgcccccaggagagguuccuggucugugucaaagucugguaccauaaaaaccaaguaaggauggaucugacagguuaucccagcagcuuauaaagcaggguuuuuaacuucauuuguagaaaagaagggagagguuacggcuagaggcugagguagccuuuauuuaaagugcagucuacuugccaggaauaaaguaguaacuagaacacauucccaagcagcugucauugccagccaacuagaaccugguugggccaguucucaccacacaucacaagcagaaagcccuuugcaguauggcuguacagugagaaugacgggccuuuaggaaggagauaauacugaggggucugugccauugcacacccuuaagacguuaagcuggugugcugggaacuaagccaccagcacuccccuuugguuguuucugcagcuggucagggcugccagggauacauaugaagggcuuagcuuuccuuagggaaagaaagcacuuuggugggacaacacugcaaaggucgucaauagaugaucauuaagagcacaaagaacaagguaugggguuacaggcaaauggcuuuauuggcuuauuuaaaaugggcuugucaucacaaggcuugggaaguucagaaaacuuccaaaagagauguucaaacaacccccuuucuaaccagucaaggggaaagaacauuaugcccuagacugucucugcagcuuuugaguccagccuacucuguaugaaccaggcaugcugggccuacugcaagccauauguggacuuuuacuaucuuaagaguucuagagucuagauucagaaauguuacuaccagaccugagcucauacccuuggugacucugccaagggaggaaggggagaaaaaccacagacuagagaugggccagacacccaccuucugggccuuuguuaggggccaagagugguccucugggccuacugugggaacgaaccauggcgaagccacuaagaagcacaaaaggucagugugguacuggcaucuccaaaauaaguccugaaaguacaaaugaaacagauuccauaugcagacuagaggggauugaacuuaaaacauuuaaauauaaaucaagcuauaacuuaaguuacaacuagaagagaaacaagaaaacccaagagauacucagcaguggagacugcugaacacauacacgggacaccccaaacgugaggcuauuaaagcgaugccauuuucauugugccaaguuuacauucaucauguacuagaguccaaccaggccaggccacaccgcaccaucaugccgucuggcacugcacgccagcgcggggcucuucgucaucuuccucauaggccucccugugcuggcgccagcucugcucguugggauugaacuccuucaacuccaccugauccaugucaucugugauccucaccuucugccgagggggaagcagagccuccagcugaggaagcuucuccugagagagccacuguuuuucagggaagacuaccugc

SEQ ID NO: 5111 - RNA, 2039 nt, Mus musculus
ucuuuuuuuuuucuuuguucuuguuaaauuuuauuggcaucacauucaucucuuuacagaagaaaucagccuacacccuagaauguagaccucugaaggggaagugcuccgggaagcaagccaugaugcagggcaggaccucgggaaaagacagaacugccagggcucaacccaagagaugguggguuagugcugggccacacuugggugggugggaaaggaggagggucugcuaaccuacagguaccacaacccugaaaggagcgccuucuagaacaaagguagagucacugggacaggucuggugaguucuccuuuccucuuugaguaggauagugacauaagggcaucauaaaguguugaauauaaggaaaaaaaacagaaagggagaaaaugagaauuuuaauuuuugaaguaacagcaauuuauccauuguauacacuacuauauuaugcaaaucaaccuuuuggaaaauuuagacacagaagggaacugucuaguucaguuuucccuucagagagaugaaaagcuuuuuggcucuuaagucugugauaaaaggcguacauaauucuugugucuacuguacagaauacugccgcuagcuggacuuccacacuugagucucuaacacucuguaauccagacaggguucaacccuccaccuugcaugccuguguuagaggacuuaaacacacaauccaggaauuccuuauacuaauuuacacauuuuaauugguugcauauauuaacauguacuauaagauucuuuucuaagaagcauuacauaauaaauggauacuguaauaaaaucugauuaguuaaaaguaacaagcauuaagagauacauacaaaacagccugcucagaacggagccuggguaccagccuucccacaggaccuucaaggagggagggguaaaagaccauaagaccauuaaaaaaaaucagauaauuagacacagaugaacugugaacaguucucucacucuccaguggacaaaaagaguaagcuuuccaugcccacugcaccccagagcacccagggucucugccauauuaugccugccauacacagggcucacggggaggggggacagcugccccaggaguccugacaggcacaggcuggaguuugcuugcuguguguguguuguguguauguguuugugugugcaugaguguguuuuguguauguguguguguuggauaacuguuugguggaguuucuuuuggcagcuggaugugagagcucacguucuggucuguuuggaggaggagggacgcauauugaaggccuacguguguguucuuggucugugaaggacucugugcucacugccccuucaacaacugcagcuuucugcggaggccuuggcccggucauucuuguccaguuugaugggcucagggaauucauuguacagcuccaccucuguuuccuguuuaagggcauuccgagcaauugucuggaaggccugcuccacauugauggccuccuuggcacuggucucgaaguaaggaauguuguuuuugcuguagcaccaagccugugcccucuuuguggccacuugucuguuuuccaggucaaucuuguuucccaacacaacaaaagggaaguucucgggaucccgggggcuggccuggaugagaaacucgucucuccagcugucgaggguuuugaaaguguugggggcagucacaucaaacaccagaacacagcaaucugcaccucuguagaaggccacaccaagagacuagaaccguucuugaccagcugugucccagaucugcaugguaacaagucugucauccaccaucaccuccuuggucagaaaguccgcuccuauuguggcuuuguacugguuacugaacuucuuauucacauacugcuucaugagagaggucuuuccaacaccagagucuccuaggaugaugaccuucagcaacacuuucuuccuagaggucauccuugaagcgcagggucaacggaggaggagacacaacgcaggccgcaacagagacgucugauuccggcuccac

SEQ ID NO: 5112 - RNA, 2039 nt, Mus musculus
guggagccggaaucagacgucucuguugcggccugcguugugucuccuccuccguugacccugcgcuucaaggaugaccucuaggaagaaaguguugcugaaggucaucauccuaggagacucugguguuggaaagaccucucucaugaagcaguaugugaauaagaaguucaguaaccaguacaaagccacaauaggagcggacuuucugaccaaggaggugaugguggaugacagacuuguuaccaugcagaucugggacacagcuggucaagaacgguucuagucucuugguguggccuucuacagaggugcagauugcuguguucugguguuugaugugacugcccccaacacuuucaaaacccucgacagcuggagagacgaguuucucauccaggccagcccccgggaucccgagaacuucccuuuuguuguguugggaaacaagauugaccuggaaaacagacaaguggccacaaagagggcacaggcuuggugcuacagcaaaaacaacauuccuuacuucgagaccagugccaaggaggccaucaauguggagcaggccuuccagacaauugcucggaaugcccuuaaacaggaaacagagguggagcuguacaaugaauucccugagcccaucaaacuggacaagaaugaccgggccaaggccuccgcagaaagcugcaguuguugaaggggcagugagcacagaguccuucacagaccaagaacacacacguaggccuucaauaugcgucccuccuccuccaaacagaccagaacgugagcucucacauccagcugccaaaagaaacuccaccaaacaguuauccaacacacacacauacacaaaacacacucaugcacacacaaacacauacacacaacacacacacagcaagcaaacuccagccugugccugucaggacuccuggggcagcuguccccccuccccgugagcccuguguauggcaggcauaauauggcagagacccugggugcucuggggugcagugggcauggaaagcuuacucuuuuuguccacuggagagugagagaacuguucacaguucaucugugucuaauuaucugauuuuuuuuaauggucuuauggucuuuuaccccucccuccuugaagguccugugggaaggcugguacccaggcuccguucugagcaggcuguuuuguauguaucucuuaaugcuuguuacuuuuaacuaaucagauuuuauuacaguauccauuuauuauguaaugcuucuuagaaaagaaucuuauaguacauguuaauauaugcaaccaauuaaaauguguaaauuaguauaaggaauuccuggauuguguguuuaaguccucuaacacaggcaugcaagguggaggguugaacccugucuggauuacagaguguuagagacucaaguguggaaguccagcuagcggcaguauucuguacaguagacacaagaauuauguacgccuuuuaucacagacuuaagagccaaaaagcuuuucaucucucugaagggaaaacugaacuagacaguucccuucugugucuaaauuuuccaaaagguugauuugcauaauauaguaguguauacaauggauaaauugcuguuacuucaaaaauuaaaauucucauuuucucccuuucuguuuuuuuuccuuauauucaacacuuuaugaugcccuuaugucacuauccuacucaaagaggaaaggagaacucaccagaccugucccagugacucuaccuuuguucuagaaggcgcuccuuucaggguugugguaccuguagguuagcagacccuccuccuuucccacccacccaaguguggcccagcacuaacccaccaucucuuggguugagcccuggcaguucugucuuuucccgagguccugcccugcaucauggcuugcuucccggagcacuuccccuucagaggucuacauucuaggguguaggcugauuucuucuguaaagagaugaaugugaugccaauaaaauuuaacaagaacaaagaaaaaaaaaaga

SEQ ID NO: 5113 - RNA, 58165 nt, Mus musculus
cgccuccugcggguggagucgguuacaaaggcagcagccggcccggcucccgcacgcucgcucgcucccucgcucgcacgcccgcccgccgaggccucgcgcuccucgccauuuuccagccgcgcucggacgcgggucgcggcggcggggagaggcggagccgcgagagcgcggcccgggccggccccgcggggcggucgcggccgugacggcggcucccggccccggcucccuuuccucaccccucccgcuggagaugaggggaagauguccgugucagggcucaaggccgagcugaaguuccuggcguccaucuucgacaagaaccacgagcgauuccgcaucgucagcuggaagcuggacgagcugcacugccaguuccuggugccgccgccgccaccaccgccgggcagcucgcuuucgccgccgccgccgcucacacuucacugcaacaucacggugaggcgccgggucguagccccucggggccgggcgggggcggaccugggcgccgcagucccgggacaaagggcgccugcccgggagacccccggugucccgggcacggccgguuggcggcugggcccugggcccggccgggagcucgggcugccuggucgggaggagguggaggcgcgucgcagcacggcgcgggccggcuuugcucuguuggccccucgcggcccccgucgggccccgaggucgccauggccgcccgcagccggccugcucuggggaccgcggcucguccgugggcuccugucagucgcucagguggaaaggcucucaaguaucuguuuuagcuacucguuuucccaucggguuccaaaacccacguccuugcuuguucaaccaguucucguuuguguuuuggucuccgaggacaaacgaacacugaaagccuacguauuuaaggaaaaaguuuaggacgcaaccccgggggaugguguggaaccaucguuuagcccugaccuggcuuugcgcuuacguguuuuggaaaagcucauggaaccuuccacgcggcaggugguguggugagugugcaagcugucccaccugugcccugugcggaagccuggacguuaccaggaggggaaaggagaugcuucgcaguuuauuaccggggaagaucaagugggauuggaaggcuggagaaacacgugggaaguuacuuuucuguuuaagggaaaugcucuuuagaaacauucaguugguaaaauuaucagauuguaagugaacucucuccccccccccccuaucgaaguguauuaugaggcugacuguucauugugaaauugaucucaugugcagaaaauacaccuuauuacaacuggaguuaaggugguaguuuuuauauggcuaagauuccuucuguuaagucagccaauagauaaccccaaguguggugggaauuucaaaggccuuaacuuuaugauaguuaucaaacucuauuggagaagguggauaguguuaguacuauuagguacugcuauaucuggcaaaagaaaaaacugcagcagugugcuuuagugaggagggaauucacuuucugaauaucuuguuaagcuguuguggguacuaguguuugagaacuuggcaggccagugccuauacagagaacucagacuucuuggagcguuuuauauagcugcgacaacuacuuugauguuaugaaaucuaaagggagcaucuaauuuugcguagggagcuguguugacuaguuuucuguuaacuugacaaguaauaagagagggaaccucaauugagaaaaauaacaccucaagauuggccuguaggccagccuauggggcauuuucuucacuaaugauugaggaagggcucagccaauuguggugguuuaccccuggguaguugguucugugaugguggguaugggcuuuuuaaucagcacugcauaggcagagaggcagagagggaggcagagaggcaggcagagagggaggcagagaggcagagaggcagagaggcagaggcagagggagggucucugaggccagccuggucuacagagugauuuccaggacagccagagcuauacagagaaacccugucuuggaaaacaacaacaaaacaagacaaaaaaacucacaaaaaacaaacaaacaaacaaacaaaaaaaccccaccuaaguaagaaguguccucacccccugacuucugcuucaguuccugcuuugagucuugcccugacuuaccucagugauggagugugaccugagaguuggaagcugaaguuacucuucucccaucccccaagcccuuucccaguuugcuuucagucaugauguuuuaucacagcaauagaagcccuaagacaggaacugaaggugugccucugagaaagcuuugaguaguugaaugggugaguacaauuuuggaaggcuggcauaagcgaggguguuccagaccuaggaaacuccacccagaugaaauaccgacucuugagaaggaugauuucguaggaguggacaguuaaugcuaagacuugaaaaguccaggcuuguaggcuggugaagauuuuccaaauauggaaggcagaaaguaguagucagugaaaaggaugguaaguagacuggccuggacagcuggaggguuauucagguagaacuuggagguaugggaagaaaaggaacaacugaccuacaugauaggacacucaauuuauagacugggaagccacacccuuauguugauaaggugagaaauggugucugcuuucagaacuaccaguucuuuacaguggugugguauuagaaaaugcaugaauguaugguuuugguuauucccaugaguguuaggugaugguguuggugugcuggcauuuacuaccaggggaugcaggcagucagccaugucaaagaauuaucugaccuaaagugccagcagcaucccauggggagaaccauuuugaagacaaauaggucagacaaaggauaaugcuggugaggauuagguaguggcaauggggauggaguaagaaaagacuacuaaacugggugaaggauguguuuacgugugcuagugcaguggugcugcuagcaggcauuaucacaguugaccuacuaaugauuguggccagacacgaucagaagacaauuacaaauucucuagguguguauguuagcuuuauuguggaaaacuaacaaauauacagagcagaacagagagacauugugcacccaggcucagcuaugauaaacuuuuggccaaucuuauuucauguauaugccuauuggauuaauuugaagaguagucuagacauacaauuuuuucuauaaagauuucaguaugugaguauaaaagguauacuuuuaaaauauguuuugauaauguauagggccugcuuuuauagguguaauuugcucagaagggaaaaauguuggaauucaaauacaagugccuggucuacuagguuugugaccugcuauuuugcacaaaguuguaggucauuaguguagugggcuuaagucguucuugaacuuuuccucuuuacauagcaguauuuauuaagcucucuguacaccagguuuccaagcucccaagcaacaugugaauggcaucguacuuguggaccagcuucugaauaguccucugaggacacugcucacuuucuuccuaaccuucuauaucagcuguucuuccucagugggacgagcuccugccucucgccucugcccugucccagccugccuuuucuaugguugauugccuuuuaagacuuucugugucacgcgcaguucauaauaacauuuccccuuuuuccuuuuaguucuugugauuucugcuuuuuuuuuucuuccauguuuacucauaauucugauuaucuuuucuccaaguuguaauaguggcagaauauuauauaauuauaaauuugugccuuauauuuucuuucaguucauacuuguucuauugacuauauggccacuguuguaguuauauuugaagggaaguuuuccugccuugaaagauagcugguaagaauuucucagacaguaucaugggcaguaaagagauacuuaaaaggucauuguagauuugauaggacaucuguaggaagaccagugucagaauuaaaaccacaacaugagugucugcuuuccugggccagggaaagugggcugguuugguuuauuuuuuccauccuguuuuauaaauuuguuguacucucgaauaugaagcucacagagucuuuauuucuuguuuucuguggacucaugaaagauuaucuguuacauaaacguacgcauugcuuuuuccauuucaguaaacaggccugguugccagucuucacuaacaucuaguuguuauaaucacaguccaaagcaaagcagcuuauuuuaauaaccaguauggccauuuugggagcuaauauguggcuuuuuuuuuuuuuuagucauuuuaaaaauacuuaagguagcaguuccauuacuccuuuugggggguuggggggugggggacgguuuguugagauaggaucucucuguauugccuugacuggcuuggagcuuacucugcagaccaaacuggcccugaaacuucaugacuauccuuagagugcugggauuauaguccauguaucuggcuccauuccuucuuguauagacuuguuggaauuuuaagagagagugugugugcauguucauguggguauauguguuuguggguacagguagaggucagaagucagcuuuggguggucuuuuucaggagcuaucuaccuuuuuuccuuugagaaaggguguuucauuggccuggggcucaucaauuagguuagguggauagccagugggcccaggcaucugccugccauuaccuccuugcuacuuggcuuaacagagugugccaccaugccuggcuuucuuucuauuuuaaacauggauucugaaaaacaagcucagguugucaggcuuguguaguaagcacuuuauagucugagcuaucccccccccuuguuuuucguucucucucucucuuccuccucucucugucucucuuucucucguguguguguguguguguguguuugugugugcgcgcgcacgugcgugcgugcgugcgugcgugcacgcacgacauacauguguuuauaagaagaccagaggccaaccuugaguguuuauacuuaggaguuguauacguuguguuuuuaaauuuuuuauuuaguuuuguuggugugcguacauguucaucauauaguuaggcaucagccaugguguguguguauaggucagaggucagucuccacuauucuugucuucugcuuuuuugaggcaaggucucauuguuuucauuuauuugaccagucaauaauacagggucagacuccuugugguugucuguccuucuccaucuccauuuuaaugcauuuaaggucuuuuaccuuuuuaaaaauuuuuuuaaagaauauuuucacuacuguaaggccagauaauuggccuugguagcuggcuagucacugucuccccagcacugggacuauaugaauguaccacuauauuggcucucugugcauucugagauucaaauucaggcucuugugcuuuuugcaaacguuaccaacugagcugcccauccccccccccccccccccaguucuccccaccuauuuuuuuagagucucauguauuauaguucaggcuagccaugaacuuacuuugugaaugaaacuccugauccuccuuucuccccucuguguucucuuucacaugcccaggaacaccuggagacucuugguacuaaguugcuguuuuagaguuaaaacaaaaaacaagaaacaaaaaaacucccacaggaaguauaaauugguauuaaauugaaacuuuauucuuuguuacuuguauacauaaauuauuucuuaaugaaugauugucaggcuaguuuugaugaaauacuuuuuguuuagcuaauuucuauucuuuguuauuaaaaaacaccuuucccaaaagcaagcuacuaaauuaacaaauauuagcacugaaucugggagggagaacuuuaagcauuacuuaauauuuaggaucuuaaauaauuucuuuuauuguuucuucauaaaacagucccccuuugcccugggauguauuggaaagcuucuugucaacaguauuguacuauacuguacaaaugggaaagugauaaccuuuacuuaaaaauacucugagcugguaguucagugguagaguacuccacuuugccuaguguaugcaagacccaguacaaaggaaggaaauaaauuaucugcuuuguaacaucuuuucuuggcaaauaaggcaaugcuguuaacuucaugcuuugcuuuucuagucuguguacugauacaaagucauucggcugaaguuguacaaaggaaauuaugaacaaaaugaccacagagccuaaggaucuuuauuuagcuuauucuccagugacagcuuaccuuuccaaauugaauucauggagaagcuguuggaaauaacagcgcugauguguuaagauccuaaaugguacuuucagauuagaaagacucauuguuuucauuuauuugaccaguuaauaauacagggucagauuccaugugguuaucuguccuucucuaucuccauuuuaaugcacuuucuugagagaaaugggauuaugaagaggcuuggguuuccuuuuuaugaaugaugguauacguuaguaaguuuuuggugaugucugcagggugggaguguuaaacuuagaccuggcaaggaguaguguuggauaagugucagguaaucgagggagggaguagagacagaaugcuaacuauaaaacauuacaggagagaaacacaacaaggcuugccccuaccccaaggcuuuuguaauaguggucucuaauagcuucuaaagauaauuaugaaaaacaauggcuaaucagagcuacagaaaucauccaggggaauuugcagccuaguugauucagaucaauuucauuauuuuaucugccuuaguucauuuuagaaaaauauucugaguauauguaauuuguucucuaccuuagcuaguuaagcaacuuuucgaauaugaugcagaguuuguguugaaaguuuuuuccaguagugugguggaauguauuuuguaauauugaaaacaaaacauuguugcgaaaaauuuagaaaccagagaagcaaaacaaaacaacacaaccucucuaauuauacuacucacugcuauaaauuuuggauuaguaucuuucuagucauuauuccccucuguuuuaugcgguucccccccuccccuuuuuuuuuucuuuuuuggggauaggaucuuucuguaaaguccuggaacucuguguagaccaggcuggucuuaaaugaacaguccuccucugccucuuaaauuuuggggcuaaaggcauaugccaucacaucuggcuaccauuuugaaaaaugauaaaugggauuguuuugucauauucuucucacuuaacaguguugugacucuguaucuuucguuguuugcucuucuaugauacgauaaauccaucuagcgaguucugucuccuaauauuggccaugcagguggcuguugcaucuguuuuccuauuuuaaguagcacucugagcaucaguagauggaauccuagugcacauaggaaaugcccgugaaguuuuccuauagguugcuuuuaauucuuguugcagauuugguuucugaagguagaacaaauuauauuguacuauauagaaacuuugcuuucagcuuccaguuuuaucagauggguaaaaauguuagcacuggguacugagugagaucaccacaguaagacaggagguauaguuaucuauagcccucugaccucaugcguucucgcagaacgcugaguacuccacacuagccagaauuuaccugugaccgaccccaacugucccacaacaggacagucagagagaagacuuuguggcuccccccaccugaaagcucauuauugggaaugguuagaauguguucuggcuaguuucauauuagcuugacacaggguagaguuaucuaaagagggaaccucaguugagcaaaugaaaacauaagaugggacuguaggcaagccuguagggcauauucuuagugauugguugggaagggcccagcucauuguggguguugucauccugggcuggugguccuauaaggaagcagacugagcaaaccaauauguagcaccccuccacauccucugcaucagcucuugcucccagauucuuguccuguuugaguuccugccuuggcuuccuucaguggacuacaacucaggauauguaauccauauaaacccuuuugaucaugguguuucaucacaguauuuggucagguuuugugucaagggagggagguaucaaaaccagccccaaaggaacauguagguuaauggagaauggagaaaaggagguguuuuuuuuuuuuuuucccaggaggaaaggcuaggggauuuggcaggagagaaguuggaaaguucuuaauauuuuugggagucaggacuuacuuaaacucuuaaauauaucacaggucuaaggaaacuucauuuuuaucagcuauaccuuugauauuuaucauuaaaaauuaaaacagauauuuaaaacauuaauaacuaauacugcaaguuucuuugauacuuguucugucauuugcuucugcacuuuuacauauauacuuaaauauauuuauauguauuacaauauauacuaauucuauguauuuaaaauauauuuuuaaaaaacauuuuuauaguauauggauuguaaaacuauauauucuaaaaauuuuuguuuguuuuugcuuuuguuuuuguuuuuugagacaggguuucucuguguagcccugacuguccaggaacucauagaccaggcuggccucgaacucagaaauuugccugccucugccucucaagugcugggauuaaaggcgugcgccacuacgcuuggccuaaaauguauuuuauguguauguuuugucucuuauguaugucuaugcaccaugggcauggccuggugcccguggaggcuggaagagaagguauuauuauauuugcugaaaaugaaccaccaugcggguucagggaauugaacccagguccucugcaagaguagucaugcucuuaaccucagagucaucccuccagcccaguuguuugaugcuuuaauugaaguaaugugaacaaaacccaacuucgauaucugguugaaaaaaauuaauuuuaauagcaauagccacuuuagauaauuggacucucaauguccuuuagugcugggaacugaaccuagggccuucagcauggcaggcaaguguucugaccacugagcugcuucccagcugggaauauuuuugagugaguggggggggggcggcgggggaagacuuuacaaaaacuugaucuuuuucuugcaugauauuauagcaucaugcauugaucauugggaaauauuuaguugauaaaucuucuaaaacauugauaaguuuuacuauccaacaucaaaauacaauuucacuaccagucuccucagaauacuuucugaagcuacaggcucacacuaguggguacaagucuuucaaaguuugaaugguuuucucuaaaguuugacuuuuauuauuggugaaauauacugacuuuuguuuugaaaaugacacucugucucuuauuuuugagaaaacaucuuccagaaacucagguuggaauaagcauugcagucauccuuucaaguaaaagugucuguuucacgucaguucauuucacgucaguucauuucacgucaguucauuucacgucaguucauuucagauggagccacacaugccuacucucaagugugcuacagugacuccugugugcuccccgcgccauuaccauaguauuaaaaaggcuuauacgguguaagggacagcacaucacuggcauucugaaggaacgccugguuucuuuuucacagcucgguucauuuaaacacuagcagggcaagauuccagcagaccacuguuaagaccuucacuugugggaagguagcagcacuuuccaguagaguaauucaguaggaagaggaucauugacauuuuagucuuguacugaggggugcaaggccuuugagaaacauugaaaugagugcuuagacuugcugccuauccugccuuuucauguacaggauuuaagauauauacagaucucaagugcaacugauuucccuucccuaaauuucucuuaacauggggcaaagcacuucauuccucuuuaagcucauguuucuucaugcagauauuuacuagauaaacacaagucuguacgaugagcuucuagauggguuuuuauuuuguaaaagcuaaagcaagugcaaaccccagacaguagguuccuaagcuaggaugaaggauguggagaugaagauacccugcuaagugccuuucuuuaagaaugggguuaauucugaaggugcuuuaccuuucagccugugaagagauuuggagccaguaagaaagaaauacaaagauaagccaaccagugcuggacagguacauggacaccacuacugaccacuaaucucuguaguuuuuccuuaagauuuaguaaaauguuuuaaaaauuuuuaguuucugugcuauuaguucuguuuuguguaugugugugugugugugugugugugugugcgugcguguguguggaggggauuauauaugcaccauauauguauauaaugagauuauauauggcauuaaagaacauuguucuuuaaaacuauuuguguagugcaguuuucuacuacuuaaauauauucaucagcuaguaucuaccaaugaugucuuuucccagauuccuaguaaaaaucagaauaaaggaacaacaacaguaacaacaacaacaaaugccuguuagugaguaagagcauguaaugcuuccuuaauucacuuaaaacaacagcacuucguuuuaaaagaugcauauuauuaguagcauuucucaguaguucuuuuuaugguaggauauuguaauucuaucauguuugaguuuuuuuuuuuuuuuuuuuuuuuuuuuugguuuuucgagauagguuucucuguguagcccuggcuguccuggaacucacuuuguagaccacugccugacuuaauucuaucauguuugacuggcaauagauguauuucucuguaacaaaaacuuagaaacuuacuuauuuugcuuaauuuaucuuauguguagagguguuugaccacauguaugucugugcacacaugugugcagugccugcaaaggucagaagagggcaucaaauccccgagaacuggaguuauagguauuugugagcaccaaaucuggguccccuguaacagcaaucaauucuuuacugcuaagccauuagaacuuuuuaaaacauguguauauguuugcucucaugaguuauguguaccaucucugugcagcagccuacagaagccagagguuguuggauuuccuggaacuggaguuagagcugguggugagcugccaugugguugcugggaacuggcccugcuccucuacaagagcagugaguacucuacucaccgagccauggcuucagccuccuaaauuuagaaccuuuaagaacaaauguuacucuugguuucuguggaucagagucuguguaccacuuacuuaccuugguuucucugaccuguggucuucccagugcaggaaaguguugguggaggcuacaguggucagaaggauggaaagggagagaaccgccuccaaggucucucucauaguuguuggcaggauccuucucauaggauguuagccaaaucugagaaccuugguuuaauuuuuagaguucuuuuucaacuucuugccaugcagaguucuccauagguggcagcugauuuucuucacccggauuaauugcaagaccaggagauaagcaagacagaucuuaacuuuuuuguaacucgauuuuagaagugguguugguacuuuugcugcauuuagacaugaguggcuuaguccaagaaacaggauuuuuuacaagacaugugauaccaagacaugagaauuaacuggggccaacuuagagguuuccuggcagaguguugagaucuccauugacauuuucuucagauaaauguuguaaauaucuauauuaggagaaaggcuaacucagaaggccaccccuguggcaagugaaaucuaaggauugugguagcccugugcugccguucacucugcuccuagcaccuguuauaguuaaaaagcagucuuuaaggauuuugguauaguucagugguagagcaugcaccuaugcaugaccucauguuugauccucagagccccaaaaacaaaacaggagaaacuaccaccauuaagaaaaugauuaggcagcaucaaaugaagguaaucuuauuuaaugugucuguuuccaagaaauuauauucugaagccagcuagcaauccuagcacuuaggaggcugagguaggaggaugugcagauuugagucuacauagugagacuauaucucaaagaacgaaagagaaauaaaacaaagaaaucaacuacauucauuguuacagucuaagaagggauggaaaaacaaauggauuaguccauccuuuagauauuauuugugugugugugugugugugugugugugugugugugugugugugugugugugugugugguguuauacacaaugaguacaggccuagaggugccauauccccuaaagcuggaguuacagggaguugugagccugcugacauggugcuguggugaagugaacucagguucucuggaaaaacaguccauguuccuaaccaccaguccaucucuccagcuuacuuuuugagguagggccuuuaugucuguccuaucccucgagcucacgggcuuccuaccuagccuuugagguggccacccccaagccuggcucaauguagugaauuuuauacaggugaaggagaaagaaaaccuugaagaaguuucuauaauuauuuuacauugaaggccagaacgcuguaaguagagggucuuggaaaaaguacguaauguuuagcaugugugaggauuuggagacguuccuuggauuauuuuuuuauaguucaggacuagguaucuaguuagaaauguagcauuauuaaaaggcaaagcuacuguucaaaaucuaggcugaacuuuaaaguugggauuuucuuuuuaaugucacuuugagagauuauuaugauuccauauuuuaaagcucugaaaaacaaaagguaaaagcuagaaaauuugggucaugauagacauguuguugcaagucuccaguggugcuugacaucuccuccccuuagauaauuuugguuuuaaucauuuugcucauugguuaaaguauuauugucugcuuuuaaacuuacagauuguauaacauggacuacgcaagauuaaguuguuaaacuuaguaauuuuaauuuuuaaauuccacagaggaaucuggucccucuccacaugaauuucaauguugccuuucuucuuuuaaugaacuuuaugcagaucauaauuaccugccccuuagugguaugguuuaguugcaucucuggguuggucuauuuguaauauguuucaccuaguugucuuuguaacaggaaucuuacccaucuucuucaccaauaugguuuguggacucugaugacccaaaucugacaucaguucuggaacgcuuagaagauacuaagaacaacaguucgguaaggagaugaaccagacuuuccuuuuuccuucucauggucuuaugcagaaacauuaaauauuaagcaguuauaugauaaaaaauuuaucauacuaaaauuuacuccauuuauuuccuuuuccugauaauuuuccaucccuucuaagaucguaauacaaguuguuauagcaugauuaauaaugacaauuuuagcaagguuacagaccuuuugaaguccaucucccucuuucuacauguacauucuauuuacauuaggaauugaaguucuuuuuuccccccuucauucuugccauuaaacaaagcaaacauuuuugauagacuguugggugaggugagaaaggacaaagaugguaagugagguaacauaggauagcaucaggauuuuuuuuuaacuuuuuuuuuuuuaauuauauauauaaguacacuguagcugucuucacacaaccagaagagggcaucggaucccauuacagaugauugugagccaccaugugguugcugggaauugaacucgggaccucuggaagagcagucagugcucuuaaccacugagccaucucuccagcccaacaucaguguuuguguuagggaauuccuuugcuaguuaaggcccacaagucugcaguaaaagccaaauuuauugaaaagguuuguugguuuguuugugauccauagucaucccccugugcauacauuccaagacucccaguagaagccuguggguaucucugaacuguauaaaaacauguuuucuucaggacacugcauaugaagagauuaauaguagcuaguaaaguagaaccagugacaaugggcuccauguuaaagaacuauaaacauuguguacuuucaguugguuuauggggaccuugauaaacccuggaaagcaauauuuaucucuggguuagaggggggugcuuuguaaagagauguaucuuucuaggcugggaagauggcucaggaguuuaggacacuugcugcucuuacagaggacuuuaggucuguucccagcacccaaguugcaacagcuuacgaguaccuguaacucuagcucuggggaucugaugccucuguucccuauaggcacuguacucagggguacaaacuacacacaauuaaaaaauaaaaaucuuauaaaaaguauccuuuccuuuuuuuaaauauuaaaauguuuuauucuuugauuguaaauaucuaaguacccauuguaagaaaacuauuaaguuguagauaaaaagaggacauuuagcuuucuuauaauuuucuaccuaauauaaccacuguugacauaauggauauuuucugcaguuuuuucuuuguuagaaaauacauaugcuauuucauauguuuuuagauaguuggggucaugucuguaaucuuacaccccuuuugaacuuacuguuuuuuccauauuaguaaauccuuauagaacauaauuguucuuuguagaugucaugauuuuuuaaaaauacuccucuuaaacucauauaaacugcaaaaaaaaaugagcuggagaaaaacaauuaauuuguugaagaucuguaauaacucaaaugcugcuuauuaccaaauagaagauacaaugauauuuuauugaugauugcaacaaauuaaacaccuaggguaaauuuaaauaugggagacuuauaugaagaaaacaacaaaauuuugcaccaaagaauguagacuuagauacuguggacagacagaugucugaggugugacaaaugccacuuauccuguguccuaauaucuauaaaucuaaugcagugucacugaaaaugauuuauuuauuuugguguuuaaagacaggguuuugcuauauaguucaggcuguccuggaacuugcaagccucuugccuuagccuuuccaguacugggauuauaggcuaugccgccaugccugagagccaucauauuuguuucugguauugucagaaugacucaagaauaaguaauaaaauacaaaaguuuaaaagguaaaaaauuugcccaaacaguaaaugaaauaaaauauuaacuauuagaacuagaccaacaggcaauagaaauuuagaaacagccaugcaaaugacaauuuagaauaaguaaagcuggcguuuuaacccaggaaggaagaaucuuucuauagauaauuuuagaacuggccauuuugggaacuuagacucuuuagcucuuugucuugucaagguaaaugguuuaaacauguucuuaaaauuaagaacacuggggcugcugcaguggcucagcagaugaaagcauugccucaagauugaugaccuagcuugggcuccaggacccacaugggagagagagagagaacucuuccuacagcuguccucugacugccacacugucauggcacauggcaucccucgcucucccaaccuccauaaguguaaagaaguucuaaaacaaugaagaauauaaguuucaaaaguuuguaaaagaguccagaucuuaagagccaugaaacucggaguaauuaaacccagacagguacauguuucauuuucagcagacuggugaugggaaagacagacagacauagcucucuagcuguuccuccuuaaauugcuuaugaguuaggccuacuggcacaggcccauaaucccagcuacuuggaguuaaggcauggauauugcaaggucaaggccagucuggucaacagauugagauccugucucagaagugaagauaggguugaaacuauaacucauugggagaaugcucaccuacuuugugcaggguccuagguauaaucccugauacuaaaaaaaaaccccaaaaaacaaaaaacagaaaacaaacaaaaaaaaaaccugugucaaguuaaauggaauagggcuuauauuggaucuaauuauagaaaguaaguacauuuaccugaaggaaagauacacuuucacucugauagauagccucugccgauuucucauagccugguuucuaauaaccuuguuuuguuuugacuuuuuaguuuacuuacuggaguagagaaucugccguuguauagacauuucuuagcuguccaguccaguggcuccuuuuuaguacuaaagcauuuuuccaugguugaaauuuuguuccaucaacauguauuacuuaaugcccaccaauaaagagcugguuaaguuacuccagcuuaguaaaaaaagaaugcagccagcccuuuuccauaguacacauugcaagauauaaguaaaaaacaaggcauagaauauuguguaaucuguccucuuuuguauacaguauuguacaauacauauuaaugauggcuuagcugugcuugcauucuccuuccuguaaauguaggaagcuguuaacagaacacagaaaaauacuuuaagaguaucgauugacuucucugaagcucugugauaaaugauguguauucaaagccaagguuugucuguccugugcuaauugauaaccuaguggggaccucuaugagaccaccauuccuuggcucucuuacuaucucgucuuggucuccucugagaugcucuuccuugguaugucucuuuauuaucuuuuuauucuguguuuucucugugcaagcucuuuuacucucauuacuuaagucauacuuuauuuauugcagagaucccuaaaucuguaucucuagccagaauguaucuucagagguugaaacccauacacuuauguuauugauccucucuaucuaggggaucuugcuuagaugugccaugggaugugcuugucaguuucaauuugucuccaucuuguuuucccucacuaauucucuccgugaaaacgaaacaaugauacuggucaucugugccuggcccugggaacuuaagaguucuuuuuuauacuucuguuccccaaaccauaaacucuaguaacuaccaaaaacuuguucacuuaccuaaauaguuuagacccucccugugaucugaguuucuuccacagucccugaagaggagggaaguguuaaaaguuaaacuuccuggaaaauagacucccuguuuuuccuguggcuugguauggagccaucauacugcuaugaccuauagcacugcugcaggguccugaggugggauccgcggucagggcuguuuccuggccauccugucaucucaugaaguaccuaccuacacacacacauccacagacguggcggcccuuuguuucccuuugagcacgagggcauuuguuugaucuaauuuagugcuuagccuuccucaugucuacuuggaagggcuugcuuguucuuugcuggacuuaacccauucuaauccuguuccuguuuucuuaguccuccauaaaccugcuucuucuucaugucuuuucuucaucagagacacugagcuaacuauuccugcccagugaaguaaguugccuuaucagcucccaucugagucuuaaauauugcuuaucuuuuauguugaggaaaaacccuacauaaugaaaaguauguuugcacaguuuuccuuguuugcuuccuuaaaguaaauauaccuacaaaaauuuaaaauggaaauuuaaacagcuauucuaauauggcaguuuugcuaauuuuuuuuucuuuucuuuuggagaggcuuaauuuuaauuacuccuuacugucaugagacagccuucauuucuguuuugcagauggcagagacuaaagccaggguuuagguauaugcaagguuauuuauucuaggcugagucuacuaggccacaauugccuuaugguuuuaaaugaaucugauuguugcaaauguaauuuuauaauccauaugcaacacuuucuuuaguuuuuugguagucuuacgaaugcauuaauguucuguuguuuaaaaagcugcaaguuucuaagauuaguuagcaacuagacacuaggcagugucugacccuuccuucugugccuuuuuguugguguuaccuacuagauaccaugcuauaaggacauacuaagcuguaauaacuuuucuaaaaucgugauuuucuuacaccagcagcucuaacacguaucagagacugcuuccaucuaugggcugcaguuagcaggagcgcauuuuccuuuccuucuggauugacuaacaguaguuguagcauuauucaaugucgucuaagggcucuuuaacauaaugcuuauuuacugaaauauguuuuguagcuccgucagcaauugaagugguugauaugugaccucugcagauuauauaaccuuccuaagcaccuggauguugagaugcuagaucaaccacuacccacgggucagguaaaguaaacguucucuaguguugaagagcugaacucauugucuuaauugaaaguuaaacuaggauaauuuaaaauuauuauacagccuauuuggaaguuaguuuuguguuccuaguaaauugccuugcuuuaggugcuaacacaggcuuuucauuucuugggguuguuuguauuuuacuguaauaggugagcacugcucuccgaccccuccauuuugauuuuuguuaaaaucaaaaugauuuguguguuucuucuuugacugguuguuuagucaguuuaguccuuugacguaccaugucuaaaagucugucugugcuucuuaagaugaaaugcaaaguuagcucucccaagccauggaaauuuccaccaguucagcaaucauccaugacauuuagacuuaccuaauuagcuauuaguuaacugacuuuuuauuacaauaaaugaggauuuagcucuuauauaaacuaccuacuuaaccaccuacugcuucuaaagcauugcuuagucaugaacgaucagugcugugaggacuuuggggagccauguuuucuguuauggcauuuccauaccugugcauucuuuuacuucucaggguucuuuuuauaguaauacuucccaguuuauaaaugucacaugcucuuucugggauccucugucuauggagucccugucucuucugcauuaauuagucuuugugaguucucggauggccuguacaguugucaccuugagauuuuucuuuucugcuauccuagagcgaaucuauugauuccuggaucucaugucaucucuauuggcuuucuuuuuucuuguucgucucuauuuauuacacugucggauaaaggccgaagcaugaaggaauggcauauuuccugaguuagcuuuugaaaaaccugguucagaguugguguuagaacaagcccgcccacacugguuccaaaaugugguucuuguugccaucuuccuagucuuugaccacuucucacuuguacagaguagucggucggagugguuugucagcacugcagguauucuaaaagcagugcgcagugcuguacaugggaguuguguggccucaguaucagcugcuguuguguucucuuucacucaguguuugagugaauaauaaaucuaggcugaaauuuuugccuaagaauuucaaauaacuaugcuguugucuucuagccaguggcguagcugaagcugaugccacccggaaucuuauguaugauuuuucuuuggaagcuucagggaauuugugcuuucuuugguguaaugcacugcagcaguguccuuaacucaggaucuuuucucuuucauugcgcuggacguugaguaaggcugugucccuuuccaaauuugagucuugaguuuugguacauauuuuuguguguuaacuuugcuugucuauuuuguuuguuuuggaguuuauuaacuggacuuuucaauuuuguuuuuacguuuuggagacauggucuuguacacuuuaggcgcagauuucaaaaaccauauguagcugaggcugaugguugucuuuauccugaaugcuagaauuacaggcuguaucgucaaugcugggcugcuuuuagauuuuuagaccucuugguuugagucuuuacaucuauuguauuauauucuuuuucuuaauuuuauuuuauuuuuauuuguauaugcguguguguguguugguaugaacguugguggcacuuuuauggaggucagagaacaacuugcaggaauugguucucuccaccaucugagucccaggaucaaacccagguggucaggcuuggcuacaggcaccuuuauccacugaaccaacuuaccuuuucucucuuucuuuuaaaauuuugcuguacugucaacuuuuuucuauuucacacggacaauaauaaguuuuaagguuuuaaaaaauauguguaugaguguuuugccuacauguaugugcaccacaugcaacaguagagaaucuugguagucccuggaaguagauguuguuagcugccauuaggugcuaacaaucaaacaguaggcuucuacaagagcagcaagugcucuuaaccacugagccaucucuuuagcccugaaguuuuguuuuuauuguauauguuuacccuauuuucucagaacuuaauggcuuagagcuggaugugguggcacacgggaggcugaggccagccuguccuacaaaugaagacucagucucagaacccccaaacaggcuggggauggaugguaguacucaccuuuaauccuggcacuugagaaguagaaacagacgcaucucuugaauuuggagccagucaaagcuguacugugagacccugucucaaaagauuaaaacaaaaaaaucuuaaugccuuaaaauaguaauuguugcgauuggauggauuaguuaggcuuagcugaguaucuauugguuucauuuggugacuguugugugcagucaggugcacacucgcgauaguauggcuguggacaacuagugugaucuuuaucucgaacagcucucaaguguucacacauggcuuccuuuuucccccacucuucauguaucuggcaucuuuaguguuucuuugccuggcauuuuuucuguacaugacaucauccugaagggccucuucauaaggcuucuguuuccucagaauuucagucagaacucuucaaggauacaagaggggaaguugcugggcauuuuuuuuuuuccaggacaggguugcucugaguaguagcccuugcuguuuggcaacucacucuguagaucaggcuggccuugaacuccuuuaucuaccaaugcccagcuuaaguugcugggcauucuuaaggcuuaaaccuggagcacgccagugagggguuugugagcugaaucauucuccaagccagcgcagguucacugugggcugugaguccuaggcuuuaagccugguggugugauucaucuggaggagggagucauguccagucucggaaugugagccugagcuuaagagcucucugauugucccuucuuccuagcauucuguacaggucauauagaugugguagaaucauaaaccagcuuauuguggcacuuuggccuguuuagcaucuguauuuuuuuauuugcuauauauuuucucaguuucaucuugucuuguauauauuguaaagccuguucucaaguauuuuuguguccuaucuuuacucauuuguauuuugauguuuuuuaaacauaccuuucuucauuugugccaaauaaaugauguggaguuccuuguagccaacacuugucaccugauagcuuuagggggaguuuauguugauucccaaccacucuucccccuacuuuuccacuuguuaguacaggguaaaagauggcuccaguuucucugcagaugacauuuugucugacagauaaucuccuggguucuacuuaaggagguggggaaugcagagcauuugagggcugugugguguguguugcaggcaggcuuuugguuagucuguagguuuccauccugccugcugcuccuguugcaguguauuuggugucuugagucuggagccucugaauugagggugcuuuuugcagaucucuccuuggucacugcugucuccugaccuguacuugcacuugugagcuucacugaucacagcuccuauuuacagucaucuaauggaaaugguguuuuauugcuccucauaagucccuuuugcuuuucaaauuuuuguauuuauaaaauguuuauucuuuuguaauuuaguggagccuaaagaaagaugagaaaaauguuuaauuuuucuaacuguucagguuuuauuuucuagaggguccaugguuuuguuuuuuacuuacaauauauccugaacuugaagucugucuuguuuuuccuggguguagauuggacaacaguguagauauccaaguuaauuugugaauuauguaagaaaaauggccugauuuugaaucauccuuuguguuuugguaauuaauauuguuaggauagaugugguaauuuuuuguuuucacuuagagucuaagguuguugaaugguuuuguuucuuuuuuaggcucuuguuucacuucugcaucaagguucugacuuaggaagcuuugcugucucuccagcccucacaauguuucucucugcccuggaauuuauccaguaggcuaggcuggcuguccaacaagccccagggaucugccauaucugacuuguacauggguacuaaggaucugaauucaggucccauguuuacugccugagccccuccuuuagaucuucauagcuagccaucuguccuuacuuuccucugacuuuauccuucaugcgugcuuacuucuguauaguuuaguguugccuguauugagcuuuaagagucacacuauauauauuggcauguuuucuuugcaguuccuuuuuuauugcuauguucauuucguuguucaaaaagaugagaaugcccauuuuccacuugaguguugauagauaaugguaggcuguuucuaguuuuuugaucuuuuuguuugguuuguauuucuguuaagaguccuacuguggauuuucuuguuuguauuucuggauacucuugugcagucauuucucugggguacauacuuaggggguugcuuugcuaggauuaucucucucucucucucagaccuaagaguuaucuagacagaacgguacaauacuuuucaggugacuuuggguuacucuuguuuuugucaguacaugugaccuugcaagugauggacugacccgcugcugucagugcuguuacugcuacucccugggggaucccuccagaguguacucucgucuugauuuccuagaaagguuugguuuauggagauagguaugguaugcauggagaguguuguauacuuggugucuguuuuuagcauggaaaguguguuggugcggagaacccacauauacaaguguguacacguacagagcuucugacugaauggugccaguuccagaguucuaaguuccuuaguggguguuacauuuaguguuaauagauacaacuccaguggcugugugauuccucuuucuguguauuucauuuuccugucugauuuuucucuguaacuguggucucuguuuuguuucucaguauuucuuuggggguagccagaaacacuuacuauccuaaacuccucgcagagcuugccaccaugcucuuugccuugcauauuuuuccucuuguucuccagaugaauguuagaccuuuguguuccugucuuccagguccuuugaaugcuuuguucagaggagacugcuggguuuuuuuuuucuuuuacuguuuuucuucaaauguuucuuucuuuuuuuuuuuuuuuuccuucaaauguuucuuauuuccuagagcugucuugcccuuuuuauaguaacuuguucuuguuuugcgggugcaguagcuucucaacaggcauaaugauuccaguuagauuuuagcucugucuucuucacuaguugugcuucaggccauguguguggcuuuucugugugguacccucagggucuguuuucuucaugguacuuggucauuugcuuguuucuaggagagguaugguaucagccaguaccaguuuugacagauuucuguaggaugcuugucucuguuguccaguauguagaccuggguucugcugaagcuggaggguggagcuugugcggcuuccaacuucagaguguguuaggagauuucauucuuggguugaguuauaauaaagagguuuuuccuuuucucuuugguucuacugcccaucaggguagauaggguuccuauagaauagaaugguccuuuaauuagagcaacuuuccagcaguucauucaguuguuuuccuguggcuuucucagucaggacaucuaaaacuuuagcaaccauaggauccaucugcucugucugccgcugcuauaguugugggucuguauauuguuuuucuauaguugugggucuguaaauuguuuuucuagguagcaaugucauuuauuaucaaaguucgucaccucuccucccaaccucuguuuugguuuuaagacaggguuucuauucucagcucaggcuguccuagacuagaacucacuaugugggcuagcugaccuugaacucacagcaggccucuugagugcuaggauuacaggccugagccacugugcuugcuuucaaugagcuuuugaaaagaagcuagccuugcuuguuaaaaugaaggccuuaggacuucaugagccuaauuggcuuuguguuuuugucaaauuacuuauccuuuggggaaggguauugcuuaccuuucucauuuauaaaauguuaggcagggacgagucugauggucacagacauaggcuagagcugcaugucagaaucaccuaaaaugcuuuuuaaaaaacuuaacuuuuaaaaauuaaaauauaauuauauuguuagccuuguccuucaaacaccuccaaaguaccugucuugcuaucuuucaaauucauggccucuauuucuucacuugucuaacaaacacacauacacacacacacacacacacacccaguccauguaauauaacuguguggucuuggugugcccuccguuggggaggacuacuucuccgaugaggaggauuucuucuccgacuguugcacagcccgcucuguguuugcauuucauuguugucauucuuguucacaucuuauuuagauaaccaucauggugagacuucagacuuccucuuccuuccucuggcucuuaaaaucuuacggcccaucuucugcuaugagccugaaccuuagauguaggaguuguguuguuagauacaucaguuggggcuggacacuaccagcccacuuauucuuuguguuuugauugguugugguuuucuguaauagucucuaacucuugcauugaaaugcauuugaagagagauucucugggguaguuagcaucucaacaaugcuuuuuacccuuggugcagacuuguguuugggaccuugggacugcuugguagcuguguuauuucuauuuuugaaaagauaccaaaaauaaucugguuuagaaauacagaaaaggguaaacuacaauaauuuugggaacugcuugcuuuucuuauuuugucccaggaaaggaauaagugauuagagagaugcagauuuuagaacgagucugagcuuacauguaccugacagauuuuuccagcucacugauuuugaagaguuaaugauaaugaauuaaugaggguguuuuguuuuguuuuguuauuaagacuugugcucucagagcaucuaaaaacaggccuugagacuccuaagauccugguguucugauuugaucucugaguccuaguuucuugauguuuuagauauucugggucccaaacuaaaccuaccuuuaugaauacagauauauuucccauauugagagauggcaaacuuugcucuggcaagagacuucaugugcgacuguaaaaucccacgugacugcuguguggaugaguagcaagcccugccuuaggagaggugcuucacagcagauagacuggcucucagucacucucaaguacuuacuucuuuauaacaucucaccauuuaaaaugcaaggcagaugaauuuauagaaaaaucaaugguuuuuuggagggggguguuaauuggguagauaaggaaagaauaauuuggaucauuuauuagaguagaacauauaaguaaaaaaauuaaaauuagguuaucuuuaguuuuuaaauuucuuuuauauuugauucccuuuguucuuaaggcaucugcuacauuggauugacuugaaauuauuuaauaagcucugcucaugggacuguagugacagugacuaauaguggccagcuuuccuaugugcucuguauagcguuggcacagucuuucucuguuucagaaugggacaacugaagaaguaacuucagaagaagaggaagaggaggagauggcugaaguagguauuuauguaagaauaguacuucaugaauaucuaaugguguuuucuccuuuuaauuuuauuuguuuguguguguguguguguguguguguguguguguguguguguagguguucguggcauguagaggucagagggcaacauuugagaguccauucuguguuucugccauauggguucaagaauuggacucaagccuuagacuuagacuccggggaacuucccuuuauuggcugagugguccaucucacugguucacaucucaugaauaccuuaauauuugaucauuuuaguaauccuuuaaucuucuuuuugaaguaauauuaguguugaauaacaaaaacauuugguauuucaaaugagauauacuuucuaaaaucugguuuuguuucuaauuaacaauaugccuuugaacaaauuuuuuuuauuugagggcaguaaaaauuguuuacauuuaauaauaguauuuugcuuauaauuugguuaauuuuaggaaaaacuacuaaguuuaaaguuuuguguuuacaguuggggagauggcucaguugguaaagugcuagcuaugcaaguacggguacaugaguucagaucucuagcacucaugauuagaaagaaagaaagaaucaagugcugcaacuuacaucuguaacuccagcucuggggagguagagacagaaggguuccugugacucuuaguuagagccaggcagcuagaccuagguucagaaagagauccuguuugaaaaaaauaagguagugacugaggaagacucauuuguuguccauacacacaugaaccuaacauaggcaggcagacagacagacagacagacagacacagaauuauguuugaaugaaagguaaguuugagggcaucacagggacuggacugcuugcuagaagacauuaucucuuauugaaaaaacaucuaagggcuuucuguuagucugcuuugugcugcuagaauuagaauacccaggacuaggucauuuauauugguauaguuuugagagcuaagaaguuuagaaucggguaucuugugaggauuuucaugcugugaccucaaagaauagaaagggaaaggacaggagaacuuaggcauauaaccuuuugcgcuuccuuuauaaagggcuuaauuccaugaucaaggaaggaaggcucaugcuuaaucaucuguuaaaggcccuauuuuuuaaaaaucuuuuuuguuuuguuuaagauaggauuuccuuuguguagcucuggcuguccugcaagguugcucuauagaccaggcuggccucaaacucagaaauccaccugccucuugaguacuggagauuacaggcaugagccaccaaugccuuuuaauauuuuuaauuuuuauacuuuaauuuuuuaauugaaauagaaugauaucacuuuccuuuuccuuacucuucccagcuaccuucccuugaacccuucccaugucccucgacucccaaguugauagccucuuuuucuucauuguuauguauguuaaauaugaaugaacaagugagugugugugucuguguacacauaaccugcugugucugguuuugcuuuuguauuugguuucaagccugaccauucugcaaucgauaaggaagcuggcucaucccugggagaggcuauuuuuuccuaaauuuuucuaaaaagugcaugcccucacuaguucuaggagagcugccaagucucccgguaccaggcaugacuccccuccuguugagugggucuuuaguccaauuagacugcuguugcugccaccaacaucugagugccaccuccugccccuugaugcauaucugccaugaugaaaauggcgguucauaaguguuaccccuggggggacugcucccuuccuuagcagcuugcauauuauuuaacugcagcuguggagcuggacaggacagaagccuucaggacagauccagcucagaucaucagaguccugucuuaagaguggugacauuagcaauagggaugguccuugucuuaauacuaucauaacaccauaccugauuuuuggaggggaacauuuaaauaacaaguuuuguagcaacuuuccaaggcauuaagauaauugucaguuaccaauagaucuuuaggcuuuugaacauuugaauuuaaauucagguuuugaaauaaagauccaaagcuccauugaccagauaaaaugcauaagaauuucaugaucuuuagcuuuaagaaaauuguuuuuuguuuugaaucuuauaauuauauucagacuuuuaccuuauuuuguuugaaaaaaaaaucuguuuaaaauguacuuugagaaugggucaaagcaaaaggagucauuuguuuuguguccaggaguagaauaacucuuaaaauucuuuaaucggagcgacuucgguggaugggcuguaugcuuuacgguuuucaugaaguuuaauuuaggaggaacaaauugcaugagaagauuaagcuuccccagccuggcugcagugaaacagacuuuguguucaguuucucugcuuuucuuuuacuucucaugagauugacaaggggcagugauacuuagggaaguaacacagaagacucugcaauuuuacuagaacuagcguggcugaccggccugaguguagugugcuucaggcacuuaagcagaggagaggaggcuccuagaauacacuggaagggaaaagcagaguuagagacaacaugcuuguuggauaagguuguuggucauauaagcagaaaaugguuugcuguggauauuguuuucggaagaugagguacauucaggauuugcugacuaaagugcagguaaaguguguggauggagaugacuugagguuggaggaggagauacagguuaaggagacguuauugaaauucugaagaaaacaaauacaggacaggagagaagucuucauaacaugaagcccuguguagaaucuggcuaagaacacaguguaauuugugaaaggagaccugcugaguugguuuuguauugaagguagucauuguccuucaauucagauugcauggaaaguggagguaguggguaacuccuucagagaucuugcuaauugaaacuuaaagcaguacuaagauacuuggaaaagccaguaccagauagcuugggcauagauuuguguguguguaagaacaaaugauacaggaaagagaauggucugcaaaagauggucugcagguguuuuucaaauucuuuuucuaaaaacugcccuaaaguuguuuuuaaaaaaaaucucaaaaaauuagcacuuugcguuucgguucuuauucugagagcauggagauucuguauuuccuuguuuucauuucaggguuuuuauugauagaaaaaaauuaugcuggcuguguguagcuugauugguaaugugcuugccuaagcacgcacaagguccuggccuugacccccaagcaccacacagaagugagcauguggcacuuacuuagaauccuagcacaagagcuauucaguaggaguaucagaacaucaggauuaucuucagcuacauagggcauuugagccagcccauggcuacauaaaaccuugucucaaaaaaaaaaggugauuuaguauccuaaugaccccauaauggaugauccuuugaauuaauugguuuuuguaucuguagauuuuuuuuguacuuaucagaacgagauggguauaauuaugccuaaauuauuguucauauuucuuagaauaaaacucuagcugggcagugguggugcacgccuuuaaucccagcacuugggaggcagagguaaacgaauuucugaguuagaggccagccuggucuacagagugaguuccaggacagccagggcuacacagagaaacccugucuugaaacaaacaaacaaacaacaaaaaaacaaaacccaaaaacuguaaggucagguuucuagaacaaaguaugaguaauuaaagggucacuaaauuguuugaaaaguuccucauaauuggagauuuuuaaagguggcagauuugauaauagucacaacuuaaugaggcugugggaucugcuuuccacagaacauaagguauuaaaggagaaaaccuugugaguggagucuggggcuuuccuccuccuccucuuccuccuagaauggaugcauccuuucuugcuugugcuuuuaaaauuuuauucaauuuuuuuuucugacuagaaaccagugaagaagagaagcauuaauaagccuuuuauucucuuuguaggauauagaagacuuggaucacuaugagaugaaggaagaagaaccuauuaaugggaaaaagucagaggaugaagggauugaaaaagaaaauuuggcaauauuagagaaaaucaggaagacucaaaggcaagaccauuuaaauguaagugugaguaaguaucuagaaccugaauuucgugauuacauaauuacagaucgagauaccaaucucagcucccuuuccauccuugacuuaguaauggauuuggucauuuguugaccuacgcugcuucuccugauuguugacagccacuuucuacccuguucaucuguucuucacaucuugaaaacaaacugcugucucuguauaagaauccuguguugguuaguuguaauugucaacuugucauaaccuuagaauuaucaugggaagagggaucaucuacauugcauuggccugugggcaugucugucaaggaacugucuuacuuacuuaacugaugcaggaagacucagcccacugugggugacaccauuugcuagguaaagagucuugaauucuguaaagaagacaaaagcugaacugcagucaagcaaguggguaggauuguacauguucauuugucucugccguugucuguggaugugguaugacuaucuauuugaaguuauuucuuugacuuuucuguagugauggacuguaaccugguauuguagauugaaacaaacccuauucuuucccuaaguugguuuuuugucaggguguuuuuaaucacagcaacagaaaggaguagaaggaccucucucuccuucauccuguugcugcuguacuuacucccguaccauagguucuguuguguucagauucagccccugcaaacuauuacucugccucugcucucccuuaaacccgaccucugucuuuugcacccuaaccaacucaaaaguaacuuuucucuuuagguugacucaucccugcuccuuacccccaacagagucugaacuauguagcuauggcuagccuggaacucuguguagacuaggcugccauucaauucagaaaucugccugccucugucgccuaaguucuaggauuaaagguguguacuaccuaccaugcuagaugauuuaacauacuauuuaugagaagaaacauggcaauauaagaugcauaguuuagugaaaaacaugcauguguggcuuuggauuguucaacuuuaaaauguagucagacaguauauaccuuuuggaagucuugugaaaaaugaaaauggguugguaggguaugucaaugccaauaugcauuggcagucugguugucugacacuuccuaccuuguuuuagagcagcuuauuaagcucuauaaagucagggccagcugcuuuguuuuaggcaaacacagugaauggauuguuauacaaguuaaugucaagaaugaauuauaacaaguaaauucuuuuccuuccuucaaucauauuuaauacacuauuuuaauuggcaagucuuuuguugcagagaacuuuaaccaagcccauaucuugauuauuaaaguaaguuuuguagcaccugaauuaauacuuuauuugcugugucugaugauggacuucaguuuguaugguuauaguuagaacaucugcaagcuauuggauacucugacauagaauaaggcuaaguacuuuauauuaccuucccauuucaucuucauagaaucuuuaugccauugugggaaauagacauucuucauaucuuauagauacaaaaacuagggcucuuaaaaacccaguuuaagggcugugagaugguacaguggcuaaagugguugccucucaagcacaagcguuaggacugguauuugaaucucuagaccccacauaaaugcugagcguuugugcuggccagccuauacuuccacugcucaggaggaggagacaggauccccugagcaagcuggcuaauuaaacuaaacuguuauucagugaauaagguggaaagcaaccaaagaugaugaucuacugcccacaucagccuugggccuguacauguguggguacaugagugagucuacagauaugcaaauacacauguauaccacacacacacacacacacacacacacacacacacacacacacacacacauauauauauauauauauauacauacauuaaaaaaucugacuagguugcacagcuaggaaauagaucuuuaaaaaccuuuaaacucagaguaguacaaccuucaaacuuugauuuuuaagaaaaaauacucuuauuuuguaugcauguguauggaggagagggugcuugucacagcacaccuguggaggucagaggacaacuugugcugaaguuaaugcuaaaauguuauagugagggucuuguagcauuuuuagaaguuguaguuuggaauagacucauacugaacucuaaacugucagaguccaugguguucugggcauacuaugaggccuccccucaggauagaaacaagcaacacaugucuucaguuuucuguuuuucuuaacauuucauaguccuuuaauugcacuucuugauuucuuaauacugagugguagucauuuuuacaauguuacuguaaaauuuuacaucaggcuuugauaccuuaagccuuuaauuauuaauuguuucagggugcagugucugggucaguacaagcaucagacagacugaugaaggagcucagggacgucuacagaucacagagcuacaaggcaggugaggcccuggcucugcuggccauuugcuucuuuacauggaauguuguuucucuuuugcuuugcuuuccuuuuggggagugauggggggaccauuuagcgcaaacuguuuuugaacucacuauuuuucuguuuggucaugaugggguuagauaauguggggccaccacaccaacuuugugucauuuacuguaauguagguagacagaguuggaaauuuuuauuaauguuauuuuagagaugugaaacucagguuuaacgaaauucuaaaagauaaaagagauaaaaugaguuuaucuuuuuguuuguauuuuugcuuuuuuagacaggguuuuucuguguaucccuggcugcccuagaacuuauucuggccucaaacucaggcuggccuuggacucagagauccaccugccuuugccucccaagugcuggaauuaaagauguguaucaccacugcucagugacuuaucuuuuguauuuaaaaaacaaacaaacaaacaaacaaacaaacaaacaaacaaaaauuacaggggcuggagggaugacuuaguaguuaagagcacugacuacucuuccacagaggucuugaguucaauucccagcaaccacaugguggcuuacagccaucuguaaugggaacugaugcccucuucuggugugucugaagagagugacaguguacucauauacauaaaauaaauaaaucuuuuuaaaaaauuacauaacuuuuuuuugcccuuuuuucugauaaagauauaauauaugauuuuuauuuucuggcaaaagcaugaguaguacuacuuuuaaaaguaagauuaauauauuuuguuguacaaggaaaacuugcuggauuuauuuucauaguuuucuuauuuugaaacagaacuuacaauagaggugguauucuuuuuaaaauugguagauuucauucauuucacaauuccaugaaaaaaaauuauuuuucaagacuguagcuguagcucuuggguagaauacuugcccaguguucugccuacuugacauggggcccugggauucaauccucaaaagcaggaauuuuuuuuaaacagauaguaagauuuguguauuguagagccugaggaaaaauacacugcuguaguguuaauaaaaauaccaauuuaggaauaauuuauuaaaaagaauaauauagaguuguuuaaaagauuaauauuaagagcuggagaguaguuaagagcacuuugugcuuuuggagaggauacaaggccaguuuccagaccucgugucaagcggcucacagcugccucuaacucccagucuaggguaucugauacccuacggccuccauaggcacauacacaggugguauauauacaucgacacagacacauacauaauauaguacaaauacuaaaaagaauaaauuuacaugcaugcucuaaaaauggggacaguagaaaaaagaugucucauaaagugaagcuuaaaguaauauauauagaaggauauuuucuuagaagugucuauauacauugaacuguuacuugcauaauguuuguuuuucagugaaagugaguacuaaacaguuuuuuaaaauucauuuaaguaucuuuuaguugauagcuuuaguuauuuugauagugaaaauuugcuguuauugacuguuuaguauauuuagaguuagcuuacaccagaguaauggaaaugaagaguaaccagugugcccuaugucuccauagggauuuauucaguggagcuaauaaaugacagcuuauaugacuggcaugucaaacuacacaaguaaguaccuucugugcuagcuacccuguuuuuuacaaugaaauguuggguucucuuuccuuuuuugccuuaucagucucauaguuuuauauucugcaugugccugggcagcacugcuggagaaguuguuaaguuaccauagagagcucauucugagccucaauggggagagucagacaacggggaggaguggauaggcaggaaguguuuggcacgcuuaugagagugugacaguuuacaaacaaaauguauucagauagcaugagccugugauccuguuuauguuugaaauaaggagauuuagauaguacauauagaagaauuauagaaaaaauguuuuuauagugauuuacuuuuggugguauuauuggcgguaaauuucuuuucuuaaacuucuugguuaaaaauauaauuuuaggaaaggaaagcaucaaaauguuuuucaguuguuugaaaaguuauguguaucuaacuguuguucuuuggaaugaccauuaauuucagauuuccuuuguucccaaggagcuagagagcccauagugacaccccccacccaccccaccccggacuguggcacacuuuagaacuucuguuuagaacuuaccuuggaggcucuguugccccuuuuggacugguucaguuggagcuuaguaagaaagguuucucuaaucuuguuugaacuggcuuuuguuuuguuauucuuaggguugacucugauaguccuuugcacagugaucuucagaucuuaaaagaaaaagaaggcauagaauauauuuugcuuaacuucucuuuuaagguaagaauauuguaaugggauucauguccuucuaaugggaguauguaagugacucagcugccuuggagaacaauuugguaggauuugaguucaggauuuuuuuuuuuuuccuuuccuuuucuuuuuuuuugagacaggauuucauuguguagucucagacucacagaucugccuacuucccuccaacucccaaguguuggaauuaaauguugauacugaguuuggcuaguuaaggaguuguugagguguauacuccacaaaagaugaaugcuuagacaccuggaaacacacaagaauguguagagaagcaugguuugucauaaccacaaccaaaacaauccaguuauaguaaauuggagaauguggcauccauaagagauauugacaagauaggucagucuucuauauaguauauauaaguagaagaaauuagacuuagacuuuuagccauuuuguguaguuccauuuauauagaauucaaaaauuguaaaauuaguuuuguauagggcaugcguuuugagugcaggcaagggaaauuugguccuguaaaugaaacauucuuagguguuuuaauggucuuuagccacaaaaacuucucuuguacuaaaauucaauggggccgggaacccugcuaaaacuagaaaaaacauuucuagguagacuuuuuagguacgaaacagugagaaaagaaagcucaaaagcaugaagucaguguucauaccugggcaacaggaccagaagcgaaggugugaucaccauaaagaguuacugaguagacagagacaucuguaggcuuccuguuagucacguggguauccuguuuacaauaauugcuaaaguuucccuguauauuuaugucccuuuuggaauuacuuaguaauuugaagcuguuaaaaauaaagguuaaaaaagaauagcaaugggcucuagauaaaauguuagugauuuaauguauauaauaugguaagaucuaacgauuggacaucucaacuagauugaggugcuuugaggcuuucuguugaaguggccagggcugcuguggugagcugaggaggagauuagggcagugucuguccacagacaguaguuuaucagagugacuuugauauccucgugcuauuuaagggcuuggauuuacaguccucucugggguaaaagggcuuuucaagaacauacugaaaagucuuacaggcucugggaugugcucuuugugcuguaaaccagccauaggggguuuuuauuugagggcauaguuggucuguucggcuucuuguuuuguuuuaaacaguuagcucccuuucguuggcacugguugauaguacauaguugaucucuggcugacuaguuggaggcuuuuacuuaaucuugcaaagaaaugaugcagagcuuguauauauggcuuuggugcuacagguggcacagguggauauaagauguuugaaaggaagaaaacauagacauuugucuuagucagggucucuaguccugcacaaacaucaugaccaagaagcaagcuggggaggaaaggguuuauucggcuuacacuuccaugcugcuguucaucaccaaaggaagucaggacuggaacucaggcaggucagaaagcaggagcugaugccgaggccaugaagggauguuccuuacuagcuugccuccucuggcuugcucagccugcucucuuauagaauccaagacagccagcccagagauggucccacccacaaggggcccuucccccuugaucacuaauugagaaaaugccuuacaguuguaucucauggaggcauuuccucaacugaagcuccuuucucugugguaacuccagcugugucaaguugacacaaaacuagccaguauaauugaccccuugucaacuugacacacaaacacaucacuaguaagccucaacccuuacauucuuauucauccccaaggucuaaauaacuuuaaacaucccacagucuuuacauauucuuaaaauuucaaucucuuuaaaauauucaucucuuuuaaaauccaaagucuuuuuacaaugaaaagucucuuaacugugggcuccacuaaaauaguuucuuccuucaagagggaaaauaucagggcacagucacaaucaaaagcaaaaaucaauguccaaccuuccagugucugggauccaacucacaaucuucugggcuccuccaagggcuugggucacuucuccagccaugcccuuuguaccacacgcgucguccucuaggcuccagaugccuguacuccacugcugcugcugcucuugguggucaucucaugguacuggcaucuucaaaacacugcaugaccccuucaguccugggccuucaauugcaacugcggcugcaccuucaucaauggccuuccaugaccucucaccgugccaagccucagcuguucuuugugaccccuucaugccuucaaaaccaguaccaccugggugacccuuacauauuaccaagucccguuggagcaggaguacaaccuuggccauaucuggaacacagccucuuugugcuuucagaaaacacuucccagaagaugucaccucaaugaugcuggucucuucuuaaucaccgcuaauuucuuagcuccagcuaaccagcaucaauagucccaguaaugccaaguuuuugcuuuaguaguucugguaucuuguuaaucacggcugacucuucagccccagcuaaccagaaccacagaaucuucacaaucaaagcagcaaugucccugaaaagagucuuuaauuuucccucugaaauuucacaaaccagaucuccaucuucugcacuguucucaacauuaucuuccaagcuccuacacaacaucugacagagcucuuaacaaugaauggaucuucaagcccaaaguuccaaaguccuuccacaguucuccccaaaacauggucagguugucacaggaauaccccacucugcugguaccaauuugucuuagucagggucucuauuucugcacaaacaucaugaccaagaagcaagcuggggaggaaaggguuuauucggcuuacacuuccaugcugcuguucaucaccaaaggaagucaggacuggaacucaggcaggucaggaagcaggagcugaugcagaggccauggagggauguucuuuacuagcuugccuccucuggcuugcucagccugcucucuuauagaauccaagacagacagcccagagauggucccacccacaaggggucuuucccccuugaucacuaauugagaaaaugccuuacaguuguaucucauggaggcauuuccucaacugaagcuccuuucucugugguaacuccagcugugucaaguugacacaaaacuagccaguacaacauuaaagaauauuuucuucuuagaauuuguaaaaagcuuuauuaguugaaucccagggcacagcuuauggagaagccucuaggcucugaaguagaauuacuuucuggaauuucugaaacugaagguaguucucaaucagucaaaagagguuuuauaguucauuugggaucauauauuuaaauaaagaccuauuuuaauaauaauuuugcucuaccaagcuuuguauccaugcuuuuauuauacuauuaaauuauagauagauuuaaaaguagaugaaagugucacugaguuggcaucuuguauggacagguguuuucauuuucuaacuugcaguagaaaugucgcacuggacaaacccauccuucgcuaggagggcuggagagugugcuagucauuuuccacuuguuuucuuggaaguaauuggaugcgacauguuuaguucuaucuugccucaaaaugaguuuuuaaaaaccauuacuucauguuguuugaacauaaaaauuggacauaauuuuuguuagacucucuuggccugccaucaucaggagcaggaagccuuucccccuccagcugcuguaggaaguuagaagcagcuuuccuuaccuggccaucagggaacuaaugucuaacacucuugccugcuuuaguuucugucugugugacaucggaugacucucaccuuuuuagggcuggagugaggcagggucucugacuaaccuggaguucuccagggugucuagacuggcuggccagugagcucaagagacccucccguccacguguccucagugcuggaaacacaggccugugccagcaaaccugacugucgucuuugguuccgaggcuggagcucaggucauucugcuugcacagccaucuccucagcaccaccucugacuuuuugaagcagcuuacccauuguauugaauguuacuauuguugcuuaccauaguauaggugaucuuucuacuugucuuuuuguguucuaucucucuucccccauccuguuuccuauuggauuuucuuaggacucccauuuccugccuuuuaacuuaguagguauauguucucuuacucaugcucuauauaucuuugaauugucaaaguccaauauucauuuuuugccuuuguaaugucauagccuuuagcaguacuucucaaacuaccuaauacugugaccuuuuaauacaguuucucauguuguggugaccuucaaccauaaaauuauuuuuguuguuacuucauaacuaauuuugccaaguuaugaaacauaauguaaauaucugauaugcauguuaucuguuaugugagcuggguugagauccaccgccuuagguucucaguacaugcacuuacagucuuuacuuggacucugagaccagccaaacuuauucucucagguuauagcuagcauuaucuuuuuuuuuuuuucugccaaacuauuguuaaguuuucuuuuuaguauggcuuugcagaugggaaaaugcauauuuuauuucugcuuuauuucuuuuucuuugagacaaggucuuguucugaaucacaggcuggucucaagcuuguuacccucugguccugcuuccuggcugcugggguugcagguguacacugcucugccuggccguaauugcauuuuugaggaauauagaucuuuagguuugcaaguugucaacuccuuucagcuccuugaagacagauaucuuucuuagcauugaagauucuagacuuuccugaaagugcuuacaguggucaagcauugagaagucuuuggagaauucucauccauuuuucuugcccucuucucucuucuaagacucagacaugugugauaaagauugugucauuauuuucugcauuuucuaccucuuguaccuuuuggggucuuucccaaauucauucugguuguuuguuauuuauuuuccuauuuauugaaucucuguacugcaguuuguugacauagucucaguugcccauuggguuuaguuccugcugcuguggcuccagaucagaaucuuuauggguucuguuguaaugauauacaguucugcugugguuugguuucaucuucucuuccuuccagauguucagcaguuuugcaacaugcaccuguugacucugucucauugugguuguccuguugggcuuacaucuaagucuuagcauugauggacauuaugugugaaaggcugcagaggaggguuucaguauuguggaagggauuagcauuugcccugccagggccacagacuggggauaccuaggcagucagugauggagauuucugagagccagacuugacucccuacaaggguaguuggccguuggucccccguggcccauccugacgugcggaaggccccaggauguggccucugcugugcugcagcuccagcuuuugccucccuggcugcaagucugcauucuguuguuugcuaaccucuuccauuccucuucuauaguggaaagaaaaggccucucccaggcuugaccacaccaugcugcucaguguauggugugagugagugagugcagcucugcgcuguucugucccuuauuugauggcuuugcugcuguugcuuguuucucaucuguccuuugauacuaauuucacuuucaugacuagguaauaaaagaggauacauuucuuuauugauuauuugaaaaccuucuagauaaugcaaaauuaaaaauaauguucuuaaaauugauuaaacuuacuuuuuuuaggauaauuuuccauuugauccuccguuuguuagagugguguuaccuguucucucaggaggguaaguuuacauauuuacuuuuuuugugauaguaugugucagaguccuuugcagaacugucuggagccugggaggucaggauugcuggacuugacacaggauuuugugucagguagguugaaggggcuugagaacuuaccuuucugagaaguucucaacugaaacugauaguuugggguccacauucacaaccacagguacaaauuacuuacuuauaagcagacauccuaauggaguuuauuuauauguguugacucuuuagagaugaguuucagcugaguguaccugccuguaaucucagucugucagaaacugaugcaggauugugaguuccaggccagcuagagagauccuuccaaaucuguaucuggauguuagguaauauggucaguagcuaucaaaauacugucuuuaaaaauguuuuucaaauauaaaccacgcuugaggauuucaggaaaguuuccguuacugugguucucacaggccugugaugcugaguguggucacagugauaauccgguaacccgaggcagcuguggagcucaucucugcauaaauaguuacuuaauacaauugacuggugauugucauacauccguacugaauuuuguccugcuucuuuuuguaguuaugaagcuaugggaggcaugacaaagaucaaguuaauuaugauauauuauacaaucccccauaugggcuucacuaaacuacuuguaggggagcaggggcgauggcuccguugcuuagaguaguuguuucucuugcaaaggacucaaagucaguuucuagcacccaugugaagugacuuacggcuacccaguauuucagcuccaagggguuuaaucccccuuccggccucugcaggcacacacauaaauggaaaaaaaaaaaaucuuuuaagaguucucaaauccucagcuaauucuauuuugugagaugaguucuacuguaauaauaaaaucuaaaaacauugcccauaagcugauaauucauguauuugagacaguaguagugacuccuaaagaaagacuuuagaucuucucagaaauagucucuuuuaauauauagauguacaaaacaaauauaacuauaauuuuuuguuuuuguuuuugagaucacaaccugguaaaauuucucaauauagugagaauauguguggccugauguugggaaguagaguauggcacaacuggccaugugucuguaaagcccagcaggaacaggccuguguuugugacguguugagccauuuagaugucuacaguacuaucacggaguacuucuuuaacagaugacuuagguggucccugcagccugcuccuuuguuacaucuuccagaaaguuaugugguauauuaggccuuaugaacaucaagcucaaugauacucauuccaaagggacuuguugaagacuuggugugaauuuuucccccccacaaagucacuaaauaacagcuccuauucuguuuuccacaaaucacuuaauaacuucuaauuuuuuguggccuguuggcaucucagaagauggcauccucugguuuacuguuugggaaauguugcucuuucagaaacccaaaaucuugagcgauccucagcaaggcugaagugaucccuuagacaucuugcuucugcuuuuggcaaacaguuacaacgcugaucacaaaugcuguuaggcugagugggaaaucacacacucagagggcacacacaaagauguuucaaguugucaaguuucauuucguuaccuuuaaacauucccgcaugcuucuggguuaggcagugaagguaguuuuucuaucauaaagcccauggcuauuuuuggaaggagaauauuagguaaccuagccaaauauuuacauacacaaaauaaacauaggguggaaauauagugaauuuuaaacuuuuguaucccuuccucagaacaccagcccuuuccuagccaaguguaacaacauuaauuuuuuuuuacaguuuaguguugcuauaacauuguaaauucugucacaaguauuuuuuuucuccuuucucugguaagcauauuuaacggugaauauuggauuuaucugucauuaacugguauguaggaaaaaggaaauaauuuuuuaaaauguucuaggaauggaagagauggcucaguugguaaaaugauugcugagaaauuaggaccugaguugagaucacuagacccuacauacagucuggguaugauggcuuauuccugaagccugagcacuggggauguggggaaaggagaauccuugaagcugucuggcuagccagacuagcaaauuggugagagguucauugagauacccugucuuaaacaguaugauggguagcugggguuacuucuagccuccauaguguauguaacagacacacacacacaccacauauauacaaaagcgaggaaaagcacccauagugauggguccgaccuaaagacuauagaugagaucccauugccacaggaucaagugucagaagaccuaauggaaggaggaggaaggugggaaagccuagugagggaacaccaaaguagcuucuuucauagcgcagcuacaaaacgaagaaaaacuauuggcugaucucaaacaacaaucucagaaucagaagacagcuuaaauuuuguauaaaucuauagaaauggaggcauguuaaggggguaugugggcucuauugugccaucucaacaaaacacugaagauugagacuguacagcugucugcaacuuucagcagaguugucagccuugcaacagaggugcagagaaagcuccagagacugaauaacaugaguguguggccauuaagaaaacagauucuuuugcuccuguucucugggauguuuggagccaaguuuuuaauuuuugacaucagaaaaguuuaguauucuguucaacuuauuugacaaguugauuauauuagaguaaugacuauaaacauuugaaauuggccgcagucuuaugucucuaacaacaguuuuuauuuugguauauuaucuucuaauuuugugugaguacugucuuaguaauguacuuaaguauuuuaaggaggauuuuguaugcuugcuuuccuuuuuuuaaagguauguguuggguggaggagcacuuuguauggaacuucucacaaaacagguaacucuuguguacaguucuuagccuuaguggacuauuuuccuagauaagauggauucuaagaggaaagaucuuacauguaguagcaccuacuuuuauaaacaaguucaagguaaaguaguaaguuguuguuguacuuggagcuuguuccaugcuggaacagccauugagagugauguuaaucugaaauuauaaucuccucaguggcauuuagaacagggggugguuugugagauuauagaaguggcccaguguuuuuccugucacuacagauuuguuagcacugauuugcuguuguugggguccuccucugugauguuuuacuagguuuuucugaaugggaauugugaagacugcugaguuuagaugcaccuuguucuucccacagggcuggagcagugccuacucaauagaaucugucaucaugcagaucaaugccaccuuagugaaaggcaaagcccgggugcaguuuggagcaaauaagguacuugacgaagaacuccacagacgugcuggggugcccaggcuagcaugccucacaucugaggcaucuuccugucuugauucuauuuuuaaaauuuauuuuuguguguaugaguguuugccuguguguaugugucuguacuguaugugugccuggugcccuuugaggugagaagagggcauuggaugaacuauaguuauggacaguugugagucaccaugugggugauuagaauugaacucagguccucuucaagaaaaacacuccuaacugaggagccuucucuccaggcccccaucccccauuguaguuuuuuuuuuuuuuuuuuuuugagaccauuuauuucuauucuuuuuuauuugguuuucuuguuuuagaaaaguguagguagaaaacauagauguguaagagaagauacucauuacaguuccuuagccacauugucuuccauagucacagucauguuuagagucugagcuuauuauggcuaaauauaacacgcuaaguaaaaagcuuggguggacuuugagauuucucuaaacuggaaccauguuagcaucguuaauuuucagccaguguguacaugcuggacucuauucuaaucuacaucgguaaccacuucaacccuuucauaaccuaagagaaauguucuguugucuucauuuuauagauaaggaaacugaggcacacagggucugauaacuccuaaggucaaggacucaagacaaggguuucaguugggcaggcauagucuaagcacuuauucacugagcugugugcugaauuuacuucuuucugggugagauugcaguuauucauagauauucaugauguguguuuugaaaaaaacuucugugauggaaaucaacuuugaucugauacuuuuuuguauagugaauguuuccccuaaaguucuuuguaaaauuucauugcuuauucagguaguaagauuuauaguuauauuuuacuucaaaucaugagauugagauuauuuuagaauguuaauccacagaaaaaggaaaauguaaaagaucaugugaaaaaucaguauuugggcugauaguguugcuuguaacagcuguuuguuuauauggaacaaaaaugccauuuguuuaaaaucuaaaguuaggcagcucaccaauguccaauaauucauaucaaacaagcauuuacuuauuuauuuuguucguuuguuuguuuuugaagacaggguuuuuuuuguguagaccagucuggcuuagaacacacagagauccacaugccucugcuuccugagugcugggauuaaaggcaugcgccuucaccaaugaaugggucagaccaacauuucuuaacaguauauaugacucuauuuuuuuaucuuaaugugucaauaaaaugaucauguuguauaaucuaaaacuuuuuuccccuucccuucucccuccucccucuugcucuggccucgcucgcuccggcccauaguuuuuuuguuuguuuguuucucauuacggaugguuguaagccuccaugugguugcugggauuugaacuccuaaccuccagaagagcaguaagugcucuuaauugcugagccaucucaucagcccaaucuaaaaccuuuuuaauguuaaaauauuugcucaugcaaaguuccuaaaguaaauaauaucacaaaaaccugaaaaggugacuuguaauuuugaguaccuagaaauaaggcacugacauguucuucagugcuuucuuccugggaucuauuuauauagagaauuugauguuaaauuuuacauguuuuccauuuuaaaagaaaauuagaagggcauagaacagugauuuuuguuuuucuucuuucuuuuuggguaauugaaaucuaccuguauaccgugcaaacuuuucuucuccugagaacuguguaucaacuacagaagggcaggggaauuuaaguucucuauaguuugaaauucuagaaccaccaguauuauuuguuccacuucaauuacuuuaaaucugcauuuuuuuuuuaugauguguaguuuucuuggcaaguaagaaaaagcauuauacuuaagaugcuaagucaggcugcugaguacuuuuguauauugaaguacgcucauacauugcuuaauuguggauaucuuuuugcaauuuuguuauauaaacuauagcacauaccuaagauggcuguaaagacauagcuuauagaaucuuugagaccaucauccuguaugcuuucaugguugacagaagugacuuuaugugguuaguacaguagaaggugaauucagggagauuuuuaggauaaaaccucacucuuuuuuuuuuuuuuaauuaaaaaauauuuucagcuaagaaaguggaaacuuuguacaauauaauagaauuccugaauuacauacucugcaggggauagucuuaaguauuaacuuaaaaaaaaauacuacaaaagucugacauggugauucauaucuauaguucuagcaguugggauguugugccaggcuacccugggcuauggagugaaacccuaccucaaaagcacuaaaaucgccgggugugguggcgcacgccuuuaaccucagcacucgagaggcagaggcaggcagauuucugaguucgaggccagccuggucuacaaagugagcuccaggacagccagggcuauacagagaaacccugucuugaaaaaccaaagccaaaccaaaccaaaacaaaacaaaaaccacuaaaauccuaaacaaucaaaaaagaaagcugaauggugagagggcucaguggguaaacacauuuggcaccaagccagagagagacccugagcucaaacccaaugggagaaccaauuuccaagguuaucuugaccuucacauucacauuauaguacaugucucucccuguguucccacauacacacauaaaauaaaugcaacaaaaagggaagauacagggcuugaguagaugacucagcuuuuaagaacaguugcugcucuuacggagaaucuguggcaaccaguuuacaguugccucuagcucccacugcagagggaucugaggcucugggcaucugcacucauguguacauacucaacauaaagacauauauacaccuaauucaaaauaauaaaagaccagcaagucaauucaugagauagaacugcugccacacaggcccgaugaaccaaguucaguuacaguggaagaucagacaggcaaaugcuaauagccauuguuacugauuaggggacuuuuaaauacaaguaggguuaaguuaaaaaugagauugauauuuugugcucuacaaauuucugucauauauuuauuacuuuagaauauuuuaaauauuuacauuugauuuuagucaaaaagccaagaugcaauaucuuaaauauauugucaguuguugguuaaaaguaauuaagagugcuugccuuuuaaaaagcugaauuaacugauacgcaugcuggaaaucugaguucuuuucaguagacaugauugagacuggguuggguuaaugguacugagaacuggcagcuuuguccaggcaagagccuauggagagauggaaguacauucuugccaucagcucccccacuccccgacagugagaacaaggagugagaacaagucauggaguuagaaggauguaggccaggguguuuccuguucaauuacuaggaaauaaagucuguagcauuaacuuggggcuauacaaauaauaaauucuuucagaguauaggccuguucauagaaauaguucccagcacuuggagagcuuaggagggaagauuguaaauuugaggccaugugggcuacauugugagacuagaccuaacugggcucuauaaggagacccuaucuucaaaacuaaaaacugaauaaagcaagcuaauguguuaaacaugcauguuacagagggaccaucugucaaugauagugaaguccuagaacacacagccuuggggcagugcugacccuguuucugcaaucaggauaggagccuucuguugcugccaccuacuguagaacucuucguaauggccacaagccggggagugacuaaucccuggcccuguauucauaagugaguugugcugccaaauauaggagccugauucuccacaggggcuauucugaucccauguuaacuguauucucagcucucaccagaagcagacuaauccucuagagaaaaguguuucuaacugaagcuuguaggcuucccaaggauuaaaaucaaacaaauagggaguucaguuaaagaucacaacuaggccacccaggcacagaaaugacagaaauaugaauguuauauacauguccccaaggacugguucuugaaauaucagaucucaagauagggguaagggauagcugagguuguagcugagugguaaagugccuacuuagcauguguucaauccccagcgccucaaagcacaaagcagaacaaaauaaaaacugcaguuauugaaaugcaauaaaauaguuauaugaaaugucagaggaagaaaauagcuaaguaaauggucauauguuauaaccccugcacuuagagaagauggagacaguaggaucagaaguucaagguaauguuuggcuacauaguggguucaaggccacaguggccuaaacgagauucuaucucaaaaagccaaagaaaagaaaacauuuaaaaauggaaccaugaagccaggcguaguggugcacgccuuuaaucccagcacuugggaggcagaggcaggcagauuucugaguucgaggccagccugguuuacaguuccaggacagccagggcuacacagagaaacccugucuugaaaaaccaaaaaaaaaguggaaccaugaaagacuggaaaugaaguugagagaucugaagaauccauacagaauagcuuaaaacuggggagaaaacccucauaaaugcacagggaaauccagaucaauauaccaacaaaggaagggcugcauauguugucugcuggcuaaaccagcugaucucugcucagugugagauguccugugucuuauccagacauacauaagaaacugaaaaaguucacagcaaggcagacaacauaaaaacagugcuaucucccaaaacuauauaauucaauguaauuaaguuaaaagauaaugaagauuagaguacaaaugaacuuggaaauuuaaguguauuucuaaguuauaguaaaaagaacauguaaaacuaaaaauaauuuugaacuguaauggcaauaguaaauuucuugaaaagaagauguuuaaaguuguugaguaaagacaacccauaaugcugaaaaacauaaaagaagacagacacucucugaucuaguuaaauaaagcuuacguaauuuaauaugccagaaauauacaauguccuguggaaauucagacuuucagacuguuggucaaauaggaauuugaaaauaaaauucugcagugucugagauagcagcaacaaugcagucagacacuaaaggaggcucccagcagcaggaaaaggaaggacaugacaccugggccaugaaagggagaggcuggacgccaugaagguacaaggguagggaaggugagggagaggagagucuacaaaugcacaccuuguuccaaaaugcugagagcuaguuccuuguaugcugaagugcaaagugaaccaauaacaauagaucaaaauccaacucauugauagagaggagucaaaagggagaaauuagcaaagauguaaggagcagucuacaguccugaccuggaggucagucaucagcugugucaacuguccacaguaacagguuccacuuaggagagugggugcaguguuuccugaucugagaguaugucauguguauuuuguuagguuuagucuaucucucuuucucucucucucucccucucucccucuucccccucucucuuuuuuguuguuuucaagacaggguuucucuguguagcccuggcuauccuggaacucauucuguaccccaggcuggccucgaacucagaaauccgccugccucugccucccaagugcugggauuaaaggugugcgccaccacacccggcucuuuuuuuuuuuuuuuuuuuuuuuuuauuaaagauugauuuauauaugugaggacacuauagcuguacagaugguugugagccuucaugugguugagggaauugaauuuuuuaggaccucugcucacuccagucggccccucucgcucagucccugcuugcucaggcccgauauauuuauuauuauauguaaguacacuguagcugacuucagacgcaccagaagagggaguaaggucuuacuacgagugguugugagccaccauaugguugcugggauuugaacucaggacuuuuggaagagcagucagugcuccaacuugcugagacaucucaccagccccaucuauuucucuuuuacuuuucuuuuuguguaaauaaauuagugugaauugauguuuugucugcauuucuucuuuguguacuguauacauguuugcugccugcagaggccaggagagugcaucagaucccuggaacuggaguuguuauccacugugugggugcuaggaauugaaucuuggugcucuagaagagcagccaguguuuuuuaaccacggaaccaucucuccagcccaugaaauuaauuauuuauuuauuuauuuauuuauuuauuauuauuauuauuauuuuuuuuuuuugguuuuuccagacaggguuucucuguguagcccuggcuguccuggaacucacuuuguagaccaggcuggucuugaacucagaaauccaccugucucugccucccaagugcugggauuaaaggcaugcgccaccacugcccgacccaugaaaguauuuuuuuuuaaaguuuuauuuaucuauuauagguaaguacacuguagcugucuucagacacuccagaagagggcgucagaucuuguuacagauaguugugagccaccauuugguugcugggauuugaacucuggaccuucggaagagcaaucgggugcucuuacccacugagccaucucaccagcccgaaaguauuuuaaaaauaucuuugagaugauuauuuuuugucuuaggugccugcggcaggaaauagggucuauaggaaauaggguuuguugacagaaauaaaaauaauagcucacaaaugcauggagacuggcucagcugaacugaauaguagaccagcaggcuggaaccccaaggagaauguggcucaacagaguugaggggcuccugggaggcuuuuuggaggagcucacagauggauggccuugcagcccauguggagaccugagcaaggccucaguguagcagaggcuuagccuuuggugcagaagcaucauuccagguggguuuugcucauacuuggccaguacauaguuggucuuuggaaaacauccugcacaugaauguccuugcaaaagcgucuagagaaguguacgagaaacuaguaaauguagcucaguauaggggaagcagggacaggaagggauugguuguugggagacugucuguacauuuugugucuucugcacuugucuuuguuguagaccagguuguaugaugugcugcuguagauggggugaccuguuacggagagcgugucugguauuuauuauuugaaguuaagaaguaagccauucaaacuuuuaaggcaaaauucaaucugaacuuggcuucuuagagaacuuaccuucuuacuuuagccaaaagagguaccuugguggcaaucauggacauucuuacauuuaaaauauuuacaaauacuaaaauguacaaguauuuacauucauggugccugaagcuugguguuuucuuaucuggaaucaugaucucauagacuugucguuuggaugaaguuagaaggaagaguugggguuuuacucauccacguguguuuccuuugacuuacucagacaguguggggagacccacacuaggacuauaaacucucaugcuugaccagugguaggaagacuuuaagacaacaguuuggaagcuuugggguuuuauugaaauacaauuuugguuuuguuauucuuauaaaguuauacuaaguauggaaaguaacacaaguugucugaaaaaugaaaauguucuuuuaagcauaguaaugaugcauccagaaauuuacucugcuuuucauuggccugcaguuuugauuuaauaauguauauuucuuuuucagaaucaguauaaucuagcacgagcccaacaguccuauaauuccauuguacagauacaugagaaaaaugguauguuuaauucaauaaguacuuauuauuuaugaaguuacauauagcacauugauguuugccuuguucauuuuuguguuaauuuuuuuaucaaauacuguuaauuacagugaggagaaaaacauuuucuauauuuguaaucuucuaacaaaucuuaacacucuuucuaucaaaagcugaugcccugaauuccuugaccuaagugccuuugagucauugccaagaacuuagguuaauagauaaauuccuuugcucacuuggaauauacucuguaagaaaggaguugugcuagcagcucuguauaggggcucuccugaagcagagcuaauguaaaaggaccacggacaucugcuucugaaacauugucagaugccuuccuaccucauggucaaaccuauaacccuaccaggcaaaaacacuggacuucugagauagagcuuuacugugugugugucaucugguucuugauucucuuuucuuguuuuuguuugacuuuuuaagacaagaccucauuaaguuucaggcuggcuuugaagucacucugcaggcaaggcuugaacuugaguccuuuugcuuccgucuucccaguagcugggauuauaggccuguaccaccuggccuagcuuggaagaccuacuugcaagugccauuuaugucacucccuagcucuguggcuuuaagcaaguccucagauuuauuuagaagagaaaucuguuucuguguguauuugccacugcacacacuuuguaggugcugagagucaaacucagguugucuggcuugccagcaaguaccuucacccauugagacauuuugccagccucugugaucucuuucaucccgaguuuccucaucugaagguggcaaagugucuguuagaaaacaugaagaaaaagaauagugccuaugcagagcacuguguaaccaagagcccugaauaaggaauucauuguaguagugaaagggaaacuaaugcucuucugugcagaguggaaggagcgcuaccuuagggcaguacuguaguacaugcuccuaccucugcuagagguguguuaguugggcugggaacuuaccaugcaugaggcccuaaguucucagaaugcacaugaaaagccaggcgugacaguggaugccucugaucccaacugugggaagcagagaaggaaagaggcuuggguuugcuggccagccagucugaaucuuugcacugcagguuaagaaccugucucaaaaaaaaaaaaaaaaaaaaaaaaaaaaaagauuugaggaagacacgguauguugcccucuguguacacacuuaauuaggcguauuaguuuguaaguuuagauuugugucuuacacuuuauuuuauuuuaaugacaaagacaacuugucacuuuucccgugacucccuuuaguaauaguauucaaaaucaaaucuugaaacuucaaaggaaggucuuaaaaucugaaguuaagccuaggcuuguauaguagucauuucuaguaagugcaucagaugaguguguccuagugccugcucuguuccaggcaggacugagcauccaggugccuuucugugagagcucacuuuuguggagccugagcaagcagacacacuucccccuuuugguuucucaaacaaacccuacaauugguguucucaaaauguuuauagaaaauguauuugagugagacagagaguuuugcauugaugggagagcaguggauucgggucccuaucaugaguaacuugauguguagucauacauuauaagauuacuaacucugaugaacugccucacauagcuggaauuuuaaugugaugagagcacuuucccuaccaaugcuuuuguuuguuugcuuuaaauucuggucaccaggauuuugugugggggauacuuugagugagguuugcuuuuaaauacaaaacugagauggaagguuaacauguagcuguuaguccauaaugucacugucagcuaggaguaccauucauacagagaugcugaaaauccaagcaugcguuagucauaagcaguaaccaaaucagauauaaaauguuguuuaguuaauaacuaaacaaguguaaguuucuacaguaggauuaaacaacacaguuacgaauagagcuggaccugaucuuaguaaugccuuuuucuaacugcuucaagauugauguaguuaaccuuuucccauuuuauuucaggcugguacacaccuccaaaggaagauggcuaacuacauugacauaugucuggaccaauguugcuuuaaagaaaaucguuccaacguacagacauaagcuuuugagugcccguauaacagcaguaccgaagauauuagcuaauagaucauuuaguggauaaucugucaacugacauccaguuacagccuuuucauuuugcucacuuuagguaucuuggacugagcaguggggccuuuacuguauuuuuccugauaaguacacacaauagccacucccuaccaccucuuucuugaaaagugaaaucuuuuaagcagggaagugagcauccguuuacugcagcugugauuuuuacaguaaccuuucuauauugagccuaugggguaugaagauuugcaaaaucuuguuuguuuagagccaauaaaaguuuaacugauggucaauacugguuuagaaauuuuaggucuucuaaaccauagcuuuuucaggucugaaauaauuuuauugccaaaauuaugacaggaagccuccucauuaaauuguuacacuuuuucacgguugugugaaaguuugaacuaaucuaaaaguaugaucguaauuguaccauauuagcguacagcaaaacgaggcagccacuugugagcaguaauuuccacuggagcagcaggguccuaguggaccaaaccugcuuccuguugguucagcauuucuugugaggaagagccacagugcagagccugaaguucuaaaguaugaggucauuuuaccuuuccauuuauuagcgggguguugcaauugacgauaaacuaauaaacuuauggaaugguuggcacaaagacagacucuuugagcaaaauuaugaaagauaccuaaauuggagauccuuaaauuuuugcuguagucaugcaguggcuuuuacaucagaagaccaguaggaguucagccuguguuaauucuuuuuuaaaaugugacacagaucaauguacuuugcauuuuuauuaccuuuccugaaucaauccucuuugguugguaauagacuuuuuuggauccauguuugauuugaaucuagcuacuuaagcacuuuuaaaagaaaccucgaagcacacuccugcacgacccaguacagaguuaaacggcuuuucuuauauauuugauuugagauuuuuuuuuuaaacuuugcaaaccacaucuaggagauguggcacuugugcauuuuaugugugguguuaguuucucuugauucuguugguuaagagggcagaaaagauaucugguauucuuggucacuugguuacccuaaauauaugauugccaguggcucagaugacaagugacaagacagaauucuucaacacauuauuaaguuccuuaugccuaaggcaaaaucuugaauacauuauugaauucuaauuuccuaauggcuagcagauugacagcugcacauuuggcaugcuuugggguuggguuuuuuuuuuuuuuugauuuuauuuuucauugcagauuuauuuggcaauguacaguaaauuuuguaaacuugcaucaaguuuaugaauaaagaaccauuuaaaaaucaguu

SEQ ID NO: 5114 - RNA, 1852 nt, Mus musculus
ugcugguuguguugauuuaaauaagaaaggccccauagccucucggaaugccuggucuccugggagaggaacuguuugaaaggauuacaagguguggccuuguuggaggaaguuugucauugaggauggaugggcuuuuagguuucaaaagcccaugccuagcccagucucccucaaugcuggugggucuggguguaguucacagcuacuccuccagcaccaugccuguccgccucugugcucccagccaugaugauagacuaagccucugaaacuauaaacaagcccccaguuaaaugcuuccuuuuauaaaaguugcuuuggucaugguguuacuccaucuuugaaccuuaguaguuucuuuauucuuuccugacaaugucccagaacuccucuucugacuugugcgguuagucuugccugucaguuccagaaugguugcccauuuugucuuuuagcucuuucacucaacauaaaugugguuuugagauucauuuauguucugucugucugucugucugucuaagugcaugcgugaggucagagguugucaggcaucuucuucaguucuuuugauacagggccuuucacugaacuugggcuugcuguucuagcuagguuucuuuuuucugcuuccucuagacccuugcuuguuugggguuagguguggggagacuuccagacucuggucuucaugccuauacagcagacacuuaaccaaacugaucccuguccccagcccuccauuugaagcauuuucugugauauaagggacaagacuuauuuccuauucugcuuuucauggacuggguuucugguccuagguaucgugaaugacgauguugcuuuuguguaaguuucucugaaacuuaagaagugaacuugcucguuuuuagcacugauguauauuuaacucaaaaagaaacugcuaguuuugcaaauuucugccacgguguacucagugagcagagucugaggguugcaguugcugcaaauccuugcuacucggaucacagcuuguggcaauagccuggcuaguauguguguagguagauaguccuuugaguauuuccuuggaaucucucuaaugaccagcugcuuugaauaccuuuugugugcuuacuagguacuuguauauugacuugugauguggcuggcuuacucugcuguaguuuuaauuuggaccgcccugcaucuucucacacaguuagacacuguuuagguuucccuccuaggcuuuguagcagaguagcucauuugcuguugcaacagaauacuuggcagaugcugucuggguggggaacuugcuuaguucucucuacaagggugcauccuuguagagagucaugugagaggcuugagaaggccggucacacuguccuuauugaaggagcccagugugacugcuccagcuuggcuguaggacuccaggcucugggguggugcugcccaagugcaaggucucucuuauucccaaccuaaucuaggucccucacagagugcccagagucgauggugguucuaaaucugucagguuaaccaccaagacaccaucacaagccuuaucagaaacuugcauuuuucuuucauguuuuaagcucacaguauaugggauuugucuucugcauuuuuuuuuccuuugaauaucccccaccacaaccugguuugaguuuuuuauagaaacuuaacacuuaaaaagauuuauggcaucuugccugcauguaucucugugcacuucaugcaugccuggugcucauggacaccauaagaggguagcggaucuccugggacuagaguuagacuuggaacugaaacgagggccucugaagaacagcacuucugaugaacuucc

SEQ ID NO: 5115 - RNA, 7511 nt, Mus musculus
uaagucuuuccaugucacagcugaagcuagggcucucaagccauggccaccgcucccagcaagggcaagaaaggaggggccacugccaagaguguggagagcagagagcccugcuuccucucaaaggggacauuuuaggaggagaagcaaggcuggaccacguguaucacuuaugccccucucaugccagcacuggacuccuggggugacugggaccccggagacccaugcucagggaccuggaaaaugguuuuacagcggcagagaaauggaggugagugccccuccccuauccuuagcaaauucucaagaacucaguuucugguuaggaggggcuuucucuagguaggagaggguuaaagguugagccuaggacuccugcggagauagacugccauuaccuaggagguuugcaggaucuagagguaaugggagccaggucuagcccaagauagccuugggguggagggugaggugacaaguaucccccaguaccuggagcaggcacagugcagagcccacucacuggcuucaacaauaaauccaaguccacaccuagggcaggcaaagcaagcacauucacaaauaaauaaaucauugcccaacaggcaagagaugugcuuaguccucacuuccagcaaggccccacacagauaccuuuccagaaaaggcacacucccaaguguauagggucccaacagagagaaccacuaugguuacuguagauaccagacacugagcacgaugagguaggauucuaaggcuuucccugcgauuaguuuaauuuuuuuuaacaaagcaaagacagcuguucuaaguacaacccauuucacagaugaggaaaagugagggaggaagaagaaaugaaacacccaaagucacagagaccagcgcugaugcaggacccuuuacuucaugguuugugguuuaccagcagagauacagucaugcaaacuuaaccagccccagagccagagcggcuggggcgcuaguaggaaagauggggaagggucggccuguugucaagcggguuguaggcuguggcaaaacucuggguccagagaacacuagcgcucuaaagguggaggcggggucaaaagcuacaggaauccggcuguggagcgaggugccagacuguuuccagcgcuggggcaucuccgagcagccuuucuaaccccgacuuucugcagaaccugugccgacgcucuugacugcaaccauuucccagcccagcagcuucggcucuuagcaguuggaccgccgcgccugaauuagauagaucucgggcagcgaggccugcgggauccaaguccggacauagcuuuuggucgagauacuuuaucccagaagcccacccgcgccccacuuagagagguaucaaguuuuugguguccuuucagaaugggagugagggaccaacagaccaccguuggauaaacacuguuuguaccucaucgauuugucuuucaacccuuugaaacaaaauucacaacgauuuuuguuuaaaaaaaucccgagucuuagaaaucgcagauuuuucuaggauuaaaaagccaccgggaagacgguaaauuaccccgugucccacauuuguuucugauuaguuguguuguaauugguuuguguaacccaaaaucagagaguucguaaaaaucuuuuacuguaugagugacacaucacagcacuguuuuuaggcucuaugcagcugagaggagaaaggagagggugggagucagcaucaauuuaaccaaaagagcaaaaaguaggagggaggaaaagugccuaggccagggugggugggaggacuguggcucuaagucucuggauuccuuuuggcuuacccaccugcaacaucgaguuuucuacaggcggcgcgggugggaaaguccgcauagaguuuauccaaacccaggugcucauuuccuacccguucucccuaacuuggaccccgccgaacaaaggcucaggcccaccagggagaaagguggccggcuggaccagugauggucccgaaacagcgaauccucuuuucucccucaaggucugucguccccaggaggaauuuuuaauuuaaaaauuauaaaagaaaaacacuuuuaagggggagacgacucucaucuauucccagaagacuauugccuugcuaggcaaacgcccuacaaguccgaagaaagcgcggcgcugcggcagagcccgcgggguggagaugcggcuuccaagggauugcgggacccggggcugcagagaggaucuaggaagguuucgggggagggggcugcgcuccauuguucacuccgaaccaaucagagcuuucccacuuccucccagccaaucucccugcgccuccgugucuaccccagcccacccuccggguccccaucaucucccgagcaagccccagggcggugggagagcugggugacgcuacaggucccgccuccagcucgggccccgggcgagugcgugcugacgucaugcugcgugcgggccggugcggaaucgcuccuucaacuccgcggggcaggaguuaguuagcaaagagcagaggcugggcgcucgacccugguccuucuguccccggccgcaagcuuugcucacaucucucucugcaugguggauauuauuuuucauuauccuuuucugggugcuaugggggaucauuccaagaguaagucuuucucuguguguggguguguaugugugcuugauaugcaacauuuccaaugcagaagaauguuuagcggauucuacaaguggcuuuuauuugacaaaauacuugggagaauaaaaaaaaacaaacaaacaagcagugcauuucgcccauaacacuguuuauucguuggaauccuacuauuuuauuuugcaauuagacauuauuucccaaguuggcuggaaugaccucaggcugugaaauucuuuuucuuuucugcuaggacaauuagguuugauuuagagaaauggguuucuucucugccuuaggaagguagagagguuucaguagcuugaucugagguguuuaaacuaagaacugucgaagaagcuaagaggggacagggcugaaugcugcggugucugcguugaaauagggagucgcugugagcgggagcgggcggaaauccgggcuuggcugacaguguggacacggaggcguccguagcuccccagugucaccgugcugucgucugccucccguuagcucugucucuagcugaaccgauacuacguccgcguucaaagacggugauaauggaaauaucaggagauuguguuguuuucguuuccuacuuucuggaucauucgaaaguggucucacuuuuagagcgggagaucaagcaagggagggcggguuggguuggggcugcugcagcggccaaggccggccggguccuguaccgggccugacgcgggcccugcgcccuucccugcuagagaagcccgggacggccaugugcgugggcugcgggagucagauccacgaccaguuuauccuucgcgugucgcccgaccucgaguggcacgccgccugccucaagugcgcggagugcagccaguaccuggacgagacgugcacgugcuucgugagagacgggaaaaccuacugcaagcgggacuacgucaggugagccggcgggacccgggguucggcccccuugggcugggggggacacggcugcgcguccugggcucgggucccugcgcugacgcccgccgcacccgggcccgcaggcuguucggcaucaagugugcccagugccaggugggcuucagcagcagugaccuggugaugcgggcgcgggacagcguguaccacaucgagugcuuccgcugcuccgugugcagccgccagcugcucccuggagacgaguucucgcugcgggagcaugagcugcucugccgagcugaccacggccuccugcuggagcgcgcugcggcuggcagcccgcgcagccccggcccgcuccccggcgcccgcggccugcaucugccagguaagccucucucccggcccgcagcgcugcgccgcgucaguaggauguacgacuguguagccgacagcugagcuuccgacgggaagccggugugaaaggcugcgugcgcugggaacccugcuaugugucugcgagugcgggggucggggggaauuguauguaugugagcgugagagccucgggaguuguguucuccguggcccggaccauguaggaucgggagaguggaggacccggaauccuaggugcugccugucuggguuguguuuagaauuccuuugaugaacagggagaaaagguauccaucccacccggagccaagggaagaaggccagcggcgcagaagaggggccuguguucuuguuuugauguccggcuagcauaaagaaagguucagggaguuuauugguuaaaacccuccuaggaugauaggugcucuggccaggaguugcucagacugggaaauaaguguugacaagaagcagguggagagggugcgacaggagaccccaguuccaggaagccaggggaucugcuacucagaucgagguagaccaggcccucuguguggcaccagggauuucuuccucucuguaacuccauuuccacacuguagaaggaggggauuggucuuggugggcuauuuguaaauguuuacccagaacuaguaaugccuagaggggacuuuaauguaaacaaugcagcuaaaauccaggguguguagaccggguugaaaguaaaacagaauggaguugguguugaaugaacccaagcugaguucgcccagggacuccucuuuguuuugaaauguaggcuugaggcuguucgaggugggugugaaaagcagcagacacugggcugaggggacccagaacccagagaaucucagaccgaagccccaaggcagguagccaggaaggagccauucugugcccagaaggccucagcugcccaaagucugaaucguccuaguccgagaguguuccuaagggcgagacuagccuaggcgaucccuuaggagcagaaagagagucuccuagucuaggaguugugcuaugaccugaguccuuguccuuuuccuuucccccucccuugcuggagucgcacuucgauuuccaccucuuccucuaaaauuccaccuucuuccagagggcuuugcuuguucggcuguucgcaguuggguuuuccuaggguguacuaguacggcagcggcagcggccuggagccgaacuccaucaccgcaaggcaaucgggcuagggagauagggacagaacaaaaagcauuuucccucuggguaaggcgaguggauggagagggagaugaacaauagccaaacgaaccgaaugucagggaaacgaaaucuuggggagaauggcuggcggcccauccgaccuucugucucucggccccugcagacgcuggguccggacgacagcccucacugcgcacgcacgugcacaagcaggcggagaagacaacccggguacggacugugcucaacgagaagcaacugcauacccugcggacgugcuacgccgccaauccgcggccagacgcgcucaugaaagagcagcuaguagagaugaccggcuugagcccgcgggucauccgcgugugguuucagaacaagcguugcaaggacaagaagaaguccauucucaugaagcagcuacagcagcagcaacacagugacaaggcggugaggugcuggugacgggcgggaaggcgggugguauccccggcggcuuucuaaggccucuuucuggggaacuaggcggagcuggacucccuauguacuuuggcaccggaaccuuaggagaaaggcugaucuuggcguucaaguugcggugguuguuggugguaccuugugccaguuacagcccagaguugaggggcccucggcuuagagacgacccuguggcaugguugggacuacgggguuguacuuuggggggggguagagauagggcucgaucugaguuuuuguuuguuuguuuguuuuguuucguuucgcauaccuggcuagggaagggcauaaaggacuuccguuucucuggccugguauuugacuccuaggagggaacuggguagcagguuugugggcccuggguuaucuccguugcgaaaugggggauucguugugugcaguggagugcgucuccuccucaaaacaauuuaauucccaacuugcucuccagaaccugggguucuaugcucaaaaguggugcaaaagcugaccuaacucuaaugccuugugcuaucugucugcuugccccucagagccuccagggacugacugggacgccucugguggcaggcagccccauccgccaugagaacgcggugcagggcagcgcagucgaggugcagacguaccagccgcccuggaaagcacucagcgaguuugcacuccagagcgaccuggaccaacccgccuuucaacagcuggugaggcccugugcaaacugcacgguggacgugggguggaggggacuucguucguucacauaggacuaggggucuuggggacagauuuggcaaugagaaagccugcugggcccgcaaccucgcagcugacacuaacccgguuuuaaugugucuuucaccugaucccaaucccccugugcgggcggggaccuggcaggguuuacucagcugauggcuugucuggagggaacacucccggucuuugagcagguaauccaggagcagcagccugagccuguguucacuuguuuucccugaugucucugcccuuccagguuuccuucuccgagucaggcucccuaggcaacucuuccgguagcgacgugaccucucuguccucgcagcucccggacacccccaacaguaugguaccuaguccgguggagacgugagcgaggaccccucccugccagcccgcggaccucgcaugcucccugcaugagacgcacccaugcucaggccauuccagcucugaaaaaucuccggcccuuguaauuauuguuguuauuuaaagcgagcgggcagaggcacgcgaccgcgacgggacggccagcagcgcuggggcgcagccugcaccgcugagacuggagacuccggcuccaaggacuuuuuuuuuucuuucucauaacuagaauuugggacauucuggguuagcuccgcccucgccucucccucgcugcguggggaacugucacugucucucugcgccuugcucgcccgggaacccaucugaugggguccuacagggcccuaccggugaggacgccugcuccgaacucgccugcgcugacccgaggcuuuguucuggaccuggcagcgaggacggaacaauuccaagaaacagacauaacccccaaagcgcaugacugccggacagaguagaaaccagacugucuuuuaaaaaguguuuuaaauuaucagucgacggaggacagugagagccuuugccgaacaaacguaaguuauuguuauuuauugugaggcgaauagugggacgaauauuuugaucuuaauaaaacacaacccgaugccau

SEQ ID NO: 5116 - RNA, 7511 nt, Mus musculus
auggcaucggguuguguuuuauuaagaucaaaauauucgucccacuauucgccucacaauaaauaacaauaacuuacguuuguucggcaaaggcucucacuguccuccgucgacugauaauuuaaaacacuuuuuaaaagacagucugguuucuacucuguccggcagucaugcgcuuuggggguuaugucuguuucuuggaauuguuccguccucgcugccagguccagaacaaagccucgggucagcgcaggcgaguucggagcaggcguccucaccgguagggcccuguaggaccccaucagauggguucccgggcgagcaaggcgcagagagacagugacaguuccccacgcagcgagggagaggcgagggcggagcuaacccagaaugucccaaauucuaguuaugagaaagaaaaaaaaaaguccuuggagccggagucuccagucucagcggugcaggcugcgccccagcgcugcuggccgucccgucgcggucgcgugccucugcccgcucgcuuuaaauaacaacaauaauuacaagggccggagauuuuucagagcuggaauggccugagcaugggugcgucucaugcagggagcaugcgagguccgcgggcuggcagggagggguccucgcucacgucuccaccggacuagguaccauacuguuggggguguccgggagcugcgaggacagagaggucacgucgcuaccggaagaguugccuagggagccugacucggagaaggaaaccuggaagggcagagacaucagggaaaacaagugaacacaggcucaggcugcugcuccuggauuaccugcucaaagaccgggaguguucccuccagacaagccaucagcugaguaaacccugccagguccccgcccgcacagggggauugggaucaggugaaagacacauuaaaaccggguuagugucagcugcgagguugcgggcccagcaggcuuucucauugccaaaucuguccccaagaccccuaguccuaugugaacgaacgaaguccccuccaccccacguccaccgugcaguuugcacagggccucaccagcuguugaaaggcggguugguccaggucgcucuggagugcaaacucgcugagugcuuuccagggcggcugguacgucugcaccucgacugcgcugcccugcaccgcguucucauggcggauggggcugccugccaccagaggcgucccagucagucccuggaggcucugaggggcaagcagacagauagcacaaggcauuagaguuaggucagcuuuugcaccacuuuugagcauagaaccccagguucuggagagcaaguugggaauuaaauuguuuugaggaggagacgcacuccacugcacacaacgaaucccccauuucgcaacggagauaacccagggcccacaaaccugcuacccaguucccuccuaggagucaaauaccaggccagagaaacggaaguccuuuaugcccuucccuagccagguaugcgaaacgaaacaaaacaaacaaacaaacaaaaacucagaucgagcccuaucucuacccccccccaaaguacaaccccguagucccaaccaugccacagggucgucucuaagccgagggccccucaacucugggcuguaacuggcacaagguaccaccaacaaccaccgcaacuugaacgccaagaucagccuuucuccuaagguuccggugccaaaguacauagggaguccagcuccgccuaguuccccagaaagaggccuuagaaagccgccggggauaccacccgccuucccgcccgucaccagcaccucaccgccuugucacuguguugcugcugcuguagcugcuucaugagaauggacuucuucuuguccuugcaacgcuuguucugaaaccacacgcggaugacccgcgggcucaagccggucaucucuacuagcugcucuuucaugagcgcgucuggccgcggauuggcggcguagcacguccgcaggguaugcaguugcuucucguugagcacaguccguacccggguugucuucuccgccugcuugugcacgugcgugcgcagugagggcugucguccggacccagcgucugcaggggccgagagacagaaggucggaugggccgccagccauucuccccaagauuucguuucccugacauucgguucguuuggcuauuguucaucucccucuccauccacucgccuuacccagagggaaaaugcuuuuuguucugucccuaucucccuagcccgauugccuugcggugauggaguucggcuccaggccgcugccgcugccguacuaguacacccuaggaaaacccaacugcgaacagccgaacaagcaaagcccucuggaagaagguggaauuuuagaggaagagguggaaaucgaagugcgacuccagcaagggagggggaaaggaaaaggacaaggacucaggucauagcacaacuccuagacuaggagacucucuuucugcuccuaagggaucgccuaggcuagucucgcccuuaggaacacucucggacuaggacgauucagacuuugggcagcugaggccuucugggcacagaauggcuccuuccuggcuaccugccuuggggcuucggucugagauucucuggguucuggguccccucagcccagugucugcugcuuuucacacccaccucgaacagccucaagccuacauuucaaaacaaagaggagucccugggcgaacucagcuuggguucauucaacaccaacuccauucuguuuuacuuucaacccggucuacacacccuggauuuuagcugcauuguuuacauuaaaguccccucuaggcauuacuaguucuggguaaacauuuacaaauagcccaccaagaccaauccccuccuucuacaguguggaaauggaguuacagagaggaagaaaucccuggugccacacagagggccuggucuaccucgaucugaguagcagauccccuggcuuccuggaacuggggucuccugucgcacccucuccaccugcuucuugucaacacuuauuucccagucugagcaacuccuggccagagcaccuaucauccuaggaggguuuuaaccaauaaacucccugaaccuuucuuuaugcuagccggacaucaaaacaagaacacaggccccucuucugcgccgcuggccuucuucccuuggcuccgggugggauggauaccuuuucucccuguucaucaaaggaauucuaaacacaacccagacaggcagcaccuaggauuccggguccuccacucucccgauccuacaugguccgggccacggagaacacaacucccgaggcucucacgcucacauacauacaauuccccccgacccccgcacucgcagacacauagcaggguucccagcgcacgcagccuuucacaccggcuucccgucggaagcucagcugucggcuacacagucguacauccuacugacgcggcgcagcgcugcgggccgggagagaggcuuaccuggcagaugcaggccgcgggcgccggggagcgggccggggcugcgcgggcugccagccgcagcgcgcuccagcaggaggccguggucagcucggcagagcagcucaugcucccgcagcgagaacucgucuccagggagcagcuggcggcugcacacggagcagcggaagcacucgaugugguacacgcugucccgcgcccgcaucaccaggucacugcugcugaagcccaccuggcacugggcacacuugaugccgaacagccugcgggcccgggugcggcgggcgucagcgcagggacccgagcccaggacgcgcagccgugucccccccagcccaagggggccgaaccccgggucccgccggcucaccugacguagucccgcuugcaguagguuuucccgucucucacgaagcacgugcacgucucguccagguacuggcugcacuccgcgcacuugaggcaggcggcgugccacucgaggucgggcgacacgcgaaggauaaacuggucguggaucugacucccgcagcccacgcacauggccgucccgggcuucucuagcagggaagggcgcagggcccgcgucaggcccgguacaggacccggccggccuuggccgcugcagcagccccaacccaacccgcccucccuugcuugaucucccgcucuaaaagugagaccacuuucgaaugauccagaaaguaggaaacgaaaacaacacaaucuccugauauuuccauuaucaccgucuuugaacgcggacguaguaucgguucagcuagagacagagcuaacgggaggcagacgacagcacggugacacuggggagcuacggacgccuccguguccacacugucagccaagcccggauuuccgcccgcucccgcucacagcgacucccuauuucaacgcagacaccgcagcauucagcccuguccccucuuagcuucuucgacaguucuuaguuuaaacaccucagaucaagcuacugaaaccucucuaccuuccuaaggcagagaagaaacccauuucucuaaaucaaaccuaauuguccuagcagaaaagaaaaagaauuucacagccugaggucauuccagccaacuugggaaauaaugucuaauugcaaaauaaaauaguaggauuccaacgaauaaacaguguuaugggcgaaaugcacugcuuguuuguuuguuuuuuuuuauucucccaaguauuuugucaaauaaaagccacuuguagaauccgcuaaacauucuucugcauuggaaauguugcauaucaagcacacauacacacccacacacagagaaagacuuacucuuggaaugaucccccauagcacccagaaaaggauaaugaaaaauaauauccaccaugcagagagagaugugagcaaagcuugcggccggggacagaaggaccagggucgagcgcccagccucugcucuuugcuaacuaacuccugccccgcggaguugaaggagcgauuccgcaccggcccgcacgcagcaugacgucagcacgcacucgcccggggcccgagcuggaggcgggaccuguagcgucacccagcucucccaccgcccuggggcuugcucgggagaugauggggacccggagggugggcugggguagacacggaggcgcagggagauuggcugggaggaagugggaaagcucugauugguucggagugaacaauggagcgcagcccccucccccgaaaccuuccuagauccucucugcagccccgggucccgcaaucccuuggaagccgcaucuccaccccgcgggcucugccgcagcgccgcgcuuucuucggacuuguagggcguuugccuagcaaggcaauagucuucugggaauagaugagagucgucucccccuuaaaaguguuuuucuuuuauaauuuuuaaauuaaaaauuccuccuggggacgacagaccuugagggagaaaagaggauucgcuguuucgggaccaucacugguccagccggccaccuuucucccuggugggccugagccuuuguucggcgggguccaaguuagggagaacggguaggaaaugagcaccuggguuuggauaaacucuaugcggacuuucccacccgcgccgccuguagaaaacucgauguugcagguggguaagccaaaaggaauccagagacuuagagccacaguccucccacccacccuggccuaggcacuuuuccucccuccuacuuuuugcucuuuugguuaaauugaugcugacucccacccucuccuuucuccucucagcugcauagagccuaaaaacagugcugugaugugucacucauacaguaaaagauuuuuacgaacucucugauuuuggguuacacaaaccaauuacaacacaacuaaucagaaacaaaugugggacacgggguaauuuaccgucuucccgguggcuuuuuaauccuagaaaaaucugcgauuucuaagacucgggauuuuuuuaaacaaaaaucguugugaauuuuguuucaaaggguugaaagacaaaucgaugagguacaaacaguguuuauccaacgguggucuguuggucccucacucccauucugaaaggacaccaaaaacuugauaccucucuaaguggggcgcgggugggcuucugggauaaaguaucucgaccaaaagcuauguccggacuuggaucccgcaggccucgcugcccgagaucuaucuaauucaggcgcggcgguccaacugcuaagagccgaagcugcugggcugggaaaugguugcagucaagagcgucggcacagguucugcagaaagucgggguuagaaaggcugcucggagaugccccagcgcuggaaacagucuggcaccucgcuccacagccggauuccuguagcuuuugaccccgccuccaccuuuagagcgcuaguguucucuggacccagaguuuugccacagccuacaacccgcuugacaacaggccgacccuuccccaucuuuccuacuagcgccccagccgcucuggcucuggggcugguuaaguuugcaugacuguaucucugcugguaaaccacaaaccaugaaguaaaggguccugcaucagcgcuggucucugugacuuuggguguuucauuucuucuuccucccucacuuuuccucaucugugaaauggguuguacuuagaacagcugucuuugcuuuguuaaaaaaaauuaaacuaaucgcagggaaagccuuagaauccuaccucaucgugcucagugucugguaucuacaguaaccauagugguucucucuguugggacccuauacacuugggagugugccuuuucuggaaagguaucuguguggggccuugcuggaagugaggacuaagcacaucucuugccuguugggcaaugauuuauuuauuugugaaugugcuugcuuugccugcccuagguguggacuuggauuuauuguugaagccagugagugggcucugcacugugccugcuccagguacugggggauacuugucaccucacccuccaccccaaggcuaucuugggcuagaccuggcucccauuaccucuagauccugcaaaccuccuagguaauggcagucuaucuccgcaggaguccuaggcucaaccuuuaacccucuccuaccuagagaaagccccuccuaaccagaaacugaguucuugagaauuugcuaaggauaggggaggggcacucaccuccauuucucugccgcuguaaaaccauuuuccaggucccugagcaugggucuccggggucccagucaccccaggaguccagugcuggcaugagaggggcauaagugauacacgugguccagccuugcuucuccuccuaaaauguccccuuugagaggaagcagggcucucugcucuccacacucuuggcaguggccccuccuuucuugcccuugcugggagcgguggccauggcuugagagcccuagcuucagcugugacauggaaagacuua

SEQ ID NO: 5117 - RNA, 20043 nt, Mus musculus
uaaggcagggccuggcgggccucagcaacgcaguagucgacagacuucaggcugggguguggagccccggccaccgccgccacugacgacccccgccccccacaugcagcgccgccccucuguggcugcccgugaagcaaggcugccaagccccggcuccgccugccucccuccucgcggcuuucugcguccucgccgagcgggcgcgaugcggcugggcccaaggcccgcggcgcuaggacugcugcugccgcugcugcuguacgccgcgguggcuggcgccagcaaggcggaggaacugcacuacccgcagggcgagcaccgggcggacuacgaccgcgaagcgcugcuggguguccaggugaggauaccaggcuggguaccgcaucgccaugggcuuuguccugugacaaagcgggacgaccagagagagaggccuuagcaagagcggccugacaaugggguccgggcggggcucagcuuucgcucuaggagacccugaggccuguaaagcuggugguacuguugcaguuccagaacaagauucuuucuauuccuggauccagggacaggauuacuuagagugguagugggggcguauugaagagaagugugggucauccugaaaccacuggggcaaaugaggcaugugguagcucuguuuccuuccaccaucacgccccacugauuguaaugcuugauucuccugugugugguuucccucccaaaaggaagacgucgaugaguauguuaaacuuggccacgaagagcagcaaagacgauugcagucgaucauaaagaaaauugacucggacucugauggcuuucuuacugaaaguaaggacugacuugcaccaccaacaauggagaaagcccuuuguaggaaauuaauguacauuuaaaaaaaaaaaacuguugucuauugaauucuaguagauugcugguguucuaacaagcuaaaaguaacugugauauggaaaauaguucuuaugccuggaaggugggcuacaaguaaaaucagugcuuugaugguauguaaauguuacuggcccuaagagaauaaguuugccagucauaccuugagacagacucuuccucacaucacuuuucucauuguccauaguaugguucauuuuagagacacuugcccaaaccuuucuuagcacaucacaugauacaacauuccuucaguauguaggaauuuuaagaaucugcuuuuauuaguuuauuauaacaauuagcaaauagaaacaucccaucaaaugugaauuauaucgaaacauuaaaaaaaauggugcuaauggggacuuagaaccagcuuaucuaucucuucauagaguugaagaaagucacauucaggagggaaaaccuuauuuuuaaauaaauggcaaacccaggaguggaauucagcucuuagccuuaauucaauuuuuaauguucuucauucaaaacaaacaacaaaagagugcucuuagguauguucuuaggcagaaauggaacguacaguguaaaagaauauucuaaauaaauuacuagcaauuucuuccucaagugaaccuugaaucuaucagaauucuaccuauacuaucagguauucuggguugaucuuuugaagguucagaaucuguccuugugacagcaagcuguuuguggugucucuccuuuuaguguuggucagcauccagauaaugaaguuacggaacagggaaaugcugucaauaaauagucacauuggugcccucaggcuuguuccuguuaaaccaugaugaaaucucuaagcuaauagaaggauaguggucugccuuguuuacaaauggaguugaucuagaagacuuuaguacuuguuggggucuagaugugcuuaaauagucugaucuucauuuuauagguaaagaguuugaaagguaagcuaugguuuagggccaagcugcaaugugagccugugcuucuggucccugauacauucugcuuccuacuaggcuccacuaaguccuuuaagguagaagaaacacucguugugcuuaaggaaacacaaaccucuggaggacccuuaagagaacguuacugauuugaguuuugagggccagagcuuggagucuaaagcugggcccaaaggcccugaggcacacuuaaaccaaaaaacgcagaccagcuugggcaauaaggagagacccacaacuuuaaaaauaguagacguucucaagagguaacaaaacaccauuguuagagcucugaagccaaaagcaggugagggucuauagacucuuagcugugaaaccuugggccuuucugaaccucaguuuuauuaacugaaauagugaugauuauaaguugggucaauggaugguugcauaauaaauauuagggucuuggagugggaaguagaaaucaucugugcgugucuauguaccugagccuuuauaagccagcagagaagcagcggucuuuagucucuugaugcacauuaccuuuaagccaagugcuguacacucaugcucuucuugcaaauauucguuguaaccuccuuaccuaucuucuauaaugcaguguaauaauugccucuacgaagaaaucaugaaucugaaaaggggcauuugaaauuuuugaacuuguucucuaugccuucaggcaccaagagaauaccggcaguuauacaagaaggacagaaauuaucauuacuacuuuguugaaauuucuuccacaugcaaugaugcuuaacagaacuauacuagagcaguauuucucugccuucaggggcuugacuacuguucacgauuuaaaccaugucugcuaacacaucuugauuaagguguggugggcccaacugcaaucagucccaacucuugaaaggcagaggcaggaggauucuaaguuugaggccagucugaucuauguaaaaaguucagguacauagcgagaccuugucuuaaaaaaaaaaaaaauuuuuuaaaaagcacacacuguauguguauauaaaauauauauguacauauauauuuuuuauucaacucauaaguuaaagaaaaacuuuaaccuuuuauaaauaauuuuuuucuaaagcauucaaaauuguaugcuucuuaagagacaugauaauuccaacauccuuggacucuuccacucugccagcucuccccauuccuuauuuuuauuaauacuauugggacacuuugucagguuuuucaaacacuaauguuauuuuuuucaaaaaaaaaaaaaaaaaaccagaaaucuucacucagauuggaauucuuguaaacauuuuuguguucuggggaauucucguagaugaacucagucaguggauucagaugucuuuuaagcauuacgcuaugcaagaagccaagcagcaguuuguggaguaugauaagaacagcgacggcgcugugacgugggaugaguacaacauccagauguacgaccgggugauugacuuugaugagaacacugcucuggaugacacagaagaggggucguucaggcagguggguccgugcugcucccgagagccugagguccuaggcuguugcuuugccacugggcagucaccaggaccacuccaguggggguuucaaugguuuccuuuuagccagccauaguacucuuaacucuagaccuaaguuaccccugcaucuguuucccuucucacugauuuguccacauuuccagaguuauuccuuaagugcauuuuggugacaguaaucuacagcucagcauuuuauuuuucaaauaauuuagcaaucagcuuaauaucauauuuaaauuuuggagggaauaauuccaucccuuaaaaaaaugaaauaaaaauuuaauuguagcaaaauaaccauaacauuuuucauuauuuauuuaugguuguauguauuccuauuugggcacucguuugcaccauguuugagacagagucucuuguuuacugcguauuccaugguagcuggcucuugaacuucucaaguuguacugugcaguaaagaaugcuuugaucacagagcauguccuacuugacaugggugauaggggacugaacccagguucucacaugugugagcaagcccuuuacccacugagccaucaccucuuacauuuaccauuuuacaccuuuugguuuuuuuuuuaaauggaauuggagauugaacccagggccuugugcgugguagacaagugcuccacuaugagcuauuucccagcccacuugaaccauuugaaagaguuuucaauagugcuguguuaaucuuguuguucaaccaguugaucgaacucucuauuuugcaaaacuggauucuguacccauuguacccauuaagcaauaacucccuguuucuacucccaccauucuaccaucuauaaauccgccuauuccagguacuucauguaaggaaaaucauguuugucuuuuuuaugacuacuuuauuucacuuaauauaauguccucaaaguuuacccauguguuagcauaugucaaaauucucuguucagaaaggacauagucuaaaaagacagauaucugcaggcaguggugauacaagucuuuaaucccagcacuugggaggcagaggcaggcagaucucugaguucgaggccaguccagucuacauaaugaguuccaggacagccaagguuacacagagaaagcuuguguagaaaacaaaaacaacaaaaagcccagaaaucaaaaagaccagauauucuagugggucggucggucggugggugggugggugggggcuugagucucucagccgaauuuugcuuaucuucuuggauucuuucuuuuuauuauucuuugaaauuuucauacacuuauacacugugcuuugacuguccaccuaucuuuaccucuucucaacuucaugauguuuuuuuuuucuuuuuaauccuguaauaagugugguauacaagucucucuuuuagaucuugcuuuuaauuaucuaggguacauucccagaagugagauuauuggaucgccucuguuuuuaguuuuuugaagguauugcaguguaguuuuccauaguucuauguuauuaauaaugacucauuucugaagauccaauauacagucuguugaauuuuaauuuuguuuaagcaaauauauagcuuaaacagaaaugugaagaacuuuuuuguuuuuuguuuucaggacagguuuuuuucuguguaguccuagcuguccuagaacuuacucuauagaccagguggaccucaaacucagagauccaccugccucugccucgcaagugcugagauaaaaugugugcaccuccacugccaggggagaagaguuauuuuuauugauuuuucaggaagaacuuuucaagacuuccaggaagucuguuaaaccaaaagucuaucaauauaaaugacuauaugcuugagaaauuaauauuucaggaacauuuuaaaggauuuuuuaauguaaaaaagaauaaaaauaaaaacaauuaccuugucccagaugucccugaacuuguugggguacuuggaaaucacuugagccuuucugcuucauuugcauaugucccucuuuaauuuuuauaauggucaucauuuaucauuuuauauauaguauauauuuuagaauugcacuggcuaggugaacuauauaagcuauuacuaacugcagcuucguauuugucugguaaagauuuggguuuuguuugguuuuuugagacagucuuacuuuguagcuuuggcuaucccagaacuccccauguaggccacucuuccucaaacucacagagauccaccucccucugccuucaagugcuaguuuugagugcuaggauuaaggaguguacuaguacuccuggccuguaguuacucuuaaccuguccauaugucaccugugugcagguuaagguuucuagccuacaagccagucugccugccuuacacccagccuuaccacuuaauaguugcuagaccucucugagcucaguuuccucaucucuaaaagugguauaauccccacugaggauagcaguggugugcggagacaguaugcgguagcaguuggaaugcugaguaguuaauuucuaguugaaagaauaauguaaaagaagcaguacuugggagguagaagcaaaaauauuucaaguuugaggcaugacuaucuugggccagugagaugacucaauggguaaugaugcuugcugccaagacuugggaccugaguuuaaucuccaggacccacuuuuucuuuuggaugaagagaacugauugucacaguuguucucugaccuccaaacaugugcuuugaugcccccucccaaauacauaaauaaauaauguuuuuaaaaauguaaugaagaauuaagaggugaguuaguuuaguuguaaagaccacuggcugcucuuucagaguacacaguucaauucccagcacccaugugguggcuuacagucuuuuuuaauuccagucccagggcuaugauguccguuucuggccucuguggacaucaggcauguguguaguauacugacauacaugcaaacaaaacucccauagauaugguuuguuuuuaauuuaauggggaaaaaaagacccugucucacaaacagaagaaauauguacacuucacaaagguuauauuucauaaaaguguucaggcguuuguuuacugcaucacccuuaaauuaguuaggauuuaauuuguaggaagaagguaaacuuuuugcuuccuuuuucguuauuugaauuuuuauuuuccagcagccuaaaagaacuguaggucagucuucaugcuagaugguacugugcucaugacaagugcucaugagaucuaugggcguucuccucagcaucacuagaguucuuggagcuuugcuaaaaccaugauaugcuaccauggccuuccugccagggaagaucuuaaauacaauauuuuaaaauuacuaguuaggguauaauuuccugccuguuuacuaccuucauucuucucuaacuucuuuuuaccacuccaaagaauuacuuuuccaccaaaaaaaguauaugucuaugugcacaagcacccguauacuugaacacacagagaagguauauguguuucugaauucuugagaaggaauauuauauaagacaugaugguguugacauuaaagucuucauuuugaagaauacauuacacaauuaugggaaauacaaguagcccuucuuaaagaugccucguuccgaugcuguuuucuucaucaagugcaccguacauguugcucuaagacugucuuuuaagaacgggcugggggcuagagacauggcucagaaguuaagggcauuuacuguuuuuucagaggaccugguguggguccccagcauccacaaagcuuuguaacuccaguuccaaggguuuggguggcuuaaucuggccucugaggguuccagcccuaauguacuacacauacacucauguaagcacacauacacauaaaaauuaauauauuuuaguaaauacaaguuuuuuaaagaacucaccaaauuaaucuaaguguccaaauggaaaugauauagucucaaagcaaacacuuaccaauaggaauccuuuuggcuauuauuugacuaggacuaucacuaucuuuuugcuguucuagucauauuuuuuuaaagaauuugaugacuuauaaauuucaaaaaucgguguagaauauaaagacaaacccagagaaaauguguauuauucuccaaaauauaaagagcucgguaugaugguauaugacuuuaaaccgaacacucaggaaguagaagcagacagcuucugugagcucgaggcagccaagguacacagugagaaccuaccucaacaaauaaacuauaaaagaugaggaaugaguuacaaacugaaaaucagaugagaauaaaguagccauaaaaagcaguuaucugagcaaauuaaaguucucuguauugaaaucuaguagaaaucuaaaaucaaauugugccuaacucuuauuuuugaugaguugccauauaaagaauauagacaacuuaaaguaauuaccucuugugaaauaucuaaaaaaguuuuucugaguaguaugaagaacacaaguuaguaauuuaagcagaguaauugaagauugggacgcuaccuggcaaaguucagaauucuaacuuaaaacuacugaauaagcaauguuuauuuauauaagauaaucauugcaugcuuauuaagaccuaaauauuauccuaggaucauaaauuauguuuccucauguaaaaaaaaaauuguuuacccaaaaaauugcaguuuuguucuuuauaaauuucuguauaaaaagaaaugauuaauaugguuuucuuauuacuguacuuuguccucaaguacagugguucugaucuuuccuaaugaugagacccuuuauacaguuucucauauuauagugaccccaaccauaaaauuauuuuguugcuauuucauaacuguaauuuugcuguuaugaacuauaauguaaauaucugauaugagauaccgguaaaaggguuauucggacccaaagguugagaaucacugcucuaauagacuauaagaaauuuauaaaaagaaaauaaguagguugaguuuuuaaugaaacuuucuauuguugcuuuuuuaauuuauaauucaaaauauauauauugacucauuuaauaugaggcacuguuuugauaggcuuaaggguuuuuuaacuuauuauuuaugaguaugaguguuuugcuugcauaugugucugugugccaugugugccuaguguccucagaagucagaagaggacaucggauucccuggagcuggaguuacagaagguugugagcucuccuacucgugcugggaaucaaaccuuggcucucuacagcacccagugccugagccaucucuccagccccauagucuuaaacuguagcccuggcuguccucaaacuugugauccuccugccucaacuucccaaaugcugggauuacaaguguguggcaccaugcccugcaguaugcacuguuauuuaaaugcaaccaaauggccaugaaauacaacccucccccaaacuguuggccuuuuuuuucuccuuccugugcuucuccaucccuaccucuuucagcuguugaaagaaagcuuuucuuuccauagacaaguuuggccaaaguuagcucacucugcuaaaacuuuuuuuuuucuccaaaucgaaggguucuuucauaaggaaaucuaaacagaugauguuuuaaacagugacuuauucaaaagacuuaguugauucuacacaggaccucaaauucuuguuuaucuacuucuccccauguuaaaccuguuaaauguaaauuauuuaaaguuaugaaacauaaaugcagcuaucugagucaguuuuuaaaacuguuauaacugagagaauauggcuggcuuguggagucuagauguuugaagaccaaauucuuuagggggggcaugagccccucuacagggugucaguaaaauaccuauuguugaaguaaaugacugcugacuaagcuauuuugaaaaaaauuaacaaugguggaacacauacauuaaaaauggcuaaaaguccauuuauaacucuguuuuaaaaagugauguuugcuauaugcagguucuuuagugcuaaggcuauucccagaaauauuaaaaacugaaaguggguuaaguagcaacaucacacuaauggcauucaaagcugguggucacagaaucauccuaaagugccugaaaguuucuguacuugaacacacuuuuaaaaggaaaacaaacaaaaauguuuauuuaaccuccaaacaaauaaucagaauaaagagccuccacauaugguaucagaaauaagaugaguuucucaaaauaagugaccauuugcugaaacauguuaacauauuuuuguguguguauucguguuucuguuucuuguuuuuguuuuuguuuguuugcuugcuugcuuuuugaaacagggucuuaaugauauacagccuaaccugccuaaccuggaucccaggggcuggcauugaaucuguagugauccacgugccuccaucccaaaugauguuaacauauuuuugaaaaaucauuuagaggacaagaaucaauuuuuuuugagauuuauuuauuuauuuuauguaugugaguacacugucgcuguacagaugguugugagccuucaugugguuguugggaauugaauuuuuuaggaccucugcucacuccaaucagccccgcucacucagucccugcuugcucuggcccaaagauuuauuuauuauuauacauaaguacacugucuucagacacaccagaagagggcucagaucucauuacaggugguugugagccaccaugugguugcugggauuugaacucagaaucuacgaaagagcagucagugcucagagccaucucaccagcccaagaaucaauuuuuuaauaacucugccaugauauaagugguagucuuauguuuauuguuuuggaagcauuccaaaauugcuggacugaauuaaauaucuguggcuuuuauuaaaccaugucaccucaguuaucuguuagcagucuaagacucuuuuguuuuagggcugguugguugguugguugguugguugguugguugguuuugagacaagaucuggcuuuuuaccacagacuggccucagagugguaauccuccugccucaguuucuggaaugcuaagauuccggguguguggccccgccccugacuaacauacucuauuccguacacuucaggguuacuauuucgguuacaugguagcagcugucauacaagcuucuuagagauuuuuguuccaauuuauagaagaagccaaagaggucaagcaguuacccugcaugcacagcuagaaccaaggucgggaucuaucugacuguggugcuucugucuuuauguugcuuuguauggauguuugugauaagcuucuccuacucuuucagaaggcuauuguaacgauaaaugagauaaugaauaaaaauguacguuaaaucucgucauggauacuuaucaaaguguuuuuuaaugcugauuugguacuaagauccuuaaauuucuucuuuuuuuuuuuuuuuuuuuuuuuuuuuucaaagcuucaucuaaaggauaagaagcgauuugaaaaagcuaaccaggauucagguccuggucugagucuugaagaguucauugcguuugagcacccugaagaaguugacuauaugacgguaaggaacaagcuugacagaaauacugagugacuaaaaccuaggugccaaguuguuaaaaugaguuguaaaacaacagaauguagagacuuaauagauuguccaguacucuucccacauaagagagaagagaggcuucuggugauggugagaugauaggagggagaaagaaaggacguugcuuuucaucuuuguguccugucuuucugccuccucugucagaaccaucaaggccguucaccccuuuguaguuuucagacagaccuuguucuagguucuugaugcugugucauccaaguucucgugugcuuuacagccucaugagaacuuuuggucugggagaguggauugcauuuugauugguuuucacagggugggaguggugcugccauacuuuugcaggauuacacauaguauaguaaguccucaucccugagaaccuaaagaacuggucugggaaugccauucauuaguuugcccaaggcuucaggccccagcaccacaaauaagugauggaucagcaauucgacccugaacaguuggauucuaguuuaauuauucuaacacuucuugagaagccuuacuuugcaucacauaauaagaaaacuuuaaugacaauacauguauacugaggucugcuguauggcauaaaccuccagcugugugguuuauuuccugaguauuuuauggagggagggguagcuuuuuguugaguagcuaaugaccagaaucuggugucuugaauaacaagcaggcacaucuuucuccauagcucagcggcaaggcugugccauuagugccacuuugcuugucauugugaaguuucuaauuucucgcuuggcacaaaggacaugaccuaguuuaagaccagugcuagguguaauuuaaaugccaaugcuaagcugggccaagcuaauugaguucuagaaaagcaggcagaggauacuggacuuugacuuuuuagagaacaaggaacaguugacuggagaugaggagagcuggagagagcaauuaaauaacaggcauuauguaauaggagccuggcaggggaauggaauagacuccaucaaugcuuugaaaaccuuguaauagcaaugucaggaauguuguuuuacaaguauuaagagagaacgaggacccugaaguuuucagcuuguguaaaaguggcaaaagccaugccuuugacacagugggaugcagcagauggaaccguccaugguggugcugucuaugcugugauggagcugauggccgcacaugagacaugaucacaguauggagucucaccgagagcagcuucacugacuccugcuugcuuaccuugcuugguuuuguauagguauguuggauauaggaaaaggcaggaauauaggaucaguuauuaucagugauuuuuaucauggauucaaguuagaauuuagucugaaaggcuuguucuguucuguuugugguacugggaauugagcauaggcauuugcauauguucauaccagguccuuauaaauugugucagcuagccuugaacucauuguauaguauggacaggccuugagcuuucaaucccccugccucagacuuccaaauugcugugauugcaggccugcucuaccaggucuagcuuugaaauauuuucauucauguaguucuaaaaauucuuuuaaaguauggcgacauuauugaaauaaaucuguuguuccccaaguauauugcuuggauuugggaauuaucauuuugaucagugauucuuaacuuuuguuggauuauaaacucccuuccccuuuaaaaauacgauuuauaauuuuuaaaaaaauauaugguuuauaaauaaacuguagcacuaucccagaagaaauguauauagacccaccacacaaaauauuagcuuuaugagauucucauauguuuucucuaaaacuaauccuuggauccucuucuacaugcaaaauuuguacaacuggauuuuuaaaaggacaauaauguguguuucaauguugauucauacaguuguagguaagcccuugaacuugucuggacuggagauuugaguguauauuuauuuucacuacaguucaaauucuaaaguuuggauugagaggcuuagggagcagcugguagugaagacaugagagacaggcagggcgauaauuaaagguaaagcaaagcccuggggaugagcgcaucccagaagauacaggauccgaggagaagcaggucagggacuugggcgaggcaggaguugagaagugagagcugaaggaaagaaacgcuccacagugagacagaugaaggguugguugcucggugagagcuuggugugagcgagagacagauuugaauguagaaaaugaauguaggcuuagaaguaauagggagacugacuuuggaaaccaagagcugcuguuuccacccugcaugccaaggagucuaaggucaugaucuuugagagccccuacuggauugcagagcuaauggagcuaaagggguuggggguagucagaaguggcauucuuuuucuuauauacaucuuuaauaaauauaaauuacuuuuccucuuccccuuccucccucccuccaacuccucccaugcuccccaucacucaaauggaaggcuucuuucuuugaugaguuauugucacauauguauauguaugcagaaguauauaguuacaacaugcugacugcauuugcgggggagggguugugcacgcaggcacgcccacacagucucagggcugaccacuuuguauuggauagucaguuagggugcucauuccuaaagaagcagucauuaguuuccuguaguucuuugucuagcaggagaccccgugagacuuucagagacggcauucuugagaaggaagagaauguacagaaagcaggagaguaugcuuagugcugcagguguuuaugggaguaaaauagaauucuucacaacaaaaaagaauaaagauguaacguuuaaaaucccucaguacuugggguuuauucuuacuucugaguucuggaauuuagaaauuguuuccuguaaguaugaacaaccagaauaauuguuuaugaaaaauuucugcaauaggauuggucaaguguuugugacaguguuugugacaaguaucuuuucuuugaaugaacgugcaauaggaguucgucauccaagaggcuuuggaagaacaugacaaaaauggcgauggguuuguuaguuuggaagaauuucuuggcgauuacaggcgggauccaaguaaguuuccugagggagauggagaaagagugggcugggauuaagggaagagccaagcuuauugagcgcuguaugaugaggagccugcucagcaucacagcuuaucugacaugcugccuugcuugguuuuuuuccauguacagugucaaacaucuuccuuccuuuucuagcaaauauaaugccauugucaauucaaagaggaaggaagguuguucuuuuaggucuugagaagggacauaaaauauuauauauacuauauauuguguguguguguguguguguguguguguguguguguguguguguguauuuaguaguauagacuagaugaaguaaguuugacuguaaagagaaaacccucucucuaagcuauuguucuuuaccacaacuguugcuuacaaauuuuuuaaaaugcaauuauaaaguuguuucccugguuuguuauugcaaaugaaacuugaguaagacaucacaguacaggaacguguaaaacagucacaugguguuguucuggacuggguguguaucuguucagagugcugccuggcauacuggagacccuggcuuucagccuuagaacugcacaaaccagacgugguggcacauacuguaguccuaguuuauggaggcagaagagucagaacuucagaguugccuucagcuacauagggaguuugagacuagucugaacucugacccugugucaaaaaaauguuuuuaauuagaaauaaauguuaccacuuaaaaauuaggaaaacuggaagucuggauaugugguaacacuuaauaaaagcacuaauuaaauaugcaacaguuuuaaacuaaguccuuuuagcuaacgucucacuuuuggaaaucuuuacauuuuugucccuauuucaggacuguucuguuaaguaguucuguuucuuggguuuccuuuuauaguaaacuuuaaauucacuuccuuuagcgggaguggguggguuggugagcgggggggggggggggggcgugauagcggaaggauguuuuucagaggggaaaccaagaaaggggauaacauuugaaauguaaauaaagaauuaaaaaaauggaaaaaaaauucacuuccuuuauuuuacauuuauaugaaacugguuuugugugauauucuuauauauuuauauuuuguuuuugcuuuuuucuuaagcugcaaaugaagacccagaauggauacuuguugaaaaggacagauuugugaaugauuaugacaaagauaaugauggccggcuugauccccaagagcuguugucauggguagugcccaauaaccagggcauugcacaagaggaaguaaguaccagaauucccaguucacacuguguaacugaggggagagcaagcuguaaccuggauccaaggaaaaaagaaauggaauuauuuaagauggguacacuauuuuguuuugaauuaaaugauaaaacucucucauauuaaccccccccccaggaaacaagaaaguuaaaagugugucauguacuaaucuuaggacacaauccauaggaugacagcuguguccuaccuuuggaggcgcaaguggauuguacacugugcuaacccuuuuuuaacuguguguagagaugcagaacucagaauagauuaauuaagagaauaaugagagaagcaguagacagacagacacaaugcauguguaaucguuuuaaaacguggaauuuacugagcuccugguauaccuaugugguuuuggcaaaucacacuaaccugagcauuuuccuuacaaagacugauucuggacacuuuaugguuuauuuucuuuuaaaggcucuucaucugauugaugagauggauuugaauagugacaaaaagcucucugaagaagagauucuggaaaaccaagacuuguuccuuaccagcgaagccacggauuauggccgacagcuccaugacgacuacuucuaucaugacgagcuuuaacccccgagugcgccccagcaggaugcggccuucuguaguuugcuaccagcuugacuuuuaugaugagauauagauguuguccuuuacacucuuaagucuuaccacuucagaugaucuaaauguagauuauaacuuuuggccuuuucaaagaaaacaaaacaagaacuugucauuuauuucaagacauauugaaggaguaaacuauuaauguugugccauaugaccacacagucuuuccuaaguacuccaucuauguagugcuguguuguggaauguugagcucuguugccauacuugaagacauggaggauuuagacaugucuaaacaauaguauuuaaguagcacgugaugaagcugucaguuuucguucuuguacuaguagacuuacuuuugaaacugacaaaggacaguguuuagauuuaguguuuuaucuuaaagccuuuaaaggaaccuucacaaggacuuaaaccucacauagauguugagaaguucuacuuaauuuuaaaaugguuucuaaaaaggguuuugucguaugaaauagaacuuuauauuuuugcauauguauagauaguaauuauauuuaauguauaacuauagcauuaugguguguggaaauugacauuguccagaacucuucacuuuugauugauuaaaaauaaacuguccuaucuuuuuauauguuuggguuuuuguuuuuuuuguuuuauuuuuccagauaaaucuuaaauucagcauggguuuuguuauauuaaacauuauucauuccuuuauuagauagugaauguucucaagauuguuaauuauucuugguacauagucuuauuuaccuuuuuuuaaaaaaauuaaaagaauuauguuauaauugaacgugcaccugagacauuuucaauugcuuuuaugcugagugugauuuugcacuuuggugcuaacauaauguuuuuguuuuguuugagaugcuaggaaucauccccgggaccuuucucuggcauucuagagaaguguucugcuacugaauugcaaacccuuuagccccagagauaaccuuaagccuuguggaagcugagagccaccucacugagcgcuuauccacacccagacaauuggauuucgucauauucaaguaucagcaugccuuuguuagaguggaggaaaguaggugagaaauuaacuuucugggcuugugacuuagagauaguucuuuuuuuuucuuugccuugcauuccuuuuauuuauaggcgaaaagucagcugagaauuuguuggguuuuuuucagguuaccaaucagguggcacacauaguguagcucaccaggcccuugugaguguuugugaaccgccuccaccccccaccccaccccuggcucuuuucugacagaguugacuaccagcuccugcccugccuuugcugauguuaagcuguagaugcaaacugugaagucagcauuaacuauagcugucuuacccuaguagcuaagguuuucacucuaacccacagcaucacgaggcucuagcaguguaagaauugaauuacugucaucacucaucugucacugcucggccucacugagauuguuuaagguagcuacugugguuaucaggauguuaacugauuuuguuaguagauucucuaaagcccacgucacagauguuagccuaucauacagauuuaacuuuaguccuuagcagaaauccuuucacuuaguuaagaaguuaacauuguccauucagcaugaauauacagauacaaaacuuggugauuguuaggguuuaccaauaucuguacuguuuuccuuagcauaaaggaaacugguuuguagcccucuuaagguaggcagugacuggcuccaaccagcugaguauaguagucauugucacuccaugacuagucagaggcagccccuuucuucuacguagcacuguggaggagguucaguggaaacacuagagccacagaguugaauguccaugauugcuuaguggccacauggagaacaaauggacccacgguggaaauaagcuuuuuauuuacauaguuuuaaugauaccagccuagagauagaggaauuuuugcuguuuuugaaccacagcaggacucagcccauccuaagugaagauuagcauugaagaaguaacuucuauaggcacuuaagcaaaaaggaucuauuaaaacagaauagaacuuuuguuuguuuuuauuuuuugagagaguacucccaggugggccuugaacuuguccucuugcuucucgauacaguugcauaguucuugcuguccaugcaguagaguagucaugacaauccacacuuacugucauccaaauccccuguuguacaguaagauucguucuuggucuucuauguaguauguauuacagaaauaguuuucauuggccuucaagauggugcugcagugggguauagcagcacaggccuguaacccugcacugguugguggagugcuugccgagcauacacaaaacauuggguuugaucacuagcacuacauaagauuggggagguagaggccagaggaucagggauucaguuuuuauacucacuacauagacaguuccaggccagacugggcuacaugagaccucuuaaaaacaaaaacaaaaaaaggaagaggaggaagaagaagaggaggagaagcagcagcagaagcagcagcagccacaaccgggauuuauagagcuguuacgaaguaguugaaagaaguuuuaagucuucuauguagcccugguuggccuggaacuuccuguauagacaugcuguccuugaaucggggugaucuuuugcuucugcuuccuauugacauuacaagugugcaacuucauauccaacuucucgcggcuuuucauuuuacuuuugugggucuuuaaaaaaauaaucugcuuuuguucugucuucuacagagaguuuucugagaccagauucuaaaugaagagaaagcaucaaaauuuuguugggugcuaguuuugcuugcuaacacagguaaagagaugauccuguuccagggaaacacugagagcacgaagcccacucuugugugaacggcuggucuaccugaacucucuuuaaauaauaucaugcaaaugcuguauuuugugaacauaccaguaauacaaaacacgauucaagcuaaucaggggugaggaaggcaagggagacugagcuauuacuagcauuguaguugauagucuuuggucucugcuccuucagccauucugauucauaaccccagcagaaguaaaccaccaaacaacccaacagagagcaaaacagcagucacugggggcuugaaggaagaaagagaugggaaugagcuaugucaaugcugcuguccuccuaacuuaagaaucugacaggcaucugacuuuaaaaaugucauguggcagaagcugagcuagaagucagcguagguaguccauagugaaguggaagaaacacaaguucaccuggagguucugcugucuucgcugucgcaucuuccaggcccagugauuagcacauaauagacagcuacugaauccaugaacuaacaaagugugauaacugauauauccgucuaacacacuguucuuuuaaugucuuauugauucuucguggauucauaucauacaccccaauccuacaaucguauuuacccuccacacuugcuaccuacaccccaaag

SEQ ID NO: 5118 - RNA, 20043 nt, Mus musculus
cuuugggguguagguagcaaguguggaggguaaauacgauuguaggauugggguguaugauaugaauccacgaagaaucaauaagacauuaaaagaacaguguguuagacggauauaucaguuaucacacuuuguuaguucauggauucaguagcugucuauuaugugcuaaucacugggccuggaagaugcgacagcgaagacagcagaaccuccaggugaacuuguguuucuuccacuucacuauggacuaccuacgcugacuucuagcucagcuucugccacaugacauuuuuaaagucagaugccugucagauucuuaaguuaggaggacagcagcauugacauagcucauucccaucucuuucuuccuucaagcccccagugacugcuguuuugcucucuguuggguuguuuggugguuuacuucugcugggguuaugaaucagaauggcugaaggagcagagaccaaagacuaucaacuacaaugcuaguaauagcucagucucccuugccuuccucaccccugauuagcuugaaucguguuuuguauuacugguauguucacaaaauacagcauuugcaugauauuauuuaaagagaguucagguagaccagccguucacacaagagugggcuucgugcucucaguguuucccuggaacaggaucaucucuuuaccuguguuagcaagcaaaacuagcacccaacaaaauuuugaugcuuucucuucauuuagaaucuggucucagaaaacucucuguagaagacagaacaaaagcagauuauuuuuuuaaagacccacaaaaguaaaaugaaaagccgcgagaaguuggauaugaaguugcacacuuguaaugucaauaggaagcagaagcaaaagaucaccccgauucaaggacagcaugucuauacaggaaguuccaggccaaccagggcuacauagaagacuuaaaacuucuuucaacuacuucguaacagcucuauaaaucccgguuguggcugcugcugcuucugcugcugcuucuccuccucuucuucuuccuccucuuccuuuuuuuguuuuuguuuuuaagaggucucauguagcccagucuggccuggaacugucuauguagugaguauaaaaacugaaucccugauccucuggccucuaccuccccaaucuuauguagugcuagugaucaaacccaauguuuuguguaugcucggcaagcacuccaccaaccagugcaggguuacaggccugugcugcuauaccccacugcagcaccaucuugaaggccaaugaaaacuauuucuguaauacauacuacauagaagaccaagaacgaaucuuacuguacaacaggggauuuggaugacaguaaguguggauugucaugacuacucuacugcauggacagcaagaacuaugcaacuguaucgagaagcaagaggacaaguucaaggcccaccugggaguacucucucaaaaaauaaaaacaaacaaaaguucuauucuguuuuaauagauccuuuuugcuuaagugccuauagaaguuacuucuucaaugcuaaucuucacuuaggaugggcugaguccugcugugguucaaaaacagcaaaaauuccucuaucucuaggcugguaucauuaaaacuauguaaauaaaaagcuuauuuccaccguggguccauuuguucuccauguggccacuaagcaaucauggacauucaacucuguggcucuaguguuuccacugaaccuccuccacagugcuacguagaagaaaggggcugccucugacuagucauggagugacaaugacuacuauacucagcugguuggagccagucacugccuaccuuaagagggcuacaaaccaguuuccuuuaugcuaaggaaaacaguacagauauugguaaacccuaacaaucaccaaguuuuguaucuguauauucaugcugaauggacaauguuaacuucuuaacuaagugaaaggauuucugcuaaggacuaaaguuaaaucuguaugauaggcuaacaucugugacgugggcuuuagagaaucuacuaacaaaaucaguuaacauccugauaaccacaguagcuaccuuaaacaaucucagugaggccgagcagugacagaugagugaugacaguaauucaauucuuacacugcuagagccucgugaugcuguggguuagagugaaaaccuuagcuacuaggguaagacagcuauaguuaaugcugacuucacaguuugcaucuacagcuuaacaucagcaaaggcagggcaggagcugguagucaacucugucagaaaagagccagggguggggugggggguggaggcgguucacaaacacucacaagggccuggugagcuacacuaugugugccaccugauugguaaccugaaaaaaacccaacaaauucucagcugacuuuucgccuauaaauaaaaggaaugcaaggcaaagaaaaaaaaagaacuaucucuaagucacaagcccagaaaguuaauuucucaccuacuuuccuccacucuaacaaaggcaugcugauacuugaauaugacgaaauccaauugucuggguguggauaagcgcucagugagguggcucucagcuuccacaaggcuuaagguuaucucuggggcuaaaggguuugcaauucaguagcagaacacuucucuagaaugccagagaaaggucccggggaugauuccuagcaucucaaacaaaacaaaaacauuauguuagcaccaaagugcaaaaucacacucagcauaaaagcaauugaaaaugucucaggugcacguucaauuauaacauaauucuuuuaauuuuuuuaaaaaaagguaaauaagacuauguaccaagaauaauuaacaaucuugagaacauucacuaucuaauaaaggaaugaauaauguuuaauauaacaaaacccaugcugaauuuaagauuuaucuggaaaaauaaaacaaaaaaaacaaaaacccaaacauauaaaaagauaggacaguuuauuuuuaaucaaucaaaagugaagaguucuggacaaugucaauuuccacacaccauaaugcuauaguuauacauuaaauauaauuacuaucuauacauaugcaaaaauauaaaguucuauuucauacgacaaaacccuuuuuagaaaccauuuuaaaauuaaguagaacuucucaacaucuaugugagguuuaaguccuugugaagguuccuuuaaaggcuuuaagauaaaacacuaaaucuaaacacuguccuuugucaguuucaaaaguaagucuacuaguacaagaacgaaaacugacagcuucaucacgugcuacuuaaauacuauuguuuagacaugucuaaauccuccaugucuucaaguauggcaacagagcucaacauuccacaacacagcacuacauagauggaguacuuaggaaagacuguguggucauauggcacaacauuaauaguuuacuccuucaauaugucuugaaauaaaugacaaguucuuguuuuguuuucuuugaaaaggccaaaaguuauaaucuacauuuagaucaucugaagugguaagacuuaagaguguaaaggacaacaucuauaucucaucauaaaagucaagcugguagcaaacuacagaaggccgcauccugcuggggcgcacucggggguuaaagcucgucaugauagaaguagucgucauggagcugucggccauaauccguggcuucgcugguaaggaacaagucuugguuuuccagaaucucuucuucagagagcuuuuugucacuauucaaauccaucucaucaaucagaugaagagccuuuaaaagaaaauaaaccauaaaguguccagaaucagucuuuguaaggaaaaugcucagguuagugugauuugccaaaaccacauagguauaccaggagcucaguaaauuccacguuuuaaaacgauuacacaugcauugugucugucugucuacugcuucucucauuauucucuuaauuaaucuauucugaguucugcaucucuacacacaguuaaaaaaggguuagcacaguguacaauccacuugcgccuccaaagguaggacacagcugucauccuauggauuguguccuaagauuaguacaugacacacuuuuaacuuucuuguuuccugggggggggguuaauaugagagaguuuuaucauuuaauucaaaacaaaauaguguacccaucuuaaauaauuccauuucuuuuuuccuuggauccagguuacagcuugcucuccccucaguuacacagugugaacugggaauucugguacuuacuuccucuugugcaaugcccugguuauugggcacuacccaugacaacagcucuuggggaucaagccggccaucauuaucuuugucauaaucauucacaaaucuguccuuuucaacaaguauccauucugggucuucauuugcagcuuaagaaaaaagcaaaaacaaaauauaaauauauaagaauaucacacaaaaccaguuucauauaaauguaaaauaaaggaagugaauuuuuuuuccauuuuuuuaauucuuuauuuacauuucaaauguuauccccuuucuugguuuccccucugaaaaacauccuuccgcuaucacgcccccccccccccccccgcucaccaacccacccacucccgcuaaaggaagugaauuuaaaguuuacuauaaaaggaaacccaagaaacagaacuacuuaacagaacaguccugaaauagggacaaaaauguaaagauuuccaaaagugagacguuagcuaaaaggacuuaguuuaaaacuguugcauauuuaauuagugcuuuuauuaaguguuaccacauauccagacuuccaguuuuccuaauuuuuaagugguaacauuuauuucuaauuaaaaacauuuuuuugacacagggucagaguucagacuagucucaaacucccuauguagcugaaggcaacucugaaguucugacucuucugccuccauaaacuaggacuacaguaugugccaccacgucugguuugugcaguucuaaggcugaaagccagggucuccaguaugccaggcagcacucugaacagauacacacccaguccagaacaacaccaugugacuguuuuacacguuccuguacugugaugucuuacucaaguuucauuugcaauaacaaaccagggaaacaacuuuauaauugcauuuuaaaaaauuuguaagcaacaguugugguaaagaacaauagcuuagagagaggguuuucucuuuacagucaaacuuacuucaucuagucuauacuacuaaauacacacacacacacacacacacacacacacacacacacacacacacaauauauaguauauauaauauuuuaugucccuucucaagaccuaaaagaacaaccuuccuuccucuuugaauugacaauggcauuauauuugcuagaaaaggaaggaagauguuugacacuguacauggaaaaaaaccaagcaaggcagcaugucagauaagcugugaugcugagcaggcuccucaucauacagcgcucaauaagcuuggcucuucccuuaaucccagcccacucuuucuccaucucccucaggaaacuuacuuggaucccgccuguaaucgccaagaaauucuuccaaacuaacaaacccaucgccauuuuugucauguucuuccaaagccucuuggaugacgaacuccuauugcacguucauucaaagaaaagauacuugucacaaacacugucacaaacacuugaccaauccuauugcagaaauuuuucauaaacaauuauucugguuguucauacuuacaggaaacaauuucuaaauuccagaacucagaaguaagaauaaaccccaaguacugagggauuuuaaacguuacaucuuuauucuuuuuuguugugaagaauucuauuuuacucccauaaacaccugcagcacuaagcauacucuccugcuuucuguacauucucuuccuucucaagaaugccgucucugaaagucucacggggucuccugcuagacaaagaacuacaggaaacuaaugacugcuucuuuaggaaugagcacccuaacugacuauccaauacaaaguggucagcccugagacugugugggcgugccugcgugcacaaccccucccccgcaaaugcagucagcauguuguaacuauauacuucugcauacauauacauaugugacaauaacucaucaaagaaagaagccuuccauuugagugauggggagcaugggaggaguuggagggagggaggaaggggaagaggaaaaguaauuuauauuuauuaaagauguauauaagaaaaagaaugccacuucugacuacccccaaccccuuuagcuccauuagcucugcaauccaguaggggcucucaaagaucaugaccuuagacuccuuggcaugcaggguggaaacagcagcucuugguuuccaaagucagucucccuauuacuucuaagccuacauucauuuucuacauucaaaucugucucucgcucacaccaagcucucaccgagcaaccaacccuucaucugucucacuguggagcguuucuuuccuucagcucucacuucucaacuccugccucgcccaagucccugaccugcuucuccucggauccuguaucuucugggaugcgcucauccccagggcuuugcuuuaccuuuaauuaucgcccugccugucucucaugucuucacuaccagcugcucccuaagccucucaauccaaacuuuagaauuugaacuguagugaaaauaaauauacacucaaaucuccaguccagacaaguucaagggcuuaccuacaacuguaugaaucaacauugaaacacacauuauuguccuuuuaaaaauccaguuguacaaauuuugcauguagaagaggauccaaggauuaguuuuagagaaaacauaugagaaucucauaaagcuaauauuuuguguggugggucuauauacauuucuucugggauagugcuacaguuuauuuauaaaccauauauuuuuuuaaaaauuauaaaucguauuuuuaaaggggaagggaguuuauaauccaacaaaaguuaagaaucacugaucaaaaugauaauucccaaauccaagcaauauacuuggggaacaacagauuuauuucaauaaugucgccauacuuuaaaagaauuuuuagaacuacaugaaugaaaauauuucaaagcuagaccugguagagcaggccugcaaucacagcaauuuggaagucugaggcagggggauugaaagcucaaggccuguccauacuauacaaugaguucaaggcuagcugacacaauuuauaaggaccugguaugaacauaugcaaaugccuaugcucaauucccaguaccacaaacagaacagaacaagccuuucagacuaaauucuaacuugaauccaugauaaaaaucacugauaauaacugauccuauauuccugccuuuuccuauauccaacauaccuauacaaaaccaagcaagguaagcaagcaggagucagugaagcugcucucggugagacuccauacugugaucaugucucaugugcggccaucagcuccaucacagcauagacagcaccaccauggacgguuccaucugcugcaucccacugugucaaaggcauggcuuuugccacuuuuacacaagcugaaaacuucaggguccucguucucucuuaauacuuguaaaacaacauuccugacauugcuauuacaagguuuucaaagcauugauggagucuauuccauuccccugccaggcuccuauuacauaaugccuguuauuuaauugcucucuccagcucuccucaucuccagucaacuguuccuuguucucuaaaaagucaaaguccaguauccucugccugcuuuucuagaacucaauuagcuuggcccagcuuagcauuggcauuuaaauuacaccuagcacuggucuuaaacuaggucauguccuuugugccaagcgagaaauuagaaacuucacaaugacaagcaaaguggcacuaauggcacagccuugccgcugagcuauggagaaagaugugccugcuuguuauucaagacaccagauucuggucauuagcuacucaacaaaaagcuaccccucccuccauaaaauacucaggaaauaaaccacacagcuggagguuuaugccauacagcagaccucaguauacauguauugucauuaaaguuuucuuauuaugugaugcaaaguaaggcuucucaagaaguguuagaauaauuaaacuagaauccaacuguucagggucgaauugcugauccaucacuuauuuguggugcuggggccugaagccuugggcaaacuaaugaauggcauucccagaccaguucuuuagguucucagggaugaggacuuacuauacuauguguaauccugcaaaaguauggcagcaccacucccacccugugaaaaccaaucaaaaugcaauccacucucccagaccaaaaguucucaugaggcuguaaagcacacgagaacuuggaugacacagcaucaagaaccuagaacaaggucugucugaaaacuacaaaggggugaacggccuugaugguucugacagaggaggcagaaagacaggacacaaagaugaaaagcaacguccuuucuuucucccuccuaucaucucaccaucaccagaagccucucuucucucuuaugugggaagaguacuggacaaucuauuaagucucuacauucuguuguuuuacaacucauuuuaacaacuuggcaccuagguuuuagucacucaguauuucugucaagcuuguuccuuaccgucauauagucaacuucuucagggugcucaaacgcaaugaacucuucaagacucagaccaggaccugaauccugguuagcuuuuucaaaucgcuucuuauccuuuagaugaagcuuugaaaaaaaaaaaaaaaaaaaaaaaaaaaagaagaaauuuaaggaucuuaguaccaaaucagcauuaaaaaacacuuugauaaguauccaugacgagauuuaacguacauuuuuauucauuaucucauuuaucguuacaauagccuucugaaagaguaggagaagcuuaucacaaacauccauacaaagcaacauaaagacagaagcaccacagucagauagaucccgaccuugguucuagcugugcaugcaggguaacugcuugaccucuuuggcuucuucuauaaauuggaacaaaaaucucuaagaagcuuguaugacagcugcuaccauguaaccgaaauaguaacccugaaguguacggaauagaguauguuagucaggggcggggccacacacccggaaucuuagcauuccagaaacugaggcaggaggauuaccacucugaggccagucugugguaaaaagccagaucuugucucaaaaccaaccaaccaaccaaccaaccaaccaaccaaccagcccuaaaacaaaagagucuuagacugcuaacagauaacugaggugacaugguuuaauaaaagccacagauauuuaauucaguccagcaauuuuggaaugcuuccaaaacaauaaacauaagacuaccacuuauaucauggcagaguuauuaaaaaauugauucuugggcuggugagauggcucugagcacugacugcucuuucguagauucugaguucaaaucccagcaaccacaugguggcucacaaccaccuguaaugagaucugagcccucuucuggugugucugaagacaguguacuuauguauaauaauaaauaaaucuuugggccagagcaagcagggacugagugagcggggcugauuggagugagcagagguccuaaaaaauucaauucccaacaaccacaugaaggcucacaaccaucuguacagcgacaguguacucacauacauaaaauaaauaaauaaaucucaaaaaaaauugauucuuguccucuaaaugauuuuucaaaaauauguuaacaucauuugggauggaggcacguggaucacuacagauucaaugccagccccugggauccagguuaggcagguuaggcuguauaucauuaagacccuguuucaaaaagcaagcaagcaaacaaacaaaaacaaaaacaagaaacagaaacacgaauacacacacaaaaauauguuaacauguuucagcaaauggucacuuauuuugagaaacucaucuuauuucugauaccauauguggaggcucuuuauucugauuauuuguuuggagguuaaauaaacauuuuuguuuguuuuccuuuuaaaaguguguucaaguacagaaacuuucaggcacuuuaggaugauucugugaccaccagcuuugaaugccauuagugugauguugcuacuuaacccacuuucaguuuuuaauauuucugggaauagccuuagcacuaaagaaccugcauauagcaaacaucacuuuuuaaaacagaguuauaaauggacuuuuagccauuuuuaauguauguguuccaccauuguuaauuuuuuucaaaauagcuuagucagcagucauuuacuucaacaauagguauuuuacugacacccuguagaggggcucaugcccccccuaaagaauuuggucuucaaacaucuagacuccacaagccagccauauucucucaguuauaacaguuuuaaaaacugacucagauagcugcauuuauguuucauaacuuuaaauaauuuacauuuaacagguuuaacauggggagaaguagauaaacaagaauuugagguccuguguagaaucaacuaagucuuuugaauaagucacuguuuaaaacaucaucuguuuagauuuccuuaugaaagaacccuucgauuuggagaaaaaaaaaaguuuuagcagagugagcuaacuuuggccaaacuugucuauggaaagaaaagcuuucuuucaacagcugaaagagguagggauggagaagcacaggaaggagaaaaaaaaggccaacaguuugggggaggguuguauuucauggccauuugguugcauuuaaauaacagugcauacugcagggcauggugccacacacuuguaaucccagcauuugggaaguugaggcaggaggaucacaaguuugaggacagccagggcuacaguuuaagacuauggggcuggagagauggcucaggcacugggugcuguagagagccaagguuugauucccagcacgaguaggagagcucacaaccuucuguaacuccagcuccagggaauccgauguccucuucugacuucugaggacacuaggcacacauggcacacagacacauaugcaagcaaaacacucauacucauaaauaauaaguuaaaaaacccuuaagccuaucaaaacagugccucauauuaaaugagucaauauauauauuuugaauuauaaauuaaaaaagcaacaauagaaaguuucauuaaaaacucaaccuacuuauuuucuuuuuauaaauuucuuauagucuauuagagcagugauucucaaccuuuggguccgaauaacccuuuuaccgguaucucauaucagauauuuacauuauaguucauaacagcaaaauuacaguuaugaaauagcaacaaaauaauuuuaugguuggggucacuauaauaugagaaacuguauaaagggucucaucauuaggaaagaucagaaccacuguacuugaggacaaaguacaguaauaagaaaaccauauuaaucauuucuuuuuauacagaaauuuauaaagaacaaaacugcaauuuuuuggguaaacaauuuuuuuuuuacaugaggaaacauaauuuaugauccuaggauaauauuuaggucuuaauaagcaugcaaugauuaucuuauauaaauaaacauugcuuauucaguaguuuuaaguuagaauucugaacuuugccagguagcgucccaaucuucaauuacucugcuuaaauuacuaacuuguguucuucauacuacucagaaaaacuuuuuuagauauuucacaagagguaauuacuuuaaguugucuauauucuuuauauggcaacucaucaaaaauaagaguuaggcacaauuugauuuuagauuucuacuagauuucaauacagagaacuuuaauuugcucagauaacugcuuuuuauggcuacuuuauucucaucugauuuucaguuuguaacucauuccucaucuuuuauaguuuauuuguugagguagguucucacuguguaccuuggcugccucgagcucacagaagcugucugcuucuacuuccugaguguucgguuuaaagucauauaccaucauaccgagcucuuuauauuuuggagaauaauacacauuuucucuggguuugucuuuauauucuacaccgauuuuugaaauuuauaagucaucaaauucuuuaaaaaaauaugacuagaacagcaaaaagauagugauaguccuagucaaauaauagccaaaaggauuccuauugguaaguguuugcuuugagacuauaucauuuccauuuggacacuuagauuaauuuggugaguucuuuaaaaaacuuguauuuacuaaaauauauuaauuuuuauguguaugugugcuuacaugaguguauguguaguacauuagggcuggaacccucagaggccagauuaagccacccaaacccuuggaacuggaguuacaaagcuuuguggaugcuggggacccacaccagguccucugaaaaaacaguaaaugcccuuaacuucugagccaugucucuagcccccagcccguucuuaaaagacagucuuagagcaacauguacggugcacuugaugaagaaaacagcaucggaacgaggcaucuuuaagaagggcuacuuguauuucccauaauuguguaauguauucuucaaaaugaagacuuuaaugucaacaccaucaugucuuauauaauauuccuucucaagaauucagaaacacauauaccuucucuguguguucaaguauacgggugcuugugcacauagacauauacuuuuuuugguggaaaaguaauucuuuggagugguaaaaagaaguuagagaagaaugaagguaguaaacaggcaggaaauuauacccuaacuaguaauuuuaaaauauuguauuuaagaucuucccuggcaggaaggccaugguagcauaucaugguuuuagcaaagcuccaagaacucuagugaugcugaggagaacgcccauagaucucaugagcacuugucaugagcacaguaccaucuagcaugaagacugaccuacaguucuuuuaggcugcuggaaaauaaaaauucaaauaacgaaaaaggaagcaaaaaguuuaccuucuuccuacaaauuaaauccuaacuaauuuaagggugaugcaguaaacaaacgccugaacacuuuuaugaaauauaaccuuugugaaguguacauauuucuucuguuugugagacagggucuuuuuuuccccauuaaauuaaaaacaaaccauaucuaugggaguuuuguuugcauguaugucaguauacuacacacaugccugauguccacagaggccagaaacggacaucauagcccugggacuggaauuaaaaaagacuguaagccaccacaugggugcugggaauugaacuguguacucugaaagagcagccaguggucuuuacaacuaaacuaacucaccucuuaauucuucauuacauuuuuaaaaacauuauuuauuuauguauuugggagggggcaucaaagcacauguuuggaggucagagaacaacugugacaaucaguucucuucauccaaaagaaaaaguggguccuggagauuaaacucaggucccaagucuuggcagcaagcaucauuacccauugagucaucucacuggcccaagauagucaugccucaaacuugaaauauuuuugcuucuaccucccaaguacugcuucuuuuacauuauucuuucaacuagaaauuaacuacucagcauuccaacugcuaccgcauacugucuccgcacaccacugcuauccucaguggggauuauaccacuuuuagagaugaggaaacugagcucagagaggucuagcaacuauuaagugguaaggcuggguguaaggcaggcagacuggcuuguaggcuagaaaccuuaaccugcacacaggugacauauggacagguuaagaguaacuacaggccaggaguacuaguacacuccuuaauccuagcacucaaaacuagcacuugaaggcagagggagguggaucucugugaguuugaggaagaguggccuacauggggaguucugggauagccaaagcuacaaaguaagacugucucaaaaaaccaaacaaaacccaaaucuuuaccagacaaauacgaagcugcaguuaguaauagcuuauauaguucaccuagccagugcaauucuaaaauauauacuauauauaaaaugauaaaugaugaccauuauaaaaauuaaagagggacauaugcaaaugaagcagaaaggcucaagugauuuccaaguaccccaacaaguucagggacaucugggacaagguaauuguuuuuauuuuuauucuuuuuuacauuaaaaaauccuuuaaaauguuccugaaauauuaauuucucaagcauauagucauuuauauugauagacuuuugguuuaacagacuuccuggaagucuugaaaaguucuuccugaaaaaucaauaaaaauaacucuucuccccuggcaguggaggugcacacauuuuaucucagcacuugcgaggcagaggcagguggaucucugaguuugagguccaccuggucuauagaguaaguucuaggacagcuaggacuacacagaaaaaaaccuguccugaaaacaaaaaacaaaaaaguucuucacauuucuguuuaagcuauauauuugcuuaaacaaaauuaaaauucaacagacuguauauuggaucuucagaaaugagucauuauuaauaacauagaacuauggaaaacuacacugcaauaccuucaaaaaacuaaaaacagaggcgauccaauaaucucacuucugggaauguacccuagauaauuaaaagcaagaucuaaaagagagacuuguauaccacacuuauuacaggauuaaaaagaaaaaaaaaacaucaugaaguugagaagagguaaagauagguggacagucaaagcacaguguauaaguguaugaaaauuucaaagaauaauaaaaagaaagaauccaagaagauaagcaaaauucggcugagagacucaagcccccacccacccacccaccgaccgaccgacccacuagaauaucuggucuuuuugauuucugggcuuuuuguuguuuuuguuuucuacacaagcuuucucuguguaaccuuggcuguccuggaacucauuauguagacuggacuggccucgaacucagagaucugccugccucugccucccaagugcugggauuaaagacuuguaucaccacugccugcagauaucugucuuuuuagacuauguccuuucugaacagagaauuuugacauaugcuaacacauggguaaacuuugaggacauuauauuaagugaaauaaaguagucauaaaaaagacaaacaugauuuuccuuacaugaaguaccuggaauaggcggauuuauagaugguagaauggugggaguagaaacagggaguuauugcuuaauggguacaauggguacagaauccaguuuugcaaaauagagaguucgaucaacugguugaacaacaagauuaacacagcacuauugaaaacucuuucaaaugguucaagugggcugggaaauagcucauaguggagcacuugucuaccacgcacaaggcccuggguucaaucuccaauuccauuuaaaaaaaaaaccaaaagguguaaaaugguaaauguaagaggugauggcucaguggguaaagggcuugcucacacaugugagaaccuggguucaguccccuaucacccaugucaaguaggacaugcucugugaucaaagcauucuuuacugcacaguacaacuugagaaguucaagagccagcuaccauggaauacgcaguaaacaagagacucugucucaaacauggugcaaacgagugcccaaauaggaauacauacaaccauaaauaaauaaugaaaaauguuaugguuauuuugcuacaauuaaauuuuuauuucauuuuuuuaagggauggaauuauucccuccaaaauuuaaauaugauauuaagcugauugcuaaauuauuugaaaaauaaaaugcugagcuguagauuacugucaccaaaaugcacuuaaggaauaacucuggaaauguggacaaaucagugagaagggaaacagaugcagggguaacuuaggucuagaguuaagaguacuauggcuggcuaaaaggaaaccauugaaacccccacuggagugguccuggugacugcccaguggcaaagcaacagccuaggaccucaggcucucgggagcagcacggacccaccugccugaacgaccccucuucugugucauccagagcaguguucucaucaaagucaaucacccggucguacaucuggauguuguacucaucccacgucacagcgccgucgcuguucuuaucauacuccacaaacugcugcuuggcuucuugcauagcguaaugcuuaaaagacaucugaauccacugacugaguucaucuacgagaauuccccagaacacaaaaauguuuacaagaauuccaaucugagugaagauuucugguuuuuuuuuuuuuuuuuugaaaaaaauaacauuaguguuugaaaaaccugacaaagugucccaauaguauuaauaaaaauaaggaauggggagagcuggcagaguggaagaguccaaggauguuggaauuaucaugucucuuaagaagcauacaauuuugaaugcuuuagaaaaaaauuauuuauaaaagguuaaaguuuuucuuuaacuuaugaguugaauaaaaaauauauauguacauauauauuuuauauacacauacagugugugcuuuuuaaaaaauuuuuuuuuuuuuuaagacaaggucucgcuauguaccugaacuuuuuacauagaucagacuggccucaaacuuagaauccuccugccucugccuuucaagaguugggacugauugcaguugggcccaccacaccuuaaucaagauguguuagcagacaugguuuaaaucgugaacaguagucaagccccugaaggcagagaaauacugcucuaguauaguucuguuaagcaucauugcauguggaagaaauuucaacaaaguaguaaugauaauuucuguccuucuuguauaacugccgguauucucuuggugccugaaggcauagagaacaaguucaaaaauuucaaaugccccuuuucagauucaugauuucuucguagaggcaauuauuacacugcauuauagaagauagguaaggagguuacaacgaauauuugcaagaagagcaugaguguacagcacuuggcuuaaagguaaugugcaucaagagacuaaagaccgcugcuucucugcuggcuuauaaaggcucagguacauagacacgcacagaugauuucuacuucccacuccaagacccuaauauuuauuaugcaaccauccauugacccaacuuauaaucaucacuauuucaguuaauaaaacugagguucagaaaggcccaagguuucacagcuaagagucuauagacccucaccugcuuuuggcuucagagcucuaacaaugguguuuuguuaccucuugagaacgucuacuauuuuuaaaguugugggucucuccuuauugcccaagcuggucugcguuuuuugguuuaagugugccucagggccuuugggcccagcuuuagacuccaagcucuggcccucaaaacucaaaucaguaacguucucuuaaggguccuccagagguuuguguuuccuuaagcacaacgaguguuucuucuaccuuaaaggacuuaguggagccuaguaggaagcagaauguaucagggaccagaagcacaggcucacauugcagcuuggcccuaaaccauagcuuaccuuucaaacucuuuaccuauaaaaugaagaucagacuauuuaagcacaucuagaccccaacaaguacuaaagucuucuagaucaacuccauuuguaaacaaggcagaccacuauccuucuauuagcuuagagauuucaucaugguuuaacaggaacaagccugagggcaccaaugugacuauuuauugacagcauuucccuguuccguaacuucauuaucuggaugcugaccaacacuaaaaggagagacaccacaaacagcuugcugucacaaggacagauucugaaccuucaaaagaucaacccagaauaccugauaguauagguagaauucugauagauucaagguucacuugaggaagaaauugcuaguaauuuauuuagaauauucuuuuacacuguacguuccauuucugccuaagaacauaccuaagagcacucuuuuguuguuuguuuugaaugaagaacauuaaaaauugaauuaaggcuaagagcugaauuccacuccuggguuugccauuuauuuaaaaauaagguuuucccuccugaaugugacuuucuucaacucuaugaagagauagauaagcugguucuaaguccccauuagcaccauuuuuuuuaauguuucgauauaauucacauuugaugggauguuucuauuugcuaauuguuauaauaaacuaauaaaagcagauucuuaaaauuccuacauacugaaggaauguuguaucaugugaugugcuaagaaagguuugggcaagugucucuaaaaugaaccauacuauggacaaugagaaaagugaugugaggaagagucugucucaagguaugacuggcaaacuuauucucuuagggccaguaacauuuacauaccaucaaagcacugauuuuacuuguagcccaccuuccaggcauaagaacuauuuuccauaucacaguuacuuuuagcuuguuagaacaccagcaaucuacuagaauucaauagacaacaguuuuuuuuuuuuaaauguacauuaauuuccuacaaagggcuuucuccauuguugguggugcaagucaguccuuacuuucaguaagaaagccaucagaguccgagucaauuuucuuuaugaucgacugcaaucgucuuugcugcucuucguggccaaguuuaacauacucaucgacgucuuccuuuugggagggaaaccacacacaggagaaucaagcauuacaaucaguggggcgugaugguggaaggaaacagagcuaccacaugccucauuugccccagugguuucaggaugacccacacuucucuucaauacgcccccacuaccacucuaaguaauccugucccuggauccaggaauagaaagaaucuuguucuggaacugcaacaguaccaccagcuuuacaggccucagggucuccuagagcgaaagcugagccccgcccggaccccauugucaggccgcucuugcuaaggccucucucucuggucgucccgcuuugucacaggacaaagcccauggcgaugcgguacccagccugguauccucaccuggacacccagcagcgcuucgcggucguaguccgcccggugcucgcccugcggguagugcaguuccuccgccuugcuggcgccagccaccgcggcguacagcagcagcggcagcagcaguccuagcgccgcgggccuugggcccagccgcaucgcgcccgcucggcgaggacgcagaaagccgcgaggagggaggcaggcggagccggggcuuggcagccuugcuucacgggcagccacagaggggcggcgcugcauguggggggcgggggucgucaguggcggcgguggccggggcuccacaccccagccugaagucugucgacuacugcguugcugaggcccgccaggcccugccuua

SEQ ID NO: 5119 - RNA, 9894 nt, Mus musculus
aucagcggcucgccugcugccuucagagugcaaaauugauucagcuucuguugaucggguaggacugguuggcuucguccaauugguaaaaugccuuugcaacagguuacuugcaugguaaggggaggaaguagaccguggugggggaaagggaggcgguggcucacucugggcgcucgucacuaauuuggagggaggagaagucacuggcuucguggauggaucuuucugaauuuuggcaguagggcuuucuguggucugaugggccucaccuuccccacuagacugagauguaaaaagagauuugggucugacugguggguuuuuaggaauacuuuuuguaguaucugcaucugggggaacggcauaaagcucuuccacacugcaagccuuagggcuagauugaggugcuucuggaggagucuggggggguuggauagaugccacaaucugacauaggacggcgcuugcuuucucccuagugcuguugcugcugcugccuggcaccugagacccuugugccccuuccguuuugcccgcaggcucuugagugggucucuggauuuuugcuggggagcuguggguggaacuguagcuucuuuguggagaagacugaccucuguugagacaauuguuaaacuccugcaccuucugcgcuacugagccucuuuuccgcucugugcuguuggaaaacccuuuagcuuggggacagucugugagcuugcugggggugcuaucagacacuuugcuuucaguuucuauuucuucguaaguauggcuuauuacgcuugugguuuuuuccuucacagagaguucuccacuuguucccagaaaacuuuuguagauggcgagauugucauacgcauuuggauuaauaacaauggggacuuuaauggcauuuuuggaacuccgggcauaggauggcucaucauggaugauaaugggaaaagguggcaucccggcauuguuguaacuauuaaauuuuauuucagacaaauuaggugacuuaacagggaugguuuuagaggagauguuuguagccgugggugaagugggcgccgacuuauggcaguuuuuccuuggagggacauuuggcccaggucccccaguacuuaauucuauuuuagggaucuuuugucguggacuggugcuggacguccacacuuccugguaucggauugcacuggauuuuuugagaugggcauuuauuuguccuggugucaaugcaggugauguaacuggagaguuuggaguagaagaugaaccuuuuaucuugggucgccccaggugcucgcuggccauggcugccgacacauccacaacgguauauggcuuacacagcggcuguuccagauuuaccacacgguagggcuuugucuguucuucuacugggacgaggcuuauggugacugccuggccagcgauaucuguagaagcuuugcucucuggcuucucaguauguacugcaaucuugccauccuucuccuguaaacggagagcaaggacagcuuugugcgucucuggaacuuucaccgagcuuuuggaagucagugauucguccuucuccucauuguuaccaggaggacuuucaaaauuagacucaguuucugcuauguccuuagaauuuccuggguuaccaggagauauccccccauuacagaccuucugggauaaacugcuggcuguuucagagcgugacucuucugugaaggaggagccuggugaugugcagucagaugauauugugcucugaacgcuuccuugaccauaggagaccccagaauuuuccucauaaccauucaggauuucaucauagcugucgucauaguccacagcacagauucucugcagagacuuauuccguaaggggauaguauuccacuuuuugcucacaaagaaucgaacaggagacaggguguuugcccugaaguuagcaaagcgaggcugcccucucaugcgaaucuccauggccaacagcucuucaucgcucucaucccagcucucaugcuccuccuccauguuacugaaaagcacaucuuccucacucuccucaccacuggagaacucaggguagcagaaccugcccccuucguuacugaugaccucggcgcucccgcucaggaugacguguuugcccugagaguccuucaugcucccggucaugcaacugggugggaucuuucuuuccaacgaucguuuguagcaaucauuuauucuucccaagaauguuucucuggcguuuguuucauuuccucugaccggagggguggcuuccaggcccgcuaucuccuuuagcacuucaguuagcccguuguuguuauuggauaucuucugugcacugucauuauuggcacacugcugaggaucacugccaaagccuucagcaucaccuucagaauuguuguuaagugguuucuggcucagggacgucuuguuuugguuccaccccaggaugacaggcuuguucucacaguguuccuggaugcuuagcucgccacacacgcuuugcccaucugccaccaucauagugggcuucacagcgauggugggcuuuuuagccacagggggccggaaguugcccgugcuccugacucggugguuguuacugugauuggcauuaguuuucccacugccgugggugaugggcgucuucucagagucuggaggaagcuggugcaagcuuuuagguuuaaagcaauucuugcauucgccagguuuccaaacguguucaguaaagguguuacaagcagacauuuuuaaaaauagaacuucgcagacaaugcuuuuccuucagugcauagcaagacuugcauuugcaucugugaguuuucaccuccuuauguugucauagcagcuccucuaaguacgaucaaucuguggggaggaaaaagaaaaaaacccugaaugcgaaagguauaugagauuuaccacuacgaaugauacggaaaagaacuagcuuuaacgucuaaauuuuuuucuucaaaggauugagaaaaaaaaaaaacaauggggggaggggaacaacuuuucuauaguuaaccggcaucuuggaaacuuacucauauugguaucuauguaauuuccagcuugaugugucuauggaaauaacugugugaucuccuauccugggaaggccuguauguguaugugugugcucgagugcacaugugugagcuggucgagcacaagugugugguauggaguaaggggugggagugcugggagggaacccggugccucagauacacugagcuccacucuccacccccggguuugccuuugauacugaucugugagugucagucaaucucugcuugacauaucucaguuccuaugcauucuuccauucacccuuaacauauuagcugcuuagcagacucuuuggauccagugcgcuaaaaaucaaucccucguuucucuaagucaguuuuuccaauuuugucuucuuacaucucacuggacccuauucuugccaucgccaggcacugcuagcaguucagaugcuugccaucucuuguccagaugacugggauaagugaggcugagucuugucccauucuaugccaucaucuuguuuguuauugcugcuacuucaggugugguucucagagaaacacacuagccucaccuggaacuuguuagaaaugcaguuucuuuagguccagcccccgacuuguuacacuugcauguuaaucucagcugagccacugcucuacauuggcagaugugacuccaucgccuucuuacuaauuagcauggaaccagguauucuugggcagccuuaccuaaugcagcacuuccuaaugccagugugcacacuggugaaugcugccaggugaauaaaaaccacacgggggacacuccaggucuuaccuaagucaaaugcuaggggagaauaacaaaucugaauuuuaaacacgguauuagaagcuguaagacuagaucuaugccucuuagcaccucaccaucuucuugacaaucaacucuugcuguacucuccaauuggguacucaucucuucuuggauuacagaaggucccuucuguuuccaaagacaggggccucccucccuuccuguguguauguguauguaagcauuuguguugagugugugcacauaugcauguggaggccagaggaugacacuggaugucuuucucagcucuucucugccuuguauuuugagaugggguccugagcucaccaauuuggcuaggcugguuggucagcaagcuccuggcaucugucuauguuccuaccaguacugggaugauuaaaugcacuguacuuuaaaguuuugugccacucaccucucagcacugcagaccuucuagagugccaucacagcccuaugcuucuacguagaaugacaaugacuuguguuggcagggccaagcuuccuggguucaagacucagaauagagcuacaguacuccuaaccuuaggacagacaaaaguguggggauuuaaugccuaaaauaugaaaaaaguccaacugauuacuugggacccaucaaaauaaaacauguugagcuggggauauaacuugugauaguaugguugccuagcacacacaaugcucuggcuucaguauacgcauggacacacacacacacaugaaaaaggggauuuuuuaccuaaaguaaaaacacuuucaaaacagaugggcuuugggagugugaaugcaaaacaaaugauggauuuuaguagauauacugccacauacuguguucauauacagugcguguguauguguguguguguguauguauacacacauacacacauauacacacacauauaugcauauauaucuuauagcuaucugacacuaaaugcugcuugucauauagaaaagcaagugagacccacggugugaacuuccugggacaaucagugaguguauguuugugaaguugagcauguggcacacuugugaggacuuggaugguucaguuaauuuggaaaacagucuggcagcuucuuauaaaguuaaacauaaauuugcuuugauaccuaacaaucucauucuucgauauuuacuagaaacaauaaaaaugucuacuuauaccaaaaccaguauacagagauuuacagacaaaaacuggagccaaucauacacaacugcacauauuugucaaaacucauaaauugaacacuaaaaaggaugaauuuuauuauaugcaaauuaaacuucaauaaaccugagcuacaaaagacaguuugggcuggacagaaaauagaccuuggaaggaagaauaaaaggcaagaaaauguuucaagggcugcuacaggcaugcuaagaucuaaugagaaucugcccuaggguguggcaucguaucaggcaaggcagggaaacuuaucucaaagaaugacuggacuuuggagagaguuaagaggugcugagguggaguuuauuccaacaaugugcaaggauauuuaccaagauaggaauacuggagauggcauaacuucugcagggaagaugaucagagcaugcucugugagcccacauacaacagaguaggcuguugauuuucaccaaucuagaacacaggagagaacugugugccucucaagugcuuggggguauuuucuaggcuaggaagagcauggggaugguagagaacaugcugggggugaaccagggagaagacauaacuaccccuuucucucagaaaaaagggcaaauaaaagcuacauucaagguaacgaugaggcggacgccagaagagcagacagcuauuuccuaugcugcucagggguacugggaaaugagggccuaugugucccaguacacuuggcagaacaagcguaggcuggccucucuguguucugguguagcagugaggauggaauucagacuggugggcuggacagcaaaguggcaggacacuggcagaugacucuuuggaaaagauuuggguaggaagaguuagauucaaaaaggacuucuugauuuuaauauaggagaaaguagauaauguuguauggugauaguggggggaagacagagaagaauaagagaggcagaaaaggcagggaaagagagcacaauucaaaucugagaauguuaaaacugacgaagcucucauuuuguuucuguuguuugaugaaccagggguucugaagaccagaaaagaaaguaauucuccuacauuuacaguaaaugugagaccagaacugagacuagggcuauacuauguauguuucgucuacaaaauguauuuauuugauguauguguuuaugucugcggaggucagaggauaaccugcagaagucaguuuuucuucucacccaugcagguuccagugacuguaucaaguuguuaggcuuagcauaagcaaauuuaccugcuuagccauuugcugggccuagcauauguuuaaaauugcuaauuuacuuuuguuagccuugccccuuuuuuguaguauagucuucuugaagaaauaaaaaaccccaaugcaaacauggaauacaaugaaugcagaaaaauuguguaaaccuauuauucagaauuaauuucuacuagcaacuugaggcauuuccuucgagucagcaaguuuucuuuuuuaaaaaccacauccuguauacuaagcaucauaugacacugaacagaaaagaggaagacauccugccuaauagcuuguuaaccaagcugaccuauuccucguaagguacuacagguuuucuuuguaaguaguaugugcuuuauuuuucuccaagauuaauaaauaugaaaaauuauuuccaucugaguauguuaguuaaaccaaaugauggcuuuugaauugaucagcaacaaccacauuaacaaaacugccaaaugagguucaucaagaccaguuaacucacgucaucgcuagaagccaguuuuaguguggccguuccuuugaaaggccugugcacaucuguaucuaugcugcuuggaacccggagaugaaaggagcacacaccuccaguaagcaccagauggagcugcugucuaagccacaaaaccuggacuuugaugccuuccgcuuuaaacacuaauuauguuuggagacaaagauguucaguuaaagaugcugucaaaacuauuuuaacuuaaugcaggcccuuagagaaggaagcuauacccaaugcaggucuauccgaggccgggucuucuggcuuuccugccuuugcagaaucacuuaagggcaauugauaauaccuacagcuuucccuucucgugcccucucguugacagcacuguccaaacaggaaacuugagucaccgaacuuaaguugagacauuaagaaauaaaagugucuccugcagcaugugcauacagacacagcgaccugcucugacacgcucuacgaauuugccagagcaggucugauaaggaguaucaaaauguaaugcuugguuuuuuuuuuuaaagcucauuugcuuauauauucuuuauaaucuuuuauuuaaaauuuuucauaauuuugaucauguuuucccuuuccccaaauucaccccagaccccuaccuacccaaccugauauuuucucccacucccccuuuccaaaaacaaaacaaaaaugaaaaucaaauaaaacacaaaaaacuaauaagacaaaacaaacucuaaauagcacccccuuaaaaacuccaagucccauggagccuguuuuacacugacuuccuuggagugugguugauacaucccaaaacacucugcuggagaaaacugauuucccuuuccuagccaguaucaacugcaaauagcaucuuaguuaggggugagacuugcguccacuuccugucaucgcugggaugacucaaaggaaacaguguccagacacagcaggacugauacacauuugaacuuacagagaccagcacaugagaccagcgcaggcucaaaccaaaccacauucuuagaacccuaaagcaaauccuacagaugaaaugguugaugggaaauuuuaauggcugaagcugccuccagaagcuagccaggauuuaccccaugaucuaaaauucuauuucauaacuuccaggaugaaaccccucgagcuauagauagagcuauucuagaguagcugauuucaucuugagucaugaaggccuucugagaaccuacugcugcucuuugcucucugcugcucaacaauggcuauaauuagugugcuucuugcccaacuguuucaaguagauuugacacaaaacaaccaauucucccuggauuucaaucuuggacuaaacugucagcaucugcgcuugcuaagagggaugcaguuccuguccuuaaagagggacuggguagggggucuauuaaacuccucacacaguacuccuuaaagguaaccaaaggaaagcccgaccaucauaaaggaguaugggaauagacugcuaagguccucccccaauacuuugacuccugaaggccauuagcucuccccauaaaaucugccucauuuccacaguggcagagccaagaauccucacugcuguccacaggcuuuuaaggacacacuuggaggcgcuaggccacauggcaucccacaguagccagucucuaugauuccaacgucaaauuuauaaagcaagguuuucauuaggauuuguaauggaauuugugauucacuuauauauuuuuuuaaaaagcaaaggaaaaugugacaaauaucccacgucauuguucccaacuuuuccuuuuuccacagugaaaaaugcugaccugacaugccaagaccuucaguacaugacuaaaaggguagagaggaaguggaagcaaagcugcaggaagaugcuugcaggagauaaaagacaguuucacuguggaucacaaauagaaacucuaugagaaggcucuucuggagauagcaugaugaugaugaugacgacggcuacggugauaauaauaauaucacuuuccuggcuacaagaauaggcaaacucuuaagauaugauguucuauuaauucaagaacagagcaaagcaaagcaugcuuaauuugcauaucuuaaagcucuauuacaugacagaagcagcccauucacuuuuagcuguucacaauucuguucagggguuaccucugugaugacuuuuccuucugauucccuaaauaccacuauuauuauaucgcaucauacuguaaaauacaaguccugugaagacagaacugugcuauguccucuucuuauuugcaucaauggacugcugagaaaaaacuagacccugaagagagcagacugaacaaauucuacuaaguccuagacauagggucacuuugcccaugaagacucacaauuuucaaaagacccugggacauauaugauaccauuggugcugcucuuagagugaagaaacugggauuuguccaaggccacacagagccugugaaggccagagccagggugagugaaugcaccacguguauauacaaaugguacagggugagcgaauguaccacgaguauguauaaaugguacaguucagcucaggcauggacgacagagaagacauguuguguacaucaaaagaaaagaaaugaggagaagagagaugaaggaacuaagaagcagaggaaagggaaacugggaagaaaaaaguucauuauucuacgaagagaaaccggacuuguaugauuuuagcaaugcaaccauuucuggagacuucacuaucuaguguaaccuguacuuugguaagugauauuauauuuucaacuacacuaaaauuuuccuccuuuagcuacagcaaaguaaacaaucuauucuguaaaacauuuauaauuuaaaccuuuaaagaagaaaauggcaaauuagucaacgucugaauuacacacuacuuugagaaguauagauugauugcuucaagaaaauacugcaauguaacaaguuuuaauuaaaauuauacugaaagaguauuuccua

SEQ ID NO: 5120 - RNA, 1915 nt, Mus musculus
ggguagggauuaggguguuggaaauagcauagcuauugagcccaugaacucacacaguuaugguuaacugcacaagacccauuguguggguucugggaaacaaacuccgaccuucuggaagaacagcaagugcccacccuggccagaacagggguguuggaaggugcuacacuugcauacucaggggcuguacgcuaugugugugugugaacuuuauauggucaaacaaggagugaagccugacaccugucaggaugauaaauccuuacuaggauugaugauggggcagcugguuucuuagugccagguuggaagcaggaaaggaguuaacuccugcuguccucaucugagguauccaagguuaaaguucuccuugacccuuccuccaugaucccuguccauuacagucccacacauacauacauauagguaaaagauacauuaaaaacaaaagaaaagaaauauguaguauagacauucugugcccacaaagcacaucugauucuuuaccaaaagaauuugguggcuucugaacugaauauuucacaaagagauaaaacaggagcuggagacauggcauagcaguuaaaaacacuggcugcuuuuucagaggaccuagguucaauucccagaaccaucauagcaggucacaaccauuuguaacuccagucucacgggaaucuggcacucucucuugguacugcauguauguggugcaaauacauacaagcaggcaaaacauccacauauaaaaaaauaaaauuugucauguaaauaaacauguaaguaggcaaguucccagcuaaauguacauacaagcaagguuauuugugaguuaguuaacacaggagcaaauaaguaacaugggacugaauaucgaggaaagaacaccaagauuguggaaucagaccaggcagaggcccugggcugacacuauguuccuacaagggggcagguuacagaaaagucuucaacaagucuacuguuucacugaugucaggggacaagauaauaaaaccagaaccagguucuaugacauuuugacuuugcuguuuugcacacaaauacaaauuucuggacauucuaguaauacugggcagaaguagggaacccacagcuaccacacuuuccuaagauugagaaaguagcacagaaaccaagaacuggaacacccacccaacaaaggcaagaccugauaccaacaccuacaaacauucaaucaucauggcuccagaugccuagacaccagcacaaacagccaagacaauaugcucccaccacaacccagaacucuacuaugggaggcccuaaaaaaugcaauauagcugaagagcaagacaagagcuucacaauaccaacuaugaauguguuaaaggaccuucaugaggauacaaauaaacugcuuacugaaaugugugaaaacacaaagaaauaauggaauaaaauaaugaaaacaauugaagacaugaaaguagaaauugaaucacaaaggaaaacccaaacugaaauaaaagugaaaauaaaaauuucaaagucaaauaaaaaccucagagguaagccuccccaacagaaugcaaaacacagaagagaaaaucccaaguauugacgauaagguagauuucuucuuuugacuggauaccucagucaaaaauaugucaaagcuaaaaacucaagaccaguggugguggugaaagucuuuacugcuggcacucaggaggcagagucaaguggaucucuccagguucaaggcuagccugaccuucagagagagcuccaggacagccaugacuacccagagaaacccugucuuaaaaagcaaaacaagagucuaaaaauuccagguacaaaacauccaggauaucugggacaguaugaaaagaacaaaucuaaauaauaagaacagaggaaggaggga

SEQ ID NO: 5121 - RNA, 7783 nt, Mus musculus
gaaacugggagcugaaguugagucgaauggaaaagaauggaacugauauguucagguaacaaagcccagagacaucucccagguggagacgcccccccccgcccccacgccguuuccagcgugggagaggaaagacuggagauaauuuuuucuuuucuuuaaaaaccaaccaaccaaacaaauguauuauugcugggugugguagcgcaugccuuugauccuagcuuuagggaggcagagacaggcugauuucugugaguuugaggccaguaagggccacaugguaagacccugucacacacacacaaaaacaaaaaacaaacaaaaaacccaaaccaaaccaaacaaacaaacaaaaaacucaaccuauuguuguugugggguugucauugucaucguuguagucgucauuauuggggaaggccaccgugggacuggaggucagaggacacuguguagagucgguucucuuguucccgguguacagguucugggugggugggugggugggauugaauuucuuucucagcaagugucuugauucacccagccuucuugcuggcuccgaagaguggcagaucucucugcaaucacgcuguuuaaacguuucaucauaaccuuaccuucauuccaaggcccugggacagacccuggcugugagcaaagugacaagaaacugaguuauuugggaaggagugaagaggccauccacccguggugugugguagcuguuaaguuucaaaccugggacaaaggcuuaggugccuauuuaacauaucaaagcaaaccuggcagccuggugcucccugugucccccaucccccuaccuguuacaaggcccuccuggcuggcauacuugucccaaccuuaaacuucuccagcccaggugcccuucucuacauaauccaaccauuuugguugccuggcccuuuugucugcacuauuuugagcuuccugacaguugcaccugguuccccucucuccucucucccuucucccuccccgccuccucacauggcucagggucacauucacucugggcucucccagaugucucugacuuugggagaugcugucucccauauaaaagggccaugcugucccuuuaaucuacaauaaaccuucuccuccauaccuagaagcagucauguucuuuccuuuuuguuucucuuuuucauucaucuggugccaaaccccgagaccagucauguuccuuuuccuuuuuuauuucuuguuuucauucaguagcaaagucaggaauucugcuguggccuacagaccugcaacccacugagaggcaggcucaagggaccacagaggaaaacagaaccaguguuaccuuucuuguagggacauuucuuugccggccucugcuccuccaggagucuauaaauucuaagaggccuuccccagccucccucuugacaaaaccguauucaaaaucccagggaaggguuuugaucagccgcgguggcucaagcaaccagguagugcucaacagcaaggacacauggagcuguucagugugacucaggugcccucucauagaguaggcacauccaggguaggaaguacugucagacugggguucacuacuuaccccagggggucaggguugggggaagcucaucucaccuaucacagggcccugugaucagacagagcggggcuauccacucuguuuucccagcacgggaauggggcuggggugagaucaggccgggaggaggaccugagagaaugaacuggccccuugcuggugccugcacggcugggaacugaugcuccgccuccuuugcugcaugggugucccuauggcuugggcugacuucccucaugauuggauggcaugccuaggaugcugaugcggugggaaagguccucuggagguguucugauccagucgggcugggucuugccugggaaucuggauucuuaccacauguucuagaacaucaguguucacagccuggggaacacugguuucagcaaggagagcgagccuuuuauguggucugaacaugaccagaggaguggauauccacagugaaagaauaggcaugagaaaguggcuaacaccggcuuugaaccuugucugcacauuccgaauacauggggagcucuucagcugccugucguccaggcaggaggacgugucugccccugacuccaucaggcagcuggagcugagccaccaguuuugggagguggggaggaucauuuucauucugucuguauucucgcguccagaccuuguccuucccacagcccagaagagaaaaagccuugacugccuccugguccuguccuggcugauuggaccaacgguagacacuugaccuaauccuggccugacagcucccucugggagucuacagcuaaacagggaagcuggugaguugucccugagggcuggggaagcugaggcugccaucucugggcaacaagcucagucaugcaucccccugacaggacaucugagcaagccaccucuacagagagggacagguggcucugugcagucacaagcugagccgaagggaaagaggaaacacucccuugucccuguucgccacacuggccuaggcuuccccagcgucuguucaacaggaacacccucucacuguccccccacucccccccccccgcucccccagucaaaugggcuguucuagcagucaaguauuaagggaacacagacagcccugguaguuaacacaugaguggcccagggcucuuacuccauuuccugaagggcaguggcuggcaccuacugggcacaucucacaagcuugguacuuuuccuggacaugguauccaaguuugccaacagucccugaagggagagccaugaucuucauuucuuuuucuuuuuugcugagaagagcaguaaugugccucagggugccugcagauuaucgcagagcagagcagaggcuuaagcugguggcagaucgcuuccgaccgaucucaccagaagccaauuauguaaagcagggcugagggcagguccugcugugauaaaggaguggggggcugcugcuugccugcccccuagagugagaugggacaggagagcaggggcgggggacugagcauuggggacuuugggccugugucccaggaagguagcagcaguagaggaaagaggugcugcacagucuugggaccugggaguuauggccccuuccauugauugugguuuccaaucaauagcugauugacagggcgcagaguacuuugugacucacagcugcuccuauccuacccugugauuucucacaaugcuugauacucaucucuuccuuaacagggugagacacacacacauacacacacacacacacacacacacacacacacagagagagagagagagagagagagagagagagagagagagagagagagagaaccagaggucaacuuugucauuccucaggagccaugaccuuguuuuuugagacucucucuagucagugaaggacucagccugucucugcuuccguagccccggguuccaagugugucauugcuugaggguuuuugugggggguucuggggauuaaaagcaggaccuuaugguugcauagcaaguacuuuaccaacugaacuauuucccagccuucucccugcaguuuccaauguuucccaugaaccgcggguuugcucccacccuccccacccugcccucuaagcuuccuaagguaggguccugcucaucacguucuuccuacuacaacccgugccucucagugacuuguagaaguagguacucgaugggggaaguucuagaucaaacaacaucccauuuccaaguggggaaaacccagggaacacacaggaaugacagcugaguugagcuaguaccugacucuauggaccgcccaggguguguagaggcauacacuguccugggacaguguacaaauccagauugaauuaggaugggaaggucuaaagccucauccuguagccagugccuuuggagguggagaacaacuccccuucuggugggagcaggugaaucuuccuagagcugaaagcaaugggccgugaaauagagaaugugcucgcaugcagagcccugccuaagagccugggagagaccgugcuuaauuucaauguaagcacccaguaggaaaaugacaaucaggacugcuaauuucaccccaaugggacaaaauucguuuugggguagggcaccugguguugguaaagcucugacugugugguggggacgaaccuuccuccugggcccaugaggcucuggcuuuaguggcccaugauuguucugcauguuucgaacaacgacugggcacugaaagcuguggagaucugcaugaaucauaacaguagggcacacauuuauuggccacuuauucugugccagacccaguucuaagggccuccaaggcacgaucuaauucacuccucacaagcugaaugggcagcuugccacaguugcacagcuggcuggugguagagccaagauuuggacccagcucucuuggcugcagacucugugcucuuaagccccuauacucaacccaacgucccgauaugcuauauuucaaugguaaaaaguucagcgucuagucuuaccugauccccauguuggcaaacccaaaguuagaggauucauuuguggaagggccuagaccacgaacugaaguuugccauaagaaguuguguguguguguguguguguguguguguguguguguguaugcauagguacauguagucaggggagagucagccaacuauggcuucucuggccaauaugcucacccaagcccaucuagaaagaucaaucagcaccaucaugguucauuuucgucugggugcuccugagccaucguuaucacucuagccccaagucucucaaccuuuaaagaacaagggccaaagcacacagguccccaaggaaguauauggaugugguucccaugaccaugcccccuccccagucccucguagcauagcuagauaguucaggcugguugccuaggauacagugcuuggaacgcccucauugagggugaggaugaggaggcucuaggcugaggcuaccauguauguaaauguuacauucagccucacaugugcgugugcaugugcauaugcgugugcgugugagcacguaugcguguguguguaagguuuuguguggauguaaucugcuguccugucagugugggagaaugggagggggugcuguacagauguugagugcuuuggggugggugugugagcuuacugggguggggugucugugugugcagaggugugcauacucacuuuggacucuuuggccuccaggacuuuccuccuucagcugugagaugugucacaagagcacacaacaacucaccauugccccuggagugcucucgccaacauucugccucagccucccuggccaucauccuguaccuggcuucucuccauggaaacagcauccacccagaggagggaggcuucuguccaacccagggagaucuagcaagcaaggcggagcuuucaaguacaucuucuuuuuaaaucagggcacucagagauucugggucacuuugaaaaaucugcuaucuguuuuugauccccucauacuguaccccagccuacccugcugaugggacuuuggacuuccuagcuaucuggaugagaagucucagggcgcucugcacagagcagcauuugaggcagugugggaaaugggccagaagggacaccaaggcuggggagguggaggggccauagcucccaguugucccaggugacuaucaggguagcaugccaccuugaagauggggauuaacggggccaagcacaugccuggggagguugugauuguugcuuucguugucaugggcaggccaggcuggagcaugaugggaagcuggaaacagauagaaggcccagaugguguuggcuucuccuaggcucuugggaaagauaggaccagagauacuuagcaaggucacccccaaagcauguccaggucuagugcuggaccauggacaggucccagcccgcucugccucgcagcacugggugcugcuguggaugcugcucuaaguuuccauucagccguguuccuuguguccuuggagugucccuuaugaagccggggagcuggcagguaauggagggccaggcuuuacugugcccaugccucucuuuacgacgccauauuuuuuuaacgaccuauguaaaugucugcgagucagaacaaagucagggccuccggcugcccccucccccacucgccugaccuugugcgucccaggggaaaguuuucugagggcuguggcaguggugguagccucuuucguguggccacuuccugguucagcuugagucagagcagggacuauggcugacgacuuauuuugggaccuugugccugucaccucucuuccugcuccucaucuacacaauggaaugcagagcgcuuagcacuuucugaagcaucauggugccgcuacacagcccugggcagugguugggcccugcccaggguuucuuguugucaaaacagguagaccacugcuuuagugcugaucagcccugggcucagugcagugggcaagggauggucucagagacgaccccugucccugcuccucccuggccugcucuuccuuuggcuucaucuucuuguacccgggauauucugcaacaccacucucaggaaggugucuccacagcacagggggguuggggagcaaggaugaaguugaugagcagagaaccaggcauggucacugcugauguccugguugaggugguggcuggacucaaaggagcugagggaagagagagccugggauugugccagggcagccagagacccagucucugggucaccagaggccucuccagccuucccuuuguaguaacagccagaguugugaaugcagauuauaccauaacaggaggacauaaaucccuuugcaggccgagcaaccgaacuccuagggggagcucugaccaccuaggacugcacugcauggccacuguguccccagcuccuaauagaugccaaggccagauuaccaggccuuuagcacagcugcuaaaccuccuuguauucugauuagauuucuagacucuacugaggugccaggguggccugggaggguugacuggcauacaucgugaccaugggcauugacauucacucugcucaccuaccuacaccauagugugcccgccaccagcaccucauucauccgugaaagagagacugcaggagguaguguagcuucguccacuuucacggaugagaagccugaguugagagugguugagaaugaguucuggcuuucaaaccuaccuggagaugggccucgcuguccucucuaccuccugacucuccagauuugccucucacagggaauauguuaucuucagagugggauuaaagaagagaauucaggaauggcuuguagccuaucugucagcaccaccccugauaaacugcagcugacagaauuacugccccugccucugcugcagccugccacagaaaggauauuguggggaccaggggacagcaaagccagacugucucaggaguccccuacuccugagaaaacucuagaggccuguauguauaucaacggaugccuccuccaaggacagagggacuauagauguucccacagagcagcgguucucucuguaggucagugaccccuuuaacaaaccucuaucuccaaaaguauuuccauuacaauccauaacaguaguaaaauuacaguuaugaauuagcaau

SEQ ID NO: 5122 - RNA, 2302 nt, Mus musculus
uccacccaccuccaguaaaggacaacguggcuguguuucugacacagucgucaagcaagggccagccugggcuggcaacaccuacaggcaaucaaucccaggaaggagcgaauaguuaccaccugcuacgacccaugaagauugggucuggaacccugacuaccggcagcaagggaaugaaaaaagaacagacccacagguagguggacacaggaaagcuaaggacaaauggggugugugcgugcucugacgcacacauuaccacagugagcagaagaguucacuaugcacaaugcagagccaggacuuagcuggucaccgucgaaggucucugcaggugagcagucuugggcuguaaucauccaggacguggagcagcaauugcugcuuuuguauacacuggacacuuguugucccuuggaccaggaggaaggcuuugccagcccucugagccucacccaggggagacuuugcuacuuccaccaggcugaaacauuaagguuuuugacauggcucaaccuacgucaacaaugcgcagucacccaauacuucacuuccuucgggcggcuucugcucuccgcacucaagcacuccacaagccucuguuuccugggucaaagaaaauggugaaguucagaggguucagagaaauaucacagcaagcuaggcugucuacccuguguuuauaaaugcauggcacuuucccauccccaagucuuuacccacuuaucuguccccaccaccaaaagcccuucugucccucagcaaccucuuccaucacucccguuuuaaucuaugcuuaacacacgaugcacaggagucuccuaucacuucaaauccugacucuagucccagggugaagaaaagaacaaagcucagcaagauucgaacugagagccuguauuuaccauucuuucugggaacauguauugaggacauauccagcaacccuaguguggaaagaaagggauguaaaccaucauccaggaaaaaaauagaucugaaaagcuaagcauuaaguggaggacuggggcaggggaagcucacaugguuuggcaaaucgggagagacaucuagucuuaguguuugaccuagaaccaaaggguugaauagacauuaacucauagaaguuguggacccccaccccagagagagcgcagcauaugcaaaggcccuguggugagaagacaaagagagaagccaugugaccagagcauagcaaggaaauggaauuggagauggagcuaccuguaaugugaggccaaggcaauagguucuagugggcuguguugggaguuggcuuuucagccuugaggcucugagcgacccuggaaguucaaagcaagggaggaugagcccgcuuuccaacuguuuuugauaccacaacucugcucccugcagucagcaaccacuuuucuugaggcccagggccuggcacaaggcaaggcauauucagaaacuugggcuuuguagcugagcugacaauucaagggaccaggagagcuuggcuucucccaagucuaccuaggcagcacuuagcccucccugccucagauaaguaagcauuaugucuccuccaucuugggccauagccuaccacaagaaggaaaaggaaaagacaagcaaaaugcuccaccagaguuucagggccuucccaagccugccauuggcucgugcuccccaucccuccuccacucuucccagaugggacauuccaucaguuuucuucccugagaggcaucuuccuaugcucucaugguuucuuccuugucagacaaccucagagccugggaauccuugcugaccagccugggagccgugcagaaggagaaucugccacagugccaccgagcgggucuagaacgcggucugcuccaucucagaugugcuagccugcgugcgcugcuuugcuuuccacaacagcucugcagucccuggucagaggguaacugaucucucuuccuaaggauguggagaugacccugcaggugaccuugaggucauggaggucuugcagagacggcucuggcacaccuguuucucccaugcuaaucacacccacccaggccuuggggaggggcucugcucugcucaaagcccaagaaggcugccugcugcccagggaaggagacauguagcacagacauacaacagagaccuaggaaaguguggccccauggccauagggcuauagggucgugggugucagaagcuaggcagaaaaggagcccuguccacaacucaacaguagaguugaaauugcaguuugguaggucgcuggcuggagaaggaggcguugggg

SEQ ID NO: 5123 - RNA, 1917 nt, Mus musculus
ugggagguccugaugccaacagauucagcuagccuagucucuuccuucugccaaggaucagccuggucuuggagagggauucugaggaagaggcguuccagagcaucuaaaagaacggcaugaaguuagucauagaguacacacugacagccgggguucggcuccagacagauuucuccuagagcucauccagauagcucugcucucagagaccaaagcccagucuuuuauuuacauaucauuuacuccagguucccuuuugauuaccccacaaaucagcauucuaugacccacaccccuugauucuuagaaagagacaacaaaccuuuuuuuuccucagauagcuaagcauagagcaaaucugacccaagaccaugaggagaggcagaaugcuauuagaaaaauggaugcugauuugucggcagauucuccacucugcuugaagagacaggaggaggggcuucuuuuuuuaaaagacauuauuauuauuauuauuauuauuauuauuauuauuauuauuauuauuauaucuaaguacacuguagcugucuucagaugcaccagaagagggcgucagaucucauuacggaugauugggagccaccaugugguugcugagauuugaacucaggaccuuuggaagagcagucagugcucuuaaccacugagccaucucuccagcccgaggaggggcuucuaaagacugauguccaguauuuuuuagccauuauaggaaacacagaauguuuuucuuugcuucucccauuccuuucauaucagaguaaaaaccuugauauugucuaaggcagcauauuugagaauaggucauuuuucuuuguacagcuccuaauuuuaaaguuucuccugaucuucuuguugcugugaacacauucgggacauagcaaauuaucuuccacuccugguucugagauaacacaggcugguaacaggaagagaaaauuuauucuuuggggagugucuggaaaccaggucugcccagcaugaaauugcaggcgaacccagucuuuccugucuacagggcacugccugccacggacaucauggaccacacaccaucugaauccaaugauuuguggcagaaaggccccuacagaagaggaaggaggacagcgauucacagacacuggcugagcaguuuuuauagcaauucuuccccaggucccaaauguggaccccugaggugaaguuagaauuuccaguagaccacucuccuacuuuagcagcugcuuggaggcccuauuccucugaagacuaucuuggguuucuugggaaccaacuucauucugaccucaugagauguguugggaauauaacauucuuguuuaaaauaugaaugucaccaacaucucaaauaacccucaacuuucuugccauuccuuugauaacaucauuaauaggaggcaggguggcuggaggagaggugcuugguaugguuccuguugaguguucgauucccucauaccucaccagacaacggacuggugguuugaggucugugguugaagaaacauuugauucuguaggauauucugugguugacuccucaguaaaugggaccagcguuaaaaccacacuuucuuuauccaauucuuccucagauugguucuuguuguaagucuccugguaugacauuuucaggcaggcuugggagaagacaaaagcacucuauuuuuuuuuuuuaaaacauugcaaauuaauucagagauccgaaugccuuuaaaagcacagacaauaagauaccuggaugggauccuguucugagauucccuugucaccaugccugggccuggaccuaaacuugcucuguucuaggcuaguuuugaacucaagaaucuaccugccuuuguaagcaugaacaacaauaaacuuaucuggaugggaucuugcccacaauca

SEQ ID NO: 5124 - RNA, 926 nt, Mus musculus
ucaacguauucccuuucucccgcauucuccaucauggugcggaagcuuaaguuccacgagcagaagcugcugaaacagguggacuuccuaaacugggaagucaccgaccacaaccuccacgaacugcgugugcugcggcgguaccggcugcagcggcgcgaggaguacacgcgcuacaaccagcugagccgagcggugcgcgagcuggcgcggcgccugcgcgaccugccggaacgcgacccauuccgcgugcgcgccucggcggcgcuguuggacaagcuguacgcuaugggccuggugcccacgcgcggcucacuggaacucugcgacuccgucucggccucguccuucugccgccgccgcuugccuacuuugcuccucaagcuacgcauggcgcagcaucuccaagcugcuguggcuuuuguggagcagggucauguccgcgugggcccagacguggucacugaucccgccuuucucgucacucgcagcauggaggacuuugucaccuggguggacucauccaagaucaagcggcacguguuggaguacaaugaggagcgcgaugacuuugaucuagaugccuagcgagucuucuuguccuggcuucucagcuacaggucacugaaccggggauggggaggauugccccgguguacugggaauuuuuccuagaauuuggacugacaauuaagugacugugucuugagagacagugggaagcaguuuuguaccgcacuggggauugcuagcuucuugugccuuaaacuuugugguguagaagcaggaauguuaccucuuccccuuugcuuucaucuugaaauaggaccgucuggauggagaguuugaguucaguauauuuauaucguuuaaagaaacccuuuccuaaugccaauaaaugucccaccgacguuguuuaagugcac

SEQ ID NO: 5125 - RNA, 35236 nt, Mus musculus
ugucuagcuccgcuaaggcaccuaauuggucagucggcacaggcacuggcggcgugcgcgagugguacggacgugcgguaagucuggcccugucuaguuuggcguucucucagccgcaagcucaaacuucuucugaugacccagggcuggcuucgcagccguuaccuggggaggcuggccagucuuggggacuuggacuuggccauauuuuugucguuguauuccaggcagucuggcucaaacucaugaggaacauuuauguguggcagggagaauucuguaaccgaaagacaaacgacuccauugcuagagagacaguagcggggagggcggcagaguucacggacguguggugggagcaucuauugggcuggagaagaggcuugggugagccugacacuuaggaauuaguucgcuucuuuuccucggccuccugccuugcugccauugcagguguaugacacguaagguccuguuagggaucauuucuauggcauacuucaggauaccuugacggggaagcucaguaauuaucuacugaauacucccgguuauuuuacaaacacucugaugcacaccuuaaauccacacugauaauagucacuuuuaacaaauuuucuuagaaaguauucuuagccggguguggugguugcauaccuuuaaucucagcacucagaaggcaggcaggucucuaugaguucgaggccagccuggacuacaaggagaguuccaggacagaaaaccuguccccaaaacaaaacaaaacagaaaaaaaaaaaaguauuuuuaaugucuuaggauauaggaaugcagcuuucuucuuuuucuccuggguuucagacccaaggcuuggugcaaauauggugcgcacuuuggcaaguacuuuaccaaguggagguauggcaccauccuuuguucuuuuauuuguuuauuuuccuauaugcauauguguauguguguuuugccuacaugucugcacaccacaugggugccaugcugggaagaaagucagaagagaguuccaguuaguucccuggaauugguuuacagguggucaugaauuaccacaugaaacccagguccucuggaagagcaaccaguacucucuuuuuuuuuuuuuuuuuuaacuagugcuguguguguuuuuaagauuuauuuauuuuuauuuauaugaguacacugcaacugucuucagacacacacuagaagagugcaucagaucucauuacagaugguugugagccaccaugugguugcugggaauugaacucaggaccucuggcagagcagucagugcucugaaccgccaagccaucucuccagccccgcaaccaguacuuuuaaccuaauggcugaaccaucucuccaguacccuuccacccuguccuauccuguccugugcauucuugcaagauggaaacaguugauaacaguguaaagguacuucccacugcagaacuguauauuugaaugguuaagaugcucacuaaccucacuccauccccaaaucaaucaaaaccaagcacugucacugggcuacaaagccagcugcuuagcuacauugacggaccagauugcagaacugggaauuggaccuagggacaucacacaugcaauggaaacacuccucuauugaguuauaauuccagcuacccccuuuaaaaaacgauuuaguuuauuacgugccucacuauauguaugugugccaugugcuugucuagugcucacagaggccagaagagaguaucagauuuguugugagccacuguguuggugcuggggauugaaucuaauuccuccguaagagugacaagugcuccuagcuccugagccauuucuccagccuguuuuuuuuuuuuuuuuuuuuuuuuugagacagggucucaauagacccacacauaucuagaauucccuaagaaucugagacugacuuugaauugcugguccgcccuuccugccauccuccaugaucccccccagugcugggauuuuagguauuggugagccugguuccaaccuguuuucuuuuucuuucugagauaauuaaggucuugccagguuagcaggcugguugugcgcuuacucuguagcccauccaggccuuuaacuugucauccucauuccucacccugugaagugaggucaugauauuauaggugugaaucaccacauuuuuguuguuugagaacacggucucucuaguguauuccugacugucuuggagcucauuauauaaaccagccuggccuucaguuugcagugauccuucugggugcugugguuaugugacugugcuucuguaccuggcuaccaccuuuuuagucacguguucucccuguuguaccuuucucccagccuucuuucugcucuccugucacauauguucucccccaaaccccuguuuuuuuuuuuuuuaaacaucuuuuuuacccccacauuuuuuuauuagauauuuuuuucauuuacuuuuuuuuuugguuuuucaagacagggcuucucuguguagcccuggcuguccuggaacucacucuguagaccaggcuagccucgaacucagaacuccaccugccucugccucccaagugcugggcuuaaaggugugcaccaccacacccugcuaucaauuauuaucauuaccucacuuaaaacaaugcuuuauagauccagggucucauguuagucagcccugcguggccuggaacucacaaagaucugccucccaagugcugggauuaaaggugugcuaaccuggcuguugugugccauauuuuuaucaccucuucuguuccauuucuaagcuggucccauuucuuugguauugugaauaaugcagcaauaaacauggaucugcacaugucuguaacuccaguuccagggaccugaugcccucuucuggccucugauugcaucaggcuuguucauguugcauguauauacacacaggcaaaacacucauacauagaaaauggaaaauaaaaguaagucuuuuuaaagagggagaggaccaaaaaauaaaaauaaaaaaauuaaaaauaaaaaaagccaccaccaccaaaaaaccccacacauaacaggaaagcagaaagaaggcugggaagacauagccuccuuuggguauacauccagaagcagugucuucguuagcuuuuuguuuuuguuuuguuuuguuuuucuucaaaacaggguuucucuguauagcccuggcuguccuggaacucacuuuguagaccaagcugaccucgaacucagaaauccgccuaugucugccucccaagugcugggauuaaaagcgugugccaccacacccacccuuaguuagcuuuuuauuucuguaauaaaacacuauaaccaaaaucaacuuaaagagaaaaggguuuacaauuccagcuaacagucugucacugagggagugagggcaguaacuuggaggcagaaacugaugcagaggcuauggaggaauuuuccuuauuggcuugcuuuucaaggcuuacucagccucauuucuuguagcacgaaggaucaccuaccugcccgagggcacugcccauaguggacugggucaagaaaaguaccacaaccaaacauuagacagagcucgagaagucuuguggaagaguuggggagaaggauugaagaacccagaggggauggggacuccauaagaccaauagaguaaauuaacccgguaccuagggagacuuuccauucucaggggugaaggagagggaggacugggaggcugggaggguguugugaucaggauguaaaaugaauaaauacauuaauuaauuggggaaaauguaccacaagcuugcuuacaggccagccugguggggacacuuuccuuuucuuuguuuuuuuugaaauguugccccagcuguccuggaacucuauguaaacuggauuugccucugucuccuaagugcuggaauuaaggccacgugugucaccaugccuggccuugguucuuucuuucuaaaaauuauuuuuuaaacaauuuuuaaagauuuauuuguuuauuuuauauauaugaguacaccauugcucuccucagaccccauuacagaugguugugaaccaccaugugguuccugggaauugaacccaggaccucuggaagagcagucagugcucuuaaccacugagccaucucuccagcccuucuuuccuuuuuaaauuauuuauuuauucauuuauaucuguauguguauauguuugucuaaguguauguuugugcagcaagcgaguguaggagaccuuggaauucagaagaagccauugagcccuggaacugggaguuacaggcuguggugagcuuucaguuaaauccaggucuccuacaagagcaguaagugcucuuaacugcugagcugacucuccugcucaugggacauuuuuuuaaaaauugauguucuuuguuccaagaugacucugguuuuugucauaguugucauaaaauuagccagcacaaaugguauugcugugucauuuauauagcucuauuuaaaaauuuuuuuuagaaauaucuauacugauuuccauaauagcuaagcaguccuauacugccaccaucauaauuauaaauucauauuuccgcaauccucuccaguauuuguuauuuguuuuguuugugauagcuauucugauuguacugagaugaaauaucaaaguguuguuuuuuuuaaagauauauuuauuuguuuuauguacaugaguacacuguaucugucuucagacacaccagaagagggcaccagaucucauuacagauggucgugagccacuaugugauugcugggaauugaacucaggaccucuggaagagcagucagggcucuuaacuguaacugcugagccaucucuccagacccaucaaaguguuuuuuaauuaaaauuguauuuuuuuauuuguaugagcacuugccugcauguauguguugccuuauauccauggagaucagaagaggccagaccuggaguuacaaaagauuaagaaugaccacgugggcgcugugaacugacccugggaccucugcaagggcaagugcucugacucccugagccguaucuccagccccucagugugguuuuaauuuauauuuuccugaugacuuaggauguugaccaucauuagaauuuacacguacuuacuuguggguuggugugcaucuauaguuguauguggagccagcggacaacucuugguaacugauuccucucucaccauguggauccuagggaucagacuuaguuccucagacuuggcagcaaaugccuuuacccucuggaccaucacacuggccccugcugaauauuugaaaaaguauuaauuggcuauuuguguuucuucuuuugaguacuauccauuucauuaggucauggauucauuggaggagauuuguucauuuuggguagguggugucuuaguuaggguuuuacugcugugaacagacaccauggccaaggcaacucuuuuuuuuuuuuuuuuuuaagauuuauuuauuuauuuauuuauuuauuuauuuauauguaaguacacuguagcugucuucagggagucagaucucauuaugggugguugugagccaccaugugguugcugggauuugaacuucggaccuucggaagagcagucgggugcucuuacccacugagccaucucaccagcucccccaaggcaacucuuauaaggacaacauuaaauuggggcugguuuacagguucagagguucaguccauuaucaucaaggcaggcaugguacaggagcugagaguucuacaaauucaucuacaggcugccagcagaauaugauuucuaggcagcuagguagagguuuguugucguuguuguuuugguuuuuuuuuuuuuuuuuuuuuugguuuuuugagacaggguuucucuguguaucccuggcugucuuggaacucacucuguagaccaggcuggccucgaacugagaaauccgccugccucugccucccaagugcugggauuaaaggcgugcgccacaacacccagcuacauuuuuuuuuuuuuuuuuuuagugcuuuguuuuguuuuuuaauuacaucauaacugccugucaucaugggaugaagugaauuaauaagccauuuucuuuauguuuacuuuauagggaagauggaagaacugagccaagcccuggcuaguagcuuuucugugucucaagaacugaacagcacagcugccccccacccacgccugugucaauacaaguccaaguacaguuccuuggagcagagugagcggcggcgccagcuacuggagcugcagaaaucguaaggguacucuuggcuggccauaugcugggggcugggaaucagucgcaggcagcuagacuugucuccuuagaacccccuucacagaagaaggucauuuccuguccacaaggucggguggguaaauucugucacagguaauaaauuaucuuuugucccuacauuuuaggaaaauaaggagagaaaaacugagcuuuugaagcacaacucagucauaugguuaacauuuucuguuucuggcaacagaacucaacuuugcaguuuagggacuuaugaaggccaagccuagacuuccccucccccauccccuggguugcucauguguggaggcucacucauugugaugaugguugguaugcucuucccaucugccuucagcucagauguuucuguaguacccuugggaauucaaguucauuccauagauaaucagcagaaaugguucccauauacuuaacucuaaaugccaaaaugaacaaauaggaauaaaucaggauaggcauguuuuagguugcccucucugaagaccuguccuuuguucuuaauguaucuuauccuuuuggggggucagaaaugagaagaaacuagccacagcugugccacuugcaucucgucuggacuuugugaggugcuaugucaguagaugaguuuaagagauaguuccuacgaguucugaguugucugcugaucauaaucccaucucaucccaguucacuccuuucuucuuccuuccuucuguccacucaccucaccucaccucaccucuccucuccuuuccuuuuuccuuuuuuuuuuuuuuuuuuuuuuuucauuuuucgagacaggguuucucuguauagcccuggcuguccuagaacuuacucuguagaccaggcuggccucgaacuuagaaaucuaccugccucugccucccgagugcuggaauuaaagucaugugccaccacugaccagcuuauuccuuguuuucaauuguaauuuauuauuuucaaauagguaacacauucauauggcucaaaauacauggaaaaguauaugggaaaaacucuccuuccuggucuaguuccuccuuugaauuacuaguuccucauguacccuugcaaagcugucuuguacagauagaagugucuauuuauauacaacuuuuauuuuaucaauuaaacaauucaggccaaugacuuaucugaauagguaaagaugccugcugcccagucuguuggucugaguuccaucccaaggacccacaugguugaaggagaaaacuugauuccuuacaaguuauccucugaucuccuuaugugcccauggcacauguaugugccuacacacauccacacuaagucuugcacacaaaauaaauagauaaaauguagucauuuaauaaauucaguuagcaguauacuacaccuacuauaucugcaaguuugauuaauagucucuuguuuuucucuuauuuauuugaaauaagucucagggcuugagaguagacucaguauauaaaguucuuauauaaggaccucaguuuacauucccagguuccaaguaaaacaugauuauguuuaaucccagcacuugggaggcagaggcaggcagauuucugaguucgaggccagccuggucuacaaagugaguuccaggacagccagggcuauagagaaacccugucucggaaaacaaaaccaaaaccaaaaccaaacaugauuauggcagugagcaucuacagauugaguacuguguagagcagagauuggugcucccugaagcuuccuggccaaccagucuagcugaaacaguaaccucuaaccucaacaagacacuguuucaaaaaaaggaaggagagagacuccagacaucagccuucagccuacacauuuacucauucacacacaaacccccacacaucugcacacauacacauucaucuacacacacguguguguacacacacaaagacagaugggaucuuauguaaaccuaggcuaacauuaaaauuauuaucuaccuuguauguugggauuacaaguaugaucuaugaugucuaguuuuugcaguguuggagaucaaacacagugaucuuguauuuuaggcaagcccucuacuaacugaacuaugucccuagacacaucauuucuuuuaaugguaccagcuauuccauuaaauaaaugguucauaauguagccgcccaguccccuggugcuggcaccugggaaguuauuuuccuaugugguuacaaagauggauugaagguaacuacaguccuucuguauacauacaaauauuccauuauuuuuuuuuucuuccccaagacaggacuucucuguguagcccuggcuguccugcuggccuugaacucagaaaucuaccugccucccaagugcugggauuaaagaugugccaccacugcccgguaguuuuuuucauuuuuaaauaaaggucauugugcuuuuucauauguccuuacuaacaagcaacuuugugggaauguaugugaacaugugcauuaagggaaaaaaagccggggcuggagagauggcucagcaguuaagagcacacuuuuccacagguccugaguucaauucccaagaaccauaugguggcucacaaccaucuguaaugggaucuaaagcacucuucugguguguuucugaagacagcuacaguguacucauauaaauagaauaaauaauauuuuuuuuugguuuuugguuuugguguguuucugaagacagcuacaguguacucauauaaauagaauaaauauauauuuuuuuugguuuuugguuuugguuuuguuuuuuuuuuuuuaauaauuuuuuugguuuuuugguuuuugguuuuuugagacaggguuucucuguguagcccuggcuguccuggaacucacucuguagaucaggcuggccuugaacucagaaauccaccugccucugccucugccucccaagugcugggauuaaaggugugugccacuacuguccggcuauaaauaaauccaaagaaagaaaaaaagaaagagagagagagagagagagagagagagagagagagagaggaagaaagaggaaagagaagaagaggagaggagaagagaagagaagagaagagaagaaaggaaaggaaggaaaggaaaggaaaggaaaggaaaggaaaggaaaggaaaggaaaagaaaagaaaagaaaagaaaagaaaagaaaagaaaagaaaagagaaaaggcuuagagccgagcaugguaguacauaccuuugauaccuguacucaagagaccaaggcaggcaaaucucugugaguucagggucaaauugguccaugcaguaagcgccaggccaguuuauauugagacuuguucuaauuaaaaaaacaaauaauaaagaaaaagaaagaaaaccaacugagcuaccaccauggguaaaggugcuuacugcaaaccugaauaccugauuucaaucucugguacccauaugaaggaaggagagaaccaacuucuuaaaguugcccucugacuuucauacacgagcuaugcuguaucucugugugugugugugugcgcgugcgcacacacacacacacacacacacacacacacacauauauauacauguacucacacacacacaaaaagaagccauguugguuuuagugucugcuggguuguuuuuuuuuuuuuauuuuuuuagauuuuaauuuuauuuuauguaucugugugcucuaucugcauguauaccugcauaccaaaagagggcaucagaucccaagaaagaugguugugagccaccauguaguugcugggaauugaacucaggaccucugaaauagcugccagugcucuaaaccacugagccaucucucuagccccuaaugucugauuuuuuugccuuagcuuuguggaaauuguaaaauacauuauauuccaaauuaaucuguaacaauuaguuuugaaauuuuucuuuuucuucaguuuccccaauuugcuggaauaugcuguuuuguuuuauuuuuaaauuuauuuuauguauuugaauacucuguugcugucuuuagacacaccagaagagggcaucagaucccauuauagaugguugugagccccguguaguuucugggaauugaacucaggaccuauggaagagcagucagugcucuuaaccacugagccaucucuccggccugaauaugcuguuuuuauuauauagaacugggcauguugauguauaucuacaacccagcaugaaaggaaagguagaggugaaguuaagugucaggaauggagagauuguuuagagugcuuguuguuuuuacagaggacccaaguccaguuucuagcaccaaugucagaugggucacagucaccuguaacucccacaucuaaaacagcgguucucaaccuuccuaauguuaugacucuuuaauacauaaaauuauuuuuguugcuacuucauaacuguaauuuugcuauuauuauugaucauagaguaaauaucuguguuuucugauggucuuuggugacuccugugaaagggucauucaaccucucauagggaucaugaccacacacagguugagaacuacugaucuaucgcaucuguugcccucuucuggccuccauaggcaacugcacucacaugcacauacacacgcacagagaaagugucauccugggcuaauagggaaucugaggcuaugcuaaguuacuuaggauagccugucugagcaaaacaaaagcuuggguauugugaugcaugccugucaucccagcagucagcagucagaggugggaggaucucugugaguuccacgccagccuggucuacauuauaaguucugggacagccaggaauacauagugagaccuugucucaaaaaaacaaaaaaacaaaaaaacaaaaagcaguagcuggagagcagaggaguucagaaccugccuuggcuacaggucacucugagcaagugagugaaaccggaccuaauaaauaacuaaauaaaagcugagagaggaugggggauacacagcuucuucuugguacagagccagccucaaaggccuuagcacaaggcccuaaguuuaaauuccacugugggggugaaguggaaguagaaggaaaaagagaaaagaaaaggaaaugaguuaaaguuggugacguuuuucuuucuuuuuuuccuuaaagacuggggucucacuauguaacucuccuagaacccacucuguagaccagguuggccucgaacucucagagauacaccugccucuuccuucccggugcugggaucaagguugagugcuacuauaccaugguagaugucaagucuuaagccaagagaccucucuugaaggucaaacaaggaaaggcugaguucugagggguuuguuugcuuguuuacugguuuugucagcaugcugucugguguggaaagucccagaagauguucuucuuuuggacuucucccugcacuugguguuuccuccuuccuaucucuggagccuuugacgggugugccaggcaggaaacgcuacuucucaucuggagugcagugggcuaauguggguucagcacauccagcuagcgacucguggaaauuccuuuaagaguaaauauuuuacuuugaacauucuuaagaaacugaggaaggcugcguguguucagagggaguuuccugauuaggaaugaugaggagacaguuacuaguuuaccuuggcaaaggaaauucuguuuuuuucuuacccacaccaguaucuaaauuugucaucuuugaauugagugagucacacugugggguaucuuuuuaugguauguauagaccugauccuaucuuuuucucuuccagcaagcgguuggauuaugugaaccaugccagaagacuggcugaagaugacuggacagguauggagaguggggaagaggaaaacaagaaagaugaagaggaaauggacauagacccuagcaagaaguuaccaaaacgcuaugcuaaucaagugagugguccagagcgugcaccuuccuuccacaugcagucaaaccaccaaaauacaugcugcuauaagaagagggcuggcaagccuagugaguuaggacucugggguauuugaagggagaaugguggugacuuggaagcacugaugaagcuggaccuagcaguguauuaugcuuuuaaucucagcauuugggaggcagaggcaaguggauuucuaugaguuugaggccagccuaaucuacauaaugaauucuaggacagccaggacauuaucuaaaacagaacaaaccaaaccaaaccaaaccaaaccaaaccaaaccaaaccaaacaaaaccaaagaacacccacugcuuaagucuguggcuagguguuuggaguuacuagcccagcgagcccaugcuguuaccagaggcugucagcuugcuacagaaagcuccugagcuccuccuacacuaguaacagaucccaguucucaucaucauccuucauucuuuugggcagggaacacauacaauccagggcuucgcaugugcuaggcaaauguucugucacuauugaacuagagucccagacucuuuucuuugucuuuugucauuuuuuuugagauagggucuuucaguguaguccuggcuggccuugaacuuauagcagucccuucuuuuguuguaauuacaggcacccaccgucauaucuggucuuccauguauuuuuuguaagacagggucuuggcuauccuggaauuagaacucacaugucgacagguuaguuuugaacucagagaucaaccugccucugccucccgugcugggauuaaaauguguguaacuagucauuucguaguuggcuugggugaggccuauccacuacccuaguguccucgucccuugguuaguagucuuuccuaccuagaguauuaggaggccagucuugacacugcauacugaggcauuagcaggcaggaagaacaucuuaaugacuuaauuaccuuaaauaaagagauccugugcagaacaaccaguugacuaagguaauggugaacugugaaacagccaaucacuaugccacacucaaauaaaugcucuauuguggcugguggugcuccagggaaacaggaaagagacuguccccaaagaagaaaaggucugggucugcguuuaauuaagcagcagucuuucccgauguaauguacuacuuugucaaaucuuguugcuuucagaauuuagaaauaucuguuuaccuguuuuccucuuccaaauauaguacagauaaugccuucuaugacaaacuacauggguguuggaaacuggauuuucuuccucagguagagcaacaagcacucuuaaccacugagccaucucuccagcccgcaacaagcacucuuaaccacugagccgucccucuagcaacagcaaucaguuccuauugucuuguucugguggcucacuuuuuauuugagacaguagcccaggcuggccuuuaaguugcuauauagccaaggaugaucuugaauuccagauccuuuaaauuuuuacuuccaaguguagaauucuaagugcgcuuuaccgcagcuaauucuagaauaguuuuaucaccaacacacacauacuuacagauacuccauagucauuuguucccaacuagcucauaacucaguuaucccguuuauacuaaucuacguucugcuacauggcugauuaccucuccucaguuucauaugucuggcuucuuccacagcuuuguaguuagucucucugagccugauucuucccgcagucccucucucugucuggaagucccgccuacuguuuccuucccagcuacuggccaucagcucuuuauuaaaacuagucagggaauuucuuaggugggggaaggacagagacaccuucacacaguauacaaaaauguuauuccaguagccauuuuauauauauauacaaacaauacaucauauauaauaaauauuauauaaaauauauaauaaaguauauauauuauguaguaaaacaaauacauuuauauauuauauguguauauauaauauaauuuauauauaauauaaaauaauauaauuuauauuauauauaaauauguauauauauauauauaauaaaacauuuauauauacucuuuagaaaaaugucuguucuauccuuugccagucauucuccacuauuuuucauuuuccuuuuacaaaaucugucuacauuuaucaacgagccuauucuggauaacuguggccuuuugugacugucuucuuucagugagcauaagauuuucauggcucauuuauguuacaguauuuaucuuucuguguguuuauugucaauauuccauuaacaggacauauuuacucauccuucaauuaauggcuuuuuguguugcuucugcuuuuugacgauuaugaaugaugcuaccaugguuuuguguguguguguguguguaggguggcuuuuaauaugcuuacauuuuaauaugcuaacuauuuauauauacucuuuagaaaaaugucuguucuauccuuuaccauuuauuuucuuuauguucaagaauauuucauuuauuauuaguauuaugugugcacaagugugcccauguggugagacaacuugcaguggcuuuuuccucacuggcuugcacagcaagcacguuagcccugauuuccuacccuucuguccucccuucuccuucccuuucaccuuuagcaguguugggaauugaacccaacucuauggacuuugacaggcaagcauuccccacugggcuguaucccagccccacuugauuuggggggauuuggacccugacaguggugauucagcaagcuagggauguagcucccugcugccccagccgccugaggaguccuuuucagaacuccacucuaguaaagccagauuguugacuuuaucucagaaaggaauuucaggauaagccaguaugaagcaaugcuguauuuuauuuuauuuuuuaacauuauauuuauuuauuugaauguguccauguauauguugacuaguuuuuauaucaauuugacagaagcuagcucaucugggaggaagggcccuuaguugagaaaaugccuccauaggcuuggcuuguaggcauggcuguaggguaccuuuuugauggaugacugauaugggcaaugcaacuccugggcaggugguccagggugcuuuaaggaagcaggcugggaaagcuaugaaaagcaagugaggaagcagcaucuuccauuaccucugcaucagugucugccuccagguuccugcccuacuuugaguuccugcccugacuuacucaguggaauuaucagugaaauaaacccuuccuucuagguugcuuuugguccugguguuuuaucacagcacuagcaauaggaaugugugaggaugcaucugccguggcaugugugugaaggucaaagaaaaaccuaugggagucuguucuucucuuccaccaugugauucccagauacugaauucggguuaucagccugguggcaauugucuuuacccacugaguuaucuugcuaaccagaauguuuguuuguuuaaugaaguuucccaauuaaaaaaauuauuuaauuuuuauuguaugugcauuggugugagguugucagauccccuggaacuggaguuacagacaguucugagcugccacaugggugcugggaauugaaccuggguccucuggaagagcagccugagcucuuaaccacugaaccaucucuccagccccaagauuucuaauuuguaaaauauuuuauuauuuauuuuauuuugugugcacaaguauuuugcuuacauguauaccacguguaugucuggugcuuguggaggucaaaagagguugucagauucccuaaaaaggcgauuaugguugguuaugagcuauuauguggguauggaaacugaacuuggguccucugcaagaaacaauggguacuuuuaauuguugagccaucucugcagucuucauaaaaggaauguuuaacauagaccuccuugugggaguuaacagagaggagcugauggaguuacccuucauuuccuuuaugacagccauacauaggaugcugaggaguuuugauguuauugucuuuaaggaguugcuaggaggagcucagcagguaagagcauuagcugcuuuuccaggggaccuaaucuaauuccuagcacccacaugaucauucacagcaauuuguaacuccagucugagggaacugauguucucuuccggcuccuugagcaccaggcaugcguaagaugcacagaccuacaugcaagcaauuacccauauauauuagauagaguuuaaagauugcuaggagauuuaaaugagaucacaggguaauuccugagccuuauggagcaggauuacacuuuguaaucagaacuauagaucacggggguacagggaguuaggauauuguaacuguaaauaaaagugaauacucuuguuguuuaugaccuaucccaaccccccuuaaugcuucuuugagggugcuccuccacccacauacccacuccugccucacugcccuagcauuccucuacacuggggcaucaaguguucacaggaccaagggcuuccccucccauugaugccagauaaggccccuucagcuucuucaguccuuccccuaacuccuccacuggggucccugugcucaucugaugguuggcugcaagcaucugcaucuguauuggucaggaucuggcagagccuaucaggagacagcuguaucaggcucccaucagcaaacacuucuuggcauccucaauaguguuuggguuuggugucuugaugugggauggaucccagguggggcagucucuggauggccuuuccuucagucucugcucuacucuuuguauguuguacuggcuaguuuugugucaacuugacacaggcuggaguuaucacagggaaaggagcuucaguuggggaagugccaccaugagauccagcugcaaggcauuuucucaauuagugaucaagggggaagguccccuuguggguggugccaucucuggacuggcagucuugguucuauaagagagcaggcugagcaagccaggggaaguaagccaguaaggaacaucccuccauggcuucugcaucagcuccugcuuucuuaucugcuugaguuccgguccugacuuccuuggugaugaacagcaguauggaaauguaagccgaauaaacccuuuccuccccaauuugcuucuuggucaugauguuugugcaggaauagaaacccugacuaagauauaugugaacauaucuuuauaucaaaggaauuucucuuucuuuuuugguggugggugguggugguggaccagggucucacuguuccuauuggccuggaauucacuguguagaccacagacuggccuuagucucagagaucuaccuugccaccacacccugacaaaggaauuuuuguuguuguuuuuuuuuguuguuguuguuguuuuguuuguuuuuuuaaaggcuggaucucacuguguagcccugguuggccugaaacucacagcgauauaucugcuggugcuucugcugacauuaaagauauaaagauagcaccguuaugccagaccuaaggacauuuuggagaggaggguaguugagacagcaucucaguauuauuugcucugcucuucuuauugcucugcucuucuggaacucacuauguagaccagguuggccuggaauucccagagauccuccugccucugccucuuuucuuuuuuuuugguuuuucgaaacaggguuucucuguguauuccugguuguccuggaacucacucuguagaccaggcuggccuugaacucagaaauccaccugccucugccucccaagugcugggauuaaaggcacacaccaccacugcccggccugcugccgccucuuaagugcuggcauuauaaugugggcuaccaaagggagggaaauauuuuuuuagcaucgucuuggggcugaagaaacgucucaguggugaagagcacuucuuucagauaaucgggaguccaguuuccaguguccguguuguggcucagaaccaucuauaacuuuaguaccagagaacccaaugucccuuuauugaucucucagggcaccagugguaugauucauacauaaagacaaaacacucacauguaaaaugaaauaaguaaaccuaaaagagccuuuaaaauguuuaauguggauaaauagcccuuacagcaaacacugacaauccugcaagaauucuuuucuuuuuuuuaaaaugugacuauaucuaugccugcaugaguuucugagcaccucaugcauguaauaugcugaaauucuccguucuuccccugacaggguuucucuguguaccucugacuguccuaaaacucacucuauagaccaggcuggugucgaacucagagauccacccaccucugccuucccagugcuaggaucaaaggugugagccacuacugccaguucaggccugcauucuuaacauucuggagguguagccaagaggaucauaaguucagagucauuuucaccuauggagugaguuuaaggccagccuuaacaauuugagauaacaucugacuaaguugcccaggcaagcuguguaaauuuaccgucuucccaccugagcuucccaaguagcugagauuauacaccuauaccaccauacuaccuccuaguaucuuuuauuguaaugcauggcaugucaguuugggaaaugauagucaagucugagcaugacucaagaugaauauucauuccugaggcguaagaccagaauguaauaguuaugcugguagucagcaggcaaauaaggaaagggaaaagucccuuacuguaggccuggagguaaggaaauaaguaggaugcagauggugauaauaagggcagaugccaagccaccagugaaugucuuccaucugucaguuauacugcagaccagcuugcuuuuugagcgcacuugggguagaaguaccucugucuucagcuuuuaucuguacuugcauuauguauauaggauaugaauuuuuuuuuguaauguuugaauggcacacuccugcugaucuuuuaacaccauuuuugucuucccaguugaugcuuucugagugguuaauugacgucccuucagauuuggggcaagaauggauugugguuguguguccuguugggaaaagagcccuuaucguggccuccagggugaguagcugcuuccugccucuuuugccugcaagccuaguaugugauaaaagggauugucuuccuccuuuucaucugccacagcagcuggccuggaguuggccucccaguacuuuccuuccagaaaagucuguugccagccaucuuugggcucaugacaacccuauagaaugaagaagagucaaggguaucugugaauaccuaaugagagugguagcuuucucccuacaggguucaacaagugccuacacuaagaguggcuacugugucaauagguuuucuucccuucugcccggaggcaacaggagaaacucaacaacagccaaagguaccuguauaugauaucuauuuaauauguguuuuggguuuccuccugacuaucuuuuugaugcugaggcuucaggggcuggccagccaauucaguaggugaaagugcuuucugagaaguccucaugaccugaguuugaccccuaaaaccuccagugaaaguuagaguuaauuccugaguuguccuggggucuccacacaggacauaugugccauaacacaugcccaugcacauguaacauacauaauauaaaacuuuaaauuacucuaucacuaaacuacauccauagucccaguuuuguuuguuuguuuuguuuuguucuugagauaaugugaaccaugugucuuaguuaggguuacuguuguucugaugaaacacuauguccaagagcaaguucaagaggaaagggcuugccgggcgugguggcgcacgccuuuaaucccagcacuugggaggcagaggcagguggauuucugaguucgaggccagccugguuuacaaagugaguuccaggacagccaggacuacacagagaaacccuguuuugaaaaaccaaaaaaaaaaaaacaaaaaacaaaaaaaaagagagagaaaagggcuuauuugccuugcucuucugcauuguaguucaucauuuaaggaagugaggacaggaacucaaucagggcaagaaccuggagggaggagcugaugcagaggcuauggaggggugcugcuuacugucuugcucagcuugcuuuuuuauagaacccaggaccaccagcccaggggugacaucacccagagugggccagcccucccccaucagucacuaaguaagaaaaugcucuacuggcuugccuacagccagaucuuauuggaggcauaucaagguucccucuuuucugaugacuuuagcuuaugucaaguugacauaaaacuauccagcacaccauguaacccaagcuggcccaaaccuccugaucuuccugccuuagccuuccugugcuaggauuauaaacugagauuaaaaucauuauaccuaguuauuuacuaaguuuuuaucauuuaagaaaaagugucuuguauugcccaggcuaucuucaagcuugucauguagucaagacuucaaaucuuuaucuuauuugaucugcuucucaaguaguagaauuauaggcaugugccauuaucuuugguuuauuugcauuuuuuaaaaaacuaauacaaacugggcgugguggcacaugccuuuaaucccagcacucgggaggcagaggcaggcggauuucugaguucgaggccagccuagucuacaaagugaguuccaggacagccaaggcuacacagagaaacccugucucgaaaaaaaaaaaccaaccaaccaaacaaacaaacaaaaaaaacuaauacaagaugguguuuugcuuggcuggguauuuuucuuugucuauuuauguguuuuuuaaauuuuuuaaaauauauuuuauuauuuugugaguauggauauuuuuuuugucugcauauauaccugcacuauuugcaugcagugcccguggaggccagaagaauuugucgacccccagcacuacaguuauaaacuacuauguguggccauguggaugcugggaauugagcucggguuuucugaaggaacagccacugcucugaacugcugagcuacugcuucagcaccaugguuucauuuaugagacaaccucuuguuucacagccuggccuucaaguuguagguggccaaggaugaucuuaaacuucugauccuuuggucucuagcuccaaagagaucauaggugccggucacugucccuugcuuuaugggcugagugcugaacccguaaggcuugugcuuaccagacaagugcuuuaacagugggacugcaucccuaaaucauuuaugagacaaccucuuguuucacagccuggccuucaaguuguagguggcuaaggaugaucuuaaacuucugauccuuuggucucuagcuccaaagagauguuuccuguuguguguuuuuaacagcuagucugucugaggauagaacaaaguucaaaacccuccaaauauucuccaugggaaaaagcagaaacacagcaggcauuucagugauggcagggagagugggauguuucuggcaccucaguguggggccaugagaacugagugaagucaaggaaguugggguggaccucugacacguuuggguggauucccuaauugguggguguacccuuugucucuggcccugcuuggcaccuugaagacaauggucuggaagggcuuaguucaugagcaguuguacugcacuggucuagggccucaacccuuuggcccuggugaucucaagaaugucugucuagaacaggaggcuauaugcccuucugcugcuuugcaucccagggugcugauugucacaaacuucuuuccacguugacccuucucuggcaugcuagcuaggcgggaccucuuuagcuuucaugggugcucccuggucaaguugucuguugcuucuggccuuagaugcagguaagguagcuccccccuccccuuuguuuuguagaaucaggcagaguuugcauuuguaaaauuccagguaguuuucuauacaaucugagccaucauugauuuugauagucucagggucuugguguucuuguuuacccuguuuuuguccaaggaggaggccacauccacauuccagucuugcccccuggucagugcuggaaagccauagggaaaggccgugugcuuuaggagacagggagucacucuccugaggugucacuaucagaucaaugccagaacuuugcugugugcaugagcacagcagccuuuggcuagucauuuuaaugauccacuuuggaggcaaucucucuucaaagucaagucuccucgguuacaugguacacgcagcccugugagucccacugggcuguacaucuuugaaucaugccuuacacaaugacaagcagucuuuuccauaaaggucccagagauaaugucaaguguaauggcaugcugagcuguuucuggggauucccaggcugauuuccuuccuccauugcuuuccuuagcuaccuuggccucaauagacagaccagaguuauaaggauuaagucauguguucuugguugguuugaguggaacugguaaggcugauccccaaacccuauucuauucucuaccugcucaggcucguugaagacuuauuuccuguguuccuuaaguaguaaggcuaacuuuuuuguuguucuuguuggagucagagguucauguaggggucagguuggucauguagcuaaggaugacuuugcauuccuuaccuucuugccucaguuuaccaagguaaguagcacuguagcuugccuccuuuacacuggguuucucuuucuacaacugcucguagugucuguuguauaacuuagcucucgacuaugucugugaucaucuuaucucuguuuccuuaaagagagugacagcuuacacuugauaucucuacauugcacagcacuuaaaauaagaagguaacaagcacuuggaggccagccacucagaaggguaaugccagcuugggcagcagagcaaaaaacuuucacacauaccuaaaauaaaaauagccuagaguggccgggcgugguggugcacaccuuuaaucccagcucgggaggcagaggcaggcagauuucugaguucgaggccagccuggucuacaacaugaguuccaggacagccagggcuacacagagaaacccugucucgaaaaaccaaaaaaaaaaaaaaaaaaaaaaaaaaagccuagagugguagcaggugcuugugaucccagcaugcugaaagucgggcacaguaggauugccuuaaguuugaggcuugauugccuuagucuggacuacaaagugaggucuugccucaagucaaagcaacaaaucagcagguuugauggcaccugucuauaaucuuagcacuugggagagagaagcaagaucaggaguucuaagucaucuucaucuucaaguacauagugaguuccagaccagauugucuuaaaaacaaaacaagcaaaacuaaaaucagagcuucuuuaaaaauaaguaaaaggggccggugagauggcucagcaguuaagagcacugacugcucuuccuaagguacugaguucaaaucccagcaaccacgugguggcucgcaaccauccguaaugggauccaaugcccucuucuggugugucugaaggcagcuacaguguacucauauacaugaaauaaauaaauaaaucuuuaaaaaaaaaacaaguaaauaaaagaaagucccaacuuguuuagaauccauuugucuacagugcugucuugaucucucauacucucuuaccucuggcauccuuuacgaugccagguagcuacaaagguacuugucuucccucaugcuuaguacugacaguugccgugcgccccgaggauugucaccuugagccuauuaggguggaacucuggcuggaagcugaguucuauguugacuuucuuccuuguaucuguagacuacaccauucuggauugcauuuacagugaggugaaucagacauacuauguuuuggaugugaugugcuggcggggacauccuuuuuaugacugucagguaaggauuaauaauguccucaugucuuuccugucuucuuuccuccugggaaggugguucagcauguggguuugguacgugaccaacuucuuguuauguacaggaugugguaaucaagaacauuaucuaaugcucccuguaccuuugagggcguuugaauuagcuucauuuuaaaaacaaauaugaggaacuagggaaauauaagaguuauuuuauuuuauuuugguuuuuugagacaggguuucucuguguucuguguagcccuggcuguccuggaacucaguuuauagaucagacugaccuugaacucaaagaucugacagccucuaccucccagaugcuggaauuaaaggcauaugccaccauuucccagcugauaugacaguucuuaaggaagaagaaagagcagaggugcaggcugggguguuagcugcuguggcucccccccccccacuucuuuccagagaugggaggauuguugcagggaugauuaaaggguaagaagugugccauguuaugcagacagcaccauuaaaaaaaccucauauacucuucuucacucaccacauccugauccugaaaaugccaggucauucuugguaugaaacaaagucuccaaucucaaagcuugcucuaggaagagagaacaggcauagaccacuauuucuagcucagauugucucauuuccuccccuccccuccccuccccuccccuccccuccccuccccuccccuccccuccuuugcccuccccucccuugccuuccccuccucuccucuccuuuuuugagacaagcucucacuauguagucuaggcugaccugaaacucagagaugcaccugccugucuccuuugugcugggaucaaaaguaugcaccaccacaccuggacagacugcuagacugcuucuuuuuauagcuauuacccuaugguagauuucaggaaaugccagcuaguggugagucugucuguccaucuguugcuuuugagacaaggagucgcucuguauuucaggcuagccucaaaccuaccacccuccucaugucucagucuccccagagguugggauuacagaauuuugucauuuuuuuccugguacauuuccuuuaguuuuguuaaaggauaagucaucacaucuauucacaacuuacagauugggcaauuaaaauugcaugcacagcuauacucuaaggaaaagaccaguucagcgguagcuuaugcccauggcagccccuuuguuucaggcuuauguccugaaucucaggcccagccugagcuacauggcaaggccuuccuugucucagcaaaaggaagcaaggggcugaggaugcagaucaguugggaaagugcuugccuacugcacacaaagcuugaggcucaguccuaggcacucauaaacugauccgucucuauaggcucuacggagcaucagaaauucaaggucauccucugauauauagcaagucugaggccagccugagcuauaugaaacccucucucaacagaaacaaggaagaaaaggaaagaaaacaaacaaacagacaacuuuuauuguuucaaauuuccagaagcaaaguaaaagaacaaggagugucucauagcuauagaaggguacacaucaauaauuuagagagucaguucuuaggaaaagauucagcuguguagugauuuuuaauagccauauuaaaugcagcaagggagaguugguauaaugugcuuuggaguggaggaguucuaggucucacgguauuuacuuuguucacccaggcaagugacuucacuuuucugauucuaagcauccuuaacauguaaaauagcaauaaugauaauauaguuccuauagggugguugaaguuauuuauucaucuauuuguuuguuuacuuguuguuguuguuuuuuuugagacagaguuuuucaguguagcccugacuguccuagaacucauucuauagaccaggcuggccugaaacugauggauauucaccugucucugccucucugaguguugggacuaaaguccugcgguaccaccaucuaccuauuuguuugucuguuuguuuaaaaacaguggcagcacaugacuuuaaucccaacaacaugggaggcagagauaggcagagcacugaguucaagaccagucccaaaugcguuccagaacagccaggguuacacagggaaaccccgugguggaggcugauuucacuacuaggucaaggaugacccgacucugccuccuaaaugcuggggcuuagguuucagcuacuaugccuggcagcuuugcuaaauuuuaaaagaaaaagaucuuuauaacauauacuuguaugaaaauguuuuuauguuauaauauaaugcuguguaugauauaaacaaugaaaauauauuuuggaaauuuauuuauccuuaccgugugugugauguguuugaauugaggccaaaggauaucuuuuaggugaggguucuugucuuccagguguggaaucuaaaaaucuaauguagguuaucagguuuguaugguaagcauuuuuagccauugauccaucuuaccaucugaaacaugcaugcaucuuuaaaaucuugaaagacuugacaaacuauaguuauaaauggaaauggaaauagcaacagcagggcuuaggucuuuauaacucaaugguauuagaaugagaauaaaaguuugaaaugaauauuuuaucuuuucugugacagacugauuuccgauucuacuggaugcauucaaaguuaccagaagaagaagggcuuggagagaaaaccaagauuaauccuguaaggcuguugguacaguuacagaguucuuuuguguugugauagauuauuuuugagaugagguuucauauguuccauacugauuugaaccuggcuauguggcuauggcccuagauuccugaucuuccugccucaacuucccaaguguugggauuucaggcaugagccacaauucccucccucccucucauuucucccucccucccucccucccucccuuccuuccuuccuuccuuccuuccuuccuucuucccucccucucucuuuccuucuuuucuuucucucucucuuuuuaaagauuuauuuauuuaauguauguguguacaguguagcuaucuucagacacaccagaagagggcaucaggucccauuacagaugguugugagccaccaugugguugcugggaauugaagagcaguuaaauauauauauauauauuuuuuuuuuuuugguuuuuugagacaggguuucucuguguagccuuggcuguccuggaacucacuuuuguagaucaggcugggcuugaacucagaaauuacaccugccucugccuccugagugcugggauuaaaggcgugugccaccacgcccagugcaaucaguguucuuaaccacagagccauuucaucagcccccuucucuucucuucucuucucuucucuucucuucucuucucuucucuucucuucucuucucucuuccuuccuuccuuuuuuuuugaaacaggguuucuguauauauuccuagcugucuuggaacucacucuguagaccaggucagucucaaacucacugagaucugccugccucugacuccuaagugcugggguuuaagguguggaccaccauggccuagccccaaguuauuuuauaauuguauguguaaaggugauuugccugccuuuaugucuuuaccacuugagugcaugaugcccacagagaccagaaaaaggcgucagaucucuuaaauugguugggaaccaccauguggaauccaagccagguccucuggaagaguagccagugcucuuagccacugaaccaucuucuaaccccagagccacuacucuugauugauuaguuuaucuuuugaggcagcauauuuuaaugguauaaugguaagacaaugaguuuaauaguuauccauguuugaauuuuguuuguggguguaauaauugcuaguauaaggacuagaggugugacucaaguguacagaacuuguuuaguauauguaaaguccuaaguucagccgggcagugguggcgcacaccuuuaagcccagcacuugggaggcagaggcaggcggauuucugaguucgaggccagccuggucuacagagcgaguuccaggacagccagggcuauacagagaaagaaacccugucucgaaaaacaaaacaaaaaaaacaaaaacaacaaauaaaguccuaaguucagucccuagcaccauuaaaaauaauaauguaauuauuaggauaauagccucucuugcuauuuuuuuuuauuugcaaauggcacuaauaagcuaggagagguaauauauacuuguaacauagcacacaggaggcugaggaagcaggagaucaagauuggcauuagccuggacaacauaguaauagcgugagaucccaucucuaaaaguaaaggauaauaucaagaguuacuguaagaaacauaaauaugcaugcagcuccucauagcucuagcuuuaugguaagccacuuaguaaauuaugccugcuauaaaaugcuguguguguguguguguguguguguguguguguguguguguguguguagcagcaguaauugagcccugagugucaugcuuacuuagcacugagcuguaucuaugucgugugacaaaacuuuucuuggggagacacuauacccaucuaaucgccgcagguagggagcccauggcaaaucaaaguaagauaucaccaacauccaacacggugaagcagugguccuguugagguuacuuagaagaauauaggugagggguugcacggcagaaaugacuggaagacagcugcaucaucaaagcccacccuagcaugggaaacaacucacaagagcugggaaaucugagcacccacaaguagcucagcaggcuggagaauguccuuuccaagugacccugguccaaacagguuccaggcaucuggggugguuucuguuucuuccaggcagcugacuggucucgaagcugccuuugcagcucuguucucggugggauguucagcuuuaguguuucuuucgcagggcggggcuucagugaaucuagucaaccucagggacuuccugaagcuauuuugaguugucuaucuuccugcauaaggaauuucucagcagggugaauggaauguuugaaucuugaggaaacuguuacauaacaaccuauuggagacagggucucacuauguggugcaggcuggucugaggcucgcuaguaaaucagucuagccuagaucucugcgagugggaacugggacuuggggaaacauaucugucuuggcuuuucagaggccuggaaguaggguccaagaguuuuuuccuauucccaaccucuuuuuuuaaagauaagguugcuagcuuagguugacuuugaaaagugaaacuuaguuaucccccugccucaguuuccugagugcugggaaggacaacuuacuugauuaagcuuuucaaucauuagagccagucucauuugaaacguacuaacucuuuguucuaauuuauauuucaguuuaaguuuguggggcuaaagaauuucccguguaccccugagagccugugugaggugcugucuauggauuuuccuuuugagguaacgaaaccauuaucuguugcucugaaugauuguaggauacaaggagacuuguguacaugcagucuuaaaagaaccucugauuuuucugcaucuuagcaugaaaacagggcuaaagauuaauuuuacagaaaugauguaacugcugcacuccagagccucaacuuuguuucuacuaaaagagucagaacaccagaauugcauagcuucucagcauccccugaaaaacugaggcccagagacgagcaaagacuuccuuuauccuagaucaucauugugugacuuguuugccauaagcacaagaaucaggcuccuuguuuggcugccauggcuggguguaacaacgccaggcacauaggcacauguagcugucugaaccuuugguucucuuucgguggaagcacagauggucccagggauaacaguguccgcuacucuguggcacagugguagggccgacucauugcccaugcuugucuuguaugaaaaucuccuguucccaggaacucccuggucugagauagucuaucauccucagaaccucucucucaauaagcaaagguuucuuugcccaucaucccuuuuaaaauucugccuagucacagucaaguuuuugcuugaaguauauuuaauuuuguaaaggauaacagcuuccuggauaaggaaauagcaaagacuaaguugcuucauuucugggagucaauuaagaaggugguaagaacacugucuuuauuuauaacccuuacaucccaguggcaagaaaugcuuuuuaggggugagucauugaaucacaagagaaaguauggggcuguaggagguuuucccguuuagaaaaacugaguuucccagaauacagcuccaaacaaucuggguguggggugggguggggguggguggggggagugguuuguuaggcagcagcaguagcuugggaagcagggccucugaaaaggacuguccugugcucagucugugcccuggugcggaugccuguaucucuugguuucaucccauaugagggacucagcuuugcuacugagacuuuagguagaaaguguccagaacgugggggcagagggcguggacucaggcugaauuccugcuucaugcuuuugucuuucuggugugcuuacaacuuuguauggugagaaacaccaucucuggaguccccucugcaugggucagaaaggaaaugaaggaguaggaaagcauccugucacagagcgccgggggcgaggguguuacuagaucuccucuccacaacccuuucuucuguuggacaaggcgucacucuacagcucaggcugcuugauuuugagaucuuccuugcuccaaccugcagaguccugggguuacugauggacacuaccauuucaagcccuggugcuuucuuuguuugaagaaacugcauguaagauacaagaagucuuuuuuuuuccacuggcaguggcucagaauaaaaaagggaaaacgagcugggcaugguugcaccuccuuuaaucucagcacucagaagguggaggcugguggaucucugauuuuaaggccaguuuggucuauguagcaggacagacaagcuacauaauaaagagaccuugcuucccaucaaauagauagauagauagauagauagauagauagauagauagauagauauccacaagaguugcuucuguacaacugucuuagaacuauguggcccaaagucauuaugauucuugauuucucuucuacagguagaugggcugcucuucuaccauaaacagacccacuauagcccugggaguacuccucugguggguuggcugcgccccuacauggugucagauauucuggguguagcuguuccagcuggcccacugaccaccaagccagaauacgcugggcaccagcuccaacagauuauugagcacaagaggagccaggaagacacaaaggagaaacucacacacaaggcuucugagaauggccacuaugagcuggagcaccugucuacucccaaguuaagaaauccuccccacagcucugagagccucauggacaacuaaacuggacagcccaggaaagacuggggcagaggacagugaugauagccauuagugaccuuauuucagagcauucuuuccaaacccagguugcccccugucuggaauguuggcucagacuguuguggguaggucucuuuuggauggaguuggaauccagguauauaugaauaucucuugcuguguuagguauaucuuagguccacaguguaaauauaugugauucuuuagacaaagguugcuugugguuauucggguuuagacauuucuuccaccuuccccaagucccuaggcugccuauagcaugacuauugagauccuggcccacuucacccccuuuagcacucagacauucugcuggguuuccaguugcugcuauugguaaggccauuuucugaaaggucuuaccaggaacugcaguucuugguauuugaauauguuccuucuucugagaaaacaagugugauuuuucuacuguuuagaccuuuccagagauaaaaugcuaaugggguucauuuacuuuacgaaauguuagagccacuaucaggagauaaacuuugugcuaggccucugagguguagguuauagaggcagacaaguccuugagggguguaccauccagcaagaaaauaaaccccaagagcaugcuuuaaugcagaaaagugcccagaguuuagggacaaaggaaaagcagauuucacagagaaggauaaagcugggcugaggcccuggggaggggccuaguguacugugcaaaccagaaagcagguccucaaagaguugcacuauagcagcauucccugagaacagggugggacuuucuggaaucaaguagguucaacauggcucugguauaaaaauagggguggagaguuacggggaggaugcuggaaggcagagggagauuuugucuuagugaaaggaaauuaaggagaagcccuggggugagaucuaugaaccaaagcucuucaucagcuaugaaaaugggagauaguguuuaaaauuaaccaguuaguuuucacucuguucagaaaggauauuucagacccugagguggccucagucugcaacccacucugauuuccacauuccuaguguuggguucaguguggaagcugagaaaacucacuucagauugggaagcuuaaaaaugaaagcuuuauuuucugagcacucugggaggcaacccgguucaggaucugaaucccguccccugaagggagagugaacaauuuuaaaggaugggaacacaaagccugggggcagcugcuguguuauccaauuguauuugggcauuaugggcuaaacaagggaauacuugcaggagacuggguggcauccagggcaccuggcuucaagacccuuaauucauucucccaaacauuaugucgagagcucagagugauaagaaaacaaaggagugggucagcugcacauaaguagggcauaacagguaacugauuauauauuuuuugcaccuugguuuagguaacaccaauuucuauauucuuuacugguuaacagacaauuaagaaaacacuuggggccgggcgugguggcacacgccuuugaucccagcacucaggaggcagaggcagguggauuucuaaguucaaggccagccuggucuacaaagugaguuccaggacagccagggcuacacagagaaacccugucucaaaaaaccaaaaaaaaaaaaaaaaaaaaaaaaaaagaaaaaaaagaaaaagaaaacacuuggagggcuggagagauggcugaacaguuaaagagcacuggcuacucuuucagaggucuugaguucaauucccagcaaccacaugguggcucacaaccauguauaaugggaucugaugcccucuucuggugugcagauguauaugcagauagagcacucauuaaauaaauaaaucuuuaaucuuuuuaaaaagaaaaaggaaagccgggcaggggugguacacaccuuuaauccuagcacuugggaggcaggggcaggcagaucucugaguucgaggccagccuggucuauagagugaguuccaggacagucaggacuacacagagaaacccugucucaaaagaaaagagaagagaagagagagagagaaaacauuuggagaagugagauauguuccuuccuaggucuaggaacaugagccuguccuugagauggcugcaucuggacaccugucuccuuacaagcugucccagagaaggcugggcucagaaaacuguuuacaacagaagcuguucagcuauaggaaaguccccagcuccccuagggucagggaccuugaauuugguuucucccuaugauuaaccggagucugaaaaugcaauggcaguacuuggaauaaguuucuuugacuugugaccaaacacuaggacugcucuuauuggacaaacugacaucaucaucauucccuucaacagaauuaguguccugugaaaagacuuuuaaagggauccagggcaggucuuaugacaugcaaugguccuuggaguuacugagcucugaagagaaaucugguuccacagagcaguucaugcacugggacucccucgagcaucugcucucuugggcauaagcugcuuugaucagacagggaggaccuccuuuuacucucccagugagagagccuacuagcauuugccuacacaaggucuuucuagaauuaagaucagauugcaauaugaauauaguaauguuccuuacgucaaggaauauguagaaacauuagacacuuaguuucuucaugcuggccuuaaacuugcuuuucagcccaagcaaagccuugaauuuucaauccacucucggccucccaaggagcugccauugcaugucuuggccaccaagcccugacuuguuuaauagucuucagaauucuucagucuucuuuuagcagccagcuuuaccaaucuggggacugugcaugucagugucaugcaagaccugguuuaguaauaagccccuaguuuagaaauaaacuuggcaaagccugguuucaaaauaaacccagguuuuggguauggugucuuagguuuauaaucccaguacuuaggaagcugagaccggaggauugccaugauuuugaggcuaaccugggcuauaauguaagacacuguuucaaaaaaaaaaaag

SEQ ID NO: 5126 - RNA, 2120 nt, Mus musculus
auuuuuacuccuucugugaacguaagugcacacucaagguuuauuuaugcaguggucugugugagguuuucagccucucuuccuccaguuuaaaaugucccuggaucuacccgaccaauagaguauacauuuucccuucaugcuccgccuuccggaggcuugcccaggcggugacauuuaaaggccuccgcuggguuaucuccgcccccugagggcugcagauucugguugucccagugucacaguauucagucagcccuagugaccagcuaguaauaucugggcuuuuggaucagauuagagcuccagaccuuaauuuuggagucggcuugcugaaaguagcugcugagugcuccagauggcuguguuuagaagaccgugaaaguguaaaaauaaguggguaggaaggacaaggcuuucugucauuguuuugguuaauucuccacggcggguaauacuacugccuuuuccuuuucaaaucucaaagccucggguuucggccgcugagcuccccgccaucuccgaucccggccuuggaacgcugagguucagucuccaguguaaacauuccacaaaaggacugcuaagguucagcauccucgcgcagggcggaauggucuccuuccuggaccggcgccguguccaauggcggcuccuaccggcgccaagauaguccaaucagaucauugggggcggggccuggcccagccguguaguggguggagucggccucacuuaaggacauuuuuaccccacauugguuacuuaccuuccuggggcuaugagagaagcaaagguagucuuccaaugcagggaccggcggaggcgggagccgauuuguuaggccuguggcuggggcgguauggggagggauaugugagacucuccaaugagaugugaagagguacuccucuuccuccaauaguauuagagcccggaggagggauucggcaaucagucuccaauaggcgggguugaguuagggacucuccccgccaauaggggcguggagaaggugagcggcucgcucuccccucccagcgagggaagagggcgggaguaggucuuugcggcauagugauuggcuaaaccauugacggauggguaauauaucccguggcggagcgagguuaagccuucccucggcggggcgggccgggagagugggcgggauuucccggguaacagagaagcggccgcggcgguagaggcggcagagacgguuucuccaucuuccccccuccccuuccccccuuagaguuucccucccucccucccuccuucccagucugggcacccaggccugugaccgcuucgugggcgcaaaggagguugccaguccgcucuugcgggccugugcccgcgccguuccggggccuccgugcugggugcgaggcucacgccgggagcgacgcacaggcugaguggcuggagcuuuugcggugagagcacgccgcaccgcgguccgcccagcagcuggguggcggguaacccgggacuggagggcguguguuuuucgggggggcugaccucggcuucccgugcguggcuguggggggcggagcggagccgcacucagugcgggagggggaggagagcguagucccggugcgcacggaggggcggguccuagucccgccgaucagaggcggggccggcgcgcgugcggugguggagaaaggggcgggacgggcucgcgcuaaaggcccgcggcugugaccccgccccuucucccuuaugggcgggaccacuggcugaacugcuuuggguccgcggggcgugcgggacgggaagagggucccggcguguggcuuucagggcgcgguggcgagggggcgugaagccuguguucccccgccuuagcgggauccgguuggccggaaggcgcguccggggcugugaugccacgccccucccgccccgcccccuccgggauuuccgccuccuuagcagugaagaggagcuggggaaagcccgcuguggcgucuggcagggggucagggcuccgugucugcuccucccagcauccccgugggugggagggccccuuguagacugggaacgguggagguguccggacuuuaugcuguggcuucuucauccauucugcuuggggcauc

SEQ ID NO: 5127 - RNA, 1729 nt, Mus musculus
uaggagcaagugcugugccuaccgagccacccugcuguccccauuuagucuauauuuguguauaugcaagccagcucaaccucagacaucacuccaaaaguccauuuuccaaauaagcuccuuuaaugccuggggguuagucuaagugggcuagcaucagggauucccucuacaauguacugcucccaguguuaguucaggcccaggcugcacuuagauuuccauggccagcuuuucaagcaugucccaggaauaggacgucuucuugcuucagcggcauuuuuacugacagguacuuccccagcccucaccuuguugucuuuaaauguuuaauuuaguuauucuuagaaagguugcacagaugugauagucagaggacggcguucgggaguuagcugucuccuuccacaguggauuccugggaucuaacuuagucuuaagcgauugcguggcggguguccuuacccauugaagaagcuaccucaugagccaccuucacuuguaaagcaugcauuucaaaacagagauguaacccuagcugaggccaagacaagagaaucacugaguucuaggcaggcugugcuccagagcaaguucagauaaacgagcagcccaccaauccacaacucaaagcugccacaaaacuucaaagcuacauggguguauaccacuaacagacauccauccauacaugcaugcacauacaaucaaacacauuagcgaaugagcagugccuggcaguaccaggugcagaguccaaguucaauaaauauaaacccuuauuacaaaagggaagcuauuauuugaaaaaccaagcacuaucuuuuuuugagacaggguuucucuguaucgcccuggcuguccuggaacucacucuguagaccaggcuggccucgaacucagaaaucugccugccuuugccucccgggugcugggauuaaaggcgugcgccaccacgaccggcucaagcacuaacuuuuuaaaagaacauucaaaagauauaguuugacauacuuuuaguggggggaaaacacuauacuagauuacugaagaccgugaacacaaccucugaauucuaaguaaaguuucccggcuacagcugcccuggguaaccuuucaggauauuugcugcacugucaagauggcugugcuuuaccaggaaucuugucaaauaccaaucucaagucuuaaaaaaagaaaaaacuuccuuaugcacacgacuuaaggccugaauuuaaaaguauuaacaguuuauuuuucaaagcuguauuucuguuauuuuucacuguguguauggaugugggggugugcacccgugucuguguccuagaggccggaggugucaguacuuggagccugagauacagguugacaugguugcugaaaacugaacucagguuuucuuagaguaauacucacucuucaccacuuagucugcuuagccuccuaaaugcuaguaugcaaaaauaacaaacguauacugauggauaggagaaaaaaaacaagcaaaaacaagguucuugaaauuucaaagccuaggacuugugacuccaguacacaaccuauuauacacauucuauaaacauaagaauuaugcucagcagugguggcacaugccuuuaauccuaguguuuggggggcagaggcaagcaggucucuuagucugaguccagccuagacuacagggugaacucuaggacacccagggcuaaacuuuguuucaaaaaca

SEQ ID NO: 5128 - RNA, 12035 nt, Mus musculus
cucgggucuguaagcugguuggaugccggaaccuuugguuccaagcggugcaacgagccggcagcaccaaggaucuuccggggagggaaggcgcaucgccauggcggcagcgccguucuugaagcacuggcgcaccacuuucgagcggguggagaaguucguguccccgaucuacuucaccgacuguaaccuucgcggcaggugugguccuuggccuaccacacccgcgcgcucuccccuucccuuccggagggaaacccaggccguggccaaccgggccgcggaacaaaguucccgccacugccaggccaggggcuggggagcgaacgguagagguuggucugugcugcugagcugccaggcaguccucacggccuuagccaagggagagcguuuccccagccauccgcuggcucacgggugggacaggggcggcuucgagcaugcgcccaucagcugcuccugcccaggcucuucggggacagcugcucggugacacucuccagcuuccugacgcccgagaggcuucccuaugagaaggcggugcagcagaacuucagcccugcgcaggucggcgacagcuucggacccacguggguaacgcccaguuuggcgaagcuccgccccacgaccaaacccuagucugcuagauagcagaguggcgcccucugcugagagaagcuccuuuauccuucggcgucuucacuugaguauuuucaucccugcugccucucccccuuucccuuuauucuuugaccauuucucugaugcugcacaugcauggagaacaucuuaaagccgaggguuuccacuccuaggcccaucaaaauggcucucuuacagaugguggaccugcugguuucggguagaacuggucaucccugaaguuugggugggccaggaaguucaucuuugcugggaaagcgauggagaaagccuugucuggcgugauggggaaccuguccaggugagguguccucucuuagagccagauacugccacagauuagccugguuuuuggagaagccacagcugaaugaaugggucuccagaguaauuucaugauuucggaacugaggaaauugccaguguuuagacacacccgaagagguuaucagaucccauuacagaugguuguaagccaccagaauuuggacaccaguguuauaaauccccaguuuucauaagcuaguuuuauuguguauaguacauauguauugggggaaacuucaaaucauucuaaaaugauauaaaguaagguauuaaguuaucuucccaugaauaaugaauuucuuuuaacugcacuucacauuccccagauguuaaauguuaaaugucauaccagguuuaaucuuuguaaugcuaugugaugacacuuuauauccauuauagauuuuaaaaaacuaagacauuucuuuguugguccaugcagcuuccguuucaaaguccaguaacuggguccuaaaagaagucagagcccuagccgggcguggugcugcacgccuuuaaucccagcacucgggaggcagaggcagguggauuucugaguucgaggccagccuggucuacaaagugagcaccaggacaaccagggcuauacagagaaacccugucucgaaaaaacaaaaaaacaacaaaaaaaaaacaaacaaacaaaacaaaacaaaaaaaagaagucagagcccuauccaacuuucuucucuucgauggcacccaccuaacugaacacugaggaugaaccaaucuaucucaaacuccuugggcuucuuuuuuaauuaauauaacccagaaccaccacaaauucuagacaaauguucucaccacugagcuaauccaucucccaccucccguuuaauucgagaaagggucuugcugaaugaucccugauaguagccuugaucuuguuauucucuaccauggaccucccaaguagcuagaauuauagaccuguauuaauauaucugccucacuccaugggguuuucuuuuauauauucauggguaaaaaggcuaccagaggggguuggagagauggcucaguggacugacugcuaagagcacugacugcucuuccagagguccugaguucaaauucccagcaaccacaugugacuuacagccaucuguaaugggaucugaugcucuauucuggugugucugaagacagcauacaguguaccaauacauacauuaaauaaauaaaucuuaagaaagaaaagcuaccaaccaggccuccuaaucccugcccaagauccuucccauaagaccaucuguagggaccuugaaguuaacccaagacaccccaauucagguucuuugcacaaaugaaauugauuuguuucagagggcagagaauaagagacaaagacaggagaccgaggacaagggagaagggaaagagguguuugucccagaagacaaaggucuaagaaaauggcagucuauaaagcuacaagaagaaagccuauguugggaugagguggucuaaucccaaauaagagaauagaccuugguggcuagcuuuagggauguaaucuagcaguuuuacaaggcagaaggaagugggaagaagggcaaggccugccauagccgugcuugccgagcuccagcuccccagagucccuucaccacugcuagcaaacauaaacugcgugcuggucaccgauggguggaacacuugcuaccaagguucccugauuacuuuauccuagccuuuccugguaucggugauucagggcagggcagcuggauggcagagccuggcccucauuggcuuuacucgaccuucgaauuuucuaauggccucaagcccggucuucucuuuucucuaccaggguuugaccaaagaaggcgaaaagaccaguuauguccugagcgagaggcugcgagcaucagacccucggagguaagcauccgcuuacacagauguguucacauaagugaaaucuuaauaucuccuuucucgugguaaauauaaaagaacauggggaaauuaauuacuccuauuauccuucuaccagggaugaccaucuuuuuuuuuuuuuuuuuuuuuuuuuuuuuuuuuuuuuuuugguguuuggagacaggguuucucuguguagcccuggugcccuggcuguccuggaacucacuuuguagaccaggcuggccucgaacucagaaauccgccugccucugccucccaagugcugggauuaaaggugugugccaccaccgcccggcagggaugaccauucuuaucaucuccgucuucauaaucucaaaaugucuuugagcagaagcaccuuuuacuagaugaaaguuauuucucugauauuuuacacccuaccuuuuacauuccauuauuucauauugagggagcauguuuucuauaccaugaaaagcuaagauauuggguuuggcuguuuguuguuauuuauuuguuguuuuguuuuguuugaaacaggaucccauucuauaucccuggcuguccuagaacucacuauguagaccauguuggccuugaacucacauagaucuacuugcuuccucccaagugcugggauuaaaguugggugcuaccaugcaugauuauugcaguguauauuuaacugugcauuuuuguuuguuuguuuguuuguuuucuuuggcuugguuuaguuuuuuugagacaagguuucucuguauagcccuggauguccuggaacucacucuguagaccagagccucagacuucauagauccaucugccucuguccugccucucaaguguuaggauuaaaaaggccucugccaccacugcccaguguuaacuguauauuguuucagauuccuccaacacugugaauaugguaagguggccuugaagggcagacggaaauagucauaaaauuaugaaacugcugaagauucuggaagaacagacugaggacuccauugccagacuaggagggcuggagucagaaaggcuacccuuuagugaugcugaguuuagcuccagcagaggaaccugcugcccaggugcugccuccaggaacugguguacuauguuagcuaguggagcuugggacugaaagucagccuuggaagagccaaacauguuugcugugcagcaaaggcuuuaaggccaagaguacuuuguacagacagccuuggaaauaugaagcuaaauagcaguauagcucauaggaauccaaauuuagccauagcagaacacuccucugcaggacauagguuugaacugguauuucuaccaugauccucccacaccuaaaccugacaucccauggguuccucugggaaguggguccuaggcguaaaugggggggggggggcaacugaaugccugcuacuugcacucuugucaagcucccagcaucuucugccaguucacuggccugagacugccucucuauauuuauagcuugacucucuauguggaaguagccugcaaugggcuucugggggccgggaagggaagcaugaucgcagccccugacccagagaagauguuccagcugagccaggcuaaacuggcuguguuccaccgggauguccacagucuccugguggaccuggagcuguugcuggguguggccaagguacuggagccccacccccauccagaucccuacuccaggcacauuguuugaguuggggcaccaacaggaguaaaggguuaaaaguggggagcuuugcugagaacccuugagagaccagcuagagccuugcuauaguagugcuugaggagucuuuuaaaguacagaacccugaugcagggccucggggaggacagccagcgcagcuuccaggcccugcacacagccaaccagauggugaacauaugugacccugcucagccugagacuuacccagcagccaaagcccuggccuccaaguucuuuggccaacauggaggugaaagccagcauaccauccaugccaugggacacugucacauugauacagguaaggcaccauuguucguuagggugccaggugcccuuaaagccuugaguguggcugaaaccugcgauaugaucauugguaaucuuuggccuucuggaccuuauuuuuccacuuguguaaaauaaaucagggacauuagaucaugggcuccguuggcuguggcuugcuuauucuuccaacaaaagcugauagcucacgaggcccuguggcagauacuggauacguagcauuguggagacugguuacugcagagugaccagguguggugaugcuguauaugagaccuggagccagaagagguauuucacccagcuagguuagggagucugagauuuccuagcaaagugacauuugauuuacgugaugaugacacagggacccccaagcacagggaccaggucagguguucagcuuugaggccgaguuuguaggauccuugagaguuuucaguucuuuguuugcucauuguuacugugccugaguccaggccuuugcuaucuauguagcacugguagguuuugcacugauagcaguccuccaauucagcuuccugaaugcuggauuacaggugugagccgcugcaccucgaaauguguguuuuuuagccagcuccuugcuguacugauucagaugcagcuaagguuucugaccauggaacaagggcugaugaaguuggaccugaggccuagaggucaggagcaacuggaggucauacaacuugcccagauaagcccacgcuaugccucguucuaguaccuuugucucuggggaaucugagccuuaauguaaggcucguccaggaccugguaccuguguccuggcaguuggucucaguccuuccugcccaacccgcuccuccuaucuugcaggagggacaugaaguaacagcacaauaggggcaccacauaggucugcaggguagaccuagauaggaagagggcugggcugacccacuggagccuuaggcugggucugucaugguuuggguacaggggagggcugcugaucuccaaagagcaggaaccuuuuuaucuccucacucugucccccacccccagccuggcuuuggcccuucaaggagacugugaggaaaugugcccggagcuggucgacagcugugacgcucauggagcagaacacagacuucaucuuugccugcucucaggucagagggcagcugugugaagcagaugggcccgaagcggggaccuaaaagaccaagagugucccuuaccuuuagcuacccgcagggccaccggaugcuugacugugaguaguguccuuuuuacuccuggcccaacucccaccccauguuccccacaggcacaacaacuugaaugggucaagagccaguacccuggucugcaugcccggcuccaggaguuugccugccgaggacaguuugugccuguggggggcaccuggguagaaaugguaagugcccaucccugguacuaucuuccagcagcuagucaguugagccugaaaugagcaagacagccucuuccugggguuauaacccuguguuagugcacccauugcacuucuacaacaaagugaaguuggcccaggguccuacccgugucuagucuggugcuaacuccaacugucuugcuguucuguccccccaucccccgaccccaacaggaugggaaccuucccaguggagaggccauggugaggcaguuccugcagggccagaacuucuuucugcaagaguuugggaagaugugcucugagguagucugggagcuggcaccgcagacuauccccaggggacacggggacuuggcugaggcagcuccacugagagcugagagccuuauccccgcaguucuggcugccagacacguuuggcuacucagcacagcucccccagaucaugcaaggcuguggcaucaagcgcuuccugacccagaaacugagcuggaacuuggucaacuccuuuccaguaagcaagccccaggggucagggucuggaucccacuuggcccacucaacccuuuccagagugugguaggccugugccugggucacagcuaccauggauguggaucgacaucgccucaggccugucucuagccucugcccugcccuucucugccugcagcaccauaccuuuuucugggaggggcuggauggcucccgagugcugguccacuucccaccuggagacucauauggaaugcagggcaguguggaggaggugaggggacacgggaugcugggcuuuucagagagggcuggguaucuuguccuaggcugacaugucccuacccaucuaggugcugaagacugugaccaacaaccgggacaaggggcggaccaaccacaguggcuuccucuucggcuucggggaugggggagguggccccacacagaccauguuggaccgauugaagcggcugagcaacacugaugggcugcccaggucaggccugagccaucaucagccauuuucauguagcucugcccucgagcccuugccuugagccugcccuuuguuuauauaugaaauuuaacuccuccacuggaccuuguaucucucaauccugacccaucaucuuccaaacuucuaccuugaggauauggugcagggaaauucugagguagcaagaggcuugaggccaacagagugcagcucuauauuuagggaauuggcuagggagugguuucuuuguuggggccucuggccugcacuguagucaaaggacaaacuauaggacucucagcugggagcccaggcuuguggucuuccucagggugcagcuaucuucuccuggccagcucuucacggcacuggagagagacucaggacagcugugcacauggguuggagaacucuuccuggaacugcacaauggcaccuacacuacgcaugcccaggucagggccaggcuaccagccuagucaauaccugauaugcaucgggcuguggggaaaggguuggggaggggcagggcuagagcucagugggcuguuucuccaaguagaggcuuggaaaagaggcaccagagcuggguuaaucccgaacacagacagcgggugggacagagccuuuccagaggaggaggguuugggugggaggucacuugagguaaguuuucuaugagaggccuugggaggcugucaaggguucugagcaagagagagcuuuggacgguguccugggucacaucagaauuuaaggugacccucccucccugggcacagcucaagaaggggaacagagaaugugagcagauucuucaugacguggaggugcucagcagccuggcccuagcccgaagugcccaguuccuauacccggcagcccagcugcagcaccucuggaggucagucagguaccccuuccugcuggucaccugacuucuagcccugccauagccugccucucccagccuucccugucucucugccuuuggucccuguaggcuccugcuccucaaccaguuccaugauguggugacuggaagcugcauucagcugguggcagaagaugccaugaacuacuaugaaggugaggccaaccuucguaccaguccuucugcucucagggcuaagcgggacggacccgaugcucacccauggccaaacccaucucucuucagacauccguucucauggcaacccacugcucagugcugcagccgcagccuugugugccggggagccaggucccaagggccuccucauuaucaacacacugcccuggaagcgcacugaaguguuggcacugcccaagccuuguggggcucacagccuagguaugagcugacagggggaagcuggucuugcagcaggaaaaucgaaggcuagacagcaugacaaggauacuccccagggaaucuuuaccuugggguaucccaaucuggagagaaguagccguguacuaucccauccagccuauccuuaaccugagcaaggugucuagaccuucagagaggcuacacugaugccuaggccuuguccccagcccuggugacagugccaaguauuggcuacgcuccugcucccaccccuacuucacugcagccccuccucccccagcagccuguguuugugaugcaggagguaaguccuagcagcucccaaugggguggggccuagacugggguucuccuuggucuggagccaggggcuggggcaaugcacagcuuuaggaggguuggguugggcugggggggggggguggggaacacuacucacucggcucaaggacccuccccuccaagacugacgguucugugacuuuggacaacggcaucauccgggugagacuggauccaacuggcugucuuaccucccugguccugguggcuucuggcaggugcuaacccuucacuguucuuaaucccaugccuggcuaguucaucccaaacuauaccaucuucccacuguucccuggccacuacacuauccaaguagucuacaaguaccucuagacuggaacccacacauggagcaggguaggcugggcuagcagcacccugacccuuggcccuauuuaaccuguccccaccaauuauagcuggagagaccaccaaucccuauguccuuccagggaagccauugcugagggagcccuggggaaccaguuuguguuguuugaugaugugccauuguacugggaugcaugggaugucauggauuaccaucuagagacacgguacuucuugggcaggaccugaggguggcuguguaugcacgcuucucuggcuuagugccacucgccuucaucccacaggaagccugugcugggccaggcagggacccuggcagugggcacugaagguggccuccggggcagugccugguuccugcuccagaucagccccaacagccggcucagccaggagguugugcuagauguuggcugccccuauguccgcuuccacacugagguagaaauggcaggguaguggccaucuuuuccggguauggcuggugaggaggccugaggucauucucuuaugcccacccucugccccccauuucaggugcacuggcacgaggcccacaaguuccugaagguggaguucccugcuagaauacggagcccccaggcuaccuaugagauccaguuugggcaccuccagaggccgacgcacaacaacaccucuugggacugggcucgcuacgaggucugacaugaggacugggugggacuuguacucucccugucuggggagagacuguggguugaggacaagagggaaacaaugacugacaccugugcucucuaacaugggccaggcauuugcuaccugcuuuacuuugguuugguacuauauagccacuguuaccauuucacagaugaggaagcaggcagacaggugggauggcaugccccaagcuuccuugaguggcagcuaggaugcaaccaugggcucuagaacuuacugucgcccaacugaaaggggcucugggaugcagccacccauaggccuuggaucugcccuucaggugugggcucaccgcuggauagaucuguccgagugugacuuugggcuggcccugcucaacaacugcaaguauggagcaucaguacgaggcaacguccucagccucucacugugagugcagugcccgcuggguucaggacuggcugggguuugugggagcuuccugugcuggaacuccagccccucaucucucccacccacuccagguugcgugcacccaaggcuccagacgcuacugcugacauggggcgccaugaauucacuuacgcuuugaugccacacaaggguauguaccagcguagcagggccccucuguggcucuugaccaccucugugcccuuuccugagguaagggguaaaccgaggcaucgggguaaauggaggcagcccagccccaguccccuccagaggcaccgcagggagcucccacuguccacauguguuucuuucuggucauaccccaggcuccuuccaagaagcuggugucauccaugcugccuacaaccucaacuuuccccugcuggcacugccggcuccaggcccggccccugacaccaccuggagugccuuuucugugucuucaccagcaguagugcuggagaccaucaagcaggcaagggagaauagacuggggagaauagacuggggaggcuccuggggugcacaaguucuuggcccugcccacuguccugccuuccuccaccaggcugagaggugccaucagcaccgcacacugguucuaaggcuguacgaggcucauggcagccauguggacugcuggcugcacacgucguugccuguucaggaggccacccugugaguggagacucgguagagguagaggugggaguccugcccuugucgguccucauggccucuccuguucuccaucuaguugugaccuccuggagcagcgagaccccacuggucaccuuucccuccaggacaaccgucugaagcucacuuuuucucccuuccaagugagaucccuauugcuugugcuucagucuccaccaaacugagucuugacuggauagcuuugggaguuccucauuuccaccucccuagcccgaagcaucuugugcaauaaaagcuuagauuagcagcacuauaauggugccuugcuguuucucauaaggcugcucugcacgggcuguaaggagggagaguauuuccaggggcaagaccuaagguuaccggugugugcagggucuggcuuccaucucagauacuggagaccucgggugaccauaagccaagggacuuugagauaaaaagucagcagggagaugauggcuggacaggaggccuggagccugccuccucugacccccauaucaucucacuccuccccccucaacugggagggaagcugugggcaaguguuaaacugggagaacagccagccauagacccugaugccuccuggagcuaagcugggagaacagccaaccauaggcccugaugccuccuggaugggaagagcuauggaugacaccuugggacugccugggcccaggucugcagaggcagaauguccucugauagucauggccuugaguguauaugugggggguugggggaagggaggggagacaaggaauuaaauauauaaauaggugga

SEQ ID NO: 5129 - RNA, 3299 nt, Mus musculus
cagagucagcugaccugagucaagccggaagaagcucuggauuggaucuccugacaucauggugagggauugggaaagaugggaaguuggguaucgggcgacaaagggguucggugguucuaggagcuuaaggagacaaucuucacuggcgccugccugggcgcggcggaacgucggagucugcaggcgcagccgcguuuccucgcguccaucccugggccggagggucccaccucccggauucucagacucuccacggcccccaagggaccucccugggucacccacuucccugacugucgggucacaggacgaaaacaugcuuaggacugguuaggaagccucuccucgcuuuccugagcgaaggagugguuuugggauuggguuaagcuuucugauucauaauccauucauucaggagaugcguguugaguguccagcccauacaggcaucgggauucgagcugcagaaggggagggcaagucagaagcaagaauuggcagccguaggucuuucuccaacugcagaggcuuuccugaaccgugagcgcaguguuaggacucuugaagaugcaacucggugaaggguaauuuguguuacccggaugagaagcggaggcagagaaagaauagccucagacaagaaacagccgugcagucucugaaugagccaggcuccuugagagugccacauccugucgcgcuagagcuuggugaagaucaagcgagacaagcaaagauuaagucucacugggacuuggaucacuauuaucaaaauagcgagcauucccucuggcugcccaaagugcuuuguuaacuaggagauuaugggaaguggaaucuggugcuguagcucggugguagaugugcccgaggcccugacuuugagccccagcacugccaacaagccuggaaaaaccuaggaccaggaagggcccagcaaaggugaaggcagaaguggggcugggguaacaaggagaaucgggcaaguuguuguggcuggagcaugguagacacuuaaggaaaauugccacggaugcagagaguaaaagucagaacgaggucagguggcagugugggcagaguauucacaacagucuggacauaggggacaacaggugaccagacaguacucauuccuggccacaccucagcccaaccgccagccugccuucccacguuacucucuugcagagguuccgguucuguggcgaucuggacugucccgacuggguccuggcagagaucagcacacuggccaaaauuguuaagugcacugguuuacuuaggguugggaggagagaggcucaggguggaaggaggagauugggacugggagcuggaagcgggcugggguggugaaggagucucccugaggauggggccucaugcucuguuaccuuggucacguggcuggcccuccuucagccaguccccuagcagugagggguaagguuggucagucuggcugagacagggacauccuuuucaguccucugugaagcugcgacugcuguguagccaggugcuaaaggagcuucugggucaggggauugaugugaguacuggggcaggggauugaugugaguacaggaacugauaccacuguccgagaaacuuagggggcccagggcagucuguucuucagccuccccgccccuuggcuauccccuuccuucuuucuagccccagcccauucuuagcacaggaucugggccaggggcagggggcugguggcaggacucugguacccacuuaggaccgccuuuucccauaguaugagaagaucuugaagcuuacugcugaugccaaguuuggugaguaccccgaaccgggcaccacagccuuccuuccgugauccuuccgcuucagaugggaagagucauauugacagcccuguccacacccucugccacuauuugcuggucccacagcaaugcaugcaugggguucaggagauuugggacccaaagcuggagaugagggcagggagguggcuggggcccugguggcauccccugcguccccugugggucucuagagucuggagacgugaaggccacggucgcggugcugaguuucauccuguccagugcagccaagcauagugucgacagugauuccuuguccagugagcugcagcagcuggggcugcccaaagguacagugcaaacaggcaggagggaaaccuauggguagggguuccuggaaaauacacugagaccuucuuggcccugagauggucccaguccucugugggcccugcagccugagacccaccccuuaagcccagugccagucuccacccgccaccucagcagagcccccucagagcuccgucugccugcagagcaugccaccagccugugccgcuguuacgaagagaagcagagcccccugcaggagcaccuucgggccuguagccuacguggugagugugcucuagacggagcaugcacaagccaaacgccauugcuccuggggaagccggaaccacaauuacacacagagcagcugagggguuuagaucuggcugaggaucucaugacuauggcccgagcuuucuuuucucugagauucaugguauauagucucaugccugccuuacaacgggccuggcuuggagggcaggagcuuuguaggucacacaaccuugaaggguuaugagcugagcccaauuguggaccgagauggagaacuuugugacuuuccugguggcuaacugccgaacuucuugccugcagugaacaggcuggccagcgugggcuggcggguagacuacacccugagcuccagccugcuucauucuguggaggagcccaugguacaucugcagcuacagguugugccugcuccagguacccaggcccaaccuguuuccaugucccucucggcagacaaguuccagguucuccuggcagguaagguuggaccugcagagguuggggccccuccugggucuggcugacuuggaacuggcuauaaaaaccaggcuggccucagacuugccucugcuccuuaccacucuccuucacccuccuguccccugcagaacugaagcaagcccagaccaugaugacugcuuugggcugagaagaguguucccagccucugugaggccucucugccugcacugaguggcugcccuccacacgccucuuacuaggguggcccuggccucuuaguccugguuagggcuacuggggaucguccccaaaauugccuucuuucuuuugaaagaaaguacuugccaaccauuuuuauaggcaagaagaauaaacaaguguacagcaaugugu

SEQ ID NO: 5130 - RNA, 11472 nt, Mus musculus
ccgcucgggaccacaaacggcgcccagcggcagcacgaacggucgcgcggaacgucucucugggcuagcugccugccgcgacuucccgcgcaaggccggcgggacagggacccgcagccuaggcggcgcugaaagaugccgcggcugcuccggguggcggccgcuagaagccuggugcucugaagguaggagcucgccuacccggcaggcgcggaaacuugggccgaguuugcgggcggcgcgugggcaaggggcggguggcccugccccagggcgccccuaccggccagccccaggacggagcgcggggaccggggcccaggugcugaggcuucgggcggucagacuacggggcccagucauaccgcugcccagacuuugccaggacuuggaugcucccugggccugguagagcuccggagccacagcacugccugggcguuagggcuggcgaagagucaggcggaucccucgggccucucgcggggccaggcucacgcggauugccgggcgccgauucgggguggcggugggggguugggauugguggcggcgggcgcugaggugccgcggggccguggacgaacccuguuggaacaggaccgccugcgguuuccuagccacugcuugacucacucucuggccacagcccaagcuggcgggaucgucccgaaggagguggcugcccagacuuugaggccgccccccccccagccccccagccuucuggaccucagugcagucugcgggcaucgauccgugggguucccagugcgaaucuccugacuuuuuuacacguuuacgugagcuaaggaagggcaccguugggcaguggggggcaugugugcagauucgggccaugcauguacguguaggaacagcuuugcaugcguggcccacggcagucugugugucagccugccggggugcacgugcguugcagaggcgcggagagagaggcuuggggacacccggaagccugguguggcgguggggcgccaguucccuacugaagccggcuggcugugagccacuggcacgagggucacgggcggggccgggagagggaaauuaggagcggagcauccggggagacccuuucucucaaacugagaagugugggcugcuccacguugagugagugcucagaaccucagcacgcaaaguuuuuagaagacugguaucuguuagagcggagagaauacugaugcgggccucaacuuggcugggaucgcgcucuucaugaggccccaaggaugugacguggaaauggacccacggaguugucugucucccucguggaaaagcaggaguguaggcgcuugacccugcccuggguucuggcugagguuagaacuccucuaagaacuggcagaacuuggacaucuucacgguaggaucaccuguuggcccuaccuuccccaagcgccuuaggcuacuuugguauccggaaacaaggcaccuucuuuuuggcuacucucucaguggggguggccucuaccgagggagcuuuccauccuacuggccgggcauuacgucaccgccucaccuuucagagucuuggguuggcuuuuuggcgcccucacuccuccuacaaagacuccugagggucccaggggucugguucucaggaagucuccagggccaaagggcacggguugggcugagcccuggagagacggacucuugagaggggugguuagagcaggucccaaggagcauugguggaggugagaccaaagccagcccuuaauuaacccagaccuccccaaggauagagugggcuugguaccuucugagccaugugagucuuguggugcagagucggguagaucucuuucaaggccauuuuggucugcauaguggguuccagauggagaaacagggagacccaaugagaaaauaaaauaaagcaaaaccaaccauauaaguauggagcagugcaggauggggccuucccuagaccauauuaccacccuuuacauuuucuugucaccuugcuggucuagcugagccccuauagucaugaccacuguucagaaaggaggagaaagguggucccugcuugcuggugacagaagugugugacacuuuaccugugaccuacuuauaggaauauugaucccauuuacccuuuucuaagccacugggaguuuuaggggguaggagugcucacugggggagggagaggagggccauugauaaccccaacugagaaaccucagagggagccacccauaagccauuggggaugccuguuucuuaacgaaagugccugugauaacuggacauugguccuuacccuucuuuggacuucccucugugcuguauucuuuucuuucaaguagaaccuagauuuauuaaggaaacaugagaaagaaaggaaggaagaaaaagggagagagaaagaaaggaaggaagaaagaaagagggagagaagaagaaaggaaagaaggaaaugggaacagcaccagggagagagagagagagagagagagagagagagaguguguguguguguguguguguguuucucccagcacuuagucugcccaucacuaaagcacuguggaaguaguugccagcuaggauucuugccuuccaccuccccugguguacacacacauuuaucauguucacaaggcuuggcgaugacacuccuuccuuaagccaaggaccuuccuguuggcaccucagcgccaucugguggucagcuuugacccugcugcgagcugaccuuacuugguuacccagacaccucuuaagagggacugcccuguccaaucaagacuaguuugguucuggggaccuggcuuugagguucuggauuuggguaagacaagcagaucaauaaaguguuagaagaaacuagaauuuguaggcagugcugggauuucaugucuuggcagguuuauuuuuuguuuuuguuuuuguuuuuuuuuuuaagaccugugacaucuuggaguaggaacuucuuguccuaucccuuucauuagugacuuugggauagauuccucuuuccuaggaaagccaaggcagcugacacuccagcauugcccagaaccccaaggccccuaguacaugguucuuaugguggaguguagacuuacccuaguacaugguucuuacgguggaguguagacuuguauguacggccacagcacacauacuuguucacuuggguucuauaccuuaaaaacuacagcuauaacuaggugguggugaacgccucuaaucccagcacuccggaagcagaggcagauggaucuuuugcaaguuuuugaggccagccuuauauagcuacaauaacaacaacaaaccuacaaccagaaacaaaaaguagggucagaaaccugugcaagugucacuucugcacggagucucagcugaguaauacuaagagccagggucucggaugacaacaagucagaguggccuguguucuaacuaucuuggccucuccucucuuccaggucagcaagucaaguagcagggguucaggagagcuugacaccuucauaguaauggcagagaagcggccccuagggccucuggggccuaugauguauggcaagcugccucgccuggagccagacccagggccaggacacagccugccccuuucugcuagcagccaggacuccugcaauuacaaaggugcauauuucuccugccccauaggggguacuucgaaggcaggaucugagcgguuggcauccuggaccccauauccaucuuuguaccccacugguguggcaggauccccacuccggggugacaaccuacugacaaacugccugcucuaccgucccccgacagaaggcucugaaaagauacaagacucaagugagcugcugcccuucgguccccaggcucaugcguacccaggcccgccccuggccgcgcccaagccugucuaccgcaacccuuuguguuacggacucuccacuugccucggagaugggggaacaaagagaucauuggauggugacuggacccuggugacagggccccugcugccuucugcugacccacccuguccucuagcuacagcuccuggcaagggccagccccuggaugggacguucuugcgaggacuaccaucugggggaccuggcaaggacucuucccugccuuuuuccccgugccaggcauucuuggagaaguaucgaacuauccaaagcacagguuuccuggcuuccaaguacaccaguccuuauccuggggaugcaaagcaagcaaugucugaggggcccuccaguccuuggacucaacuugcacagccccuagggccaccuugccaggaugcaguggcagcccacuauccacugcccccaccgccacaggcccugccuugcccuccaucuugucauccagaaaagcagggaagcuauggcucguugcucccacugccaccucuaggagcccacaagggggcugcguaccaagcuggggggcugggcagcccuuaccugaggcaacaggcaccccaggcuccguacaugcccccucuugggauagacaguuauuccuacuccucugcaccccucccagcaccaucaccagggcucaaacuggagcccccucuugcuccaaggugcccacuggacuuuguuccccaaacucuggguuuuccuuaugccagggaugaccucucucucuauggggcauccccggggcuugggggaacaccgccuucccauucccagaacagugugcagccugugccacagcccggugccuuccagcgagcaugccagccuuugccagccagccaacccugcucugagccugugagaccugcagagaagccaacuccagaagcucaagagaagauguggcugcccagcugcaggaaagagcaacuccagcccaggccaaacgagcguccuggagugccuauuguuauccgggacaguccaguuccccgcaccucaccagcacugcaccccugugccaaggagcggcagucugucccacagaaggaugccaggccucccagcuccccaccaaugcccgugauugacaacguuuuuagucuggccccuuaccgugacuaccuggaugugcagacaccagagcccagggcugagcgggacucggcuccagccaccaguaagagccaagacaaagauugcaaggggaaccugccugcucaggauggagccuccaggucucacugcucucuucgugaggagguggcucuggacuugaguguuaaaaagacgauggcagagggugucccugucaagguccccaguccugaggugcaugaaaagcccgcugaagcuguggaugggccagguauagaaaacacagugucaggucugccuggccuaaaaaagauggucacagaaaucccugaaguaacugcagaagccacaccaaggaccaacuuccauagcucuguggccuucauguuccgaaaauucaagauacuccguacugcgcccguaccugcagcuauugucucaucucccacuaccccggcuccugucccugcgccugccccugcacagccuguacccaaccccccgucugugccagugggacugcagauccucacucagccuuugccaguggcaugcuucaaccuggcccugccuagcccaccagccauaguggccuccccggccccagccucugcuccaccuccaucaccagcuccugcuccugcuccagccucggguccugcuccaucgucugcucaaguucccacugcagccccaguggacuccccggaacagcacuucacagggcugcacacaucccucugugaugccaucucaggcucuguggcccauucuccaccagagaaacugcgggaguggcuugagacaacugggccguggggccaggcugcguggcaggacugccaggguguucaggggcuacuaggcaaacugcugucccagcugcagaaguucgugugcacacagcggugccccuucccucauguaguacgggcuggugccaucuuugugcccauccaucuggugaaggagcgucucuuuccaaagcugccaccggccucuguggaccacguguugcaggaccaccgaguggaacuacggcccaccacucugucggaggagcgugcgcugcgugaacgugcccugcacggcugcaccucgcgcaugcugaagcugcuggcacugcgucagcugccugacaucuauccugaccugcugggccuacaguggcaugacuguguccgccgccagcugggugagcauggggcagcucuguagccacuggagcuguguugaaugcguggcagcuguguggacugcuuauauggauggugggcagaggggcugagugguuccaggaguuucugguggggcaccgggugggacuccagagcucucggguuugccuuguccuugugacgcucuaggcaccagugagaucuguuugcaugcaaaugcucuuggguccgcuccuggguuucauugcugugaagagaagaccaagaccaaggccacucuaauaaagggaaacuuuuaauuggggcuggcuucaguuucagagguuuaguccauuaucauuguggcaggaagcauggccgugugcaagcagacaugaugcuggagaaggagcuaaggguucugcaccuugauugaucugcaggcagcagaagggggaguguguuccuccccggggguagcuugagcauaggagaccuuaaaaccugaucccacaguuacacauuuccuccaacauugcaccaacuccaacaaggccacaucuucuaauagugccccuuccuaugggccaagcacucagacuuucucauaaccuucugugucuuguauaugcuucuuugggccuuuggcuagacucuguuuucuaucuggaaauuucagugucuuccauccaagcacuaacccaaaguaaugcccuguaugcugccucuuguccccugggccucuccuuacucaucucuauccaggggccaccgcucugucuuacuucacaacugcagucguuccaguccuggggaagcgucuuuguucauuuaaaaaaaaaaaaaaaaaaaaaaaaaaaagcaagcagugccugggaucuggcaggaccuccugcuccuucccacacaaacuuuuaccuuugaauguauguucccucuggucuccugcauucgcgugcacacccuugaugcccugaaucagaggacuguuugugguucucuuuccuccacaaugcuucauuguccuggcucuugaguuguacucuuuggaaguaucucuuauauaacccagcgcacccucaguggauggcccugccucccuaguaccugacuauggaaagcugucccuugcgcaacuuugagcuugcuuuuuuuuuuuuuaaauaguguuuuagaggacacauguguugcaauguuauauggugcggcggacgcucagacuucuuaggccaugacauggugaggguaguguagccuuuucugugucaggaaacugacuuguggauuuugggcccuuucuggagucuuuccugcccgaggucacacaagugccacccagccccuuggccaguuuucugagcaauguauucuacuuucuuaacuagcuaagaacucccgcuguggucaggguggaggaagccugaggcaguguacuaccauggaacagggcccuagguggcccacauuccugaguccugcuccugcugguuggaagucugauccuggcagugagccucccacugauaagguugaagacccuugcuccccaugcccucccugagcuguggggccccuagagaagugcuucucagccugugaccacuuuugaggagcaaucaagccuuucauugggcuggggguggggaaucacauggcagguuugcuuuccuguugcuggguuccugugaucuccuggccuccaucugcacuggugucacagcaguuuggucccuggcuccugcccuggggacuuuuguggcaggaagauaaugguuuuuuguauggcagagccuuuucuccccuauucuguuuacucagcuauacagugggaugauccggccggguuacccguccugcgagccuccuuucguuccuuacuuccaagcagccucuucuaagcuguguccucggcggguagagcucuggugucccuuggguaggagugucucuuucagcaagcuuccauuggucugaucagugggcugucugugaugccaugacacugcugggccacuguucuaggcgacuuugggacuuaggagaugggaccuugcaguuuggcuuuugccaucugacugugcuuuccuuuuguagguggcuuugacacugaggccagaacuuuauccccaucagaacccacggucaccagagaugagccagaaagccaagccuuggcuggaaaguugccagcccccaaggucaagaagccagggaggaagccaccgacgccuggcccugagaaagcagaggcagccacuggggaagggucacguaaucccucaccuagcucuggugccagcaccagcccaccaggucccacccugagggcccgcuuccgcaaccuguuagaaaaugccuggcucaaugguguggcacugccuacuuggggucacaaggccuccggagcagaucgaucuucgccucacccccagcucuugggcagccagacccaucaucuguagcauuguuaccagggcuauugggacagcccaccauccggggacugcuguguaccuguccugacauccagcugcccacggcuaggaguggauaugaggcugagcccaccuaaccgggcagagacuugcugaacuuuuaacuugaggauccuucucuugagaaaaccugugggcauuggagccaaccccaccuggccuugaauccugacuguuguguccugggcaagcacuucaccucucaugagcccuuguuccccauuuguagaauaagacaacacagccuaccucacaaggguuguuguggggaugaugucugaaauacaacuaccaugcuuugguuugcuucuugcccgggauaggccugggaccucagucaggcuguggaauaacaagacugagguuggcagaacuuuauugucaagucuucaugugucuuggaacccaguuacucuaagagguaccugguacaauguguaugacucacgugcuucuucccccagaccacugcagguguagggaccuggccuggggcuggcuugaagagccuaagacuguucuggagucauaugucugaccuaccugggcugcuucucacaccccuguaggguuguguagaguuguaugcuucuagagccaagcagcugcagggaccggacccgacaggcugagcucaauacugggagaagguccagacugagcacucuugguauuucccaagacucuuggggucuccucccugcaagugggcuguauucagcugguggcugauaaguuccugucuuauuuaaggguuuugaugagacugcgcccugggggacagcuauuaaagcauuuggguuguuuuuggagcugggaucuagcuuuguacuugaggggucauagaugaguguugcauaucacccgucaccaucuggcugucgucccugcuccuguucaggaugucuacagcuucuaguauuccacuccuacaggcccgcucacaccuaccugcuggccauccacuccacccugggaaagaccuucccgugacuauggagaaucuuagaggcgggugccuuuaugugucaccacaucugugugccugucuccuaggacugaagauggaagugucacccuccuuuagugucccuucaguuucaccauaggcucacucacauuccccaccaucccucuuuucuugaacauggcuuccuucgaccugugccaguccgucagagcucguuagagcugugugugcuagcagcuauucccaucuauacuaacugcaaggaugagccuggccccgagccuggauugaauguggcagcuaccauugcccuugugcaggcccaagaaauucaguuaggugugaauccccuuucuaucaccagcaacaccagaaguucuaaugauuauuuggguucauggguuuugacuuugcuuuuagauggggucucacccuguagccccagugggccuaaaaaaugaguuguuggguguguaugcgagugcguguaaccacacuuaguuuuggauaaugguucaagacuuccacaguugagcagccacaucuggugauggcuuucuuguaggcagaauccugacauagaucaucguaccacauggcagaagggcucaggcacgugucauccgggcagcuuguaggcuuccagcauucgauuaucuggccucaccuaaagcaucccacuuccaagcacaguaguuggauugaauucccauccccucaccucacaauggggauuacauuucaacaugugaacccgggggggggggggggggccggggaggggucguguugaaaccacaucuagauccaccaccuggccuuggaauuggugggaauaggaauuacgucacacugucauuucaggaccacccaggagagugguaucaguaucccucugccccacccuuaguccccuucccuuguuagaugauggugcaacaggauaccauguuuccacccagggccagaaagaccuaaguggucucaguuuacaagucugucacuuuaaacucacaagcuccugauuuggaguccauccuuggugccucagggggaguggcuagacccacauaucaccuaacaggagggacugggccuugagacuccagugugggaaaaccuggcauuaauguucaagacaagaggcugagggccccagcagccaguuuugcugagaagcagaaacagcaggaugaauggaggaacagcucuuccccaguuguaguccagguggggaugagggagaugggauagcgaugaaggcuuugucuuuuugguagccuaaauguauucucuucugguuugcuaagaggguugagcugaaccaacucucagccccucaaagcagcuuagagaauggcccaagugccucuuacuuucucugcuggaaauggaggggugcuuuuagcccuaccucugucaccuuaccugaaguaggacuacuggggguguccagccagcaaguacugguuugguuugguuugguuuuuguuuugccagcugagcaguucuacaugcucucugggccuccucuggcugccaccuccagacacuugacaguacagccuuuucagguacccuuguuuguucagcaggaggaacuguagagccaaccauuucuggcuggccaagaaugucugggcuaggcugugguuggcaggcagguggggcgccuuguguacauaaauccuugggcaaagaugugaugcucuuaggaugcucuaaccaagcccugggucuuggcauugaguucugcaguggaagcgacucccaggggccccaggcagaggaacaugcuacuaaaguacuggcauuca

SEQ ID NO: 5131 - RNA, 26736 nt, Mus musculus
auacagggucaaaugaucccuuuauuauauucauccaguuacacagauagacacuggcucgggcaggucaacugccaaugaggggauaguuugugucucucagaaacaaggggcagugggcaccaggagaaugcaaaagcaggucacuggcuggcgacagacaggaggacucccagcauccaccaggcccucccaccccucaagcaaaccaucugugcccggccccaucucucucacucucuccucaucaaagugcauaguugccugaagaugcagcaucccagugccugagcagcugggccagacacuggugacaggcuuucccaagggcagugccaggcauggccaauaggugugagccaggaaagaggagaggccgauaggacaggaaguugacuggggguaacacccaacagcuguggaugcuaggcuggcagcuggaucacagcuuuccuggaaguaacagaggacuaagagaaagggagcugggagaagggaagaggaggaagagccuagcccuagaaucucucaggguagcaggagcuaugacaacugcucuccauagagaaaacaguaggggagagaaucaacuaagccuagggagucaacaggaaaggaacuuuccagacacucuuggauucucuuacaaggaagaagcugaaaaaucaaagcucaagguggccugaaaccaagucuuaggguccaaggcaaaccaaugugguaugguuuuccagucucccuagccuagguggguuucuguugcaaggagaugagaaacagccagcugcuccuugguaaggccuacccaccucaggccucaugcagaggaauaagauaccagacaauguccacacccugcuugaaagauacagucccaggaacuaagaucagucuagagagagaugaggguucuaagagaacuaaggaaaggccuggaaucgaauccugucguucucgugaauggaagaggagggaaggacagaacacuaaacuaaaaacuaaaggcagagccauccugcccuuccuccugccaaccaggaauccuacucaggacauugugcuugcagcuugaacugggccugggagcaucucugcagaauguguccuguagccaggacaagggagacuggagaggugaacuacccucucaauggguccuauuugacuucuccucagaucuucccccuucagaccuaaccuucugaccucuauccuuucugccagacucaauuagaacagcuacuccuuccaggaauccaguggucacuuugagaagcuagaagcccuucugagcuggggccagccacaccucccccagcgaccaaugaugcccucuguuccaccacggccuuuacaccuggcaagugccucauacaagccagcgggaaaugcagagcggcucaagguggaucugggcagcaagggguggaagccaggagagggaaaaggagaugccugccucugcgggccaggcuugcagaaucaaggagaucagcucugcauuuccauuccccccccucccccguaucaaguaccaaaugggcucagaauccccaagcugggugccccuuccacgucaggguuggcugagcucccaugucagcuuccuggaacuggggagcggauuggggguaucuggguagucuuaaaagcagacauaacugagacaccccgcuuuaggaagacaacgaaaagcuacauggggaggaaaaagaucacggaggagccagcuagggaaaugagcacaaagaaucucacaaugagggaggaacgaggggaagaggagguggagggaggacuacagggagcaaggggacauccucucugucccaucgccuagaaccugccuaucaccaugaacacuaauacuguugcuucccaaugggacuaaaggcagaaauagcuuaggcucaucacccugcacaagguaucuggcucccugcuaggccucccccuggccuguggagucucugggccagggucagaggggacaaccugauggauggagggggcugguuuaguucuaaacauacaucuagcaccacaacaagagaucgccacuguacauuaucucacaaggggacauaggcuuggcuaccaaugcacagaaaacacuucuugugcagugcaaaguucccagaggacccaaaggugggggcagggauagacauauacauauacguacacacauauauauauauauauauauaacucugauucuuuguacaaaguuggggaggagaaaagggaagggggaacccugcuuggucaccacacagaagauguggcuuaagcccccugucccacuggcccccagcccugccuccuggugggcuuggcuggcucacaucucauuggaguacguguaguugggaguggcagaauacugagucugcgguugauucauggcacccugagcagcccccauggcugcauucugggcugccugcugcacauguggguucuuccacgcuccagugguccauuccuccugagccuugcugaaacugccuccgcuaccccgguagaacuuaugaaccugcagaagcaaccacagggaaugguuaagcagaggacagcacgcagggcacaguguugcacccugcaagcccuaaaggggcaaggaggaucaugauuuaagaggcugucuagaaaacaaaaauaaaaauaaauaaaaggccaggagcgguaacugccacgcgccuguaaccccagcccuuggggagacaauggcacguaauucuucaauacauguugaguuugaggucagccuggguuucauaagucccuaucucaaaaaaaaaaaaaauugaagcugagcacuauggcacccgccuuuaaucccagcacuugggaggcagaggcagguggauuucugaguucgaggcuagccugguccucagagugaguuccaggauagccagacagggcuacagaaaaauccugucuaaaaagccaaaaauaacaauaauaacaauagcaacaacaacaaaacaauaauaauguuuuaaaaaauugggugggcagcuauucaggaaacagauaggauccuuuugugaaaaauuaguccuccuugggggcuggagagauggcucagcgguugagagcacugacugcucuuccagagauccuguguucaauucccagcaaccacaugguggcucacagucaucuguaauggaacccaaugcccucaucuggugggucugaagacagcuacaguaguguacucacauacauaaaauaaauaaaucuuuaaaaaaaaaagaaagaaagaaagaaaagaaaaaucagcucacggaguaaguaacucagacuucuguguucugugucugugugucuguguguguugugugugugugugugugugugugugugugugucuaugugagagagagagagagagagagaacgaaccucuagucucaguucuugccuuccaccuaguuuaagacaagguuucuugguuuuucugccaccgugugcaucaggcuagcuggcccacaggucuccugucuccauuucccaucuugccacaggagcgcuaggauuacagcucacggugccuggcuuuacacagguuccaggaaaucacacucagauccccacaucugcacagcaagcauaucuacccacugggguaucuccccagcagcccacuugugugugcuguaugcaaacacagaggagguucacuugccugucuguagagggcaggggucaacaccagcuaccuucuuccauugcucucuaccucauguuugagaaggccuccucaucugaagccuucccuuucggccaggcugaccggcccuaagacauggaaucugccuguuucugcucugcuccccggcuacaguguugcaaucauuugccaccugcuauggaucuguggacuccaaucucaggaccuucugcuuaugaagcaagcauuuuuacccaccaucuccucagccuccugaauccucuuguaacccagacgaggaaugcuucaggucacaguccccucccucagccacccccucacccuugauguuuacacauaccaugcuaagagcaaugaaggaaaagacggccacaacugugaacaugaccgugggaaugagcaucaccacugcugagccgauguucgucccgaagaaggaaaugguggcaauccagccgcuguaggaagaagccagcuguggggcugugauguaggaaaagggaacccaggagccaucccaagggucaucucauugccacagggaggagccacagaguggccacacuucuuauacuccauagccuaugcucccagagccccugagccagaaggcuuguccuccccagcuuuccuacaaaaucugacacgccuuggcuacccaagacaccccuucccaggucuccuuccccuccaaucuauggugaacacuacuccacuaccacaaagccucucuuucuauucacacaagccacucaguggccggacagugguggcacacaccuuaaaucccagcacuugggaagcagaggcaggaggauuucugaguucgagaccagccuggucuacagagugaguuccaggaaagacagggcuacacagagaaacccugucucagaaaaaacaaaacaaaaaacaaaaacaaaaacaaaaaacagaaaacaagccacucagugcccauaaaagcaaaguaccuuagcacccaggcaagcgaacagcccgaaugcuacuccagcagcccaggucagaccuuuggcacuuaccagacaccccagccuggaauucccacagccuggaugaugcugaugaccagcugagccaugaaggugaagaagaaugccaugaagcugaaggaacugucuguccuauggcagagaagaugguuugucaccugggcagaggcacugggcuucccugcacucgagcucccaaagcuccucugggcaaaaggacgagcaaacaacacaagugugcuuugaaugagaauguaaaaaggauggccuucauucagagaugagcuaggccugugugcaagaaagggcugcccccauaaaaggaccguccauccguagcacauagauuaacggcccuacuggcauagcgauacuuggcucuguugugggaaaagcaagcagcuccauuaucaaggaacuggaauggggguggguggcucuauagacucagaaacagcaagucucgguggcauagaaaagagaccuuacugacaccaaacaguagcuaauuggcacauagauggugaguccugucgauaaagagauuuaaggcuccauggcacugaaauguauauucugcuggcaccaagacagcuuuguugcugucuugcagcucuaauggcacaaaaaauggaaaucccaguuggcacuggauagacacucccuggcaccccaucaauacauagauagguauucccuuuggcacaggcuuggauggcaucauuggcccaugaauagcauccaugggucuuagauggccacuuccacugacacgugaauaaaggguuuucuugguaccaaaccagucauuccccacugguacaaggauggacagcuccaccaagacagccccauaggcaaaacuuaacaagaagggaaaacugaagaaggaaggaacuaaggaaggucccacucccaacccucucaacccagccaggaacucccaggaaucccaagggaaacagaagauaagaguguggaacagcagucagagggaaauagggguaggagcuggggucggcaccaaccacuuacuugaaggccuuguaaaugggccgaaaccagcagacguaggagcaaggugugaagaggaugagccagagaaaggccaggccaaaguugguggcucccccgccuccgaucagccacgcgagacagcccaccagguucacggccagcgugacgcuguucacugcagacccaggagcacaugcacacacagagauagaaaccagauacacacacagacaccaaaguccauacagagacacgugaguguccagacauggagacacacaccagggauuccauauagacucacaaacaaauacauggcauaaacacagacaagcagcaagauauggacauauguggacauacaugcauaaaugcaaacacagagagagagagagagagggagaggaagagggaggggaaagagagggagagggagagggaggggggagagagagagagggagagggagagggagggggggacccacaagccauaccaaugaauacacaagaaacacacacacacacaagaguauagacuauaagaaagcaagcugggagcuuggucaacacuuccccaauucacccuuaggaaucugagaaaucccaacaaccaagagucucuagagcaagaagaacgcagagcuucugcccagcaaggccccuggaaggaucucaaagccucaggguccuauccuaguaagcaaggccucugauguguguguuggggggguggggggguugggagggccguguuaagaauuuagcuuagcaugcaagagaccgggauucuauacauaagaccacaggucagcccuugguccucucagauccacagcgaucacuaaccccaaagcaagagaccaucuuaucuuuucuuacaaagcaaggacaggaaauagaaggagaaaaagaccuaaaaacaucuuuucaaaccauggggcuaccugccuggcacuucaguagggcagacagcaguggcugggaacucaguccuugucugagacauuucuuagacuacuaucuucuuccuccaagaugucuuccuuaccuaugacccuuuccucugaccugcagaucugggcugcccugcaguuccccaagugcaaucccaaucugucacccagacuagaaauuccucagugugagauccagacuccuuccuuucucaccucaccuagaagauccuagaagucauaucacucagucacacccagcagaggucuaaagacucuuccuuugacagaaauguuagcacugacacacacccagguccucagaccucagagagcccuuccucgaacccuggaugaggcuccgaagaccugcaaguuaacaaaggaaggugggcucaaccuuggccucagccaaccaccucugcucccccuucugagucucaaggcucagauacaucucucuucaggaccauggcaccugacaggcaccuagcaaggacuuaaggagauauuuauagcucuuaaauccagcuucuggacaagaucuucucauguagguggaguuccaggagcccagggccaggcagaaugccccuaacucugacccagccugacuaugucaccucuacagcuacacccaucucagggacccuauaacaaauauagauauuucuugugcauaucagguguuuccuccacuccuguugauugauucaaaguuuccuagagcuuuguucuuacugauuuuguuugcuuuuuuuuuuuuaaagauuuauuuauuuauuauauguaaguacacuguagcugucuucagacacuccagaagagggcgucagaucauguuacagaugguugugagccaccaugugguugccgggauuugaauuuuggaccuugggaagagcagucgggugcucuuacccacugagccaucucaccagcccccuuguuugcuuuuuuuaaaacagcaauuucuguguguggugucugugugugugucugugucuauguguauguguauguguauguguauguguauguguauguguauguguauguguguauguguauguguguauguguaugugucuguguuugccauggugcacacaugggaaagucagaguuggugcucuccuuccacuacauggguucuaaggaccaaacucagaguuggccuguuggccuggcuguucacauagaaaagacacuauccguuaucauauuggcuagcaucgcucuuuccaggcucacccgucucuagcucacuuacucuagcauguaucuugcaauucuccucucugucuuugggaugggcacccccugacucagcaaguacuucuccagccacgaggcacucugucuuuacucuucuccuuguccagcucuauagagccugcaauucuuuguuauacucccuuucuuucuucuuuugagauagguucucacuauaugacucuggucgaccuagaacuuacuaugcagacaaggcuggcauugaacucacagagauccaugugugucugccuccuauaugcaggaauuaaaggugugcauuaacccagaaugaccuuaaugcacaucuuuaccugagcugaaugccccuaagaaaaaaaagguauugcaguggagaagccugaaaggacuagaaauucauagaaaaccucagaugacccugugcaugccucugagauccuggaggcuggguuuagcauccucaccuucugcuacaaaggcaaggaugcuaaccccacccacguuccccaaaacccccacccucagaccuccuccauauauuuuuuaaaacuguuaaccuuuauuuuuuauuauuuauguguauggguauucugccugcauauguuaucuguauuugcaugcaguaccuguggaggccagaagagggccuagaaccuagaguuauagacaguuguaaaccuccaucuuggagcuaggaauugaacucugguccucugaagaauagacaguacucuuaacugcagagucaucucuccaguccccuccucauuuaauggggggaaaaaagcuaucagguguaacuucauuuuccuuccaguagcuacaggcuacccauaucuguccaacuucuccucuucucacguuauagggcaggagacccuucucugcucauaggccaaggcaggucauggaacagucuaugacccuuugcuauuacugacuacucgccuaugaauggcauguuguaaagacggugauuuuuguuugcuugcuuuuuauucucagucucucucuccucucccucucucugguguguguuauguaucugcgucuguguccguguauauuugccauagggaggucagaggacgacuuuugggagccuuucuuuacauguaccuuguaaaggcauggucccucuuguuucugcacuuuguacuccaaacucagccagccuucccagugaccagguguuugucucccaccucggccucccagcuugcccuggacugggaucacaguguguaacaccacauccaacuuuucuauaccugggcuccaggucuauugggcuugugggccuagaguguucacuccuccuucccaaacugagauacccacuagcccaagacagcauucuuuacuacucucuugacacaacugagcacgggcacugagucaaggcagugccaccuguaacagaggccaacugcagacacacuacagccuguccucccucacacuccuaagcaguaucuucugauugcccugagcaaggucaagucuauagaccucaugacagcaccauuccacuagccugucucagaccaugacaaacaggcaccucuaaacucucaucccuaaauccucagagcauuagaacccuacaccacacagcuaucggaaaccguagcuaucccugagcuguacucucuuucuacaauagagaaccugcuguuugggaaguagggcacccaagccagauuccaugucuccuaacucccagcugaaugcucuucucuuugagaaacacaucaacaaacaugaggcuuuaaaagaaaggcucuucuccaaaugcaccacagguucccuggaaaaguauuccagugggaagggggucaagaagcaaaaagaaauaacagugcaaaaagaaaccgcacucugaacaagagagaacacggaggggaagaaaagaggccuacgugaaagaagcugaggcccagaaggcaaguggccagugaaagugagcuugccgggaccagcaggggguguucccaggccaugcagaugcuacagcuggaaagcagggugugcaagcaccccuccccauggccagcaccucucccucauccccacagcacucacacauccagagguaguagaggcgcuuggucaagcugagaugcugaggagggaugucugccucgaagucuugguagaaacauggcuucagugggaugaauuugggcaauggugggaaguuguucacuuucucugugggugagacacagcacagggcaucaccuuggauaucuccccuggccucccuucuugguccuauagguccuauaugucccuccccuccuggcucgacugccuauagauccuauauacuccuggccuugugcccugguugcucuguuauccccacccaaaugucccuacuuccugaauaggccacccaaauaaaucaaagaugcuaaaacagcaucuaucagcaccagagaaugggauaggccaaccaugcugcgacuuggucagguaagacagggcuaucaagaugcucaacucagguccccagguucaaaaucuaaccuagggcuagauggagcuaugacauucucagacagacaagccacaguugggaguuagggggacaaguagacaagagugcacauaaaaagcaagacuucugaaggcuaggaccagggccagauacuuuaugcuuucuuuccaugucuaccccagcaugacccugccucuccuuacccgccaugauggaucagccagcucaguaagccugcucacaccucuuuguccugaccuggaaggaaagaaagacucgaugagcaugaggaucagcacaccgucugccucagcucccucccgcucccgcuguguuucuccaucucugaggcauggcaugcucccauccauccccacugcgggaaugaacccacgugcagcagcucuucaccccggggaguccgcaucggccacguccuucuagcuguuuaaaagucaacuagccacaaucuggagucgccugggaagagagccccaacugacauugccuaggucaggcuggucuaugggugugucugugagggacugacuguugauccauaugggaagacccagaccaccauucccugggcaggugacccuggacuauguaagugaagaaaacuugcugaacauaggugguaagcaagcagugccuccacguuuccuugucucugcccgugacuauggacgggauguaacuagcuguuuacauuccugccucgacuuuccccucagugauaaauaauaaccuggaaguauaagcauaaccaacgcuuccauccccuaagucacuucuggccagcauauuuuguuuuguuguucuauuuugagacagggucuuacuaugcaauccuggcuggccugguacccacuauauagacuagguuggucuugaacucacagagaucacuugccucuaucuccugaauaggaagauuaaagguauguacuaucaaccccauuuggucagaguguuuuauaaucgcaacagaaaugaaacuagaaccacuguuugcuucgaggcacaaagucugcccucagaaaaccccacccagggcuaucgagauaacuccgcuggagaaaaguggcauacaucugaugacuuuacuuagagcccuggaacacauaguggaagaggagaacuggcucccaaaacuuguccucucaucacauguaacacaaacaauaggaaauaaacaagugaacaaauaaacagaaagaaagcucacagaagguaggcaagggcaucccauccucugcccugcagacuaagcugcccucccuccugcccucccuccugcccucccuccugcccuguguucacuuaguagaacuucauuauccaggcagugguagcacacaccuucgaucccagugcuugggagguagaggcaggcagaucucugugaguucaaggccauccagguccuacacagagaaaccuugucucaaaacaaaacaaaacauaacgacccacuugguucucugaucaagacaaaugugacuccugcccugcacacgaagcaguccauagcccccugcugucagucacauaggagaaaccagccuccugggcugguucgcacuugaggcccuagcacucuggagacaggugcaguaagugagaggcaagggacaagggacccagaggugagucugcagaauaaaaggaaaaaagccagauucccagucacuuagcccauggggcaaaugaugauagcccacaaccagaagcaugggugagaagugguccaggguccaggggagccaagcuguguuguggccauggugggaagacuggcaggcagggcuucaugccggcauguggaguacaaggggucagaaacugagcagaagccugccuggcgcaugcauuaagucaucaguuaaggcuguagagaucaucuccucuguacuguguggaagcaucaccugucaauaaaaaucugauggccaaugagcugaggcaggauuagaaggugggacaucuggcaaagagaggaacucugggagagagucaagcaugggaaaagaaucccacccagacucugcggaaguaggacuaugaaacuaaggaaagguaacuguguggaagacacagagcaguauaaacgggaugauguaagcuacaagcucaucagggaagagacccaacuuggccuaggcauuuauucagaaauaauaagccuccaaauagcgccgggugugguggcacacgccuuuaaucccagcacuugggaggcagaggcagauggauuucugaguuuaaggcuagccuggucuacaaagugaguuccaggacagcccgggcuauacagagaaacuuuuuuuuuuuaauacgaaaaaaaaaaaagccuccaaauaguuauuaagaaaaugggguauggguagaaaagcccacgcuuacauaaugcuaaagaaagccauugugcaaucaccugcuaggacagcacucuaagggaacacguacguaaucaagaccaaaaaaggguccacagucaaguacaauggcaacucaccacuuucuaagcuuggcugauauaaaguuuuguuuuguuuuuaagaaaaaccaaucuaugaugucaaacaugaggacacagucuguaagagagcucagcggauaaaagccaccucugagucugaugacggcggaaguguuagcagugaauccaucugagagaagacacccggcauccucacuauccuucuaccuucucaguggugugaauguuuccaaauaaaaaguuagaggcaaauaugaguaauguuaauaaugggucacaaaacacuggaaaaggugucgccuggcagagcggcgcauacaccuuagugaccucagcacucacgaugcugcggcaggaggagcacaaggugaaagccagccugggauacagggcuugacggaaggaaaugaagggaccuuggauaucgcucagggguagaucacgugauuagaauguacaggcuugagcaggcaggauggcuuagcaggucaagugccugagaccaagccugaugacgugaguucaaucucuaggccucacguagcagaaggaaagaaacgacgcccacggauuguucucuaacuuccacaaguauuccaggaggcuuguaugccugccuaugugcaugcacacacauuaaauuuaaaaauuacaggggggggaggggcuggagagauggcucuguaguuaagagcuccggcuucuuuugcagaaaacucagguucaguuccaagcacagacauuauaacucaaaauuguccauaacuccaguuccaaaggacucacuguccucuucugaccucuguggaaaccagaaagacacaugguucccagcaggugugcacaugcgugcgugugcgcgcgcgcacacacacacacgcaggccaaucguuuagacacauaaacuaaacuaaaaauaucuuuaagauagauagagauagauaaagauagaaagaacgaacgaacaagggaggcccugguuguaaccaucagcaccaaaaaaaaaaaaguguguuggagcaaaguccuuuuucauuauuuuuaaugucuacuauuuuaugugucuaagugucuugccugaacauaugucuauguuccccauguguguaguaucagaaaggggcauugacucuccugggaauggaguuguggaugguuacaagccaccaugugggacuguaauggccgaggguuauggaagaacaguggagggagcuucaaccccagauaccuaagauaugagauggcaggaguugacuaccuugcccaucccaccucagagcacaaagccagcaccccaccaucaacccuagcaggaaguuaugacccugacagcuaucaggcuucacuccuuguuugaccuuauaagauucccuuucccccgcccuauagcuccaaaguauguagaugacacaucuuccaacacccuuucccuggccaucggugcacagccacacaaauccugccccagagucccuggccaacuccucaggggcauggauaugcccuuucccacccaauaaaccaaaccagguccccgaagcugauccccaacuguguucuuuacccucaucgauggcauccugaaccccuauaggccuggcuauccaagggggaaguaggcacggggcaauaccaccaugugaauacugggaauugaacccagguccucuggaagaacagccagugcuauuaccacugugucauuacagaguucuuugauaaagcagaagaaaugacugaauuuuuuuaaaaaaaucaccauucuggggcuagauauaucacucaguggcuuucuguacaaacaugagagaccaaauuugaauccccagcaccuaaauaaaaaguugaauaugguuauaugcgccuguaacccuuugcuguuggcaugagaagauaugagaaccagugggacuugccaaccagccuagccaaagcccagcaaguuccagguaggacacugugucucaagggaauacaguggagaaggcuagaucagggugucugagauccuucacuggccucugggugaacucacaugggcacacacauucacacucacacacacggguaaggacacacacaccaauguaacacacacauaccacacguacacacccuccucugccaucccugcauaacaacagacauagcagacacaggcggagauuaccuggcuaccucaaucacugugaggcgguugcuauggagaagcaacagugcgagcgucacauuuuagacugcuuauuaauucugagagaaaagcuaucccuaaaaugagagacucuggcagaccaaaugauuaaacuuagcauuugugaugacagaauagaaaucacaauguauccacagaaggacacacaaucaucuguguaacauuguugccaaaaaguguuaaaucugaaaguuaaauaugagccagcauggccaagcaugcccauagugcaagcaauaacgagauggaagcagcagcagguucaggaguucaagacuaagcugaacuaccaaaggccccaucucacaaagaaggguccuuaguuaguaaugaaaaagaaaagaaaaagaaaagcagggcuggagagauggcucagugguuaagagcacugacugcucugccagagguuccgauuucaaauccuagcaaccacaugguggcucacaaccaucuguaaugggauccaaugcccucaucugguguggcugaagacaugugcccauauaaauaaauaaacaacucuuuaaaagaaaaagaaaagcagcuguuuacagaaagacaacugccacuaugagauaccgagucaaauuuacaaaaauagaaaaauaauuaaagaagguaaucaaugggggugggguggggggugggaggguugaacaagaagagcuuugggagggucucugaugcaaguagguggggcaagccaugaacugaacaggugguaagaaacagaugcaggcaagugcggggccuugggaugcagugggagucugccacuguacucgcuggaaugagaggcaggaggcaagaacagggcacucggcaaaugggcagucagaacacagucuacgugcucuggacaguaacucggaaagcugugggaaucaggacaccucuaagguaccugcugccacagaggaagcaguuccagaucugaauacaggaaggucagauaggaguuagcugggcaaaggagugaggagaacagaagaggcuaaaagagcaguggccucagguaugcaaggaauacaggggcagagggacagaaagcuucaggggagggacgaaaggacagguaaaaaggcgcaagaggcuggagggaaggcucagugguuaggaacacuuacuacugcugaccccaaguucaguucccaggcagcucagaaccuccuggaacuccagcuucaagagauccaacagcuuccggucuccuugggcauguguaugcacaugugcacacccauacacagacacacacaugugcgcauuaucauuauuauuaaaaggugggaagggaugaaaaggaaacggggucaucccuuucucgaaggcugugggcaaggucuggcuuugcccuuaaagccacgggacacaaugaaggauuuuguccuuccaaaaacaauaaaaaaacaaaaaacaaaaccacaaaaacccucagucuacuuugggguugguuggugggucaguugguuugaaacagguuaucacacuguaucccuaggcuggcucaggacucacuauguauccuaagcuaccuucacacucaugacaaucuugccucagcauuugaugagauaacaaacauccucccaaaggcccaacucagcuuuuauacagccaaaaagcuaaaauuuuuaucauaaauaaauaaaacucugagggguggggagauagcucagugggugaaggcgcuggccacacagaucugaugaugagaucaaucccugcaucccaggcaggcgugguuaaggcucucacuuguaaucccauuauagcaagaugggagguagggacaggaaaaucucuagaaagcuugaagccaagcuugcuuaaggcaggaagagcagacucagcaggagacacccugucucaaaaacaggguggacgccagcuguggugaggcagaggcaggugaaccucugugaguucaaagucagcccagucuacagagcaaguuccaggacagccagggccacacagagaaaaccugucucaacaacaacgagaugaaagaugaaaagcaacuuccgaaaguguccucuuaccuccacauauguaccaugaugugcaugcaugccucugcucccgcucacuugccccccucccucuccacccccauuacacacacacacacaaauaaaucuaauuuuuugagacagaguguuauuauauagcuagcguguauauagucaguauauaacuauacuggcuagccuagaaucacuauguacgcuagacuagccuugcaguugcagaaaucugccuaucucugcuuccuaauggcuaagauuaaaggugugcaccaccacacuguaggaaaaauauuuucuuucuuuuuuuuuuuuuuuagaauuuauauaugaguacuguauuuacauuaugcccuuucccugcccccucauguucauggauuuuuaaaauuauuauucucauauguguguaugcauguuuaacuguguaaacacaaucaccugcuaaguccauuuacuauuguucauauauacauauguuuagggcugacuugguauuggauaaccaauuaggcagcucauuccuggggaauacugacucucccuccuuaaaaaaaauauuuuuuaaagaacaaauucaacauuuguaggacacauaguuauaaaccuaguacuugggacauaaaggcuugaagaucaggcgucugaggccagccuagacuaucaugagaccuuaggaggaggccagccugggcuaucaugagaccuuaggaggaggccagccugggcuaucaugagaccuuaggaggaggccagccugggcuaucaugagaucuucagagaccaugucucaaaaaaacaaacaacaaacaaaagaacagguuggagacggcucagugggugaagguguuugccaagcaagccuugcaaccucugcuccaucccuggacugcauauaaagguggagaagaaacgacuccccaaaguuguccucugaccuccaugugcccccacagaaauaucacgugcucaugcacaccacaguauuuuuuuaagucuaugaaauuaaaaaaaggaaauuccaaaaucuacuuucucugcacucauccuuaaacugccuaaccuuuagacaucccaguuuugcuaguuuuguagcagaaucucauguauguuaagcaaggacucucuuccugagccaaacuccuagccccagauccucugcuucauuuaauguauagcuauaacuauaucacaaauaugagaucgaauaugcugugucauauucugauuuuuuuuuuuuugagacaggguuucaauguguagcucugguuggcuugggcuuaucauaauccaauguuuucuucucaucugcccccccccccuuaagucugaaaagaaugucuuguacuuugugcgugcaaugccuguaguugccagaagagggcaucagauccccaggacuaagaguuauagccaguugugagcugccaugugggugcuggaaauugaacccauguccuccugaaaagcagccagugcuuuuaaccacugagccaucaucucuucagccccacucaauaacaucuuauaaaaauguuucaaugcaacucucuugagaagccuauacccagacuuggguguggccuagccuuuuccuaagugccccucucucuuaaugcucaugcuuagggcuauguucaaauccuuucuuaauaaacucucacuuucucuuuccuuaugugguauaaggugaucugugaaaauggucaucucuacccugagucacagaaucauggcaucaguagcuucacacuuuugugcucacuuuaagaacucacccaugaaacugcucaagguuuccaggcaugguuuccagggcaugcauaccuagaaagccaacaaguaucucaaagcugucccuuuaaaauagcagugagcaucauucugaaggcccaggagcauagucaguagaugugcccaggccaauaagugcgacuggacacggggucaaagagaauacugaauuuuuuuuugguuuuguuuuuuguuuuucaagacaggguuucucuguguagcccuggcuauccuggaacucacuuuguagaccagacuggccucgaacuuagaaaucugccugccucugccuccagagugcugggauuaaaggcgugcgccaccacaccagcuacugaauuuuuuuuuuuuaagacagguuuggugacucauacuuuaaucccagcaccuaggaaauggagacaaaaguuucaggaaguucaaggucauaguugggcuauguuuugaguuugagaacaucuugggcuauggugguggucgcugaagaaauuagcucaacaauuaagugcggguacuggucuugcaggggaccugaguuugcgucccagcacccacaucagaaggcuuagacccuugagaaagucuagacauccagaaaucuggccccucuagccuccaagggcaucuaugcucacaugcacauaccugugcacauacauacauacauacauacauacauacauaauugaauaaaauaaauuuuucaauaaagcaaaaccauaagaagcucauuccuguagcccuagcacaugggagggccucaaagagaagggggaaggagcgagcacuugcaaagaauaaagcagaaacugguauggcaccuuuaaucucagcacuucuucuggaggcagaagcaggcagaccucugugaguucaaggccagcuuggucuacauagcuaguuccaggacaaacagggcuacauagagagacucugucucaaaaaccaaccaaacaacaauaacagaaaggaguacuacagaaccuaaggauuucaacccagauucuuggagggucuuuuuuccuuuuuugguuuuccgagacaggauuucucuguauagcccuggcuguccuggacucauucuguagaccaggcuggccuugaacucagaaauccgccugccucugccuccugagugcugggauuaaagguguacgccgccaccaccacccagccucaacccagauucuuuagucauccaacauagccaacugggcaaaguacccaagaugcaccacugucuacagagaccucaugacugacucaacacaugcauaaggcccccucccacacugagaggauucucaccgaagaggaacaaaacggucccaagucaguaaagggagcaaaaaggucucucggaagaaacaagacuuuauugcaugaggaaugaauucaauguaaaauaaauacaaacaaguaaaauaaauaugaauccuaacucuauuucaaaaaaaaaggagggaaggaaggacggacggccauguggcauggcgguucggcgggugaagccccugccgucaagcaugacaaccugaguucccuagaacucacaugccagaagaaauaaacagauuucugagaguuguccucuggccucuauaaguaugcuauagcauauacauacacacauacacacacaaauaaaugaaaaaaauacacaaaagauuuauuuaauguguuggguguuuugccuguguguaugucugugcaccacaagugugcaggcccuguggaggccagaagagagugucaaauccccuggaacuaggguuaccaugugagugcugggaacuaaacgaacugaacacaguccucucuggaagagcugccaaugcucuuaaccacagaaccaucucuccaguccauaaaaauauuuuuuaaagaauuuaguuuauguguauaugugauuugugugcacauauguauguacaacagguguaugccugguaccugccaccgccgccgucagagggcacuggagccccugucacuggagguacagaugguugugagccaccauguggguacugggaacuaaaccugaaagacucaaugaggagccucucgcucaggucucgggauacuaguagacccccaagaacucacgagagcccaaucaauauugguugcugggaaagagucggaaaaucuccccagcaaacccaaguccucugacagagcagucauugcucuuaaccacugaaucuccucucaagccccaagaaaaaccuuuuuaaauaaggaaauaaaaacuuuccuauuaaugaguacagaucuaucuuaaucuuuuuaaugacuggccaacuaggucaacagugccauggccacagagcagucagaugugacuuaggcugacccgacagucagaaagucacaguguccaggaagcaacagagugagagccaugcuaccaagaaacugggaaaaucugagugaaaagaagagaugugucaaggagcagaagggauggaaguggcuaaaaccacagcagguggcucccacauauuggccccaggggacccgacgccucugaccuccaaggcaccugcacucacgugcacauacccacaggcagacacacacacccgcacacaaucaaaaauaaaaucuuuaaaaaaaaauccaggcuugauggugcaugccuaucguaacugcacuugggaggagaacgcagguggccagaucccaucucaaaaccaaacaaggcaaagcaaacuggggcuggagcuuugucuacacgcacaagguucaggguucaaucuccaacgcccuacagaauagguguggugggacacacccaaaguucuagcaacaaaggcaagaaggucuguucuaggucauuaacagcuacacagugaguuacagaccauccugugcuauaaaagaccucccuauacccaccucauaaccugccaaaaaaaaaaaaaaaaagggcuaaguuaauccugggcuacagaaggagacaaaacuacaacagcuaugacacuggguaggaggcuuucuuccaggucaggaaacacagcuaccuuaacaaaccaggaggaagacaucaaagaaagcaggguggaggcucaggaggcagcagugagggacaugauugacaggcagugguacucugggacacacaaagggucaguauccaacguaguguguagggcuuuccacaaggacccuccuugcuagaauucaagagaugcaugagaaaugcccagaguggcagcacauaccuauaaucccagcauuugagaagcagaggcagcaagaucaauaugggucagacagcagccugggcuacaugaugggacccugucucaauagaaagagagaaaggaaaagaaaagggcuggagagauaacccacauguuaagggcacugccagcuccuccagaggaccaguuucaaaucccagccagcacccacguggcagcucacaaccaggguagggaauuuaacacccucuucuggccuccaaaggcaccaggcaugcaagugauacacagacacacaggcagacaaaacacccacaccauaaaauggaaauaaaauguuaaaaguuuaacgcucuuacuuuuaaaaagaacaguggacaggaagagggcaggaacaggggcauggcuccgucucccucaucacccucaucaccugcauccugaguaaaggucuuugggcuuacaguccagguugaaauauuccugccaugggacagacuggagagcagaugagagugaggaagacuuucuagguguuuucgaugacauaagguuaugacuaagacaggacacccuggugaaagcagggucacacugcccugaucuaaccgcuuucuauauucugaauggagcauccagaacggaaucugcuucucaguaggacacacaggcaaaauggcccagugauugagggcauggaacccaaggacgugagcgaccauaugccagugagaacaagaugggguggcugaggggcaccgccuuccacaaauagaaugggauauggaaugagaaccuguuuccaaaaucaaggccuccagcaaaacaagguagacaaguagggaaguggagguaaaaacuaagucauaggagccucaagggaagaugcucccccagcucucacugcagccugaccccgaucacaggccccaagucauuucuccaaggugagcagucagugacagagaagucauaaagucguccguccguccgugaaugauccagggcagaaaucuaguuugugucugaaaggaaggacucagaggggcugcaggaggcugagaucacagaaccagaagucuggggguccuuuguccuuaggacaaggcuaccuuuuucuuggagaaaggagugguuuuggaaaugaaagaaagcacuggcuuuuauaaacaaaacucuuaauggaggauuaguauuugcucuucaggugagaaucuuuuguaauuaggggguggggggagcagguuacaccacuucugaaaaauguaggcuuaauaaagcaucuuauuaucacauaagauaccauguuagccgggcgugguggcacacgccuuuaaucccagcacucgggaggcagaggcaggcggauuucugaguucgaggccagccuggucuacagagugaguuccaggacagccagggcuacacagaaaaacccugucucgaaaaaccaaaaaaaaaaaaaaaaaaaaaaaaagauaccauacauaacugaaauuuuggguagguuagguuuuaguuuguuuugacacaggcucuugcuagguaucccuggguggccugaaacucacuauuuagcccaaacuggccuugaaaucucagcaaucccaccuuagccucccagcugcugaguaugggcacucaccaucacaccugauccaacagaaccugagugaagguuguuuacgaaaccuagacuguaacucaaucaauuccuuagugugacugguccugcaaucgugaaaaugaaagucgguggucaaugaaaggagggcaagccuggcccagguccggccaggggccugacacuaguuccaaguguucucagcuugccaacaagagccccucaucucuggcacagaagugaucauucuucuguuugccuacuggcuaagacagacguuucuacuuccugcuugaccucugacccucuucuccugaucucaaucccaucugcaguccugaagcccaacgcuaugaaucacccucaaaaaccagcacucuccugggcgugcuaucaucgugcugcugcuaacgcuguggugcccuccugcaggcacagauccugcaccuggcauuuugaagcuuuaugccaaucauauacaaaucccuccuccccgcuacccucuuucuuuaccacaggcugaaauuucuauacauaacaacauuuuagagaauaccaugucuagucacccccagugaccccaaaccagcagccuaucaccuuccuuaacccuaucacuucccacaccuccucugggacccuucccaaacaucacuguucugcauccuaccacauaaauucuaaagcagucacuggugcuuaucucacccauccagucucgucuuccaucccucacagauggaagcuguuuuaauacagagcuuugcucaguagcccaggcugaucuuaaaugcccaguaauccuccugccucagccuucuaacugcuaggauuacaagcaugugccuuccuacuggacaccacacaaucuggaggcugaacccagauguuaacuuguucuguuucuuaguaugaagucaggggacaggcccugcaguaggaaaaaucagguccaugguggagagaagauuucagaucaggcagacugagccccacacugagcauacccaccccauguuuaagacuuaaagcuuggauauccuccccaggaagacgggugccuuccccuaaagaggcaaaggccagcacuucuguugagccagcuguaucacuuccuucaggaacgcuucagaccccaaacugacagcaaggcaggaaguguaucguggagaggaggccugacaggcagagaggaagagggaaaagggagaacucagaggguucucuuaaacagaacaagacacuuccucaagggaggucacuacuuaguccacuuauuuugucccuagagaaaguguuagcagaaagauacccagagagggguaucaacuuguucagcagugaccagccaaagagggggcuaaagagacaaccacacuggagagauggcucagugauuaagagcccugacugcacuuccagaagaccaaacuuuccccaguacccacauggcaacuuacaaccauuuguaacuccaugggcuccaacgcugggucggaggacacugcacacaauggugcacauacaagcaggcaaaacacccauauauauguauauguagauuacaauuuaaaaacauaaaggaaagaaaaauagaaauggccacaagucccaggacuccuaauccccucuacuaacacuccauuuucgauggcccaucccugccacgguucucucucagcaauggagagcugguccuaucucuccaaguucccacagacgcuaaacuagcaaccccaagcaaaaucucucugccaaccguggcccugccagaaucaucucccucuuucacaguccugauggagaagacauaauggguaacgcacggguugcacauuucucuagaccaucccucccacacacaccacagacaggcugggguggagcagcagugcuucaugcccaccucugaacuuuguccauuaccacacugagaugcccucucucgccucugccuccuuccaaaucccaccuccagaaagucuccuccugacagcugcugccucuugucucugucuccagcccuggccuuugcugaucuccucaagucggccuuuaacaaccaauuaucaguccuagucuuacuugacucccccagacuccagaucaggagaaccucaaggcaaggacggggauugguucuuacacaucuccccuccuuccucgugacugacuggugcuaaugcuggaugcgcuacauccagcacccccaucccacuccccaaagcccuggugguauccgggcccuaggcagugcacccaucccccuccuccaaaaaccaggcugcucagacccgcgguacaaaggucggccuuccagggaugaguacaacuuggguccaccugcaggugccuuuugugauaccacggucacuagauuccagacguucccauccccggccgcaugcgccaucccaaaaggaggaggccggcuuccagggaaugccagguggaacucgggguuugugggguggagggcccaaagcccaggcuccauccaagggccugacgucacccaaaucccgggcucccucugcggggacagaggaaagaggaaacaggaauggggaggaggauuuagggguguacaaagagcgcuuaccaccccaagcaggaaaggucaccucgacuccccaccucuccagaagcucgaccuacccccucaaaugaagagggacucuuugaaggcagaaaauuggagccgcugacaccucuccaacccagcucguagcuuccccgcagugcccuccuugggucuccaggcccaggacucaccagccccgaccgcucggcugcagaaagguagucgcgcugcgccgcgcugagcugcgcugcaccgggcgaucaggcgcggagcgggccgcgagcggcucccggauugggggcggggagcgugcgcgcgcg

SEQ ID NO: 5132 - RNA, 717 nt, Mus musculus
cagcagagcgcccucgccaccgcaucucugcugcuuuugugcucucccucccgccauggccagccuuaaggaucucgaagggaaguggcgccugauggaaagccacggcuuugaggaguacaugaaagagcuaggaguaggacuggcucuuaggaagauggcugccauggccaagccagacuguaucauuacgugugauggcaacaacaucacggucaaaaccgagagcacagugaagacgaccguguucucuuguaaccugggagagaaguuugaugaaacgacagcugauggcagaaaaacugagacggucuguguaccuuccaagacggugcccugguccagcaccagcaaugggacgggaaggagagcacgauaacaagaaaacugaaggaugcgaagaugaucguggagugugucaugaacaaugccaccugcacucgggucuacgagaaggugcaaugagggcuuccucgucauccuggacaggaguuagcugccagagugaauaugcucaauucagugagcggucaaaugcaacaaacagcuucacuucuuugguuuuauuuuucaugacuguugaguucucuuuaucacaaacacuuuacauggaccuucaugucaaacuugguuuacccaggaucauuccuuugguuaguaaauaaacguguuagugcuaauuuaaaaaaaaaaaaaaaaaaaaaaaaaaaaagaaag

SEQ ID NO: 5133 - RNA, 2735 nt, Mus musculus
cacagagccacgggugauuugggaggugaaguucuccgaagucaccaucuguucucccugaaccagaccuuaugcaggaacaaccuaaauaaauacuaugcuuaagguucaaaugccgacucaagccuggucccugagcccugcgggguuccagcgcaagggcaucccuagaccccuccuagguaagagaucuccaaaccaccuuuuggggcuucgcuacuccaccccuccagggaccucccucccguucucuuacuauauuuuugcgucaagggcagccagugcauggucagcagagagugggaggcguuggcugcggcugcacgcagcgccuucccugggcugggaccgcuacgucguggccugguccuugcguagcugcuuagagagacacuaagcuuugcuccuccugaucauaccuccaggcucccggcaccuaugcaccucugaaaugcaggaagugaugcguugggccagccuaaagugaauggggaacaggagaccauuucuuccaaggcguuaaauucuuauauucaugccugaaaguccuuuacuggagcugcauacauguuuaugagcguggcucagcccgagcuaacgccggauuccugacuuccaauuccagguggaauuccuugccagucagccuuggccucuagaaauccagaggguuguuuuuguuaaaaggagacugagagaagacagguuuuaagaggugggaggcaggguggagugccuuggcggaaugugugugugugggggcggguacuugcaaacucugggaacuccacugaaucugagcagaggcucgggcucugcugcgaggugaggugggcaguagaaagaugaggucugaucaaagcaagacuguuuaauaaggagugacccuggccuggggccacgcccucaauauucaaucccguuuccauggaaaggcagggagggaaucagacagacgugggaagcaccgggaaggaagacgcacugaggacuguaaggaacgguguucucaaaguaucagcaagaugguguuuggaugagcacagcaucagucuagggggagagcugcccggcccuccucuuccucuuugcuaucugugacaauucucagccccucagcucagaacaacgagcuuauaucucaucucuucuuggaguguggcugcagcagcuggacuuuuuauuuuuuauuuuuaccucaagugugagugacuggcuccaaucuccugcucacacuccaggagugugccccgaacugggacucugcccuggaucuaaucuuaauucuuguagauuucacagggagaagcaggcucuggagucccaaccuuggggagaccccacgacugagugcacucaggcaagugguggacuuaaagucggcaguuuuggauugaucugagaaaaaguuccagaaagacuagaagcuauguaggaaugugcugguuggaaaagaagagagcucugcguucccuggaguaugcaagccuggguuaaacaacuuggaaaucauguaggccguacacuacaauuuggaagaucugggggcagcagguuuguucugaaaagagugaaugguugugccucuacccaaguuggcccucaaggacaccgccacccucucccaguaccacuacccucugccagagacucucccauucacuuuauuuuccuguggagggagaacgcagaaaaggcccgguuccccgcccgcgcaucgcuuccuuuccagcucccucagcagcacuuaaaauguaaaugcacaucgugauuagccgcggggucgcuaauuacagcugaagccauucauuacgcugucagcucucuccaucgccugccggcugugcaaguggggaggugaugggggaaaaggauguggggacagcucgaugcuggcagccugaaagcccagaacuggcagagaggcggugagccgaagaaaccgguuggaccgugaagaagccguggugucagagaggggagaaaggcgggaggcuggaaggaaggagauuaagugaggaggaugaagaggaaggguauaugagaagcgauaccaggaugggaagaaggccagaggaggaaucgugcgagauagguaggaaccuuccaaaaggggacagaggacagcgggaggaggaagaagguccaacguggggaaaguggguaaacaaagguacuaucuuugcugcacacaacaucacgguuagaaaggcaaccaggacguaugcugaaaaagcugguugcccgccaaacccugcggauacguuugcauauguaaauguauuuuuaaauacuuacaagaaaacggcacacuggcaucuguuaccucuguagccacauucagauuuuguugcucucuuuaaaggcaaggauaacagaauacggauaggaaauuaaguaagcguaaagucuuggaggagccuguguaauugagguacugacccggcaguccaggcuucauuagccucuuucugcuucuugugaccuuggacaauugacuuaacccuugugcccugguuugucaccuguaaaaggaggguaauuauaguaaccugcucacugugccccugaguuccugggacacaguagcuguuauuucuuuucuuauguugugauuaaaauaaaaauuuaagauugcaaaaggaggggugagaggugagaggaucagaaguucaaggucuuccuuagcagcauagcaacauaccucuccuaggcuacgugagucaucagauuua

SEQ ID NO: 5134 - RNA, 5663 nt, Mus musculus
ugcgcgccgccaucuuucuaaaggcguguuacgucuugucauucguucuuccccgcgccggucuggccacuggcggagcggggcgggaccggucauggcgaccgaggaguuccgcgggcaugcggugcggauguccacccaggggucucagccuggcgcggcucccgacagcguggcaggaacugcggggcugcccuccggacagagcggcggcgcgggccuccggcucggggaacgcccgccccccgccauggagaagcggggacccuacuuggugacacgcgcaccuuccauucaggcuaagcugagugagugcagugggcugcauaagggucucugcccgagcggguugcuguggccugggguuggucucuagagccccgugaucuuguccccagaguggaggggguuuaggugcagcccucuccuguccccgacaguccgaaaagcagcagaauggggaagaccuggcugacauaagacccuuugacuuccagagaagcaccgggaccaugccaaggccguucugcggagaaagggcaugcugggugccuugacgaaccgacccgauucuucagggaaaaggucucacugggcuuuuuacuuccucugucagcagcguucaaaggcccuaucccuuccuguuugggaaucagggcacuguuuaagguugagcuagcuagcuuauuugcugguaucuuaagaaugggaacuaggagggauggggcugggugggagagugagaacuggaacuaccucuacucuuuauuaaaagacugugcaaaauagaaaagucauaaaauagacuuuguaaaaggggaguugcaucagugcacagauaggauagcauuaaaggaugagaugguugcuggagucccgggagugaagauggagagcccgugcaguauuuuuggaguuuuuuuuguuuguuuuuuaaaggcagaaugguacccucuuagagcugaauaagaccucacacagcuguuuauagcugaaacucaaaugugacuugccugggauccccaggcuaagguggaaagaugcagcuuuuuaccugguuccugaaauggggaggugggccuuuccuaggagcuuucagugcaguagagugggccagaaaagaauccgagaagccggagccaacugcauagaacagcaguucguggugacugugaccggguagaaggaaagucuggaauaguccacucaguucuuucugcauagggaucagggcucuggccuucccugugaaaugccucugcuuucuuccccgccccaucucaggucagugaaguuuaacaagggcuacacugcucuuagccagaguccagaugaaaaccuggugucccucgacucugacaggugagugcuuuccuuggaaauagucagcagugacuugaauagaucagcagagugcuugaugcccuugccugcugccuuucucccccgaggcccuucauguacacuccagggcugcucucuuuugacugcugucccuuccagggauagcauggcuggaaguguuccuguccuauugggcuugcacuuuuagcgagaaucaccugcgggagccauuggugcucacugggacucugggcuugaguucucuggugugcagucuuugcuucacaaguccuucagacccccuugcaugcccucgccauuugcagcugugccacagagauguccccugaacugauugucuuccucuucuccuagugauggggagcuggaauccagauauuccuccggguauuccucugcagaggcaaguccagagcgccuaucugugcagggucaggcugcaggcaggucaccacccaccacugccaaaauguuugugcugccugcugugugcacagcacggugcuagauuccacuuugcucccuagucuuccacuauucccucuucccuaagcaaagagagacaggcaucuuaggauggcuguugaaauucaggagacuauauauccucagagcuagaagugaugucaaguccauaaucuuggaauccucuuucuaaguuccggcuaagugucuauaaacugugcuggaaugcuucuugugauuggucacucacuacaucuaagaaacauugcuugcugcccucuuuggguaguuuccaggucuucuguuucuugcagccuggacccacuggucauagguuugccuuccaguguugaaagguaauucaaggcuucccuuuuuuucucugagucagcauucaacccucccccacccaucuuccacugagcuugcuuucuucaguuccaucucuggcaauaguaugagcacaccuccuaggcuggucuuuaggacaucuuucuagagugauugucccagcgagaaccaaagggacagaaaauucucagccaggcaugguaccaugugccaguacaaguacaaaugagcugcaguuagggacauggccgcacuggguagcucgucuuuauucuccuaggaaucauugguuaaucucaguuuugcaaaggagaaaacagcuugcacauuguacccuccuuauaugucuaagacauuaagauugucaaaaacuaaggaaauucugucaagaaucacaagucuaaaaauguccuagcaucauugauguccugccuaccagcacccuggugaaagcaggcuggcuuugcaggaaccuagcccugccagcacagaaggaacuagcagcaaugcugucccccuaccacuuucuacuguuccacauauaccucuaauacucaagccuaguuuucuguugccaaccuuccucucuacauagcccuggcuguccuggaacucgcucuguagaucaggcuggccuugaacucagaacugccugccugucucccaagugcugggaucaaaggcauguaccaccacagaggacagccccauauucuucaaucuugauauggauaucugggugacagauuuuuaaagagaagccuggcugguucucagugagccucuggggaguuccucacugcuggaaagacacugcacagaaagggccguccuucuguaaugcaggaugugcagaggccuggggcuagguagagcagggaccugccuuuaggcagcagcucuguaugccucgcauccuguuuuacacuucuguccucuuccuuuagcaggugaaccaggaugugagccggcagcugcugcaggauggauaucaccuggaugagauuccagaugaugaggaccuggaccucauuccuccuaagccuauugcuucuuccgcguguucuugcugcuggugcugccuuggggauucuuccuguacccuccaguagccauagcccuccaggaugggccgauggccccaauggcccuucacagugauacucagugcacuggguaucaccgccagccuagaaccacuggaggcauugaccucuggggaggccaguggccuacaggagcccucaccuggugcuucucaugucagaggcccccgucugggucauaggugauagguggaagucggcagguucccacuggggcaguuucaggaagccacuuuaauaagggaggagaaacuuccugagguucuuaugcugauugcuaagaaaaccauuuacagacauucugacuccuccugaggagggagaagaaagaacgaacuccuucacucaggcugugcuggggguauggugagaggcagagagcagcacuuuauggcuugcaggaggaaucucaaagaauacagcugggaagcgccaaguggguuguuccuuagguuacagcaaggaaucuaacuuaaugauggagugggccuguggcuuucagaaccucugaacuuggaccauucugcuggcccugcugucuggaugggcuuaguaacucuguuggcccuuccccuguuacaagagaacugcucuguuguauauguuuauuuaucuguaguuccuuggcauuggagaguuucuccgacuuuuuuuuuuuuuuuugagguaaaaauuggauuggcaggaaucugcaguuuuuguuauuaccagcagagggagcugcugggaaguuagugccuuccuauguuuagcuguguaagcuuuugagaaguauugauggaugagagguguccugguguagcugugugacucuggccuacauggaaauguuuagacaggaugggaaggggagacuuaagccagcuccuggaccccacuugaguugaugaaucugcagugcaaggaggccuucccucuaacaaggcacauuucucuccccagcacagggcucacaggcugguagagcacuugccuagccugugcaaggcuagggcugaugcacaaaacaaaacaaaaaaaaaagccucugggagaacacagcuaagccccaagccugagacucaguacuaagccucuuccuggaaucuaguuuucccagucccccucugcccggguccuccucuuugggguuuuuuuuuuuuuuuugguuuuucgagacaggguuucucuguguagcccccuggcuguccuggaacuuacucuguagaccaggcugaccuugaacucagaaauccaccugccccugccucccaagugcugggauuaaaggcgugcgccaccacugccuggccucuuugcuuuaucuuacccagguguguggugaggcuugggguagauacgguucccagcauaaggggcggcaauagucagaguuagggguugggcaccacaugugacuguccguccagugauuacuggaggcuuaggagaaaugauaugccugcuauguccuuucauagguaguagcaaaaaagguaagaucaaaagauaaggcuuucccuauuacuuggccacaaaucuguucucaugauuguugccagugccuagcaggggguuuuguuguugcucucaggcuguggaaggcugaaaagaguauacuaugucuaggggcuuuuuacucgacugcuuggcagcaucacaagaaggaagaugggacagaagccagaggcacaucuacuugguucuuggguugggucauagaugcugccugggcucuacagugggagucugcaacucugugcaaggaucucauucugagcacuuuauguauggccugcagggaaggaacacagaccauauccaggcuucuagggcucugcagagguggaguccucaugugcagagggaacagagauaguacagaguagagaaagacuuggugguagggcucagugaggccacaagggcuuguggaacuuaaguguggaguucuauuucuguuugguuaaaacagaguagccuggacauuuggcagcuccugggggugggcagugcccaagaaaccacacucucugggguaguuguacuuggcuagaacugucccuggaaggaaaguugucgagcuagguggccucguguggaaaagcauuacuuguggaaaaagcucaguaguguccagcuaggagggauagaaaugggcagcuguuaggggacagacaaaaauaacaccaauaaaggcacagaggugcucacacccuaacugccuuaauuccaagggcuggguguucugcgggaggcugucccugggaaggagggcgucugagccuccucaggagugccugugccucccccacguuuguuuacacugccccucaguccucuuucuugccuugcacuuucauagucuguuauaauaaaugcaguccugguagugag

SEQ ID NO: 5135 - RNA, 2231 nt, Mus musculus
ccucagagcuagaagugaugucaaguccauaaucuuggaauccucuuucuaaguuccggcuaagugucuauaaacugugcuggaaugcuucuugugauuggucacucacuacaucuaagaaacauugcuugcugcccucuuuggguaguuuccaggucuucuguuucuugcagccuggacccacuggucauagguuugccuuccaguguugaaagguaauucaaggcuucccuuuuuuucucugagucagcauucaacccucccccacccaucuuccacugagcuugcuuucuucaguuccaucucuggcaauaguaugagcacaccuccuaggcuggucuuuaggacaucuuucuagagugauugucccagcgagaaccaaagggacagaaaauucucagccaggcaugguaccaugugccaguacaaguacaaaugagcugcaguuagggacauggccgcacuggguagcucgucuuuauucuccuaggaaucauugguuaaucucaguuuugcaaaggagaaaacagcuugcacauuguacccuccuuauaugucuaagacauuaagauugucaaaaacuaaggaaauucugucaagaaucacaagucuaaaaauguccuagcaucauugauguccugccuaccagcacccuggugaaagcaggcuggcuuugcaggaaccuagcccugccagcacagaaggaacuagcagcaaugcugucccccuaccacuuucuacuguuccacauauaccucuaauacucaagccuaguuuucuguugccaaccuuccucucuacauagcccuggcuguccuggaacucgcucuguagaucaggcuggccuugaacucagaacugccugccugucucccaagugcugggaucaaaggcauguaccaccacagaggacagccccauauucuucaaucuugauauggauaucugggugacagauuuuuaaagagaagccuggcugguucucagugagccucuggggaguuccucacugcuggaaagacacugcacagaaagggccguccuucuguaaugcaggaugugcagaggccuggggcuagguagagcagggaccugccuuuaggcagcagcucuguaugccucgcauccuguuuuacacuucuguccucuuccuuuagcaggugaaccaggaugugagccggcagcugcugcaggauggauaucaccuggaugagauuccagaugaugaggaccuggaccucauuccuccuaagccuauugcuucuuccgcguguucuugcugcuggugcugccuuggggauucuuccuguacccuccaguagccauagcccuccaggaugggccgauggccccaauggcccuucacagugauacucagugcacuggguaucaccgccagccuagaaccacuggaggcauugaccucuggggaggccaguggccuacaggagcccucaccuggugcuucucaugucagaggcccccgucugggucauaggugauagguggaagucggcagguucccacuggggcaguuucaggaagccacuuuaauaagggaggagaaacuuccugagguucuuaugcugauugcuaagaaaaccauuuacagacauucugacuccuccugaggagggagaagaaagaacgaacuccuucacucaggcugugcuggggguauggugagaggcagagagcagcacuuuauggcuugcaggaggaaucucaaagaauacagcugggaagcgccaaguggguuguuccuuagguuacagcaaggaaucuaacuuaaugauggagugggccuguggcuuucagaaccucugaacuuggaccauucugcuggcccugcugucuggaugggcuuaguaacucuguuggcccuuccccuguuacaagagaacugcucuguuguauauguuuauuuaucuguaguuccuuggcauuggagaguuucuccgacuuuuuuuuuuuuuuuugagguaaaaauuggauuggcaggaaucugcaguuuuuguuauuaccagcagagggagcugcugggaaguuagugccuuccuauguuuagcuguguaagcuuuugagaaguauugauggaugagagguguccugguguagcugugugacucuggccuacauggaaauguuuagacaggaugggaaggggagacuuaagccagcuccuggaccccacuugaguugaugaaucugcagugcaaggaggccuuccc

SEQ ID NO: 5136 - RNA, 1913 nt, Mus musculus
ggugccacacauuugaggccggccugggcuacagaguggagacccugucuuaaaacaagaacagcaauaaaaagggaggcucccugggcaaaaaugcaagcaugagcaccugaggucaaaugccaagaccccacauuaaugccaguguguaacacaauggugguaaucucggcaguccuccggggagacaagagacucucugcaaguucacugccagcuagacaggaguauguggugaaaaaacaaaccaaaacccauaaaaagaaacaaaaucaaaacaaaagagacccucaaaccaaguggaauaaggaugaaccuccaacccccaggcuccugagcuccuugcacauccuuugguccaugugcaccugcauucacacacaaagagcauccuuuuguugcaucacccauauuuuaguguaaaaaucucuccaggcagguagcauugguaugcagucacaagugagaacagcagcuuuguccaguguggcuugccucagauuuccacacucaucaaaggagcuuaacaucagaacuuguagcuaguggcagauugugagcaguaucuaccgcccagcuggcagcuacuaccauccauacuggcucagucaccccgaggucaccaaccucucucuuucagccauaugaacaaacaagguccaagguggguggcccuggggcuuacuacuaaaaugggcucaccucccuucagguaggcaugggguacguuggcauccagaaacauggcuuccccaggcuucaaggugagcagguucaggaaguagauggcgaaacauccgauaucaccugggugcuguuggugcagcugcagcaagagcuucccauaaauguccuccauauuguuuccgucaaauacugagggucacagagcaucccaaggccacuaagacacacaugguauccacagcuuuacccugacaagggagccuuggugaacagucccuaccugacaaaugcagcucuuagacggggccucucuuaaacaucccucaucccucaucuuugcacaaaaauaucaucucucaccucaaccaugcacaggucuggccuggcuacaacagcugggcauugugguacacagcuauaauccuagcaccaaggcagaaggcucaccgugagugagagguagacagauuggacugcugaguaugacccuuucucaaaugauacaggcuagggacguaccuuaguugguagagugcuugcccaacaugcaugaaacccuagguuugauccucugccccacaaaaaaacagggaugguggcacaugccuguaaucccagcacccggaagauggagggaggagugucagaacaguaaggccauucgugccuauauaacauguuugaggccagccuuggauacaagaaacuuucucucaaagagagguaugggggaaaauuauaugaaaaaauauuuaaaacacauauaccacuagcaucuguuuagauuuugacaaaaaacauugucuccagacaauugcccaaaaacagucucccaauuagggaccacuuauugcucuuaagcucaaaaucuauuacagacagggagguaacccgaaagcuucauggagagugucaaauucccuacuaaccaaggacuuccccuuuguuagcacuucagcucccucccaugucucaggaagucuguccaucuuagcaaacugggaugguugccuaccccagaaagcacagggcacaacaugcuaugggccaaaaugugcccuggaaacugaccaagagaagaggcgcucagccugggccagagggaggagggaggcgucuugggagggcaggagcagggugagcugaguuuccuggaacacgcagauaagggaggaguguauucagaaugugcaggacccacaauaaagaaagcaguguucguucca

SEQ ID NO: 5137 - RNA, 3424 nt, Mus musculus
uccaguuccccaauguuuuauuuaauauuaaucccaaauguauuccuucuuaugggaagagaacaaucaaaacaggaaaguuaugucuuuugagacuaaaauaaaugaguacuagcuccucacagaucuauuguugagacucaugcuuucggagacguuugagugucuggacagacgauaguagagcaccuccuuucuguagaugaggcccuggguuugauccccaagagcaccucauaagcggauacggauacaugcuucauacauccagggcugucaguugcuuccuuuuuucucaacuuuccuguucuuccagcuguggauggggacacacccccggggagaugccaagauccuugacaaccguauuucccagaagaccuuaggccaguggauugcugaaaacccggacugcuugggcucaaaggucaaaaacaccuuuaauggaaagcugcccuuccucuucaaaguacugucaguggacacggcccugucuauccaggcacacccuaacaagguacgggaucagagggugcagaggucaggguagggaagggcuuuuggggggaccuccccacagauauuagugcugcuucccuccacccauacuaggcucuagcgaaauucaagucuuacuaacaacagcuuggcugcucaggcucagaugcuggugacacauacagaagcuaagugcaaguggacaacugacuggccuaugccaagagagagucucuaaguuuguccuuggcuuccccucccccagccuaggucuauucuuaucuggcauugccccgccuggcucucuuggagaguucaauuccggaauuccaggacagggcaggcaccccagcugcugccucagcugcaccccaccguggaaacuucucacagccuggcuuauacagucugacuaaacucuuuuuaaaauacuuauuuuuauuuuauguauaugaguguuuugccugcauguguaggccugugcacucuaggaguagagugugugggaaggccagaagagggcuuugaguucccucagauuggagauacagacagucaugagcugcugugugggugcaagcugaacccagguccucugcaagagcaaccggugcucuuaaccacagagcuauagcuccaggaccuuuuuuuuuuuuuuuuuucgagacaggguuucucgguauagcccuggcuguccuggaacccacuuuguagaucaggcuggccucgaacucagaaaucugccugccucccaagugcugggacuaaaggcgugcaucaccaugccuggcuuccaggaccuuuuuaaaaagauuauuuuauuuuauguguuugccuccguguauguauguacaucgcaugcaugcuuggugccuuuggaagaaagaagaggccaucaaagccacuagaacuggagauacagaugguugugagccaccauguggaugcugggaaaagaaccugagcccucugccagagccgcaagugcucuuaaccgcugagccauuucuccaaccccuaauuuggggauuuuuaaagaucuuacaaagcgcaagcuggccucaaaugcauuauguagcugaggaugaccugagacuccagauagaaucuaacucuaccucccccuaaaucauuuacccucaucacacagcuuaugugccuccuguuuaggguuccuggccccaggccaggccucuuaauuaagucugucccagcucuccccuggcccauguuucugcccuggguaggcugaacuccaaguuucugcaugaugccuugacugcgaucauugccagagguaagaagccacuguuuucugguaaauggagcggugggcagcagcgacugcagaggcugguacuccuaaugaugguagcuguaccccaauuguuguccuccacugcccauccacaggagcuggcagagaagcugcaucuccaggcuccagagcacuacccugaugccaaccacaagccagaaauggccauugcccuuaccuccuuccagggcuugugugguuuccggccaguggaggagauugugaccuuuaugaagaguaagguugggugggaaugcugaggguacaugcacugggccuggaacauaggaggagccugggccagaggggaaauagagacagugaggcuuaauaucguagggacuaaagggaucuuggccucaugaggcagucuuaggggccagugggccagagggugagaccaggcucaggugugguugcugagggcugguggugagccaugucuauacagcaagguuuggguagcgcugcuggucuuugguuagggaugcagugggaggaccucacuucuuccuguccugucuccucauucuugacaucuccuugcccuggccacccuacagaggugccugaguuccaguugcugauuggagaugaugccacagcacagcugaaggagagcguggguggggauacugaggccauggcuucugcucugaggaacugcuuuucccaccugaugaagagugagaagaagguggugguggagcagcuuaaccuguuggugaaacggaucucccagcaagguggguguggcaggggccuggguggguacgcugccuaagccugggcucccaacaccaggcugggaugaggcauggagacaggauugcuggcccuuuucaccaagcaggacacuaaaaggggccaaacuuagaugguccuaagaucggcagcuaccguuucuuucccagucuugguggaguugcggccccagggugaaugcuucuucuagacugguuuccuugaggugguuggaagcagacuggccuagaggauggauucuagcagggcccucucuccagguguucccagauuccucccaacucuccggcugcuugccguggggcagacuugcauuuggggggcuagggagcaggaagcacacccuucgcuagaggacgcaagccuugugcucugaaccaucaaccucuuccuuaaagaugucugaccuugugcuaacagaguucaggaaacgaccaaggcgggugugguugagucucuguuguccugcagagucaacgaacacagugagacuccuggcagagucucagccaggagcuuacauggcagcuccucgauguagccuuagcuccuugcccgacuggccagcuccuucuccaggcagccccagaacccucuugcgguucagucuuugccuaagucggcugugugacuuugguguuacagccauuuucucucaccugugcaugcccccucguuccgugucgcgguuccgaguaucuuaccugcuugcauacuauuagagaaccuuggccugcgcucgguucugacauccaaguaugcagggacuccuuaccaccauguguucacuugcucaaaccggggaaucuccaggccagagacuucauguuccucccaguguua

SEQ ID NO: 5138 - RNA, 15899 nt, Mus musculus
ugcagaaucacuaugacacagagcaacagcaggguaucugagaggagucucagugagguccaguacugauaguguagccgaagccagaggccuugaaccagaucaaugacucacuacaacuuccacaagauuuuguuuucuuuugggaggaaguggaagggcauagggugaguacaagggaaccaggggaugggugggacuggggugcaugaugugaaauucauaaagaaccaauacaaaguuaaacaaacaaaaauuaucuuauuauaagcaugugugaauguuuugccuucaugcauguuuguggaucacaugggugcagcacccacgggggccagaagggggcaucaaauucccuugagacuggaauuauaggcaguaaugagccaagauguggguggggcugaggaacuaggguccuuuagaagagcagccagugcucuuaaccacugagccaucuguccagcuccuagaugucauucauuuuuauuuaauguucuuauuuguuucaggauccucuuugggauugauuccaggugaucuuuagacucuuggcuguggcaggcuucucuggcuauccuugguuuugaugauuuuguuaauucucaggagccggggccaaguguuuacaguauaucucucugcuagaauuggucugggguuuucuuccugcaagccugugguuggggguuguugguaaaaggaucugaaagguaaaaugauucuaaugugacuaagcagugucuuugugacuuugguuggcugaacagagccuggcaagucucuccagaauaaacaguguuaggcugagaaguaauuucauccauuuuaagucaucuccccucuuuccguucggcauccuuugaaagaagucacugagcacaggcuacacccaggaaguggggggcauauauaaauauuuggacacuuaucuaugacagauagcuuuuguuuuuuaaaaguaaacuaccagagggcagggauguagcucaguugguagaaaacuuacucaccaugcaccaggaccugguuugauucuuagcauuuugucaacugaacauggugacacaugccuauaagccuagcacuugggaggggcauccaggaagauuagaaguucaagaucauuucuagauacauauggaguuagagaccagccugggcuacaugagaauaugucucaaaaccaaaauucuacaauaaaggaaagugcacauaucauagcuagcucagugaauuguuuuauuuuguuuugcuuugagacagucucgcuauauauaaugcaguguccauguauaacuccaggauuuugaauaugacuggggaagcaagggagugaagaaaagacagacagaagacagcacacagacaggcacacacgcacauacacacaugcacacacacaggggaugugggggagggggagacaaacagagagaggaggaaggaugggagggagggagggagagagagagacagagacagagagacagagacagagagauacagagagagcaagcacaggagaguugggcucucaaauggagaaacuggaguacccuagaaguucaguguguucacuauauagaguugaauggagaggugggauuuugcaguagcugaacaaggacgugggguuaucauguagagauaaacaaggaguuggaguauaugguacacagcuagaucaaggagacagguuuagcuaaucucaguacuaguaguuucuguaggggaggagucuucauacuguaaauaucuagagggagaaagcugugauggacauuuuuugcacacacuaacaauaucuacacacagauagaagaaaaggcuuugccucugagucucagcucaggggagaaggcuuugccguguuccccaugggccugaggcucuggggugcucggcacggcugcacuacgucgauaucacacuuucacucaggacuuuacucacucggggcuuacuuugcucucuacaaucuaguccaggcuagccuagaacguaagagccuccugccuggggcccacgaauacuggaauuauaggcacauagcucuaaugccuggcuucagugcaucuuuucaaaccugacaaccugaccuggugacuucuaggucagaagguagaaugucaccagaccccagaauccccugcgugucccccuugccccccaaaguagcuacaauguugacuucuaauuguauggcuuaacuuggucuggcuuuugaaaaauaucuuccuuuauuauuuauguuguguuauaugcacuugcuggcacgagugugugcacaccacauugcauucaggaacucucagaguccauauccccuggaacuggaguugcagaauccugugacauucaugugggcccuggaaacugaacuuggguccucagcaagagcaguaaacacucucuaacugcugagacaucucucuagccacaaaauuuuuuuagaagauuuauuuauuuauuuuauguauaugaguguacugucacucucaucagacacaucagaagagggcaucagaucccuuuacagaugguugugagccaccaugggguuucugggaauugaacucaggauggaagagcaguuagugcucuuaacuguugagccauuucuccagucccuagccccaacuuuuacacauuaauuuuauuuagcuuuugagagucucacugcauaucucuggcuggcccaaaaguugccauauagaccagguuggccuuaaugaacagaucugucugcuucuuucuucuaaauacugggauuaaagguguaugccacuaugccuggcuccaccauguugagacacggucucucuacauaguccuggguauccuggacucacuauguagucuaggcuagacucgaacccacagagauucaacuaccucuaacucucaagugcugagauuaaaguguggccuaucacaucuagcaaucuuuauuauuuaaaauuuuuuucaaauauugaaaauuuuuauuuuaugugugucuuagucaggguuuaauugcugugaugaaacaccaugacugaaaagcaaguuugguaggaaaggguuuauuuggcuuacacuuccugauuacaauccaucauuggaggaagucaagacaggaacucaagcagggcuggaaccuggaggcaggagcugauguagaggccauggagggugcugcuuacugguuugcuccucuggcuuggucagcuugcuuucuuauagaacccaggaccaccagcccaggguuggcaccacguacacuggccuguggccuccccccauugaccacauuggggaaaugugcuacagcuggaucucagggaggcauuuccucaacugggacucuagcuugugucaaguugacacacaaacccagccaguacaauauguaugaguauuuugccugcauauaugucuggagaccagagaggauuuuagauccccugggacuagaauuauugcugauuuagagccuucauguaggugcugggaauugaaccugggcccucuggaagaauaacuagugcucugagcuauugaacaauccuucagaccuuuacauuuuauuuuaugcauauggauguuuugcuugcauguauguauguguaccacaugugugcccggugugcauggaggccugcagaggccaucagauucccuggaacuggagcuucagaugggugugagcugccacguggcaauuaaugcugaggcuuccagccaaggaauaguuguuucuuggguuuuguuauuauuguuguuguuguuuuggagaaaagguguuacuaugcaguccuggcugucauccaagucauggagaucucucuguuuccaccuucugaguacugggucuaaaggugugcaccuggcccuaccuuuauuuucugagggagucucucagugacccugaaagucagugguuuggcuaaaugggauggcagugagcuucaaggauccaucugucuccucccccucaguguuuggguuacagguauaugccaccauuccuggccuuuaaaaugcauuucuaaaauuuauuuagaaguguuuuuuguguguaugcugcaugaguauucaugugcaugaaugugggcaugccuucgccauaggucagaguccagcucggguuucaguucucagucuccaucuuuuaugagacaaggucuauuguuauucaccacugcucacgacuggaccucugacccuugagcuuccaggauuuuucugacuccaacacucaucagcaguaggagcucaggaauuagacaccugcugcagagucuagcuaauauugggaccaguacacaguacacacucagaaaaagguuugauaaauuaauuaguacucacaagcagguauaugaaccugcacaagagcuugguggcagcucuucuuagggaauauacugcucuggucauauagaugaauaagaauaguuagugcuuucugaacaucuacuaagcccaggaucuccuaccaguuaacacaggacaucucucugucagcugcuaucacuaccugagccucauuucuuacuugacucaauggagaccuggagaugguaagugguugacccuaagccagauauaggguaugggcagaggagagagcaaaucagagaguuacugugagugaagaacuagaggaacuagagguugugccacucaaaauuuuuauuuagggcuguggauauagcucacuagguagagaguuugccuggugggcaugaagguucugucuccagcacugcauaaaaccacacguaagccuguuaccccaaagcuugagagauggaggcaggacccaccguucaaggucaucuuugguuacauagggggugucaagccaucuugagcuacaugagacugucuuggggauuaaacuaagauugucaggcuauccuuccugccccccaaaaggguuuucuauuucugcucucugacugguacagcugugaagugugcuagcagaacugacauauugaacauuuuauucuccugaauuucaagugugauugagauucacggcucuccaaugagugcuccaugcuucuaccuaagugaccuuuguaaaacugcaugcuagauuccccucagagcugcuuguuaacuucucauggcauuuaaaacaaguuuccccaccucagcgugugauccugucuucccacacggucuuccacuuaguguaacuuucccaccugccagaggagacgucacagauuccuccagcugcugccucugcauugucauguguugugcccauuacccagaauacacaaccccuccuuccagccacucccccgcacucaagaaaguacauuguuuuccauuaaagaugcuuguuuguaccucaccaucgugaagcacuggugauaaggcaccuccauuccuccacucaaccaacuccuccagccugugacuccaagccaccuccucuaggguuauccuucuuuggacauuuuccuccuccuccuccuccuccuccuccuccuccuccuccuccuccucuucuucuucuccuccuccuuuucuuucuccuccucuuuuccucucuucuucuuccuccuccuccuuuuccuucuccuccuccuuuuccuucuccuccuccuuuuccuucuccuccucuucuucuuccucuuccuacuguuccuccucuuccuccuccuccuucuuuucauggaaccaaaaucauugugucuuagugauuuggcuucuucucacucuuuagacuacaaugucucccaccaugccagcaauaucuucccccaaguuccucacauuuauucuaagcucuccagagucugccucaguuuccucuggauuugguaacaucucuggacucuccucaggcucucuuuaggguguggcuucugccuuccuuguggagaaggggauuuuuguaggguauugcuuguuuccuggcuuccacuaucuagcccucaacaguacugaccaaaaacccccagcucuuucucugccagguugacuagcaagcucucugucucccuccagcccaaagcccucuccccuccuaaugugcuccugguaucaguuacuagggaagccaaagagcuucucacgcauaggcuuauaaacuuuggccuuaguuggguguuuagcucugugucaaggucuccaaacuuucugcccaucaauuagugaggcccauuccuuccauugugacccuuagcccagacaagucuuggugauagugaguauaagacccauaaccccagugcgcaaggccugggggaaauaaaggccuuugcuuaaagccugagccuguugcccagggcuuuccuuagcugguagaaccauugccuggaagcaagaggucaaggucuuaggcucagauuucauuugucagaggucacugggccuuuccuuucugggauccaucucuccagcagauaagaaagagaggaacuggcuuuauuagcuaauaaaguuuuugguaaagaacaugagcaaaacaguagggcuuccugcauuccuggcugcaagccucagagcugggccuuccggcuggcaguaaaauacagauuuccuccacucccuggagcuaaggcauugguagggacaauggaaacaggaggaagagugacuguagagggaucuacacacaguagugcuuuuacugcuuggccgggaguuauuucuauacaagaucuuucaauucucugauucuugcuccaacuuggguaucauguccagagaugcagugaguggaauggcugacuauaaagaugcugagaaggcccaccucaccuccuauguggcuugcuuguucugauacccacuuuauuuccucucccucucucucuuccuuguccucuucuuccucccuuuuuaaaauuguauuuuauuuuauuuucugguuuuugcuauaucugcugugcaauccuggcuaguccacuguuacuauguagucuaggcugaccuugaacucaugaaaauccucuugcuucagaguuauagcuauguaccaucaugcccaacccuucucaccuaacucuuaucauugcauaguuggagcucaauacuucugcuucuguguaccccaccuauaaugcgguuugacaaucauuucuaucucauaggggcauguauaucugauuaauuuuccacaugcauauuuucuguucugggacauagaggaagaagagggagacuguaagggucggguguccugagaauggcugcaaagauguugagaaggcccgccucaccuccuguaugcuucauucucuggagcuaagucagcgguugggacaauggaaaacagaggaagagugacaccaaaagaaaucuaacuugcugugacgaggauccaggaaggaauacaagggggaagccauguuuuauuuagacucagaacugaaacuacuagaucccucgaugggcagaccugguagauucugcaagaggcucuguuuccuaucuucagauaccuaagggauuucagcaaacauggugacagaaaggauuucacauucugagaggcacaguggggaagaagaaguugaaagaaccaaaaagcaaaggggaauccauucucuggggaucaauaggggucuggaugagaguguggacguaggacuucacccaugucaaaauggacagaaguguuccugcccuccagucuaccuccagcacagaagccugagguuagcucaggcuagacaacauccucacuacugacucucauuuuccucggugggauacuucuugaauagguagacaugucuggagaacaccacccccuuaccacaaccucuacacauaacuagaacaucuggaaacacugugccuaugagguggguccucuuaccaggaacauccuccagggagauaccugggaggcuugacuggacacucuugccucuguucagugcuaucucagagagcacuccccuggccaccucauuugcaguuguaaacuguccccugcauaucauuuaucuuucuagugcucuuuuuguacuaugccugucucuguguuuuguuacuuaucaccuguuucccccauagcagcggguaagcuucgucaaaggaguauuguuaauccuuuucaccucugcaucaaucaccagcauccagcauaguaggagcuuggcgaauauuugcacaaugcaugagggcggcauguaacuagagugggaggugaggggguggaugaaguguuguuuuuuuuuccuggucuuggucacagagcagauaucaauguucuuucugggcucgggagcucacaggggagggcaggugaagguguuaguuaggaacagguugaguuagacacgccaaguucagauguucuucuuacacuaaucucacucugggagcacccuucagggccagagagcaccugcaaaacagccagcuaggcgugccggguggugcugcguguccugccacuaaaaauguggacacacgcuguucaggccuuugcucucaggcagaagccgagcaucgcacgcaaacccggcccuuugcaccgcuggcgcugucuugucgcgcccuugcaaagcauagacuauuucuaucucuuaaaccccaccccaacgccccaggagagcuggcccuuuaagagccucacccacgguuccccucccccagcuagcgugacagcacugggacccgcgcccgguugugaguuggguagcuggguggcugcgcgggccuccaggcucuucucacgcaacuccggggcaccuuguccccagccagguggggcggagacaggcagcccgaccucugcccccagaggauggagcaggcuuacgcacgcuagccucaggaaccugugugcgugccaagcaucacccuuuguagccccagacccccuccugcugucucgcguggauccuuccuccacccuuuccuccaccauacuuagauagcucugcacccgccgcccgacuucucuguguugccugcuucaguauguaugcacaacacuagcaagccccgggagccuacagggagcugcaagcggggacucccgggcuugcagcuugccuaaggugacccuuagaggugagaucugcaagccugccauccauccccacccucuagaugaagcagcgcgaacuucggccgauacccaauuuguggggcacagagucaguccaauggcgccacuggccuuccuguccugugaccucugggcuggggucguugcgcuucucacgcgagcuuggacucaguaauccagggaagcaaagucaccacccagcuguucucccucuaccagccuuucccgggcacccauuggcuuguaguaggcaagaggaucuuacacacugaauguuucaggggugcaaaaauagugaaaaggaaucccuaugacccggaauggaggccccaguacuuacuuuuuagguuaccccagaauuuuuccucaaaccccucccucagugggauuaugcacuguccauggagcaccuugaaagugugggggguggugaccccaaccuuuauucuuuuucuuuucuuauguuuuuuugugccuguaccuacaucagguauccgguauggcuucuugccuaucuccccccuccccccugccuagagcacucccuaaggcugucccucccucggucccaccacugggcucagauaaggaggcguggccaacagacacagaguccuauaaaggugguggugccuucacccuaacccugaaggugguaguucuuggagcuuccccgauccucccuaggguccuagagaacacucuucacuucagucccuccuuacagcccaaggugagugcuugggggggcuccuggauugccccucccucccucccucccucccucccucccucccaagaaaaggaaauuuuuggugaagaguuacuggguagcuccuucaaaacagggaacuacacuuuuauuuauuuauuuauuuauuuauuuagugaccagguaaauuccuuaagggagaaacugaggccagagguaucagcuauuuagauagaaaugagauacccuuccacuucaggccccucccccuccucacugaccuccuagggcgucuucccugcaccuuuagccccuuccucaggacugccagugggggugagggcuccucucuggauguguaggguggacagugaagaugcacugagcuuuucugguguucucugucuuauuuaaaaacuacccccaauagccucuacccucccaaagggcagcaugucagagcuguuucugaccuaggcuagagaggcucccuaccccacugacugucucuucuauccuugcugggauaccaucagcuccauaaacugagagcuucagggaacuggaaacaccaguuacauuucccucggcccuuccaccuuccaaagguuaggguuccuuagggacaccaauuaugaaguguguuuucagccccuccaggaagccccucugcuucaagcugacuguaguauuugggaauuguacaucuuccuaucguaugugcuucagaucuucucuuccuaggaucuguacccucugaauuaagcaaucuuucuuguuggcuuguuuuguuuuuuugagacaggguuucucuguguagcccuggcuguccuggaacucacucuguagaccaggcuggccucaaacucaagaguuccuccugccucugucuccuaagugcugggguuaaagguaugggccagugccucccucccagaugaauugggcaagcuugucuuacccucucucccaguuauguaacugaagucucaguguuaauaugacuuguccaggaugaccuggacuguacuucacugcaaugugacucuccugacugggcagagccuuggagcagauguuaaauuugcuuacuuuuucuagaauaaaucuaaagagaaaguguccucuuagucaaaacuaagcucaaauccauuccuaguuuuccugacuccagucagugguuuucuuauagcccuaaccuuauaggaaucuuccuuuucauuucugcuuucuuaugacagcaaaagagggggaaggaccagacuauucauucaugagaacugagcacaacaaaaagcuuggccuggauuacuguuacuuggagcugugucuagcuggucucccuuggcuuuuaaaguguggccccguugaacuuagggagcuaggccugagaggaagguggcuugggcauugguuuuccuguacccucucccauuccuguccucuacugggguugaugggguucuuuagauccugagaugaagaacaguaaagaacugagaacucagauucucaaaaguuuucguucucaaaaggaggcaucugugauagcagcuguacauucuauggaacuuucccuaagagcugugagcccuggcuaaugccccauuuggaagcugauuucccugcugcuagaguaagcaaugaggccaaagaaacaaaugaucucuugauuuccugauaggauggcggcuuccucaagggugauggguagacccaaagagauuuuucgggugacauuuguuaguugcacauuuauuggaauguguuaggaaaaucaaagcuguauuuagguacagacauuguucaggaugauguugccuaguggauguaaaacugauuuuaggagacacaagguaaauugggacgaguggaaaccacagagauuggaagccacugaagccacacaauuaagagaggugcucuagaagugggcuacuuggguugaaaguuuacacaacauucccuagcugcauaacuuugagaauguuacuuacugucucugaaucuuacugcagccuucuucaucugcuuaugacuaagauugaaaauaaaaugagagagagaguguguguguguguguguguguguaugugugugugcuguguguguguguagaauaugauuaaaauauauugugugaaaaauaaaacaaaaccacauugagcuucccggguacugagacuucuccacgagagcucagucuaccugaccucagccuuugugcauguggaguaagaaagaacugcagcacacaguggcagcuccacaagcucuguccugcucuaugcccagggaacagcuccaggaggaaggcuucucuuuccccugacacuuuaggauauuuauacccucgcccucagucugaugccuucuuucuuuuggccucaccucucagcagccaccuagaucaugccuuccauguauggacuuccagccuucgugucagccacagagcugcuccuggcugucaccguauucugccuuggauucuggguggucagagccacaagaaccuggguucccaaaggccugaagacuccaccagggcccuggggcuugcccuucauuggucacaugcugacuguggggaagaacccacaucugucacugacacggcugagucagcaguauggggacgugcugcagauccgcaucggcuccacuccugugguggugcugagcggccugaacaccaucaagcaggcccuggugaggcagggagaugacuucaagggccggccagaccucuacagcuucacacuuaucacuaauggcaagagcaugacuuuuaacccagacucuggacccgugugggcugcccgccggcgccuggcccagaaugcccugaagagcuucuccauagccucggacccgacgucagcauccucuugcuacuuggaggagcacgugagcaaggaggcuaacuaucucgucagcaaacuucagaaggugauggcagagguuggccacuuugacccuuacaaguauuuggucgugucaguagccaaugucaucugugccauaugcuuuggccaacguuaugaccaugaugaccaagagcugcucagcauagucaaucugagcaaugaguuuggggagguuacuggcucuggauacccagcugacuucauuccuguccuccguuaccugccuaacucuucccuggaugccuucaaggacuugaaugauaaguucuacagcuucaugaagaaguuaaucaaagagcacuacaggacauuugagaagguaggggagaagcagguggugaugggaagcaguuaggauccagggccagaacaucacaggcaagcuuaaaacugguagcagaauguacucuauccucagcaggucaacgaaacuuuucuuggcugguccuucuaugcauccauaagacaagagcuacugaauggaggagcccuggaccaguucucucucucucucucucucccuuccuuccucucuuuuuuuuucuuucuuucuuucuuucuuucuuucuuucuuucuuucuuucuuucuuucuuuccuuccuuccuuccuuccuuucuuucuuucuuucuuuccuucuuucuuaagcuucauuuauuuauugcauguauguggguacacuguugcugucuucagacacaccagaagagggcaucaaaugccuauuacagaugguugugagccacccugugguggcugggaauugaacuccuuuggaaaagcagucagugcucuuaagcacugagccauaucugcagaccccugggccaguucuucaugguagaaaaaaguuaaagaacucaucaaauaacuaacagugucaggcucugugccuccagggucacuugaguuggguuauccauucuuuaagguagaaagagacuuggagagacaaggggaaaaugggacagcagccucaccaugacaucucuuuaacagugaggggccaggccuagauggaugguuaggucugggauauuucucaccuuggucuccuuugucucccagggccacauccgggacaucacagacagccucauugagcauugucaggacaggaagcuggacgagaaugccaauguccagcugucagaugauaaggucaucacgauuguuuuggaccucuuuggagcugguacguguacuuugguguaucauuucugugcucaggugccccuaguugccgcauaccuaaccacugccucuguuccauccuguucaggguuugacacagucacaacugcuaucucguggagccucauguaccugguaaccaacccuaggguacagagaaagauccaggaggaacuagguagguggugacuccauucaaaagacucuaaguggaggacccugauaaagucuuggcaaccccuuaauccuucugaaccucugaauucuguagacacagugauuggcagagaucggcagccccggcuuucugacagaccucagcugcccuaucuggaggccuucauucuggagaccuuccggcauucauccuucguccccuucaccaucccccacaggucagaccauagauccguugacauuugauaccagaucucaguuuaguguacacagcccauuaggauucgugggaaggauauggcauggggcgggguguggauuuccccugugugugguccugauccugacuacguguccucuuuccccagcaccacaagagauacaagucugaauggcuucuauauccccaaggggugcugugucuuugugaaccaguggcagguuaaccaugaccgguaaguugacaggggcagugaaaacuccugggugggauggaugcauccucuccugggcuucagauuccuuggggauugaccugcuugaugauuauaaucccugaacuuugacuucagcugucucccucugcauauagggaacuguggggugacccaaacgaguuccggccugaaagguuucucacccccagcggcacucuggacaagcgcuugagugagaaggucacucucuuugguuugggcaagcgaaagugcaucggagagaccauuggccgaucggaggucuuucucuuccuggccaucuugcugcagcaaauagaauuuaaggugucuccaggggagaagguggauaugacuccuaccuaugggcugacuuuaaaacacgcccgcugugaacacuuccaagugcagaugcggucuucugguccucagcaucuucaggcuuagacuguccaggaugcucaccagaccagguggcuguuccugugauucaacuuuagccagaaacacagauccugggacauugugccugccuccuacuuuggacuuguuucucuauaugcugaacacacacugggcacagcagaggcccacaggaaccucagauccuucucaauuucagcaucaacuaggagaucugaaaggguuaggagauaccugggccucagagaacuccugaagagugcucugggugcuccaguggcuaacugguuugaaaaauacugcagguuauagcaggaugugucugguuacuuugacaagugggagcugcccagaauggagggagaagacagcuuaaaauucuggcacagaggugcucuugccaccugcugaggcuaaacagccuucccaaaugguuuaugacacugcauguggggggcaccucuguucacccuacauagaaacaaacagggugcuccuguccuugcauguccauguuucucuucaggaaggguugagacuugugucuagaaagacccaagaacagagggagagauucucugggcaguaaaaccaggucuagaguaaaggaaugacuuuugagacagagucuuguguagcccaggcugacucugaacuugcuaccaaaggaggccuuggacuccuuuuuguuguuguuguucuuacuaccuuaccaagugcuaggauacagucauagacuacugcaucagcucuuggucucucuucuuuacuguauaaaauguuuuucuuagaaaauguuugugcauaagagcuuuguauuauggacuguauuuugcuuaugcauuuguauuaguuauaccuuaagagauuuagauaauuugcuaguguaacaaagaagauucuaacucaaguauucagaaauauauauagaaaaacccuaccugaacuaaauaaaaauauuaccuggaag

SEQ ID NO: 5139 - RNA, 813 nt, Mus musculus
uacauuuuuuuauuaguguguguguguggucaguuuuggggagucaguucaauccuuucaccauuuguucccggggagguccucagguuugaaugcaagugcuuuuaccugcugagccaucucacccgucccucagcuucacaguuuuaaaguugguuguuuuugguuauuguuuuccuuaauuguggaacuuucugagaaaaaucacuucucucuugaguuuagcuaacucuaacuuuuguguaaacucaauccaauuugauugugcauuaguuucucagccaucuaaaacaggcagugucuccacgaaaguucaguggaaauuccccuccccaaacugauucuacgaaugacuguguuauaaaccccauuguugcauguucgcggugggccagaaacccgacuuaaucacuccccuuacggacucaacuuuuagcgcccuggugcgcugccacaaggcagguuuccugggagaaaggagcaagaagcacaagaggcuggcuacgugggagaacugcgucuucaucggaagggccgcggggcgccuguccacuuaggaacccgucccccucggagaaggcucgcccuccggccuaggacuccuccaaacccgggacaaccaacaggcuucacauauaucccuggagagcgcgggaaucaucgggcuauuggcugcuuucgaaaauuccacacugagucucccuaccucagguggugguacaauugugucugacagaaagcuacaaccuacuggcuucuaggaccucaaacugcucgugcucgcacucacgccuccuaggacccggaagcauu

SEQ ID NO: 5140 - RNA, 18994 nt, Mus musculus
gagcuuccgguuuccggcaagaggaccagagugaguguuuacaccggcggcucgcugcggccggguuccuuccgcgggacgggugagggcgcugggcccccucccugggcgcgcggggcucucguggguccggaguagcuaacuggucccacgagagaggugggguugucaacauugucccuacucacgacuagguaucugugaccuugggccaagagacuucagcuuucugagucuuuauuccugaucuguaaaauaaggacaaugaugccaguuucaggagacaguugugaggauugaaaucgguauacaaaaaccuccuuucucgcuuuaaaccuaaagguggauaguaccuugaaguccgcugggucgcaccacaguuuuuucuuagccuugucuuuacugcaagagaccucuuuggcagaaauagugucuguaacaaggacuggucuugcgguacaaggcucuugcacccuuugaauuuuuagauuuauuuugugggcauucauauaugucaggcuggggacuguguuagaaaagcucuagucuuggcuuucaagaaugggggggguuucacaaauaugagggacgcaaugagaaguugagaaguaaauaaguuguacaagggaaaaagcagcaaagagaagguagcuuucuaagucuggcaucugguaaugaagcuggcugacuuguccucaaaucuauugauuuguguugcucuuuugccuugagggaacagggaaugugugaccaagaagagagcauggaaccgauguguuugugugggucuugguaggaguuugcuaagaggccaaaaagggaagagaacuuauaugcaaagacaggaggugagcagaguuacauauaggggacaacuuuguuaugaaguauacuuacguguguuguuauaaaggggcagggcugggucuauugaagaaagcugguaggcgucagaauaaauggguuuguaaucuggcuguggaguuaacacccaccuguucauagaagugcuuugggauuaaugggggccuucuaagcaguuaaguuuguuagaucuguguuuuaacaauaagacauuggguggugcuauagaucucugauaagggcaggcaagagagacaagggcccuccuuaaaguguuguuauagcuaaaucaaaagcuggagaagaaaaccagaaaugaguguguagaagggagaggguugggugaucuugcuugaaccucacaacauuccuauccaacugauuggccuuuuguguuuacuuuuuuuuuuuuuuucuuuuguuuuuuugagacaggguuucucuguguagcccuggcuguccuggaacucacuuuguagaucaggcuggccuugaacucagaaauccuccugccucugccucccaagugcugggauuaaaggcgugugccaccaaugcccggcuuuuguguuuacuuuaaaggugaagaaacugaggcauaagagaaaucccuuguaguccaccagagaaagaauuaagggagggacacuagguucuaguucuagccucuuagugcuacaccuauguuucucuagcaguaguacacugaaaugaucuuuccuuuauucuuguugcagggagagaugaguagggagguggguugacuuuuaaccguuaaugccuuauuguuuuacagggagaaagagagagcgcgaaagagagaggaugucucucucagacuggcaucuggcagugaagcuggcugaccagccacuugcuccaaaaucuauucuucaguugccagagacagaacugggagaauauucccuagggggcuauagcauuucauuucugaagcagcuuauugcuggcaagcuccaggaaucuguuccagacccggagcugaucggugagucuucauuggcaggagcuggguugcugcucuugccccugggacaggagguaaaagggcuuguugccuccuuccagaguaaguuuuacaugagugaaaacauaaaacaugacaaaacuguuguuugucacuuuagucucauguuacacugaacuacguuauuauuuaagacucuucauuaugauguuguugaagucuuuugucugaucgaacaaaauuagcaaagacuugcagaugagacaagacuccucaaucugucaccuaagacuuaagggauaauuagaaggauguuuuuguuugucuugauggcugaauaaagggaaggccgcaaaauaggaaaugagguuggcaauguacuccuaguggaggaaggaagagcuuucguagagaacagucagauuagauuaggagcgaaauguacgcuagccaaggguucucccuggugaagacauuccuaucacaggugaucagcuccauccucuuuuuucgguuuuucgagacaggguuucucugugcaguccuggcuguccuggaacucacucuguccaggcuggccucgaacucagaaauccgccugccucuacaucccaagugccaccacugcccggcagcuccauccuuuuugauguuauauuuuucacauuuauguggaaucacuacucucuacaggguugagcuuuagagguguacugugcauauacuucuuaaauaagcauuuguacuugauaaaguuguuuaaaauguugggguuuuguuuguuucaagacagggucucacuuuguagcccuggcuggcccaaacucaccacuuaucucugcuuauugagugcugggauaaaaagugugugccagcacaccuagucaaaaugucuuuuauuuauuuauuuauuuauuuauuugguuuauuuauuuauuuauuguuuuuuucgagacaggguuucucuguauagcccuggcuguccuggaacucacuuuguagaccaggcuggccuuaaacucagaaauccgccugccucugccucccaagugcugggaucaaaggcgugcaccacuacgcccggcaaaauguauuucuuaauguccccaacacacauugugcugacgauuaaauccugggucuuguauaugguagggaacuagucugcuacugagcuguauccaaagccuauuuauaugacuuuuuuuauuuuaaagcaagaucuuaauaaauugcucaggcuagccucaaauaucugggauuauagauaugugccacuacaccugggagaaagucuuuuuuuguauguaugugacgcauguaugugaguguacagaaguaugcacucgugcaugcauaugaagagaccagagcaggaugucggguguuuccccaucucauccaccuuauuuccuuggcacugaaucugaaucuucuuccaguuuggguuagacagcaugggcuuggugucagcuugcucucugccuucagccacugguauuacaggcgugugcagccaugccuggcuuuuuaugugggagcuggggacuugaacuuaggucguaaugcuugcagagugaguguucuuuaccuggugaguugcuuccuaucuccugagugcugucuaauuaaaauaagauucucaggggauagaaaccaaauugcuuugagaaacaaaauaugaauaggcagguuuuuuguuuguuuguaugauuucuuuguagauuugaucuacuguggccggaagcuaaaagaugaccagacccuugacuucuaugguauucagccuggauccacaguccauguucuccgaaaaucuuggccugagccugaucagaaaccugguaagggagaguuuguccucaguuagaugggcagaacuuucuaguaucuccaagggaagagcuuguguguuccugggauacaguccugggugauuaccaaaguggugauaggugcuaucucuauccuuauugguuuagauccccauugguaaauuaagaugugacguuguuauuguuaacaccacuaauaauagauauauauauauuuuuuuuuuuacuuaauaaguucauuaaccauuguuuucuaaccauguaguguguauggaucuauuuaaacucuuuagaucaacaguugauuuuucaguaaacuuuacauucuuuuauuaucguugcucuguucauuagacaaaagccaggaacuuaauuuguuuuuguagugcuauaguucguucuugguuaagcaacucuucccacaaauucccucaggugaugauuuguucaguaagcuaacaccgccugcugagcucauaacuuaccuccagaaauauuccacuagcauucaaguagcucucggagaaacucuacaaaaccuaaagcccuuuuaguuuauuaauggaaguugcucuuggaauuuacaauuuagauuuuguguuuguguuuuaaacaugucuccauguauaaagcuaagcuauguaaaagaggucagcauuguuaaauagcaguuugacauuuuuauuugucugugucuguuaugagugguuaucaauuuuuuuuuuuuuuuuuuugguuuuucgagacaggguuucucuauauagcccuggcuguccuggaacucacuuuguagaccaggcuggccucgaacucaaauccaccugccucugccucccgagugcugggauuaaaggcaugugucaccacgcccugcuugugguuaucaauuugaaaguuauuuuuucaauucuaaacagaacaaaaacaucuuuuguauccauaugggaagugagagaggagagcagccuggcauccuaggauuaggugaugcucacagccagacuuuggagucccacuguuuauaggguucaccaugaugagucaaggacauccugagacaucauggaucaaguggaaaauaauauccuugccauuucugaacagagacaaagcccauucauuguccagacacacaagagaucacacaccccucuccuggcugaugagcgggacuguaccucuucuacgucgagcuuuuaccucucucagguuugccuuuucucuugaguagggcuauuaaaagccuaagaauaaaacugaccccagagcaaaaacuguuuccauagaaucauccaugcaagcccagauccucugcuuuucuaauauccucugauggagcugccccagaguucucgugguguguauucuccuccgcguccugagccuugaaccuagcuuguucaggucaggucugucucucugcucuuccacuagaggacauugacugaagaaaaugaaugauugugguuucuguaagcuaguuucguuuguuuuucccgccaucaguauguuacauaaucaggacaugguagcuaaauaacacucuagcacuuuauagauaaaaauaagaucagaagaauauuuguuccaggucaccuaauuaaaaugaauguuaggacuaggauaugaacccaaacuauucugggcuuguguuuucuuuuggccugacugccuuucuuucccaaaggguguuacagcgacacccaauacucuuagcagcuugugccuuaggacauuuagagccuuuuucuccuugugucaucugcagguuuauuuuugaaacaaauggaauuuuuauugggaggugaauguaaauuuaguucugaaaagaaaguuuuaaaauaauaguacuuuagauauuuucuccuguaguauucuucuaaaaguagguggauuugaugauacacuuucguaguccuacaauaacaggccaaggaaggagguuacucacugaaagccagccugguuuaaauaguaagauucggucccaaacaacagggaugaagcaaacagucgccccccacccuagaguuggugcauuucuguaggaggagaaucugcuagccucucuucuucugccuggcuuacuguggcggucuccacugcagguuguguguguuugugcgcacauguauguguguauauauauauauaugcacacacauacauauauacauacauacacauauauauuuguauauauauguguauguauguguguguguauauauauauauauguauguauguauguguguauauauauauauguauguauguauguauauguauauauguauguaugcaugccagggccucacuuuuauagccuagaacuuguacucuuuccuuuccuucuagaaacuaggauuagaaguauaugcuaccauacucagcuuaacuuuuuuauguauguauauguuuauuuauuuauuagcagugcuaagaucaaacauuuuacuacugagccauacucugggccaaggaucuuacuuaagcuuucaauuugagcagagauaguacccuggucuccagccacagaaagcaauuugauguuccuucaaagcacugccuccucaauucuaucaagccuuccuauguauuuuuacauaggcuuugaagaccuucuuccaauaacauuuacuuugccuuaauuuccccucuaggauggucuccuaggaguccuaacuuggguccuuaacucauauugaugccuagucacuuaaccaaauucaguuuagaacacuguuagacuuccuguauguugaauacaguguccagaaaucaaaagugaaguugcuauuugucacaugauaaaauuuuguucagaguuuuuuucuuuuuuuuuuuuaagauuuauuuauuuuaugugagcauacuguuacucucuucagauauucagacacaccagaagaggcauugaaucccaugugagccaucaugugguugcugggaguugaacucaagaccucuggaagaggucagugcucuuaaucacugagccaucucuccagccccaguucagagguuucaaauuccuugaccuuacuucccuagucauuacugcaauucuuuccugggauguucuuacaggcaucaguaucucugcccagggccucaauaugguauuuuauaauugugugcuuguuuuaguuucauuucuccuauugccccaagaguuuuuaaugggaaggacucuuauuuguguguguguguguguguguguguguguguaugugugauuugccuuucuugugacuugcucauagcaagauucaaaauaaaugcuugguuagguaauuuacuugugguaucuauuuucaaaggagccagcccucauggucaugaugacaugguugcugcgcugaccuccgggcauagagcucacguugcuuugagagcaguguauagaguuggaugcuaugaccuagauuacccugaggauagugcugaaguguggaccaggaugaacuuccugcuuguuccuauccccuucccagauuuccuccccuauaaaauaggugcugauagucagguaagcaaaugcaguuuagaccccugcauguagaauacaguguccaaaaauccuaagagaaguugcuauuugucauauggugaaaguuuauucagagcuuucacgugccuugcacuugcuuagucuguacugggauuccuuuuuuuauugugguuugcuauuuacuuauuugucuauuaguggugcuuaggaucagaugcagggcuuaacggguuguuggacacaggcuuccccuagcccaguuuguguaucuuuuuaugaaucaaaaaauauuacuggagcugcagaggcgacucagagguuaauaucacuuucugcucuuccagaguacugugguucaguucccagcacccacauguagcucacaacaaacuguaccuccaguucuaggacaucugguggucaggagcucauguggcacacaggcaugcagagaaauuauguaaaauaauuauuauauaaaauaauaauuaaaagauagaaaaguaaaggagucuaaaaaguauuauaaaaauucaaaagaaaauaacaaagaaagaauuacccaugggccugucccucuaagagcauguuauucuuuuaucuugcuccuuccagccuuggaccauaugcagacugacauauuuugcauaguuuuaccagagaaugcacauccaacuuuguguucuauuucuuucucuuaccauauugugucagcauaguguuauaucguuaagaugccuuggcguacacuuauuuuaaguuucuacauaagaggccacugacuugauuauacauucuuucuuuucaaauguaagaagucuagaauuucuccagugggcuguugaucagaagaaccucuuucaugugacaagaucccccucuguuggaacuuuguuuuauguacugaagagaauucauugagaguguaaauuccaaguuugugacacaaauguugggguauuuuuuguuuguuuguuugagguggugcuuacauucuuagagggugaugagggaagggacucuguagaccaaguuguaccuggacaaaugcugaagugauuugccuacaguuaugguaaugauagauagagccuggguuguaagauaacuaagugucguguucuccagaaccuguggacaaaguagcugcccugagagaguuccggguccugcacacugcccugcacagcagcucuuccuacagagaggcggugaguuugagcuaagacuguaggaguaaugagaacacugguuguuguuuagcauagggacugacaguacauugccacagcaaccaacaguaccucugggaguuuuugccaugucugugggccucaauagacuccuaucuuuccccaaagagccugucucagucaugcauugguuguagauucccuaugaugauaauuauacaccuucuccucagacuggccuuacgggccgacugugguuacagcuacagagucuacacaccuuuucuaaugggacuagauccuugacuuuuggugaacugccuaucaccucuuaagcauggauuuccccaauggaaaaauggagaauuaauacagcugugaacuuccuuccuaauguauacaaaugugaagcagucauuguauggagauuggaagggccuucggggagcuggaggaauuguuauugggcugugaagagagcauuuuguuuuagaaauauuacaaauagggauggugagagugaaccacagagacuguucuauugugguggucuguauacaacccuccuauauaagcacucaaauggaggaagucaagaaagugugggugugugaugaauguauaguguuagcuggugugcuaagccauccuuguuucuccugcaggucuuuaagaugcucagcaauaaagaaucucuggaucagaucauuguggccaccccaggccucagcagugaccccauugcucuagguaaguacaagaaaagauuugaagaaauaugagguuuuggaaaaggagaaaccaggagcaaaaaagggccaugaccaugcuuugaagaggcacugcuauugagggaugagggagaguagucaagguacauuccacacaccuaauggcucuccaucguccuuuguggcaauucuguguggccuaaaugcaggaaacugugggggaggagggagcauucccacuggaacaagauacccaugacuuuguuucuccucuuuucaggagggcugguuugggauccaguugaguugcuugcuuugagauuuaaugcagcugcugcugcugcuuccuggaucuugccaguguuccacuguguuaagagaaaucuuggucucuuccagggguucuccaggauaaggaccucuucucugucuuugcugaucccaacaugcuagauacguaaguguagccaucauuuuauagugugccauuccucacacggucaggcuagaaaccugguuguugcccugggaucuuuuuuuggaggccaguucagucucucgccaggucugcuuucuaaaugugucaagauguaagaagcggcaagggcugcuuaaggaauagaaaagcccagggaugggagcaugugaaguguggcucaaugaagcaguguggagagagagagagagagagagagagagagagacagagacagagacagagacagagacagagacagagagacagagagagagagagagagcgcgcaugugaaguguggcacaaugaagcaguguggggagagagagagagagagagacagagagagagagagagagagcgcuuugugugcuagguugauuucacuuaguaaaugucaggaauuuuaagcucggugaaguagacauagguauauagggcauaaaauguuagagcuguaaugacaguagugacucuguccccuuguuuugcaaaugaagacguuaacugcuuuaggaagagaaaggaguccucagaggcugcccauuguauaagagguagugucuggacccaguucugaaccuugagccuaccaggcuguauguuccuauauucuauuaugccuugccuauaguuuugcuuuuuuaucugugugauagguuuucaguggaucuuaaaaacugagccuuucugacccuucuaaggucagaucaucaagaugacagaacuuccuggcaaaagacgcugaagagugggcuaaauguggggccacaccccuguaaucccagaacuccgguggcagaggcaaucacaguaaaucugagacuagcuuggccuagagagcaaguccucuaggguaacagccagccagagauaaccugugaggcccuaucucaaagccaaaacccaaacuaaagcaaaaugaccuugggcugaaaacuaagggcauaagggcagccuggggugcucugcucuacuggcuacucacacugucauggacaagggugucuuuuccuuagucugucuuuucuacccuucuucuagauuggugccugcccacccagcccuagucaaugccaucauccugguucugcacucuguagcaggcagcaccccaaugccaggagcugacuccucuucccgaagcaugcccuccagcucuuaccgagauaugccaggugaggcccucaggagcuggucguagcucagggauuggcuuuacucacagcuauguauaguguuggcauagggcaugagucaggaagagcaucuguccuguaauuuuccgaggggagagaagagaugggaauuuggagcauaacuugagcugagaucuggagcugcgccggugcuuuucuguucuuccuccuggaaucuguucacucuccuccagguggcuuccuguuugacgggcucucagaugacgaggacgacuuucacccagugagugccauggcagccugccccuugagggagaugguccuaggaacuagcuucuccuuaguaccugccugggaauuggucacagggaccuuugggguccaaggccaugucauaguauuccuuuagaaagguggggccuggggcuggagagauggcucagugguuaagagcacugacugcucucccagagguccugaguucaauucccaacacccacaugguggcucacaaccaucugaaaugggaucugauacccucuucuggugugugucugaagacagcuauaguacaguuguacacauaaaacaaauaaauaaauauuaaaaaaaauaaaaagaaagguggaaccuuaggaagucuuccugggaacugggguguggggugugguucuuuuguccuaauuguggaugccucucuuuuuccagagcacucggucuacgcccucuagcaguacaccuagcucccgccccgccucccugggauacaguggagcugcagggccccgccccaucacccagagugagcuggccacugcccuggcccuggccaguacuccagagagcaguucucauacaccaacuccuggcacccagguauggagagaggguuggcaacaguaggccaggcugccaagaguggaacuccccuguaguagauaugauugccuagcacccuggugguagaucucuuugcacuaaaccauggggcccugguaggaauuucucaccugagguucagguaacuccccuuuugacuuacuugccuuuagggcucagaaguccacuuuuagcacaggccugaguggucccucuuaccuccauagggacuagauauagagaguaagguucuuagugaugauuugcuccaucuccaaagcuaccucucucaguacugggguucuagguugggccugaggccucagaguccuuuucucuggaguaaaagagaauggggaccuuuucugcccacauaaauuacauuuagguucuccauaauacaguguaguuaccuaacaggccucuguuggaaagcaggagucagguaccccaggaguagugugggguccugugacuaucugcugugaaacugaggcagcucugggcaacgcugacuauuucuuugaaucuagggccauucuucaggcaccucgccaauguccucugguguccagucagggacacccaucaccaacgaucuuuuuagccaagcucuccagcaugcccugcaggccucugggcagcccagccuucaggugagucuccccaccuccagguuuucaugcugaguuuggcaugcuuagccuuuuucugcacacuggaggcuggaagccuucccucuaggaacaccaagggcaaauguaugguaguuugacaggugagccuucccagaaagggcauauuguucuuguggcuucccauucuugccugagcaacuguagccugacuccuguggucauaaggaaguuuuaguuaaucauuuauucauucauucauucagugagcauugacugagcaguaagcacauauauagggccggguugaacugauagacuucaagaagagcagguccuuugccccugccaugcuagcacacgauuuggggagcaucuugguuauaagcuuagcugcuuaggguaagagccuaagccaaucugaacugagagaaguuuaagcugauugguagaggucagagguuugguaagccagguaguagaaggguuuuguaauggggaagagacaacugccugauggaacagguguauauagauagguauaugugguauacucaaaacuauauggcuagcaugcagugucauggcguagagcacccugagaugggaucagagaaagaggguaaaagccuagguagaaggggccuugaaugugguccaaggagguuagauuuaucugguaguucuugguaguucuugagaagcuuuaaggagaaaagggucagcuacauggagagucagcgucucagcauuguaucucacacugucaagugagcuguucgcuuuaugccugauguucuuacuuacagugaaucugcaaaggacacaucagucugaguuuguuugugucccacagcuaugagaugguaaaaacuuucauaaaaaaggaggggggaacagaccuuuuugguuuucacuauuguguguggugcgcauugcugagauggacaccuguuuaucuccagcgcgaugccuguucacuaggcuccaaggcuccaggcuuucacugccucugccugguaugaaccaaaguugagaugaugugugcaugucucagccuucuacagccucacuccugccuaugucuguuugucuuccuaccaccuucucuucauauauaaaguuuuccguaaguuguauauuuccuuucugugaugaggcagacaguaaugaaauuaugagguacuagaagaaaauguggguaaauuuauuugaaucuuuacaucagggaaugcuucucauggcugaaaucuagagucuaggagccauuauauacagucguucuaaauuuugaguuugacaaaguggaaauuuauuccuggaaaaccacagcuuaaaaaaaaaaucaguagcaaaaccuaagcaaagucuuaggacucuguaacccuaucagacaguuguaaacguaucagacaagugguacaucuuccugaaagagaaguauaagccccagcauuuccuaggaaagcaggaaagugugaauagacuguucugagaacaggcucuuacacgcacaggacuccuaggagacccauuucucggaaauugucccagaaguguuuguguauauagacaauggaagcuucacggcacucagagucacggcagcauuauuuguaauggcagaagauuguaaacagucaaccaagggcuagaauuuguauuauaugcuugcuaaaaaguuuuuguaguagggcaucgugguacucugugaucucagcacuuaccagguugacauaggaaugucaugaguugguggauaacaugugcuauauagcaaaacucaauuugacacaagguagagucauaugcaaggagggagucucaauugagaaauuccuucuguaaaauggguccgugggcagucuguauggcauuuucuuagugauugaaguaagaaaaccuagcccaugugggcuguucugccccugggcuggugauccuggguucuauaagaaagcaggcugagcaggucaugaggaacaaagcagugaguagcauaucuccaugggcugcaucggcuccuggcuccagcuuccuacguugcuugaguuccugcccugugucuccucagugaugaacuuugucagaggccaucuuugaacacuacuugguaaacugagucaggcagugaggugcggugguggcgauuggggucagugaugaaagcagcugauggaggucagcacuaagagggggugauggacggggauaaguccugauagcagcugacaggggcugcuaccuaugacagccagcgauaagagaaaaaaggaaaggggaaagucauacacacacacacacacacacacacacacacacacacacacacacacacacgagagagagagagagagagagagagagagagagagagagauugaagcaaaggcagacuucagcauuuuuuuucucuuagccauuuuauaccucuuaagacaaaguuuuucuauguaagaaaauuaccucauagccacaaguuacacauuaucuaaaaauaaucaccacaaaaacauauucuucaaaaacagaauaaaaucaugacacaaaaggaaauugcaacaggauuauugguuauguauuccuuuuuugaaacuuuaaugaaauaauucuugucuuuuuuuuuuuaagauuuauuuacuuuaugaauauaguauacuguagcugucuucagacacaccggaagaggucaucggaucccauuacagaugguugugaguugcugggaauguaguugcugggaauugaacucaggaccucuggaagagcaaucagugcucuuaacuguuaagccaucucuccaacccccucaucuauuuuucuuucuacaaguuuauuguaacuccaaagcacuaauucuuuuguccuagauuaacagaauuuaagcaggccaagucuguaguagcagguuucucccugugcuugauugacagcaaucuguacuuacgaaggaacaggacaucuaucuuacgucuuauuuuugaagucuugaucagcuagacuggcuaaucaucuguucucuguacuuauacuuagaauugcuuauucuuuacucauaaucuuucuauuucaugguacacaccgaaaccuguuaccacaucccuagaucacaagaccaaggaacgcaggcccagccuggagugaaugcuuucuuuuaucauuaacuugucccaagccuguuuuucuugcuucuauaaugcaugagcgcucccugugcuccugucucucauuccugccgcucuugccagucugugagggaggggcauucuauucuuaacucuaacuucaaacuuucuaucaacuaugcuaacaucccaaaacuacuuaaaucaagcuaacucuccaaaacuacuuaaaucaggaauuccauaaaaucauuaauucaucuaaacagcauuaucucaagaacuucuuucaucuucauguugaucugcaggagacuugcucaacagagugggcuaucacccaggaaguaauuacaccaggcuguaggcaaugagggucucucgguguccacucacaccaagccagaugagugaggagcauggcaauggcaaacaugagaaagcaagcacgucaguagcaaggaauccugggagaagucucugggucacgccuuuccagagcgcacauugucgucgcucuagggagcucacuugcccacuguagcucuucuugcauggcacccgccaguacuuaaaagcuauaagguaaaauaaaccuuuuucuucccaaguuacuugugaucaugguauuuuaucacaguggcagaaacccugacuuaacacaguguacuaacauagaaagaucacuuuccacuacaccucaugguaaacacaacuuaagcuaggugugaugacauguaucuauaaucuuggcacucagaagguggaauugggaguucaaggcuauccccgacuauauaauaguaaguuugaggcuagcuuaggcugcaugagauccucuaucaaacauucaaaagcaaaacaaaaaguaaaaccaaaaugaaaauacaauaaaaaauaaacaaaaacaaaacuaaaauacaacuuuagcuuauuuuugcugguuuuacccuuugacaguuucauacauguuuugaauauaauugauuuugauuaccauccucugacccucuuaauaucccccucaucccuaucaaauccuucccaacaccgcuggucucuuucccaaacugaugacuuuuggguuuguuuuguguccauuaguuugcccaggccuucuguauaagcacuggaucagagcuauccacuggagccuggcgaggucaccagugggcacaagacugaaggcagugacucucccucuccuugacucuaacaguaguaaauaguucaguaggaaggaugccuccagccccuccuccacccauccugacuaucagcaggcccauuguuuugcuuuuguuuuuacauuauuuaacuuauuauuauguguauguauguguaucauguaccauuauauggauuccagacucagucaucugguucccaaggcaagcacuuuuacccacugaaccaucuucccaguccccaugggccguuuugggaagacucagucaguguaggcauccacagcugcugugaauucauuauugcaaugguugugucuugcucagagaguagcauuuuguaacucuucguccagagcuuucacuuucacuucuuccgaaauguucucugaaguuuagaagggauagaguaagugucuuguuuuagggaugcgcacuaaagcaccauguacagucaugaaucuucauucaucaccauucacuggaaagacaagcuucucugauugaagcugagaggaaaggaacauaguaucuguguauaaacaaauauuuagaaggcaguuuaguacagugccaauuuuucuagacaacaucauucaguccccuuccccuuagggcuuuuggucagauuugucauauuuagauauagagucccuuguguagagcaggccucaaaggcaaucauagaacaguuauuuacagcuguaauagcagugccaccaugugcaaguggagcuucuuaucugguuucauguggaggguucacagguggguaagacccuucucuuacaguagccugcauagaaacuugugggauuauuaaaaagcuuccagcaggggaaucuuccagcucaguuccaguguuauuucucuguuucgugcuaccaaaguguugucuucagcgauaagguuuuauugucuaguucuggugggcaaccaagaggaauggaaagaaccuguauuguuuuguggagcucuggaaccuccuuaaccaguaacuccuuaguaaguaucccacccuuggcacugcuguuuuguauaaucuauagcuucuaggaacagcuucuccaaaccaugaaagguuuacuuaacagguuucuuugugacuuuucacaccaccuuuguuuuggguguguuaggguagcuacccuccuuguuucuucuaucacaacaccuaccucuuccuugcuuaaaccuuuccauuccagugcccugcaucucugcuuucauagagccgacauucuucuucauuccucucuuaaggcagcuuccucccaguggccucuuggugguuuccugacaucugcaguuacucucucucucuuuuuaaaaagacucacugggcuugaauuagaagugcccuguacugaccuccuaagggaagaaccagcacaccugucucaaagcuaaccucaaaaugugugcauugcgugugugugugugugugugugugugugugugugugugugaagaaccagcacaccugucucaaagcuaaccucaaaaugugugcauucugugugugugugugugugugugugugugugaacaaguuuuuggaauuuaggcauugaauaauuuacacuuucucuuuacuauaaaacuucaugcugggcagugguggugcacgccuuuaaucccagcacuuggaaggcagaggcagguggauuucugaguucugaguccagccugguccacaaagugaguuccaggacagccaggacuacacagagaaacccugucuugaaaaaacaaaaccaaaacaacaacaaaaaaaacuucauuggcuagagagaugguuaagaguaccagcuucucuucccgagguccugaguucaauucccagcaaccacaugguggcucacaaccaucuguaauaggauccgaggcccucuucuggugugucugaagacagcgacaguguacucauauacauaaaaaaagcaacaacaaacucauuuguuuucuucacauucaaguguaucuucagucuuuaugaugucccuaugcuauggucccaaacaucaguagcuuugcugugugucuucucuuuuuccuuucuauccugaaaauacaaccuuuuaagucuaugacuguucaucaggagccuugcuaauccuucugccugaccugucuuuccacagauccaguggcagccucagcugcagcaguugcgugacaugggcauccaggaugacgaacuaagccuccgggcccuacaggccacuggaggugauauccaagcagcccuggaacucaucuuugcuggaggagccccaugaacuucuuguaccugaacaccuagcaaauugcagaggcuguuccuggcaagaagcacuugugaaguugcuucuagauuccccacccaaccccaccccaauauaucauaugcuccccuugccu

SEQ ID NO: 5141 - RNA, 14516 nt, Mus musculus
caggagaggagauggaauuuuccaaaguuccugaguugaccucuucagugccaggcauuggcauuguggagaugaacuaggcagguacucucccucaaguacuucccagcccagaaggggacaggaccacaccugaggacuauccuaaagaucugaacaguggagacagaaugaagagagcuugcuuggacagcuuuauguagcagagcugguacaagugacuuaggccuugaagggugaguaguucauugaguuaaaacagguauuguccaggucuggauaaaaggggagagggcaaugauaagacaacagaaaaaugaaauggggcuucagugggggaauauuuacaggcccagaaaccccaaacugaugaucauagggugaugugaccuaugaucaaggccuauguccuacagguguagcccuauacaacaucugacuuuggagccuggcaccacaguggcaaggucuggagcacuuugccuuacuuucugggccucacugcugcagacggaacaaugacggacccagugcucugagcacacucccaaacacccugacuggagaguaggugugugaauggcagcuaucacugucacgugaauuauuacauugauuuagaaggaucuguucaguucauaaaccccaaauaauggagcccagccagucaugagacuugcagaacuauagagucacugggguagagcuggugcugguacuggaggccgugcuaaaaaugauccccgaggucuuaguccuggcagaggagaaacgcagcaggcugggcuggguaacuguguuggcaauuuccccuucaaaaccaccugaacuggagccccauucauuagcaugagaauggcgcgccggcugggaucugaggguccaaagguauuuguauucgaaagagcuuccucuguucuuggcucaaagucacugcggccugagcugcgaggcugggcggggauccaacacacacugcggguagccugggaaagaggggaguccuacccaagugguugcuccgagccucgggaccacacucagaaaugcagcccagaacaccuuccccaucccagcccacccggagccaucccuguauuugggaagcucucuuguaaguucuugaaaugucuccccaccccuccagccuuuauuucuuuuuaaauccuguguggaagaaggcagggguuugagaccugugugccucucacaaaggaaccuagaguuuucaaagguggagaagcacugcccaacgggauuaguaauaguaaccaucauuacagcuagugguugggagcugccccuugccaggcaucauguuaggaauuuuacauacauuauccucgguguggcucucuuuuuaaaauucaugccacaauccugagaugugguuucaagccucacuuuacugaucaggaaacuaugauguggaggauaguguuagcuuacccaggauuaagaaaauaaauuuccuaucuggaguaugggcuacaguauuaaguuccacaccuccugauugcccuuccggcugccccuuuggaaaggaguccaguggaaugaagggauaguuugacaauuuccccuucagguccucccagcucaggcuccggucaucagcaugagaaccaggucugagcagaagacccacccucaucucuggcccuucucuaucaauccuucucugggcacucagguuuguuuaucccccuagggaucugcuguggagcccagcaugauggcauuucuaagggaaaggcaggaaaggcagggagcagaaagauacccgccuaguuuguguagcacccugugucacccucagggaagaacccagaauccagaauggaccccacaagaauguucuucacuugucugcccaaccucuuccucuugccuaguccuuuugucaucuucaagcaggcaccccauucuguucucccaccaccuccgcucucccuccuuauccucaccaacaagaauccaagaacacuccagugccuuagccacucuguaaaguucccaagucuagccauaccguuacugacaacuucauggagccucagcuagguuaccauauguuaccaagaaaaugggguccccucucaggauuccuaguuucaauuauaaaagaauuuuggaacagacucagaaggaagcucugggacaauccuauaagcacuugaaagaaaacaccaggucaggcaggcugccugggaaaggcaaagaugccccaauccugaguaugacaagccuugccacacccccacacagaucuccuuucuccacaaucuuucuucuuaaugucccauuccaucagaacuuucaggccucguacaagccagaagcccuggugucugcuugugucuuguuucccaucuguccuaggacuaacuccacacugcugcagaagaccgagcauuccuccgcacuggggugggagugcucuguguaacccagacagagugcugacucagucucgggcauggugguggcauuacacaagggccacagcugccugggaagccacacucuugcucucccugaacccccagaggcuguauguagggguaggcaggccgagugcucaagggcccugccuugccaagcuuuuuaucugcuucucauuauccucgcccucugccugagaagguaauuaaaucugucucccaucaaaagcuggggcuggcuucaccccaaggccuggcuggcauggcagggaaauaaugaacacucucaccagcccuggagggggcgggucuuaguuggcuccacccucgcccaucacacaaaucugggagcuaacauucaguucuccucaggguuaaagaaagagucugagccuucuagguuguggaaaauagagcccuaguguccuggcccugaggcuugagguucaggauccccaguggggcagcucaaaggaagaguaugugccaugagcucuucuugugguuaacagaacacaggacccggagcaaguuugcuuugagagcucagaagagagacaagguucccuuucuuuuucccuuuaucucaccaagaggauguaaugaugaagaugaaggcuaagaaacugacaccggucucuaugaccugccccaguuacaaaaugaacacaggaaggcuucguagaaagcgcuuuagaggauggcagggaggcacaggagagaagagacagggauaugacagggagacugguguugugggaagaaggcagcagggagguccucaggggguccuggaaguagugggagucaaugaagguuuaagaggucagaaguuagcgggccccaugugcagggcuggagagacagcuccauguuuaagugugccaguuccugcuacuaaagaccaguguuauuggcacccaugcugggcagcucacaacuucaugaaacuccagauccagugcccccuucagguuucugcagguaccugcaagagcaguguuguaagauggaaagaaaaggguuagugugcaguucggcuugaucccucuaucucaaggcucucauucuuggcucugucugacucaauaaggagggugguucccggagcuuagcaaggggcacucugcccagagucacuugggcuauggcacuugaccucaauagucuucccugacaccgggauucugggaucccucuggaggccucacuuucuuccccugugagauggcaaagaugaggauaguuauagugaagugucccucacagaccaaugagcaucaggugucuuaucugugucagaagagcccugaucugguugccacagguuuccuccagccacaggaggccuggauguucuucugguuuuugaugggagcucucacaauccuggcaugagcgcauccuagugggcagguuuugggccaaccuccaacuuucaaguagccuugugagagccgcuacucaauuacccuuaaucuucuugaugagguggagucuagccaggcauuacaggccccacaccaaguccccaagcccuggucacagauuacucugccacagcccucccaucucagucuccagauggcuggugguggcagggaugauguguccuuccuacccuacugccuucuggguggggguggugaucagauccacaguguggaagagauauucugaauuucaaagacccggcuucaaauuucaccauuagaauuuggccagaggccuggaaggccuucuuaauccacaugucucuaggugccccugugagucagaaaccacuuucuggaagagggguuuccuuagauccgaggaagccagcagaccucuggaaggagcagacuugcaugguggggauugcaaggcacagagugcugcuagcuaagcagaccaggcagucaucucaaagucaguggacgaaggugcuccucccagcuggagcuuggguugaagaucuuacuauagaacaccaagaaacguucccuaugacaaaccacaugcaugggcgcacagcauggcacacacagaagcaagccaggaacccuuccaggcauuucuggacuggccaggacgccacagucaucagcaaaagggagaucaggacaggccuugcuugaguguagacuuugucucucugcauauguuucugaugucaugugcucacauuuguccuccauguccuuguccuggagcugauaaaaguaaaauaggaguucguccuaagacuggaaggcagauauauauaaucccugccuugggauggucuuuuacugccuacacuaggacuagaaagccagaugacaagaaggguggccgcacguugcccuuugugaaacagggagauaaucagggcaugcuggguggcaggaaagcagaguauaccaaucccaaggacuuuguuuucaaguaguugcugccacaaggugccacuaaaggcccagagagguugacugacuugcccaaggccucucaggcuuucuaaagccucacuccugagcauuuugcacuggucauagaauggaucugcugugcuucugaaauugguugggagagucacaggcaaguucccaagaauguuaacaagcuugcuuagugacaggaugggaggagaacaccuggggcccaagccuggaagucgaaggauuuguccaauaacauccaggaagagaaaggggagcuccuaguggggcaugagguucaagcccaguucccagacacugugaggcuaacauugccauugccgggaaagcaguaguucacccaaugugcccaaggucuuccugaguggcugugggguagccccucuacccucaauuaucugcacacuucccaccagccccuagaugagcccacuucagaucuuggucuaacaaugugaccauggccuucauggguccuaguuauaguccuuuugacaaaggcaagaacagcacuuaccacagucaggauucacuguugugucuacacagggauuucucugcucuguucucucuuccuucugcugggcuccagggcucgguccacuaauauuuguucaaugccaguuggagagagacguuggcaacaugguagcccaggacugccaaccccugaagcaagaguugcccuguuuucucaugagugauggggacuucucuaacagauugaacucagacaccaugugguccccucccccucuucagaggugccuaaccuccugucuagcucuauguacccuucaagacucaaccuaaggaguaaugucuaauucuuaccccaugcacagaauggguuaguuauuuuccccuuguguuccauaguaccuugaccaucaacagcauugcuaaugaucaaagauauagagccaccuguguguccaccucugccacaagaugagcuucuagcuauagacacuagagaauuaguguggugguuugaauaugcuuggcccaggaaguggcacuauuugcagguguagccuuguuacaauagguguggccuuguuggaggaauugugucacugugggcuugugauuuaagacccuuacucuugcugccuagaagucagucuucuccuaguggccuucauaugaagauguagaacucucagcuucuccugcaacacgccuaccuggacucugccaugcuccuaccuuaaugacaauggacuaaaccucugaccuguaagccaggcccaauaaauguuguccuucuaagauuuaccuuggucaugaugucuguucacaacauuaaaacccuaacuaggacagaaguagguaccuuguaugcagcuacugaucuagcaaaugccuucuucucaguaccuauccauaaggaccaccaaaagcaauuuacuuuuaauuaguaaggccaguaguauaccuuuacaguuuugucucaaagauguauuaacucuccuguucugcaucauaacuuaguuaagaagggaucuugaucaucugucucuuccacaaaauaucacauuggugcacuauauuaaugauaucaugcugauuggaccaaacgagugggagguagcaaccacuuuggaaucacugguuacacaugcauaucagaggacggaaaauaaauccaaccaaaauucaaggaccguuuagcucagugaaauucuuacgaguccagugguguggggcaugcagagauauuccuucuaaggugaaaaacaaguuauugaaccuggucccucccaccaccaagaaagaagcacaacauuuaucgagucuguuuggauucuggagacagcacauuccucacuuggauguguuauucaagcccuuuuaccaagcgacucagaaagcugcuagcuuuguguggggccuggaacaggaaaaggcucuucaacagguccaggcugcugugcaggcugcuauaccacuuggaccauaugacccagaagaucugaugguacuugaggagucaguggcagauagagaugcuguuuggaggcuuuggcaggccuuugugggugaaucacagaagagaccuuugggauuuuggagcaaagcucuaccaucaucugcagauauuauucucucuuggcaaaacagugcuuagccugcuauugggccuuaguggaaacugaacauuugacaauaggauaccaaguuaccaugcgaccugaacagccccuuaugagcuggguaucaucagacccaccgagucauaaaguaagacauguauagcaaacagucuauuaccaaauggaagugguauauaagugauuaagccuggagcagguccugaaggcacaaacaaguuacaugaggaaauugcccaaaugccuaugguuucuacuccuuauacaaugcugucugcugccaagcaugagccuauagccucaugggguguucccuagggccagaugacugaagaagagaagacuaggaccugguuuacugaugguauauggauuucuuagauuucuaaauacgaggcagaguggugggccuagagccuugccuggugauuccuuagaaacacuccccaaagggcugaucguagggaugaguuguccugccacaugcccagcacuauuagguccacagagcaggggaaggauaugagccuagaggcaagaaaauuaagcaggcucucauccuuagacucugucuccucauucguggcuggccagugacucacaugaaggcuccauguagccuaggcuuggcagcugcagaagugaucauagggcucauggcgaucuccugcaggacucagauaugggaacuggacacugaggaggaggcaaaggcagaggacaccccucugguuguaucuggucauaagcuccuggugaugguaaaucuucauugucaccuagauaugaggucaccuaggagacauaccucaagugugucaguaaagguguaacugacaugggaagaccuacccugaacauacaggcccuugaacacaagcacgauacggcacguguagaggucagaagacaacuggcaggaaggaguugguucucacuuuccaccauauggaacccaggaggaaccgagucaucaggcuuugugaccaguaccuuuuacccacugagccaucuugccagcuccagauuucuuuuuaagugggugcugaucacauucauuaaggcccauguguggagauguuaaaacccagucaccucccaaaggccccaccuucugacaccaucacauuugggguuagcaauuuuuaaauguuuauuuuuaaucauuugucugccuauggguuuacacaugugggcuuguguuccucuagaggccagaagagagcacagggucuccaggagcuggaaguacagacaaugugagccacguaacgaagggcccacaaauagagcuugggucccucuggaagaggaguuggacuccuaaucaccaaccuaucucucuagccccaggauaagcauuuuaaaauaugaauuuuguagggacacaaacuucuaaucuucaacaaauagggagguccggccuugcauucuguuccucuuugguuccaacagggaagcaagugguacuagcagugugaggagaccuaauguguuccagacagaguggcuguucuguuacaaacacacaaacuacaagugcauaaagccagggucucuaaccaccugccagguaggagcugugcucaccuucuugagagaaggaaacuuaccaaacagaaagaagacauagaaaacagagauugcccccaaacucauaacagauuggauuauuauuauuauuaauuauuggugguggugguggugguggugguggugguuuuuugagacaggguuucucugugaagcccuggaugucuuggaacucacucgguagaccagacuggccucaaacucagagagcccccugcuucugccucuuuaaagguauguggcaccacaucuggcuucagauugaauuaaucaagucuucucacagagaauaauccaguccuaaaggcuuuauaugcucaauuuuaauuuuaaaaaaggaggaggagaaagaggagaaagggagggagggagggagggagggagggagggagggagggagggagggagggagggagggaagaauuaauuuauguuuaaaucuuuuguauccugccuggcaugguggcacacgccuuuaaucccagcacucgggaggcagaggcagguagauuucugaguuggaggccagccuggucuacaaagugaguuccaggacagccagggcuauacagagaaacccugucucgaaaacaaaaaacaacaacaaaacaacaacaaaaagcuuuuguguccuagaaaaggggggacaucuuuuuaagucauuuugugaagccagcaaaacuuuaaucuccacuucaagcaucugcacaguggagaaaauaauagguuggcagggcagcaucaggggccuugagugcaugugcacagcauguaacaugccugcuauguauuccacaugcacuaguuguuuuacgcggucacaccaggauccagguugaaaucucugucucacugaaccagacaucuagaauggcaucccuaggacaaagaaggggaaggaaaaggugaacuaugauacuugaauagagacccuaaaacccaggggcaaccuggcaaacuggaucccacuagacucucauucaggcccuucaagcuagcugcacccaugacauuuugcacaccaagcucugagaaccuguaacugacuguauuaagacacagccagggccauuugaagacaaaacucaagguucucugcauuugcuccucaggcagguacccgaaccaaccauaccacagccguagagugcuuggccuuauagcccaggcugucuuuagauguaagaguccccgucuuuaagacagguagugaagcugcucuguggaucacugaaggucacaggaagaacuuggagugaccuggcccauaacagucacaucugucugaggaacugucuccucugaagaucacugccuuccacaccuggcauucacagagacuggaauccaucuccugugugugguacuuucucuguauaaguggaacacacauacagccuucuguaauagcuacuuggccaauuccaaaacauguuuaugucaaaauauucaugacugacagauucccccaacccaccccacuuuccucucugaacuagagaaacagccuauucaaauccuauauccugacucacagcacuccggcaucaucuuggaauaguucugaauaccuguacuccuccugcagauaugauccuacaacccacuuucaguucacagucgcauacauacuacuucucucuauauguguaaucguguaacucauggagaagccagaggucaaugccaaguaccuuccucagucacucuucaccuuguuuauugagacagagucucucacugaaccugaagcuuacugauuaggcuggacuugcugggcagaaaccccuaggguucaucugucuuugccuugccaguauugggauuacagagguaggauguuuuauauggguuaugggguuccaaaugcagguccccgugcuugugaagcaaucacuuugacucuugacugagccaucuuuccagcccugcauguauacugugucucucuuccccaucuguagaaguccaucauggagccaggguggugcagaguguuaugaaggucacugauggucugaaguccugaccccggcccuguaucugugcaaccuuggaccagauccuaagcuugccgagucucugauucccuaucuggaaauaacaauagacacucagcaucagccuggugcagugguucucagccuuccuaacgcugugacccuuuacuuacuguuccucaugcuauacugacccacagccauaaaauuauuuuguugcuacuucauaacuguaauuuuucuacuguugugaaucauaauguaaaugucuguguuuucuguugguguugauccauagauugagaaguccuggcucaacgugagacuccuuuaugagcugacgaagagauacucaguguaccagaucaguaggcacauagggaaucuggguacugggaucuaaguagucuggagacugggugguccucacaucucuuucuccccuguugaggcugaagaguugaaggguaagggccagcccaguuguggcugcuggcuuuggggcucuucagccacuggggaagcuccagggaaaaggaugguguccuuaagaaacagcagcuuaggucuggcccguuuucccuaaagcagggaaagcaaguuggucccaacaacucacgggaccaacaacugcaccuuccugucuguuagaagcugcuucuuccugcuuugaacauggagaaacugaggacagagaaagccuuggcauaccaucuaguccagcucccuuuuuggcucugaagggaagaaagcaggggauauauaaagacauuccuggcaucuuuuuagcacaauaauguucauguuuuuggaagcaaaaguugucuugauuuuuacccagaccaaccagguagguacccucuaucucaucauccccauuaaaagucagcaaacuuaggcagcuuccucaagagcugccccuaacucgaggcagaauuagaacuucagguaucucuuacccacucauauccauaaucaacacguaccuccuaacagaguggacucugguaagaacccauguuuuccagucauacgccauucacuucaggcccuuaggaagucacucuguuaugcucacugcucuauucugucuugaccuccaggacuccugagcaucauucaaggaauucucuggucucuaaacccaagucuaaaggcagcugauuuaucugauuuaucccugggagccacacccagcacagggccaagcacaaacacaaguaagugugaaugagaacacuuguggaaggaauagaggaaugaaaggaugaaaggaggaauggaaugauggaagagaggaaggauuagaagcccauacucucuucuauagcuucucucaacagaaaaacaaggccccaagugucuaucccacauugauuaaccucagucccuaccaccacugcuacaccugauccccagcccccugccacacuguucacagcauuugugacuugcccugccacccucaauacuacuaggacacagagcacucaccuuaggcaagugaccaggccuugaccauagacuggcagaggaaggauuuggaggccuggucugggccuucaaagaccuagagcaaauguccaccuucuucauccccaucaucccuugcuuacugggaacuggugagguucaugcuacuucccugagguggggagggggcuggggggacucccaguguuugucagcagaguaugguauuggggaggacuguguuuccaugguuacuagccaugggagcugcagggagauggggccaugguguacauagacacagauccacacggaccugcaagaaaaauagcaacagauuugcugagucauuggccccacauauuuauagucucuggcgaaggcagaccugccuaucagaggcuaauaauacugcagcaguguguuaauugcaaagacggagucuucaagcauccauucagacacccgagacugcuucuugaauaaagagugaggccucacaaugagccaggcuuccuguuugguagcauguauaguuaggagugugugugugugugugugugugugugugugugugugugugugugcagguauaugaaaccugguucuugcuuggcacaaaagcuacuguuauaucaagcagacugaaaccagcccacggcauggugugacagcacacucuucaacccccuccuaugggugucuaggauucacccacucuacagauggccagggcaaggagggguccaaaacaaaggauaugaggaugcuuggcuauaucccagggaugagaggacaugaggcaugaggcaggaugcuaacagcaacucucccuggggacagcuauuauccucuagcucuguacagccagguaagucagaagagagagaguagaagacuuuuaucucccuguaggucaaccaauaggccaccuggcauagcaaagaucaaacuggagcuggaauaugaaaaacugagccaagcucagucaguacugagagcugguaugccaccuuaaauaaauauguaagggccaaguucaucccuguagagggaucucugcuucacccucgagauguccauccagacacagugucugccccaacacugccuuaugguggcagcaacugugcuuugaaacuugggagaucuacauguucccaacaccugggcaauaaggcccugaguggagcuauaggugaaauggauauguaucccucucagacagcacuauucuugcucccugugaaucuucugacugaccaaguauuugccuggcuugggaucaguucuccuuaaaggcucuguuccucucuggacauguuccuucuuauacugggccucuaguagagccagguuagagcguguuuucccaaaagaccccuagccccuuuggucuucugcugccuguggccccugcaugcacauugccuuuggguuuaggaggggaaggguggauggcaacagccuucucucagcuucagccucagugucacaucuagaucaguccuugaccuuccugcucagccuacaagacacccaugcuuuccucacaaccaggaaggaacaacaaagcaagcucagcaggaggaggguagcugggcuggcuguaucaucugggccuccaucucgcccacaccaaucccccaaacagcucaugcucucgugacugaguccacaguacucugugaagagaagggaggaggcucggggagagaggggcaucucuccgguucucacuucuuaagagaagguugacuggagagccguuauuaauaguaaauuaaauagugagguuauucugaauaauaaagagcccuucugcuccaaguucccacaguccucucuccagggaaacacuugugauagcuugagauguggacuccgugauuggcauuuguagggcgaagcggggacgaaaauguagcucgguaguguuuucuuaucacacugaagcuuggguuucauccacagcaucacaugaacgaggacagugagucacuugggauauggagagacgcaagaggaucagaaguuugaggccacccucaggaacacagcaagucugagggcagcccgagccacacacgcuucuuaccaagaaaggaugaagccaauguucccacucuauccuaaaauaggcugccaagcacacccaagaauguguccugugaccccacacuagaagaccuugacacucaguaugaucgcaucacgaagccugaucuauacccaagggugggaaccgcaucacuguggucucuacccaucauggagacccucucacucacucacucgcccacucacucacagugugaccuugggaagccacugaacugaucuagucucucucccauaaaauggacuaaugguugcaucucccccgagagcuuggcagaaggguuaaaauuaauauguacugaaugcuauugauuauauaaaguuauuauaugugaaggacaugua

SEQ ID NO: 5142 - RNA, 8568 nt, Mus musculus
uuuugugaagccagcaaaacuuuaaucuccacuucaagcaucugcacaguggagaaaauaauagguuggcagggcagcaucaggggccuugagugcaugugcacagcauguaacaugccugcuauguauuccacaugcacuaguuguuuuacgcggucacaccaggauccagguugaaaucucugucucacugaaccagacaucuagaauggcaucccuaggacaaagaaggggaaggaaaaggugaacuaugauacuugaauagagacccuaaaacccaggggcaaccuggcaaacuggaucccacuagacucucauucaggcccuucaagcuagcugcacccaugacauuuugcacaccaagcucugagaaccuguaacugacuguauuaagacacagccagggccauuugaagacaaaacucaagguucucugcauuugcuccucaggcagguacccgaaccaaccauaccacagccguagagugcuuggccuuauagcccaggcugucuuuagauguaagaguccccgucuuuaagacagguagugaagcugcucuguggaucacugaaggucacaggaagaacuuggagugaccuggcccauaacagucacaucugucugaggaacugucuccucugaagaucacugccuuccacaccuggcauucacagagacuggaauccaucuccugugugugguacuuucucuguauaaguggaacacacauacagccuucuguaauagcuacuuggccaauuccaaaacauguuuaugucaaaauauucaugacugacagauucccccaacccaccccacuuuccucucugaacuagagaaacagccuauucaaauccuauauccugacucacagcacuccggcaucaucuuggaauaguucugaauaccuguacuccuccugcagauaugauccuacaacccacuuucaguucacagucgcauacauacuacuucucucuauauguguaaucguguaacucauggagaagccagaggucaaugccaaguaccuuccucagucacucuucaccuuguuuauugagacagagucucucacugaaccugaagcuuacugauuaggcuggacuugcugggcagaaaccccuaggguucaucugucuuugccuugccaguauugggauuacagagguaggauguuuuauauggguuaugggguuccaaaugcagguccccgugcuugugaagcaaucacuuugacucuugacugagccaucuuuccagcccugcauguauacugugucucucuuccccaucuguagaaguccaucauggagccaggguggugcagaguguuaugaaggucacugauggucugaaguccugaccccggcccuguaucugugcaaccuuggaccagauccuaagcuugccgagucucugauucccuaucuggaaauaacaauagacacucagcaucagccuggugcagugguucucagccuuccuaacgcugugacccuuuacuuacuguuccucaugcuauacugacccacagccauaaaauuauuuuguugcuacuucauaacuguaauuuuucuacuguugugaaucauaauguaaaugucuguguuuucuguugguguugauccauagauugagaaguccuggcucaacgugagacuccuuuaugagcugacgaagagauacucaguguaccagaucaguaggcacauagggaaucuggguacugggaucuaaguagucuggagacugggugguccucacaucucuuucuccccuguugaggcugaagaguugaaggguaagggccagcccaguuguggcugcuggcuuuggggcucuucagccacuggggaagcuccagggaaaaggaugguguccuuaagaaacagcagcuuaggucuggcccguuuucccuaaagcagggaaagcaaguuggucccaacaacucacgggaccaacaacugcaccuuccugucuguuagaagcugcuucuuccugcuuugaacauggagaaacugaggacagagaaagccuuggcauaccaucuaguccagcucccuuuuuggcucugaagggaagaaagcaggggauauauaaagacauuccuggcaucuuuuuagcacaauaauguucauguuuuuggaagcaaaaguugucuugauuuuuacccagaccaaccagguagguacccucuaucucaucauccccauuaaaagucagcaaacuuaggcagcuuccucaagagcugccccuaacucgaggcagaauuagaacuucagguaucucuuacccacucauauccauaaucaacacguaccuccuaacagaguggacucugguaagaacccauguuuuccagucauacgccauucacuucaggcccuuaggaagucacucuguuaugcucacugcucuauucugucuugaccuccaggacuccugagcaucauucaaggaauucucuggucucuaaacccaagucuaaaggcagcugauuuaucugauuuaucccugggagccacacccagcacagggccaagcacaaacacaaguaagugugaaugagaacacuuguggaaggaauagaggaaugaaaggaugaaaggaggaauggaaugauggaagagaggaaggauuagaagcccauacucucuucuauagcuucucucaacagaaaaacaaggccccaagugucuaucccacauugauuaaccucagucccuaccaccacugcuacaccugauccccagcccccugccacacuguucacagcauuugugacuugcccugccacccucaauacuacuaggacacagagcacucaccuuaggcaagugaccaggccuugaccauagacuggcagaggaaggauuuggaggccuggucugggccuucaaagaccuagagcaaauguccaccuucuucauccccaucaucccuugcuuacugggaacuggugagguucaugcuacuucccugagguggggagggggcuggggggacucccaguguuugucagcagaguaugguauuggggaggacuguguuuccaugguuacuagccaugggagcugcagggagauggggccaugguguacauagacacagauccacacggaccugcaagaaaaauagcaacagauuugcugagucauuggccccacauauuuauagucucuggcgaaggcagaccugccuaucagaggcuaauaauacugcagcaguguguuaauugcaaagacggagucuucaagcauccauucagacacccgagacugcuucuugaauaaagagugaggccucacaaugagccaggcuuccuguuugguagcauguauaguuaggagugugugugugugugugugugugugugugugugugugugugugugcagguauaugaaaccugguucuugcuuggcacaaaagcuacuguuauaucaagcagacugaaaccagcccacggcauggugugacagcacacucuucaacccccuccuaugggugucuaggauucacccacucuacagauggccagggcaaggagggguccaaaacaaaggauaugaggaugcuuggcuauaucccagggaugagaggacaugaggcaugaggcaggaugcuaacagcaacucucccuggggacagcuauuauccucuagcucuguacagccagguaagucagaagagagagaguagaagacuuuuaucucccuguaggucaaccaauaggccaccuggcauagcaaagaucaaacuggagcuggaauaugaaaaacugagccaagcucagucaguacugagagcugguaugccaccuuaaauaaauauguaagggccaaguucaucccuguagagggaucucugcuucacccucgagauguccauccagacacagugucugccccaacacugccuuaugguggcagcaacugugcuuugaaacuugggagaucuacauguucccaacaccugggcaauaaggcccugaguggagcuauaggugaaauggauauguaucccucucagacagcacuauucuugcucccugugaaucuucugacugaccaaguauuugccuggcuugggaucaguucuccuuaaaggcucuguuccucucuggacauguuccuucuuauacugggccucuaguagagccagguuagagcguguuuucccaaaagaccccuagccccuuuggucuucugcugccuguggccccugcaugcacauugccuuuggguuuaggaggggaaggguggauggcaacagccuucucucagcuucagccucagugucacaucuagaucaguccuugaccuuccugcucagccuacaagacacccaugcuuuccucacaaccaggaaggaacaacaaagcaagcucagcaggaggaggguagcugggcuggcuguaucaucugggccuccaucucgcccacaccaaucccccaaacagcucaugcucucgugacugaguccacaguacucugugaagagaagggaggaggcucggggagagaggggcaucucuccgguucucacuucuuaagagaagguugacuggagagccguuauuaauaguaaauuaaauagugagguuauucugaauaauaaagagcccuucugcuccaaguucccacaguccucucuccagggaaacacuugugauagcuugagauguggacuccgugauuggcauuuguagggcgaagcggggacgaaaauguagcucgguaguguuuucuuaucacacugaagcuuggguuucauccacagcaucacaugaacgaggacagugagucacuugggauauggagagacgcaagaggaucagaaguuugaggccacccucaggaacacagcaagucugagggcagcccgagccacacacgcuucuuaccaagaaaggaugaagccaauguucccacucuauccuaaaauaggcugccaagcacacccaagaauguguccugugaccccacacuagaagaccuugacacucaguaugaucgcaucacgaagccugaucuauacccaagggugggaaccgcaucacuguggucucuacccaucauggagacccucucacucacucacucgcccacucacucacagugugaccuugggaagccacugaacugaucuagucucucucccauaaaauggacuaaugguugcaucucccccgagagcuuggcagaaggguuaaaauuaauauguacugaaugcuauugauuauauaaaguuauuauaugugaaggacauguaacuguggcugauacuugcuggacacaauguaaagauuuauuagauaaguuagucauggcuuggauguacacaagaugaagcuagaggcucaggguccuauauagcaggggcuuuaaguccgaugcucugacucccaguagauccucucucugacuuagggccuggcuaguggaggagaggauacagugaugucaucuccugcccaucaguagaucugaccucaguuucuucaguggcaauggaagguauguaagaaaaccagccuuacuugacguguuauaaaacaguaacuaaguuaacugagcuccuaccaugucaugugucaggcaggcccucugcuaagugcuuuacugucacaggaucacuucaugaaacccuuacaaguuuagagguggguauucuguucuauagaggaucagggaggugaaaagaaaaacaaaaauccuguccaacaucacaaagcuaauaagggaugagcuagaaucugaauuaaggucugccuaaaccuacaaccaaagaugaugauguccuugaagccauuguacuuaggggugggucaauaaagagggugcuggccugagcucuaccuacccacuccagguuuagccaccaaacagccuuccgcuagauaucagcuuggcccaggaacugagugauggcaaagacagaaaagugacuguugggaugaggggacccuggaaggagguagcagggcaccagccugagacuggauguccagaugugaagaagggaaacggacuggaucaggcaccugccuauauaacauacugcaaaccuaaagacucagacacagccauuauaccuaccuccugcuccuccugacaugauccagaaucaucugguuccucuugggcccacuuguccccccuuccugcaucuccaauggcagcagcuuugggggaacagucuccccuggggccugaugcugugcucagucgcuguuuaugagaaggaaacaaggccggcugcguuuucuaaagaggcuccagggaacugcagcugcgugccaggguuucaggccucccaggauucucuguuguuggagcugggacagugagcauggccagucacggcccuguggaggggaugcaaggagggugugcccacuauuggaaacaauauguuccacuuggggcugguugagcguuuguccuggagaugacucugagcucagagcugggacugugagggacuagagugauccucagcacccugggguuccugaaacacaggggccucccuucucagguaagcaagaggccuguggaacagggucugacauccucuaguugggaagcccccuccuuauagugacacugaguccucccuugggaggaaggaaacagggagggacgguauuccaacagggaagguacucuguaagagggccagagccuuugccgccugucaggaguucugaacaguuaagggguacaaguuggggaugagaagaaagauauggguaaaaagguugguuguaaagggcuuaggcaacauaccaagagcuugugucuucugcuaaaugcagcaaagaaccccuggaggaaauugucuggucugauuacucugggacuaacucuccccauccagcccuccugagcacugcagugggcuugucugagauuccacucuggaaccagagaacaguguagcccggggaagucaggcacaauauagagggcaucugaguucccuacccugaccccggaucaaccagucuccucuccacuccacaaacacuugugucagacaugauaagaaagacauaucaggaaucaagcagguuuauguaauuaaucacgucgauuaacagaaagggaaagauuaaaugaucauccuaacugacacuguaaaugaauuuaguagacuggacaucagcucugcuaaaacucaguaaaaauaaaaauaaaaauuuccuugacacaauaaaaaaaauacaucugcagccaacaucagcaucauucuugguaauaaaacacuaucggggggccuucauauuuaagucacagugggacaaggaagccugcuauuaccauaauuauguuacauuguucuggaaguuuaagccaauacauuauuacauuaaaagagaaaaagaaguguaacauuugaaaaggaagagaaauugcugucauuauuuguacaugauaggauuguuuauucagaaagcucaagagaaucaacugaagaacuaauaacagaggggagaagaggucaggaaaauggccagggucagaacgauacacuagcaacacccagucggagaacauuaggacaaagaaaaacaggagcuccagaaugaauguagcaaugacuaaaggguauuugagguucaagaauaagcccucggaggcuggaguauggcucaggggugggggcugggguacagcucaguggugcugggguauauaggucaggggugggggcugggauaagcucaagggguucugggguauagcuaagugguggagaauaggguacggcgcaguugugggggcugggguauagcucaguggugggggcugggguauagcucagugauggaggcuaggguacagcucaguggugggggcugggguacagcucaggagugagugcuggggaauggcucagugguagaggcugggguauaacucagggguggggguuaggguacagcucagugguggaggcugggguauuaguuggugcuugaggaugagguagggcucaguggcagagccuggccuuagcacaaggccuuguguucauccaguaccaaaagagaaacggaaauaauaaagguauagcucaguggucaggguacuugccuagcacgcaugaaggccuugguugauuccuagcaccccaaaaaacugccauauaggcuaaagagauagcuuagugagguacgugccuuccaaguauggggauauggauuugaucccuagacccgauguuaugagagggcuuguaaucccagcagaggggaacagguaggucccuggaccucacuggucagcugaacuagccuacuuggugaguucuguuuagcaaagagacccugucuaaaaauaaaaagguagauggcacccgaggaacaccaccaaagauuguccucugacccucccauguugggggcacacauaaacauguggacacacaugggcauggugacacaaaccuguaacuccauugcucagagcuuagaggcagggugaucagaaauccagagucauccucagcuauacugugaacuagaggucagccugggcuauagaugauuuuguc

SEQ ID NO: 5143 - RNA, 11695 nt, Mus musculus
aucugguuguuuaggaugagcuuucugaaggcuuuggggccugugggccccggauccuuaaguguuuaugaauuuuauuaugacuguguuuguuuaaauauauauauauauuuauaccucuaugcaucccccgcccccccccccaagccccuaguucuugcccuuagcuuucuguuugguggccguauagggcagcacugucugcgugcucuugucugauacugucugagugcugcuguuccuugugacccuccgggucuguucuggggccaacguggggcccaagcgucggguggucaacggagagcgcuuggucuuguagggggcuggggagggcuugagggggccuguguguggcuccacgcggggcagcucuggggccaggucccccuccuccuccuccucucccuccucaccaucccccucuucaucgucacagcacagagcaugguagagcacuuugucacugaaccguacccucucccucgucccuggaguccgcuggggcaccuggcccuuugcagggccagcacugaaggccucuucacuggaggagucuggugucuccacucguggcccguuggggaugggcaaaccaccauucaugagcugguagucagggccugugccuggccguggcgccucggggccauccaccgagucugaugggguggagacauccaggaaagaacagaacucccagcugucugagaggauaucagccgucaugaaguccagguggcccaggucaaaggggccgcccacaccugccuugucacugcuggaggugcugcucacaguggccgugguccagucaucuggcuccaguucaaagucaaagucagagguuagcuugucgaucugacucaccaccuggccggggaagggagaggaggugagaggggcuaggugggacucagaauuaccuaggugugugugugugugugugugugugugugugugugugugugugugugugugugagagagagagagagagagagagagagagagagagagagagagagagagagagcacuagcuccuagcccauugacucugaaagguacugcuugaacugaagucacacaaguuuguuuguacuguuaagaauccaaauuggggcugagaauacaguucagcugguaaagugcuugaguuugacuucuauaacccaucuuaaaaaaaaaaaaaaagcugggcaugguagugcaugcuuauaauccuaccuuggggaagcaggaggaucccuggggcuugcuggccagccagccaagccuacuuggcgaguuacagacuacuaagaggcuguuucaaacacacacaaggccaaauugcacaaggaugggccacuuguucagaccacccccuuaguccccuggagggaggcguaccaccuuucaccagacacccugucuauccauauaucauuuccucuugaguacagcugcuaucuggggugaggauaguauagugaucagaguuucaagcucauucugauggaaaaggggucgaauaaaagaggucagcaggcccugaaaaccaugcccuggggacccccuagcugcaugaccauaacacagucaguggagacaaaagacaagggacagucauaaaaacaagaccccgcccagcaucuuggaacccucacuggcaccaguuaaugacucauuccgggaucucuuuccaacacuggggacuggaccaacagguguguggcacuggcugagucacccucccuuucucguacccucaugcucugcaaccuccucccuccuugccuuccuuguccauugaugaauggagaucaauccaggcuugcuggagaaaagaagaaagccuggaaucuuuggaagugauaaagagaacauccacccuggcccagagacaauuguuagaaccacucaaggggcagcucaccaguggaggccacuguacccuacucugccugcccaccucccacccacccaaagggaagcccuuggucucugagcaggcagccccuccugcagauacacagucaccuuugcuguugucugcagugagagagggagacagauuaggcaaaggccuaggggggaguaaggagcaugaggauggagggaggagauccaggccagaacucaaacauaaaacaaugaaaaccaguggagggaacaagugucagagccacagagacucagggacaaagccaugugguaagccaucaggaacugcaucuagcuucuagcaucucgcggcguuaucugccuggguucagggaggucaguuaguaaguuaacuaaguuaaguccuaacccauaacucauuccugggaacugcuaccacgagaugcugcuccaggccuggugaggggugggugggaaguggcccagcauaaagcacaaaacaaagacacuaccugcagcaccugggccagugggagaugggcucuagauacaagugaccugacugucccuaccccucuucaggucuguuuuucaaucuuuaaggaagacucuaggaaucuguaagacacaguaugagaagauauuuaggccugcuacaaacuggaggaaucaggacccccuggugacuuugggcaagucaccuaagcuggcuggaacucaaugucauuuaccacugagugucuaaccaaugucagcagagcuuuacagggaggucuuggaggagccccaagaucaaagugaugucauuuccuaccucagaucaaaucauuagcucuacagccuugagaucauaaagcucccaggugcugucucuuuggccugguggcugggugcuggggcagucugaggaguggcucugccauucagacagccgcaugcucagaugggacucugauuagugagagcugucagcagcugcuucagcccaaggcugagggugccaggaggaagcuggaguugaauggcuuggcugaaaucccacagacucagcaggaaugagcacuaucaggacccaggccugagggauagcaggggugucccagguauauccagcagaagccuagaagcccaggaacccagacauacuucuuucacugaggaagcccuggcugggcaccuguucuagcagccuuuccauugggucccuucccuucugcauuagcauccucuuuugguucugcaucaggguuuggagggagagugagcagggaggcgguuuuuaggucucaugucugcccccucuuggcgguggaauugaaggaagaugauaauccacuuucaaauuguauucucuagcuuugacaccccucuccuugcucagggagaugaacacggaagagauauaaacauauuugaaaugacaguguuagggcagccaaaaccuuuaguaccugggcucugaagccagagcuggacuccagcccugacuucacuacuuaugagcaaccuuaaucaagucucaacuuccuucugccugccugagagcugcugugaggacuuaagcuaaugccccugggaaaguaugcagaagaguguaaaacacaggcauccaccaugcaccagugaacaugagcacacagccaggaccaggagcagacggaaaucaggguuucaccuaagagaugccacaaugacgggcauguuucagagccuguucagaaugccaggauacgguagugcgucuuccauagcccaugugccaguacugcccauuuugccugaagcgugggugugcccauucagaacaugacuacaagaggucccugaggcccauggcugcgaggcucacaggcagaucuggcuucccaacuacuuaauggacagaagugagggugagaaagggaagccauguacccgcagaacccaucuucugaggaggccaagaucagcucauaaaccugcuaauccuuuccuggcacaccguuucacaggucaacauggagagcaaguguggaauaggcccgugcuaccugacucucugaucuggcugucuugaaaucugugauuucucucugagauuuaauaaucauuuugccuacauguaauuugggauugucuuggaguacagagaaauaauuauauacacagaaggaaagagggggagaaagaaccagaaaaaucucaaagcuggggcacaagagagacacugaugaguuaacugcgcuauugugcuugcugacagggaaacugaggccuagugcguggaaagagcugagguaaagccagaaggggaguccugggucuggcaucuuacuaacaagauuaaacuguuccagaggggccaagagggagcacuguggagggacaggagaacugagggccgagacagaacccagccccuguuccaggggugccucucaccucugucuugaucucagccuugccuauuuaauccccccccccaauaauuuccuguuugugcuugguucaugcucugcauuagagcuuuccugaucagcaucaggaccacaucaccccucugccucuagccuuucccuuuuccaaaaccuccugagcuuuccaaacaccaccccuuuuccccuccagcaaguggccucccccucaucucucugcacaucucccagagcuggagcuccagcugccacuagauucaccuggugugcccucccucccaccaucauccucacuuccuggaggaagccugcugguccccagcugagggcgauauuggucacaguuacacaucuauguugugauacaguuggcggcugccucccuacuagacaggaagccuaagaaagacagguggggucugucuguuucaccuaccaugaggcuccuggguugguacagaugcuggcccacucuacauacacagcugaaagaaggcagggagggggcaugagugcauguguuugugcgugcacauguaugugcacuccugcuugccugugcgugcguacacacaugggcgcacaugccuugaugcucaagagccagugcugagggacccagcauugcagacccagugucccacuccuucccuccuucccggcucccugggcagucgguuacauaacuggggauccugcauuauuuaugaccacugauuauuuuuuaauucugugauuacauuguuuauuaucuuccuggggggcuguggcauuggggagauggggauugagcugaccaugauucauggcucucauccugcaauuuggccuaauuggcuagggagccucugugaaucuguccggaggaagagaaagcaaaggagaaaaaggaagaaagaaaagcacggacaaaauaauaaggaaaaaaauccaccugaguuuccuugagcugcggguacuaagcugacccacuuuggcgcagcccuuugguccccaguuucuccugcuccagcugcuuccugguaggccacauuuauuuaucucuuacuagcaaggccuguggcuuucccugucaccuuuacacauggcaccuggccgauggacagcugugaaacaggcugccacgcgccuguuuccuaugcgaagccggugggauccuccacugccaccucaggcugaggaggggcugugccuaccccauucuccugagacuccugggacacagagauuacagcaccccuacguuauuuccuacucaagacucacgggagauguggggguacagguggcuaauaaaggaucgcuuuuaaacucccaccuccacccccaccccccauggaacaggaagaaucgaguccauguucaaggugagcucagaaccugguggguuaaggauaaggaccccuucacccugccaugggaguucagagucugugggcagcaggcagaacaguagcaaggcagggacauaaccaagauauauuauuaaagugugugggcuucucacugacagcaaacuuggaguuccacacucugaugcacagggccuaugggaugcccugcccuccccccaccccgagaccccugcccuucuuugcuccacuucccaccagcuucccgucccuccuccagauccugguaucacagcucccaccacucucuuucccuagaugccugcuaacccugccccucaucucuaugcugcaaaaccacuuuauagaugucagucucucuccaguccucacuggguagggggcugaacugccuacugcaggugacccauuagaggccccuaccaacgccaggaccuggcccugaccugccugcuuuuggcuaaaaugcugauguaagacucugggaaacaagggaagagcauggaagugcuagacucauucagaaacgauaccuugugggcagcugaggccuagcacuaugggagagcaccugcuuagcauguauggcugggcccuagguuugauaccuaacacugcaaagcagaaaaugaaacaagaaggacguggcuuugugacuguucuacgugauuuauguaagggagcauagaaauguuuggcaucuuccuuuuacagaugggcugacagaagcacagagaagcaaagugacuuucccaagcucauacagcucaggagguggagcacugaggaccaaacgcuggcugccuggccuaugcucucugucccuuggcauggucugucucuaauggagauccauggaaucuggggaguuuauggaaccugcugggauuggccuggcauccuggaguauuaaggaaccagggagaacaagggcuaauuaauaucuguaguucaugccccaacccuggacacuucaguuccagcuuucagagugcuuuugcauucccuacaucccuuagucccccaucccuacccacggagcugaugacagagcugugguggggauugggaggguggacagaggaaacucaaauucucuguaagugcgagcggguauuggcccuccuccugcaugcuaugucuccaaugucaccauguuggauaucauuugcagcaucccugucagggacaaggcgucagugccuucuguucggagaggagcaaagggaggcucaugggcuuagagcagagggcuuuggaggcuuucaucuucuggucaguuucaggcuuuguacucaggaaugugugugugggugucuuccagggcuagcggugacuggcagggaagaggagguacagacaggaggacggugagcggaggacagagaaucgcagggcccacuucucacugccuggcuccuucaacaagguuccugugcaguaccccugccagcccuguuugcaacacuugucuccauacucaaguauuaggucugagcuggcagguacugcccaugacaucggauaugauggggagauaggggaugguucauccuaccauggucucaccacagcccugauagagaagcacuaugaagggccugaauggagcucagaucagcuuuauguucuccugaaggaccuagagcuacagcagaaguuugaaaccaggaccugagauccauagauacuccuguccccaacaaccuccagcccaugggaaguugguuaugacaucucuccucuguuugggucucccuuccucucugcccagcacccuaugugcauauccccuuucugggggauuagggagcucagaggcucaacccccacccagcuggguaccauuggcagcgggcaggcaguggcauacgggguagacucugguuuccauagcaaccugccaaagucuuggggggagacacauggccuacagaugugggggaggggacccaucacucuguccuggcucagaccuccaggguguacagacuaucaccuggagugcugggaugaggagcauggggaucaguaaguaugaaagggaugauggaggugucuacaagcuccaucaaguaacccuggcacuugggcaccacggcucaagcaucaggcaucucuuagaagcugucauaaugcugagguuacacaguagcccgccugccaaggcuucaaauaggcauugggaaucuugaguucuaggcucaaguuuguuauggauggguuguauggcucuaggcaagccccuauuccucucugggccccaguuucuucaauaguaaguggacagggcuugucugaacuaccugugagaucccuccaaguucuggaugacuacgcugaggaagaagaagcagcagucuggaaaaugccccauugggaguuguacugaggcugaccccucgggauuguagacaguauaggcuccuguuggguuccaugucccugcuugagauugagacuuuugauaguucccauggcccugauaaaacugcagagcauccagaauaagacagacuaggagaggacacccuaauccuucggcuucaugagaucagaggaaagguuguuuaggggcuguggucuuuggcauccaaacuguauuauggagcccagagcacagcagcccagccuaugggcagaagcacuaccaccucgaaguccugucuucagaggccugacuccaauucacagcucccuucaaacaaccccucgcccuggcuuggauucaggccaugcuggaaagccacagggcucaaagcuugccccucuccucaguuuccuacagccuccuuccccaaacacagcuggugggggagcuugaagccauaucucagaaugauccauucucccacuaucucugcaggggccuugguuacaagcaguugaaaguugccuaaagcccaccuggcuggugaaauggcacccagcgggcgaauucaggccagcggcucagaaugcuggucaugcauuuuggacuugaacacaacccagggggcaggguggaagacauguguaccucauuacuccagcaaugugggaagcaguaauuaaacuagguucugcuuagaaagacagagaggcuuucuccgugacuuuuuggucuuugcaaaaaaccacccagaagcauguccugcaagggggugggauggggguggggacucagcuccguuaaaaaaaaauuaaucuuuuuuuaaauguauguacagagaaggaccucugauccuuaccagaaucucccagccaccuuuuaacuccagggcagggagguuacagcuggucuuaacuccuccugcuuuuggaauaucugaucuuuugagcugauaaaucuuuuugagcugggccucaagcaaugaggauugaccagacagucauccacacucuccuagaguccuugcucagagucuaggagguaaacaguggggucaagggacagacaacuuggguuucagaagaaugugucccauuaagaauagaguagggcagauuuaguccucacugagcacccggaguacuaaccauagagaugggcccacugacagcugcucggucucugccacaccaaggccccaucaccagcucuggggauagggauuuuuaagcaaaccagauuugaaguaaggagaauggaaaggggaugggugcucaguggaaacaggccaugugcacauagcauugcacacucaagacacaggcaaaugcuuuacugcugagcccagccagucagggugaggggggucuguguggccccugcuggccucuuaacucaccucccucagcuccuuagccacuucuuugaguucucucaggaugccuucaaguugcccgaugaccaucuucaugcgcugucgaauccgcucucucucuccaccacuguuggggucgucacugggcugcccgagguccggggcaccccgaauguucauccuucaccacguggccgcaagccugcccauacucgccccagcggggcacacgcuucgucugccuccacggagccccccucggccgggcagagcuccacauuuuaacggccccccagccuacccuggccuugggcggcccucacccagccccugcagccugccacuccaccuacucgccucugggugggggauggagcacccagagggagacagagucugacagggugggaggggggucaaggugaggacacaggagggcaaggggaggggccuuagggcccaagaacagcuuccaggacuugaagugccuaugguguacagagcugaucuuugcccgaaucuggaugcggaggcagggggaugauucugcaaggacuaaggguaagagaugcccuugggaugggggaaggcagcaauccccucgcaacuccuaggcaguuacaaaggcagaggucucuagaugcagcugaaccagcacagggacggugaucaggaucuuccagauguggagggggcuccagaugugaacagcacuggagagggaacuggauuggaggagggcagcccccugcagaaagagcgagccuggcgucagcccucccaggcugcugcaccagccugcugcugcugccucccucuucucucugccugcacccuccuuccuagcuggagauuuauuuauuuauuuauuuauuuauuuauuuaguggggaggggugguggaggcagauaguuuucaacacccuucuucaacagaagaguggaggagccccuguuuuagaggaaugagcccuuagccuccucuggagcacucuagccguggugcaccccccgcccccagccaccaaccaagcuuggccagacugguuuagcacagggccucuccagcucuccaaccuucuuucaaugcccacagggugcccuccuucccagaggacccuuucucccccaaccccgccuucccuccgaacccuccgaagcuggacuccccuacucaccaagggugggggcaguggccuuuccucuaagcagugucggggccgagccacaagacgagguuggggggcccccaaggcucccuagggcgggcuucucucucuggacccuucggcuccuggccucaggaaggucuuccgagcggugaccggagacaucugggcggugggagggggcggggccuccgcgcuccggggaagggggcaaaaaaaaaaaauccccaaaaaucuccucaccacgcucgccaggcucccggucgcgaggguccggcgagcucggaggccccgaggccacaggugacccgagccgaggugacaccgguccgguccaggcgacuaagccaaagucggagggcuggggagggcgccgggauccccucagcccacgcccggcauuccccgggcuccacaggguucgcgauucucucuguccauucuagaugggcaggucugagccccuccggggucuguccugccuuugccuugcucugcccuucccgagcuggcacugcuagguguccgggguguacucagccgggacccagaauguccgugcuccggcccgggcgacgucuggagcggccgcagaaaccgcucaguccagcccggcagucggcuccaucaacgguggggaaaguccggauuccuucgcgucucgggggaggggaagcagccguggccagggggacccggugucgagcacagcggagaugagugcacgaggucgggggggccucagcacggcggggcucagccgaggaagcaaaggaaagcagaagggggcgagcgagacgccagggaggcgauggaggaggcgcgccgggcccggccaggcacaccgggcgcgcagccuccgcucggcuccaccgccuccagcgcgcucgcucacggcuccgcgccucgcggcccggggcgccggguagcugccgauggggcaaacgaggcaccggggcugcucgggccuuucuccccggcugcuucgcccucgcccugcccugcccugcccugcccacccggcuccgcgggccuggcccgcuuaccccgagcgccgccgcgccccgccggacuggccgcccggccgggcgcaggcucccucaaag

SEQ ID NO: 5144 - RNA, 161765 nt, Mus musculus
cgccccccucgcucuaccgugaggagcccgagucggcggcggguggcggcgccuggaaccuggagagaccgagccaccccccggcucucggccggaauguacugauucuccucugcucuccuccccgccccgcugcaggagggaggcgcccggagucuuucccccugggcgcgcgagggggccgcgcgggccgggccgggccgggcuggagccgagcccugcggcgcagagaccggcugaggcgcgcugagggaagggcgcgagcgcuccgcggcgcuaucgccgccgccgccgccgccacucgugggguagagauggcggcggagcgcgaagccgggcgacuccucugcaccuccuccucccggcgcugcuguccgccaccgccgcugcugcuguugcugccgcugcugcugcugcucggacgcccggcguccggcgccgcggccacgaagagcggcuccccgccgcaguccgcagguaagucgggccgggcccgggacgccgugggggcuggggcgcggcaccggcucccguggccgcugcgguggguuuuuguuguuguuuaggauccagaggggaacgugcgggaacuuuuccuccucggcucccguugcuggagagaaaagggucucgcgugguggaaagcggagcaggcaggagggguuccuaccgggggaggggcgccuccgggauccgggccggagcucugggguccaguucugcgcuuuguaccgggaggcagguucaccccucgccucuuuccccucccccaggcucaucccacuuguaagagugggacauucuugugcucacacaagcaccaguagaggccacuacacaccucauuagauaaacaaucguacagccaauucauuaauuuucaggaagggauggaggagggggcuugaauucauucucuucacccuccaucccccucggccauggguugcccagcuucugaaguccagggaagcgcugucggaucucgagggacucuucgcucagugauuggagccugggucuucaggagagggggugcuaaggggcauacuagccccuucaugaucagaucagugguguugacuuagccuuguggacgccuuggagagcggcuccaagugauucugugaaguagugccucuuuacuagggauuuaacuauauuucuauguaacccacucucaacuucugaaaaauuucagacaucggauuuuuaaggauuugucuaauugucucuaugugacuauauauguauauguguguguauacacacacacacacacacauacacauauauacacauauauguguauauauauucagcaucuuuuuuuuuucuguguguuucaugcauuccuggagucaccagcauucuuacauauuuaagggugccaauugacacaucgccaagccucugauaguugagcaggguucacucggcucuugaagagcaaauugacaugugcuuugcuaaccucguuuaccuaagguggugugccauauaacuugaagaaacuuucacucacuuuguggagauuuagauuuuuaauacgaaggucaccugaucagacacaauggcaacuuguaauugcuaaaccaaaaacguguuucccucugauuguuaugaaaucauuaaaaucacuucgaaaugugauuugcugauaaaguuuguuauuuugcauuuuguguguauguguauagagcucacaacuugccaguguuaacaguuuuaaacccacacuaguauauauuauuuaagcugcuaaacaggaguguuaauguuaaguuaggaucacugaugugauaggcauuugcacauuuaucuuguacaaaguuuggggcacaguuuucagaccuucaguguaaguaccugaauaguuucuuuucaugggaaugggaaagagaaauguauaaauuuuggaaaacaaguuccucuuuuuuuuuuaaauuucuuaugaaaauuuauauacagcugauuguauguguauuugaggucauagcuggaguuuguguuuaaaguuuuggcagagacuuuuuaaaguuaacaaaagcuuaaacaaugcuagaauuuagaaauuuguuuuacauuuuauuauucugucugucugucugucugucaugcguguguguuugugccugugccauggcaugcugugugcuagucagaggacaucuucggaggagucacuacucuuuccagcaugcagguccuggggagugaacucagcuccucaggcuuggaggcccauuaaagcagucacuuagaaagggaucuuaacgucugcuuuagcaugaauucaaucagugagguuuuauuuugcaaugaugagaugggagacauuugcucucugccuuuauggaguuggcaguccagcauguagguagggaccauagcugcucagcuagaauuacauaguuaagugauugugauaagcacugcaaaauagaguagguuuugaggaagugugagcuggcgugauuuaccuagucagugccagaguucucgaucugagauggugauggguggagguuaguuagaaggcucacaguuaauuaguaguggauagagucuagagcacaggucugauucucccucauaggccuuuuuauuuucauuccaaaauauuuucuguugaccccucugucucauuacaaaaaugauaaaaaaaaaaaaaaaaaucacugcagugagcaggggcugaucuguuccguccugagcugugggaagagaucaggagauggagagcugagucagcagucuugggucaggcugucuguaaaucagauaucauuuguuaguauugcuuauuuugaagacgauaaauuugacuuuuuuuuuugguaggagagagaugauauucaguaguaagagaaaaauagaugugugggaacagaacaaaugaguguucuacccucuuaggauggacauuuggacacguggaagaagaggaaaaagcaaaugagauuaugguagaaggugguuagcaguggggaggaugggaagugaguaagcacacagucaggcuaaacagcuuuguagugauccuugggggagacagauugacugagcacccugugaauugcaagugcucucaguugacauucuucauagaggaccccacacauucugacaggcauuuacuugacuugacacauuaccucauaagguggucuguuucuguuuuuaauaaugucuguuagaaaaccuugcuucacauugagagugauauucagucucccacucuugaguuuuagcucuucccucgccuuuaucaguaucagcaugcauagcuugacuuaguguuugcuuuccccaugguuucugcuuuuguuuuucacauuuucuuuuacucacuuaaauacugauuccuaauguugucuccuucuuuccugucuuuugacucuccugguucucuccccucucccucucucuauuugguagccucauugaugcagguccaaaggcagacucacauuugcuccucuuuccucuucuuccuccaucccucuuucucagugucagugaaccagucccuggccaggucucugacaugguuagagugguuagaaugauugcauggauuugacuuguaacaccugcuguaaccaucacuguccaagugcucuccugaauuaagaucuagaaaaccuuauucugguugaucuuugccuccuagggauuccuucugucuguaccuuuucaucuuuauccacaccugaacuagcaauagcaacacuguaauaaaucucuuugccucaacaguuauccuguaggugugucuuccuaucggagagauccuucugagcaacguuucuaaggguggaacucccacugaaaaugucuuacuaauaaguauuccauaguuccuuguucuaaaaauccuugggauggagauugugagauccugugcguucguuaacacucuccaccaaucccaguuuaaauuagucuccucucaucacuccuauguguacccuuuguucucccacuccagauuaauugcagagcuuucugccuucaggcuuuugcacaugcuguccuuuuuuuuuuuuuucccuguuaaagcuacaucguacuucuuuagcuccuaucuuaucggggaaacuuuuuuuuuuuuucuauuggcuucucccccagagaguuuaaugguugcuguucucccuguuccuguagcuuuuaaaauacuuuucauuuucuauuacuuauuuucuugucaccuuugauugucuuaaccucuggaggauuggcacuugacuuacuugucacuugacuuacuugucuuaauauccguguucuaucugacgcauccaugaggcuaguugugcuggcugguuaguuguuaacgugacaucagcuagagucaucuggaaagacaaaaaccucaguugagaaaaaugcuuccauuagauuggccuguaggcaacugugugugugugugugugugugugugucuugaauuuucucauauaagaaagcugucugagcaagccaugaggagcaagccaguaagcagcaugccuccauaggcuucaguuccugacucuaggcuccugcuuugaguucaugcccugacuucccuaacugauagauuaugaccuggaaauuguaagaugaaauuaauccuuuucuuccaaguuguuuuuguucauggugcuuaucacaguaauagaaacaacuaggaugcuagauaaccaguaaauguuuguugaguuauguuuggcuguuuuugaacugcugggccauagaacaugauuccuuuauauguuugcggacagauucauguguagggugugcaugugugacaguuguuccguucucuccccaucccucuucagccacucuuaacagauuuucugacccuuuaugaacuugaucauucucuuaaguacccugccauuuuaauauuugucaguuuugucauuuguagaaggauaauugacuuuuccugaguuguauagaaaagaagucauauauuuuugggguggugaaugcacauaagagauaagaaaugugcuccuuagcaaauugucugaaaauuaguauaucaugugagaugaagaaagaacuuucaugugaaagcaaggaauggguguaugacucaugguucuacagcuauaaguauauccauaaauuggggccacaggcaggcaagaacaguaccuuuccuaccuaaauggauugccaggaaaaugagaugugaaguugcuuauaaacuccauuauauuuguguagaauagacuuaauaguucuuguuuagcuuuagaaaugaaagugugauuuaguuuuuacuuuguaagauuuuauuuguguauguauuugugagggggaacggggagaaggggaagggagggcgaguguguguagaggacagaagacuacauuggaucgcucaauguaggugcugggaaucgaguuggguccuacaugagagcaguacuugcucuuaauugcagagccaucuuucuaguccuucccccucccccaaguuuuucuuuugucucaauugauuauuguuaguuuugccuuuuauauuuucucuauaucaagaaacauauuggggguuacaucaacacaucucuuuuaugaaggcucuguguaauagucuuuucccccagauacuuugauaagugauuuccauuuggugaguauggauacaauacuacagugcacccauaccaggagaacaguaggggcacugccuagagguguuguauccgucagagagcuggugagcugaguuugauuuaauugggaacacugucaagugaaauaugauuguaaaauggaggccaaauuuuggauuaauuuacaagaaagaguauuuugaucaaaaacauuuaugagacguugcuuuguaguugcugucuacuauaugacucauucuuuuacaucaugacugugagcuauguauaacuuuaaauguuuucccuaaauuuaauguguuucuuuuuuuuuugccacauuaucuuuaaaccauuuuauuuuuaagacuuauuuuaaaaauacauguuaguuugcaguuaacuguauagaauuguaaguuuaauuaaucucauuuuuaacaauuuuaaguauuuguagcaauuuuaaguauuuucuuuccuguauauguauauaguuuucuuuuuuagacauaagcagaauuauacaauuaauuauuuucagcauguauuuuuuuagucuuacuauuggagaucuuuccuaucagugcacauagauuuuuuuuucauaacuguuauuugagauagcuguguauuuuggaaaaugaguauaauacuuacaguggucaauaaaaguguuacuuauagaacagucaaaguguuugaggcuguguaccagucucuucuaucuguauuuuuguauugaauguaagaguaauguuauuguacaccaugcaaagacuguccuuguaucauucaaaugcugguuucucugccucugcugacuucuguguccaguuacaaucaaacauggcauuguaaugcuuuuauucuaagagucuccauguuguguaaauauugcuccccauuuauucccugauuugucaauaaaagcugauuagccaaugacugagcagggggagaauagggcugggcuuccuaucccagucagccaagggggagggaagggagagagaggaagaggaauaggaggagaagaaggagaaagaggagaaagaggaggaagagagauuugccaugaggaaagaguuggagaggcaccaugagaacacaucugaagcagagagagcaagaccacuacuaaaauacaaguauuaucuuggggauuuuggcugggagguagccagauuagcucagaggaauagaauagauuaauaacuuugauuucccauauauggguucauugcuaagaagauguuucuguguaucugcagggucaggguuuaugauuguuagcguuaauguggauggcaccauuccucgacugggauccuggucuguaguagaaaagggaacugagcgccauccugcauucucucuuccuuauuaugaauguuagguggucagcagcaccaaaaucuuaccacuugaauucucugccaugauggacugcaccuuugaacugugagccaaaauaaauccuuucuccaauaaguuguuuuaucaggguaucuuucucauagaacugggagaagaaguuaagucacaguuccauucacuguaguccacuacugguagguuaugcacuugaacaucccacugcugggauguagcugaaggccccuacuacaccacauacaaacaaaacaacaaaaccuauugaccaaaacauuuacaacuugucuaacauguuuuuaccuuuaauugugcauauuucauacuaaauuuuuaaaauuuuaguugcagauacuguagucuuuguuuugucuguuaguugguuaggaugcuagguuaguugguuaggauggaguggguuaauagauagucuaaagcguccuucuacuauguccuucuacucuuugucugcaguauauaacggagcaauggcuucaucucagcuaaaugacuuucauguaguuuuuguauuugaaaacuggugguuucugguuugaugugaaaauuaaccuuuugucauucucuaagacguaauuauauaucuuuuccuggucuaaaguaaggugugauugggaaaaucuuuucauugcuuauaaaugauuauaugugauuucauuuuauauguguaaaaauuagcuucaggguuggguucaugaaacacaagcucaguguuaaguagugaaacauuuaaguuauaguauuucuagaaauaauauuacuugaaugagcagguuuugcugccuuuucuaacgauguaguuuuauauuuuaauuuuugagacagggucucuuuauuuagccuagacuggccuuaagcuugucaucuccugcccugggcucccgagugcugcuggaauuauggacauauaugaacaaccaugucuaguuuauagauauuguugugauaaaaucaguguuugaauaauuuguuauaaggaguuagcaucuggguagucuucauauaagguuguaaguuuuaacauuuaaagguuagaaguaaccuuuaaaugauuuuauggcugagcuggagcucacucugugugccacucuggccuagaacuuaagagauccaccugccucccaagugcugggauuaaacuaccaccaucuaggucagcaagaauuuuuaguuuuucagucagacaguucuuccagagcuaaagauuuaaauacuuuuuacucauugcaaacacauaucuuugagccauacacucuggagauagauagguaagaugaaauggauguguucucuguguuuaggaagccuugggucuaauggcugagaugagacagguaauagguaacuugauuuggagcaaacacuauuuuugcuacagguggaaagcguucuggaaucacugugucagcgcugaucaagcgacagugcugcugcuuucagaacucuggaucuggaucuuuaguccuaguuuaggaagccagugaacagcagcucuccaguguaaauuacuuacucucucucucuuucuuucuuucuuucuuucuuuuuuuuuuuuuucaagacaggguuucucuguguaguccuggcuguccuggagcucacucuguagaccaggcuggccucgaacucagaaauccgccugccucugccucccaagugcugggauuaaaggcaugcgccaccacgcccggcuacuuuuuguuucuugagagugauuccugaaaugugugcauauaugaggaucucauaaaaaagucaccuggaguucaacuacuacagugucuuuuggauuauguaccacuguaugugugcaugugcaugugcgugugugugcaugugugcuguuaauacugagaguuagacuuguggcuuugcagguuggaugcagccugaaccuuucuucuauaaaucuggagacagauuguucuguuuguuuguuuguuuguuuuguuguuguuuuguuuuuccaugacugauuauuaguugacaauacuugguaaaaucuuacugaggguuccugagcagaauuuuaaaaauaauacuucauagaaauugaauagagacuguuuuucuguugcagaaugauauauaaaguauaguuaacaaaaugucauuacaguuaacaauucaggaauagaauaauaaauuguaaauuucauauaauuuuuaacauaacuaaauguaauaacuaaaauuugaacaucuuguuggcuaauucuugaaaacuugaaauuugagugugguaguuuuagauuuguguauuguguucaaggcacugugcacagacaugcuuugacaguggccuccuuuauaaauagcaccagaacuacauugaacucaaccuuuaugaucuucauguaacugaagaacaggacuaagggagguuuugaaguccaugcaucaugcaaguuucucagucccagaguucucccuuuugaucuuaccuuuauuauaagcacuuuuaacagucaggacaaucuaguuccaaaugcauagcugaccagaaguggggaggauugucuugggauguucuugaccacaggagagguggugagguccuguuuuuuuuucucuucugguuuuuauuucucuggccauggcauuuaucuuuauggacaacauugcuaaacccuauuguuaauuggaauuuuaauuuuuguguaaaguuaacuguugauuugacucuaauuuuuaaaaaaaauuauaaaaauuugaauaaauguauaaaauaaaaugugaaaucauacuccaggccuguccucagagguaauaacuuuuaauaaugcagauuuuacauuauauguguauaauuaaauacuuaagcaauacaucuauaacaaauggcaaguuggauuaugauguacguguuauuuaucgacuuguuuuaggaccucuuuuuuagaugagugcauuguaucauaguuguuugauagccauauggcauucuguuaauauagucuauuuuguuaauauagucuaaucgguuaaguuguuuucugaugcccccaaauuucugauuguuaacaaaugauauaaugagccuacguuuuauaaauguauauguuuauaucaaauaaguguggaaguauaagauagaacauuuauauuaaaaaucaucuuugauuauauauguguuucuauguauuaauuuuugguaguuauuugcaaaucauuuguuuaaaaguugauucuuagcaacaaaugagagagucuguuucucuacacccuugccuauaaaugauucauguccagacuucauaauuuuugccagcuugacagaugaaaacagaagugucucuauguaucuguuuauuuuguaugauguuugugaaugcugccccacauaugcugugguacucguguggaugccagagaacagccuuagguguuggucuuacuuuucuggcuugccuggugcaggauccuuuaguuguuugcagcugugcaugccaggcaggauggccugcaagccuuuuagguucuguuucuuguuuuccaucuugccuuaggagcacugggauuguagauguucauuacugcaccuccuggcuuucuguuuguuuugaggauuuaaagucagaauggcauucuugcacagugagagcuuuacccaucagcuaucuccccaacccuugguuuugcauuuacuaauagaauuagcaccuucucagguuuuaauugaugauuuauauugcuucugagaauuaucuauuuuuuguuuauuuuuguuuguuuuuuguuuucauauuuuccucccccucuucagaguuuaaugauagagcuguauguacguuuuuguuacaagggaaaauggaguuuccucuuuuggguccuuaguguugucacccaccaugaugugauguaguaaagggauuuuugcuagagucagcacugauuguuagcgaaauaaacuucuuuauaagccacccagcuucagguauuucauuaucaugaaacuaaaugaacuaaugcagagggcagggcauaauuucuauuuuggacacuuugaaccuaaaauuuaggucaguacaauguguuuguaacuauugcagaaccggagaucuggugagagguaugggauggcauuuauuuauuuauuuaagauuuacuuauuauauguaaguacacgcuguagcuaucuucagacacaccagaagagggcaucagaccucauuacagaugauugugagccaccaugugguuacugggaauugaacucaggaccucuggaagaacagucagugcucuuaacgucugagccaucucgccagcccugguccaggucuuauuagauaaagaugaucauaguuuaugucaugagaauagaucugcuuagaaagggggaaaacaacaucagcaacaaaauccaaccuggaguaaauacuuaggaaagcaucaguaguuggguuuacaaagaaaggaaaacaugcuauguuugcagcgauuaguaccaaagcagggugagugccuagaauagggacagggucacacauagagcuuuacuucaccuacagagagguucuuauuuuguuuuguuuuugagaaauaucuguauaaauaaguggacuagugcuaaaauaauguuaguucuuuuucuaaacucuguagucacauucuuggccucagaguuugagugcuaggcaagaagagugaagguuacaaggacuauacugguaaauucuuuacauuaaaugacaguuauaacaacuuaccacccacccuguugugcugagguaaacaaugaguugauauauaugguguuuaggacagagccugguuaucuuaaucgcccauuaaacauaaacuguuguuccuguuguuuuguucuauacuagauugagagguuaucgaaaaagacaugaaaguuagauaacacugauguagccugguuuauguuuuuaucugauggcuuugugcaauuagacuguuaagugaguguguuugugauggggaggauaagcauuuguuuauucuuggguggucagcuggcucucaggaucggagcugagagugagauggaggguaacggcaaaaagagcaaaauacuacugagcagcaaauuaaucucccucccucccucccucccucccucccucccuccuuuccucccucccucccucccuuucuuuuuuauuuuuugagacagaguuucaaucaggccugggauucacauuguagcccaaacaaggcuugaaccuggcguuccuucugccucgguguucccugugcuggguuuacagacaugagacaccaccacacaggcauacccacccuggggccuucuugugaccuaggauaacaguagauucaaaacaaaaauuguaaauuuucuuuaacauuagauuuuuguuguugauuuuuguuguuuuuguugucauauuaguguuucugaagugugaguuuuacagaugacaguguccuguugcaaagccaaaaguugacacaugccuauaaucauuuuugaaaaguuuauuuuuauuauaaaaguguaucauuuguuacguaauggauagguaguuauucagugaaaccauagcaguaaccuuuaaagauugaccuguuauguauguaggaaaagaaauuggagauagugcugguagcuguuuuuaaaaccuggaguuuuagccuuaucuguguccugcugaauaauagggaaaacagcuuguucacuuggcacucucccuccucucccccccccaugguuaaauuauuauuucuacuuaaaguagauguaugguauggcuucucuguauuuaguguauuuuucuuuugcauuugugaaccuauuuuaagguaggagaaguuuucuucuuucauugcuuguacuuuaauuucuuucuugaguuccaaagguaaaguguacccccccgcccccguucucuaugguacuuuauguagccuuuuauugugucaguuuuuuauuuuuauuuuuggagauuuuauuacuaacugcauacaaauuuguaauugucucuagugaguaaauacaucauuaggaaguuauucaucuacuuuugucaaguguuuuuuuuuuuaaauaagauuuacuuuuauuuuauguauaugaguguuuuaucuacacguguguaaguguacuguaugcaugccuaaugccuacagagaccagaagagggugcugaauucuaucuagcugaaguuacaggugguugugagucaguaugcagaugcugagaaaggaacccaugccuucugcaagagcagcaagugcucuuacuugcugagccagccaucuuuccagcuccucuagcucuguuuuaguguuaaauaauuauauuuaucgucaaauuugguauaggcuugguuuugcuguauaaguaguauguaguuaaauguuuuuauuuuuuauuuaauguaauauuuuaguuuuuauuuaauguaauaguugauauuuuagccuuuagucuuucauuucauuauuuaauaaacccccugcucauuguauauucuuucuggaucuucuuccuuuuauaaaauuuacuuguguguauaccuguguacgugugagugugagugaguguguguguguggggggguguggggugugguguguuuugaugugucuuugcauguacacguaugugaugcauauguggacauuaccagauaacuuuuguagcucucucguuauacuuucauguuuacuuugagggucaaauucagguugccaggguuacacugcaaacucuuuacuaggcuaagccauuucuccagccuccuccucuucuuccuccuccuccuccucccuuucucuuccuccucuuucucuucuuccucuuccucuucaccuccucuuccuccuugguccuuuuuaguuacuuuucucucuuguaacugccaacuguuacucuuuuacuguuuauuucaaugguuccaaaaacaucuucaacucguacugaacauaauuucuuagacagugaaaacucuauaauaauuugcacuucccuuuuaauuuuuguuauuuuuguauauuuuauuucuuauauugcauuuaauaagacaucacuauuauuaaauaaaucauuuauuuagauuuacucauaugcuuuucucuuucucucucucuuuuuuuuuuuuacuugucugggcuucuaucugggauuauuuccuggagaauauccuguaguauuuaguuaggucugcuggagauggagucucuuagcuucugucugucuuaaaauacuuguaauuauuucuuuauguuguuagagauuggaugguaguguuuucuuuuucuuuccuuuuuuuuccuuccaucauuaaaguaugccauuuuguuguuuguuuguuguugacuuuagcucucuguugagaagucagguauguguaguuuuuccuccuggauaauaugcuuauucucccucuaucagccucucuuaaaauuugccccuuaauaugacugccagaaauuugacccugagauuucugguugugguguucuuugcauuuauguguugcuggacuucuggaagcugugagaugaccacuuuuaucagcuguggaaaguuucuggcagaucucuucaaauacugucucauuggaauuaguucuguucuguucuguucuguucuuuucuuuucuuuccuuccuuccuuccuuccuuccuuccuuucuuucuuuuuuuuuuuuuuguacugucaucucugacaaguucagaacagcucuaguuuuguauuguauaguuguuagguuaagaacaacaguuucuuaagacucaguguucuuaucagagacagcacuuccauuuguugaguuuuuaaauuuauuuuuuguguuuucauuucuagaauucuauuaugucuuauaguuuccaaauuucugcuuguaguuuuauuacuuuaguccuuucucuuauaugucucugcaggugagugguggggcgugcuuuuauaauuugugguuuuugaguuaguuuugucuauucauguuugaucgaauggcagguauugaauaaaaaaaaauuaucgagguuaucugaauggcauugucaccucuagaaaggucucccuuugguaaacgcugaugcuagaggagcuaacaacuucagaucauuucaauuuguucagggacugagauaguuuagcauugggcuuuguccuaugaacugaaguacauuagguuugccuuugcuucauagucacagugcuuugagguucuaagccucaguuuaagggguuuacccuucuuucuagcaggucuucucccuggagagauggcucacaggguaagagcuuguuguucaaacucaaggaccugaguuuggauucauagaauucacauuaaguaagaaaaagugggugcauauaaccucaccaauaugggagaauggaggcaggaggaucauuagaucuugauggccaccagccuagcuccagguuuagugagagacucagagauaaucagggaaauuaggcagagauugauagaacaggacaguugacauccuccuuuggcauccacacacccaggacaagcucacauguguguguguguguguguguguguguguauaccauauacacucauuaauuuagcucacuuaaaccucuuuaagcaguagucuuuaaaugugcuaauuaugcaucagcaguaacuacuguugauugacuugaauuuuguagacuaaugauagaaaauagcaagugaaggaugccccuuccuauaauauuguuuaauucaccaugucaacaaaucucucccugcagccuacuaagccuuuucuuuaauuaaguaucugauuuacacugcagauuuuauucauucgaggauucaguucuuguuuaaacagauaagguuagcagcucagguuuguuuaaaauacauuguaaauacaaccagaguuuuaccuggggcaguucacuuuuagacugcguuguguuuagaaggcaagcacuuuuguaaccaguuucuagcauaggcugguuaucuaguuuguucaucuuaagauuaugaaauccucuuguuucucacuccauuuagaucuacuccccuggccaguuuagguuacucuaaacucuuacauaagauaaggagaagaaaagcaacagauagagauaaauuagugaguaaugugaagugcuucuauuuauuucuuuuuucuaacauugaguuucugugcucccauggacugucaaagauaaccaugauguaauauuaaguacaauaaaaugaguucuugauguucgaagauacccucaucuuauuuagauuauggagccaguuaauaguuugggcaaauguagagacugccauagccagggauccaccccauaaucaacauccaaacgcugacaccauugcauacacuagcaagauuuuauugaaaggacgcagauguagcugucucuugugagacuaugccggggcccagcaaacacagaaguggaugcucacagucagcuaauggauggaucauagggcucccaauggaggagcuagagaaaguagccaaggagcuaaagggaucugcaacccuauagguggaacaacauuaugagcuaaccaguaccccggagcucuugacucuagcugcauauauaucaaaagauggccuagucggccaucacuggaaagagaggcccauuggacuugcaaacuuuauaugccccaguacaggggaauaccagggccaaaaagggggagugggugggcaggggaguggggguggguggauaugggggacuuuugguauagcauuggaaauguaaaugaguuaaauaccuaauaaaaaauggaaaaaaaauaguuugggcaaauagaacuuuauugucaugucugaguuaguguggucacaugguacccacagcucucucaacauaacucaccuucuuucuucuacuugucacugcccauaucacuuugcaaacauuugaaauacagcugaugugacugggguaagaagccagaugagaaauuaguuauacacgccauucuaaguagcagccauagcuuuuuuuuuuuuuuuaaucuuuguuagucucauugucuaccacauugacugacauguguucagaaacauuuuguuuuacaaagacauuuuuuuuccagugcuggacauugaacccagagucuuguguuugcuuggcaggccucuaacucugagcuacauuucuauccuagccuucagcauuuuguuuuuaaaugaaagacuaccucaaaauuacagucauaggagaagcauuugacucaucuuccugucuuuauagaacagucagguuuauguccaagaccagcaauuuaaguuccuaugaauugcuuggcuuaauuauucuuuagauaauacaaagagguggguaaguauaauauacaauaaacccagcaaacagcuuccuagcaaacagcugucauuggggaaauggcaaggaauauaugguaguauguguuuuuguuuuacauuuggugucuauguuugcugaguggugugcuguagcauauauugaaucauauaagacauaauuuuguucuuaaggaauuuggaacagagacuaaaggaauaaucauccagagacugcccuaccuggggauccaucccauauacagucaccaaacccagacacuauggcagaugccaacaaguguuugccgacaggaaccugauauagcugucuacugagaggcucugccagugccugacaaauacagaaguggauucucacagccauccauuggaccgagcacaggguccccaaugaaggagcuagagaaaggacccaaggagcugaagggguuugcagcccccuaggaggaacaacaauaugaacuaaccaguaucccagaguucccagggacuaaaccaccaaccaaagaauacacauggugggacucauggcucuagcugcauauguagcaaaggauauccuagucggucaucagugggaggagaggcccuugguccuaugaaggcucaaugccccaguguaggggaaugccagggccaagaagcaggaguggguggguuggugagcagggagaggugggaggggauagggggguuucggaggggaaagcaggaaaggggucaacauuugaaauguaaauaaagaaaauauuuaauaaaaaaaagacucagaaauaaaucuauacucaaaaaaaaaaaaaaaagaauuacuaucaguacauugcaugauaagaugccaaauaaggugcauacuuuuccaagcaccagcuuuguaaaauuaaaacagucaauacucagggcccagcguuagaaagguaugcaguuuucaguucuucaggauguaugugcagacugaguuggggaaacuguccagaauacauacugaugauuucuuucccuuugacugagcagaaugugagcuucuccguguaaacugcaugaacauugagccuguugauuucuuuuauaucagacugugucaugucaucagcuaagaaguuuuccaaguaaauuuuauguacugguacuggccuguuguggaaauauuuagugugucugcgcgcgcuuuuuguuuuuaauuauugagggauaucuguuuaucccuuccuugggaucuuaaagauugcaaaggauaaguccuuugguuguuucuuguguauauuucuaacuucuguuaaguuccagagcaguccuuuucuguugauaacuggggaacccuuuccaggaaggccggucucacacuuacuuugccgugagugaggcugacacuuucuccucucuuacagcuuuucugggauucagaggggccaugcuguguuuuacagggaacuguguuuuauuagcucguuguucccucuucagaucauguuguaagauggaauagcaucugggaaagaacucagcuaucagaagugcagaaacgauuuuuguaaggauuaagaaagaggaaaacuugggaggguccaugacagcuagucucuuacaucagcagagaaguguagagucacauuuucagucuguuauaacuucauuuuaauuggcugcauuaaaaacacacacacacagacacacacacacacacacacacacacacacacacacacacacacacaaauuaaacuagcaguuaugcucuuucuuuauuucuccucaauguuggcaguauaaagcuuuguucagagaacaugaacaagcagguacaaggacacuuaugugaaugaagcucugccuagcugagugacuugccuugauuuaaaauauggcccuuggcaacuucaaauaguuuguuuucucagagggaaaaguucagauuauuuauccauguuuaguaaaaacuauuaugauucucuaguagggaauacucuccgauucauuuauugauuaaauaaacauuuaucgaauaguuacuguguguaaggcacugcuaggugaugagagaaauaagagcuaauuuaauaaaguauguaccauguguaaaaacaauaaaaaugcuguguagaaagugauggguguuguaaaagaauauagagugcuuugggaauuaaaaguagacauuucuucuugacaggguaagucaaaguaaacuuuccgggaugguaggauugagcaaguccuggaggccaugauaagaaaugguucuuaaaagguuuagguacaguagauuccugugcaauggcaugggcaacuacugacuguauuuauccuguguugcuuugcauuaagguacaguugguuauaauuuccucauuucauuuugcaaaucucaucuuuuuuuuuuuuuuuuucaacuugcuaguaguacuagaaguccuaaguuagaagagggaagaucuuaggcuaguugguuaaccucucuguguuuucuuucucauguguaaagcacuaugugccagggacuuaugaagaguguuaacauagccagccagggugguaguuuacauugguaauccaagcacuugagaagcagcgacagaacaauugccacaagucugaggcccgccugguguguacauagugaguucuaggccacucagggcuauggaagacauuauccuuuuuuuuuuuuuuuuaauuuuuuuaaaguguguguuauauguaauaagucauuuauuugugguuauauucccaguaaguuacuagcaagaauuugaaaacaggccagaauuauaaaguacuaaacuguguaguauuuuccuuccuagaguuccuuugaucuccaaagugcaguagcucuuguccuaucuguguacuuaaagcugcuuccccuauucuaaggagaaaggaaaacagaagugcuaugguagagugcccuaacugacuugguuuuaagcuauuauugcuacuggucauuuagcgugcuacccuuugcuccaaagaacagagguuuuacagugaagagcuggcaugcauuguaagcuguuaugucauacaguagaccuauguuggucaacuuagaaguaaauauuagggcucccccacccccaccccaagagauccuggaguuaaauucuacaggauaauuucuauacaugcuuuucuccugaaaaauaauaccaauauaguucuuguuaaugaguaaaaugguccaaguuuacucauaaaucuuuuagggcuuuucaaugagauauugaaauguaggcauaguagagguguagauuuuaacaaauauaucaaugguuuuauuuauuaauuuauuauuuauuauuuauuuuacauuuuacuaguuagagaaaaauguguaguuuaaaugucucccuuuguuuuguguucuguacauuuguuguagaaaucaugugguuuugauuugguauugacgugugugugugugugugugugugguucaugugguuugggcuggccucuagcuuucuguguaguagaggauggucuuaaaugccugcuccuucaccccaucauccugagaucaugggugugcaucaccacacccguuuauaugguacugggcuuaaaccuagugcuacccacuuguuaggcaagcacaguaugaacucagcuacaggccuaguuucucauguguauuuuuaauuuguauuuuucguucauaugugaaauuaaacaacuguuaguggagauaaucuuuucuaugaacuuuguugauguuaaauaguuucccuucagaagucaacuguuaguguuggagcuacaaagagugaauaaauuuccugagaggaaacgauaauaaaauauucaggaagucguuaggaagcaagaacuuuuguucuuguucauucagauaagcaguugagacuuuuuaguauaucaauauaguuuguacuaguggaaggaaugaaagauuuggcagcuucuaguacuguuggggaccuugaacuguguagaauaauggaauauagaaugcauaaauguuaacaauuucuuguagcuguuugaauuauuuccuaccucaaccccuuuugaguaucuuuaucagagaaaaaugugagaacuaucugaaaucaauaugugacuaacucaggagggacccuggucuuggggagaccugcaggaguugauugccuuucaccucuggcgugugaagcaagccaguaguaugacugaguuuucuucccaugccuugcuuucuggucacuucuugguuguuugucuuagucauuaauuucccacuuugcuauagaaucuuuggucacugugacuagccuguguuuuuccuuuuugaauggaauuauuacacguguuuuuaacaagcugaguuuaguuugcauuuucuucuguuuaugucagaagcagcuuuacccuugagugauaagcucuggaucccgucacguggaugagccucuucuagaaccugugagaggucccaacauugcauuugguaguuagauauugcaccuguaaauugugcuaaauugaggauuugauucccccuucugaauuauguauggggucaaaccuuucaaaacccaaaccaguuuggacgaugguagagguuuaguguccauuucuaaaugaagcugaggaaaguuuagugaagaauacugugaaggaagcgcuaaugaggaagccgagcaguugacuauagagcagcagcucugaucucuuggcugugacuccuuuggggggguugaacaguccuuucagagaggucuccuaaggccaucagaaacacagauauuugcauuacuauucauaacaguagcaaaauuauaguuaugaagugccagugaaaauaauuuuaugguuggggguugccacaacaugaggaacuguauuaggaggguugagaaccacugcuauagaguguggaguggccagggaugcuuucucuggcaucagggccaagguagugaguacguuaaggugcugucuuuggauuuaaagauacauuuucaaguagugguuucaguagcauuuugaauuaaauaaggaaucccaagauaguauauuuuacucagaaauuuaguaauauaauuucagaaucguuuuauugaaaaaauugagucauuguguuaauuaacagaucgcuuaagaguuaggaguuuuaucagugagccuuucucugaacacagaguaaagauauaagucucgguuucucugucacagcguguuagcuuggaagaugauucuucucucuacuucauuuucucauccucuggcucuuucugucccuucuuuuucaucccuuguucucuucacuuuuggauucaaaacucucuuguacuucugaggauuuugaaugaccacugaagauaaccacauuuuaaaauuguauuugcucuguucuccuuaaacaugacuggguguucugcaugucuggagacucuuauuuacaguuaaaggagagugcaguauuuuuagagccaguucuauccagccugcgguuggcuaaccagcuaaguuucaaauacgcuuacaauuacuuagcuuuuccuaaaauuccuuucugauuggccugauaacauuucuagaaaguuguauguaucugccaccugguggugaaaugguauagcaaauguuaacuuuuagaacuguaauacuauuuaagcucuacuuaagcucucuggauauguagcauuuucuuacccuccuuuuuuugguugagaagauauuacuuuaauacacuacuacaggaacauuuugacuaauuuguuuuacggugacuucuuagauuauaggugacuucuuagauuaugaaauuuguauauucaucaguugcauaacuucugacuucuuugaaagcauguuucuauuuaguuuggagagaugggagcuuuuaagaguauuguugauuguaguauuucuaaaaugaauagucaucaacucaagaaaaaguaaaguugauagaacuaaagcauuuugugggggggcaauaauaacauauuuaaaaaacuuauccucacugauccucagguuuauuaauacagcuaagcugugcuaggauuaaagaccggaauagugacuaauagaaacauucuuguuuucucaguguuuauagucuaauuagagaaacauuguuacuacagggguuacauauauauauauaagagagaagucucauccaggcuguuagcaggggaaguuucucuaaggaaauggcauuucagcuugggugugacagacauagacucagucuaauguggaaagcaaguuggcaguugggaggaguuaauagggaaguugggguucuagugagagagagggacugugguaugaauuaaaacaauaaauuaauucaggaccaugcaggguguaucacauguggaugucagagaaucgacuguccuuccaccagguggguccuggggguugaacucaggugagccauaucaccagccucagucacuagucaaaggaaucuuaggugugcagcacauacauaacaugagucauuuuguuuguuuuaacuugugguacuuaucuuauccuguaagucauuagauguaugaccauagaaaaguuaguaauuuuuauuucgugaccuauaaaaaugaggaaaauaaaauuauaggguuauuaagaggauuaagagguaauuuucguaaugucuuuuuuauuauguucuuuuccuucugcccaacaugguguuuuaaggauauggccauauugcuacgaauacaucuaguaaguuuccucuaauuacugcucagugcuucauagugugagccuucuuaccuaggguaugaauaccuagguucguucuaacucccacuaccucaaauacacuggcagugggaauucuucgucauggauccuuugcaaauccuggaaugguauuuuuuuccauuaauuaauuuauguauucacucgacaucucgauugcagccuucucccccuccucccaguuuuccccuuacauagcuuccccccccccccccggggauugggggugggagguccugccucuuucccacucccauacuaaccuacccaggcacuucaaaucacugcuggacuaaauauaucuucucccacugaggcaagacaagacagcucacauguggagcaagauccacaugaaggcaacaaaaucaggguaagcccccguucugguuguugggggacccacaugaagaccaaacuguauaucugcuacauaggggggggcuagguacagcucuuguaugcuuuuugguuggugguucagucucuugggaucccccaaguguccaaguuaguugacucuguuggucuucucauaggguauaaauuuaauaaauuuugccaaauauggccugguuaagaguguuuguacuaguuuguugguauaucagaguuaucaucucaugucuuugcgaagagcugacaggacuuaacuucuuaaugcugacaucugacaauuggucuaaagaguuauuucaguguugguugaauuugcauuucugauugcuaaugaaucuuacagugauugcacuuuucuguaauuccauguugcuauccugucuucauuuuugugucaaauuucuagucuaauuaauuuguaacucuucguucuuguugguagacaugguaaaucauuuuucuuugucauguuuuuguuuguuuuuguuuuuuacuuuaccuauagucuccuuugaacaaaaagcuuuaacuuucuuguuugaacccauugauuuuucuccuuuuaaaauuaauuuuaauuaguaaagcauuugcacuuacuauguauuuaacaugauuucaaauacauauucauuagggaauguguaaauuaagcuaacauacucauuacuucacauauuucuuuguaguugauuccccacucuguuauuguuuugggaauauuauacauaguaauuaacuaguccucuuacugaguaaagguuuacuuagacuuagguuuucucucagggaacuuuugcagccuuugaccaguggcacccaacccccuuuaauucuugguaaccacuuuuuuguuuuuaguuuuuuggguuuuuuuuuuuuuuuugguuugauuuuuguuuuuuucugaugcaacaugcaagagguuuauugauccagcacacuggggucauccugcaauaggggcagagacgaccccaaaucuucuaagcauacacuuuuuauaguuuaaggguagaccuugguaauaaggugaguugguuuaagcccaugguuggcccaugcugaccuuuucuucccccccuauagaaaugguaauuagccucucccuuccagaguggcaaguguuucuugaccuucccuuugcuucccccugcuuuuaucaacuuuacauuuucacuccauuuuuuuucauuauuuuuuuaauuagguauuuucuucauuuacauuuccaaugcuaccccaaaagucccccaaacccucccccuccccucucccgcaacucccacuucuuggcccugguguuccccuguacugaggcauauaaaguuugcaagaccagugggccucucuuuccacugauggccgacuuggucaucuucacuccauuguuaagugagauuaugcaguauuugucuuucugcucuugucuuauuuuacauaacauguuuugucucaaauacaaggagaaacaacuucucuuccccugccuccuccacuuccuugcugaccucaaacucaggauacuucugagucagccuucaguguugggauuacaggucuguuccaaccaugcagugcuuuuuuuuuuuuucuuuuucuuuuuaaagauuaagugcuuaccuaguaugcaaaggcucuaggaucaggauucuucaacacacauuaacauuuauaucccaucuguggugugucugaacacuguuuucuuaccaguucaucuguugauagacacuugaggugauucuguguugucuauggagaaggauuccuuacaaggacuccaguugugcuuuggcacauugauuucauuuucuucuuugcauaccuggugggauugcugaguuuguuuuguuuuucauuuuggguuuuugagacaagguuuugaacucacuuuguauaccagucuggccuucugagugccggaaucugugccguaagaucuccccacgguuuucuguagcaacuucacaauccaguauuuauacuuuaccuuacuucuuguuuuuucuugaauuuagcgguucuagaucucaccuuugcauaauaaauaugccgaguaucugcuguauuuuaggcaugggauguagaacuugugaaucagauacacagacuuuagcacagccauuggaugaaccaugcugauguagaaaauauggaugaugaagaaguucaaacuugcacuugcccuuauccaucgccaaauuaagaaaaaaguccacaacagaacuagaaacaguaaacuuuuacccucuuuccuaacucaugucugugaccggcauuuaguuuucccccauuccuaauauuuaccuuuucuuauucucuuuucucccuguuauaccuuuuuuguacauuuguuuauacaugcguaugagggaaaacauguuguuuuuuccccuccccuuucuggcauugcaugaccuggcuuaacauagauucuaaaucuauccauuuuuuuuggcagauuuuaugauuacauuuuuauuuaaaguugaauaguauucaucuuacauuuccacuauccauuuaucuggugaugaacaacuaucuugguuucaauuccuuguuauagugaauaaagcagcuauaaaugucaggcugcagauagcucuauggaagcauaaggaguuuuauagacaugcucauaagugaaaguaccauaguuuuauuuauuuauuuauuuauuuauuuuugcuucuuauuugcagguuuuuacaauaaacuuuauaaaaaguuuagagugggacuuggguggaguaaagaugauuaauuuaguauaaaauuuuauuaguauauuauaaaauaacuguacuuuauguagauucucuuaaccuucaccacaaucagaaaacagauuacucccucaaauuaaccugugcuuguuaguuucuuuuuuugagacaggguuucacauugcaggucuggcuggucuggacuugcuacguagcuauggcuggccucuagagauccacuugcuucugccucuauggaagcaaggccuugagccauccugauguacauuugucguggaacuugcccuccacuaauccuugcaaccacugauauacucucccaggaguuuuacauuugagugccauacaaguugaaucaacagguucuagucuuuggaagcucuucuuugaauaagcauaaugccuaugaaauguguuguguauaaauaaauuguuuauuucauugcuaaguaguauugcauccuuaacgaaggaaagcugauuuguauuuugugggaacauuuguauauaggguuaguuuuauguuuguuguuguuguuguuguuguuguuaacauguuuuaacuuuucagcagcaaaaauuucaaagugagaauauuggauugaugguaaauguuuaacuuuauaagaaacuguuaaacuguucccucaaaugggcuguaccuuuuagaauuuuaaccuacaguauuggagaguucuaguuguuuggcggccucacagagaguugauauucucaguuuuguucuagucauuauaauagauccauagccgggucuuacugcaguuuuaguuuccauuucagaaacaacucaugauauucaauauauuuuaauuaaccuuuuaaauuuuucucugugagugggguggugguguuccuugucuuuaaucccagaacuugggaggcagaggcaggcagaguucaggcccagccuggucuacagaaugaguuacagggcaaguagggcuacacagagaaacccugucuugaaaaaccaaaauaaauaaguaaagauaaaauuuuuguuuucuguguacuauguacaugaauguguguagcgugugcacaagugugugugucuguguagcagaugaguucaccucuaugauuguguguggagguugauguugggauguuuuuuucaauaccuuuuuccaccuuuuaaaaucuuuuaaaauuaaaauauaauuaaaucacuucccuuuucccuccaccucuucccaugcccuccccucauucucucucucucccucccccccucuccccucccucccuuucaugucugugcagucagcugaggauguuugauauuguuucuguguaugauuucagggaugaccacuuuguauuggauagcuaauuaagggguucauucugagagagacaaauucuacuuuucucagcauucguuaguugccuguaguuuguugucuagaagugugaccugugauauuuucuccuuuggcuuuagcaugucuauugguguuguuauaguucaggcuuugcuuaagcagcuauguuguugaaguaucauggauguaucuucccugucauuuaugugagacagucucaaacagcaaacguuuugguccucuggugcuuacagucuuuccucuccccucucugugagauucccugagccuuaggugaagaaauuuugugguaucuguugggacuaggcucccuaugaucaguugaauauuuauuuaccuaucuagcuaauagauauaguccucucucuuccucuuucucuguguguuuauguauauauguguuuaucuguauauguauuuaccuguguguguauauguguuuuuauuuguguguaugcauguauguguguauguauuugugugucuguguuugaguguauuugguauguguauauguuuauguauauguauauauaugugagugcauguguguaugaguguguguguguguggcgucuuaaaugaaguuaugcuacuuggacuggcagugcucccugcaaaagccauaaacucuguauuaagacacaccagaagagggcaucagaucccauuaaagaugguugugagccaccaugagguugcugggaauugaacucaggaccucuggaagagcacucaguccucuuaaucucugagccauuucuccagccuccuccauaaacucuauaacaaaagcccuaguauuagguaugagaaaccucuguucaagauguugguuagaguaguccagguaaaucucaaaacaaaauaggcuauugcuguuucccuugauugccuuuuaaagauuggugguaaguuccuaugguugaagacaccacacacuuuggacaaaggaguugggagauucgagcuauaacuaacuugaaaaccucuuuugugcagucuaauuucauaguaccaggagguacuauguaaguugccaagggaggggaguccuguuuagguaugaugcuuaugaaucacaacaauagucagcaugguaggauauccuuaaagauguagcagucgcacucauaucugugugguaaacaacagcuaucuaauuggauuauggcccaguuaacaugaaggaaaucaugccugcuauuagaaacguagucagcugcccugggauagccaagucauggguauuggagaaccuccuacuacuacuuuacuagaucaacauuauuuuuaacugcauucuaagauuucuuuauaccuaaagguaaguguauuauuugcucuauguacaagaagccucuuguugcagcaaauggacaccauuacagaaauccaccuuaucucacgaaacccaacgauuacagacacuugccugccuuugccuccugagugcugcauuuaaaagcaugggccacuacaccuggccaguuucauuauacauucucucuaugcuuuucuuugacuauugauuuaaaaguguauucuuucaguuucuuguuuacucuuuuauaguccguauauuuuucagagcaaagguuguagauaucgucaggcaguuuauuaguuuuuacaaaaugaacauauuuuaguguaucucuguauaaucuagggcuuuuaaaccgguuuaguuucacauuuggcauuuagcguaguaugaguuuugagguaauuauuauuuauauaagucaggugguuuuuuuuuuuguuuguuuguuuugcucagagauaucuaguuuuuuaguccuauuuauugaaaguacuauucuuucucuauugaauugcauuagcuccuaugucaaaaaucaacuuaccauaaucaugugaguuuauuucugggcuuuuuacuugauuccauugauuggucuccuucgcuaaucccacauuguuuugguuuucauaucaagguaagauuuauaaucaaguaguuugaauauccaacuuuguuuuuauuuaaaaaauucucuagcuuuucuuuuucauguaucuuuccaucugaacauugguuaucuugucuuuguaacaauucuaguaaagauugucacuugauuuguauuaaagccagagagcaauuuggagaccuguugaguccuugcauuauaaauauaauacuucuuuaggcuuguuaacguaccuuugcugucuucuuaguagcauuugaucguuuucaguuaucugauauuucaugguuuuagagcuauuucgugauuuuguuuaaauuuaauguuuaguugacucacaauauagacaucaauuuuuguauguugauuuuucuuaaauuauugguuacagaagcuauuuuguagauuccuugugauuuucaaauucaguaaucauugucuugcaaaugaggacaguuuuauuucuucuuuuguuauauauaugcuuauaaucaaauuuuuuguuuuauuauaauggguaggauuuccaguauacugcuagauaacaguugugaaugaaaaacacccuugaccguuccugcucuuaagggaaaugcacucaaaauauuuugccauuagguaacaccaggcuuuagguuuuaaaucuccuuuaacaaguuaaagaagguccuuuucauuaccaguauucugagguuuuuuuuuuuuuuuuaaaucaugaaugagaguuaaaaccugucaaauauuuuuuaauugacuauaagcucauucaguuuuccccaguagcuuguuauuucuaugguaguuuucauugauuuccaaauauugauuaaucuugaagaaauaacucccaacuuggcuuugacuuugcauguuuuucuuuuucuuuuuuuaaauucaguguuucccucuuugcccagccugauccugaauucacuauguaguucagguuggccucaaacucacagcaguccucauggcgcaagcugccucagugcugugacuauagugugagccaccauuccuggcuuuguuuuuauguauuacugaacuggaucugccaguaucauguugaagacuuuucucuacuucgugaggaauaucggucuauauuugucuuguuugguuuacugucaagguaacaauaaacucauaaaaugaguuuugacaccuuuucugccuucuggaauaaaucauguagaaugcuauuucuuaaauguuugauagaauucagugcugcaacuaaaaacauuguuauaaagauaaaaauuaacuuuucacaaccagaauaguaauaauauuauagaaaacauugcuuaaaacuuagaaaccauagaaucauaaggacuuaguaucucucaagucacaauugagagcauuuuuaacauuuagaaguuuuucuuucuuuuguguacauacuuugugugugugugugugugugguuuguuuuuuugagacagaguuucucuauguaacagauauggcuuuccuggaucuugcuuuguagaccaggcugucuuugaacucagaaauccaccugccucugccucccaaguacggggauuaaguugcacacaagcguguauugauguaaauauuaaaaacuugggaaucauguaaugaaugccauuuugcuuaugggcucaguauaguugcuugauugcauugugugcauaucccauaauuuuccauaaacauuuuauauuguugaacauuuaauuauguuaauagcuuuucuguauuuuuuuccugaaagcuauuuuauagacauuuaaagaguuguauagucaagaaucuucauuauucauugcaaauuguuuuuaaaaaggauauaaguuuuuuaucccagaugugaauuuuuaauguguauuuucacaucuagaaguauauaaugcauuguaaacauugcagcaugccgguguuuguacaugauguauuuuagaaugcuaaagaguggagaauacuguuuaaaaauccucaucaaaugaauauauuucuggcauagguaugcacaucugugacaguguuaguauacaaguugaagcuuuaaaguuagaaauguacaaaaaugcuaguaagaaguuaacugggucuuaauaauaugaucugugguccacagauuuuauuauuuuccagauuuuauuauuuuuuauuauuuuuauuauuuuccagauucugggaaaguggcccuagggaccguuccccgauugggucugggguagcagagaugaaguauggauuuagcaaauauuaauucaagaacacaggaagggagugugugcuggcuguggggagguuuagaagugcucagccauugagcuagucaaggcauaucaaaauuagcugacauguguaucuuuuauucgugaauccagagagcucuuggaccagagcaacgcaugcacaaccugcugagagcaucaagcaauuuaacuguucacagcuacacaugugacagaggaaaagugaaaaagagaaauggaauuguuaagaagucuaauuuauagaaaagggacugcguuuucaguuagauuggaaguagggucacauuaagagaauguggagcuggcaaaaagaggcaaaggguuuugugugccugcuauaaggaguauaaagccagagucaggcaaagaugacuaagacaguggucucaacacccagcagugaccagggcuaaagaaaggcaugaacauggagaggauaagcucaugugaagagugcuauaggauuaauuuugauuaauugguccagaggcugaguagaugaagcagaaggaaauaaaauccaaaaaccagcagagugaaguauuaaaaacagagaaagcuuucugaaaagauuggaaaucuagguuucacucucuugagcgugaguuaucauaaaggaacuauuucagauuugugguuauuauuauggucaguaguuguagucccgauguugaguaaauucuuugaaaauguauagaccaaagaucauugcauuuuuguuacucaggaguguuugguguuuauaauaauauaaaguuggaugugacuuaaauacuagccauuagcuuacagcccuuuuaugcagggugauggaucugucauugaguuugcuucagguggacccaguguauauuuguguugucagcauaauuacugaguauuuuuuuaaacuaaaaagugucuugguuuuagauuuaagauguguuugcugcaauggaauggaauacuguauagcugcuaagaauuagguaaaacuauauauacuggcagauacauauucaguauauuauugcuuaaggaauacagguugaaaaacaauguuauaugcugaaaacaacaacaacaacagcaaaacaaacaaacaaacaaacaaccccaccaaagacaggagaucccucccugcggcaagauggcuagcuauaauggccaaauuagagagcucugguuucaaaggagagacccugucucuauaaguaagguggagagcuaguugaagaugacauccaacaucaacuucugauugccacauauacacauauguacauguacacauacacuuccccaaacugugcccacgugaacaugcaaacacauaugcacuuucuaaguacucauucaaauauuaauauaaaaagggggcuaaugauuuucacuaggugcuguaaauuuaaucagaaaccguugacuaauaaaaaauuuauuaauaagcuauaauuuuaguaucagauuauauauaguugguugguccuacauaaauggcauuauauuaaaauaauauacaauagaaauuaaaauuagcacuaccacaccaccauuguuaaguuuguaacauuuaccuuuuacuuuccuauuccuaguucuuaccuaauuaauaucaaaauacagaauaaagagucauauuuuuaaauaauuuuaaauuauauucuaugguguuuccccuuauaguagauaguauuuuggaaaaugugccagguuuagguauuguguuaaauguuguauuucaugauuuaaguuucccaacugcuuaauucaaggcaguaacuauuacucuguuuuacaaaugacuauauugacaauauguaaucuauucaaggucauacaacuagcaaguagcaugacucagcuuugagguugggcagcuugacuuggaacccauguucuuacuaacucucuuauagauugaauauugaaauggccucacaggcucaggaguuaaaaauuacaggguagggccuaccugcaaaaagugugucacuggagguaugcuuuugaagauuguaccuagucccuggcuccuccuuucugucuuugcauucuauacaccacauucuggcuauccaagagcauggugucaagcagccauggaagaaacucuuugaaagcuugaaacugaacuaaauaaaauaaagccuuuucccccuaaaguauuuuagugaugguaccauaauuuacauaacuaucuuaccaguuaaagaucuaguuuauaggccuuaaaaucuaaaaccuggacauuuuuauuuaacaaauuugugccuaguauaugcaggaucuuuauuuugggcacugugggcuuugguguacauagauuuaguuuuuauaauccaguauuguuuaaccauacauauuuaacauuucugaaagguuggauguuagguggagauuucuuuauacaguuggagauuuuuccuuuggauaucacuacuuuagugacgcauuccuuuaaaaaguacuaucauugcuauuauuuugaauuuugcauacucacuugucaguguguguguaugcaugcacauacagcuguguguggaaguuggagaacaacucucagguauaguuucugugguuauuuuuuucccuguuuccauugaguaaucucgcacucugcugaucuauuaaaacauggcacuagauuggacauuuacuuggugacaguuuuguuugaacugagcauuauuuuaccguucuugaguguauuugcuguuuggauugcauauugucacuucuguaucugguuuucucaguguuuguauuguguuuaugguuugagucauauuuucacacaaaauucaauuucuauaauauaaaauacccuauuaguucuuacauuuaaaaaucuuacaagugucaucauuuccauuuauuuuucagcuucaccuauuuuauauuacaauggcacaauugcuaaaaucaguaaaccuguaucaguauauaguuuuuggcuagagucuauacuuccuucauauuucuuguuuuuacuuauuguucuuucuguguuaaauuuuacccagcaucucauacuauaucuaguuguugcauuuucuuuagggcuuuugaaugaggcuauauguuuccuguauuuugaugacccugucaguuuuaagaagcuggucagguauuuuauuguuucccacuuacuggcuuugucugaugauuuuuuuucaugauuaagcuagaguuauuauuugugaggaaaaacacagagauaaaguaacaacaagcaucacauaguuccacugugcuuuaucaguaugggaagugaaucuggucgguuucagggacuuacugaaggcuguuuugaaguguuuaccuuuugccuuaaggaccuucccuggagauagaauguuucaaucuuagcagaaacugcuaaacaucaguacuucauuguauucauaguugaauaguauuguaacauaauacuguggaaauaacauauguuauuuauugaucuauuaguggauguugguuuauuuccauguuuauacacuugggcuaguuuaaguaaugcugauaauguacauucuauuuaguuguuuuugcaaagaaugcauuuuguuagauuuggaauuugcacaauuguuuguuuuauuacucugacuuuauuuucuauaauuuauuuacugaagaaacuuugcgauuuacugugaauaauuucuuuucaguuguuauauugcugacaacauccucaucucaucucuuacuauauuucucuacuuuuaguuuauuuauauucuuaauugauaguuggaucuagagguaugaucucuuccaagguuuuguuuuguagggugcuacaugugauggcagcagauucauuuaagaauuguauugugucugaguaagauuuucuguuuuaucagccaccaagcucagcaaaucaugcccucguuagcaauucuggucuuuacaaccuuuucauuccugugagguaauguugaucuuuauaguuuuuccccuccccuccccuccccuccccuccccuccccuccccuccccuccccuccccuccccuccccuccccuucccuccuuucuauauuccucccucuggaugucuuuuaccaugugggaucuagggauggaaguuaggucaucaggcuuggugguaagugucuuuacucacuggcuccaauuuuuauaguuuaaauaaauuaaaaauguaaauaagagaguauaucacagaaacuguaaguagcuugcaaaauauaaugcauucucuaucugguucuuaugggagacaaucugcugacuuauaaaccauucaucuuuuauuacuuuguaccucuaauucauuacaguugcauuauagugacagucuuaucaaucuuugacuuaggaggaacacuugaauauacagaagcuuacuuucagccauguguaguuaccauagagauugauuaagaaagaugaggagggcuggagagauggcacagugguuaagagcacugacuguucuuccagaggucccgaguucaauucccagcaaccauaugguggcucacaaucaucuguaaugggaucaaaugcccucuucuggugugugucugaagacagcuaaagugcacucaugcauucaauaaauaauucuuaaaaaaagaaagaaggaaagaaagaaggaaggaaagaaagaaagagaggaagauagaugaggauuuccuuuccucuuucuugccacugucaagugaucgauucuauagcauucauuacacuuucuuuaaauuuuacaaucauuauaaagcaguagaggucaccauauuuguuucaaaauacugaaguauaauuauugagguucaaagguuuuguguuugacaagaaagggacugcuuugagacuacuuaagugauagucauuacuuuuagguuguuuuaaauuuuuuuucauuuaucuuauguguauggguguuuugugugcauguaugcuuguucaucaugugugugugugccuggugaucucaggcuacaagagggugucagauuuccuauaacuagaguuauaaguuguaagcugcuguguaggugcugguaauggaacccaggucuucugaaagagcagccauuggaccaucucuuuagucccaagauuugucuacucacaaaccuggaauuagcuacuuuauaauggaucuuuugaaugaaaauggugguuagauagcaaagccuggcuagagaaaauguucauuguuaauggguuaguuauuaccacugggauguuucagugaggaaagcuaagaaauguauauuguucuaaaaaauauaauucauauugguacuuaaaauugaagguuagagcucuguuuagucucacugauuuuauugauuuccuuccacaauauaauuaaaauagcuuauuuguuuuaucucucaucacauuuuuagaguaacaauacuaauaguaacugcaauuaaaguuaaaucuuuguagguuugucccuaagauauagacuacuucuaguuugguuuuuuuguuucaaaauucucuuggacuaguucuuucugauguggcuauaaugauguuuggacaguuguuuucuaucugcuuucaguuuuuagauauuuuaaauuuugcuuuuuuuuuuaauuuuguuuuuuacuuaguaaaauguuuauaugguucagugacaaacuggugaucaaggucuauucagagacauuugccuucaaucuuugucuuuuucgcauauuuuuucuuauguauguauagccuaccuaucucgguguuuaaauauauucacuuucucugauuuacuuuuuacacauuuuuuauagagauaacugugguagaauauaguuauucugcagucuuauuuauaucugcauaguacuaguaccucaguguauuaguguauccuaguugaguuuacaugucauauaucagaaugaguccucacguucagucugaauagguucacaaugaauacuuuguaccuguuuacgacguuauccaguguaccuuugauaucacuucagagaugcgcgguuguuggguuggaggaugauaaauacauauauauguauaugccagaugcagucagugaauacgccauucuguauuucaucagccuguuuccuuacaguuagucuaucuaggcuuggaguuuugauagugugauaagugagaaauuucaauguaguuuuaauuugcauuuuucuuacuaugaaauugaaaucauaguuucagaugauugugagccauuuacauuucauuuuaguaacguguucuagggcuauguguuauccuuuugauacugugaacaucuuuugggagguuuagaguuuucucccucucuuuucuuuuauucuaauuuuuuuuuggggagguauauuguggacaugauaugaagauauuuuuuaaaaucaauaagugaaugaaauuugucugugauuuaacauggcaguuuuaauagugcagaauuggguuaacaagcuuuagaauucuguuuauuuucaucaguaaauuuguuacagaauaaaagaauucuagaacccaauuuugcagaccuuguuagaaacaagauuuuuuuuuucuugaaacauuuuauuuuggguugagagcuugauuguacacauuacuuguagaaaauagcuuguuauuaccacuuuucacuuuguucucucuuuuaaccuguuagauugcccauaggauuucauaagcauuauuugacagugaaagcuuucaucgaauuauuuaugggaugcaguugucuauauucuaggauuaauaucuuuacucaaauuuuuuuaguucaacuuggugacagcuuguguacauauggugauauaccuuaauaaaauauauaaugcuuguuuaucacaaugaaagcuauuaauacugaaagaauaucaacugacuuauauuaacuccuuagaagguagccaguuacagaagaauuauagaaaaauaguuuuuaaaaaugugaaggucacucuauuuucaaauugcugcucuuagaaucugugccacugcaugcuaucgcuuucugauucucuugcucacuauugucgguguacuugcuauuuggugaauauuuuaaaagauguucauguaagacauugaaucuuacugucuucuguuucaaaccuaagauaauucugagcagcaugcgugguacugacugaccucuucaugguaggcuuucgauuccuugcugucuucaucuccagugacuucgucauuacaguauagaaaucagcuugugcaucugugucccaccuugccauuccucagcagugcuguaguauuagaauaauuucagucucuccaucguagucaggacucccagauugcucccacuacaccugcaucauuuuuauccaaccuaauuuacucgaauuuccuuuucuaacugugaugguucuacagauggccguuugcugaucccuuuaacuuucuuaacuucacugucaugacaccaucuuguuugccuugaaguuuuaaaugauugcuuuccuuuuaaaaaucacauuaaucauauuugagucuuuucagcuaugguaaauacuuugccaggagucucacuguucguggggaucaguuuuccuguuguagugcucuccccauucuugcugccuuauuucacauauuuuacugaaaccauuuuuacuuugaccgucaguacaugaucuuaguguauaaccucgguguauauguaaugaauggggucaaggcagcucauccucuuuuaguccuuuggcuucuucugugcucugcuccuuugucuuuugacuuuuauggcauuuuguuuugagacagggucuucuguauaccaagauggccucaaaauugcuauguagcuaaggauaaccuugaauuugaucuuucugcuuguaccuuucaagugcugggauuucagguacucaugaccauagauauuuauaugguucuggggacuagaacucagccagugaaugucagacaaguccucuaccagcugaguuacacgucuagcuccucuguauaucacuuaaauucuuuucuguaacguuuugcuuccagccaguuuagaguuuuucuugcugugacagauaccuaagaaaagcaguguaaaggagaaagauuuauuuauuuuggcucacaauucuggaaguuucaguucuugaucacuggcucuauguuuuuaaaccuggguugaggucguuguacaucaugauggaaggauguuagcagaacagagcuucuuaacucaagucaaccagggaguaggaagaaggauaggaagggaccgggacaagggcauccccccaguagcuuauguuuuucuuccgcuucucgugaaguuuagcuccuccuaaagcauaaagaaauacuuuguaaaugauuucugcuccagaaaccuuuccucagcaagcugaaacaucaaaaugaauacauuuuuuauugaaacuugaaaaaauuucuaaaaaguuuguuucuaaggaaacauuucugaauagguguuaagagaucacugcugauagcugcuaaaguccuaauuuucauugucaauuauuuaauuugauaucuaagagagaauuuaguuuugauccuuccuauuaacugccauaauuccauucacccuuugaaaaaauaaugugaauuugguuguuuuuaguguugaugaaggaaaacauaguuggcugcuggccuuucucaguagaaauaauaacacaagccaaaaccauaaaaauuucugacugccauacuaaaaagguaaaauagaaaucauuuuauuaauauuuaguaaauauuuccaaaagacauguaaaucagcauacauuauuagauacuuugcauucuuguguguuuguacaauccauguuuucuaaaucaauugugugguuuuuacuauuuuacauguaucucaauuaagacuagcuguaguucaaguucucaguguauaucacuuacccauauuagauagugcacauguaaugauuaugaucuugguucagauagcuuaauuauuuuggagcaauuuuuuauucauuuuguagcaaaagguuuuaaaucaaagaugauaauucuuaccauuagugaacuggacugagggaauucucauaaagccuggauugugucuaaugcauagugaacacucaggaagcuuucauuauuauuuuuauacccuuacaccuuguccauaauucccauucaaucuuagaaguacaacaaccaaaauccagacuagaucuuggauuucuuuauuucuguuuugucucuuuuguuucuucuauuuuugccuucaguuccuugcucuacaaacuuaugauuaagaugaacauauuuuccgaggggggcguucuuugugguuagaagaugcaaaggaugaugucuuuaaggucaguucagucuuuggaagaauuaauuagcuuugcagaaagaguaagcuguggagcugaaauugcuaaaauguuauguaguaaaaugguagaaaaaacuugucacuuucuaaauaucuguguaaaauugguaauauaaauauauuaaguugugucuuugaauguuaagucacuuuaacuuuccaauuuuggcggggggauuuuuaauuaaaaaacugagaacuuaagacugagcuguauagcaucacggaacauaaaaggauaaagugaaaugucacauugggaagugguuugggaugcacuugguguuaggagauaauacugcgguguaaggaaauaggaagucacuugagaguagaaucuuaguuuaugaugagauaauuuucuuauagugaagaaaauuacacagacugcuuucauuuguagguuuauaaagaggcuugcucugaauuucuacuauugaacuuuguacuucuuccugaaaaagagcaggguuuuuauuucugcuggcauuaaaaugccauguguugauaucuugcuuuagguacuauaaaauuuacagcuaguaugaagcauacaguuagauuuguugguauuguagggauggugcuuauaacugaaaguaguucccugugaauguauucuuuccuagaaugggauucugucaaaaggugugaaguagucuaucagaaagugaggaagaaucuaucaaaaagugagaacuauucuauuaagaagugagaaauuuguagagacuuggaaaugaaggagauaccagacaggcuccauuacgauuauuucaucguauuuuguccagugacucuggccuuaguaaacuaauaguaugcagacuaaaguagauguccuaugaggacuguugagacauccaggccagcuuuuguauagacagcugagcucucugcagugcccaaaggaaaacuguuaaaugauagauuucucugcucucugcacaugguuguugaacaguaaaugauucauugugaagcuguuuaauaugucuuuagauuuuuacuccuuuaucuucuuaucuuuuuccuucacaguaaccaggaguaagaaacugaugcacacuuccuaccuuuuucagggccuauguacucacauauucauugagcuauaauuuacauucauugguauuagucauuuuccacagaacucuaggccaauuaaacacauggcucagguuuuacuggauaauacucugaggcagguggggacuguuguacuauaugaguggauccagaccauccugccacguauugugaugguuuuaucucacccauuuuucugcugaguaguuugaacuuuuuaauuuuuucuuguauacaaaaaucaucuuucucuauuguuuuccugcuuuguuucugugcuuugcaaaaguguaauuaauguguuugucaaauucaagaaaguaaaguuuaucuuuuucuguuucuaugagguuucaucuuuuuacuuaaaaggcugucuaagcuccaagguuauacuuguuuucuccuaaaauuucuaauaugauuuuuauugcauacuuucuauauguuuggaaugaauuuucauagcuguguguguacagugauacguuguagcacuugagaucuuagacccacguucuguucuuaccugugugaccuuuggcaaguuacuuaauguuucugugcugcuuucuucaaugagauggaggugauacuagggccgcuucucauaaaugagugaugcagaugugcaaaauguuuagaacaguguuaguaccauuuuauacguuccauacgucuagaagguuaaugcaguaaacauuuuaauaggaacagauagaauaacuucugguuacuuuucaaaaauugcuaaguuccuuuccagagguuuuaagacuuuucacauacauuucuuaggccucaucauguggaaucgagaccuuuuuuucuaauacaaaauacuguuuuggauuuaucuagauuuuuaaguguugggaagcucuucaaagauuugaaagguuucuguuuauuuuuuccuucugccauucuguuuuauauuuauuuagaaccaaucacugauuuauaauacaggauuaguguaucuugaagucacaauuuacauaauuuagaaauaacagucuuaacgucguuguuugaguuagacuuugcugaagaugaagcuugauuacagcuugaguucuuuaccaauuggacaauagcuucccucuccucccuuccucuuucccucccucccucccucccucccucccucccucccucccucccucccuucuuuuccuuucuucuuucuuaaguaaagggugaagcuuuaucugccuaagaugcaaaguuuauagcaguuuucuuuguaauuuuuuucuucauauguucacggugccagccaaaggcuuagaaagauugaacugaguucuccugugcucuuuacaucacaaugaguucuugaugaaaaguaaauguaaaaaaaugaaauaaaaauggaacagaagagaauaaaguuaaugaaaaauuugauaggagcuggggagauggcuuagugguuaaggacccaggauaguucccagcaccaacguggugguucccagugaucuauauaacuccuuccaggguaucuucucccucuuuugacccugugggcagaacaugugcauggugcacauacauugagcaaaacaugcauauacauaaaaucaaccuaaaaaguauuuuaaaaauuuaauauucuugggcuggagagguggcucagcaguuaagagcacuggcugcuugcucuuucagagguccugaguucaaaucccagcaaccacaugguggcucccaaccaucuguaaugggaucugaugccaucuucuggugugucugaagacagcuacaguguauucauauaaaugacauaaauaaaucuuuuaaaaaaauaaauauucuuaagaaaacuuaccuaagaauaucauuaauuucuuguaguuuaaaacauugcuuacuuuaaaaaauuguguuuacacgcgugcauacacaagaugaugugcauaucccugcaugaacuuguggagaacagaggucaacacuggcugucuccucuaucacugucugucuuaguuuuaaggacagguguucucauggagccuagagcuuccuguuuuggcuugacugguuggccagcaaguuucugggaauuaccaggcaucauguuguauugccagcuuuuauguagaugguagggagcuaaacuuagauccuuguauuugugcagcaaguaagcaauuuacucacugagcuaucuucucaggcuagaaaauauuuuuauaaaaaauuauaaagucaaauagaagggaauauugggaagugugaucauuaucaccaaugguugccuguaagucaagaggaugaauacacuacuaggaaaaugugcaaaauauguauugaguuuauuaaaaguacaaauaacuaauguaaaggauauuuuauuuacaaugaauaauuucaguuuucuaccuucuuuauguucuuuggaaaacuugacuuugaauaaaagaacuuuaaauccauuauggaguuuccaauuagacuuuuauuagcuauucauauuaucuaauagggcuuaucacaaguuuuuuuuuaauaagcuauucuaaaugagucauuugguuuuuuuaguaguaaacuuuauuuagacaucaauggcauaucauucagcaauaaucugaaauuaauguuugaauauguuguauauucuuauagaaauaacagaagaaauuuuuauuuagcuuguccuuuuuuuguuuuuguaggagccaguguucgaacauucacuccguuuuauuuucugguggagccaguagacacccucucaguuagaggcucuucuguuauauuaaauugcucggcauauucugagcccucuccaaacauugaauggaagaaagaugggacuuuuuuaaacuuagaaucagaugaucgacgccagcuacucccagauggaucuuuauucaucagcaacguggugcauuccaaacacaauaagccugacgaagguuucuaucaguguguagccacuguggauaaucuuggaaccauugucagcagaacagccaagcucacaguagcagguaaguccuguuaagugauuuacuuggauuuucaguuuuuauaagaucuaaauaaaccagugugcuacacuuuucacuuaaaugguaauaagucguuuaggaugccaguuguguauuugcucuuguuuaugagacuacacucauuugcuuaggguuaugcugaagaaacuggugcuugugugugugugugugugugugcgcgcgcgcgcgcgcgcgcgcgcgugcgucuugccugucugaaaguucaaaguugcuaucuuuuuuguuuuuaacuuggaaguagagguaguucuguuggaaaauuaaugucuuuaaaaccuacucauaauaaccaguguaccuuaauaaaacuuuaguaaacccuggugguaggguuuaggggacagcaaagagaaaagagauaugauaagaggccguaaaagagauuguuacagcauaugugauaagcagaagccuggugugaaugguauuauagaggaagucaguacauuaaacuuuaacuaagaaauagacaguauuuauauagaaaaagauggugcucuuaacauaucauuauacgaggcagacuaaaagcaggaaguuguaaaaagaggaauauuaacuccuuuucaaaggaucucuguuaaaugguggcaaauguaagagagauuaaggaucuagagagauaagauguguuuauuaaagauguaugcucuaguaggguuucuugagugugagaugaagucaucuugugaagggccauguuguuuuacucgccguggccugcugcagguguguguggguuggccugacagugauagucaucuccuacuucuucccacucucgcuugggcuuagucacuuagagcugcaguucuuaacucuuucacaggguuuaccuaagaccaucagaaaacacagauauuuacauuacaguucauaacaggaacaaaauuacaguuauaaaguaacaacaaaaauaacuuuaugguugaaugucaccauaauaugaggaauuguauuaacaguucuuagcauuaggaagggugagaaccacugacuuagggucaaauacucaauauuuaauuuggguaugacuuaauacugcaguaaucauccacaucacagauugaaggugcaaaaauaaaaauggggggauacaaucuaaugccacggaauuuucuuuucuccccuccuccauacuuucuacaguauguauaaguaaauugguggacugacauccucuguaaugucauuuaggccagguucuguucauaacugaguuguguacuucaagugggaaacuucaugguuuauaaguuauuuauuaaaauuuguuuucaaaaaucauuuuuaaaagguagccaaauuagccauuuuaaaagacuacagauauauuuggcugcaagcagcacuaguuuuagucauggccagaaaacagagaaguuuucaaagaauauuaaaguaguucauagauuuuaaauaugagggugcucuucucugggcugucuuauuucuacaccagugacacuugcuuugucuggagaguaguguggcuguauguguuucgugcucaaagguuauggaaugccguggucuaaacacagacaucguugauccauucaugccaauuccaugucucacucccacucuuucucucucacuucugcacaggaagcaggagcaccggaagcugaggcggccuuugccuugauacgcacgccacuuccuaguucuuauaucugcucucccuggucagaacucugugaacuuucuugucuuacaaaucccacaggcuuaugcuuuugaaaauuaguuauuuucacaagaccucuaaagggaguauuuuuuuguuguuaaaaaccuagaagacaguucuuccuuugauuuguuaaguucccucugccucgcuuuauucgauucuguguuuaucuuuguuaguuaccuuuucccugauuuuuguucuuucuuuaccgaagagauaauugaacuauuuuauauuuagugcuuuccuuuaaaaaucuccuugauaugaaaucaaggaaaauacauagcaggacuagaaaacuuagguguuauuuauuauuuggacuaauucaccaucauaaaaucagccuagaauaauuguccauaaucuauuuccucuucuuuacagaaacauuuuguuguauucugagcacauuagaauuacuuguaagguacuguuauuaauagaugguacuucaguguauauaugccaggcagugugccauaugaaucacuuagauuaauuucuuuaaucacacugaggucugcuaguuuucauuuaacugaugaagaaacugaagcuuagacucaguaacuuaaccaccuuuauauaaccauaaaagguggaguucauuuaaguucaagauuggacaccaguggcuaacuaaugcuuuuagccauuauguucuauagcaucuguggaauauuuagaacuucagcaauuucaaacuuagaggguagauacaaagauagaaucaagaaaucucaugugcuuuuuuuuaagucuucacaugucuuccugaucuccugguuaacauuuuucaacaucuacuuuaucauucccuaucuuaguuugguuucuauugcuguggcaaaacauggacuaaaagcaguuuggggaggaaaggguuauuucagcguauaccucucaggucacauuccauaaagggaaccaggguaggggaacauggcugccauugcuuucuuauagcacccaagaucaccuguccaggcuagcaccacccacugugagaugggcccugccacaucaaucauuaaucaagacacaccucacagacuugccaauggggcaguuucauggaggaauuuccucaacugugguuccucuuuuuuaauaacuaccuugugucagguugacauaaaacuaucuagcauauuacccaaauacacauuuuccccugaaccauuaagaguagaagguagcagacauguugcuguuguaucugccugaacguguaagugcgaauuuccuggaaacaaggacauucucuuaaaugaccauagacuuucaucaaaauuaaaaaauugauguaacacugccauuuaauguagauuucacagaucuuggggggggggguagaaaucaaccuuucuagucuaagaucacaugugucaucuuauaauuauucuuauucuccuuugauaaauaguaggaccucagguuuuccuugucuaauuuugaguuugauuuccugugaagagauugagcuuuuucauuuuggggaggaauaccauggaaguaguauaguguccuuaguuuggcacaccaaaguauauaauauuuuauugcuaaugaugcuugcuuuauuacauaagaucuguguaguauuucuccacuucaaaauaagguguguuuuuaauuaaugauuacuauuuggagaagaaauguuuugguauuuuauaaauacacucucucucaucaauuuucgcuaauaguuauaacauccauuguaagauuguugcgugaaucaguuguuaugauaguaguugcugaaugccuauuguuccucauucugucaucucuguugaguagaucuuuuccuucuccauguguuuauuacuauuaacaugagucaacagauucuuguuugugcuuucauaauguguuagcaucaucauucuacaaacuuuucagucuugauuucuguguuaaguaguucuuccccuauauuuuaagguuaaaacuugaacuaaugacaucaggugaggaagugucuuucuuuaucuuuuacuuuccuaguuucacucuuagaaucagccucuaauccaggaacacugguucuuugcaguaagaaugauacuuagaaaucaagauaaagucaccauuuggacucacuguuaaagaagugacauugauucagggagggagagagagagagagagagagagagagagagagagagagagagagagagagagaacuugaauauuaaugcauguucauuaguuacauacaaaaugcauauuuacccacaccuuuauagcuccauaguucuauaucuauaguuagauaauccuuaagucuacacugagugcuuugaucauagacuauaccauagcauuuacucuauccuuaccuuuuccacauugcaccuugcuuuuccagcuaugaggaaucugauguagguuauacuuauugcaguuauuuauuagcuguuugcuuuguaucuauguaucuagucagauuacaccauauguuguggcuacaugagcugucuuggugcuagccuguaugacuguauuuuagaguaauauuuaaugacuuuuuauuuuucuuuaauuguccaggucuuccaagauuuaccagccaaccagaaccuucuucagucuauguuggaaacagugcaauucugaauugugaaguuaaugcagauuuggucccauuuguuaggugggaacagaaucgacagccccuucuucuagaugacaggauugucaaacuuccaaguggaacacugguuaucagcaaugcuacugaaggagaugggggacucuaccgcugcauuguugaaaguggugggccaccaaaguuuagugacgaagcugaauugaaaguucuucaagguauuaauccauugacaggacugauggguuuguguuuaauacauaaaacugaucugcuauaauuuuuuaaauaaacaccauuaaaaugcaagaacuauuacuauuaauauaguauguucaguuuuuuaaagagauaaaaaggggaggggccauaaaaauucacuguucaaagccagguguaguggugcacaccuuuaauucuaauacuugggcaucagaggcagccaggucuuugugaguucaaggccagccugaucuacauagagaguuucaggacagccagagcuucauagugagacacugucuugaaaaaaagaaaaaaaaagcccauuguuugguuaacguauuauuaaaaauuuauccaaggcuaggaauggugggacacaccuuuaaucccagaacucaggaggcagaagcaggcugaucucugaguucuaggccagccaagauuauuuagaggggcccugucuuuaaacaacaaaaauuaaccaaauaaaauaaaagugaaauuuaucaggauagcugugcaugguggcauaggccuagaaccccagcgcuugagcggcugaggcaggaugaccuguaguuggccucccgccaacccugcaagagcugggaguguagguugugugccacugugccuagcuaacuuguaucuuuuggcaguccucuauucucugccuucuccacaauaggauaccuuuuaauaguuaggguuuuuuuuuuuuuuuuaauuuuguuuuguuuuguuuugucuuacugaaaagaaucuuguuuaagguauuaagauucuugguaauucagauucaaauuauaaauauaauuuggcugucccugacuuguuuaggauuccuguucauagaaauguaugacuaauuuguagacuuauuuauaacacgugaacuggcuuguaguguaagaccacuguuacgagcuugauaucacuugugaggguguugcugauggaccuugaacugauuuucuuuuaaauguagcuucuuuuuguuguugccgucccugcccuuuuaauuccuauccuaguguauucucaguaaucaguuuucuaaauagacaaucuuugcuccgucucagcuagguuucuauugcuaugauaaaacacuaugaccaaaagaacuuaggaaagaaguuugucuuaaaauucacaggucacauucugucacuaagggaagucaggguaggaaccaaaguccagccacagaggaacacugcuuacuggcacgcucacauguggcuugcucaaccugcuuucuuuugcagcucaggaccacuugcccagggguggcauugcccacagcgaguuggacccuccaccaaucacuaaucagggaaaugucccacaggcuuguauacaggcuaacacgguggaggcacuuucucaguugaguuuuucucuucucaaaugaccauagcuugugucagauugacauaaaaucuagacagcacacuuccugauggucucuuuaugucauucacagugaaagguuuuggccuuuaaucuuaauaccuuuuccccccuuuaccuuucuuuuuccuucuccucuucaccccucaguugugaccagugugugcuucucuaacaguuccaaauguuuuacuuuagagcuuuucuaugugauagucucucugcguagaaucuuguguguguggaucacucucuuccuucagugcucaaaugucacuuugauauuugaaugauauuugagucccuuagauacucuguuucagacaacuauuuuuucaccucuaaugcuuuuuccuuuuuccuccauaaaauauaucaacauaauugucauauacaguaucuaauacaucugauacauauacagugucuaauuugucuuuuuuuuuuccauuauuaguauguaagcucaaugagaguaaugaaaaucuuggggcacauagaaaccaauaaauauuuguaaaaaauuugcuuaauuaauucuguuaaauuugauuaaauguaucuacauuuauagauauaaauuuauaaguauuccuaaguaauugcaaguguaauuaaagaagcuguuacuacauaauaaugugcucuaccugacuugcuuggucguauuuccuuuccacaccugagguaguauucaagcagauccuuagagucuaauccaggaaaaaaagcuuagugguuuuaaaugauggaaccacaacuuaguacuugaaauaagaacagaauucuggauauuugcuuauuuaaguacgaagagagcuuuucuugacagucacuuggagaacagccaccuucugcacuccuacagaguuuugaggucauguugguuaaaagagagaggucuuauuucaaucacaagccgguuuccguguuggcugcacagguggacacagguaaguaucagccuuagaagcaacaacucagcuguugguuggcugacuuuuaaaggcagggcuugucacugauuggcuucuagaaguauauucacugaaaugaauuguuauucaucuauuagguaguauuuacuuguuaccauggcuacaaaacuauuauuaauugacuagauaggcuuaaagaccauuuuggugguuguaaccuggcuggggauaggaauuaaaucucuaccugagagugaucucagauuucaauauuaauaaaguaaaaugcuuaacuuuuaucaauaggaguguggccaugucauaugucugcaagaggacaacuauaaauauagcauguauaaugaauucauauacaugcuauaugaauauaguggcaucuggauaguugcuacauuacaaaaucaaagaauugauagauuuuguuuuuguuuuugauuuucuuuuuuuaaaacaagucuccuagccgacguggaacucccuauguagaccaggcuggcuuaacucacagagauccuccuaucucugcuuccugagauuaaugacaugaacuacucugacaggcuugguagacuaauuuaaagagaugaaaacucagaaagacuuucagacauaauaggcacaagaaaagaaaggagagggagucaguaggaagggacacacagguauugaguuuguuuagucucggcuguuuguacccucgugugguauuguauagauucauguuguguguuccucaugugaccagaaagcaccauguaagcaggaacugucaccuacauaucucuaagacuccuaaauaaccuacacaguacuucacguguagaaaaaaacgugggaaacguuugcuguucaaacaauuuucuuggguuaguuuugcuuauuuugucacauaaagccacacagccugaguaggaauuagcuguucuucauggcuaaaguugugaggugcuuugucuuuuacuuaauuauucuuucauuuaaauuccuagauccugaggaaauuguagacuugguauuucugaugcgaccaucuucuaugaugaaagucacuggucagagugcaguguugccauguguugucucagggcuuccugcuccaguuguuagauggaugaaaaacgaagaagugcuugacacagaaagguaaauacugccugcuuagucuaaugccauuuggaguaucaguacauaaaaaucgacugcuuuguuuaagcacaugggguuuucauaugucauccuugaaaggcauuuuuauguugugucuaugguguuuaaagaaaaagcaugcuuuccagucaguagagggguugauguugcugcugcugcuguuaaccuucauuauagcuagcuugcaaggucugauugcccuaaaguguugcaugagcugccaggucugaccagguugagucauuuucagucuuacaugcacuguggaaguuucuuccuuugcuuaguuaaguaaauaaugccuuccguuuucccaagugcuggcauuacaggcaguuaucacagcugccuuuguuuugcuuucuaaaguccuaaaacgccauaagcuauguucacaaguuauauaucuuguauaagagccuucucuguuacuacucaucgucugcaucccuugucucuuccuuaugaaauggguaauuuccucaguuguauuuucucaaaaaauuccuggagugguaguaaugguucaauaguuagguaugcuuuguuuucaaaacacagcugcuucaagcauuguaaauuuacuggcaucccugucuucuaccuacagugcccuuucaaguuaugaugacccuagaauacaucuagauauugucaaaugucccuugaggaacaaaaccauuccugguugagaauggcucuuucagaacaguauauaaaaugcaaugcaugccucagauauaaacuaguuuucugauagccaugcuaaagcaauauuuauguaugcagcacaauuacaguaauacuuuaugugaggucccacuuagaaugaaacguaguucaucacaccacagcaccaugaagguauaacuaagguacagaaugauuuuuauuuaaugaauagaagggagaauuucugugacugcugcaagacuucaacaaauaguauugaaugauauuugagguacauuccuaggucuucagaaccaaguagcaaagagaguuuuugcuuuuagaguagaagaaugagagaguaguagacauacaaugugucagguuauaauaaguacucugaagaaacucaagauacaguauuccagggauuagagagaggcagaacgggguuaauauuguauauggaguauuagacaauuguucucauagaaagguaguucucaggguagagucuaagugaccaauauaaacaaaucaugguaggaaagucacguuuccccaguuuuauuugaagauuuuuuuuuuugacagcaaaugguuuuuaauccaacgugaauauauuauggugaauaauauuucuaugaacucuguggcuaaaccaggagacuuugaagaacaaguacaugguuguucugccucuaguucucuaggcacuuaaauacuuaugaguaugucgaggaaaaucugagaaaugcugcuuucuugugucacugccucagagaacgucaagacuuaaggagauugcgaugucagcacucuccauccuggccucucuaucuggggaggccaaauguucagcaguguguuuuuggcugaauuacugaguguuacaugaggaaacagaaauagguaauaaaacagagaaguccuucagguuggauguagguaguuauccauaaugucuuuguuuuugccagcaccugagaagugugggcggauuaugccuaauuuauuacuuagauuucagauuucaauauuaaaggggaaaaugucuagaaaucucaauagugcugggcuauguagaaaaacaagguaucguaagcauuaggcauccuuauuacaucuuugaaaacaaacacacaagaucacuauaggguuuuuuuuuuuaaacaaaugucuuagaauugauaacauuuaaauuuguucguauauguuaauauaaaaaagcagauagaaugagggauguggaaaugguuuuguagaggaacccaaagaaugagugcuaaagcaggaggugagcagcaacaaaguauaugucagugauuggauaauaccuucucuuagaagaccguaguucugagugcagggacaaagaaagggcuugcuuaccauacuacagcucuugguggugugauggcucacgcuugguggugugauggcuggugugauggcuggugugauggcuggugugauggcuggugugauggcuggcucacgcuuccaggaccaucaaguacaggaguggauucuucagaguuucacuuuucaagacuucauuucuaguuagcaccagccuggaaacaauagugaaauaaauagugggugggggagggggggggggcuuuugggauagcauuggaaauguaaaugaaauaaauaccuaauuaaaaaaauaaugaaauaaauaaaaaaaagcuuuaaguggcugcuuuaauugcauaccuguagauuuauauuccuugcuuuguucagauaucuuugucuauugaucuaguucauaauucuccagaugaacuaaacuuuuuaacuuuagaaaaauuugagaauauugauuuucaauuauuucuguuauaggauuguuguuuuuuauguaaauaggcuucuaucaccguagauuuaugaaaguauucaucaucuuuauuguaaauggagugauggauguuggcugauuugcgcccaguacacacccugggaguuacucaguggcaucuguccuucccuuuuccuuccugucuuuuuuuuuuuuuuuuaaauacaaacccaucccuauccccaccuccuauuuccuagccaggucaccauaggaaacuuucaguugguggcaccaccucaugacucgucaccucgugacucgucgccucgugacucgucaccucaugacucgucaccucgugacucgucgccucgugacuugcugcuugaguuaacauuuugcccucuguauuuuucuuccuguuaguaaucucaucauggcgcagcuguggugaaguuggucuuagauugguugcaaacuuuaaaauacauaauuuccauuaagcgaccagaauagggagacagcgauacacuggaggaaguugaauuggucauaaaaguaauaacucuuugggaauagcuagaagugccagagauugugaaaauuuauuuguacacgguggcauuuaugcauauaaaauaagagcaaaacaaacaaauuaaauucugaugauuuuuuuguuaaucuuagucagcuuguagccaucacuauaacaguguuugugugcuauuaugggaaaagccucauaggaauucuuuuccucaugcugaaauguaucguuuuguuuguguguuuaauccagcucuggcagguuggucuugcuagcaggagguugcuuggagaucagugaugucacugaggaugaugcugggacuuauuuuugcauagcugauaauggaaauaagacaguugaagcucaggcggagcuuacugugcaagguauguaaauauuuacugugaaauuaaaaauguuguuuacuguccaggucuacugauuaacaguaauaugagaaaggcaguacaucauaaucguuaaaaugcaaacgucuagaccguaucacuugaauucaaauucugagucugcauuucacaaauacagcaauagaaauuuuucuuuucauauauguguaugcaguauguguguaugcauguucacauguguuugaggagcacauguuggggagugcaugucuaguccugagacugauagcagagucucuuagucaaaucuagagcuugcuggugagguuacucuugcuacccagcuuucuguggggauucugugucucugccuuccaaggcuggaauuacagaugagcugccacgugcaccugacguuuguguagguucugggaucuaaacucauccucuucacuucagcaguuaaagcacuuucugaaaugaguuuguuagagaaaacuguagagaaguuucacauaauuaaaauuuaccaucuugcagaccaacauguuauugacacaagaauaggaaauaaaaaagaaugaaguccaacuauuaauugcaguacugugaccacaguugucaggaucagagccugacccuagcagcaccaacaagcgaggauuagccaccugucuucaacaggccaauuaaagagaaaaauaacagugaaaagcagagaaagaagauuuacucaguggccauaaugcaaagaacaaauaaagaagucuagugaccuccaccucucaaguccugaauuauguaugcccccaaacccggaaauuguuguuaggagcaucaaauuaaauacaucucucauacuuguuagcuucugguuuuacuucacuauuucucuucgugggaacuuuucuucauauggguauggacaaaacuuuaggguuuuguggugugcaugacucagcaguccugguuaaggugggauccugccauucacuacugaccuucauuaucugggcuccauucuuuucugccagauagucuggcauacacuaagaacugugcgaaauuucuacuugggcggaagcuuccucuucagagccgaggaagguaccaagcuucacaaugagcuuucuggaggaguucugugucuuggcuauuuuuuuuuuacuaguuugacagucaaagagaauauguuuuuacagacaaauaucugucuucagaauauuuuuguucugcuggaaugguuacaauuauacaauuuaaaauauaaauacaggaauucacuuucaaggaggaaaagauaggcccgugcgugcacacacacccacauauauaacaauauauaauauauuauuaaguguuaaacuauuaaaagaauaguagacuuucaacuggaagaaaaugaaguugggucuaaaugugaaaacacaaagaauaaauggaguuauguuuaauauuaucuuggguagaagaguguaucuuaagaaaagcagggacaagaaagcugguucagguaguaaagauggauagcuugucuuccagaaaaugccaggggaccugaguucauuuccuaguaccacauugagcaucacauaacccucuuauuugggggcuaggguuuaugucucuuguucuuuaauucagguagguuuugaguuauuugaauuaaugagaguauaauacaaaugaugcgugacuucuaagguuuauauuuuaaagccauguauauugccuuuucugauugccaauaauaacgaagaggguagucuuuaauaaauuguaacaagacuaaaauuggagccuucucuuauaucauauaugaaagucaucccaaaguagauuaaagacuuaagauugacuuuguaaagcugcugagagaaaugagagaaagcaugagguuucuggaaagguuaaaagguguuuuaguugguuucuuuucuaugugacuuauaaauagcacaggcaaaaaaaaaaaaaaaaaaaaccaacaacaacaacaaauaggcuuucauggaauuagaaaguugcacaagaaaggaugaaggaaucuuggagcgacuacuacgaaaugagagcaaauauuuccaaacuauacaucugaugagagguuaauaucuagaguagauaaggaauucaguucaguguaagaaaagaacccagugcuuaaauauguucaaaggaccugaaaagacauuuccugaagacagagaaguggcccauggguauaugaagccaaaacuaugaauaaucauuagauugugugaguaaucauuagagaaauucaaauuaaauccucaauaggauaccaccucacacacaguagaacuacuguaugauccaauaguucuuuuuauggcuguauguucagaugaaaugaaaucauugugucaaaaaacuaaguuuacucaaccaugcugguuacagcgcauaaguagcuagacuuagaaucaauuuaguaauucaucauggaugaaugaacagcaaaaguguuacaguggaagcacagcuuuauagaacgaagucuugccauuugcaauaacaugaacgaaccuugaugauauuauacuaagagaaauaagcauagaaagacaaauucugcaugaccugauuauaaguggaaucaagcauagugaaacucauagaaucaaaaagaagaaugguuacaguguauucucuacuuaaaaauuguugugagaauagauuuuaaguguucucaccauaaaaaacuaaguauauauaagguaauagauaucuuaguuuaauuuauccauucugugcuaauagacaucaaaacaauauauuuuacauaaauauauacaaguauugucaauugaaauuuuaacugaaaaaaaaaaauaaguguuuugaucuuguuuuagauaggcucucuguaguccaggcuaagccgagacuugugcugauucaccugcuucaggccucccaagggcuuaacuacaagggugaggcauuaugcucuguccuaaaaauauguuuuaaauuagcuacccuaucaggaaaauuuuaaaaaguuaaaaauguauauaauuuauaauguaauauuaaaauauacaaacuauaaauuggcaagacuauaaacaggcagaacuaaucauagcaaucacauguuaguaacuauuagguuauauaaauuaaaaauaaguacaaacaaaaaaaauacuuaaaauacaacuaaacaggacagguaauaauuugaccuaguugacauuuguauggguggaguuauagcucagucauaaacuguuugccuaguguucaaaaguccugggcuaaauuguaaaaaauaaaaacuacagacauuaucaugaugauguacagcaacuaaauaguacuguuucauugugugaggguauauugcuuuaugugaauaaucuuucaguucaugaguuagaaagggaauuaauaacaaaauuuagaaaauaguauaaacuaauauagauagaaacuagcaaaaguugagggaaguuuguagucuguguguguggggggggagagagagagagagagacagagggagagagagacagagagagagaaaggcgcagcagcaauuauaacauuaaccucaaaacugcuaaaaguagcaaauuuaaaccaaagaaaauagaaaacaaggaaguguuaaguaaaaguuaguggagggguugggggaaaggcauuaaaacagacugucagcaaaaccaaacuucagacaaggcucccaacaaauuugguaaauuugucuauuuacacaggugcuaagucaaaaggcuuacacuaucugguguuagguugaggauaacuagagacuuuaauaaacuauugauagguauauacacugauaacauuuuaaaauacucuuuaaagaacuagagauuacauuugucuuugauucccaguuuacaaaaacaagaaaccuguuuggcagaauuuauuaaaacugaacauaaagcuaauacugugguacagggaagaaugcuuauaacacgugaacagacacuggcacuaaaagucaugcccgacaguguuccugccguauuuauucuaggaacucaaacugguaaugaugcagaugcccaccagaauccagcauggcauugugucaggaguggaaacaggcacgccaccuuuauauugaaaagcguuuuuaaaaaaucucagaagcacuuuuaaaagaaacuaggcacaaagaauauaauuuuauuuuauaauauuugaaacaggcaaauucuauaauuuuuuuuuuuaaguaccaagcuucugcugugcuaaggccuuguuucuacucuggagaguggaguucaagcugugcuuuucauggguaucaugugaggucauuucuccgucauuguguacaacaaaaaccauuuggaaaauuuuguuuugagccucaucccauaacugaaaguauuuuauuuccuugauggggaaaauagcuuaugagaaauaauuggggauauaugcaccugugucucuauauguauauauaaauucagucacauuuguaugacuuguuauuuuuuaaaaaguuauagcuguaggaaaugacagugguuguuaaugcaguaaagguuauaaguucauuuuucaucuguuaaauauuucacauuuacuaucuuaccauuaacgcuugggauuucgacucaugcuaugacgugaauuagcugguuguguauuuccugccaucucagauuguugauaacagaugauaagggucaugaguugcauuuguaauagugugugaucaacuccacguacucccaaaagaaaauuuuccauuucugguuucugggaacaaauugacaauuucugaauuagccauuuucauggcaauauuaauauugugacugaucuacugcuaauguuucaaucaucuuuuuuauuauuauuuuaaauuuuagaaauggauaugaguguuaugucucuguguacuaugugugaggccagaagagcagcagauacccuggacuguacaugggugauucugagaaucaaacccaguccucagaaagagcagccaaugcuuuuagucacugagcuguaucuccaguccguccaccaucuuccuucaagccacagccucauaccgcccuccuauuacucaucuuguuuuguuuuuuguuuuuuaaaccucuagccacauuaagaaacugaccuucucuuuucuucccaucuccuucaugacgaucagccaauauuucguugucagucauugacuuucuuagaugcugcauaaaacacagauuuuauaagguaguguauagagcccaucaagggacuuacuagucaaugcuaguccuccuuagaauagggaacaaaauacccauggaaggaguuaaaguuuggagcuaagaugaaaggauggaccauccagagacuaccccacccggggauccaucccauaaucagccaccaaacacagacacuauugcauaugccagcaagauuuugcugaaaggacccugauguagcugucuugugugaggcuaggccugugcaaauacagaaguggaugcucacagucagcuauuggauggaucacagggcccccaaaugagaagcuagagaaaguaaccaaggagcugaaggggucugcaacccuauagguggaacaacaauaugaacuaaucaguacccccagaguucaugucucuagcugcauauguagcaggagauggccuaguaggccaucauugggaagagaggccccuuggucuugcaaacuuuauaugccucaguacaggggaacgccagggccaagaagugggagugaguggguaggggagcagggcgaggggaggguauaggggacuuuugggauagcauuugaaauguaaaugaagaaaauaucuaauaaaaaauugaaaaaaaaagaaauuuuuauaauaaauuuuauaauaaaauguuuaaauaacuuuauagcuaucuuuaauuauaauugcuuuaucaauuaaccaucauucuacccaucaaugucauuucugauaaauuuuuaaaguuguucagagaacccagcauucauaucauuaucuacaauuuuaauauucuaagagaauuuuuuuagauuuauuuauuuuauuuuaugucuaugaguauuuuaccugcaugucugucugggcaacauaugugugccuggugucuggaggcauccuauccucgggagcuggagcuguggauggcuaugagccaccaugugggugcugggaaucaaaucuggguccuucaaaagcaacaaguacucuuacuuccugcgccguguccuuuuuguuuguuugggcuuuuguuguuguuuugauacaggguuucucaguguagcccuggguauccuggaacucacucuguagaccaggcuggccucaaacucaaggauccaccugccucugccuccugaaugcugguaguaaaggcgugcgccaccaccucccggcaagucauguguuuuggucccaagaauuuaauauuuugucuguaguuuucucuucuuuugaauacauaaauauuaaguuugcuguucaugagcuccaucaguugcaccuucuuguacaaccgagauaucuauaaggacagaaguauuaccaucauaguggaaauuucugcaugccacuucucaucccuuacugcgcucaaagcaucuacucuugugagcuuuccaguauaaauuaguuugcuucccauaaaagcauuuguaucaucugcugcuguuguagaagacuuauuucacaaagcauaacauauuugggauucauccaugcuguauuuauuaacagcugauuuuuuaaauugguacuuauucuauaccagacuucucaaaguaauaggaccaguuuacauucugccaacaguguauauucugguggcuguauauccuagccagcaguuaguuuuccagccuuuauaauuucauucauuguacuugaguauacacacaauucuguaugguuucaauuuauguuucuguggugauuaguggugcugaguaccuuucugucuguuaacaguaaagguagucuaauaucuuucuuugugagauauuuucuaaaaugaugccuuccuguguacauaauauguaaaauagccauaucaaggagaauucuuaaaauccuguauuagggaguuuucuguugauaaccaaaagaaauagacaauagaaauaaaaacuaguggggggcagcuggagagauggcucagcaguuaagagcacugacuguucuuccaaagguccugaguucaaauuuuagcaaccacauggugguucacaaccauccguaaugagaucuggcgcccucuucuggagugucugaagacagcuacaguguacuuacauauaauaaauaaaaaccuaacaucaaauauugauagaauuucaagguuuauguauuuagaaguagauaaauuuuagcuuuuaucauuuccauuuuuuuugcuuaugauuugacauuuuucucacuguagcccauuuaaauucucuuaaauaucugaaauaucuaauuuauaaauaaauuuuugucuauuugaaguauuuaauaacuggaccuauaguaaauuaucuaaauagaauauuaagguuucccagagaaacaaccaguagguaauacaaauguagguaaagagggaaaagacuugcugaaaaauacuggcucauaaaacuggaggccaagugaggagucccaugaucgaucugcgguggugagagacuuaggagagccauagcagugugauuggucugauuagugcaugcuguguuaauaugaauaaaagucuagaauccaggaagugcuaagggcaagaagugcugagagucucugcacaaacagguagaaggcaaguucaaccuuacuuugcuuuuugguuuugguggauuggaugauacgcaugcauuggugagagcuuucuuuucuccauacaauacagacaucccccucuggaacaucuucacagacacagaaagauaacauuaacuagguaccugagcacccuguugcccagucauguugacacucagaauuuacagucguagugguagucaucuuuuuaugagucuuuaaauuacagagucaaauuccugcguugucaaaucauccauaaagaauuuuacuucccacauggcccugcuugagguccaagucaauagaacuauagaguuucucaggcauuaccccaguauauucaagugagaaaguaaaauacacgcagguuauauagguccaaggcauaacuauccucaguacuucuuagccugcagugauugguaccaugcgaguauaagagaacugugcuucauuuguucauguuuuauuuuuaauguuguaaaaagaugaaguaaagugcauguuuaaguaccuaauuuacagcuuauauugaacaaaauaauuuucuuuuuaaaacaccguagagaaacaugguuguugagcugaugauugaccaagcuucugaaagccaccagguuauauuagcuccuuaaacuuuuucauugugaugcugaauauugcugcauuugaaaacauuggaauggguagaauauuggaacuaugagccauuuugauuugccaagaacuuuaauuauaguagaaguaacaccaagcaauuuucuuuccauaguguaauccauauuuguuauggauuauauauaauuacaugaauaugccugaaaauuaucuaaauuaucuuuccuaucagcaagaauacauuuucacauaugcuugacauccuucuaaggcagagugauucuccccaagaucauauaccuaaaagcauacuagaaauucuaauguaaaaucccagaacuucugauuccuggugauaacuuuaggagucuuuguucuuugaucuuucucagugacuuuuaagcuacuccaaauaggaauuuuaugcugugauccaauacacagaaagcacauuugucuuuacaaagcagugccuaccguaccaccagagaugcacuauuuucuguccuauacuucuggaauuuuauuuucuggacgcaucaaugagucaucuugacaaaggaguaggaauugucugcucuaguuggaaagacuauuuaucacuggucuuguuugggauugcuaguaaaugcuaaccacuaaaguaaauuaaucuaaagaggguuuauuuaacaaucuaagauucuugaaugucucccuuccuuuagugucugccagaauuggcaaugcucacuggacugaacuuauuguugaagucaaaacauuuugaaaaaugaauguucugcuuuguauucaacuauugaagcuuaucuugaacagaaaauucaaugauagaagcaauuccuaagagcuaaaaugcuaauuuuucagucacuauguguaauuaaaaaaaaaaaaagacuuaaauuugcauauggaaaacuaguaaaguauuuuuuguauaguauaccuauuuggggaauuuucauugauggcgaagaguuaaaaaaaaaaugccaguaucagauugauagagaagauguuaagaacacagguucuucuuuggagaugagaacuugaguaguucauuggauguguuuugggaauuacauauauucaguguuuucuaaugcaguuacgaaaucauuucucuagguuauaaacugauacuacaaaagaauaauuacuuuuuucagauuauaagaauaacacugaaaaguacuaguaaaaaaagccaccuuucauuucaccaaccagaaauacugccuuugcucuuacaguuuacauauuuuaaaguauuuauaaacaaguucguguuuuucuuaaagugaaaucauacuauucaucuuuuugcauuuuuuccuguugucuaucauguuucuuucuacagcaacauacaauuuuacauagugacauaaauuuucaucauaucuaauaaccuucuagcagacuaacaauuaguaaaaauguuacucuuaauggcccugcuacagcuguugaaacuacucagcucugcuauuacagcaaaauagcagucauugacugcuuaacugauuagugguagcuacuucugaauuaugauuuuauuuauaaaacuggacugcuuaguugguaaaaauagcagucuagacugcucauuugcuuauucaggcuucauaguuaaugguuccuagagccucucuaaguaacaugguuuuuaaugucuuuguauaugcccaguuauauuaccuauuuguuacccuuuugugauguuuuuccccccuccaaagacugcuugguuuuucaaaagaaacagaacuaguaauuauguauuaguaugaauuaauauuacauauaugaagggaguuuauuagagaggcuuauaggcuauggucugaauggcugucuccugaggcuaaggguguggaaggcguucaguccaugagauuggaugucucaagcaguccuaaucuggugcugaaauccccaagaaaguccuagcaagguucuaauuuuuggucuaauguuggaauccugaagaaauagauuucuaguaccaaugaagggaugucuugagaacaguauagaugaacuugcuauccagagugaagccaagcaggcaaaacaaacuuucccuuuccauguccuuuugagugggcugccaccaaaaaaagguguggugguauagaaauuuuuaauucagacccaggguuucuaccccgcuuuugaccauucaguuuccggauaaaagacacacacaaccuuuauauuuacaaugagccuuaaacagcacaagagcuggguagagaucuacccucuaugcuauuagaagcuacuuuccuaugaauaacccugaguuauuacuuacuagguuucaucugggcuucucuuaacucuaauuggucagcccccagagccuguuuucuugaacucaccuagcccaugguggauucuguccauugaccuuuucuccccucaugguucuucucagaucccaagcccaagaauccuaaaaccuacaugugucucuucugcccagcuacuggcuguucaagucuuuacuuaucagucaaguauuuaccagucaccuugagguuaaggucacccuaucacuuggguuuaugugcagauucucuucucucugggacaaccacguuuugggggcucaaaauuagcauuagaauacaaguagcugcuggguggagccucucugaggacagcacgcuccugucugcaagcuuaacagaguaucauuaauccuguaagggauugguccuuacccauggggugagucucaaguugggcugauuauugguuuguuauucccucagucucugcuguauuccccaugccugcauuucuuguagacaggauaaauuuuggguugcaaguuuuguggguagguugguaucucuaucacuccacugggguuccugccuggcuauaggaguugccucuucaguuuccauauccccaauguugugaggcacagcuaagugaccccuauugauucuuggaugccuccacguuuccaucuuauccuggagauacccccaccuccucacuucugucaguugcagauuuccauucauuuucauggccaucuagucaucuuuccuguccugagccuccuccauuucccuccccauuacuccucccucccaguuccuuuccuccaucugccucuuacgacuauuuuauuuccccuucuaagugagagucaagcuuccucacuugggccucccuucuuguuuagcuucuuugggucuugggaguguagcaugguaccuguauuuuauggcuaauaucuacuuacaaaugaguagauaccaugaauguauuuuucggucuggguuaccucacucaggauaauauucucaaguuccaacaauaugccugcaaaauucaugaugucuuugguuuuuuuaauagcugaauaguauuccaugggguagauauaccacauuuucuuuuuccauucuucaauugagagacaucuagguuguuuccagugcagacaggagcauguuguccucugaaaggcaccacaaagcagcugacucagacagagacauccacagucaaaugguggauggagcuuggggacucuuauagaaaaauagaaggaaggauuucggucccaaaggggacgggaacuccacaggaagaccaacagagucaacuagccuggauuugagagucugagucugaaccaccaaccaaagagcauacacaggcuggaccuaggacuccccacucauguagcagaugugcagcuuggucuucaugugggucccaaacaacaggaaucagggguuauccaaaaagcuguugccuauauguggguuauguuuuuuuaggugggcugcuuugucuggccucagugggagacucacagaaacuugaagugccggggguggggguggggggauaacccagggaugcccccaccugcucagagaagaaggagaggaggagaugggagaaggauuguucggggguaagagagaaagggggcagugagcgggauguaaaguaaguaaguaaauaaauaaaaauaaauuuaaaaaaaaauagaagcagcaucagaccaacccacuacauuguagcccagauuuaggaugaaucuuccaccucaaauaauucaaggagaacccucuagagguuugcccagaugcuuggguuuuaguuaauagcagaugucaaguugacaaccaagauuaaccaucacaacuggcauuacuaaaguaaaagguauuuauguuaagcauugcuacaucuuuccaaaacacccuucagguaaaugggauuacuucuccuacccaccaguaaugagguuauauucuguacaauugaaacaaaaauaauacauauguaagguauaaauuuaauguuuaauauguauauacccaugaaaauaucacaacagucaggauaauuagcaguuaucacucccaaguuuucuaacgccucuugcuaaucucucccaugugucuuucauacuuucaucuuugaauaacuguugaaauacuuuagucgauauagauggcuugaauauucuagcauuuuaugugugguccccacuaccaucucguuuugaucuaguuuuuuuuuaaauaucagacuuagccacguuguuggaauuaucagcaguuucuuaccauuuuauuaagaaacauauuauguaaauauaucaugguuguuucucugucuuuugaaagacauuuagguuguuuccaaauuuuggcacccagaaauaaagaaccauuaacuucaguguuuuaauucugagguauauauuaccauuaaaaaaaaaaaaacuuuuauuccuaguauaugacuguaauuuggauggugaaggccaggagugcccaagacaccagggucaucauaacaagucaaaggcccaccuggguagaagagaccuuaucucuuaacaaacaggcaaaccaaccagaagucauuauuaccacuaccaccaccaacuucaucauaauauauagucagauaugacacuuuauucuuucuguaauuaaauuuugcuuugguuacccccuucauguuaaugaaguuaucuucuguuuucuucugauaauuuauacuuuaccuuuuggucuuuaaugugccuugguuuugauuuugcaugugguaauggguaaaaaucugacuuuauuuuuuuccaaauggauuaucuguugcuccaauaguauuauugucucuauuuauuuggaugucaccuguguacuacagcucucuauagcuuauuuccaaaugcuguuuuacuuaaaggaggcuuucauuauauuaaccccagucucagugacugacauuuuaugaggaaguucccuuucuaucgcucucucaaagcuuucuguccccauauauuuccuuccaucugacuucugaauucaguuugucaaguuuuguuaaaauucucuugacaguuugaaugacaguuuauugaauuuguugauuaguuugaaaaaugacaacucuuucagagaguguuuuaacaaggaguauauuuauaucccuaguuuuauuauuuuuaauuaaacauuuuuauuauuuuuuaaagacuuaauuauuugugaguacauugucacucuccagacacaccagaagagggcaucagaucucauuauggauguuugugagccaccaugugguuucugggauuugaacucaggaccucuagaagagcagucagugcucuuaacugcugagccaucucuccagccccuuacuuaaacauuuuaauaggcaauauaugcagagaaaauucaaggauauguaaugaaagaucaccuuugucccagacucccuccauggaaacgccauugcuguuggcuucucuucuauucuucuaaaaguagucuaugccuguucaaguaaacaggcauacgcagcaagagcaugaacgguuagcaggcagccuuaagagaugguugucaucagggacagauccaaguuugcugggauauagacugaaagcuauuuugaaaacuuugccuaagaaaaugaauaccagaaguaccaaaaugaguaguuguuuaaaugagaaaaugauaacagauuaggguuuguuuguuuguuuguuuguuuguuuagaugauacauacuacaaacauuacaaaagucuaggaaaauaauacuuuuuaaaaacugacuuauguaaugcuugucuuggcucuguuuuguuuccuugggucagugaucuugcaagucauccuuuuguuaaaguagaaagccagcuugguuuuuaacucacucuuuaagauuuguucaagugaauguaagccuauacguuggcaucucucuguugaguccaguuaauagagugggcugagggaaugucccuggaagcuguucuuacgacagcuuaaguauagacaacagucuuggcacaccguguagaugcuucuuucucagugaccccacuaaauguguagcucaguuucccuugucuuugugugaucucagcaauuccggaaaucagccaguucaccaccuacuaucauaaggagcuauuagggcccaagcauaagcauucuuaguggauuguacauagaugucgcagcuugucuugguggcaggcacauuccuaucauuuuguacucagggaaacagauuaaggccuauuuagaccauacaacaagauccuuucucaaaacaacaacaacaaaaagccauacacaaaaauaauacaguaguuuacuauuuggugguccccagccuguuagcauuucaaacauaguucagagacuauuaucaucuauuuauguaauagugucaguauaucuguuguauugaucuugugggguaaaauuacuggaucaaagaauauaugcaauuuugguuuugcauagcaguuaaguaaauuacccagcauagauugucucuguuuuaucauuccaaugagcguguuuguuucuccuaccuuuguuagccuaacauguucugguacuauuuagagaugacaucagauccuacaggcuggggacucaauucuccaugacuuuucucuccaguucagagaaguccgucacaagucuagaccuccugaacuucugacuaaccaacuuuaaguuaagguucccaugacuaccucuuuggguuacauuagcuuguuacaguggcucaagaacucaaggaaacauucaacuuauacuuacucauuuauuaugaaugaaauaccaaguauauuuuuaaaaugaaaaaggcauugagcuaaguacauggguagggaccccagagucaugugccuucucuaagcacaacacccuucaggaacacauugagcugccuagaagaucuccagaacuuuguuuuuugagggguuuuaauggauguuucauuacauagaaaugauugauuauaucaaucuccauugguaagaauucagccuucaucuccuuucagguuagggccugguacuaaaaguucugucuaauuuugguugguuccuauggcaacuagcucccuuccugaggcagucuuagagugcuacaagaguugacucauuaaaacaaaagaaaccaucaucuaaggaacuuggggauuuauuugugucaggaaagugaauaccuaaugcauauuuaacaauauucaaaguugaacauacuuaauguuuuuugucucugauguaguaucauacuuaggccuuucuucaaagacacuuaaaucaugcuuucuaaucuugcugccuuaggucugugucuguguaaucauuaaauauuuuauacauauauaauuuauuugguguaaggaauauauuaagauagggacacaaauuacagaaaugcauccaucuaucugguuaaaaaaaggaugaugucuguuaaaauuauaggaaaaagacuuaugaaaaacuagcauaaaaacauugaauccuugacacacauuuugggggaagaagcuuaccaucuaauucucugauaguucugauuaguagagcuuuagauaauaauugauuacuuucugcagcauaauuuaggcuacuuuguuuucagugguagaugaggcagugaggggugggugcuagagaagaugugccuauggagacaaugcuucuuuaaggaaaugcuuuaaauugggaucuguaggaugucuacuugucagcuaaauugggaagaaugggcuagggaaauggagugagaauggaauuguaaauaugggccugagaaaagggcaggauauuaaagucuaguggcaauuucaugguaagguuccugcagaauggaugucgcagucuuucuuggaauacaggagaccuauuuaccuuuggugcauugggaagcuuucucuggaaauggugugugugugugugucugugugugugugugugugugugugugugugugugcgcgcgcgcgcacgcgcgugcgcgugcgcacaugcaugcauggaugcauacuuuuagcagauuuacaaauacacugucaagugaaaucucuaaaaggauuucagacuuaagcgcuugggcgaggucuuggucuauuuugucaacuguuuuuuaaagauuugggugaugucaauuugugaauuguagaaaaagcuuaagaacaucaaguauacaguuuaacuaacauaaguggacacaaauuauuuuguuuuucuaguuaaagugauguaugagaauuuuaguacuaaacugaaagcaccagcauuggagagcuaauguacaugaaaaccauuaacucccaaauuacagcaaaaugaaguaaccaugaaacuuuguuguuggccaacacaauauaauuuucuguuugaauugggugccaaguuccagcaucauucaacagugguggaauuaagcuaguuuguuuguuuguuagcaaaugaauuuuggaaguauaauguuuguuuucauauuaacauuuuauguguguauuuagcaaucaaaauuacccguguaaugauggugguaauagaagggauagagaacuguuauagagaauuugaagcuuaauuaucucuuugguaacaaaauacauaaucuuccacuguaauacuuauuuucuuaugguaauugauucauuuguucucugguuaucugcuuaacuuccuaaccacaaacaucugcucucacauuaucucuaauugguaugaguacuauauaaagaguaguuaaaauccagagaagguuuuuuuguuuuguuuuuuaaaauaauucaugaaagggaaaaguaaaugguagacacuguuuaugauuuucuuacugaaaauguauauuaaaaugauuaauuuaauuuuuaaaauccauuuugcuguguuuuguagaauuacuuacucuacucuaggggaggguucccaaauacuagauaugagcucaaggaauaugucaguuccuuagaaaugguaccaucuaaguuaugaguacacgcuuggaaaguagagaaaaauuaguauuuauugaggaggagaggugaggcaaguugcuuuuauaucuaaggaaaauggaaggauaaaccauaacuuuuuuuaagauuguuacuuacggaggggacuauguagacaggauagaagcccaacuuaauugggugcauauuguuuguguagauuucaguuuuugccacaugacuucugagaguggaaaauauacaaaugauucaaaguacauaucaguacauaucgagacgacagaguaaagccacacagguacagcuuaggccgaaaguuauucagaucauaugaaaugguaguuggacuguguaguccuaauggaguguauucuaaagacaaguagcugcaaauauuguugguaaaaauguuauucugagagugaggagcuauaaaauauaagacagaugcauaauuauguuaguguuaauugguagcagaaauuuuuaguagaaagaacaaauguuagaguuaaaaagauucauuuaagacuuguugaccugaauuuaguugguaacuuuaauagaaaaucaagauacauaauugcugguuuuguaaugaucagaaaauacugaaagaccaccaguaaguaaagucaugacaggaaggaccauugugcauccaacaagcccaggcuuccucuauugauaaagaaaagauaguuucaaaucauagaacuguaaccucagugagaugaaacaaaccaaaugcaucuuaaagcuaggacucacucuaaugcuuuuaaaaggaucucaaacuuauaagagauuuccccuacccaagaccucuuuguuaggagaaaacauagcagcuucccaaaggcagagcuguuagccaaagcuagcccaauugaaauugccugcaaggaugcuauagauacugucuugcaaaaauauaccugucugauacuaaacaaacaaacaaaaaaaucuguugauaggaaaucuguugagcuguguucuagauccugccuauuggggugcugugggcuagaggugguauauagaaagccacauuuggaguaaacuagaggaacuuuuggggagaauuaucauuauaucuuacagaagccaugauauagacagggaagaaaguguauacuccaagagauaagaaaauuguaaacacaauuauugaaaaauggccaagugccuauauagauuaaucacaaaagauuuuuuuuaagauuuuaugggugcugcauccuuguuauaucuagacacacacuaaauaagaucuauagugauacuacuagucgacaagagaauguggaugguaaaauuuucacagggccacgucuuuuuccauaauuuauuuuuguucaguuuacaucuuuaucacaguccccccccccaguaccaccucuacaaggcucuccccccacuuccccaucuaaggagaagaggaagcccaucuuggguaccacccuacucugagacaucuagucucagcagggcacauccucucccauugaggcccaaccaggcagucuagguaagggaaagagcuccagugccaggcaacagagucagagauagcuccugcuauaauuguuaggggacccauaugaggaccaaacugcacaucugcuacaaauguguaaggggucuagguccagucccugcaugcucuuugguuugugguucaaucucugugagcucccaugggcccagguuaguugauucuguuggucuucuugugguguccuugaccccucuggcucagucuauucuauucuccauucuuccauaagacccccucuagcucuuccugauguuuaucugugggucucugcaaucugccuucauccgcugcugaaugaagcuugucaggagauuuuaugcuagguucugucuguaagcauagcugaguaucauuaauagugucagguguuggcucucucacauaagaugggucucaaauugagccagcuauugguuggucauuccuucagucuccgcuccaucuuuaucccugaacaucuuguaagcaggacaaauuuuggguugaagguuuuguggguggguugaugucaucuuccuuccacuggaaauccuaccuggcuccauaaauuccccuuggcucccccugucccaggucuccagcuagucccagugaugccccucacugauuuccacugucacuucuagcccucucccacccuucucccccuauacuugauccacaaggccacuuacugaaaagccacaggcaucaguggcugcugagagguggggaauuaguuuucuucaaggacaagcgucuugauagucuauccaaucccaaguggucagcccugcacacaugcauauaagcaacacuaaauagguucaguaauauguauauguauaugaauauacacaaaacacuucauucagaagaagagaugagugagugugugcuuugguuauaaacacaagaguuagaaggagaggugaacaccucaggaaaaaaaauuaaauuuagguuaaaguuugcauauuugggaggauggucacuuuuccuaacuuuauucuguugucaggcuuuaguuuucuugaacuuaaucucauggcagauguagggcugucaauuugccugugaauuuaaaaaaauacuuuucuuuacagcugaaugauauuccaucaggcaguuaauuuuuaaaacuacugugcuaaaauuuaaaauauauaguuauaugauuuuauaaaaauaugcaaauaacugaauucuacgaucuaaaaguuuguugauaugugaauagcuuccuauuuucauuuucauugguaucuuuucuuuauauuuuaaagugccaccuggauuccugaaacaaccugcuaacauauaugcucacgaauccauggacauuguauuugaaugugaagucacugggaagccaacuccaacugugaagugggucaagaauggggaugugguuauccccagugauuacuuuaaaauuguaguaaguauuuuuuucaaagaaauacauuuuauuuuugaaaccuucaaguguuuuuaaauguaauaaucaaaagauauaauagacauaccaguuuaaauuacuguaaaugaagaaaaaaauauagaauguaauuuacuuuuaaccuguagagaaagcuuugcucagaaguauuuugguagcuuauauguaacaugagauuacauagcaaaucaguggcuggucuaggcuuagaacccaccagcaaucugguagugagaauguagcugucagcauugcacaaggaaugcagugugugcaugcagguguauucucauugucuucacagcuauauucaaggagcagaucucucucguccucucucucccugucuccucccuuuucuuccuucuguuccuuucucccuuuuuccucccugcucccggggucucacuguguagcucuggcuguccuggaacucacuauguaagcauggcugcucuagaacuuacagaaauccaccugccuuugccucuugaguacggggguuaaaggcaugugucaccauauccagcucuggcuuggagaauggaaagauagucauuuugaaaagcuucuaagauaugacaaacccuacuaaacuuuauaaacuuauaaaaacauuaucauacuucaaaauaagaaugaccuuaugcuaacauuacuaacaacaaaaauccuuuuagaaagugaguacgucaucacauagugcccuucauauaauuugcauguauuaguugaaggaacuuucaaaguagauacaggcaagccauggugauauuagccuguaaucccagcccucaggaaaugaaggcagggggauaauguaggggcuugaggccaggcaggcuagguuaucagugagaugguaacaaaacggcaagugcagaucguguuaaaugucaagcuauauugauaucucagucuguaaaguacuuuccacguaagcaugaaggccuaaggucagucuccaggagaaacccagguaaggccuugaguugaagagccacacuauggagauggagacagguggaucccagaggcucacugccagcuagccuaaccuaaccagcgacucucccagaucccagugcaagaaagaaaauguggggcuggagagauggcuuagcauuuaagagcacugacugcucuuccagagguucugaguucaauucccagcaaccacaugguggcucacaaccaucuguaauguacucuucuggugugucugaagacagugacaguguacucauauacauaaaauaaauaaaucuuaagaaaaaaaagaaagaaaaaguguuaaauguauaagaauuccuugucaaaauugcauuuuaauucuauauauguuagguauauaguagauauuauugccuacuaauauuaucauuuuuuaauaucaaacaaacaggauuauuuagguuuuaguaauaaguaugaauggcauaccuuaagaucuuuacucaaaacuuauuaaaaagcucagaaguaauuauaguguuuuaaagacaguuucauuuugaaaauuugucaugcaaguaauucauuuuugugggaguguuucuaaaaugcauaaucucauguuaacaaaaaguaguucuaaguacuuaacauuaaaaccaaucuguugugauuaaauuagcauuuuuauuuuaucauuguuuauauguuguuuuuuaaauuuuaaagcaacauuuaugcuaauaacaguauuucuuccuucucuuugagaacauauccuugagguuuuaaagucauguuuauuaauuaagacauaacauuuuauauguuuuucuuccuuagaaggaacauaaucuucaaguuuugggucuggugaaaucagaugaaggguucuaucaaugcauugcugagaaugauguuggaaaugcacaagcuggagcccagcugauaauccuugagcaugguaagaggggagcagcagugagcugaaggagcuugcacuggaagcaccauuacuccagggugccuugggauugcuagcuugcuugguaaaacgagccugugacacaacuacaagcgaaagagcagcagucuaaaucauuccugucacuuacaguuacuuagcgggacuuagcaguuaagagcacuuucucuuucaggggaccacaugacagcucacaacugucuguaacuccaguuccaggagaucugaugcccuccucugaucuccuuugguaucacauguguuguacauauauccauucagacaaaacauucauaccuauuucaaaagucuaaagaagggugcuggagagauggcucagugguuaagaccacugauugcucuuccagaggaccuggguucaauucccagcauccacauggcagcucacaucugucuguaacucuaguuccagggcuucuggcacucucacauagaaauacacacagacaggacaccaaucaacauaaaaacaauaaaaauaaaaguaacuuuuaaaaaguccaaagaaaaggaaaaaaauaaaauuaccuagagauacauuuucagauaacguuaaaaagaaguugauauuaagagaaaaacugaaaaaaugcuauacaaguguuuaucagaacccauuugugucaaucucacaaauuuguuucugugucauaagaaagacuucuuaauguuuacuuugcacuaguuguuuuuccaaacuaaaauuaguguaccuuuucuuauuauaaaaauaccuguuaguaaaauaaauucaaucaacauugaagaaaagaaaauuaagaguuaagucagggaagccacuguaaucugagaaaaggaagcuuaauauuguacaguuauuauuucuagagaguaacaguuauuuagcuaguaagaaaacaccuauuguaaauagcauuggcuuauauaacaagcaacaguagccucuggguaaagauggugucugcagagaaagaccuucacauaagcugaagucuggacacugcuggagagaauguggcucugguuuucuagaugacagagaaguugauacagugcuuuguuguugaaacuucagauuuacuuuuuagggucugaggagaguugaucauaaguugguaucucaccagaggcauuuucugcaaaagcacccaagagguccuguguuggggaaagcgacuggcucucagaaucugcacaugagagcuaagaaggaaguccucuccuuacauaauugguaucuccaguguuugugcugauguguguaacauuugugccagcugagaaaaggaaaaacuauacuaaaagcgccuggcuucauuuuaguugagcaggaaguaaaaccugaauguggaacugggaaguuaauuggaugacauacucuaaauucuaggaaugcugcauaggcgcacacagauauguguacugucuccuagcauguuuucuugcaacauaucccauguacaccuuuccaugcuagcaguuuacaacaguguucguuguugaauagaauacauauauauauacgcacacacacacacacacauacuuuuaaguuauucucugauuacacuuaaguuguccuuuuugucauuuuuuuguuuauugcuauuaugaguaguguuacacugaacuuuuuuaugauuauauuuucauacuaaauuacuguuguauaacaguauaugguaaggguuaucacuuagcaacuaaagcucucucccuuuuuuuuuuuuccucuuuucauuuuauuuugagcauuucuugugaaggcaugacaaagguggcauuuuggauauccauuucugagucagauacaguaagauauaguguaguuccagggccuucucggagaacuauagccugaccagagaaacuguauggcaaagcuggcaccuauacugucauuuuacuaaaacagcauauaggauuuauagaugcuauuuuuuaaaaauauacuugggaaaaaaugaaauaaagauagugucguaaaaggugaaguaucuggacagcucucauccugcgcucuacugugauuaugccuucucucaccuuagcaaccuucacgcucguaaaaugcaauuuacugaagugcguacuagcugagugagugaagcagacagcuuuguuuguuuguuguacaaugcaaugauuuucuuaguaaacuuuacagauauuuagugaauucacguccaccuaagcacuggggcuucaguguguguuugugauuacuucuguaacuauuaccaguguaaauggaugucuguguuaggagcauccuaauggagcuuuuaucugaauguguuuggugguauaaucauuuuacuacuaguauauguuuuucucugauuuugagaauauuuaagggcuuugggaauuuuuuuuaugaucauacugacaauacauuggcaagucauaggguauuagaagaauauaagucccaucuuuauuaaauuuguguccuauuuuuacauuuuauuuuuuauguacuuaaaaauaauuuacuuguaugugugugugcaagcuugucaguguguguaccauuugcccuuggagacuaggcuucaaauuccuuggaauuggacuuaggugauugugagaugcuugguguggguguggggacuugcaagagcaaguccuuaaccccugagcuguauaucuucagcccuguuuacuuauuuuugggaugggggaaggugcugugugccucaccauauugcccagguauccaauuccuuggcuuaaggugguccuuuucuaucucaagauuagaacuguaagaaacauuugcaaccauacguggcuuuuaauguuuuaauugucuaaaaauuaauuuuuuuaucauuagguuauguguauguaucucuauguggauaugcacauacgaguauccagaggcauuggaucuuuugagcuagacuugggaguaauugugagccacccaacgugggcgcugggaaccaaacucagguccucugcaagagcuguaaaugcuuucugcugcugagccaucuuuccagccucuuaguguuuugauuuuuaagauagauauuuauguaggaaagccaaaauuuaaggaccuuuggggaaaagcagcccaaauuuauacccaauaaaauuauuccuccaaaaugaaggugauaugaagaccuuuucagaacagaaacugagaaaaauuauaguaggaaaagauacaguaauaaaauuuaaugaaugguuuuucugcuuuuaacaaauuuacuuuaugaugauuggauagaauguaaauggauuuguagcuuucccucacucuuaaagaaauuguaaaucauuacauuguuugauaaaagcauauugguaguuacaucuuuaaaauuacuaauuuaacccauuaauuuuuuaggagugcuuccuuaaaagucagaaauuuagaaaaagacuguaaauauuagcacuagugauuuaaaaagguagagaaauagggauagagggaaagacuaagaagugacuuaauauuggccaguagaauaaaaaaauaauuguagaacaacuuuaugguagaaaaguuacuugaacacuuuuuaaugacaugagaaaagucuuaggaaagaauuucaaguagaagagauguaaaaccaaauagaugaaaucugaauuuaaaaugcacuuaggcauucucuuuccccaaauguuuacauuaauuaagugcuuugauaaaugauacuguuuucagauugcuguaugaacuuuugcauaaucugucagguuuuuuuuuuaaguacuaaacucagcuuuucaaucauuauugaaagguagaaaagccaccagacacaucauacugaugaccuucugcuaauaacaacaucaguggaaggucagcauucacagcuagucccuuuuagagugauguugcaugaagcagagaagauucuagcaggccccacugauauccuuugauuugacaggauguagagggaggcuuaaacagcaugaaguggaaggaugaaaacaagccuacuuugagccuuucuuuaccuuugcacucauuagaauuuugacucccaggauauacugugacuauauaacaauucccaaaaccucucccccuguauccuuguuuauguggaagcuuugcuucuuuguuuuuaacagacucacuaauacuuuacaaggaaauguuuaagaauggacuagaucaaaguugacagaguguaccucaggcuggauccaucccacuucuuguauuuuucauuggaacaugaacauacacguuuggucacagauuaucuguaucuuaucuguggcuauuucauacuguaaugacaaaagucaauaguuuagagagagacuaaauggccgguaaaaccuaaaauauuuucuugccuuuuauacaaaauguuuugccaacuacuggauuacaucacagacauuaauaguuugugauacuaaguuauuucucguuggugaaaaucuacuucacauacgacuuuuuaaagggaaaauuggaguagaggaacggagaaaacagaagagaaguaaaccgaugaaagcacaggauaggagcagcagauccaggggaagugcgcugugagccaugaaggagaagugggggcugcagacagugucuagagcauccuucuggauagggggagcagcauagugugggcagccugcgaggugaucuuuauguuuauauccuuggcuucaaaauauugaagguauuugagcaucucuaacauagucuuauuuuuuuuuuuuuuuuuuuuuuuuccauuuuuuauuagguauuuagcucauuuacauuuccaaugcuauaccaaaagucccccuuacccacccacccccacuccccuacccacccacucccccccuuuggcccugguguuccccuguaccggggcacacaaagucugcguguccaaugggccucucuuuccagugauggccgacuaggccaucuuuugauacauaugcagcuagagucaagagcucagggguacugguuaguucauaauguuguuccaccuauaggguugaagaucccuuuagcuccuuggguacuuucucuagcuccuccauugggagcccugugauccauccauuagcugacugugagcauccacuucuguguuugcuaggccccggcauagucucacaagagacagcuacaucuggguccuuucgauaaaaucuugcuaguauaugcaauggugucagcguuuggaugcugauuaugggguggaucccuggauauggcagucucuacaugguccauccuuucaucucagcuccaaacuuuguuucuguaacuccuuccauggguguuuuguucccacuucuaaggaggggcauaguguccacacuucagucuucauuuuucuugaguuucauguguuuaggaaauuguaucuuauaucguggguauccuagguuuugggcuaguauccacuuaucagugaguacauauugugugaguuccuuugugauuguguuaccucacucaggaugaugcucuccagguccauccauuuggcuaggaauuucauaaauucauucuuuuuaauagcugaguaguacuccauuguguagauguaccacauuuucuguauccauuccucuguugaggggcaucuggguucuuuccaguuucuggcuauuauaaauaaggcugcuaugaacauaguggagcauguguccuucuuaccaguuggggcuucuucuggauauaugccccaggagagguauugcuggauccuccagagcaauucgacaacaaaaggagaucaaggggauacaaauuggaaaagaggaagucaaaauaucacuuuuugcagaugauaugauaguauauauaagugacccuaaaaauuccaacagagaacuccuaaaccugauaaacagcuucggugaaguagcuggauauaaaauuaacucaaacaagucaauggccuuucucuacacaaagaauaaacaggcugagaaagaaauuagggaaacaacacccuucucaauagccacaaauaauauaaaauaucucggcgugacucuaacgaaggaagugaaagaucuguaugauaaaaacuucaagucccugaagaaagaaauuaaagaagaucucagaagauggaaagaucucccaugcucauggauuggcaggaccaacauuguaaaaauggcuaucuugccaaaagcaaucuacagauucaaugcaauccccauuaaaauuccaacucaauucuucaacgaauuagaaggagcaauuugcaaauucaucuggaauaacaaaaaaccgaggauagcaaaaacucuucucauagucuuauuuuuaugugagaaauuuucugcuucccacaugaaaugugugacuguauauaccagcuguuggccuucuggaacaauaagugaaauuuuauaauuauaacuaaaauauuagacauuuuaugucaucaucagaaaauacaauuccuuacugaauuaauaggucaaauuugagaagcauuguuucaacauuuucuuaaucaaaacauuuaaaauguaagacagagcuggcaugaccacuaagugggcaaagguaucugccacuaagccugauaacugaguucaguucccagaauccauaugauggaaggagaaaaacuuaacucccucaaguuguccucugaugcucauauguaucuugugccuguccacacuacacauguacauauacacacaauugaauaagcaaauugucauaauuauaagaaaacaguaaaauauuuaagauauuaauaucuaacacuaugcauuuucaguacgggcaguacuuucuuuguuguuacuuguuuugacguugcuauuggcaguuuguuuuguuuugagaucucuuccugugcaugucagauugguggugagcucaccuucuaagugcuggguuccauugcacaccaacaugucuggcaacagcaucucuuaguuuuagagacucuuaaaauauuuaauugaacauaaaauggaauuacuucugaauuacgacauuucaaauuaauacuugucuuuaauaauugucuguugaaugauuuuuuuuaaauugucaguaaaaauaguacaacuuaguuggaugguguuggggcuagaguucuguaacccuagcacuuagaagucagagauaggaagauuuugaguuccaagccagucugagacuucacagggagagucuaucucaguuagauagauagauggguggauggacggacggaugcagauauauuaaaagcagcaaagccugagggaaaauauccuuaacuucuucauugucuuuucuuccugcuuauuuacauuuagaaauugccuuuaauuuuucuuguaaaacugaaauguaauaaacuuagaaauacacuuuuuaaaugcacauccugucaacgggucuaauaauuagcaguauuuuuuuguugcagaagggaggaaggggugaugaaaggaaguaacgugaacuuguuuacaguaaaggaaauucacacuuuaccaacacauuaaauggcuucuaggauaucauggccaugguagauaagaauacauauugaguauuaugagugauuguuuuuuucaaauuuuugacugaaauacuugucaaaaauuccauauaguucugagguuauugaaugauagaugcucuggaaaaagugacuagagcuuggcaugauuaaaaguuggcuaaguagcaagaaauuauuagucaguaguggaauauuuuaaaucuaaagcgcuacuugcaaagguuaguuaguauugaucaaaggguuaauucuuauuuauuccuuugcuuuuguacuaguaaguauaauuuuagaaaaaguuuuacucuagauaacugguauaauuggucucuuaauugugcuuucuguaucuaggcacuuucuuguuuuuguuuuuaagacuccugcuuuauaacccagacaggccuguaauugacuccauagccuaggccggccucagauucacagaacuccuucugcaucacuucccugagugcuaggauuagucagguaccaccacacccaccucaagucuaggaacuaagauuauagauguuguaaugccagugucuccucugcaccugacuuacuuucugagucgaguaucaaaauucugugcuuuuuguuuucuguaaaaugaaggaauuaaauuaggugauuacuggauuguuguuuuguuuugguuugguuuuuuaaaaucacuucauauaucccaugaaauguaaucauuuuaggaguauauuaauaucagaugugauuuuguuuuuuauuuaauuuuauguuuuuuacuuuaauuuuaugagucuuuuugucuguuuuuaccacuaaucccucuucgggcccacaaaugaaaaugaaguuaaagauuaacauuaugaggcaaacauugagguuauucuuuaaguagaguuuuuuaaaaucuacuuaauauauuuacgucauuuaaauuugcaaaauaaaauaaucuuuuaugaccagauugaaaggcaccugaaauagcuggauaaaacuaccuaucacuguuuuaaaacagaccuaacacauguucauuguaacaaauaagagcauguaauugacugauaaaaaaggaaauguacuguuccucuucccucaucucacuuucuagagcuagcccuuguuaacaaacuuggcuuauguaguuagucaguaaauuuguaugguaaaaucccauauaccuuacagaaguauggguuugugccaagugguaagguuggaauagucaggaauuggaucuuuggcccucauagaacauuuaucuguuagaauagaaaaauauuaaacaacuaaaauauaaacaaaauaauuaaaacguuugugucugcuuaaaggaaauuaaauaaugcuuuaugcuguggauugaauuuagaaucauucccccacaggcacguauguuuaaacacuuggucucaaccuaggguuacucuuucaggaaguugugggacuuuuggacauggggcaggguggaugauacagggauguggcagccuuccuagaguuguagucagccuaagaugagagggaaccaucuuaagaaccccaccaccuaagcaccacacuagucccagcugcuaugccugccuauucugccauuaagcugugagcuaaaacaaaucuucccuucucuaaauuauuuucucuguauauuaauauuuagucccugugacaagaaaaauagccaauacacugauaaagaaggauggaacacaggccccccaauggaggagccagagaaaguacccaaggagcugaaggggucugcaaacauauagguggaacaacaauaugaacuaaucaguacccccagagcuccugucucuagcugcauauguaucagaagauggccuagccggcuaucauugggaagagaggccccuugguauugcaaacuuuauaugccccaguacaggggaacgccagggccaagaagugggagugaguggguaggggagcagggcggggggaggauauaggggacuuuugggauagcauuugaauuguaaaugaagaaaauaucuuuuaaaaaauauuuuaaaugaaaaaaaaaaagaauuauuggugaaguuaacuuuauuauuuggugguuguuugugggauggauccccagauggggcagucucugaauggucauucuuucagucucugcuccgaacuuugucucuguaacuccuuccauggguauuuuguucccccuucuaagaaggaucaaaguauccacacuuuggucuuccuucuucuugaguuucauguguuuuacaaacuguaucuuggguauucugagcuucugggcuaauauccacuuaucagugagugcauaucauguguguucuuuugugauuagguuaccucccucaaaaugauagccuccagacccuuccauuugucuaagaauuucauaaauucauuguuuuuaauagcuguguaguacuccauuguguaaauauauccuauaagacaaugagacauguuuuuguuuucuucuuaacagcauacuuuuuuaaaaaaaaaaagugcaguugaauaauaauuuaccauuuaccugaguguaauaguacuaucuuucaauuacagcauuuaggagacaaaggcaauaugauugcaaauucaaggccagccugagacacauaggcucucguauaagaaaaaaagaaagaguuuagcauacauuucaacaaacagugaauagucauuuaucuugaagcuguaguuacaagguauguaaagguugauauuacuuaaacuagcauaaauuugaaaauaaccaaauuaauacaaccaauaagagagagugcuuuaaaacauuaaaaaauuaugggaaccuauguauugaaaauaucuuaguuacgguuacuauugcugugaaacauuguuaccaaagcaacuugggaaggaaaggguugauuucacucaguuuaacucuguauauauuacuucauauaacaguuuaccaucgaaaguagugagggcaggaacucgcacagugcaggaaccuggaggcaggagcugauacagaggccauugaagagugcagcuuacuguuugcuucccaugucuugcuuucuuauagaacccaggacgaccaaccuagggguggcccuaucaacacugggcugugcuuuccccuauaaauaacuaauuaagaaaaugaccaacagguuuuccuauaguccagucuuaauugacacauguucuuaguugaggcucccuccucucugaugacucuagcuuuuauaaggugagauaaaagcuaaacaguacauauccaaguuacacuauugacauaacaaacugagcuggacgugguugugaaugccuguaauccaagcauuggaggcagccaaguuaaacuacuagaaauuauacauggaauauauuaauuuacauauaaugguuucuacuuaagaaaauuuuaguuuuuauuucuugaagcaauguuaugagagauaaaacuguagguugcauauuugacaacugucucuaaauguuggacauuguagcuuauuuuuuucaugaauaaugaaucauacaaaugguaagguaaaguauaauuuauuaaaauauuaaaaguaaauuugauccaggccugagaacucauacauguaaucugagaauuuggaggcuagaguaggaugauugauguaagcuccaggccagcuuggcugcauagugaggugaaguccagccugggauaaauuguaaaacccugucucaaaaacaaacuuguaaaccaaaagucuuuuuuuuuuuuaacugaguacaugaauagagaucccuagcuaucugaucccuacuaugcagacugguaugggaggugacauugaaaaaaaaauuagagucuagcuagaauaaaucuuaguuuuauuuaaguguuuaguuuuacagacuuggagauucagcuaagugaccuguuuaaaacaaauuauuuagcaugaaagaacuggaaccuagauucucagcuucaaguuuaugauacagaagcagguuuuaauguuucuaagacagaagcucaugugggguuuuuugccccuuucacuuuaauuucaaaaaucagacuuuuaagucaguauugugcuuauacuuagugacaaggcuggucagacaucauuuuggaaacauggcugagcaccaaauaguuuugagauaacggugguuuacuucacucauaauuaccaaaaguaccugcuguaacucaggagugucagaguauguauaguauuaauguguggucacccucugucaaaccugaacaguucucgaagugccagcauagaggcuuuauucuaagaaucugaauaauuguagcgucggcucugcugaaugccaaagugcuacucaguuucuaaacaaaaagaaaucauuucuguaugguuucuaagacauacaaggcuuuuuugacugaacuuuuuaaacauuaacugaacccagaaggguaucugggauuuuguugauuaggguucauggagaugaaaaaaagggaauuuaguuaaaguguagaaagauugaacaugcauugaaagaauagcaggcagcucagcuuuagaauucagagacgagugaauauagaagugaauaucucaaggaggugugugugugugugugugugugugugugugugugugugaguguguaccagauucuuuaauagcuaguuauagauagcauuuggaagacugcagcagauuuuagguaugugucucugauaauaacucuguaccaauuaugugcgguguuuaaagcucucaaccauguaguagcaagaacauuucuuugugucccuuaaaauuuuuugccuggcaauaauuuguuaaauguuaaguagcuauuccuacaaagaagguagaaccagaucuaugauuuauugaguuuguguaagggagaagggcuauauaaaucuaagauuauauccuuauucuuucuggguuaggaaaguuugucaucauuaugcuugagcuauaauauaaugcauguuaguuuuagauaacuuugguaagguugacauauaauuauaguuuguuuaacuugaacaugaauuuuaucuuuuccaaacucacagaauuuaagacuagaguuuaugagacuaagguagcaacuuacagccucagugauauuuuugguauuuaguaguuaaauugaaaaggcccugcaaaugaccuuuccagucucaaagaugugcuaagaaauuuucagaaagcaaacuuaaauuugaauuugaugcuauuauuuuguuauaaaaagggaauauguuaugcagagcuaagaucccagaaggauaguguauaugaauaucauuucuuuggaagcuauauuuaaaugaugcuaaauuauacaguaauguuauaauuggcagaauaucauuugggucagaaagacaucgcugacaaccuggaugcuugcagauuugaucucacacaguaucaaucucgaauuguugugguuuucaucuaaaguguuggcauugagacugucucccaauugauacaugcuuaugaaaucaccagaaauaaguauaauaaaauuugaaaugcaguugagaaaguuuuuuuuaauauuauugcauucagugcuucuguugccucacaagaacuguuguccuaaugcuuuagauguguaaagcaagugcuuuggccuagcauugaugucugagucucuaugcauguguaccugagcuacacucuaaguaguaaaguagcugugagggcuuuuuaucuggauucuggcuuggggguggguuuuuccuaaacuuugguuucucuuuagcucauacucaaaaauuuuaguucauuaaaguagucuuuuaagagaucuuauuaggguucuuugacuucuuuagcuuuuuauacauaagagauuuuuacaaaauuuggcuucugaagcugaaucuuaaaagcauuaauguucuuucagauguagcauuauggaaauuugucaugauuggaguuaacaaaucauuaagcucauugaaacaaaaaucaaaaaaauuuuuggucaaaauaguagaaaaugaguagaaauaacugcacauuuuguuuuaugucuucugggguauugagagcuuaucugggaaacagcaguuugauuuagaguggaaagaaagagcugucuuuuucuggggcucacugcugagguaggugcgucauuaacaucugacacaccuuuuaaaaugaauauuuuuaacgucaggaaaaagucagaugacuuccucaauacugaaacaccccuccugcacauagaaugggaggaguauuuuauuuuauaacuuccuucaauuguuuauauaaguauuuuuuuaaaguagcaguccacugcaaguaugcacacaauaguaaugaugaccagagugugccccugggucauaaaauuacuuuucaaccagugaggaguuaauucuucagagaaagagcuguaagucggugaguugguccuuaggauucugcaccaaaagcaguacucagaauacacagcuuugucaguguuggugaguuaauucauggucacauuguauuucuucccuaccaggcuccuggcuauuuggcaguuguacuaaagagcauuguguguauuuagcuaauuuugaauuccuucauuuugggaguguguuacucucuuguaaccauugaaacuggguaccaaauucacaaauaacaacuuaguugagccucagacuacuagagaauccugaaagcuuuuaaugaugcguuccuucaugagucucaaaccuucaugcuucucuguaaacaguuuccuuaauucaagaaacagccucgcaucuuccaacucaccagaauuugaaaucuuuucauaaucuagcacauacucaguuuuuaauaacagcucuauguauguuaucuaaauauaauaguuuaugaauauuagaccaaacuuauugguuacauuuucaaauucuauagaacuuuauccaauuuuuguccaccugcucugccuuaagaacuuucuagugaaacauaagcacggguguguuagguuccugagcugcagcugcuguguguuucccaggcugcguugucagcgaaggauaugugacuuaccgcccugguggacgacucuuucauaaacugcagggcacuguaguauucuaagaugcagccuuucagguaucaaaauaugagaaaguaggucucacaaccaagaaaauacagauuguuuuucaucagcaggaaacacuuguuuucucuuggucagucauuuugccuucaauucuacuuagaucaguaucaguuuucucuuaauuacauuguuggccauguauuguaccauuaucaaacuuugucauuuucuuugaugauugucacuucagauagcuuuuuauuuacuuauuucugcuaucucaauuuguuucuuuaagcuuuaucauucagcuauucuuaaaauugcgacauauuuagacaauuuuuuucuaccuucaacacacuuaggguuaaucugauuuuuccucuuaccaaauaauaagucuguuaauuuucacugucuucuuacucacauugugccuuucugcagaccacauucgcuaagccauuuuacuuucuuaaacuugucugaagguuuuacacuuauaacuggcuugauuaaauuuuauauaaauaccucuugagugugcaagaaguuuuaagccagugggcauuuuaacaaaccacucggcauuagcuccauucaucccaucauuuuagguugccccuccgucucugggaacuguaggguuuugaccugucuuuccauugugauuucauggugugcuguguguaccuuuuccucgugugcaggugacauguuccugccauccaacagcaguuuuaaauacaaagguuugcauuucuuuagguccuaaaauauuuuaugauguucuagcuuguuaccauugcuuuuguugcuuauucuguuaucuucucuuagcccucuacuguauaaacuacccguuauugguuaauauuuuagaaaaauauuuagaacuaccuucuaaugcauuuguuuaaaauauuuuuaauuuuuauuuuaggacuuuauucagguuuuucuuacugaaauggguuuauacgauuuauucugauuaauaguuccguuucaccagcucuucccagauccucuccgccuccucaccuacucaaaucuacacccuuucuccaccccuccccccaucagaaaacaaacaggcaucuagaaaaauuauaauaaaguaagauuuaaaacaagccagaauaagacaaaacaaacacagucaggacaaaguaaacagauucacaacuggacggugugcagagauugagagaccuuagaccacuaagucaagugucuccaucaaacgucuuccccaaggcucaugaagcucugggacgaggaggcagaaagauuguaagagccaguaggcaugaagacaccaagaaaaccaagccuuccagacacagcaggacugaugcacauaugaacucccacacacugcagcagcaugcacagggccugcacaggucuagccuggauggggucccaguguugagaggggagcaaacacaagcccuucucuguaauacagagcuaucucuaaucaauaacugcuugcacagaaaaaauugguuuuccugaccgagucucguuagauauuuaaaccauacuuaagggaagcuucguguccagcaguaaacgguuaacacaaacgaguucaguguuauuuuaggaggguuuuuuguucucauaaugguuugucugguuuguuuguuuguuuuuauuguuuuuaucuuaacaggucuuuugcuuauauagugugguuuucaguuuucuuuuucuaaugggauuucucucuguguguauauguuccuugugcuuuuucuuuagcucuuuuuuucugaagucuacuuuuccuaaaauuagcauagcuaaucaguauaguaacuguguagacuuuuuuuuaaaaacaucacuuuugucuauggugcuggggacccaaccucacauguugaguguguuagcuaagcacuguggugcuggucuccauuuuuuuguccagugcuaguuuuguuuugauuaaugcuaacaugauacaccacuuguccauuuuuguaucauuuugugccugguagguccucccaauacauuuuuacuauuaauguuuuaaagagauaauuacgguuuuauaucagcaugccuguaaucccagcgcuugagacagccuuggcuguauaagagaucugucucgaaaaccaaagauggguuuggagggaaggagagaacaaggaagggggcuugagguuuggguugauguguaacuggugcagcuugucacuccugaggcaaaaggaggaugcguucaaggauaccauuccauuuaaucgcucaguguuuccuugcguucuuuauggaaugccuccuguuuuucucuuuucugcucauuugaaaaguaaaacuaucagguuuggauauagauuuccauucucuccuucucccucucgccagcaaugcucaacagguaucauuucagaacaacagucggugagcgcuguuguucaguguaauuucugcccuuacuuuguaaauagacucucuuaaauuaguuucuucaucagaguuguuggcuuguuauuaauuguauggauuuuaucuaaauaugauaaaggaucuugagcauacaugucuuaauacugccuuggggaauaacacuuaugaauauugaagacauggcaaauaguuuuaaaauuagauacaccuuccuuauuacacuagcaccaauaagguuauuugaacaagcaugaccauuuuaaggauauucaggauacuugggaaucguuuacacuuuagaccuuuucucuuucuagaagugaaauaaugcugauaguaauagggaaaugauucccaggcugaaaguagaugucaggucuaucauugcuucugucauacaaaccuugaaaaaaaauaacauaucuuucaaguuuuaaaacucauguuagauuuucacaagacaauuugauguuucuuucaaauaauacauaacaaaaaagugcauguuguuucaaguaagcccuauucuuuuuuuaaucuuuuuuuaaaagauuuauuuauuuuauguauaugauaucuacauguauaccugcaugccagaagagggcaucagaucccauugcagaugguugugagccaccaugugauuacugcgaauugaacucaggaccucuggaagagcagccaguguucuugaccacugagccaucucuccagccuccccuccucccuuuuuaaauuuuaugugcauuaguguuugucuuacaugugucugugugagggcgucagaucuuggaguuacagacagcuaugagcuggguacugggaauugaacccagguccuuuggaagaacagucagugaucuuaaccacugagccaucucuccagcccaaguaagcccuauucuaagcauaggguucuugaaaaauuauuagacuuuuuucuaccugaaaaucagaauguuagaauuaauaaaauuuccucaugugagcuuuguuggaaaaaauuauucuuguccugacagauguucguaaauuagauugugacaguguacaaagagguuucucagucauaaccacacagcauuauuccuuugcucuauuuuuugucucauuaucauauuuauaacuugagaauaaugaugaauuuuauuauaggaaaucuaugucaucucuuaugcaucucccuaccaagcugugaaacuugucucguacacugagagacaccagugggagcgcugcauacaacuugaagucauaacuaccuuauaccuuacagugccuccuuuaugugacaaaugacucaggaguaaaugauauguggcucuuauucuacuacuguuuuuauuuuuaauaaaguacugugacugguagccuaauacgguuguuucccugacugaaugugaaugcuuuuacugaaccucuuucauauauuggaguaguuguuuuguuggauucuaguuguuggucugugcaucucaaaagcuuguuuguuuucuaauugcuucuuuucagcuguuggcuauagggaaaaugaacugugcuuucagaauuguggaauaggacccagaagagaaguucucaggaugaguacugagcugugugaacuuugauauacacagguuuugucaauuuuagaauggcaucucuaacaguuugauugguuuuucaacggcacuuauaaaaacagcuuaucucuacccugcuggucuugggaagacauugccugauagaaaccaugugaaaugauggggugucuuuucaguuuuguuagaauaugguaccauauuuaccagugugacagcccuacuggcuuuacucuuaaaaugaugauacucuuuagggaaacuguuccuacauucauugugaagaagcuggcugugauuaaaaauguuuccuguaaccauagaaaguagccuggauugccuaacaagacccugacauucuuuuggcaaugcauucaucucucuacuuccagacuggaauauaauguaaucauucugcugccacaguuauccacuauaauguacuaugaguccaaauaaacccuuucuucuuuaguggcuuuugacagguauuuuucucacagcaacaagaaaggcccucaaaauacuaggcaggugcucuacaauuuacaguugaucuucauccucaauuuaggugacuuuauuuguuguacuuugaagcagggucuccuuguauagguuuccagucuaguacggaauccauguucucauguucuuccugucucaccucccggguguugacagguauguggaaauaaaauaaaacauugacaucuagaaaugaauagcaugucauuuaucaagcaaacuguuggauaauuggaguuagccuugaauauagucucuuaucuuaaaagauacaaacugagccaggcaugguggugcacgccuuuaaucccagcacuugggaggcagaggcagguggauuucugaguuugaggccagccuggucuacaaagugaguuccaggacagccagggcuauacagagaaacccugucuggaaaaaccaaaaaaaaaaaaaaaaaaaaaaaaaaaaaaaaaaaaaaaaaaagauacaaacuaucuuugaagccuauacuuccugaguuuguuguucauaauuauuuauuaugguuaguaccaugauccagaaucuuuuauuacuguacuacuucuuugagagaaauuacuaauaacuuuugcagcauuucaaagcacauauaacuauaagagaauauugaacuaauuucugcaguaaacaaccagacaauaaccaaacuagacaaagaauauaaaagaaauauuuuaaacauuuugcaagcaugugaggaucaugaccacuaagauuagugaaauuagccccaucuuccugccuggaauacuuacuuccugcugcccaggguggguaagggcacccuuagucagagcuagauggaagaguuagguugagaaagguaguuggaauuuauagagcaggcuacuugagagaaagguacaggaaagaaacucggagaguuguaggaauucauucuccuccagucuuuuggauaccauguugcauuuauguucuaucugucucuuucaauuugacauuucuguagacuucugaucuauccuaucuucaacacuuccaaaguuuuggucaaaguauauguucucucauuaucuuaugguuaugcggaugagauuuuucuuuccuuaaguacaaaugguaagugacccuguagugcuucugcaucagauguuugucaggaugccuugcuguuuggucauguuaaccuugauggcgugugugacuuaggugguauccuccguucuaucuccuuucugaucuccucugauuacuugaguauaaauguugcagaggauuuugaagucucagagcuccuucaucuuauacaugucaucccugcuuccaaauguacugacaguugaucaauugauuuuugucuuuucagucugccccuuuguaguaccuaggaugccagaauuucuucuauuaaauuuacuuuaucuuaucugccuuauuucuuaguacacuuugauuuacuuaaaaugcuuuuuuguuuaauacaaaauggaauuuaugauguccugguuauuauuggaauacuucucaagucagguaugguggugcauguuuuuaauccuagcacucaggaggcagaggcaggaagauuucugugaguucaagaccagcuugaucuacagagagaguucuggaacagccagggauacacagagaaacccugacuagaaagaccaaaagcaaacaaacuaacuaaaaucaaacaaacaaacaaacaaacaaagaaaccaucugugcaaggaauaauaaaagugacucuaugcuugggaauauucaaauucguuuuuauacagauguaguagccucuucaagccauauguuguacaaaaguuugugaagcaacauguuuggcaucauuccauuucuuucuuuacguguguaaauauaaagacaucugugugagucagcucucuauugcugugauagaguaucuggggaaacugccuagaggaagaaagcuugucuuugcucaugcuuauggagguuuuguccaugguuguguagcucuguugcuuugggcuuacuguagugagguauuucauaaggagaguguuagcggagcuuguucacuucaugacuccugagaaguugaggagagggagacagagaaaggguuuaggagagagaagaaaggagaucccaagaaauauuucagaagauaaagauaccaauuacauucuacuauacauacuuggauauaauggaaagugaggggucucugcagaugucagacagagaagcaaaccacaugaaaagauaagaaugaaaaccagauugacuuuaucagccuggaucagacuucugagagucuaaugccaggugguuccuugucagcguauuuaaaacauaguacaauaugggaaaagguuuccaggcaacaaucaguccaauuccagaugcacaauaaagcuuaagauguuggcuacauagaaacuccuuuucaaaguacauguaacuaugaggugguuuccauagauaaaaggccuagaaucuaguguggucucugaccaauagcauagaggucagcagaccauaagggaucucccccaagguaauggucuagagggggaagaaucugggauaaacauucugugccaucucccuaaggaugaguugagggauggaagagucuggggaaagcauucuggcacauuugggugaggacugccuccacaguuagcagcccccacucucagcuuucuggauggaaugcaggugugugauuucucuccuccacugaggagaaaucacaccccuucaugauuaacauuccugguucccauaaugcuucucuggaguacccucguacccuccacaggaaaggaagacguuaguucuucuacuuacacacuugugcuuguuguaaguuguuuuuauaauuuacugugucuuuacaauaaaaagcaugaaauuaccuccacaugguugaacagccuagcagcuuccaggcacaggagcucuuuucaguaggcucucugcaguacaugaucuuggcugguauuuaaucuagggugucuagcaaggacuacugucugggagaaaaagauugcaggauuaagauuuagaaguguugcaugcaaacaacauaggauucuccuguagaauugucagauuagcacuaggcucccauguaucucuuugucucugugucucccucugucucucuaauacacacacacucccuuuuucccuccccacccccuccuuucugguauacuuguuaacuuauacaugugaugguguauggagcuguaccuucguugacacucaugcauuguguagaucucacccaauucuaggcaacgucaccaugaacaucccuggaacuuaacaauauaguagaguucuuuacaugaggaaauaaagggcuaccgagaaugaaccuuucccaagacacucuugcaguuugaaggaauuuagaaacuacacacacacacauuuuguauuucaaaaugaaauuuuaaaugugccuacucacagcucgcuucacugacuuaaguaggugucaaauuagaauaauuggauccucuuaaccaagggcaacauguccagcacagaacuuaaugguuuccaccuucagaaacagcuucagguguguguaauguguuagucaagugaagguauuggucccagacuggccugugucuguugcuauaaacauggacagugugaacaaagaagcagaaaggcucguucuuuugcagagagccagaaagauccagaguacagcacgaacaguauguccccugcacaacagucucucuaggcuggggaacuagauugggaucaaccaguagaagacugugagcccugugcugagauuuucaggcuuauacuaugggaaguuuuggagcagagugagugaucagaucuuugaacucucaggaguaaauucuaaugucaggaggacaacaaaacagcauaauuuuucaaagauuguaauugcauauacuuggccucaagaucugugguuucacuuaggcucugagcugcgaugacugauuucuaaaagucuuggaguaguuuccagauguuuuaauuuuguggaagacuuagauagguuguuuuaaaaucaaguguuugguauaacagaaaugcccuagaacgcugugagcacugcuauuuuauaucagacuaugugucucaguauauuugugcuuauagcugaagaaaacuuuauaauguuacauuuuaauagacuaacucuuccaaggauuagacauaaaaagagaacagaaaagaauaagugauuccuagugacacagccacacuggaagugaaguuuccauuuccugcuggcuacauucagggucuuuacacuacaagucagaauuugguuauuagucuaccacuugcuaugacccagguuguaucuccuuuaaauaucauccucuguaagacugagacaauauggcaguacagauuacagaauuguuguaaugauuuacugguccacauaaaugaggcagaguuccuuguggaaagugcucagauaccucuaggagacuguuugccuuauugcccuaccacuuaauucaaaacuguguacaagguaagagugcuuaucuaggcuaguagaagcccugugcuccaucuccacaaacggcagguauaggagaaaugaagucuacaaauuauuuucuucucugacuguuuccuaccaauuuucccaggaaguuuguaguaauuucucuuuuucuagcaugaggcccucucugagggguggggugguaugugugugagcgagauuaaguuugaacuuuugucucuaaaagggagauuuagguugaguacaaggaauaaaauuucuaaaaucagaacuaucucauagauaggccaccucaggaagagcagguuggcuacagcugcuuagugcuagcauuacuucaucucucgcacccaguacugcauucuggagcuguuaacaugguggugaagauccuggcagaggauccuaaguuaccuauauuguuuuuguggucuuggaauuuuggguucgguuuuuuauagugauaaaacuaaauggauugacauaaggacaauugaaguguaauuuaucaagaugaggaaaguugucacuucccuggguauugccgauguggauaacaggcuaagcauuaaaguuggaaguguagcuuucuaaucuguaaagcugaaaaaauaaaugaagucauauaccccuaccacagacuuuccccuggggcccuuuguagaguguaaugaggaguaucuauacuauaaucauuauagauagguuuuuccauguuuugguaaaguagaaaauacugagaguuauaugcagaguuugacacauauugcaugcugcuuucaauauuaagaagauugccugggcacugcugugucgucauuuaagauguguuauucucagcugucuuuucccuguuccuuauccacaacccuuaucagaucagaaaaucuguuccacagugaugugucuugaauauccccauuaguuugcaguaguuaccccagccugcauguuagccuucaguuuaauggccuuuuuuauguucauucauuuuauuuuauuucccaucgugguuuuguuuauuucuuuuuuguuuuuuguuuuucuguucucuuuaaaaaccgucgugguuugcccuucauauuccccaauguuugcacaugacaagauguugccaucccaacauuaccucccacuucacugaccagugccacuacugaccaucuagcaccagccacaacgggaccauuaccuucagcuccucgagacgucguggccucccuggucucuacucgcuucauuaaauugacauggcguacaccugcaucagacccucauggagacaaucucaccuacucuguguucuacaccaaggaagggguugcuagguaagugcugcauguuucgagccagugggcugcaucuucuuacacccugccuggucaugcucacccuguuuuauugugcaggguguuuuguuuugguuugguuuuuuaccacuuuucaguccagaaaacaagauuguugaaauaugucuuccccauuauuaggggaaguguuauuuaggucauuauauaaacuccaagcacauugaaguccuagcaguuuuuccugccuuucugaaaaaauuggagaaaguagauagagcuguuuagguggaagcauucagguauagccuggacugugccugguguguuuuguucacugauuguagugcaggaacucaagccaaaucaaaucaauauguaugcuaaauaaacauugccacugaaacacaucucuaacaguagaacuauauaccuuucucauaagauuaauucagcacaaaguguaaagauuaaagucaguauaacuuauuagucaaaugaauuuaauuuuguaccuauagggugcuuugaugucaaaagaguauuuaggaguaauggcccuagaaugccgcuguugguaaauccucugguaccuccacccaccucggggcuuauguuguuuacaagaggauguuuagaaucuccagaccucuuuaucgcacaaccuggcuugauuuauguguauacucucagucuccuuucuucccaguuaaacucauuuucuagggaagccagucuacuucucaguggugccucuguucccagucucucuggguucuuucuccuuuccucuuuccagcuaaagcuacaugucuuauuccuucuguaccaguuuaagucccaugaagcccucucagggcagucucuaccuuggcacauuacuauuacucuccauaugaacugaaacuacugauauugacaauuaacuauaauaauaagauaauuugagguuguuugguuguuucauguguauuuacauuguuuuccccaccaaauuaugaacucugugaaagacccaugucaccugcuguuguagauuauuucuuuguucauuguucucagcuuagggucuuaacauaaguacaguuuauuuuucugcuagguuaccuguaguuauuuuauucucucucucucucucucucucucucucucucucucucucucucuguguguguguguuuauggccagacuaccaagcucaucagguguaggacccugugauuuuugccuuaucacaaauugcaauaauauaccuuuaucuugauagaguggacuacuugucaaauaaugcuuacugaaaacagguuguuugagauuuuacaaagauaaggaaauaaaguccuauacauaaaaugaugguacaguacuagucuacugaacaugaaagacauuaaauaaaaggaaguuuagagagugauaagugcugagaacaagaaaaccaaaaacuaaaacaagaaagaaagagagagagagagagagagaggaaggaaggaaggaaggaaggaaggaaggaaggaaggaaggaaggaaggaaggaacaaaaccuccuagaucccaaacucacacccacaguguuaucaucuuaaaacaaggauaauaagaaugaagccgcagcccaugaacccuaguggguuucaguaucaauaucagaauaaccuacgggugauguuaacggccuaauugcaaaugucauguaaauucacagggaagaaggcaucuaguuauuccuacacaaaaggcacacuaucucuacagcaggaccuuugccuucauuaauacuuauuccauaaauaaaucucccaaacaaauaacuaugcuuuguuucuugucaugcucagauaacaccccccagcccuccccuaagugcccacauacaaguuucuauucacuuuuauacuguauuagacacagcuuauccuagcaccuuuuguuaaaucuuuagaauuuacaaaucugaugaugucauuugggagcuagaagugggcugagaauuuuacagugacaauuacaagaacacaagaguucaguuuccaugucugguguaaggauggugacaccuuaucggucaccuuccugacccagaacuuuugguagaaaucaguaugagguuaaaaauaaagcacacguuuggaaccauguguuggaaugccaguaagaauuugggcauaauaaaaugggaauggaugauuuucgucuuuugagcaauugugcccccuguuuguagccagcaguauuuugagagcacuuuuaaaguuuuuaauaggagaaggaaaaaaaaaaauccagagacauagcagguauguugaucuagaugcaguaguugacagccugggugaagguaacagcagugacuuaaaauggguaggacauguggaaaauauuaaagaagaugcuucaagaggcuaagcuuuguuaauguauuaagcuucauuuuuuuaguacaagcgaugaagggauaaaagaagucuaaaaugaagucuaaaaccuguauugugauuauuuuguuuuauaauauaaacaguuuauuuagccuucuugggcuuauauuuaucaucuuaaaaacaagaauaauaaauuauuuuaugcaguguaauaagaauacaguguaaaauguagaccuuacaggcaaacuucucuacuucugcauuuaaaaauucaaccaccagguggcacugugugccuuggucauaaguaguaauucuguugggcacuuaaguugugugguccagaggguccuuuguuugccuuucauuauaccuguguaauauuaguccucuucaccauuuaaacaccucuauauuaaacgccaguuauuuucugauaguggcuauuaaaugaagaguugagaguuacuccaaauaauaauaguauuuucaagauggauaaagcguuagaacuguuagucuaauucuagggcugcauauuaugguuaccaggccaaaucagaaccaucauuuuuaugauucaggagcuaauaauuguuucuguguuuuaaaacagugauuuuuuuuuaaguuuuauauaagcaaguguuuugccuguaagcuuuacugucuggcacuuuuaagaaaaaaguuaccccaaaacacccauggaaggaguuacagagacaaaguuuggagcugagacaaaaggauggaccaucuagagacugccauauccagggauccaucccauaaucagcuuccaaacgcugacaccauugcauacacuagcaagauuuugcugaaaggacccagauauggcugucucuugugagacuacgcuggggccuagcaaacacauaaguggaugcucacagucagcuauuagauggaucacagggcccccaauggaggagcuagagaaaauacccaaggagcuaaagggaucugcaacccuauagguggaacaacaauaugaacuaaccaguaccccggagcucuugucucuagcugcauguguaucaaaagauggccuaauuggccaucacugcaaagagaggcccauuggacuggcaaacuuuauaugccccaguacaggggaaccccagggccaaaaagugggagugagggagugggggggggguaugggggacuuuugggauagcauuggaaauguaaaugaggaaaauaccuaauaaaaaaauaaauuuaaaaaaagaaagaaaaagaaaaaguuacccaaccugucucauucuuucauuaaauaccuaaagaaaguaaaguucagaaagagcuaguggcuugauuauagucucuugauaggcuaacggcccuaccauaaccagaauuagauuuccuagcuucuuguucaacacugucuuaauauaaaacacacuuuuuucguucucauuugauucaauuccauuguaacuacacagauauucuggaaauagcccuuucugaugaucucugguuccugucugacacugccuuuucucucuccugaagagaaacuugguucauauggaccgagccaucuuagauggggcuuuccucucugggagucaugcuuaugacugacucccaucuuauaauaaugauucuauggaaaucuguuucagguuuugauaaugucacugguuucucccauuuccccaccuuucagagaggaacaaacaagauacauacaguuucagcaauguaauacuuaggaucagaaggcagauuuuaaauucuguaugugugugagucuccuuaugugagcauucugccuacggcuuguguaguguguaagcaugaugggacagucuuauacuucaguuucaaguaaaauagcauccccaguuguuuuacuaggaaauauguuguuuaaaaauguauauacaggugagucauagccugugcucuauaguucaguccuucccauuaaacaaaacagucauuggucaucaaaacaagguuuagccaccucaaaguauaagaaaugaguugauaugcuuccucuaaaucugguaacuuagaaguuuacacaaagacaaaauaguacuguggauaucuuagguauugcuaaacaauaauuuuuaauacuauaguauucuuuuuaggugaccuagccaacuauagcguaacaaccucuuuaaauauucugugacuacuuuguugggguuuuuuuuucucuaccaauucggguguuuuuaauuuuauagauaaaaauauaauuacacugguuucccuuuuucccuuuccugucucuaacucuucucauugucccccuuccaauucuuggccucuucuuuguuauguuucucucucucucucucucucucucucucucucucucucucacacacacacacacacacacacacacagacacacacacacacacauccugcugaguuguauauauguauuugguuauaaucagugguaucaguaauguuugaggaagaucacccacaguuugccaaguguuuacaacucacuuucauacacuguucugccugguaacacucaguuucacuuuugagaguaaaugugacuuagugauuagauuuucacaggagcuagagagugaaacuauccagagcucugcuguauugaucaguuucuuuucuaacccucuuuauccaaagggagcguguugagaauaccagccagccaggagagaugcaggugacuauucaaaacuugaugccagcaacuguguacaucuucaaaguuauggcucaaaauaagcauggcucuggagaaaguucagcuccucuucgaguagagacacagccugaggguaagucuuucaccuaccuguuugccacacccugagagggagggacuauuuggaguccugucagcuuuuugucuugcauaagggcuuuaagccccuucuagauaggaacaugaacuuuuacugaacauagcaaguaaagggacagccuguguauuucugcuuucuuucauauuccuauuauaccgaucuuuuaaggauuagcucauaagucuuauagaagcucucucugauccuauguauguguaugauccuaagagacaucauuucaucccucaauugcuuuuacuaauauaucuugcuuauuuuauggacaauuccuacaaugucuauguguauaauguuuauaauguagugcuuugcacagugguggguauuuaacauggcugccagcuggagugucagauugauuuauacuuuaaaugaccuguaugcuuuaacuuuuguuuauaaaaacuacaagccugaguuuauaagaaauaucauguuuuuccuucuugaaaauuuuuaauuguuacuuuuugccauaagccaaauuuuucucaaaauggucucuaguuaacuuuuacgguaccuacacuagcuuuucuguguucaugagccuaaauaaaagacugacuuaguagggagcaugugcgauacauuuguaucucccuaucugggagcucagaagaaugaguuuagcaauuacagaacagaaagaauucacgaacuuugccucguggguggaauaagggcaaggagucaagaaccuucaacuuuuuaauauuauagcaaauuacuuguccaguguuugugugccuccuaugccagguacuaugcagaauacuagaaacacagagauggugaacaaguaauguuuguucuucagcauaagcaguaguaacuguaauaaggaggccuucagucaugguagugaugaugcugaagccaugagucagcucuaggcaagaacacugggccaugaagaguguccagaauugauuuaaggcgaaugcauucucauuacagagguaggggugcuaaauuucauaguugacuguguucagauuaagugugggaauuauccauuagauuucaggcuccacccccuuccuuugguuuuaagggaggcaccauaauugagagauucuagacaaagauucagagcaaggaagaguuuauauaaaaauauagaaagaaucccagaaagauggagccugugguugaccuuaaagcauuugacauagcacaagcauucuuggggaaggaaacuggaugacccaaaucacagaaauaggaucaaacaguucacaugcaaaguaagucaugaugaaagugaaggaagggccacuggauugaucuggugcagaagucuguccuggggcugugaaccuucugaaaaugaaaauaccugugucuauauauaucugcauuccccuuggaaaaugacuauagcuuucaugagcguuucagacuuuguguccagauuguuaaaccguugaacuaaaagagucauugucaaauuuagaauugaaagagaagacauaagaaguggccuuauuguguaccuacugugugccuuucacuguguugggcaguucagacauaaagauuauuaaggcaaaccuacuacgagagacagacauuuaaauacacaauagugugagggccuacuaucacauggaaagagacuaaaauaauuaguuggagagcuuugguuaagaaagaguuguugaaugagguuauaggcaggaagaauaacccguucugaugcaagccuuuggaauuuguaacgugacaauagagaugcuggcagugaagagggacuuguaccuccugaagguguggggcauauagagagguaugagugcugaauuggccuuuggagaguauuuugcaauuuacauuuucuauuuguuucuaucuguaccauucauuguacagcugauuugaaagaguuaccggugccuuuuaaaaggaugguauuugccuaagcuuauccaaugagucuacugaaggugauguuaagaaaauuguuuuucuauuuuuuucuccuauuuuguuuuucucucccuuuaguuaaguuggaagaaaguuuccacagcaaaagaagugugacaaacccuaccugucaggcuacacagacugugcaguugacauugaacaaauggcaugauucaugacuaaauaaagcaaacaacuauuaaagugacuacauucagaucuuucuacaucuauagcaaaacagaucuuauggcauaaagcuguuguuggagaaaaacaauuuucuuaaacacuuuuuuccuuggccuuaaaucuaauggugucuaucacagugacauuaaugcuaagaaaacuuauuuuuaaugcaggaauuucucccaaaguauagaccugaucagcuagcuaggauuuauauacuaucagaugaaaagaauauucugaaaggguugauguaugagccauuguagaaguuagauccaggguccacagaggaccagcuaccccacugaagauacuguccucaucuccuuacugagcucagggaaguuguguuuuaaaaugaccaguuucuggcuccaacauuauaaauucccaugacuuggaaaaguucuuaacauacccugcaucucauuuggucagugcuaagacuaaauuagaacagaaaagggaagaaggauguagcgugcuaacuuacaguaaaugauggcuguuucuggccuugacgcccucucucuaaccgguuuauugcuuugcugcuuuuccccugugcuuguguccacacauccuuucuaaacauggaucugacugucaugcuccuguucacugccugucagaaaaucaaaaccccauagcagaucaaacauuccucccugucuggcuguugcuuucgacauuauuucucccacauccauucugugguacaaccauacaagucguauaacauugucuuuccacuuaccccuccccccccccccgauugccccaaugacaaauaaucuucuccuagaugucugagaaaacuauuuauuuguaauaccaagaaaucuucaccagcucuucucuucccuucccuaaggaacccuucacacagcagaauccuguacucucuacuaucucauuacagccaccauaugaaucugucagcauuuauuaauguaccugauucuaugccaaaccgagaguucuuugugaagggggcuucugcccaucccugcguucccagggccugcuuaguguucaacagcagaaaggucucuuccaguggagguugcuucugugugcugccuugucccucuacuaaccuacaauuuggggcugaaaaagagggcucaguaauucaaagauuuauuguacaagucuaagaauuugaguucagauccccagcaugcgcauaaaccuaggcgcaccccugccgcuccagcuaaggacuggggaagggagcagggggaucccaggagcuugggucaugcugccaggcugaagcaggugagcgucagguucacuggaagacccugucaaggagcauggcaguagagugugauagaagacgauaucugacacugaccucugugucacacacagagaucacacaguucugugugguaagaggguguauauaagcacauguacuccugaguuuguaaaucacaagauuucuuuuguguauuuuucuuauuuuuaauaaauugaagauacugaguuauauaaaggaaaauguacauagccuaaaaauacuucaaucaagucaauugucuuuuauuguuucuaaaacauggccuuugugacaguauugcugagaauggcuauugugaacugcaguaaaucuaacuuacaucuugaucucuuggaauucucuuuuuccaguucagcucccuggcccagcaccuaauauccgugcuuaugcaacgucaccuacuucuaucacugucaccugggaaacaccguuaucuggcaauggggaaauucaaaauuacaaauuguacuacauggaaaaaggaacugauaaagaacagguaugaagugcugauaugauuuuugggagaaacacuagauucuaacucuaaaggguuagagauacagcucagcaguagaacauuaccuagcguacaagaugugcguguacuguagccuccaccccaaaccuuacaaagcucucugguucauugaagaaaucaaaggugaaggagauguauaggaaauuaagugaugaugguaucuguuuuguuguaccaagauuuauucugugguuuuuaccagcaagggcuaguaagcaucaaauaauaucucuaaauaaauugcuauugauuauauuuaaucugcuuuuacuauaaauaauauucuguaagaggguuaaaacuguuaugcagaguuuguucauuuuguauuucuuuuagcuugagcucuguguguguguguguguaugugugugcacacacacgcgcacauguauguacagauauguauucuauuucuuucaaggauauugauguuucaagucacuccuacaccauuaauggacugaagaaauacacagaauacaguuuccgagugguggccuacaauaaacaugguccuggaguuucuacacaagauguugcuguucgaacauuaucagauggugagcuuuuuccuuuguaacagaauaccguucuuagugcuccucaucaguaaaaucgugugcuuugaugugaagaaacuuuuauucaugcgcccguuguaccuccuggcgagccacucacuuuuuugaguauuuuuuucuuacauguaaacuucaggaaacaccaacuucaucagcauugcugugaaacuucacuggaaagcacagacagagcacguggaaccuaauauuaaauggguucuccgugguuuuaguacagucuucugaggggaucaauuccguggcuuguucacagcacagaccauuuuauggcugugggaugaucagccuuacuggauguaccagucauauuuaaauauuuaaaagcuacaguuugacucccuuaagcagaugaucaaacauuuacaucaguaauaaagaagcaggcauaugugccugguuuguaguccaugaagaaauauacagcuuuggcccccguuuucccacccaaaauacuuaacuucaguccaaaucaugaugucacaucaacaagcagacacgucaaauugagagaaguucagcagcuguuuuuuuuuuuuuaauuuagauggccuuuagaauuaaagauggccucaaauucuuaaaauauauuauuaaucuuauagaaaaaucaucuaaauuaaaggagaguaagacauaggcuauaaaauaugugggaucuuugguuccuagauaccugaaacaaaaauaucuauguaggacacugccagcacacuuacuagaucuuucugguauuaagaaauauugguaaauauugaacauguuauauauauauauuugauaccauuuacuaaucaaaauuacagcuuccaaaugugauucuuauguuuuaguuugguuagcgccugcuguuauucucaggagauauugaacuauugaauucugauauucagauauugaaauagaugugaucuauuucagaguaaucugucacagugacuugcagcaucucucagauauaugguagauaaaccuaugccguucucauuauguacuauaaugggaagaauauaguaaacuuugcagaauguuaguaauugguaaaacuagaaggggagagugguguucauuauacuauucuuuguucuuuucuuuggacaugauuuuuuuuuuucagauaaaaagggaaaacaaaagauaaauuauaguucaucaauccaacugcauauccaguuggucaugauuugagagagggggaaaaaggcuuuuacagccuuuuaaaucuauauguaagccaaauuuuaacugcacuaaaauagguuggccuacugaccacaguaccacgggaacugaguggagugacguuuauuaacauggaaguuucuuaacauggggauuuaaaggcaacacuuuggaguaaggaaaauccuagaucuuaggccuacuaaaagggauggcuugaucaaguaaaccacauagaagcucaucuguaaacaacacguacaugaaaugguacaacaguaaacuccugugggagcuguaaggacugaguaccugccagaguagcuuguaacaaacccaaguucugaggguggggauuacacagucacaguuacguugaaugucuccaucgcuaaguuacuuccuaacagggacauguuuucagaauagcuggacccuacuucagaccuuacagcugaaucucagacuugaagccccuuaucuuuucccuaggaacaggucaggacagugagcaaagcacuucaguucagaaggucuuuauuucuguaucugcucaccagaugauagggaguugaaaaguccugaugaguagaugagguaagaagggcuagaauuagcaucuggugguagagagcaaacuaguuagcucugcuugaguuuucuuugcugucugucaucacaugaaaggagaguauaugagccaucaguuguuagaugcucuguuguuaagcuccaguacauuaggaacuuugguuauguaacuguuucaccaacagacccaaacucuucacaccuaaaugcauguugucugacaccuuggugcguugggaguucacugauugcagcuuuccuuguugaaauguuuuuagagucuagggcaguguucucaaccuuccuaaugcuuugacccguuaguacaguuccucauguuguagugacccacaaccacaaaauuauuucaaauuuugcugcuguuacaaauugugauguaaauaucugaugugacccugugaaugggugguucgacccccaaagaaguugcgaccugcagguugagaacugcuggucuaaggguucaaagcuacuuacauuccuaaacuaaguaucugauuuccagaauuauaaccugauuuuaguaaggguggaugcucauaugaacgaagcauggccacacuucauccauuguuagcuggguugagaccuucuagucacauuaguauuaauuaacauggugggugauauauggaugguugaauuguuuccuuuuuccuuuaaccugucuaguucccagugcugcuccucagaaucuguccuuagaagugagaaauucaaagguaagacuucgauucuguucacuuuacuggcacccugagccucagagggaacguagagagucagaaaugccuugggcaaacaucagaacagugaaugccaguguuguaggaauucauuugcuuugaaaaauacuaacgugaaauuaggauguaacugaaaacaccuaaaaucaaacaggaaaauaagacagcauggguauaaaaaagcugggcuaagaacucacuuacuuuacuguuucuuuccuuucucugguacuaaaaccucuuuagcuuccuauuaaaaguuuuuucuauguuuacauaaauaugacauuuuagaucuuaacuauacaaaaucauucaaagaaaguagguugcuuaugaugacaugaugccaguauaaaccaaagacagauggguguagauuuggguaucuguucauagcauccccccugguucaaguucguguauaucaacuaugugugcuuuucagaucccucugggcaacauauauaaagaagucuuaucaaaagguacuaugggaugcugcaucaggaaacauacuucuguucauuucagggcuuguuuguuuguuuuuguuuuguuuuuggacagggucuuacucuagguaaauauacauauaccuacuggcuuggaauuuuuguauagcccaggcuagccucaaacuuguaaaccagcaguuucgguuuucuauccaccacuccuguccacagaaauuacuuaauuacaccuaauuugcauucaagaaaggaaauaauucuuauaccaaacaauaguuuauuuccuaaucaguaugcuucuaaccuuauauuuuccuucuaaaaccucuuuugggauuucugauguuuucauucagacagaauacuuccuuaggagauaagucuagacucaagcagguauguccaggcugugucuauaggcugcaugcacacuagaaucgauauuaugcagccuaacccaagaauuauagacuuaaaauagggcuuuuuaguaguuucucuuguaacauggcucucaagcaugaguuuuuguagaugacaacaucauguuacaugccuaguagagcauacugcuuuaauaaucuccucuuagagagauuugaggguuuuuuuaauuaaaguuuuguuuuuuuguugugcuaguguuuuguuuuguuuuuuguuuugagucagggucucccuguguaguucuagcuggccauaaacuuacuauauagaucaggcuggcccuaaacucacuauguagaucaggguggccucaaagucauagauaccuaccugccucugucucccaagugcugagauuaauaauguacaucaccacacccaguuaguuagaauuauucuugacuauuaaauaaguaacuuggcgaggcuccaaguaccaaggguucuauaugaccauucuccucuuccugcagugaaauuggguuuuauagcauguacagucaggaacagcccuuugacauuucagucuuuuccuugcacuuccuuuccucagaguauagugauccacuggcagcccccuuccucaaccacacaaaaugggcagauaacuggcuacaagauucgauaucgaaaggccucccgaaaaagugaugucacugagaccuugguaacugggacacagcugucucagcugauugaagguaagcugcuuugcauauagucaguggcuaaaaggugguucuuucguagacuugaaauuauguuagucuaaaacugcucuaagcaguuguuuuauauaaacaaauuaaaaaugguuuacaaaaaauuguaauagcuuuugauacaaauuaauggaaaauacucugguggauuccuccaucgcugaggaguugaauuguguuugauuuuuaguuccuuuuuaucgucuccacauuuuuggaguuuauaacacuguaaucuaaaaauguaagguaaauuauacucaaccaaauugguaacaaaacuuaacacaugccaaacucaggugaaugcaaaauauuugaauagcugcaauauuauaguuacauuugcugcuaugggcaauguaaaguuuuagaaaacucuauccgaaauggcucuuuuguauaguuuucuuuuucuguauaacaaaaaaggauauaucuuaccagguggacacaaauauauaucuaauaaaaauauagaucacuaagaauucuuccuuauacgacuaugaagacuggcuaagcaaggccaggauuccuuuacaggauaucuugagaagcagcagauguaaaugaggguagagucuaggcauugcuaacuaauaaaagcaaaagcaggauccauugugcucagaccacagcuaaguacccgcugaauuaagcauuauccaaaaccucuauagaugaaaggauagcuauugucuagaagcauguuccaguauccagagaaugaaaagcuguaaucugcaugaaccaacauugaauaugcaaugugaacaaaaacagauuccuggaggcuugaagcauuaacuugaagcuuguuaaugaaacaugcaauauagauuaauaggagucugugucagacaucgaauuacacgguaaucuauagcuggacaaaauaguuguuguagcacuuaacacacauuacuguaucuuuaugucugcuaugugccuuaguuuugcuuuuuuggggggggggguguguuuggguuuuuuugagucaggguuucucuguauagcccuggcuguccuggaacucacucuguagacuaggcugaccuugaacucagaaaucugccugccuuugccucccaagugcuggaauuaaaggcaugugccaccacugccugcuuaguuuugcuuuuuaaacugucaaauuauuuagaggggagaggaacucggccuuuuuauauuuaccucucuuuugccugaucuuucauauauucuuagccuucuagaggguauggaaugauaacuaaauaauuggagaucguuauugagccauguuuguuuuuauuuaagguuuuguccauuuacaauuacaaauacaugcaguauucucuuguacuuucugacaagauaguauuaguaauggaccuagagagaugugucagugacuaacacaggcuguucuucuagaggaccugguuagagucucaacucccacauggagucuaaguacagucucagggaacccaacauccuccuuggccucugagggcaccaggcauguacauggugcacauacauacagacaaagcacccauacauauaagauaauaaauaaaaguaaauuuuuaauggggguggggguaaauugacaugcauccaguacuuguuccucucucuguccuugcuauuugugggcaaacagauuuaggauggcaccuacagggcagagccuucugucucuucuuacuauaugccaggauugguuaccuuagcgacagcauaccuugcaucccagccuaguuacuuauauuuucaauaucucugucuuuauugggguuucuguacuauacuacuguccaaagaucccaguuauuuggauauagagaaguaggaugauuucccuaacccuaauggucaguaucuuguauuuaagugcucuaaaaauguacaugugaauggaugcauaacuagucauauuaacuguuauccugcuuuguagaaagacuuuuauuugugaaucuuuguugcuuuuacuucgguaaaucauacacuuuacuaaagcuggguaguaaauaaagaguuacauaauagaaaaguuuggguuuucuucuuuuacuauaaauacacuuguucaacugguuauugaaaaauagauuucuaggccauauuugauguugaaauuauuucagcugugguuauagcaggucucaaagaacagagguaaccugauaggaguuacaucuuuacauucuuuucuggguuuuggugucuucugaacccagcugauuuuguuccuuuguaacaacucuuucauuaucuuuggucaugguuuccuuuuugacaaaguugacgggauugcauuaaguaaucccaaaggugccuccgugcucuuaaacagagaagcucuuaacuuccugggaggauuggucuuugcuguuuauccuaggguggugugggcacugagaauuacccagggguauauuuugcuuguucuuucugaacuuacacuuaacuaagcuguggacugaguugguuaugugagauguuuccuuuuauaggagauuacuaacuuuguuuuccaaagcucuuguuucagcuucuuucuuacguuugauucucaggucuugaucgggggacagaauauaacuuccgagucgcugcucucacagucaaugguacagguccagcaacugauuggcugucugcugaaacuuuugaaagcgaccuagaugguaagauucaacagcgagcaggaauggcucauaauagauaguaacuaucaccagugaggcaaauggaaagcuuuugaguuuugcuugucugugaacauuggaauguugugcugcuauuguuucugugaagcaguagaguuccuaaaggggucauuguuucccagacauugugaagaaggaaacaaaggaucagguucagaacaauaaaaauguacagggauuugaaguugaguuuuuuuccugaggccaguaaguaaagagauaauugaaguguuagccugagccacaucagugugugccuauguuucauuugcagcuuccuuuuuccugagucauggagaucuugugcuuucucucaccuuuuuguucaauaaguaguuucaggugguuauguguaguuaguuccuuuaacaaugauggugccagauuuggggagaccaaagaccuauucugaguuucaacuaagguagcaauuuaugucuugagaaauauacaugaaagauguauuaaacuguuaccuuuaaaaucuguuagucaucuaacagcuggcuuuggugccaguuuuucuggauuguuaauuaucuagggaaauaaauaauugguaucauuguuguaauauaauguuugauuaacuuguuccaaacagguuucuaguuuguugauuuaucuuucucauuaaacauguagaguuuagggaauggaaugagcaacuggguuuuauuuucuuagaaaaaaaaacaaaaaaacaaaaucauagaccguauucuacuguaguuauagauucucuuuuaguucuuggccuaaauauuguuaaagcccaaauauuuugacaggagcuaaacaacauucaccaaggauaaggaaacauccuacagagaauacaucucauuuuuuucugcuuuccuucucagaaacucguguuccugaagugcccagcucucuucauguccguccgcucgucacuagcauuguagugagcuggacuccuccagagaaccagaacauugugguccgagguuaugccaucgguuacggcauuggcagcccucaugcccagaccaucaaaguggacuauaaacaacguuauuacaccaucgaaaacuuggguaugcuugcuagguggaagggauaaccaugcaugucauuucuuccauucuaaauuuuauuacaguauaauuuuauuuuuacagaaagauuguaacacuuggugaaggaauuuugccauauucuucuccguccucacccagauugugcaggauuaacucuuccacauuuccuuuacccuuuucuguuuuuuccccugagacauacaaaggucaguugcagacaugguaacucucacuagucccuaacaugaacaugaaauucuacuaaaguuguucuaaauagccugcuuauugaaauaaagacauuaaaauugagauaggauuuucauauuuggcauuuuucuuaccguuguccuuuaugacaaaaaaaaaaaugcuguuuucugguucaggaucaguguugaguaucguuaucaugucucauuagccuuugauuuagagccaauucugugguuuguuuggguuuuuuccuuccugaucuugaugaaugacauuugaaaauacauacacaggccguuuauguuccucaaauuagguauguccagcauuuccauauuacgucuggguuugcauacuuugugaggaaugccauaguguuggguuuugucagugccucauauuagacacacagaacgauauccagugccuuugacauguuccuuuguaauaauauguauuucguuaagaagauacuuugauuuuuguaaauacuggguuucccaucaaccucaccugcuaguuuuaggacacauauaguagguuguuaccugucaaacuuuaggaagaguccacuaggcucuuguauuacacaaauugaaaaacuaauucuauaauuuauuuuuaaaaagcaaauaacaaaauaacuaucuuugaaaacgaaaaaauuggaaaaugcauacuacuuaacuugguagcuuacuuuuaaaauccuggagucucaguggugcuggugcguacauggagguugugcauucaugggauggucaguacuuaacauagucaguugaucuuuuaacaaaagugaugaagucauucaguacagaaaggauaucuuuguaacuaaggacaugggaauaaccaaaaaaaaaaaaaaaagaaugucuauauggaaggggaaaaaagaacaaaaugccacaaaugaccacaaaccguaaaauugacaaagaggagucagugagaagacucaguggguaaaguaccuacugacaaacugaguucaaucccccagccacaggcaagguagaacuaacuucugugauucauccucuguguguguguguguguguguguguguguguguguguguguguguguguguguguguuaauuuauaccugcucaccaccuaugugcaguguccauugaucagaaaaaggcauuggguccccugaaaggaaaguuagaggaaguuaaaggcaguuguaagcugucauguggcuguuuaaucuuacccgaguccucuagaagaguagccaguguuuuuaacuucugauccaucucuuuacccacuccuucaucaaaaacuuaaucuucugcucuugaaaacacaucaauaaaaauaaaaaggcaagcugcagauaagaagaaaauaucagcuauccaaaugucugacaguuugauccuaggauauguaagaauucuuacaacuuaguaaaaagaaaacccaaucaaaaugagcauaagauuuggauggacuacacuaaagaagaccuaugagcagacaguaaggguguaugguaguauaugaagauuuacgaauggaaaaugagcauguuaaaagaugcuuaguacuguuaauugucgagagaauugcaaguguaaaaccucaaugaaauaccacuguauguccucuagaauucucacauuugcuguuaaaaaugcugauaguacagcuuuguaaaguggggguuuauguauaaaguuaggcauacaacuuagcaaucccacucagaugcuuaaccaagagaaaugaaaacauguacccacuuaaaggcuuaaaaaaagauacuuuauuuauuauagccucaggagggaaauauuauaaauuuauaucaauuaguuaauaguaaauuguacuauaucuuugucauagaaacuacugaguaauuaaaauugauaggauuggcuaucaguauauacagcagaagaaaugagucuaagaaaugugcugagcaaaaagcuaaacacaaaauaauguauaguuauuuuuaaaauauuaaaaaauaugcaaaacagcuacaaugacaaauuuauaaucuaugguugcauccucaguauuagaaauugauguuuaagagcauagcuacuuggaaauguccuaauuucucuauuuagggauuaauuacaugaauauauuaauuugucaaaacuuacuaucccuuuaaauacauuuauuuuaugcuaauuuuaucucauaguuaauuuuaaaagcaaaauuuucuuuaauaaugaauuauggaccaucaagauaacugucuuagugguuugguuuuuuuuugguuuuuuuuuguuuuuuuuuuuuuuuugcugugacaaaacaccauuaccaaaagcaaguuggggaggaaaggguuuauuuagcuuacacuuccauauugcuguucaccacugaagaaagucuggacaggaacucacacaggugaggauccuggaggcgagagcugauacagaggccacgaaagggugcugcuugcugcuuacuggcuugcuucccauagcuugcucagccugcuuauagaacucaggaccacuaguccaggguuggagcuauccauaaugggcugggcccuccccaucaauaacuaagaaaaugccuuacauccagaucuuauggaggcauuuucucaauuaagguuucuuccuuucagauaacucuaguuugugugucaaauugauguaagaguccccagcacugagcgaguaagaugcuuuccaccauuccuaggaaccaugggacaucauacaugugugugacuacucauguaugcacauaaacaaacauaaauaaauguaacuuuuaaaguuaaaauaauaauauaaugaauugauuucuguggcuauaacuaccuuuccaaauuggauuuucauuguuaauauuuuucugaaagacuuuucucuuaauucauaaucuucucugaugaauuuuuuauucaaaccauugcuuuguagacaucuuuccuaagaacagcuuuaagugccuaacaaaugaguucccagaucuuuuauggaagaaaauaaacaauaguuuuuaaauguagucaaaaacaaaauauacuuucuguuuuuccuuccaaagagagacagaucagcugaacccaggcggcuucuccacaugaguagucuuauaagcaauuguuggaucgcaaaaccaaagcuuuucgguggauaaaaaugucucugugaugaccagccucccacuguuucccuuaggaaacuucugaaauaaaaguccuuuacauuucagucaggacucugucguugaccuccuggaacuuucagucuaggggacaaccaaaguaaaacacaagaaacaagugaguuaaagugaaguuguucagagagaaaaagcugaacagggcacacagaacagcccacuagaaauagagcguggcuugaaagauguagccagaacagugugaggcagaguggugagaaggaccagucugcucaaagaguaagcagugcacucuuaggaaagacucggguguucguccugagcauuaagaguggcagggccauggagggaucuaagguugggagaugagauggagggugaggaaagauuugagauaucccagagcaagugcugaacuacuagaaaagcaguguuuguugagaaaucgugaaaacaaaauuuguucaacauaaaguaaaauguguuuauuagccugacuuaauguaagauucauggaauauaaagugaaagaagcaagucaaaguugaagauguuuauguaggaauuaucuauucaucagacuuaaacucuccugagcuugaaggauccaccagagcagugguucucaaccuuccuaaugcugcagcucuuuaauacaguuccucaugugguaaccaccaaucauaaaauuauuuuuguugcaacuaaauaacuguaauuuugcuacuguuaugaauuauaauaucaauaucuucugauauguaacccuguggagguugaggaugacuucccuagagagauuguucucuuagucuccuugcagaauuaccuauaggccaucaaauccuggauuaugccuugucuaaccaagaaguugacugcucuguguuaggacguucucuggaauauuuuugacacuucacucucaguuuaucuccugcuucucuaccuuagcugugaggucagggauggaaggggcuugauuuucaagcugcaccugaaggcauauaucauacagugagcaccuuaaccauuaguagccuccaggagaggaagacuaguccaccucacucugaagacuaacccaagaaguugauggaaccaauuuuuuguaguaaauguacuucuaucuuuauaucuuuucauaucccaaagcaagcagcccaauuaauaauuuuucuuuaauuagauagacacuuuuguaucuuuuuuaauccuguagagagcauuaaaaucuuguuuucucucccucagauccaagcucucauuacgugauuaccuugaaagcauuuaacaauguuggcgaaggcaucccccuuuaugagagugcugugaccagaccucacacagguaggacaucugucugucuuggucaccugcacuuuucccaacugcuuauguagaguaugacucaggggucucccugauggguguucaugagcaaaacucaugacaacuuggagaacagacuuagaaugagugauaagccagcuuuguaaaagcuaccacagaagcauuuuguauagauguauacacuuuuuaauauguuagaaucuaggaugcagaguuuugagagaauuauucaucaugcaggaaauauacacaugaagacuauuacacuaguguagcaguuauucauaaacaaggacugucaauuuagauuuuuaguuauauauaaaacgaguuacuaucacuuuaugaggaaacagcauuuaaucugaacuuguaaaauaaugaguauguguauuuagaaaaccuagccaggagcuggaaaaacccagaggucuuucugaacugcauuccagcugugguccucagugauuuuuuuuuucuuucuuuuuucuuuacucacccuggccuuugcuuugcaguagagcgugugucugucacauagaacacagcacaugcguacauucuucaucaaauaaguacugugaucucuaaaauucgucagugcuaugccauuugaaucuguaacgaucauggcauuuacuguaccucauggagacuuguucacuaccuuauucugacuccuagagaaaguacagcacacacugcgacauggugucaguucaccucuuaaggaagaggaaucuuuggauauauucagcuaugagccauuucucuacugccucugcacuuaagauaucagcaagucugaauuggcuuagccaucacacguccaaugaugggcaguaguaguaacucaugucccaaaauccagccauauuuacuaaaaaaaaaaaacagacuaugaguuuuauguugcuuguucagaaauuauacucuggauuuuaagagcaguuuugguuuuuuuguaaucuuuuuucugacagcgggucacauuuucaaggaauucgaaaaaaugcaagcauguguauuaacaugaucacucaauuaccaucuuucagugucuuuagaguauuguugacaauaugguuaaguacuauuuuguuuaacauuuuccuacaauuuuuccuuuaaaaaaaaaaacacauuagaagugcucuucugaaugaaugagggcuaucuauuaacucuggauuuucuuucuuuuuuuccauuuuucauuuuucauuccauuauacuccccugcauucccuuuuauuuuuguuuauguuaaaaugccacuucccuuucuuaauuacuuuuuacccagacacuucugaaguugauuuauuuguuauuaaugcuccauacacuccagugccagaucccacucccaugaugccaccagugggaguucaggcuuccauucugagucacgacaccauaaggauuaccugggcagacaacucccugcccaaacaccagaagauuacagacucccgcuacuacacaguccgguggaagaccaacaucccagcaaacacgaaguacaagguacugaacauuugccuugagagcaaaaagcuaaucagugggauuuucuuguuuuaaaguucuuugauucaugcuuuuccagaaugcaaaugcaacgacguuaagcuauuugguuacugguuuaaagccaaauacgcucuaugaguucucugugauggugaccaaaggcagaaggucaagcacguggaguaugacagcucauggcgcuaccuuugaauuagguaaguauaaugcaaucccaugucacaugacacuucuucucuuugugaaauacgaaagccuguagaauucacacuguuauuguggcacauccuaucaccugcguccacuggacaugggcagugcacauacugcucucgcuacagaacccggugggcagccgcauuucaguuguguuugccauuucaacuacugugaauuuuugggucacuuugcuaaaacaguaguaaacagcagaauagugcagugcaagacagacuagguuuuagaaauugcaagaauucaaucucuggucagccaucugccaauuguuucaugagcaugccaacuaauccuacugaaucucaguuuccuccaucuuguuuggggugauagcccccccauuucuacuuuaguagguuauuauaaggcaaaaugaggaacagauggaaaagcauguggguggguagauacaagauauuauuguauuaauccugcuuacugguaaauugaaauugaaaacaaugaagugaccugcccuugacccagcaguugcccagcuguguugccuagucugaacaguuugcuggguaauccagggcuuucuuggaaagcagcucuguaagauccuucgcuggacuggccuuugcuguuuguuaguacacgugagggagaaagcauaacuaaguagaugaaggaaagaguaggcggccaaccuugagacccuguuuccccugcacuuugcugggguaaggauaugagcagccuugagaaucuauguauucugaccuauuucugugccuggugaaaaccaaacuuccacauucugugcaaaccaguuuugcccuucugcacaguugcuuagaauuucuccaggaaaggggauuggacuggagaguuaggaauacaguauagaaaggggcaaauaauuauuaguuugcuuucuuuucuguuuauuuuguuguuuguuuguuuggcuucguguugacacggggucucacuguguagcccucgcuggccuaacacucacuguauagacgaacaugacauccaaguccgucccgccugccucuggaguguugggauugaaggcaugugccaccacacucaguguuuccauuuaagaauaucuuuuugcuuuacuuucagcuuacugaccaauaagagaaaauuuuacuuucccuuaggaguucauuucacuaggcucuuccauuuuauauuaaaacucgaauguuuuaggaagcagcgauuugaaggaaugcuugauuugaucauuuuccuacuuagcuauuacauuagacauucucaccuguaacauagaaagccauuuucuuuugucaucuuuuguuuguuuguuuguuuuugguuuugguuuuguuauuuucgagacaggguuucucuguauagcccuggcuguccuggaacucacucuguagaccaggcuggccuggaacucagaaauccgccugccucugccucccaagugcugggauuaaaggcaugugccaccaccgcccggcuucuuuugucaucuuuucugcuacaugaacagcuuuuauuuauaucauuaacaucagcaguugguaguaugcuuucagugugagcuuaaaaugaaaaauaccaaguaguaaauuucuucuuagagggaauugagcuuuuaaaagccauauuugacuuuaagagucaacucugagcaagagagaaaacuuuaacacuuuaaaauguccuaccaaauaagccaaaucaauugagaggaaguagucugggacaguuauguaacugcucucaguuuuggugccuugaccucccaacaagggacaauggcacuugcccgucuagguugucauagccuuaagaaaaugcaaacuauaaaauaccagaugguagugugugcuuggaaccaccucccaguccacaggcccauucucuauccucaugguuuuaguuuuucuuugauacuuuguauagucuucuuuuuauuagaaaugauugguuauacauagacuugcauuauuaaagcugggggcuuugucuuuuuucuaugcauuugcuguuccuuaucagugaaaagaauuggaaaauugaauucuauuaaaauggauaguguuuguuauuuuguaguuccuacuucuccaccuaaggaugugacaguugugaguaaggaaggaaaaccuagaaccaucauagugaauuggcagccucccucugaagcuaacggcaagauuacagguaagacgccuuagacugggcaaguucugugucaucaauaaaguggggaugugaaccuggcuggguccuuguauggaguguagugagucauguugguccuugaaauugaagcaaggguagcauggaauugugugucuagccaguaguguuacuuaacaauauauggugggacaaccuauuuuucuacugcagcuugauggguacguuuauuuuccaaaaugcuguccacuccccagaugacuugcuuugaacuuguguguccaguuuuacuggaaauuaucuagucuguauagacugugcuuuucuacuuacaagccccaccaaaucccauuaggcuuuaaaccaccacuacagcccaaggccugucacuucacaauucugugcucuuacuaguagaguuagaagcuugaauuacccuaggccuaccaaagaucucaggaucccacccccaccccucggcccccccuuuggacuucagagagaaauuccccauaguagaauacuggcagaugcuuggaaccugugccccauucauuagaaguuugcuaaagaaccaguugccuucugaaauacaaggaagauggccuaaugacucagaaaguguauuuugucccuguaacuuuuuuuuugucuguuuugguuugguuuuuuugagacauacauacauauauauauguguguguguguguguguguguguguguguguguguguguguguguuuuauuuauaguccuagcuguccuggaacucucuguguagaucaggcuggccucuaauucagagaccaaucuaccucuucccgccuagugcugggcuuaaaagugugccaccauaccuaguauguuccuguaacguuuaaauaagauguccuuucccaauaaauccuagucauuuucuuagguuccuauuuugcuucuucuauaaaagaaacaaauauagcuuaacucagauuacauuuugcuuugucuuuuaaaaccuuaaaucacaauuuuguaguguagaucaagaaggcuuauguuuguaaggcauccugccucauuugugggaauugagugcccccugguggaaauaucuggugacagccucugugaccuaacccacccuuagaacuuugucagguuuuccaaucugccgagcauuuuccuccugggaaaugauuuuuaucauaauugagcauggcauaccauugcagagucccagaacuacgugauucuaagucagagcccucaugauacuucauucagauacuauauuguagacauuuauugacuuucagauugcaaaaagaaaagcagaaaugggaucucuuuuuucuauuaauugcucuggacagguuacaucaucuauuacagcacggaugugaaugcagagauacaugacuggguuauugaaccaguugugggaaacagacugacucaccagauucaagaguuaacacuugauacgccauacuacuucaaaauccaggcccggaacucaaagggcauggggcccaugucugaagcuguacaguucagaacaccuaaagguaacucuccccgagccaaggguuuuacuguguugucuauaaugggacugcagcauguggagagcacugguaauggacuugccagccucacuguaaagacuuccaaagaauuccucuccuacccacuggccaccaaauugguacucucccaguccacccagagggaaacguuggcugucuguaucugggcagaagaauuacagugaucucuuaguuuuuaucagagaaaucagaugugauucuuuagguuucuacagaguuauacugcacaauauucugacagauguuuucuuucagcacacacagucucuuaacauaaaaaguuuaggggcuggugagauggcucaguggguaagagcacccgacuauucuucugaagguccgaaguucaaaucccagcaaccacaugguggcucacaaccaccugagauccugaugcccucuucuggugcaucugaagacagcuacaguguacuuacauuaaauaaauaaauaaauaaauaaauaaauaaauaaaaguuuaaaugucaacuuuuguggaggaugagguuagaaggagccauuuauguaaagcucacgaaaaaagaauauaaaauaguaagccaggcaagcuuaggccaauuaaauggaguuggguacugagacuguggagaggugaaaaccugaauuucuuuucuauuaucaauuuacuuggaaguuugugggaauuguauuuuuccuuuaagacgucugucuguccaucuucaaagcuggugauccuugcucuuguuuccucuuccccugugcuugaccugucagcggacuccucugauaaaaugccuaaugaccaagguaaaugaggagauggccucucauuuuuucucuuuugcaaccuaucauuagcuuuuuguuucauuuuuccgccugaaaaucaguaucauguguuuaaaaccacacauacuuauuggccagaguaguguugaguccauguuuauagcccuugggauaucugaaaagcugagggagucacuuagaagcuaacuuaccugguggaagaaaauugaguugaauaaacucuagauuggcauuaagugaagaucagguuauccuuagaaguuaagaugcuaaaguuauaaacagugauaagcauuugaggcaaaugugagcaguauagcaaucuuucauauuuaguauuuuauuuaagugaaaagucaguaucaaaaucaguaaacacuguauuucacuucugacauacguauauaaucuuguuacauacgugcuuaucugugaccaaggauguuaauuuauagcucuuuuuauauuucuuccuuaaacauuaaguaagacuguuuuuauaaaaggauaaaaagcauguggcaagacacuuaggaaggacgagucuuaaugucaccugucuugaaauccuugacuggcagguuuuucauugugauugcucugguggcauguuagcugcccuuugugauuucugucucuaagaaacaagcuaaagguagcuuuccauauagagauagaacacuagaaauaaaguugauaauuguucucaugguuuaacaguaauaaucagaaauucagcuuuuuggaucuugguuaauguaagaaucagaacagaguauugaguuucauggcuuuggacaugugcuuguguucaacaagucuuuuuuuacaugggagggaacugugggcauaguguuuugaguguagaagcaugagauuucauaaagcguuacgcugaauaugcagagaauguaaauaugccuugcugaauacgcugaauaugcagagaauguaaauacgccuugcucuuucauuugauaacuguuaagcagcacuuugcuguucuaguauucaaaauuuuucaccuguugguauuuaggguacauccuuugaauuucuugguuauucuuuaaaugcuaaauaaaauauugggaaaugcaggaauauaaaccaacuaaaucuuggcaaacaaggugaguucaguggcagcuuuuuguuuguuugguugguugguugauuuguuuguuuguuuaugugauguguucuggaaaguuuaaauguagcuuacgugauaaucaugaaaauuuaaauauaaagaacuuaaaaugcugaguaucucugccaguuagauuuugccugaugugauagcauaugaagaacaacaggaaucuugaggcuuacauagugugugucacuugggagaugauagccucagaaguaagaggauggaguaguuaguaggaacaauggaaaaggggucagagacuaaauuaaauccuagacuaugcccuagaaguucugaaacuauacuguaggauccaagaacaacuguucuuuucuuguauagauuuuuuacuucugagaacauaucaaacauuauaguuagccucuagauuuauucuauuaaaugaaguacuuauacaacuuuauauucgggcucccuuuguuucuuuuaaaauaugauucuuuauaagaggaaagaggaauuaacauuaacucuguuuugcagaaauaaauguauuuauacauuucuagucaagcuuuauuugugaaaauaucucuuauaaguguuuacuagagcuccguguacucugccuccauaaagaggaagaggacaucccugaauuuaugauguuuguaauaguuaacauuuauugaucauuuacuacacacagagcaguauucagugucucauggucuuaaauuuccauuugguguuguaaacagauguccaagugacuaauuacaugacuugccccacagcaaagcacugccauguaguggagcugguguucacgggcagucuuguaagcacugcgugccauuaacggucaggagcagcuuuuacuuuuuaugcuugcuggccucuucucaagagcuugccacugcuuucuggcuaguaacuuggaauugaggaauaucuuuauggaggaagaaagagagaaacugaaaacuaagaauaaggauuauaaaacagaaauaaaauaaagccugggguuucugccucuuugaggucugcugcuggggagaccucacucauuugaaccugugacuauaggagcucagaugacaguguaagcaaccagaaggaaggcuuguguuuuguuuguuucuguugcucaauucauaagugacagaaaaggaagugagaaucugauuugaaucucugcuuaucuuccugcucuugcuuaaguuaacuuuauacuugaaaggacaacuucauaaucugggggggugggagggggagccagaacaauacugauacuagccaugccagaucagcaucaccagguccuuuggagaauauacuuguuugguacaagcaucagccucacuuacucccucagucccuuuuguuauaaaauaaucuacuaccacauguccucucugaccaucacuuccugggcuagagaaaugggagggggucccccacuuccugaacagcagauugguaguuaggucauggccuugaaacagaggcaccagucuucuagguaccuccuuacacugcaagcugugucuguguaccuuggcacacaaucuguaguuucccauuauuuguguuguuucauuuucuuacggaguagacugaaguguuuuguuuuuagaagacacuuaacuagcuguggaauggacugucacaucuacauguuggguuuuuacugacgugauuucuucugcuucagccuuagggucagcaggaaaaggaagccgacuaccagaccugggaucugacuacaaaccuccaaugagugguaaaacccccucuaagacuuuuucagcuuucuguggacauuaugcaguucugcuuaaaacuuuuaaguaugguuuauggcuucaauguuggcuuauggcauguuaaugugguucauuuuaauuaucggaccuaccuuuggccauuuuguggcaaguacugcugaauuacuagaagccuauuuucaucauagaauccugucucucugcauagcuagcuggaaacaagacugauuccuaaacaaaugaucugucuccuacuaccucgagagaaaagaguuagacuuugaaacacuagcccucugguaggauccccgucacccagcaaagcccgagaaccgcuucagaaucucagcaucuccccuacuauguuuuuuuaagucugggacuucuaggggaaaauacucuacuuuucuaccauucugcaaguuauuacccucaauuuuauaacacuucauucuuggugauggagcauaguuaagagcacaagcuguucuugcagagaaccuggguacaacaggacccacacaguggcuugccacugucuguaacucuagcccaaggcaucugccauccucuucuggccuccuuggguuuugcaugaugugaucuacagacauauaugggcaaaacauucauacucacuaaauaaaagucaguaauuuuuaauuuuauuaaaaaggcacuuuucuuaccauuucugaguuuacucucacacuugaacucaccacugauccucaacucugggauguagggagaacagauugaaguauucccaauuaauacgguaaaaaaaaaaaaugaguggagaagugucaucuuugacuccacucuuauucugucauaaaaccagaauucagaccucugugcuccgguugugcauuuugucacugucgagugcagucugaagugcaggggauucuguaccagguguaagaguccaggugcaaaaugucuaaaaggcaguuauuaaaauugauuuuuuccccacugucuuaucaccucuaccuagcaggcauacgagaauaccuucuuacucuccagcuaucugucuaaugcccauacuuaagggaaacccacugauuuuuagaagagaaacuugaaugcuucaagauguuuuauacuacacuugucuagcuauuucuccuucaagcaucucuuguauauugggcuaucaacaguaaaguaucaagauugugagaaaguaguuauuccuuuaucuucuuacauuuauguauccaguuguacauuguauuuugaagguucagacucuauagcaaacuauaggaggaagagaaguaaaaaaaguaccugauaggaaaaauaggcacacuuuauaaaagaggucuuaucuacccccuauccuaaaggguauaugaaauccuaaaggcuguagaaaacugggagcagaagcagugcucagcagguaagagcacacuuuccauucauguagcaaaucgaaugcaguucccaucacucaccaugaguagcucacauccaccuuuaacucugguuccagggauccauugcccuccucugucccccacagguacucacacacaugcaacagacacucauacacauacacacagacaaaaauaaucuuuagaggggaaaauuuacuaaaugucaagaugggcaucagacauucuaggaagcucuaagagcacaugcaaaggcauagcagcaccggcucacuguagagcucuacugccugcagguggaauagaaguguacaggagguuagagcuggcuugacaaaagcccacauacuuagauugcuaagaaaccugggcuuuauaaccuauauauguaaaaugucugacacuacuaauauaccaagacuuccauuuuuucaguaucugcuauuauuagucugagaacagugaagaauugauugacagcuaagaaggugugaagucagaaggauaaagaaagaagcugucccaguaguccagucaaacauaaagagaugcauguaauaugaucucagacaagaauauugacagccccuuugguggccccuucuuaacucuguucuagaaaaaaagcuuuuguccaguucauacguagaaguuaaauccagaugaaugcugaaacuuaauuuguguugaaugcagaacaauacuuucucuucugcuuguucucguaccccugcucccccagccuucaguuugccaugugggucccaccuuguaagaaucuagcccaguaguccagcauuucucuuaagagcaauguuggauuaacaguaugguuaauuuuauuggcucuaguaacuguagucuuuccuaaauaucaaaauguuaucucauugaaggucaguguauacaguuuuaaguugucugcuuagcuuuuucuuagaaaugaauaaaaaugauugaaccaaauauaaaagaauaagcucuuaagccauucuaaaucaaccucagauuuagcagucuacuuagaugucuguaaaaaucauagaaucaaaguugggaggucagauaauccaguguuguuggaaggauugccauacagagaaagguuugguuuaggaaccuagcacucuguuuuuuagcucuacuguuuggcuggcacgcccugggaccugccugucucugugccaccagguuauaauggacuccaccaugccugguuuguguguggaugcagggcuucagacucagguuauaauggacuccaccacgccugguuuguguguggaugccgggcuucagacucagguuauaauggacuccaccacgccugguuuguguguggaugcagggcuucagacucagguuauaauggacuccaccacgccugguuuguguguggaugcagggcuucagacucagguuauaauggacuccaccacgccugguuuguguguggaugccgggcuucagacucagguuauaauggacuccaccacgccugguuuguguguggaugccgggcuucagacucagguuauaauggacuccaccacgccugguuuguguguggaugccagggcuucagacucagguuauaauggacuccaccacgccugguuuguguguggaugcagggcuucagacucagguuauaauggacuccaccaugccugguuuguguguggaugcagggcuucagacucagguuauaauggacuccaccacgccugguuuguguguggaugccgggcuucagacucagguuauaauggacuccaccaugccugguuuguguguggaugccgggcuucagacucagguuauaauggacuccaccacgccugguuuguguguggaugccagggcuucagacucagguuauaauggacuccaccacgccugguuuguguguggaugcagggcuucagacucagguuauaauggacuccaccaugccugguuuguguguggaugccgggcuucagacucaggucacagcacugagcagucugcccagcuguuugaugccuuucuuucuugauaacaguuccuuccacaguaucucacuucuuaaauacguuguuucugguugacugguugguuguuuuugagacagaaucucaaucuauaauccaggugugggccugaaacucacugugugacucaauuuucugcagucuuacugcuuuggucuucaaagugucaguauuacagcaugugccaucauacagucuaaaaaaauccuagugccaggcaagaaacacucccuuguguaguguucccugagccuuuguggucuggggcucacuaacgugaggaacuguauaaagggucacaggacuaagaagguugaaaaccacucugcuagaguguccuccaucaggccuuuuugugaugagaucuugucuaauucuaaacucaaaagccauuucgaggagaaguuucuuuuuuuaaaacuuuguuugauacaguuaaacacaugaaaacaaguugaauuuagaguccagauggacuacaagcuguuuucugcauggcuuaccuucucaguuacugucucgggauauauagugcaggcucaggccuugcuucuccagcauuguggaaagagaccuuauacuugagacagagccacacuggauucagaaaagcuuuucaccuacuuaucuaagucagccacacagucacucugcauuguacccccgcuuuuuuuuucuuuuucuuuucuuuuuucauagcauucuuagcuaguaguuucuuaccuguuuguuuuguguggcaagucccacccccagcauucacuguugcaucuugaauacauacaauaauauaugacacauaauaaccacucaguaaauaauugucaaaauaggacauauguacagaacuacuucuugcugaaguugaauaagaaaauggacucuaucaucuguauacuuaugaggaaagauuuuuuucaaacaguaauuuuguaaucucagacaccuacguguuaaggaaaaauuuuugcuuuauauauggcuauacauuuuaauaugauuuuugaaagccaaaaaaaaaucccaaaggauuuagaaauggugauuguagaugguuguggguauguauguucagacgccaaguucuguccgccuuuuaagacauggucucugacuuugcagcucacaaaguaggcuuugcugucugaccucugagcucuaaugcucugucuaccagggcugcaccugccuugcuucuccagcacugggauuauaaacuuauauaaccaugcaaagcuuuucuuuaauggguucuggggaugggaccuggguccuuaugcuugcaagacaaaaacaucuuaccuaucaagcugucuccucaguacaacgugggacuuuuaaaaaugaauuuguacaucuuauaagacaccagaaaaacagaacacuaccugagccuuugugcuuagacaguucuagaauaucaguacacuugaagguuucuuuguauguuauucuuugaguaaacuucuaugccaaucccugcauguagggcagacugucauagccucaggaauuuauaaucuagaaauaguuuccuugaguagcacucuaugcaguacugugauaacugguaugaagaaaauucaccugaaauaccuugaaaagguuugauggagcugauugaauuuuuuuuuuuaaaucaccuaacuaacuaacuaacauuuguaccauuuuaccugcacaggcagcaacagcccucacgggagccccaccuccccucuggacagcaacaugcugcuggucaucauugucucuguuggcgucaucacuaucguggugguuguggucauugcugucuuuuguacccggcgcaccaccucucaccagaagaaguaaggaucucuaacaugcaacccugguuuuguuuguuucuucuuauauguugcuucuguuuuuagagugaugcaaagaguugaaaaaaacaugaaguacaggaaaagccacuuuaaaugcagucauacccccuuccuaccguggggacugucuuggggaucuuguauauuaugacaagucccauaagauucuaauggagcugaaauauuccugccaucuacugaacacaaguugaagaugcaagagaaaaagaaaccaugggagaaggaggaaaaugaaucccuaagaaauuuaacacuggcuuuucugggccucaaccuuaaaauguuugaaacugagggggcuaggaagguggcucagcaguuaagaacauguacagcuuuuguaguggacacaguucuguucccagaaccuacuuuggauggcuuauagcuaccuguaacuacagcuucaggggaaucugauaccuucuucugaucucugcagaaguguacacagaauuaaaaauaaaaaucaaucuuuaaaaaauaaaaaguuugaaaacaucuuccccugucucaggccaaaaaguuugcaucuacaagcaggaaucuucauagacauuucugaguagggagaccugguuaggaagugggacaaauccucagaagagauucuagaagaaggcacugucagucauaggagaccacacaguaacauguguauuauugccgcaaagacuuucuaauaaaacaagaauagaaaaaaaaugaaaaagaaaaacagugacauuggagaucugacucuagggcaaucugggcuagcuuuauguuuguguccuaguuuuugauggugguggugguggugguggugguggugguggugguggugguggugguggugauggugaugguggugaugaugaugauguaggcagguauaugcacaugauuguagcugcccacagaggccagaggcaucgauucccucugaaacuagaguuaauauguguuugugagccaagccacagggguacugggaaguaaauucagguccucugaaaaagccaucuucccucugugccaucucucuagccauguaucuuuaguuuuuuaacaauaacaacaacaaaaaaaauguuuuaggaacuaagaaguaaaggcuagagacaugguucaaugaauaaagugcuuauaaugcaaacaugaggaccugaauucccaguaccuacuuuaaaaaaaaaaaacaaacucagcagugugccauagaagugacagaucccucaagcuugccuuaccagucagaaaguucagggcuuagugauagaaccuguuucaaaagacacaguguagaguaauagaggcagacagcagaugucaaucacugaacccccauacacacuugcauacaugucuggauaagcccccacacgcaugcaugcaugaaaaaaaugagaaguaaaacauugagcugauaaaaauagaacaguuaguggaaugaagaaaaaaauucugcuuaugcaguuuaccacaaaaggcagaaaguacaucuguauauguacacagagagcgaaacggcuucugaacccuuaccacaggcuauuucacaacagccugcgugccagugaaggugggagaaagcuauuaaccuaauauaaguauuuuauaugugugugcacgugugugcgugcauauguguguguaugagugaggcucucacuauguagucuugacuggccuggaaccugcuauuccaggcuggcuucaaacucauagagauccacuugucucugccucuggugcugggauuaaagaaagacaugugccaccauguccagcuaauguauuuguuuucaaagggcaagugauaagcuacccuguaacugcuauuugaauaacuuuaugacagauaagucaugugauguuuuaacucucuguucucaaguagcuuucuauaguuuagguugcaucucuuuucuaagagaagaggggcucucuucugguuuugauuauggaaaacuguuuccuuaagagccugaaagucagcucuuuuagaacauuucuccaaguuucuguguuuggugcuucauuuauuuaucuguuaguacuugcucauacagcuauuauuaguaugcuugggaucuuuaaaaguuucuaaaaaaaacaaagugaauauauacacacacaaaggacaaagaguuccacagugcuuuagauggaguuaaaauucaaaguaaauaaaacugguaucauaggagugugccacuguggccaaugguucucacguuuucagauuaggaauaaucaacauacagggauaacacguguguaacagaggcccugaaagaucauaucaccaaauggcagcacagccauuuuaguuuugaaaauauccccauauuaaucauauguggcuaccaaguaauugcuauacaaaugauuuuuauacuguauugcuucaggaauaaugacaaggagaaguugacauauucaguaaaauuuaaaaacaguauauuuucagucuaaaguugauugaagcugaaacuaugaaacgcagauaugaggguccacuguacuuguuuacacuagcuugaagucuuuuuuuccuucauugcauguucaagcucuagucuuuucuaauguacuuucugucccaacuauuuuaccacaguugcuuucauugaaucacacauuccucagggcucgagucuccauucucuuccgugugguuucauguagcucugugguuucauuuacucugugcuucccagaaacucuguuucuauuuccagccaggccucuuuguucugcguaucaggcaugcgugcccuucccguccugucgcauuucucuuuacucgacauacagcuuagauaugaagcaugcccgcuuguguaggcuccugcaugugaacccuugguccacaguuaguggucuguuggaggaaguucccuggggugggguuagccuuuagguguauggcccagucccucuuccugugugauucuacuuccugacuacagguucagugcgaccagcaaccuccuacuuccaugccuucuggccaugguggaaugcauucccucaaacuguaagccaaaguaaacccuuucuuaaauugcuucagucagauagcaaagagaaaaguaacuaauacacacauguccaaaucaauccauaauauuuucaguaaaacuuuguaguccacucuucucacugugaauaaguggccugggccagaagccuuggccucaccauuucuuucuuuuuuuuuuuucuuugcucccacacagucuaugcucauucccucccuaagcccuauauuucugucuccugaauaugcauuucaaauuugccuccuccauuccacugucaugggccagcuuugaugaacucccuccaguccucugccucacaaauccauuuuuacaagaggguagggauaaaguuuuaacucagaucaaccuuguuucucccuugcuuaaaaccauuaaaugauuucccaucucugagaguaggaaguucccacucucggcugcugugaaagcccuuccuggccugguucuugccugccuucccggccguugcccagccuccccucauggcucaugcucucauccuccaguauacgaggcugcugcggcuccacugcagggcguugacacagcugauuuuaccaccuggaauacacgugcuguccccauugugucucagcauaaagucaguucugcgcauuucuccucucuaucuaagcuccagcuauuaagauuaacacuuggcauuuugguaaguucagagcauuuaaaaauaguuuagugucauuuucgucacuugaccaaaagugcugagggcacagcaguguagcagaggcucugacaggagcaaggugccuaguguauaugguuguugaaugggaaagugaguggaugagugccagcagaaaugacaguacagugacacugcugccacugcacauacccgauagucccggaggcuuaccuagagcauggcucuguccuuucccugucagccacagauuuuuaccuguucuuguuguuguauuuuuacuucuugucguccuuucuuuaucuaguggaaacuuguaaaggaaccuucugcuuuugaaguuucauuuuuaauugcuaucucaaucuuuuaauauaaaaaaggcaauauucacauauacucuggcauauaguaucuacacgaacaaagcaaaaacacguugacuuuuuccagagauaggccuuuugucccugaucuguuguucugcugcugcugcucgcugguuugaauuucugccuuuguuuaaagcuucucuccgaagggcaggguuucuuucucuuuuacuuuggguuggaguaguuuuauuuuaauugaggcuuauauuuaggcccucacaacaugcuagacagacacugcuacucagcuacgggccguuuuugacuuuuuauuuuaagaguaaaucuugcuaaguugcauaggcuggccuugaacuaacucuguagcauaggcagaucuugacuauuucaucuuucugcuucugccucccaaguaguugggauuauaggcuagugccaccacacccagcagaaaaucaauuuuaaucacaguguuuuaacaaauauauucaaagggaguacauuuuuaaaacuacucuuaauucugugccuaggaaacgagcugcgugcaaaucagugaauggcucccauaaguacaagggcaauugcaaagaugugaagccuccagaccuauggauccaucacgagagacuagaguugaagccuauugacaagucuccagauccuaacccugucaugacugauacuccaaucccucgaaacucucaagauaucacaccaguggacaauuccauggauagcaauauccaucaaaggcggaauucauacagagguaccauuuucacuuuguaagguugccugaauuuguuaauuuaguuuaguuuuaaagaaauguauaucuuguuuuuuuuuucagcauuugaugaacaauagcuagcuguuacagaaggggagagguuauggaucauuuaggaacagccuucuagauuuuuuuaagucucagugggcuucagucaagcauuugugccaccuaacucaugcuugugcauuggguuguguccuuuuuguuggacuccagcuaucacuauggcauucagaaccuuuaugauagcagaagcuucuacacugaaguacaguauauaccaucauaccauccucuuugaaucucagcaggaauucccaugauacuguaaauggaaaugccuugcccuagugcauuguuagagaaucccaaacccuccaguggaaauguauuacugugaaggcugcucggaggucuagggcauaugcuugcugcuaaccuccauacuuuauauccagggcaugagucagaggacagcaugucuacacuggcuggaaggaggggaaugagaccaaaaaugaugaugcccuuugacucucagccaccucagcguaaguagaaacuucccuuuccucaagugcuaccagucuucugugucaugguggaaaauaucuaugaguguaucuuuaacuucucuugauuccaagucaaagaccaacugccacacuuuacagaaaaaaauaccaaaccauuauuuuuuuucauaauaaauguuauucuugagcuagagagauugcucagugcuuaagaacacuggcuacucuuccagaagacugagguucaauuccuagugccaucaugguggcuuacaacuaucuguaacuccaguuucaggggacccagacacccucuucuggccuccaaagauaucagccauaugcauugugcacagacauacauugagcaaaacauccauacacaugagaauaaaaauuaaauauucuuguaacauguuuaaauuauaaauaaguagauucagaagcuaacuuaccagcuagcaagaugguucuagagauucuuaugugcaggcauaagaaccuaaaccgguucucugcuuucuccaugagguagugagggaaaaaccaacuccuaagauuguccucugacaccugcacaguggcaccugcacucuguggcacacaugauaauuaaaaaaaaaaaaaguaauuccuguacucuuccagaaguaggcacguaugugcucugagagacaggaagcaucucuuaaagacugcaauugagcuuuccaaacgucauacagaugcuuuaggcauccugcacauggucaggauuaacaagcaucuaugagauuguaacuuaguagacuuuuuuaaguuguuucauauuuguagcaugggguuuaaaacauuucaccauugacccaugcuccauuuugucaagcauauacguugcuagaccucuuuuuguaauaagcaaaauuaaaaauaaguuaaauguuacuguugagaaucaagagaggaguguggugaagagacaacucaguaguuagagcagaagacccaaguucaguucccaccacucauuucagggagcucacaggcaccuguaauuccaaccucaggggcaucuuucaccucuggccucuaugaacaucacacucauaugcacaaacauacauacaaacacacacauaacuuaaaauaguaaaauuaaucuuuucuuaaaaaucaaaaagugccacucauggugguaaaucccuauaaucccagcacuuaggaggcugagucaaaacucaguuccagggcagccugggcugucacucagacccugucuccaaagcggagaaaggcaaugagauaagucauuaucuucagacuacuguguccuuucucuugcuuuuguuucaagauaggccuuucagacuagcugccacugugggucuugcaguuaagagaaugcuuagcugcgucucugccaacaaaugaugagauaaaagagcucugggcauucuacacagaaacuggugccauggaauccucuccuuggaaaagcucuccuccacacuugcaguggaaccuccaggcaugcacaugcgucuuccucacucacacacgccucacagugcggucagggaagauaccagauuguaaagguagaucagcucugaaagaguaaggcucuguuucuuuaaaauuaauacuuuuuguacaaaguaacuuaagcuuaaugcccauaacagaaagaaaggcuuaaacuuggaagcauacaguggguggggacauauuuucucuacuuuaauagguucuuuaugugaauacccccaguuuaaaaaauacaaaaaagaacaaaauaaucuauuucacuuuugguuugguuugguuugguuugguuguuuuuacucacaagaagauaguaauuucuguguucuaagaucucaguuccuaccugaacugacuuacuuuuaugacuuagaaaauugaucacuuucuagauuuauuaaauaugucaaggaaagaagauauaauucuaguuaaaaucauuucucugcuguuugguuugguugguugguuggguugguugguugguugguugguuggguugguugguugguugguugguugguugguugguugguuugcuuugguuugguugguugcuuggcugggcugggcugggcugagcugggcugggcugggcuguggaaagaauauguaugaauacaagguauuauguaauucgugcccaaacaguuggguagguguuagaaucuuucuuucaaagcacugaaaccaggugccuggauacauucagggcuuugagagauccuuuuugaaaccugccuaguggcccuuuuguacagcuugaacuccuuagcucuguguccugcagugaaguuggagccaugcaccuggcauccacauaccuaggucugaaaaggcugggcaaagcuagaugggcugguaucagggugaggucagacccgaacccuacacagacccacaagaucagauccagcuaacuucacucuacaccaaaacauucacuuuuuacuuacuuauuuagaaacaguugaaauagcuuuuaaaagaaaaccaagcccauucugguuuucucucaccccagaaugcuuucaguuuucacuuccugggucaagcucaguuuaaccacuucaccccaacauaaacuuugggaaauacagauucugaagcaucucacuuugccccgggggagauggugaccccaggccaacugaugaccuugucagccaacuuuucuaguuguaauuucucccguggaccugcuagagcuugugguccguggaagcagcuggagaagaaaggcagccgucucacgucugaggcuucuucccaggggaaugcgauugccccacagacaucuaugcagagcucacacacaggagauaguuuaaugggcuccagagagcugauucagugugacuacuaaagcuuauggaaguguagcauagaaaagggaugggggaucccucuguuccuguuuguuugccuaguugggcagugugcagcuaguuaucuugaucauaaacaugguucuuccauauucuaaggaauaccuaugaaaauguuuuguuuucuguuuauaucucagguuaagcaagaagcuucauuaaagaggcuucauaggaaguuauaugugggauccacacagaaguuuauguucuuuauuuaaauugaauccuuagucaggaaagggaaaaggaaacuuuuaaaaugcuaguggguguggcugagcccccaggcugaacacaguaauaaauggugcuguaguacuguaauugauaguuuuauuacuagauuggaguaugagcguuaauuuuuuauuuauauuccuuucaagauauuaaaacugauuaagcagcuaucucuuuauuaauauccaucaacugagcauaugcucaaaggagucgaucuaaucuuccuuaguggggcauacuaauggcccuuuagcuggauagaaaaaauaauagaaacauuauuugcuuauagauuuauauuuuaugacauauucaugugauucguguuuuaauagaagaauucagaaaugcaguuaagccaaagaaaaagacucccuuaaucaugacugccauuccccaaaauuaccacuguugauggaauauauaccucagacuuucuuauuauguauagauguagaauaugccuagaaguguguccauuuguuaagucaaacauaaaauugauggcugauuauccagccaccugccaccaaaaagcuaaagguugggcuagugggaggugggcggggugacugguaugugucugugcaagcauguuaagcaucucucugucuuguguucauccacagcugugauuagugcccaucccauccauucccucgauaacccucaccaucauuuccacuccagcagccucgcuucuccagcccgcagucaucucuaccacccaagcagcccauggcccauuggcacauccaugucccuuucagacagggccaauuccacaggugagagaugaggcucaagcccagacggugaaagcauccccggaguuggcaaguggaauggggaaggacuugccuauuuacaagucuucaguguuucuuguuuauccugacauuucugugauggauucaaauuuguuuuuuuuuuaaccuacugcacuuuucucccugaguuuaaguauucagugcaaggugccauuuuaguaaaaagcagcaauaacuugaauugcauaagcuucuguucuuccuauaagccucacaccuuaacuuuguuaccuuuuuuaaacccccccccuuuuuuauuuuacaaauugaaagggaaguuuauucagaguggcuuaucgaaaccaguuguugccuuugucucagucacugaaguguuggacagucaugguaggugcagguuacugcccuguggaccagaguaaggacagcauccaaaaggcauccgagccaccuuaggggagcggagacagcucuaaaacauaggaaaguggcauagcgguauucagugugugguaaaugcuuugccagacaaacauguccucauuuggaaaucauggcuucaucauacaguuuuaaggagaaaagaaggaagaugagacagcagaaggaacagacugcugcugcccacugacuacaaguucauuuaaaucuccuaguuuuaagcugcaaguccuaguauuuauuacugguaaaaaccaaauguuggcaguucugagaaaugaggaaaauucuagugagcuccauuuuuuuuaaaaaagccuguaauuuuaauauuuagaaguuugaguccccacuacuagcaucucccuguccucaagcuuugaucagucauuaauaugcccagaauaccaaaugaaugugagagucuaaaagguugucugauaccucuuagcgcugcacacugccaauacuguuaccuggcuuggugaugcugcuugaacccacaccuaaauuucgccuucccacaauuuccucccaaauuuagguuucagaucuacauuuaggaagagaucauuauuccagccagauacaugggaaccaaaguuugcuguagacaugaacucauagaacagcaaguaccagaauacagcuuuucaguccagcccugcucuuaggaagauaguuuugugucccgccacacuuaccauguugaagacuaagggauccaucccacacaauccucacauaaggucgugugugaguguguggaaaguucuccuaguuggacuaucccuguccuccuuugcccugggcugggagaggcuugggaguuggagagaagacuagaaguucccacugagcauucagccagguagucuacuauuguugguaaaguucucuuuugugugugcugagacagaaagggagaaaggggagagguuacuuuacuaacaguucuugcuuugaugcccagagaggauagugugauagaugcacuagagaucuauuugaaaagcagagccaguaucuagaaguaauccaaguuccccugcuuuguauuuccccaagucuuuauaucguuagggcuuagacugcuauuuucauagccuuggguguggaggcugugcagaacuggagccuggccaaguagucucugcccuaggggcauuuaccauugcuugccaugagaagagcacuuucuguuugaccauucugaaguuuguauuuuaaacaacucugaaagguaagggauuaauccccucaccaaagcagacauuuuagucugagccuagucuuuuaguuagggauuaguguacaagguugaggaacaucuuccuuggagaaugcaguguucuggugcucucuggaguauacaaggcaaaccuagucuguggcaguggcuagggccgugacauaugcaagcaauagaguguuccuugcuuacuuuccugccaucucuuuguaaaacacaguugaggcaguuaggcuguuguacagaguugaucugccauauuagcuguuaucaggugauaugucaggacuuagaccuauuucuuucucauggccucuuauuucccuuccuagccagcuucuaccugggccuggaucgcagaugguucccggcagcuccccaggcacagugauggcuggcuugagcaagcugagaaguggcacccccagcauggccuuuagaggaugaaaggugucugaaccuggagagauuguucuagcccacguacauuuauccucauccgugggacccagcaccuuuuaaguuaaagugcggucuauucugucuacugagagcccaagggagcagauggauugcuuuuucacaaaggcagggaaguagguuagauuccugcagauaguuuagauaguuuauguguuucucuuaaggcugagaacucaaaacagucaaaauaagccuucaaacuaccuguuacagccuguugcccaagcugcuuuccgugucuccuuucugggugagaacaggucucuccuguucacacuguaugaaaaucuuucucagucucugacauugcugcuucugcuuugcagggggagacaagcaucaggugcagaaaggcaggaaaucuguggggcuucagaaccugagccugggaaucagugcagggauucaaacucggugccugucugugggcgacuugcuuauuuacccucccagugcuuccugaguuacucugagaaauaaauguaaaaugcuuagcauagaauaaguacccagugucuacaaagagaaccucucuguuguacagggacuauguucaagcucuucauucauauguguauguacauguauauauauacauauacauacacauucauauauauguauauauacauacauacauauauacuuuauacauaaugaauuaugugugucuccauguuuuauagaugaagaaauuaaaggcucagagaucuagugacuuugccagauucacucaucuaguauuaucaaaguaaaauauaggacuggcuaacuccagugugcuuuuccagccccacugugcugcccucagaagauguauuuucugaaacuugccuuguucuccaggcuaacccuucccugugccucuggauaaaaacagcauucauuugacacagucuucagcuguauacagaccccuagacuaugugaggcuuuauugucaugaggucaaagccauucacauuggugauggccaucuaguaccugagcauuggccucaccugcacaagccuugcugacagagccaauuucugguggguauuauccagccuguauuacuagacaugguugucugugaauggucaguuucuaagacuaccaaucagugagugaaauuugaaaaauuguauauacuagucuucagaaccuucauaaagacuccauaguaaguauuuuaaaucuaugaacuuacaacuaccuaaguauguaacuagagaaaaaaauugaaacugucgguugaaacaagauuguuuauagauucuuagauuagcccauccauucuuagccuuggcugucguccugauccgugugucucuggacuuagaacugaucugcuaaagugcuuauugaacaggcuuagggaaccccuggaaguagccacaacugcauauuuuaaugguaaagaaauacuaacauuuaagcuuuccugcuauagaaucuguucgaaauacccccagcacggacaccaugccagcguccucgucucagacgugcugcacugaccaucaggacccugagggugcuacuagcuccucuuacuuggccagcucccaagaggaagacucaggccagagucuucccacagcccauguccgcccuucccacccucugaagagcuucgcugugccagcaaucccacccccaggaccuccucucuaugauccugcacugccaagcacaccauuacugucccagcaaggugagugagaggagcagcaucgaccgaggggccgcuggcuucgacccagcuuugggauagaggucuuuaccacucacccuccgauaccacucucacaucccuuuuuucuuuccuuuuuucuuuucuucuuucuucuuccuccuucuuuccucuucuuuuuccuccuccugcuccuacuucucucucuuuuuuuaaacugaguuucucuguguagaccugucugucuuggaauuugcucuguagacuagucagccuccugagugcuaggauuaaaggugugugcuaccaccacuugccccuccccuuuacuuuuuaaagaaaaagcaauauccuccaaaguuuucauagcaacuuagagaagcucugugucauuguccccuuuguggggaaaacauacaagccauagcauaauguaguggugagcaggggcugaacuuuugaacugugauuucugugugggaucccugguauuaaaauccagugacauagguuuggacaacagagcugguccaucuaggccccuggaaucaccucacucuaaaagacucuucaggcuaaacaagggccagggaggccaggucugaaaaccaggagucucaagauagugagcacucauuugcuguacuucacagcucagcaagggacucuggccacugcuuauuaugguuuguuucagaauaagucugugguucucaaauuuuuucagucucucaaagccucuucagcaaucagugcuagucuaaagacacacggaucaggaccacugccaaggcugagaauggauggacuaaucuaaaaucccaaaacaaucuuguuucuguguauggaguaugucaguacuuaucauauuaguaauuaauacaagaaaguuuuuuaaauuuuaauuaauuuaaaagauaauuagcacauuauuuuuuuggugaacaguuaucacuaaguuucucuuaccuuguaagugucccacacucagucuacuguaauaaguuguuuugguuguuaaaacucugcccucacagauacauacuuggcaaauggcaguguacuuucauaaccuuuuagauauuuaggagcuuucguuuuuggaaaaagggggcuucuguacugcccacaccggucuagaguucuuaguccuuccgucucauuguugggauuuccgauacaugccaccgagccuagucuggguauucuuuuugauacaauggaaaaauucaacaaguuguagcuucuccaagacugauuuauagugcagcaucucugucugucugcggacucugcacagucugguccacuagguugcauuagauuuagcuugcgcuuuggauguguaacacuaaaacacacguuggacauuuggaagauauugguucaauaacuuuuaaaaauccuccaaauauucacacauucauuguaagaagcuuucacagucagauaacagaaacaagucuuucaaaaugguaauuuucacaaaaacuuugauuuuaauauuggcaguaucugucauauuuuccuuaaguucauagcucauucuuucuauuucuagaaaauaucuggggcuagagagauggcucagugguuaagagcacugacuguuccuccaaagguccugaguucaaaucccagcaaccacaugguggcucacaaccauuuguaaugagauccagugcccucuucuggugugucugaagacagcuacaguguacuuagacauaauaauaaauaaagcuaggaaggaaggaaggaaggaaggaaggaggaaaauaaaugucugaaugacccaugugucaaucaucuuugaauuaaaaguuuuguuguuacaugauaaaaccucaacuggcaagugagucuaucacgguccccuucuugaagaugguucugugugugguauauagcagaaacauuugcauuuuguuaaacacauguaauuuugagaguuaagauuuaauaaaacaauuucuuauugcuucauuaaggguaauauacuagcuuguuaaaauauaaaagcaugacccuaguuaaguucacagcuuauugcugcugucuucauugcuaaggcuccuaacagucuugcccauguugcuguguacccucaauacaaauaaaaccuaguaaaaaaaaggcauguguuccuuaagugucacaaugaaugagcuuuuacucccagguauuuaugaguagucuguggcucaccauacuuugagaaccauugggagaaaauacuaguuuucuaaaggcaguggaguguuucucuggccucgugguugcccucuugccuucuuccuuccaucuugcucugauaacuuuucagagcagaucccugucugagccuacaagcaucccucacauugaaacagcuuccaccccugguggacugcugaggucuaagggaucaaccuuagccacaaccuaacaaugcccuuugccccucagcucugaaccaucacauucacucagugaaaacagccuccaucgggacguuaggaaggagccggccuccuaugccagugguuguuccgagugccccugaaguacaggagaccaccaggaugcuggaagacuccgagaguguaaguuccuggggcccucggcuuggccaggauguccuagggaguugcuugcaugcuauuagcugauuguacauuuguguacacugaggucuuugccaccauagauauaaagcagauuuaaucacucaucaaacagguguccuuggagcauccccauauccugugggaauguacuauggguuugguuugauaucagaccuacucugauaagucuuacagugcuuuaucaucccaucaaaguuauauauauauauccuuccucucauuucuguuccuggaagagaaggugccuaagauuguuuucaaauuccaguauucaaugucugcauuuccagauacuggguucucuaaagagaaagcuuaagcccagagaugcuggguacacacauuauauugcucugacagagaucuagaagaggaagcaacagagccucucugccuugugaggucauugugagcugaggaguauguguaagucaggagaaaggcauuguguauugugaagaaaugcugucuuuauuaauggccuugaguauguccgcugcuucuguuuuuauggaguccaccugguuucuguaggccagcgucccagggcaguuuuggccaggcuacuuggagcucuggacagcucuucagaucauucccaguaaugguguucuuccuucuguagagcuaugaaccagaugagcugaccaaagagauggcccaccuggaaggacuaaugaaggaccuaaaugccaucacaacagccugaugaccuucgccuggacaugacuccaagccugagucuacaagucucggaacuuaaccuugaaaacaaggaauuguacagaguacgagaggacagcacuugagagcaggagccagcaaaccagccagugccuccaugugggguuggcuccaggcacagccaccugccuucuccuggucagccuggauuacacuuguguggaggcagcuucccuuugccugcugagagccugcaggacugggcacuaugggccaaaauuuuguguccagggaagaggcaagaaguacgaccugccuuuugcuuuguggucaguggcuugugucuuugugcugcaacugcaucacuuuuauggaguguagacauuggcauuuauguacaauuuuguguccuauuuuauuuuaccuuaaaacacuaucagaagccaagggagucugugauguucucucaagcaguugacacuugacugugguuccaguuacuuacggaaagucaucaacagugagguuguuugacaccacugacaggcauuggcuuguuguggguuucauuuuuauucuuaauucugagacauugcauccucugccagcuguuaauccaucacuuugaggggaggacauguugcauugcuguuuguaagcuuuuuuauuauuuuuuuauuauaauuauuaaaggccugacuuucuccucucaucacugugagauuacagaucuauuugaaugaaauguaacauugaaaagacuuguuuguugcuuucugugcagauucaguauuggggugggauuggggauugggaauaggaaauggaggggcugcugaggcccugugaauguuucugucaauguacuuuguuccagaagccugccgagaaugaaagcagcaucuuuaguguccuuuccuggcauuuccaucuucgugucacugcauagcaacuggaguuuuguuuggaucugguuauaaauucuuguacaguggaugacuuuggugauuuagcugcccugguaucuuggucauuuccucuuuggaguguccacacugaggucucuaucaauguauguuuaauugcuugagagaugccaaguagaaccagagccugacugugcucugagaagcuacaaagcacaggguggagacucccuuuguguugcuaguauugguucucucuggaagguuaaaaucuaaggcaggaucuugguuuccuauuccaaauaggaugccugcuucucugggcaccaguccucagccaggcagcucucguggcauugcagaggcucuccugaaaaacaucaaccagggugagagccaagaugggguggcacccaugacgcuuccccacauguuucuucaaggagcagaggacagagauaguggaaagagggucagcagaagcaggugccuucaucuaucccagcagcucagccaaaccccaguuagaaugaggcagcaggagauuccaggugugcugaggguucagccacacgcagaagacguugcagaguguuaaagagguaagcugagguguguauuugguuggcuuuguuguuguuguuaauguauaaugaaaaguauaagacuaacccucaggccucauguucuccaauagaucccuggaagacaguauagaaagucagucgggcuugggcuccuuagccagugagacuacucagaccaccaguggcuagccuagccuaccuguccuugaacaugggugauuuuaccccuuugaggucuuaacccuuuuuuuacuuucaacaagaugagcucuuuguaugauugcgggcgggggauaugaaaaugcaaugaucuaacuccuguugcucuucuagcuggucacaugacggcaccaggcaggguucugggacacccggugugcuuugacuguucuacaaaaagcugucagagcguucuggccuccuggaggcuagauuccucagaaacugucuagccuuugcccacagagcaugcuauguaauuagagcacuccuucccaugaaccccagcacuuguguuaccucagggccuugguaccuggauacugccacagaauuuccauggggcgggaagggauguauuuuuaaauaaaguaacuuaaaaguuggggaaauuuuuuaaauucagaaaaugcaaagcuauucuguauuacaccauuucacaauuuaauaugucuuauauuuuccugugacucuggaaacuaaaccauugugugucuugucguguccuaguugagcuggggccuagcagcuuccuuccaguggguguggagcaaacguguaugucgccucgcuaccugcuugagggguccgaagggcugcugggacugaguucuguacacacuuguuuggccuuuucuguaguugaugcuguaaaacucuauggcuuuuuaaaaacaauuucauguuuuuauuuuguauuggaaguccaauacacuuuuuuaauccaaucaaacuggucuggucaaaaaguucuuucccuuaaaaguucaggggcuccuacuuccagcuuccgaugacuucucuguggcucucacugcuauaaagcaggauuuagaauggcaaucugggcagagguaauaaaagaaaugucugacugccagccccaaag

SEQ ID NO: 5145 - RNA, 621 nt, Mus musculus
uugcauauccaucucuuuuuuuuuuuuuucauuucucagaaaauuuuauuggcuuuuuggauaaaguuuauuuuccaggaaggaugaucccaucguacuucugcuggaaccagcgcauggccuccuccuugcugauucuguguuuggccccaacgcagccuguucugcgcuucuugucugcgaugcugaacccuggccuacccagcaccacauagaaguccaggccguagaucccaaugcuugggucguauuugaugcccaggucaaugugcucuugaauuccaaaaccaaaguuuccaguauccgagaaguuauuuuuccgcaacucacacucucgcaccuucaggccuuucuccagaauuuccucugccuuggcuccgcggacugugcagugaacagcaaucuucucauuucuccggaugccaaaggaccugacaguguaucuagcuuuggagaacaccagggucuggccugugagcugcuccaacaccuuggcugcccgggucagucugucucugcucuccccgaugcagauauugaggcagaguuugcggaugcacaguucccgcaugagguucuccuuuuccccuugaucuugcgccaugguggagcauauccauc

SEQ ID NO: 5146 - RNA, 25575 nt, Mus musculus
gggaucgauccuucaccgcccacccggucgggagcugcagaauccuuugcuuacggaucucugagaucgagcccgccuugcuucccucccguucacgugacccuccgauugucacgcgggcgccgcucagcugaccggggcucacgugggcucagccugcuggaaggggagcuggccggugggccauggccggcugcaggcucuggguuucgcugcugcuggcggcggcguuggcuugcuuggccacggcacuguggccguggccccaguacauccaaaccuaccaccggcgcuacacccuguaccccaacaacuuccaguuccgguaccaugucaguucggccgcgcaggcgggcugcgucguccucgacgaggccuuucgacgcuaccguaaccugcucuucgguuccggcucuuggccccgacccagcuucucaagugagucacugcccgguucuucccuccgaaggagccgccuuccgugcgugggucagccccggcccggcucccagacacccucccguuggccucugcacagcccagucagucaccucccacgcguuucuccccuugcuuucucuauccagcuagcuggccuccccagcccagccccuaucccgagcaccccuucauugaugugacuucuuggggucucaguuuaucccuaauccuccuuuugagaacugcauuuagguuuucuuucuuucuuucuuucuuucuuucuuucuuucuuucuuucuuaagaaaugccuacuguagggccacaguucaaucaggcuguuagaauauugacaauauguuggcaauagacauuuaaaaugauccuuuauagaacaugcucaaguggcauagggucccugugaggcagugaccagggcugcagaacugagcccagcaugugucuggcacauaacuugguuaguaaaagugugagaggaaucagaacacaaggcagagagcuuccggagacauaggcagacgauuccaaaucaucuguugaaagugaagacccugucaucccgcaaggcaucuccaucauccuuacuguuuccaaagauccucaaaagagaagaugagcugcagguuuucggauuuggcguagacucugguuuggaggaagcuggaggagcagggaucuuauagucucaacccagaccccuucugucacagaguuggaaauggaaaaugcaucuugaaauagaggagagacacagcuaaggucaggcagcugggcugggaaggauuaaccaucaaaccucuauucucucaguugguaaagugcaaugcaacgaggcuugaauacccugcugcaucucauaagagcugucucgacggcacacagacuuggggaugggggugggguggagccaggaagaucaagaguccacggucaucuuuggccacauacugaauuugaggccaccuugggcugucagagacacucuuaagugaccugguaguuauucuuggagaagacuggguugccuuugauucuauugcuuucaaagaggaagagaguuucaugaugacauuuauaagaguguguggagaauggagaguuacauaacgagaaauaaugauaaaaauacuuucagaguggagguaaguauuaggaacaacuguauuuagaugagggccaaaaguauacauuuaucucuuauuauuugauucugaacgcucagggccuuggguuaguuuuguccauagucagccuguucaacaggcugggugguuuuucuuauuacuuagaucauaauaugccuucacgauaauucuggcuaauucuaagccugagaagcugaacuccugugguguguguaugacucguuuguguaugauaugugaaaucucugagucuuguuucuuugagcuacacuugcucucccugccuuuuuggauauugugcuugaagucugugugcacugagggaucugaacucugaaacacaaugcauucaucacucauccuaggaccucauaggagccguuuccagacuccugcuacuuccuuguuuguguuuuguuuuguuuucugucuuccuacacuuggagccuuucugggggugauaaaacaaaaaagcuguaaaugucuuuucacucuuugaaggaggggauaauagugggggagacuuggugauguuuaaaauaaaauaucguugaagcugccagucagugguagauuacuuagugugcacaaauuucugggucugaacaccaacaaaauagugaaggagaaaaaaaauguagggggcaagggaggaagagagagagauaugacccuggcauggcuuccuuucacuuccuuauucucuacuucauuccguacagcaguaaagcagggcgggcguugguggcguugaccguuggauugguuuuauuaccuuuacaacaggaauuguaagcuuccuaaguacaagggcucaugcuuggguauguuguagcuuuuuugguuguuuaaagucauagguuuugaguuccuucacccaucaugaaaauguuuaaaccaaauccuaguaacucagaggcaagcggaugucuguguguuccaggccagccucauuuauauagugaggucccaggcaggcagccaggauacuuagugagaccuugccaguaaguacauauauacguacauacauagacacacacacacacacacacacacacacacacacgcacacacacacuugaccaaucugauuaaggagauuuucccucuauuguagagcuauuaacaauccgagaagcucaggagaaucaaauauguaggcaugaaagguguaugcacauguacaaauauuuuguggcuugcuucuaugucauaaaaguucauggucuugccgggcagugggggugcacaccuuuaaucccagcacuuggaaggcagaggcaggcggauuucugaguucaaggccaaccuggucuacagagugaguucugggacagucagggcuacacagagaaacccugucccgaaaaaacaaaacaaaaaaaaguucauggucuuaagagaaacagauuaaauuuucuucucuguuccuugcuguagcaaauaccaccaugcccaggagguauuauucucucuguuuuuaccucugucuuaaguugugacuuuaaguuuccccagcuaauaguggugugaccauuggucaggcaagagcguggcuggaauuccuuuuuuggacuugucugcucaagagcaggaagugggggugcucagcagucaguaagcagcccauuacuuuuguaaaacuuggggcagaaaugggggagccugcuugucaggugcacagugcuaccucaccucuccuacuguucaccuuugauguuacaguacaggagccaagaacacaugugcauggcuguguuccauugccugagccugcaggccuagauuggucagauaaggaguuugauuccaugucccuuugaguguuggagcugucaggcuguuugccaugugugucaacacacaaaguggaagaagcccuuggaauugguuguuacauucugaggcacccacucccaggacuccucuggguaagugccacauaauaggguuugcuguggcaaaacugacuuuggaaugggcaaggaaaugacuguguacugaguggcaggcacuuaagaucuggcauguuuugucagccugcucugugggucaguguuauaccugucugcagaacugagacuugaaggcauaaugacuguuucuguuacacagcuccaggcucugguaggggguuccaucuagaucugucugucuaucaagauuuccucuguucauggccaccuuacagugcucaugaagauuuuugucaggacaauuagucauuuggaagacuauuagccucagggaaaauuaagcucugaucauaucuuaguguuagugacuucaaauagaaacgucuaacaucugacuccuuuucauuuccauucugucaaugaguguuauuucucugcugcauuuaucacuucccaaaaguauuucuagccucccucauugccuccaucuuuacuacaaucagugcuuauuaaucaacuauaauuaguuaauagugauaaguucaaagacuauauuaaucaaacugcucucaucccuaaguaauuuacaguuaccgucuggggauguagcugagauaggagagugcuuucugagcaugcagaaagcccugggcuugugugcacguagugggugugcagcgcauguaaguggaggcagcaggaucucaaguucaaggucuuccucagcuacauaguaaauuugaggccagcugugugaaaaauauuacaguuccugaaaaugaggauaaacacauacaauaagguguaauuuuuuuccugugguauuugaugaaugcagaagaggagggcaugacccaaguguaaggauguggggaagguacauuuggaaagcuuuccuuagaccuuggagaacauuuugugguaaaggccccugggaaagaagccuuuuaagccucauucaagacacucaaggucauuguaguugauuugcacagaucucaggugggacagcaaguucugaaaagagucauuaagucaccuagugagcacuaguaagcaggagcauuaggaaggccagcaaguauauuacacagguagcauucagccaaguuggcggucuggggccaucugugguaaugauacuuagaagcagggauggcaguuuuguggugguuaguaaugacaguagcuggacugguugcagccgugguggcugcagggacauaggcucucuggacugcccagacagggguuucagguaugaugugcuuggaagucuagaguuaggguggguagggguggggcacugaagaugacucccauaguugccacuuagcaguaugagcaauuuguucucaugggccgcugccaaugcacaaagauagaggaggaaaagggaaggugcuaaggaguggaaagagaaagaauugaccaagagaccuaugagccugauugauuguaagucugauugugggugugucuaguacacagaaucguagcagacagccaguugcacgguuagcaugggagaugaguuuccagagacaggagguucagcaggacucuuaagucccaguggcucccaauggcuggaaacuguuggaggaggaggaggaggaggaggaggaggaggaggagauuacugauauuacugggaaaguacuaagucagaauguggguggguuccuccucugaguguccagaucaucugacagccacaagacuccagggcacaaggaauaaauaccaacgugccuaggaaaugacagggugcugugguaggagagacucaagauuccacagcuagauggccugagucacagaaggcaagcaugggucagcuggggagauaucagaagcagcaccaagucucaacuccagccugagagccgcuuccucucagagcuccauguaggggaaguagcauucuucuggaaagaacagggcuacaguuaaggaggaagugaaaagagcuggugguaucaggcguuaaguagccaugaaaggaugugcagagguggcugauguguagugcgggugggucauggagaggagcgccuuauaggaagggaguguagcaugaaagggccagaggggcuuuuaugauuguuugaccaugacauugccggggagauagaccagcaauaccuaauguuggaucuuaaugugugcucaagaguguaugauguggcgacuuagcauauugcuaacgacuguuuuuccaguccagagugacgagaugauccaucaauaaauauauaaggauaacuaguuguccauuggaaaaaguaaacgcuaccuguugccauauauaaauuccagauagaguaaauaucuaaagaccaaaaucuaagauaaaagcauuaaagggaauuugcaauucuaagccuuucuaagcaauagggaaaaaaauaaagaaaaaacuauuauauuugcuauaugaaaacuaaaaaauuguaaaauuagccaggcggugguggcgcacaccuuuaaucccagcacuugggaggcagaggcagguggauuuuugaguucgaagccagccuggucuacaaagugaguuccaggaaagccagggcuacacagagaaacccugucucgaaaaaccaaaaaaaaaaaaaaaaaaaaagaaaagaaaagaaaagaaaagaaaaaaaaagaaauuguaaaauuaaagaucaagaggacaugugacuuguaucuguagucccacauuuaggaggcugagacaggaaaauuacccaagucugaagccagucuaggauaacaugagauaccuuguuugaaaacaucagccccugaaaaacaacauaaaaagaaaaaguggacaagauaggccaaauauuugcaucuuaaaaagauaaggcuaauuccuugggauuccauccgugguagaaagagcacuagacucaaauaaagcaggcaaggcugaaaaucuaaacagcuucauaaagcaauaaaagaaaauuaacuaggacuggcgagauggcucagagguuuaaaagcacugaugcucuuccagagguccugaguucaauucccagaaaccacaugguggcucacaaccaucuguaacaggauccgaugccaucuucuggugugucugaagacagcaacaguguacucacauacaugaaguaaauaaauaaucuuaaaaaaaagaaagacagauagacagacagaaagaaaaggaaaagcaacuagccaggcauggugguacacugaaaaauuacuaaauagcauacaaagaauauggcuagugauugaacaaugcuuagaauuaguuguuaauguggaaaugcuuuuguuugaauggccauuguuuuuaaagauuuauuuaauguauaugaguacauuguugcuguucucaggcacaccagaagaguuuguuggcuaaaguucucuccugggaucaagaauuugggggagauguucuuuuucuggucgugaugacauugaaagggacaggucagauuuuuaaugcaugcagaaaaauggaaaaucugauuuuuaccacaaauacugggcugcgggaaagugcuccugagcauugguuucuucauagggugggugugcaccucuggaguguuagucccgucuggaaggugaaguuucuugggucagccugguggagaucaacaucaaggaaguuccuggcucagggcagucggcuucugagacagcuguuggauaggaggcuggagagauggcuccuugcucuugcagccgccccagguucaguucccagcaccuccauuguggcuauucacagucugugacuccacuuccagggaaccuaacacccuccucuaacguccauguguaccaagcaugcacaugacacacagacauacaugcaagcaaaaugcucacguaccuaaaaauaaauguaaaagcaaaaguuguauggaguggcccugcccacccucgucccacccgcauaaguuccauguugcagaaggccucucugcgaacacaggccauacuuccagaucauacgcaggaggcuuuucugauacuaagccuucugaccucucgcgaggcaguugugcugugucugucuuagcucagcacagggcuuaggaaucgcaugucucucccacuacacugugagcuccucaaggcagggaccagggcaggcuguuccuuuaacugccccagcacugagaucaguuggugacgcacacugagugcuccaugugucuuagugggaggccagagugugaugaguggacaggagggugagggagaacagugcucauagaacagacccugucaguuuagaaugccagagccuacagggcgggguaggcaguaaggaguggggagguguccucaaggggccaaaccaaauacugcuuuauaacacaacccuguucauuuucucugcauugccaggguuuuguauccagugccugacaggugggggugcuuugacuugggaaagagcgagcugggugaagagagauggcuuuguauuaaggugaagguuuguaguauccaggugaccuacauguagcaaauuuucccuugcagagauguggaagggccuaaaagcuuuugauuuauacccccaaguccuucagagagugucugaaaaggggcuuuguauaagccugggucuguucuuagcaaccuuucccuagccuuaggacuucagaaauacuagauuuggguguguaaaagacucuagguuuacuguuuaccauuuaugguugacuaucguguagcacagucacuaugcauucauagcauuaaaugugcauauuuuaauucuagcaucauucauuuuuucagcaaacacuuauugaaugacuaccguguaucaggcacugggaacacaaagacacagauuggucccugcuguugaggaacucacagccuaggugaggagauagacagcuuauauuaagauaaguguuaugaaaaauguauguguacuccauggucacacaggaagcucuuaggaaagggugggggaauggccaaaacaguuuuauacaagaaaaaaagcagaacuauuucucagcccaacaagugugggagaaaugccaaguuuguuuuaacugcaggaagcaauuugugacaagaaaaguauaaaguuauggauaagacaggucaauuccaggauucugggaagagcucacucugcuaugaugagaauuccugaauagagcaagaaagaggaugagccuucaggucaucccguggccccugggcuccaccugaaaaccguggagcacuacuauuggacuagaggaucuuuuuuuguuuuguuuuguuuuuggugcugggggucaaaucuugaacuucaugaucuugaugaugcugggcaaguggucugucucccaguuacauccccaggcccauuagagguuuuacauggggauugucaugaucagauguucaugccaagagaucccagaagguagcaaauugaaaugaggaauagguggagguggggagggagcaccugggugguuuuuuuaugugggagaguacaacaggcugaacugagggugagaaaaggcacaaugcuaagaguugaugauugauauaauuauaagacuuacuuggauuuuuguguuuaacuguugagccuuuagagcguaggacaauguuuaacauguaacauuguuuugagugagugggucuguaaucuacuugguggaaaguguucagggggauguuuuuuaggugaauauaugcuauuauuagagagagagagagagagagagagagagagagagagggagggagagagagagagagagagagaggcucagccaagagaguucccuucugcacugaagauucagggguucuugaggcugcugagccagaggugugcaguuguagagcucuacaagagggguuggccuagaaaaacagaguuagaagucaugagcuuauugugggaggagagauguuguccaaggaggauguaaaacaaggaguggccaagccagcugucagucaacuggcucuccagggagggaagggguagugggagggagggaggauuaaaaagaaaaagacaacacuauaacacgacuccagccugugcugaggcugaaggggguuuauuuuucuccaguaugcuuuuauauuauucuggguauauacaaagaacaaggucaguccuaaggcauaaaccgagugguuaaagagcaaacaaagcauaaacaaaggucacaugauuacuguauucagaaucucaucaagacccaucaagauacaaagaacacuuuccucagcuguacucuucuugagccuacuuccuagcccuagcccaaugucaaauuccugcuaaauuccuagaagccaucccaaaagcucuccacagaggaggaggaggaggaggagagaaggcuggcuucagagaaaauggugauguucaaggagguaggagaagaucaagagagcagagacaccccccccccaagucaauggaaauuuguuuucuuuuugagacaaggucucacugugaagccccuacuagcauggaacccacuauguagaucaagcuggccuugaauucagagguccaccuuucucugccucccaggugcugggauuaaagcccuuugcuaccagaggccacauagaggaagcuuuguuucaguucaagcuuugucaaggaugcuugaugauccagaaagaagagaguggucuccgggauagcaggaucuuccugacagcagggauuguuuuguuuuguucauuuugaucacugcuguauuccuagcacuuaguaggcccucgauaaauuuugagugaauguaugaugcauaaaugaaugaacuggaaaaggccccaugaacuuaguaacagaaccacagaauuuuggugacaucauuuuucaggaguaugucuagggaagcuagaucauaguagagacagaguagugagaagcauggauggagggugaggaagaggcuacagagaggagaugaagcagaugcagauauguuaauuaugaugggccggaaacguuagcggauuuaucuuccuuuuaucuaccugguaagauagauguuguggugauccuuguuuuacagaugagaagccacaauucagugaauagccugcccagggccuuacaguaaaaagagcuaccaucaguauuuaaauuucaaucagccugacuuuggaauucagucccagccgcccagaccguuuucucuccauguucucuaaggcaggaacgccagaguaagaguggguguuuaagaugaugugcacuugagaccgggaagauggcaaauacuuuagugcugggaggaaagaggcagugggaagaaaucacuugaagauaauuuauaugagaggagccugaggggagguccagaauacaggcaaagggaaauaaaugucuuccauagaggaaagggagaagaagguaaagucagguguagcguugcaggcguucugcgagacugggaaaggaaaggaacguggaauggagcucucaagcugcugaaguaagggagguggaaccaggcauagucuugaggaagguggcacaggcuugaaguagauguuaaagagaauagaagggggcaauagaggguauaggagacaacuuucuuggguuuuuguuguuguuugauguauguguggucugugcaugugcuuguagaggucagagauagaugucauuggcaguugcucaccuccucuucagacagagucucauugaauguagaacucgcugauugggcaggcuggcuggcuggccagcaggccuccaggauucuccugucuuuguucccgugccugugagcacaggucugcuggcuuuuccagcacaugcuagagaucagagcucaguuucucgugcuucuccagcaaggguuucaccacugagccaucgauccagucccugaagacuuauacaggaaccucaagaaccaagauagauuuuuagaguaacccaguccugcuguucuguuucucucccccaaggcucggggaguugcaaaaaccagggcugaggcacagcuggcagaugugaaguugaucaggauuaaggauuuuguuccuuugguaugacagacaggcuauugagaguauuguugccauuauaccuguguaucugccuagcaaggaaggaaacgggcaggagaggaaguacagacaggaaguggagaagcuguguaauagaguccagagaaacuuccuccaugggacuugugugaugagaaggccuuuuucgucagacuuccaugucgguggugaacuugaaggcauuguaagaguggggguugguggagaggaccaaggacgggguacagugcuuaugguuuuaauauucaaauaccuuuggacuauuuuacuuuuucagcuacuucaguuagaaaagaauacaaacuuuuuuaugaacccaaagaagagaacaauucauuuaagcuggugaaggcaggaugcugagcaagguaggagguagaggacuugacucaggacccuaagaacuuuguccaucugcagucaugagugaggucuuaggagcaggaauguggucccacccugacauuguuuguggaagcccaagaccugcuggguuuggccacugcagaaccagcugucccagcccuaagcaagcuugcuuaugcugcugcugggcaccugagacaucacagcuuccuguucuuccagcugaccucauggccuggugcccgggguuugcuggcuguguggacucuuuaccaugcccagccucccacaccucaguucuugaugccaggaguguuggugaguguagagacagcuguaccaacuccuaccuguuuccugcuuuccucagagccuggcacaguggcagcacagaggcggaaaacaagugugacacaaugcuuacauccuuccagaugacccagugucccuccuguuuugucaccucccccagaccuucccucugggcgcuuguuugauccaggcuuuggcacugacuuuuaucagcccaaagccaggcaguccugggagugcuaggauucauugccuugguacuggagaaggaaccuuaucugagagccuuuguucugggggaaaaggcuuuccugcucaaggucuucaaaagagucugugacacauuccccucacccagccuauagacagcaaauguuuguguguuuagagagauaaauaugacauuuaacaaaaaaauaggaguuuuccugcuuuccaagugcuggcucagacaagccuggaguuuucagccuggcuccauuuuuuuucaucaggacaguggccaugguaaauaaaugugggugacuugugacuucucauagugcagaccuaggaccaagaggaugaugauagggaggccuaggaccuccccucuccuguugacuguggacacaggagcauucugaagucacauuggggccaugugacauucugggauaagaaaggcuuaaggagacagguuuauucguucccacagagagagguacacucugucgucagacucuagcauggcggacuuguagauguguguuaaagaggcggcuccccugguuauacagcuuaggaggacucugaagaacagaguuguaaugcaggucuuuuccccaagagguuuaaguaggaauuaguggauuggggauuagugugagggaagagaucuuugauucuaguuggguaggagaacucaacuuuagcugacuggcauccugagagcugaggcguagacacguggcaaagccuagcaucucugguuuggcucucuucacaggcugugugugguacuuaguucccgucugcuuggagacggguaacauuugggauugauuguucugguucugaagacucuccuugccuucugccaagccaucuucucucugacauuguaguuugaaggguguuaaggguauuguagggagcugcauacaaacagcuccaggaaagagcagagacgguucauucagcucaaggcaguaaaaucagacuacuuagcaagcuggguauagugguaccugccugaaaucguagcacucaagagaccaaggcaggaggauugcuauacauuugagguuaaccugggcaauacuuugucucacaaaacaaaauagcaaaauagacaauaauaauaauaauaauaauaucagaccacucugaaauccacagagauuagaaaagagggagagaaaugcuuuggcauuuguaucugcaugaccuggggucuguagucagcaucgcagaguggauuggcucaugcaggauggcuuuugccuuugagagcagguuuacccuagagaaccugcuggggaaaagacaagugggauagacugauggccuagccaucucugccggcuuaguuuccucaucguggggaccuccuggcucaucugugccuuaccuugugggcuuuaacaaagugggaacuccuuuauggggaacuuggaccagcagugcuacauacaguguacuagucuacagugagguaacgaugcacauaucuacauccagauguggaccuuagguguggcagcuuccuaauuauaaucccgauccucaguuaggcagaggcaagaggauugcccuaaguuugggaccagccugguccacacagcaaguucugagccagcuagggcuacuaagcaagauucuguuucaaaacaaauugaucauagaaauauguuuuuugggggcaaaaaauguuagugaauucugugacauaguugauuugcauuguaacuuccucugugaugaccggguagcagcagagucugccacucagcagguacugcacagcagaguguccugaagcccucugagagcagcugcuauugagacuguaaacugugcuuggggcuguugagaagagacugauauggagaguggccagcucguucaaacauggucagagcaggcugcuggggaaagugggaacacaggcugagcaaaggcuaaccaugaccaggcagggccggugccaaggguaaauaaugcccuuccuuucagagggacuagagcuagggaccuucuuagagagcuguggguuugccuguugcuucuggagguggcggggaggcaggucaguccauugagcuuacuuugucuucacagauaaacagcaaacguuggggaagaacauucugguggucuccgucgucacagcugaauguaaugaauuuccuaauuuggagucgguagaaaauuguaaguaccauucuguucccugucuucaaagccagcucuugucugggacugucccuccagcuauccugggccaggcugcugcugaaugaccuuaggcacuggggcucaccaagugucaagacccacagaaaaugucacacagacauuaagucccauggaacauuugucuucuggacugaacgugggacugauuaagaaauaugaacacauaaccaggcaugguggcagacaccuuuaaucccagcauuugggaggcagaggcaaggggaucucugugaguucgaggccagccuggucuacaaagggaguuccaggacagccagggcuacacagagaaacccugucucaaaaaagaaaagaggaauguggcacuuuguuggguuuucucaaggacauuugacacuggagggagaaccuuuggggucauuuauacuacagugaaguuaagucauuaguccugagcaacagauuuguggcuuugaagucuccaaugugaauauuagaguauuggaaucuuccucagauucuuggguaaacuagcugaagccuggaggaaagggcggucacaagguggucacacauaggaagaaucccuggauucuuauggggaaaccuaaccagcagacuggauggugcuuugccuaaugugaaccacaugcaucaguggccaggccuacagagcuagguggugccugcccugcuguuuggauguuugcugauuuauugauucauuuguaugugugaaauauguauauuuguucaugugugcauaugaaagccagacuuuuguaucaggugucuuccucagucacucuccaccuaauguuuuuuaaaauagugucucuccugagcccagagcucauuauuucacuagacuagcuggcucauaagcuccugggaugcuugucuccacccugccucucucaucccccagcauaucaguuuugugcgccccugagucugacucagggauaugagaauccaaacucggguucccuguaauugccgacaucuuacccccuguguuguccucaguccucuuuguuugcuuucuuguuuauucagagauuggcacaaaaugcuugguucacacgcuaauucuugucauuucagacacccuaaccauuaaugaugaccaguguuuacucgccucugagacugucuggggcgcucuccgagguaacacgguggggaaggagacgacacuuaggaaauaaggagcuaaugggagcgucugcucaucaugcagcugugcgugacuugcugcagcagcagacguggcacugagaguggacccugccgcagacacgguccugcucacucaguccacaguugggaugucuuuaagaaggaaagcuaacccaggcaugcuaguccagcaggcugauaguucuagcuauucaggaagccaaagcagaaagauuacuugagcccaggaguucaugcuggguaauauaacuagaccaccagccaucucuuuaaaagagaaagaaaaauaaagcuggguguggcucaugccuguaauaugugcucuuaggaggccaagggugggacacauucucaguuuuuguuauugcacugccaguccuauguucuuugaagaaagaaauacacaacccccacucuauccucugcucucgugcacaaaaggugcaaggcuacagauuugagacccuacuccaagugggaagagguccagacaguacacagcagugugcuuuacagguccugccuaaccauugaggucugauggagucuuuuuuuuuuuuaauuuuuuuuuauuacguauuuuccucauuuacauuuccaaugcuaucccaaaagucccccauacccucccccccacuccccaacccacccauucccacuuuuuggcccuggcguuccccuguauuggggcauauaaaguuugcauguccaaugggccucucuuuccagugauggccgacuaggccaucuuuugauacauaugcagcuagagucaagagcuccgggguacugguuaguucauaauguuguugcaccuacaggguugcagaucucuuuagcuccuuggauacuuucucuagcuccuccauugggggcccugugauccauccaauagcugacugugaggauccacuuauguguuugcuaggccccggcauagccucacaagagacagcuauaucagggucugauggagucuuuuaucuuaaaaucuggacacucaggauauuuuguggaacuucuguuucccgaaguagggcccaagcugcugagaacaugcaacacucugaacucagucugccagugcucgggucuuaguagacuccaagucagagugggugauuaggcagauccugagggaucaaagacuauaaguaacugucccaugccaaaccaacacagcaccugauaugcuacucaauuuacaaacuaauaccucccauaccucagcccucagaagcugguccucccccucagaaacagaagcggcccagcugugaauccaguuccuugaacucaggguugugauucucuuuucaugguucacugggagacauuaugaacagcacauugggguaucccuuucuaagaagucagcacacugggguaccuuuuucacucccugggucuuuacucugccucuccuccucuccacaggucuggagacuuucagucagcuuguuuggaaaucagcugagggcacgguaagucugaccccagcaggagucuagggagaaauacggguggaaucuguuuggagauacuguaaugugguucccgugggucauuuagcaauuaucuuggugccauauugcuuugaagaaaauaaaccugcuggccuaaggagaauguaguuuguaaauugaguagcauaucaggugcuguguugguuuggcacgggacaguuauguguagucuuugauguggagagguugguggaagaguggaggauagcuauuuuggagaacauucauacauuguauuuuggggaucuugggagagccuuucuccuuucucugucccgaugguaaguuccuuugaauccuaaugcauucaguguuugcuccacacaguucuuuaucaacaagacaaagauuaaagacuuuccucgauucccucaccggggcguacugcuggauacaucucgccauuaccugccauugucuagcauccuggauacacugguaaccaggccuccgggccuucuucauuucaugcauaggucuggguaguggggcauaauagagcuuuucuauguaacucugugagccccugggaaaaguguagaugacugccuacucuaggauaagauggauuuggauacaguguugcuuauacuguuuugggggaauugauuucucugccaggcacagcugacugcaguuuaauuaagucaagauuauaggaaaguugcuguaaagccuuugcuggggaaguugcuagcacuccugaaucugaugugcaguuguucaucuaccaccuggggcugcuuuuccuuuaucccuuugguggaacuaaaggagcugacauagauguuagccuugacuucugugaguuaaguuaugggacagcugaguucccaacagacaucucagucagaagggaggauguggaaauguugcucugagauccauggggacauagaaagcgagagggugcuguagugcuacagucaaaauucaucugaaagauggcucugaaacaugcuuugagaaauauaagugcauuccuggaacuugaggaagguugaguuuugcuucuguauguagauagaguagucugcccaguaugggguucugaucugugcucugaccuccaggaugucauggcauacaauaaauucaacguguuccacuggcacuugguggacgacucuuccuucccauaugagagcuucacuuucccagagcucaccagaaagguaugauucacguuacccaaacauggucuucagguucucaagggcaguaguucucagccuaacuaaucagaaggaaagggcagcagcuuugaagucaagacccaaggauucaaguccucacauuaauuuguuuuauaaccuuccguggcuaauaucuccugguuuuguuuuuugauguuauuuacauacauucuguuaaaugggcauaauuccuucuuauuuaucucauuagccuuagauugcucagauaaagcaguagauguuguccugggaagaugaggcagucugcugaacaaccugaggacuggugagggugggggaugggaguggguaccuggagcccagugcugaguuucagguucagguucaggucuuaguguucuguugcugugaagagacaccacgaccaaggcaacuguuauaaaugaaagcauuuauuuguuugguuuuuuguuuguuuguuuuuguuuuuuguuuuucgagacaggguuucucuguagccuuggcuguccuggaacucacucuguagaccucgaacucagaaauccgccugccucugccucccgagugcugggauuaaaggcaugcgccaccaugcccggcuaaaugaaagcauuuaauuggggcuugcguacagaugaaagauuuaguccauugucaucaugcagguagacgugguggagaaguagcuugagcgguguucuucuagauaucuaggcagcauaucuauaggagagugagccacugggccuggcuugagcuuccaaaaccucaaagcccacccugcccccaguggcauacuuccuccaacaaggccacaccuacucuaacaaggucacaccuccuaauaguuccacucucugguaaucaagcauucaaaucuaugacuguaugggggccauucuuauucaaaccauuacaaauccuauuucagaaaauaaaagaaaguuguagaggaacacacacaauggugcugccgcaugcagacaugcacacucaccaaaagaaagcaguagaugugauaacuuuggggaaauuuuaucauaguuuuaucauaauagacucuugaagaagucaccaguacacaugggcuucggacgaguguucuaaaauucaggguguuugaauaucuucucuucccaguagccacaggaaaugagauccugaagcguaucuucugccuuucagggguccuucaacccugucacucacaucuacacagcacaggaugugaaggaggucauugaauacgcaaggcuucgggguauccgugugcuggcagaauuugacacuccuggccacacuuuguccugggggccagguaagaauggagcugcaguuggaggcgucugcuaaaagaggggcuccagggcguugguucuuagaugucuuauaucuuggccuuggcucuugaaaaaauguucuccaucaacuccugccuagagggaguuccuuccauagguaaagcaagaaaguggcucaagugagccagcuccugcuucggaaguuacuccuaagggugucuuggccccagagucuuccugccugggcugcuccuaggaaaaauuuaauuuaugcagagacuuucacuaguaaaauuaugggcagauggggcuggagagauacgacucaacaauuaagagaacugguugcucuuccagaaauccuagguucaauuccuagcaccaaccuggcagauaauaaauaucuguaauaguagcccuuugggaucugauaccuuuuggugugcagauacacauacacagauaaaacauccauauacauaaaacagauaagccuuaaaauuauguauguaugcauguguguguauguauguauguguuuguguauauaagggaagaggccaugcauauugauagacaucuguaaacccaacacuuaggaaaccacaagaggaucuaaaauuuaaugccagccugaggcauaagugauucaggcuucugccuucugccucccaccccccuccccugcucccccccucccaacaaaagcaaaaguguuucccagacauugcuguagguuuuuuauaccuuaaaguagauacugaggaguuugaccccuaggguagaauuuguaugaaagaagaugggggauuggggguggcacacaccuuuaucccagcaucaggcaaaucacugaguucaaggccagccuggucuagagugaguuccaugauacccagggcuacacagugaaauccucucugaaaaaaacaaaacaaacaaagcaaaauaaaaaacaaagaagaaguugaagcuagucuuuggagaucaccauugcaugaucauuuuugcugcucagucacuugcuucuguauccaggaaccccgagugaacccuagaugacaccuuugggaagacuggaauaggcugccuccuggcccagacacagcccucggggaauguggaaaugggcagcaggcgcuagaguggaggggcugucagugggugcugacacgcugucuccuuagcccugaggggcugggugguuuaugcuggaaaaugugugugggguaagaucguacacaucggcauucauugccaguagcccagccucagucucugaugguagauauaucuguauuuacuuaauugugacuaaacagguuguuacugaugcuugugaguacccagcacugcacguguggaugaacagucaucuacucuaucuagggccuacugugcaggaguauccaugggcagguguauguguaacacucguggguucucuguuaacuuaggugccccuggguuauuaacaccuugcuacucugggucucaucucucuggcacauuuggaccggugaaccccagucucaacagcaccuaugacuucaugagcacacucuuccuggagaucagcucagucuucccggacuuuuaucuccaccugggaggggaugaagucgacuucaccugcugguaggagccuuuggacuucacgcaccagccugcggguggguuacucagcacuaugggccugcugcugcuacuuacgggcucaccucuaagggagccaugucucagcccagagaggcccuauaugaggagcaagacuguugguuugaacuccuccuccuccucccucacauccugggauauuuauggauauccucauucugagccuagaacugucuuggaaaaauggaggauaaagaaaaacaguccccacuuaagaaggcuuaaaauaguccaaucaagagucuagugcaagcuagagagcacuuacugauguauaucagaggacugaggaauaagauuuggauucccacccagcacccauauugggcagcucaugaaugccugugacaagaccuaguuaauguuaagucauaaagcucaaacucucagaucuacagcggccaaaaggggccaaggggcuucugagcagugggccccagaguuaggugugaggaaaguuugucuuuugggaacaugaugagaaaggcauggacgcaaacacaggcacuguagguuaaggaaucugcagcaggucagagaucauaggcuugcgagacuagugugauccagagagcaaauggaaggcgcguucucccugagagcgcgggucugagacuccucaagaucaggccucuuucuuucuuagccugugucuguucuccagucuuaccuggcuacaaguuggcuggagaccuugggcugucucgggugguuugauauuuuagguggaaggggcagguugcagggggcuggaugccuaaccugaagguugucauggcuacaggaugcuggaagagcuaaucaccacucuuuucuggcuucccaggaaguccaaccccaacauccaggccuucaugaagaaaaagggcuuuacugacuucaagcagcuggaguccuucuacauccagacgugaggaaggaaggagggcgggcgggcguguuagggaucaccuucuauggggaauggugucugcucucaguaccaaagucagucccgaggaccauucccugcucccuaagggucccuuuguccuaucuguucagguuuagaguggucaggugguagaucuacccagagaugcucauguccagucagggcuaggcccugccaggcucagcgccuggagggcuggcacacacagccgagugacaccuugcugaugcuccucuccucuccaggcugcuggacaucgucucugauuaugacaagggcuaugugguguggcaggagguauuugauaauaaagugaaggugagcaggggcagagaagagaaagcacccaucucaaucucccgggccucccugaccgcucuagggaccaaucauguugccaaauaggcucuacgguccgagagcugggcggcaucucuuuagcucucuagaagagcuacaaaaguguggccgcuggaguuuaggucagaaccucguaucuaauuguggauuccugaggcuuugugugcugugcuuuccuucugaaucauagacuuagauccucuguuucuuuggaccccacugccauuccccucagcucucaaccaguaauuacuucuucuauauagacagggaagcuacggugggucugggaggggagcagcagggggcucuguuaaguagugagcaccucagcucagaagcauccuuugcugcugggaagcugggagcucuccguggccuggguaccaugcguaagaaugaaccucgagucuucugaacucuguaccaugacugcccuuugaccuuucgugacagguucggccagauacaaucauacagguguggcgggaagaaaugccaguagaguacauguuggagaugcaagauaucaccagggcuggcuuccgggcccugcugucugcucccugguaccugaaccguguaaaguauggcccugacuggaaggacauguacaaaguggagccccuggcguuucauggugagagcagggugcuuuguuggcugggcugagauccaggcuaggcguuaagaggggcaaggaacacauugcaauuuaggaaaugagauggccuuucugaggagaaggccgcacuggaaggauaguuggaggagagccucaccaccauggucuguuguuuuauuuuccuucagguacgccugaacagaaggcucuggucauuggaggggaggccuguauguggggagaguauguggacagcaccaaccugguccccagacucugguaaggauuuuggggugaggccaggaagguaggguagggggugcagaggcuaggcuugcgguaaggcuugugccucacagucucugucccuuccagcuccccagugcuacacccgugagggaggcucugagacgaugcuucucuuugccugggaugcucacgucccauguggcuucugugugugcguccaauaaagcauuaugugugcaggagaauggccauugucuccacuucacaaguuccguaaagaacccagggguacuugcuugggaugagaguaaaggcauuuucucggcaaccuccccaaauacagugggguauaccacguuaacuuucagcugacaugcccuaaggauuacccuuauucuuaugucucugggagaggaggagcuuggaaucacugucuguaugcugaugcggaugguuuuaaugagggugcaacugagcccuggaacugccuuagagcgcccaucugguugucaacuuugaacaaggcaucauuuacggcugagcuaguuugggaaggaagacacacagggcgcaaucuucugucuccucccuccuguaggcccagagcgggugccgucgcugagagacuguggagcaguaaccugacaacuaauauagacuuugccuuuaaacguuugucgcauuuccguugugagcuggugagguaagcgggcucugggcagaucuaagaagaaaggaguaagagccaaaacuuuagaaguuuuugugcuagguacugucuaagaauacuccauccuguagaauuuguaucacagcccauaggugggaacauuuugucuccauuuuaggaguauacagccccugaguacuuuauuaaaaaucggcaggaagcaggauuugaaccuguaagcuuugacugacucaugaauaccuguacucccuugacuguggcuuguguaagcagucauuugauagaaacauagccuagugcagagcagacauggcugagagcccucugucgugagcucuaagacacuggguaauugaaguggcauuuuguuuaucuccaagcauguuggguugguuuguguuguuguuguuguuguuguuguuguuguuguuguuguuguugugauaauggaggugugcuuagcgguucccuaaaggucaguucuuagggcuucugagccuuagcucgaggacaggguuuaauccccagcucaguccuuuccacugcugugcuuauugaauauuagaagcaggaguggacaucugagugggccaagagcaucagacaucccucaggcucuguccucuuuuccaaaguaacugaauucuggugggggaguagagaccugcacgauagaaagagugcccucauugagaaucuuggagggaggucuccaaguaacuuggguacaguaauauuuugagauucacugaaaugggaaggaggcucuugguuauuguggagaugguguugccaugguccaaggccaaauaauucaucuuccauuucuuuauguucucuuccaggagaggaauccaggcccagcccaucaguguaggcuacugugagcaggaguuugagcagacuugagccaccagugcugaacacccaggagguugcuguccuuugagucagcugcgcugagcacccaggagggugcuggccuuaagagagcaggucccggggcagggcuaaucuuucacugccucccggccaggggagagcaccccuugcccgugugccccugugacuacagagaaggaggcuggugcuggcacugguguucaauaaagaucuauguggcauuuucucuaaugag

SEQ ID NO: 5147 - RNA, 13087 nt, Mus musculus
agcacacuguagcugucuucagacacuccagaagagggcaucagaucuuguuauagauggucaugagccaccauaugguugcugggauuugaauucaggaccuuuggaagagcagucagugcucuuaaccgaugauccaucucucuagcccagccaucucuccagccccagaauguaucuuaaagggaguauaaagauaggcuacaaacuggaagaaggugccuguaagaugcagaaaaacguaagauuaaucauaaaauguauuugaaaggugcugaagagauggcuugcuuggugguuaagagcacugacugcuuuccagagaacucagguucaauucucagcacuuacacaguuuuaggagacccaauacccucuucuggcuucugcggauuugcacauagugcacaguuauacaugauauuuuauguauauauuuauuaauaaauuauucaaaauguagcuuaaaauuuuuuagccaagugugguggcauacauuuguaucuugggagcaugaucacaaauacauggccuuuuugggcuauauauauagcaaguucaaggauagugugggcaacuuaacaagaccuuaucucagauuuuaagugaagggccaguauacagcuaagugguagagcauauaucaaguccugaguucaaucucaagugauauaaaaaagaguauuaguuacugcaaggcuuauuggaaaaguaagaaauaauauauacauggugagaauauaaaugaagagagaugccccucuucgugugacagcuguguaaccucuagagggaaguaaaauagaacuaaagggacuugcuauuuaguauccauguuuaucaacaaaaaguaagaaucugguaauacccaauuaugcuaaaggcuguaaaauuccaaagauuuccuuuauugucugcacagccauuuuaggaaaaaaguuucuuauucauguauuguguugauuguguauaugugugcacuuguauauguguguguucacacauguuugcgcuuuuggaggucagaaggacaacuugcuagagucaguauucuccuucuacuaagaguucuagagguccaacuuaggucaugaagcuugguaguaaguaagucuuuuuacccacugagccauccuguuggaccagaaaaacaauuugacaacuuuauaaagcaaaauaguuuaucgcuuugacccagcauuuuuguuccuguguaugcaaacucaaagccauacaggaaugcuuacaagacuguuuauagcaacagagcuugggaauagcucagaucaucaucaucggaauaagagaaaaauuauuugauauaaucacauaauuauugaacaaugaaaaugagggacauccauagcauguaauagcauagacauucuuaguaauaucgauuaaaaauaggcaagucaggcugacgaguacucaguagguaaaagugcuaucuagcuguacaagucuaauggcccaaguuuaguaccuagaacccacauaacaaaguuagauucauugcuaaguaucuguuuucccagcacuauuguggagagauaggugacagaagcaggagacucuccugagaguuuuagugcuaaccacaggagaaauggcagcagaaauccugcuucaacaagguggaguuguuaacaaucgacuucugaaauuguacucugaccuccacacaugcaguauggcaugugugcacuuggauucacaugcacaauaaguaagugaauacuaacaaaaugggugaguuccagaaggcuguguguaaugcguuuuuuauauugcucaaaggcaaacuaaaucaaacuuaacagggguaugugugauaaaauuagcauugggugugcuuucuuuccaggugugcaucaguaugaacagagagcaugcauuugaccaaugguacugcugauaacuuggccauuaguaucagaagaaauuagggggagugaguagguuuggaaauucccuuuguuuaguucuguuuagagauuauucuggacacaaaguauccagagauuauuaguuccaggacaagaauagaauaaucuuugggucaguaugaauuggacagugccacagguuugagacagaacgagauuucaguuacuucaagugccaucucuaaaacucaaagaaaucaaauuauucuuuuuucuucugccugcuuuuucuggaguagaaccugaaugggaauuucucuuagaaauuagccaaugaaauaaucugggcugagaucuugauguuuggaugcagaguugagcuuuguuaaggaugguggaacagguggaaggagaggguuucuguucuguaggaggaaggaauuggcaguucagcugaguuuuguucaggccauggauuucucaugagauugacagaaaauaaguguguguugacuugaaagucuguuugcucagugaagaugauguccaagccucaugaucugaguuugaucccugccaccucucucucuuuuuuuuuuuuuuuuuuuuuuuuuugguuuuucgagacaggguuucucuguguagcccuggcuguccuggaacucacucuguagaccaggcuccccucaaacucagaaauccaccugccucugccucccaagugcugggauuaaaggugugugccaccacuacccaggcaucccugccauuucuuuuuuuuuuuuuaaugggaaucacuuuucuuuuuucuuuuuuucuuuuuuuuuuucuuuauuuucuacaaagccuuuuguucuuuuuuuuuuuuuaagauuuauuuauuauuauaucuaaguacacuguagcugucuucagauguaccagaagaggacgucagauuucauuauggaugguugugagccaccaugugauugcugggauuugagcucaggaccuuuggaagaggaguuggugcucuuaaccgcugagccaucucuccagccccaucccugccauuucuuaaaagcaauccucugaacuugguaugaucagcaccaaucccagcacuugaagaggcaggugaucucuaugaguuagagaccagcuuggucuacauagugaauucuagguuagccaagacuggaaaaccaaaacccaaacaaaauaaaaacaaaacaacaaaacccaaaaaguugucuuuugaccuccaugugugucugcacucacauuauagacaccuaauaauaaauaaaauuaaguuuaaacauuugaaauaaaaagccaguggcaaaaccaaaaauuaaaucagagugaaauugugaugaaguagaauggugaggcuggaacccuguucaugguuuguaauauuaacaucaucgacuucauguuuaucccguuuccuugguuacauaacccccuaacugauaaggcuguacuuaugauaagucuggaaacagacugaaacucuguccuuaggccaaaagagaguugggaguaggggcauacagguacuguuugauaccuaaguaagaaugcuugauuucagucacuauaaacaaggucucuuauguaauugcuaagaaugguaaagaaaauauuuuauuauuauaaaaaagccaggcaugguggcacaugccuuuaaucccagcacuugggaggcagagacagguggaucucugugaguuugaggccagccuggucuacaaaguauguucuuggauagccaggguuguuacucagagaaacuuugucucaacaaagaaaaaugguagagaauuuaugcacugcaauaauguagaaaugaaagagaguugguacuuuuuuuaaagguaggauucuucaaggugguugucauuguaacuaucuguggaaaauccauacagaaggacuuagccuuuuccuuuuauccugacuggccugucuuuuguguaacuuuaaaacuacaguauauugaacuucuacuugcuuucucuuaacucauauaucugacuugucauuugauucugagguauccuacucggcuaggucccucuuucuugaguuaucugaguuauguuauuugguguacuagaacccuuuagugguucgcuggaguuuuuagaagauaaaccuuaguugcuuuuauagccuaaaaacccugcuugaucugaaccuaguuaacaucuguuugaccaagccagcucagucagucaacagguucuccagggcagguggaaggauuaaaagagagagagacaauuagacacauuguagcaugacuccagccaguuuugaggcugagguggguuuauuuuucccaaucuuuuauaucauuuuaauuacaugcaaguaauagggucaguucuagguuaagaaacaagcaagacaaugaacacacauagucaaggaacaaacaaggcgauaaacaaagugaucacuguuucuaagggcuugucaggaugaccaagauaucugagccuacuuuccugcccuugcccaaagucauauucuuucuugaagccuauuuuuuuguucggauuucugccugagcuuacuucccuguccuggaccaaugucaaauuaggcccccaaaagcucaucacauuaguuacaucauauuuucccauuuuccuauucauuauaguaugugcaaauuaaguccugugguucucucugucuuuaugcuuuccauauucuauuauacuaauucuuccuuaccacaucagggcguuuucaaacucugaguuaggcuaguuccccuucacaggguucacacaaugcucuauaagguaucacaacccucaccauacuguguuguaauuacuuauuccuugccugcaaucuccaccagacuaaauuccauguggaaaaauaguuuguuuuauucaccacugugucaccaagcaucuuaggcugguauuuggcauauaguaaguacgucaguaaauauuuaagaaaugggcgaauuaacugaguuuguuguuuucugacaggaaugggcaaaggacagcacaggaugccuuccaaggaugagcugguccagagauacaacaggaugaacaccaucccccagguauugcucguuggcucugcuugaauaggaaucuuccccuggauccugcuaaaaauaauggacgggagaaucguagagcuggggucauugugggucauuuacaggcauuacauaugcuguaagaucuugcucuagucauaugugaucuauguuguaugcaugaaagcaaagguagguuuuuaaaugaaaagaugaacuuggaagcuguggacucauuaggugacuguauguaagccaacaaaggguuggaguggggcugggagcucaggagacagaguuccuaucccugucauccccaucaucaauaaccagccagccauuuugagacuaacucuaacacuuuaccuugcucugcuuuccuuugcuucuuucuguuuuagacccgauccauucagucaagguuccugcagagucggaaucuaaacuguauagcacuuugugaagguaugcaacucacccaguucaugucuuuuuggaacccuaggccuuauuucugaugccccuuuggcacaugagucugccaaaaauuauguugaaacaucauguccuucuucccuaccuagacugucuuaacuuuacaucugugacuucuggcuccuuuucucccagugauuacgucuaaggaccuccagaagcaugggaacauuugggugugcccugugucugaccaugucugcacaagguucuucuuugugugaguccaaaagcagcccuugagauucccugaagagugagggugguggacggugugggacugcugaggauguccucucuuguugucugaguccgcccgugcugucuaauuuaggcacugggacuucuccuuggggacaaggauagcuuauuuggggcuguguagaggaauacugcuaagcugaucccuucauccugaagaacaaugacaagaucuuugacuuuaggaugaauggucauguuuugaagcauauuuccucugguaggcauuauuuuguauuauguuuccucuuaugcuuacacuugcccugucuuuggcagauaugaggaugggcaggugggcgaugccaacauuaauacucaggaccccaagauucagaaggaaaucaugcgugugaucggaacucagguuuacacaaacugagggggccccagcccucguaccacccuguuaccccaggauccaucugcccuuguaaaaggacucaggagcagcaagugaggcuguccugagaaacucaaggggcaaaaaaaguauagaagagguggccuucaugguggagauugauccaggaacuacuccacauuuggauggcccugacugacucccaccccugauuugcccaauugacuucacccuguuuguaaauaaaacaauaaaauggaaggugcuguggacuggauaugaucacuguggucugacuagccucgacccaacaccuagccaagguccuagguaaggguuuuuauucugagaguggaacuauuuguguuucaugaaguaaaagaugcauuguuuggagccaggcgugguggcacaugccuuuauucccagcaccugggaggcagaggcaggcagauuucugaguucgaggccagccuggucuacagagugaguuccaggacagccagggcuaaacagagaaacccugucucgaaaaacuaaaaaaaaaaaaagaugcauuguuuguuuaguuauucuuuuguauucuacagauauguuaguauuuuuuuaaagaaucauuuauuuuauguuuaugaguacacuguagcugucuucagacacaccagaagaaugcaucagaucccauuacagauaguugugagccaccaugggaugcccgggaagugaacucaggaccucuggaagagcaaccagugcucuuuaacugcugagccaucucuccagccccgauguuaguauuuuuaaugaaaagauuaagaggugaaguuaaucaguuauguagaugaaacagacagguuaagaauacaacugaugaugguuacucaagauuuaaaugggccuuugaagccagaauuuuuuuuuuuuuuaaccuuacucagggccagcugcuuucuacacaaaaccagcccugucagccaugcuugcucuguaucucagaugcuaggcccuuacuuuucccccugucuggccuuuaguugggauaagugaggugaagggauaaauugacaggugcgagaaagcugaguucucuagcgggaaguccuuuaagaaaggcucauagccuguggguauaguuccuuuguaaaaugcuugcuuaguguacuugaggccccaagggggccaggggccaucaggauuuggagugagaauucaccaggaagaaguuggaauucccugaacagguagguuauucugucuugacacuggauaaccauggaagguuugguuugucuuauuaaggaagcuucuggccuuucuuacuuguuccauguacccaaaaaacuuaauuuuuaagauaaggucuugcuauguagucucgucuggccuacaacucacuauguauaaaccaagcuggcuuggaacucacaaagaaccaccugccuuggucucucaagcccuggaauuaaaggcgucgcuaccaugccuaguucccuuauuuaauucuaagcacagcugagguauguugaacauuuccaaauauuaaugaaaaccagauauaaauacagaaaauaccacaaaguuccuuuaaaauccuagccugccuaccuuuucuuucuuuucuuuucucuuuucuucccuuuucuuuucucucccucccuccuucucucccuucuuucucucccucccucucccucucccucccccccuccuuuucucucucucuuucuuucuuuuuuuuaggauaguuuuucaagacaggguuccucuguacagcaacccuggcuguccaggaauucacuuuauagaccaggcugucuuugaacucacagaggucugccugccucugccucucuagugcugugauuaaaggugggcacaacaccaugccuggcaaaagcccagcuuuccagugauaacaauuucaaauucuacuauagcuauugcuuucaauaaacuaguuauugucuucugugaccuuuauuguaugucacaacaccuucuuaccuagguaucuuacuuguguugugguuccugacauuuugaacaagucaauacuacucuuaaagacccuuccugaagaaccuacuucauuaucuuccuaaguccuuaugacuaguacauuauaaaugacuaugguaggguucaucuacagucucagcuuaucuucugggggcuaaggcaggagaaccaguuaagcccaggauuucaaaaccaaugugaacaacugaccaagaaucccaucucaaaaaggaaauagcgaguauauucuaacacucuucuaagacucaggccuaacagaaauaauaguucaccaaaugacuaucaguggacucaugcaacugaaaauccuccugagaagacuuuguaacccaugauaccguaucagagauuacuagcauacuuuaguucuuauaaauuaguuuccagguagugugcagaguaccuuaauauuuugauaacaucuuauacuacuguguuaguauauguuguugcaagcaugcuacauauauauuaacuccuaauucucauaaaagccucagaaauaggcccauuuuacagaugagaaaauagucuuagaggauaaggaauuugcuauguuccacagcuaaucauaguaaccugauuccagaauuccuuuucugguucugugauuauagccucauuuacugcugauagcaaagauagaagauacauuuucuucagagaccguaaauguaucuggagcaaugguucucaaccuccuuaaugcggcaaccucuuaauacaguuccucauauugugguggcccccaaccaugaaguuauucuuguugcuacuucauaacuaaguuugcuacuguuauaaaucagcuggugcucuaacuccaccuuagguguggcuccucacauguuauauagcauuuuuggcaguuuuagaaauuaagaaaaauuuccuacuuauaaacauuuuuauaucaaugaaaucauacauauuuuauaguucuccacuggaaaacuaaucucagaaguucauaaugccugauaauucaaaacaugagauuaaaaaauucuagccaaaaucaagaaugccuucugaaagcaggggcuguggcuaggcugcagcaccucugcuuaauacauaaaaggucuggguucauuccucagcaguauaaggaagaaaaagccuuaucugacagaagaaugccucuacugcagagaaaauugcuugguagggucugguguuuuuaccugcucacaaccauggaggaagacuugggggccuggcuacuuagaaggugaaagggcugggguccuuaaagacaagugugagcuacaggacagcauucuucacagaggccagugacagcccaccuuucauuuaucugaguguaagcaaucuugccucacgggucaggaaaaggaacuguuuuccucaaugcuaaguagagaguauauuggacucaaaauuuaaaaacuccuugaacuucaccuuccuuccuauccucgguaguuuuccauacaggcuggguguggccaugacucaguuugugguaaggauguggccaucagugggggaggagcuuccuucugccuuuaauucuaucugggaaggagcagcagugucugcugcugagucauuacuggcucucacggaucacagaauuauucuggauagaccuagugauaucuuggcuucuuauagguggugaggaggaaguucuguggaugacacaauuccacuggagcccuccagccccagggaugagaaaaagguaggcuucaguucauuuagaugaacuacuagcuucuggagcaaaggacuuuccacaaauugaguuucagaacaccucacacugucaccaccauugggccagagaugcugcccucuuaaaacuuucugcagaaauaacuuugcacagaagaggacccgaagucuuuuuaguucuaguuguccuuggaaugagugaaccaggcagccagccuguaagggcagacauagugugaagaacacaucuaaggaaaagguggcaccucuuaggaagagugcacuugacccacuguuuuccugucuucgcuuuuuuuuccccccucagaauauucuuuauuguuugguuuuuuugagacaaggauucugucuaucucuggcuguccuaaaacucauucugcagaccaggcuggccucaaacucagagauuuaccugccucugccuccauccaaaugcugagauuagaguagugugucacaccgcccagcugcagaauaugaaaguugucuaauauacaauuuuucauugaucauuuuuaaagucccuuauuggaaagauaauuauuuugucugaugaugaacaguagccacagugaucauucuguacuuccacauggauaaaacucauuucuugaaacauagguguuucugagguaauaguuuuaauauuucuguggugucugauugccccugacuuagcagcaaaccuggggauauauguccuuuagaauaauaugaagucauaggagagagggaagcauugaguugggcacuguuggacucauucacauauaauuaacugaucaaacuccacccugugaaauagggauuguccucaaguuacuuuuaacggacuguacauguuaaauuauagguauagucuauagggcuagugauuaaacuagaacaaagauaagauacaaccuaacuauguacuccucuauaccaugccgauuucucagcagaagcaagauaguaggaaguuacugugacacauucugucaucuaaugagaacacuucccauagaccccauuuguguaacugucagaucauugaagccugcagaugaagagcaauucuuggcuagcaccaauucuccaguuuaauggauauucaugucagucuggguccauauccagauuggccuggaguucugccucagucccuaagugucaaggucacagacuuaagaucaccaagcuuuguaucuagauuuguggugaugguagaguucauuaaugcaugugugcgugcauuccucuguguguguguaaaagaggagaggagagagagggagggagaaaaagaaugaauaugaaucuauaaccgaaacccugaccugcgugggccuagaucuguguggcucagacugacuuuggccucuugagcguuggaauuacaggugugagcuacucugcuugacgcacaguaugcacaguggaccucaacaugaguagauagauaacugucacccuguugaacacuaugguucuuuuguguguguguguccaaggcacaaagaggucauuucuucuacccccuucucuugcagaaaggaaugauuuccuccacagauauaaccucccccuccccaacuucauguucuuuccaccauaauaaccaagcauuuacuucccuaaacuaaggggaccaaggggacuuauagaagaaacuaaaaaacuuuauuucacuacaaauugcauuuauguuacccuucccucuaaucaaaacugaccgaaaaugggaugaaggccugugauucaacuacaaagaagugucugcuugaaauggucacacccaucuuuuaccaagaaaaacaaaagaacaaaacaaaaccaaaaaaaauccaaaaccuaagguacagucuucccauuuagaauguggcaacauuguaucugcuuucaaaacucugcggaaugaagacuaguguuaacaguugggaaauuagaaaauacuuuguagggaaaaaauuguuaaugccuccaauacuacaaauuuaaauacauacacgccugagucaaaaaccaguguugacuccugcauagauaauggcuacacguagguccaguucugcacuaauuaccuuggauugguuugcugcguccagguccaggcauuuuaaaagugcaggauucgagacucaaaguauuaacauggguccaaucuagcccuccuuauuaggaggucgcgcucacguuccaaagagagacuuaaguucuuccuacccagccucuaagucuggaacccucuaggaggcagcccagaccuuccaccacucucuugcucccaucaccccagcuucccguuccgcucagccucagaggguguacuggggcgggcgccgggaggguggagagucuccgggcggggcuggaggaauguccguggaccuauaaaucugggcaccgcccugguaggccagggcagauggggagaccugggcaaaaggccaaaaagggaacauuuuguagccgaucuaaagcaacagguggcgguggcgcccgggaaccuagggguggugguggcggcggcggcgcuggcccggugggcgggccuugcucccucaccacuuccccauuggucaacaggauaacccuugagcaaauuuggucuacgauguccuuccgccacggaagguaguccuccucaaaagggcaaccugcuugucccgccuacccugagcuucucucaggaggugcgggcgccccguugagaggcggggcgccgccggccgcagcccggauugggcgaggggcggggcugcggagggauugcggcggcccgcagcugugauaaccuugaggcccagucggcgcagccccgcacagcagcgacucgucuucacuugacugacguccgcucuagguaucgcagcaggaaccgaaguacgcccgaggugagcggggagaaccuaagccaucuguccccagagccgaugcccacugguguguaacgcaggccugccugcccacgcgggacucaggcgccaggcaucgagcaucccacuccggguuggggaggagccacacuugaguccaagucuuaauccuccaaauugaggguggccggcuagcuccuuucccacggucucauucugcucucucuuccaucucaaucugguuccagccucuuaucuuacuauugcuauccucgccacccuguucucgcccugcuccgaugcucguccuccuacauccacuacgacuuacgaccuuccucuuagcucugugcccucauaauucggugcccuccucuuaaucucu

SEQ ID NO: 5148 - RNA, 1439 nt, Mus musculus
guuguguuuuguuuuguuuuuuuccggggguugguagugguggucgagcccugcccuuugagcaauugagaaugacaacagccaggaggccuggccuugggugcuauggauccaccagauaaccuucaagcacgggaccacuggagacgccggagacugaauacuuugggaguauauaaguugccuccugcaccaaagugcggcuguguaucgggaagcugauccguucuauuucagggcaaauacuagaaaagucugggacagguucagcuagcaccuagaauggucgaauagugggcugaucccugugguagaggccuguugagggcgcuguaggaugagucccugauuggauacuucacaaaacccucagccuccauaacaguuaagcacaaagggucucuuguuuuccuguugcccucaggaauaagguacauagaaacaaggugggacccuugucccuggcaacucccaacagccaccuagucagaggcuaaggccucugaaauugagauguugcagcaccaagagcucagguuagguaaggagguuggaaggcggaguagaaugaagagcccugagggaacauuuugauaugaagucccauaauugaggacccaggcccugguuuccucgaccucacaauuuugaagaccuaccugcagcugggacccaucagggcggucugggagcggggaaggcuccaccaauugagccaggcucauucugcgcgagcggccaauaggcgugugggggcgggccuuucccggggugggcgguccccggagggcacugggucuggcgcacggccucgggcucccggagaaggcgcugcgaugaccgcccugagccguagcgagccugucgaggcgggcagguaagggaggcgucccggggcuccagguccaggaggcugcgacgaagggcagggcgacucugggaaugccgcgccuaggcgccuucugccucccggcugggcacuuccaaccgcagaaauuuaggcuuggacccugcgccuccgcccggcugugaggugugcgagucuggugcgauguauccgaugugucuugguggcuucaggcgagcggaaggcacgcucccuucuggaaaucaccucgugucggccacccucgcgguccauucauuuguguuucauucauuucucgccauaacgaccccccagucccgguugucuccacacacagccuggcgcuucccugugggccucugcaaaaucagcuccucuccucuccucuccacucccagcgggaucuacucuuaggagcacacucggcugcuucugaggcaacguggagcugucccagcacgacucggccgcaccccgugcgccaggcccgggcgggcuggggcuggucuccaagcccagagagcugguucaaagucggcuugggaggaaaggaaaguucuugcagguagug

SEQ ID NO: 5149 - RNA, 16454 nt, Mus musculus
uagauucucgauuacuacauaaaaacgucguaagguuggaaaggcaaacucugggauuacgaccuuaagucucacuuuccggccaguacagagcucccugaaggcugguuggguuggugaggccugaggaauagguaagacgccuccucccuacuuagguuugucucaguuuuuggaagcaguggaucgcuuugcgcuccacgcagacucuaguguguccgagccccuuccucauucugcagcuggauucucagcgccgccccuuuuccacacacgcacgccccuccccccacuuguucccgcccccguggccaaguauuucuuuccauucauuccacagacuuuucacugaguuguuucuaugcuguaaaauccagaauauuagaagaaaaugaaaaaauauccgcucuuuugaagugcugugauguaggaaacaaagaauccgcaaugguaacacaguaaaauaacacgggaugagcugaacacaaacgggggaguggggggggggggguccuugauugcagaagaggacuuuucccaaaugacuuucaggccuguggagaacucguguuaaaaccuugguggaccgaaacuggccagaaagaaaaugggaguagagaaaggcuaguacaaaggcaugugacaaacaaccuaagaguaaaaagcaagaggauuggcauauaccuaguaaaaaccgcgcagguagacuuccauuugaaacaacuagacuauguggcgagugaauuuaaggccaaucuugaucacaaggcgggggaaacuuaacuauaacaagugcaagaaauaaucagaugcaggugcaaaggcuguuuuugaagauggcugauugccugggauggcuggccuguuagcuccugaaagaauaaggcagcuagaucuccaagugggaagccagucugagccaauuuuaaaaaaaaaaaaaaaaaaaaaaaaaaaagcagauaugguaguacacgccgaguuucaggcuagcaggggauacauagugaaaccuugccucaaagaauaaagugaaguuuagcucagugaguagaacaagcacuagauucugggcucugggucaguccugacuuggggaggucggggcgugaugggugagugaagggugagccauggaaccugaaagugaaugacuaagggugaggagggguagagaagagaaaaacagcaggagaacacgagcuuguccguccauuagaaucaccuaggaugcuuuuuuuuuuuucuuuuuuuaaguaaaacuaauaccccuccaacaaacuauagcucacuagaugacuaauguuaaggguagaguccagcaagcuacacaggagcgaugaguggugugaauagacaagaagcugagggaguugauuuccaaaccuuaaaagcaggaauccuuugacgagaaagaauugaagauaagaugagaagcuuuagcagaagacugaaagaauuaaaugacugcucugggaacugagagaagggaagccacuccugccuuuccagucaggacgguuccgugugcgugggaggcggggagggcauguaggcgggaaguuugcagcuagugcuaggccgugcuccucaacugagcccuauccccagcuucucucaguuuuugcucuugcuuuggguuuuugcaauagggacucacugaauugcuugguagccaaggcggccguaagcuuucggauccucuuugcaucggcuaccacuucugcuucccaucuccaauccuaaucagaucaccucaguuauggacccuuccucuuccugguaacccgguuguauaagcuauauguccaggcucaaagcuuaaaaaccaucuacauuuuuagccccucccccaaaacagagaugagccaauuaugggauucuaagcccaacauccacucgcccuagacauuccuguacacucagccuugacaauucaaagugucuuucucauuuacuaauuuaagaacaagauauaaagauauuuaaaacgcagccuucuuacagucccacaguauuggggaauacaggcuuuuaaacaaaaaauucacuugacagaaaaaguuguaugagguaaagcccaagaaagcauagcugcuguauguuaacuaggguuaaucaaaggaaaccugucugucugccuccugauaagaguguuguccgauaaggcuagagcauuguaugaaggaagaguagggcugggagaaagaugaagaugauaaaaugugaauauauuaugaagaaccuugaaauccauguuacaggacuuaaaguaucuaagcaauuuauaaauauaaaugacaaaaaaaaagcucuugaccucuuuuccuuccuuucuuuuuucuuuuuucuuuuuuuuuuuuuccgagacaggguuucucuguauagcccuggcuguccuggaacucacuuuguagaccagucuggccucgaacucagaaauccgccugccucugccucccuagugcugggauuaaaggcgugugccaccaagcccggcagcucuuaaccucuuacagucuagaugccuuuggaaguuuggucugucaaccugaucucagaaaauucacuuaaauauauacaguaaaauacauagaaguaagaaaccaauguuaaguacuuaaacaccuuaaaauauguagcguaguuacaaauguacuucguugcacauuaaguagcauguagcaacaggccuaauuauauaaugucaaaagaguaaugaauauaaauugcauugagauaaccugcaacaacuguaauaugaugugaaaauaucagauuuuuagugacaaaaacuguuaauacuacagugauugccuacaauuauugaagaaaaugauaaauuugagccaggaucaacuguaaauaaaggacauuuuucccccaaguccaagcucuuaaaauccuugaauuuuaaucauguccaucuguauggaucccaaguuucaaaauucuccaguguaauaguuuuaagcacaaauaugguauaguagaucugaauuuggaaaagaugauagguuggaguaaggauagagaagugguuacuuuucuguccccuaauagccaaagaccuucauuggcaauaaccuuaaccuuuuggggguggguggguguguguguguguguguguguguguguguguguguguguguaauugcaauucuagaaaauaauucagggagguaaauuggagcuauuguuagaaaauauguauggcaagcuguaacuucugcuuccucuggaagauaaugaguuguuaaaguuuuuggaagaaaauuauuccaguucuauuugaaaaaguuaaugcagaauaaugccuaaguuaguugucaaaaagagaagauagaguuggugugauggcaaaggcuuuuaauccuaguacuuacgaaggaaagggaggcauaucucuguauucaaggccagucugaccuaccaagcaaguucaggacaaccagagauacauaucaagacccugagguagaaaucaaaugacuagcuaauaaacugauuuugaaaaaguagauuggcccuugaggcucaauaagguauugaauauauauacuccuagcacuuuagaggguaaagcuggaggaucccagagagcuugaggcuggcgugagcuaucucaaaaaacaaaacaaaacaaaacaaaacaaaauaccaacaacaacaaaaaaaaaagcacauccauccccaguaugcaucaacugggaucuuaugugaccaagagguaauucuaaaagcccagccuuuagaauuacuaggucuuuaguauuuuuaguucuuauguaaagcaaaauaccuaaucaugugcucaaagauauuaauaacaguuuccugaucagauugcaucuauacuuguguguauaaauguuggacuugaaaucaggauaccuguuucucuuuuuuuuuuuuuuuuuuuuuuuuuuuuuuuuuuuuuuuuuuuuuuugguuuuucgagacaggguuucucuguauagcccuggcuguccuggaauucacucuguagaucaggcuggccucgaacucagaaauucaccugccucugccucccaagugcugggauuaaaggcgugcgccaccacgcccggcauaggauaccuguucucaucuauagccuaccacgcuacacagaccagaucucaucugauuucagaagcaaagcagggucaaaccugguuguuacuaagaugggagaacauuguugccaauccuuucaaccccuaaaaugaguaaaacucauuaacaaaaagauccucaaggcccagagaaccaucuccuuagacaccaaugaguguaccaacuuaccacucaaauccgaguugguacccaaauuacgugcuuaucaaguacaguuaaaaggugaauggaguuucagaacgacuaaucagaguacuguuccuuaacuugcggagccagguucucugagaagccgucuucuuuagcauuacuugcuuguacugacuuucuguccaccacagacuagaaacucaagcucuguaaagugugagguuccgcuauucguccccuuugugaggugggggaugggaacaagauuaucugacauuggaaauaacacuaaaagcuagugaagcuuuuaagaauuucauugcuuauagaaaaaucucuguaagguccuuucucuaacuuccaauuaaauggcuaccucuuccauaauuaucuguuauaaagguacuauaucauacuuuguacacugagaaacccucaguugucucaauuauagcuauuaucuugagaaucuguauuauagguucaaagaucuuaguccuaccuucucugguggccaaugaguaaaacucucacagaguggucugauaaacuugguuccuacaaaacagaggcuugggaauuucuacccuuagcuucuuuucucacaaguguuuuuguaacaacuuuuaaguuuacauugacaacuaaacuaaauaauucaaaauagcuagcccuacuuaauauaugauucaaccuugguccaauuuuguguaaguggcuaguugguggggguugucugguuuguuguuguuguuguuacaaaagcucgugcuuagaauuaaauuuaguguccugugcaugcuuugcaagugcuugaccacugcccugugucccagccuuuuguuuuguuuugucuugaaacaguuugcuaaauugccuaccuauacugaccucagauuugggguuacaggcaugggcacugugcacagcuacaaauauucuauuauuuccauugauguaccuuucucuaggagaaagucuucaauguagaauugcuggucuuaaggauguauacacuuugaaaauuuaauagcuacugcuuaaaguucuuucccaaaagaauucuaguuccuacagcaguacaguuuccuuacacauuuuucuuauauuagagauuauuauuaguauguauguuucucccuuuaaacugucaccccaacucgaaaaaaauuacauauaucuuuuuguuuuauguauacaggcguuucgccugcguaucuguguaccgugugcauacaguacccucagaggcaagcagagagugucagguccccuggaacuggaguuccagauguauauaagcugccuugucgguacuggguaucaaacuuaggaccucuagaagagcagucaguccucuuaacugcugagccaucccuccuagcccuguguuuuaaccccauucucuuuaauaaugaaaauggaaagcuuacuagcauuuucuucauuuuauuuuuuucuauuguaucuuuauaacuaagaucuguuuuguuaauuuuugucuuuucauuuuuccuuuuaagaacucuuuucuuauaaacauuguggauacauaguuuauauaguaaauauuaucagucuuuauuacgugacauuaaaaauuuguuuaugcuauguuuuuaugucugucuuacauuuuugcaguuauuucugucauucugcuuuauagucuuggguuuauguauuuguuuuacuuacauagaaggccucuucugcaagaauaaaaauuauuuaguguuguguugguuugaaugagaaugguacccagagacucgauauuugaauacuugguccccuguuggagaaacuguuugagaaggguugggaaauguggccuuguuggaggagguaugucacuggggauggacuuugagguauaaagagcccauuucauucccaguuagcucucucuccuugugguuguaccucaaauagcccucagcaacugcucagcaccaugcuucccucccuguugccaugcucccggccaugacagucauagagcaugaugguaggucaugguuaacccucuuaaaccauacacuaaauaaauucuuccauaaguucauuugucaugccaucucaucacagcaguaagaaggugacucagcuaaguaauacuuuuagaacuuaauauuuuaacuuuagguuuuugccauuugaaccuuuacuuaaguuuuuggggggcuaaugaaguaagucaucaugaaccuagacuagaguugaacucaugguccuccugccugugcaucuucacugcuagaauuauaggcaugugcuaccacacccagcagcugcaggacuaaucuuuagucauuugaaguuuuaucuucuuugucacccuuccagacccauuuacauucucaagcggauuaagaauggcaucuugggcuggagaaaugguucaguaaagcaccugccacagaaacacaaauacgcgaguucaaauccuuaacaccaauguacaacagcaggcaugguggcucacauaaucuaccucuugguaaaaaguuaagaggaucucuagcucuugcuagccagccaaucuagccaacucagggaaaucuaaguucacugagagauccacucucaaaaauaggugguaagccauugaggaaaacacccaacguugaccucuucccucuaccuacacacacacaaaugugcacacacauacaaggacaugaacaacacacauacaaacacucauauauaccacacacacaaaaaggcgacuuacugaauaaucuugcugucuuaaauaaaaaauugcucuuacauuaauuuuucauauuccaaaaaaccuauaaccauauaacuauauaaaauuuaaauugcuaaacuaucuaagcuugccuugaacuuugcaaucaaggcaggccuuuaauuuaccucuugccccaaccuccaagcaccagggauuauaugucuguaccauaccaccaggccugaguggcccaugcuacuuuggccauugauugcuauuucuaguuaugauagaaauagcaaauagaaaguguuaguguuagaauaaguuucaaaggaucaucuggucuauauccaugguccagagcauaacaaggggcaagcaagauggcucaguagauaaaagcauuugccuccaauccucacugagucucacuugguggaaaaaagaaaccaacucccaaaaguugucuuccucugacuucaaucugcaugccaugacauacauaaccucaaacauauacuaaauaauaauuuuaaauguuuuuaaauaaguuagagugaaggcccagcaugauggagcaugccuuuaauuccagcacuugagagacagaggcaggcagaucucugauauugaggccagcaaggguacacaaagaaacccuguuccaaaacaaaacaagaaaauuuccuuugugauaguuuuguguuucuaagaaguuuucagaauagaauucucaauuuuacuccgguagaauacccacuuacuaaaucucuccaguuugcgaggcauuaaaacuauaugacucaauaaaaucuaaucucuguacuugagagaguuauauaaaacuugaugguaauuucuacauaacaccuuauauaaaucuccagugcuuuaggguuccauuaagaggaaauaucuaacugggggaaauagaaacaaaagauugagcuuucuuuuuuucuuuuugacuuuuugagacaggguuucucuguguagcccuggcuguccuggaacucacucuguagaccaggcuggccuagaacucaaagacucuccucacucugccuccugaguguugggauuaaaggccugcaacccggcuaggccugaucuucuuuuuuuuuuuuuuuuuuuauaauauuuacuuauuuauuuauuuauuuauuuauuuauuauauguaaguacacuguagcugucuuagacacuccagaagaggcaucugauuucguuacagaugguugugagccaccaugugguugcugggauuugaacucaggaccuuuggaagagcagucggcgcucuuaaccccugagccaucucaccaaccccaggccugaucuucuaauacuuguaaacaucaaauuauuuucaaauguuauuuuugaacuaucuccccauccucuggaugcaaaacuuuuggugacauaauagauaacuauuacaaucuuaugccuuaaucuuuaacuuacugauauuucuucauuuuucacugacauauacccuaugauaaaaguuguacauuagccaggaagugguggugcacaccuuuaaucccagcacucgggaggcagaggcagacagauuucugaguuugaggccagucuagucuacagagugaguuccaggacagccagggcuacacagagaaacccugucucgaaaaaccaaaaaaaaaaaaaaaaagguuguacauuaauagucucucuuuacagaagaggaaauugugacuuaaugaaaguaauuuauuuguuuuacacagcugauacaaaacagaaccaaaucuguaaauguucagguugaaagcuuaguguucuuuucuuggccauggugguuuggccuaagccuaguucacuucucuuuucauuagaauucagaguguugaauuaucaugggcaaaaucuaugaagucagaucaaucuuuagucuauauacuuuuuuuaaaaauuugugucuauguaggucugugugugucuguguguguguggcaaacugucuauucagguacuugucuuccaggcuuauuuauaucuguaacuggcuacuaagcuagggguuauaaagaccugacagacagacagcucagauauuuccacagguuguauauccagacauucaccccuauacuguaguuacugauuguauaaaacagugguucucaaccuuccuaaugcugcgacccuuuaauacaauuccucauguuguagugaccccaaaccaugagauuuuuucuuugcuauuucauaacuauaauuuugcuacucuuaugaauugcaauguaaauaucugauaugcaagauaucugauauucaacucccaaagggguugcaacccacagauugagaaccucugguauaaaggaaagcuauauccaggaagccuggcuugagacaugugacuagccauucccuuuauaguaagauaaucuuauaucaaguccaaguacuuagucuucaccaguuuacacugacaaacugacuacacugucauuugucaucagcccuaguauuaauaggaucauuuuucuaaacaaucauuucaacuuuuauaucugucauaaagaacauacaaauaaugguuucacauguuuucuuuuaugaauaucucuugagaaaaagaaaaaaacuaucaaaagcaugaagugauagcccaugcugauuaucaacucuugaggggcugagacaggauuacugugaguuagaagccagcaugggcuacguagcaaguuccuggguuacaguguuagacccugucucaaaacacaaauaacaaaacuauuagauguuaauacaaaggaugcuguuacaucuccugaguaagcauuuuauuuuuaccuuauagacauugugaauguuuaacuaaacucucugauuagcugccaaaaagccaaguuuguggcucacccauaaccaguguguucuaugccucgcugacuucccuccugacuccgguuugucugaacucuaguuauucuuuccucuucaucccccucaccccaccccaguucucuugcuuucacacugaguguagaacccagggccugcacaugacagaaaaauggacuccccugagcugcucucucugcacugcuguucuucuuuaauaaaaacuuaauuuguacuuggcaggucagugaaggaggauugcccaaaauuucaggccagccugaucuacauaacaaguuuaaaaccagccaggguuucuuaccaagaaagacuuugucucaaaauauuuuuaaaagauuuauuuauuuuaugugugugaauacacuguaacugucuucagacacaccagaagaaggcaucagaucccauuauaguuaguugugagccaugugccugcugagaauugaacuagggucucuguaagagcagucagugcucuuaacugcugagccaucucuccagccuucaaaacauuuuuaaucucuuaauuuauggcauucuauguauuaaaaaauacauguaguuucucauaagcagucuuauauuguuuuugaaguuuuucagauuaucacaugcuauguguauauaagacugucauuaucaccucauuuuacuuuauaagauccugauaucauuaaucaccucauuuuacuuuagcauuuuuucuugaaagguauuuuuuaauacaucuuuuugugguuuugguuugguuuaucaagacaagguuucucugugcagcccuggcuuuccuggaacugguucucuagaccaugcuagcgucagacucacagagauccaccugccuuaccaaucaagugcugugaacuagagguaugcaccaucacuuuccagcuuuguuuaugguuuuauaugauuuugauuacaugaaauugguuauaucaaacuuguauggcuuuuugaaguauaaccaaaugguaaaaauaauugaucuaauaguuaggauugguuagauuggugucauaauccuguguccuuauauuaugcuuuuguuuuuuuucuuucaaucugucugugguuuuagaaauacugcugaguggcuagcucagugcacagcaguuaaccacuaccucaguugagucuguaggcucaaguaagccaucuucuacaccugcagauuugccuuuguuagcacagccugggcuggucacaugcauauuaaucccagagacaccuugccuguguuuccucuaaauuagccaaccuguuacuuaaacaagugaauaugaaugaguauuuuguuuccagcccccauuuugugucaucuaguugauagcaugaaaaaaaauucauauauauacauacacacacacacacaaaacuuuuuuaucucuuuaaguucugggcuuauuugaugcaugccuuuaauacuagcacucaggagacagaggcagaagaauuuguuugaguucuaagcaggucuacauagugagcuccaggccagcuaaaucuauauaggaagaaccuagcucaaauaaauaaacucuuuaaauaucuucaaggggacuuauuuggccuucuuugcagcucugaguuauguuauguucuuuuuuaagaugcucuuuuuacuggugaccaaaaccaaggcaaggucaacaauauagguuaucaagagaaagcacuugcuaugcaaucuuggucaugugaguacaauauccugagcccaaauggaaggagaaaauuaccuccugcagguuguccccugaccaccacaugugcaucaugacaugcauccaaauauacacauauacgcacaaacaauaaauauaugugaauuuuuuaaaauaacaaaacuauuuaauucauugcucaaaaugauacuagcaaaucaguguuaaaacuaagccaggaacacugauuccuaugcacauauguaucacaaugucaaaagaacuuccgacaggcauuauaaacauuaauuacauagucuucaucccacucauugaaguuuaaagaugggaaauaagcaaaaacgucaccucugcauaaagcugggcagaauuagaaaugaguuucauuugcguuacuuuaucugcaugguuuucuguucuugagguccccacacuugucacugaagcucucaccacugucacauccauuauaaaaggaagaaguacuuaucuuagcuguuuaaaauuaauucuguaauggaaacuuucauucaccuuuaguauaaaaauaauuuguuggggguaucauacauuuucauauugagacaagaucucguguucauuguuaucauuuugagacagucucauguagcucaagcagaccucagacucacuauguagcuaggauugaccaugaaauccugauucuccugccccucccucccaaauacagggauuacaggcaugcacuaccacgccugacugugcauauucauuagaguuagaauguguuuacugcuauggauuuuagcaaaacaucaguuauaauucuaaccagucuacauuuaaauauaaaguuaaaauucuauauugucucugaaauuuuucaacuucauucuaauuauucauguccuguacauaagcuaaacuuucuuuaguguguuuuuuuguuuguuuucuuuucuuuucuuuuuuauuuugguuuuuuaaaacaggguuucucuauguagcccuaacuauccuggaacucacucuguagaccaggcuggccucuaacucagaaaccuaccugcuuuugccuccaaaugcugggauuaaaggcgugcaccaucacugccaggcuuuaguguuuuaugauguuagcacugguggaaauuauugauuaaaaacuguagaacuauaugucauauuuaccccaguccuguaagaguagcuacuauuuauaacccaauaucacauucagcaguaaauauugucuucugacucuccuucagcuucuggaauuucugagaaucccugcucaauacaagauggacccuguggucuugaguuauauggacagucuauugcggcaaucagaugucucacuauuggacccuccaagcuggcucaacgaccacauuauuggguuugccuuugaauacuuugccaauagucaguuucaugacugcucagaccaugucuguuucaucagcccugaagucacccaguucauuaagugcaccagcagcccugcagaaauugccauguuccuugaaccccuggaucuuccccacaaaagagugguauuuuuagccaucaaugauaauucuaaccaggcagccggagguacccacuggaguuuguugguuuaucuccaagauaaaaauagcuucuuucauuaugauucccauagcaggagcaacucaauccaugcaaagcagguagcagagaaacugaaggcuuucuuaggcagcaaaggagacaaacuggucuuuguggaagagaaagccccagcucaagagaacagcuaugacugugggauguacgugauauguaacaccgaggccuugugucagagucucuuuagacggcagccagaguccccgcugcagcuacucaccccgacauacaucacaaagaagagaggagaauggaaagaucuaauugccagacuugcuaaaaaaaacgaaguagcuacugaagaaugcucgugauguuugaagucuggucuuucugccuuucucuauggugacagccucagugccugagggaaaaccacuaguagaugaaaguuuacaauuccugcuucuuuauuguucuguaagaaugucauccucuguguucucugaaugggaaguuucacuguaauccugaggaaagcgguacauucuguggaaaugucuugaacuuacguaccaaaacuuuaguaacaaaccucucauuacacaguuucaaguaagagccuucuuuucuuguugguauaaaacuauuaucccuuuuggucucccuuccuuguuggcuuauuccaaagaagugauguuccaaagcaaaccaauaacaugaagucuaaagacaugcaugaagaaaacagcagaagaaccaacaucuuuguuucacagccauagugaggcguccgacuggagguggaucauuaccuaacuccacuuauagccuucgguuuauaaaaauaaggcauucucgggugcaaaggcuuucccgucugcaaauacuuaauaaagaugacuuuagcucaucuuuaucuauuuccuggaaugcuuuaagaacauggaacgucauuaaaauaaauggcuauagacugggagcauaacuuugaggaagagcaccugcuguggugugcaggaagacuugaacucaauuccaaauugcaguaaauaaaaacaaaacaaaaccaccugcggguguguggugcaucucugguuucccugagugagugggugacucagcucuaagugauggugacuuugucuuguccuuuacauggauuuagucccucccuuuaccuaacgugcuguaguucucaagcucacaggauaaccagccaagauuagcuguuauuucagacauguucuacuuuugguagauagagcuuuuacacuaaucuagcagaguuguuuucagguauguugugguaaucuccauacuauuaaugaucuaaaacauaggagcaguuuauuuuuuaaauauaaaggaaaaaaaaugucaccuuccucaaacuuaauccaaaaaguaaaugguauaacuuuaaaauauggaaacaagacuaaaaugaaauacuacuccccacaaagcuauugauaaauuuuucuacuuguuucaaguaauuaacacaagaaguugggcacacauaauaauuagaccccgauaacaauuugcaguguauaugggauguaaaacacaaagaugugauucacucacugaaacugacuucagcuacuucuccacucuaacccugaccccagcguucauaacccaaaauaaccucuccagucagcaacuacagagguacucaguucccuggagccaggaagaggaagaugguaaaaguguaaaagcacaggcugcauaagcaggcuucaguguaugggaucugaaacaaguuuaaaaaaggaaaaaaaaaaaaugggagagaggggauuccauuucaagugagcccauuucaaaccaaaagacuuaaugaaagauaggcaggaaaauguuagaaauuggcagugagccauaaaugaaagagacaggacagggagagcaagcguagggacacagguucugauaggccaccaguggagauaaaggcagcaagcagugucauuucagugacuguuuacuuaggcagcugaucuagaccuucggagagucugcccucucaggggaagguuaucuuucggguaauacacaguaugcuuguuuacuuaaacaucagccugucuccccuuuaauagcuaauacaugcgagagcagucuugucuaauucccuaagguuugucccagaauuauuuuuuaacuaaacuauugucuuuauuuaaaaacauaaaaauauacaaucuuuuuccaaauacauaacauguuuguaaucaaacuuuaaguuagucuuuuguugaguaggcuuugugagacagcucagaggauuaacacacuuaccaccaacccugauuugacccccagguccuacuuaguaagaugagagaauuggauuggcuccuuguaaguuguccugucucccaauguacaccuuggcauacuuguaacuacucacaauauauauaaauaaguguaagagaaucuugaguagauaauuugaaaaucuugacuuuguaaauaacagauuuugagcuuacacguaguauuucacuagauacuaggauaguccauaagguauauaccugcuuaaccauacaccauuaauguaauacucauaauacuauacuaauaauauaaauacauugauaauaauauuaauauauuuuauuucaaauauccaauugugcugccccacaaguauauuugaauaugucuaaccugggucucaauauggaauugagaaguuacauauauaaacccaacauuagcugggaguaauauauauguguauucucuaccucagggcuauaccuucagcccuauuuuuuauuuuuugacuuuguggguuugguuugguuuggguuauuuuguugguggugguggugguuuuuuguuuuuguugcuguuguuguuguuuuauuuuguugaaaaaggguuucucuguguagcccuggaacucaggucauggaccauucuguguugugcaguuaaauacuuuagauacccuuaaaaauauauguccauguguugcuauaauuuaaaguacuagauaacauuauaaagguuuuaugcauuuauagccauuuuuauuguugguuuuuuucaaugguagaggaauugagacagucucucauggcccaggcuggccuacaacuugauauguagucacuucugauccucagaccuccagcucuggaggaauaagauuacagguauaugccaccacuccuggcuaauuucauuuauucuuauauuuuuccaaguggucuuauuccuauuuuauaauaaauaaaugcaaugucaauug

SEQ ID NO: 5150 - RNA, 177973 nt, Mus musculus
cgcgcgccugcucggcugcugcuggagagccgcgcggggcggggccgcgugagcggggucgggggcgcgcaggccugagaggacuggggacgcagaggcaguuggcgguggccgucggaaaguccuggcaggacggggagggacugcggcggagauaccgguccccgggcaaaagcagggaccgcgguuuagcuuccaacgcgugcucucugggcggggugcggcgggggaugugccugcccaguccgggcggagucucucugacagggcgggggaugcgcggccgccgcucucucggacccugaggcgacugggcccacccucgcggaacccuccuaccccccggcggccucggccucugcuuucuccuucugacccuggaaaccgagcuggggaagcggcuaccgccgaagaggaaggggcugugguggccaccgcggcgcagccagagguaagacccgccccagcacccagcggcccugccgccuggccuggcccggcccacgucucccgcucggcucuuuggcucccggagggcugccccgccccgccccggcggagacgccccgccagcagcucugccccuaaagccuagcaaucgccggaguaccgccgggauuccacccccagacucgacucucccguaccuuucauugaccagacaccauucuguccaccaguagccgcggcgcuucugucacuggcccccuuccaccuccugcuagaaccucuuuagacccucuuuaggacucugacuggaaccucuagacaccguuaugucggagcggauccuugucugggaaccaaggccacuacugcuuccuaaugcauugcuacgucccagaucuuuggguauccuacgagucaucgcuacccgagcuuucauagggacccucacgcagcuuacuuccagucagguuugcuagguuuucccccuacccauacgagcuuucagauagcccaaugucaugaugcucuuaccuaguaggucuccgguuagcccuucaaaucaccaucagagugcuggaucgcccccucacaccccccccccccccgcccugguguaguuucucuagaagaccucuuaagcaaaccuuguuaccugauuucuaaccaaucgggaucuuugguugaaaagaaguuuccaggaaaacucgaagggguuauuuacauaguccaguauauucacuccauuggauuuuaaggagucagacugagacccauguuuggagccucagggacugguugcugaaagggaaagagagcaaagagugugaaagcccaggcagggaggguaugugugcuguuacaagggcaagcugcuugcuccucaucuugucucuucaguagaaggaaagaaccagucuauaucuugucacuucugggcuucuguaaggauuaaguugcauuacaccaaugaagauaaguaacucuucauauauuugucucagcacuguagauuuguacagauacacagguuuuuaacuagaggaguuuuggauuuacuguuuuugaacuuguuagaaaaacagcauuuauagcuguucuuaaucccugaaggcuaauguuuuuaguauuuuuuuaccacccagucuucuccaaggaccaaguauaagugucauucagaauugaaguuauuauuaacagcuuucuuaguaguaguaaaauauugaauaaaauguuuguugaaauuauacuccugagaugucaagagggaagcguaauguuaaguguuaaguguauaauuuuaauguuuauguaagggugggggauauuuuuguaguuaguacuuacgguuuuuuuuuccuuucauuuuuuugugucuguguguaauacagggagaaaaaccaauuuacauuauggguauuaaugagacacaguuuagaagucaaaaccaucagaauaguguaguaaaaaguuucucuuucuccaaucuccaauuguucauuuucuauuuuucagcuucuguaauugguaugaugugauauuuccagcguuuauaagcuuauaucuguauuuuaaagacacacaaacuauacacaaauuauuccauuuucacauacuacugcugaguccuagagaucauucagcaauaguguucacggaagagccacauuuacugguuggguaguauuccauuuugauggacuuggauuuauuuuuaguccuuuuucuaaaaauuacugcaagcuuuuauucuaaauguaccagguauuauauguauaaaugauuuucaugguuugaaaaaauucugauaauuauuuuuguauugaaccuauaaaaagaaguguaucugaaguaaacuucucauggacucucuugagcuacaacucaagacuacuuuuaaugguaauuauauuuaucagaucaauuauuaaaggauuugaagugagggaccaaaauguucagaugagcauuuuuaaaagucacuuuagagcagauuaaaaguagaauaaaguuaaagccagaaauauauuagaagggugauaccauaguucugaauuuggauauugguaguugacaagucuuggugauuugauggaaaagcauacagagaggacaaaauuggagauauuguuccaaucuuuccccuuaugugaggauccauaugaugaagauuuuaauuuuuaguugugacauguuaaauaaauggcuguuacgggcuggagagaugguucaguggguaagagcacugacugcucuuccaaagguccugaguucgguucccagcaaccauaugguggcucacaaccaucuguaaugacauccaaugcucucuucuguuaugucugaagacagcuacacuguacucauauaaauaaaauaaaucuuuaaaaaaauaaauaaauggcuguuauguagugaauuugugucagaaauucauaacaucagguucugugccaguaguaaauuuuggaggcaaagauguauaguuacaaggaagagauuucaggcagaaacucaauauuuagagcauauaaauaccuagauuaaguucuuuuaagaaauuauuaguagugaaaaacuacaaucuaauguguuguuuuuaccacuaguauuacuguuuuaaagauuuauuuuuguuuguuagaguaucugugugugccuguguguauuugagugcauuguuugaggagaccagaagagcauguccaaauucccugagcuggaguuagaggcaguuggagcaacuggacuagguucugguaaccucaguaggguccucuacaagcgcagguugagaucuuaaccucucaacaaucucuccagccccacuaguauuacuuuuuguaaaagggucucgugcccuucaggcugaccucaaaacucacuauguagccuaggcuggcccugaacuucuuaacuuuaucucuggaaugcuaggauuguaugaaugugcuaccauguuucuuucauggagcgcuagaaauugaauccaugacuuugugugugcuaggcagacacuuuaucaaucgagcuaugucuugagucugauuauuuuuagagauaguguuuucucauuuagccuaguuguccuagaauucucaauuuagcuucaucugaucucaaauucuugagcauauuauuauauuauaggugcuacaacagagggcuaaacaauuuuuuucuuuaguuaauuuagugauauauaguuuuugaggagaugguauaaauucauuguuuuuuguuuuuuuucuuuuuaaauucgaugaugaucuugaugcauuguacaugucuauugguguucuugcuucagauaccuaauuuagguagcuggaacugcaaauguguaucauguucagcuaaauuuacauguuuuaaaagaaauauagcuauaguagaaauuaguaauauaagccuccaucuuuuaaaaucauuuguaauuauauagaugcuuguucaaucuuuauuauuuucaaagaagugcagaaagguugagaauaagauugaccaagaauuuuaauauuuuuugcuggacaugguggcacacaccuuuaaucccagcacucgggaggcagaggcagguggauuucuggguucgaggccagccuggucuacagagugaguuccaggacagccagagcuauacagagaagcccugucucgaaaacaaaacaaaaaaaagaauuuuaauauuuuuuaaauuuaaaugauugaauuucuuagguauauaacaguuuaaagaaaacagucagacuuuucagauauuuuaaaaauauaucaacuugagucaaguauguuauuauagaccuguaaggccaaacuggcuauauagaaagacugucucaaaaaaaaaaaaaaaaaaagaacaaacaaaucucaaaacaacaacaaaacacauccccugaccaacaaaaguacauuaauuuuauauauugacuuuugugucuacagaggcuguugagaacuguugucuuugcuugacaccucuguaaaccacgugguaauagaccauauggugucauauuucguaaguacuccaguucaaaaauacagaaccuucucugucucucuuccccacaaaacuaggaacagagcagacagaaacugcaacucaguucauuuugauuucuuaucuugauaaagggcaauggcacccuucuguucucaugaaguuuucaggaacccauaaaaaucaucuuuuacucuauucugccaugcuaccaauaaccaguuugucauuaugucuuguacuucuuuaucauaauaaauauuuuacaucuuucuuguuccuuuucuucuguauucucuuuauuuuaaacgaacucaaaugccuuuuaggcuucaguggugcuuuccaaguggucuuguuuucugccuucugcuguugguuucaccauacuuucuuguauauucuuuucacugcugccaaaauaagguuucugaaauauucuuaggcucuuucaguugcaagacgaaggcucagguuaucuuaaguagcuaaggagugcuuuuggaaaacaaacaugcaaauacaagagggaacccaggaaaaaugaagcaaguugacauaagaaaaggaccuauuaaguuggaagcccgagaagacuuuuaauuuauggcagugcugugacuaggaccuagaauuugugcaugcuaaucacucuguuacugagccacacucauagccuagauuuuacuuuaguuuauuuaguuguugcauuacuauuaguuuuucauaaucauuucauccuguuuuauagcuuccauuuauuccccauuucugccuuuuguaacuaccgugucauuaccauaccaacaccuugcuuucugacuugcuaucuuuuauucagaucuugagcaaagucuuuugcagucuaagauuuuuucauuuaauuccucuccuacgcuucccaaugucugcuaacaagauggaaugacuauuccuggccauucagcauugguuauguaauauuuguacaugugugcauaggauagaaucaugguucaaaguauagaguaguaugcagguuaguuccuauaaaauggaauuguaaucauugaaggcaacaucauugacuuggauaaaccauugugcauuuaauuguccuucuaguugaaaggucugcagugcuuucuuucuuuuucuuuuucuuuuucuuuuuuuuuuuuuuuguuguuuuuauuuuuugagacaggguuucucuguguagcccuggcuguccuggaaaucacucuguagaccagacugaccucgaacucagaaauccgccugccucugccuccugagugcugggaucaaaggcgugcgccaccaugcccggcccucuccgcagugcuuucuuguuacucaggauagaguuugauuuguugugugggguuucauaacucacauucucucuagcuuuguuuguuugaggcaggguauuucugugaaguccuggcuguccuauaauuuucuuuguauaccaggguggccuugaagucacagagauuugucuaccuuugccuccugugugcugggauucuuugcuuuugagauguacucuaggcuauccuugaauauggaccuaucuuaccucagccuucugagcuuuucuuccuuugcugucucccuugaauucuuuaaugcauuuuuuuuuuuuuuuuuuuuuuaaagacuuauuuauuuauuauauguaaguacacuguagcugucuucagacacuccagaagagggagucagaucuuguuacggaugguugugagccaccaugugguugcugggauuugaacucuggaccaucggaagagcagucgggugcucuaacccacugagccaucucaccagcccucuuuaaugcauuuuuacugacuuuaguuuccuugucuucaugcucuguuuccuuucaacuuuuuccuugcuuggcuaguuccugucugaccuccaggauugaguacagguauaucuuuucccaggaagcuuucuuuuaacuccuucuggauuaaaguguauguguuuuugucugugacagcccucuggaauuacuugucuauuuuccuuucuagguuuuacuguuuuuggaaaaggggauaguauaaaugcuagauaauaacacagguguuuagguuguagguucuauuuauuuauuguguauauguaggucugugggcauauaugggccuuguggaggucaggggacaacuuaaaggagucauuucuuuucuuccacuauguagguuucugggguuggaacucaggucaucaggcuuggcagcaaaugagcccaucuuacuaaccuauuuucuuguuuguuuguauguauguauguauguauguauguauguauguauucauuuugaggcaggguuaauaagcagugcaagcuauccucaaaaucauagcaauccuuguuugagucucucuagugcuagaauuauaaggcugcauuuacuugcauacuuuaaauuucccaugaaacuauaacauucuaauaaagcauuguaaguuaaaaauauuuuaacacaacuaaaccuggcaauaccauagguuagugacacaguacugcuuuuguaccaugagaaaguucaacuguuauaauugacuaccaucaaucuguguacaaaaaguucauagauaauaaauguacagcucagugaguuuucaaguguaacuauuuauguaacaguacuugguaccucaaaacagaauauugcuagaauuccccaagcuaccuuaugccuucuaauccuaauccauuucauagagaauuuaauuuuaaauguaauaacacuuuaaaauauagguuuucucucuguuuuagguuuuuuuaaaaauuuguuuguuuguuuguuuuuccaagacuggguuucuuuguagcucuggcuuuccugaaacuggguuuguagaccaggcugguguugaacucagagaucugccugacuuugccucccaaacgcuggaauuaaaauuuuguuuguuuguuuuugagaaaagguccacuugcuucuggcuucugaguacugggauuacagguguauucuaccacaccuagcuuuugaguguaucuuugaauaggcacgguagguaggaguuugauuuuguacagaaaccauauauaacuuacauuaaaaaaacacaguugcuuuauuuuuauguaauagacaagagaaaaucacauuauacuaaaauuauuguauagauggcuuguauuuggaaggauuuguuggaguagaguuguauaaaagauuagauacguugaagcauauuuggugaaagcauuaauugugaugaugaacaugcuuagaauagguacaguaaacacacaaaguacuuucagaauuguguuuggcauuuggguuuuaauaugaauuacguugguguguauugucauccaugaguagaggggucauccaggaggcaacuggaguguaauuuuccucagagugaggaaaggacgaguccugugucauagcuaaauuuggaaaaaaauugcuucuuuuucacuacuagcaauaguuguuaauuuuuuucaaaccauaagauauauauguaguucuuuacauuucuagguauucuuuuaaacauacuuucucuucaguuagguuuuucucucuuuuaauuuuaaauccauuuugucuaauuaaauagaauauggguuuuuuguuuguuuuguuuuuuuguuuuugagacgguuuuuuuguguagccaccuggcuguccuagaauggcaucucagagauucacuggauuuagaggcuugccaccccacaccuagcuaaguguauggacucuaaaaccuggauuuucaacagauuuggauucaaauucagucauaucacuucaggauuguauauuuaucuccuguagggugauaguauuuuuuuccucacaagguuuuuaaggcuuuuuguuuuuggagguggaucuuuuuguuuguuuguuuuguuuuucugagacaggauuucucuauguaguccuggcuuuccuugaacacauucuguagauuaugcuggccuugaacuggaagagauccaucugcugugucuccuaugagugcuggaauuaaaggugugggccaccacuaucaggcuggagguggggucuugauaaguuuuuuccaagguuguuuacaaacuuccugggacuucgcaguugggauuacaggugaaugucacagagccuggcuaaaguugaguauguaaaagcuuucuucauauccuuuguuauguuuaagaauuauauuaggauaagugacuaauuacaguggcuuuuuuuguuauauuugucaacagaaguaaauacuagggugauuuauuagaugucuuucaacugccauauuuuauaguucaaaauauuugaagaaauguguugcuggguauagugcuacauaacucuaauccuagcacuuggcagaagauugaagucagccuggucuacacaguuuguuccaggauagcaagagcuacuaugaagugagauuccuaguaaaaccagggccuuuucuugcuaucucaguacguaggguuaauggauauuagaauguauuuugggugagguuaucauuacuggauguguucgguuuggcaaugacagacauuccuuaaaucauugacagauuuuaguacuauugcuguuuguaguguguuaaguauuuguuugaaaucuucucacuuuuaucgaucaucugauagugggcugaauaauaucucucucucucucucucucuccccccccuaauauaaggaacuuuaccaagagacuguagacaucuucauaagugauuuuucaaucauauuuuuucugaauaauguuugcaacuuucuuuucuuuuaguucaaccccucccccuuuguuuuaaauuauaaaagcuacuuaacauugaaagguuaaaaagagaauuaaaagguugaacauuccaggcgugguggcacacaccuuuaaucgggaggcagaggcagguggauuucugaguucgaggccaaccuggucuacaaagugaguuccaggauagccagggcuauacagugaaacccugucucgaaaaacaaacaaacaaacaaaaagguugaacauauuugcaguuuauauucaauauuagcacuguuugcuuccauaguguuguggugcuaugauuuacuggauuguucuuuaugugugugcauauuuuugugaacuuauuguuguuccucuucucuccucccccuccugcugacaggguuccuuuccuucccuucccuucccuuccuuucuugccuuucucuccuuccuuucuuuucuucccccccccccccccccagacaagguuucucuauguaaccauagccauccuggaacucauaggcuggccuuguagucagcaacuagauccacuugccucugccucccgaaagcugggauuagagguguguaccagcaccaccuagcuucuagaaaguaaaugacaaauaugacaaauauguuucaaaauacuuuugaaaauauuuuuguacguguauguguguacguguggaugucagaggaagcuugugggaguugauuuucuucuaucauguguguccuggggauggaacucaugaagccuuccuugguucuagucaucuuuaucuacugagccauuuuacuggcccagaaaauauuuguuaaaaaauagauauucuuuacauuaauacuaguuuuaccauugccaauaccuucucuagaaguuaauuuacugugugugugcuccaugugcauuuggaagugacuuuuccuacugagccaucuugcugaacuuuccaguaaaaaaauuaauuuucagucuauaguucaauuuccaguuauuccuuaaaauaagaucucacauucuauucauauuuuucuuuugcauuucacuuaucucuuauacuugagaauaguucuuucucauaagauacugaaauguccuuuucaauaagauacugaaauugcuugaaagaacagauuauuuugaagaauggcuuguuuucuagaguuaucuaauuguuucuuggugugguuguauaauuuguucuuuucugguuucuauuuuugaauuuaaggcuaucuuuuuaaggcuuguuuaauguguuaauuuuuuuagcaaagucuuuuauggguaauggaauauaucauugaugauauguguauaucaucuaggcuguagaccacauguaugaggauagcaauaacuucuguccaaccgaaaauuguaaacuuaauacauuuugaaacucuuuuucuuuuggugacucgacugaaauguuuucaagcaugaacuuuguaguugacagcaugacauugcaguguuaagagguuggacaagcuggaauggagguacaugauguuacguguuccccuauuagagauccaaguuugacaggguuuaaggugguauuuguuaugacuuuguauuuuaaaagugccuuuuuuuacuccuauaauuaaauaugcuaacuuaugggaauucagcuuugacauuguucuuuagugcuuuaauaaugucuauucuuuguagguucaaaauaaagaacucuaauauuaaaguucaaauuucuuuuuucuuuugucaguguauuuuaguaaggauauauuuauuguuuggaauacauaguacuauuuauuuucuuggugugauuggugccaguuugauauguauuagugucuaguuuuuauuuuaggaauaauuucucuuuauugauuuaauucuauuguuuaaauaugcaaaauaguugcaaaguauaaaaggagaaaucauaugcuaagauaaauuuggggaucucauugaugugugugguauuuuuuucuuucaaauccuccauuuauacacccaaauuagcauacuguauguguugcuccccccccccauuucuuauuggcacauaaagauuaucuuuuuccuucuuuucuucacuuuucuuuucuucacacaggguuucucuguauagcccuugcuguccuggagcucauucuguagauuagguuggucuugaacucagagagauccaccagucucugccucuacauguaaaguacaugaauucuuuucuucuuuuuuucuuuaauuuuaaugcccccccccuucuguccuaaaucuuucagauuauagaguugaagcagucaguacaugccuacuuaggguacaguaagccuucucagaugcacacuauaugagugagagaucagaaacauacuguaaagggagagggaagggaaacuuagaaugcaagugauucaaacccuaauguuauagacuagguguuggauauuagggaacugaacccuucagacucuauuugucuuuuacucuagcgucagcauuuguggagaaugugaaaaauuauaaauuauguuaguuuaaaaaaauguggcuaaguugguuggaaaugguacacagcuuuaaucccagcccccucacugaucucuuaaguucuaggacaaccuguuguacagagugaguucuagaacagucagggcuauacggagaaacccugggucaaaaccaaaacaacaacaacaaaaaaccaaaaacuuaaauaaauaaaaugaugaugugcgcuuguaauuccaacacuggagaguugcagucaugcaaacucuugugguggucuggccaugcagaauaccuuacuggccuaauuggcaagccuaagaccaguaagaaaucuauuuuuaaaaguuuuucuuuuaaauuuuuaaaaaaagauuuauuuaguuauuuauuauaugugaguacacaguagcugucuucagacacuccagaagagggcaucagaucucauuacggaugguuguaagcuaucaugugguugcugggauuuaaacucaggaccuuuggaagaauagucagugcucuuaaccgcugagccaucucuccagccccauauauuuuauuuauuauuuuauuuuauuuuauuuuauuuuauuuuauuuuauuuuuugagacagggucucacuauguagcucuggcuguccuggagaucaaucuggccacaaauucauagagauccaccugccuuugccuucugagugcuaagauuaaagauguaugagaauagcucagcuguaaaauauauuuuacguauuuuuuuucccuuccgaaacacccucacauccuucccaacucucuagcauccagugucauguucuuucucucaaaacaaacaggcaaacaaaaacccagaacaagaaacauaucccagaaauggaaaucaaaagaaacagauuaaaccaacaauacaaaacuccaaaacaacccccaaccaaaaaaaaaaaaaaaaaaaaaaaucaaaacaaagcaaaaugaaacaaaaacuccacagaaacauguuugaguucauuuuauguuggcuaacuacuccugggcauagggccugcccuggaguguugguugauauacccagugacguuccauuggagaaaauugauuuuucccuugccacuggguaucaauuccagagagcuucuuuauuaggggugggagccauuuuuuccuuucaguacugggacccccaucugacuuaaaccaauucaggucuucugucacacaggucagccuugugaauucauauguguauuuguuuaucuuuauuuuuuaaaagauggguaggagcuagguagugaugguucaugccuuuaaucccagaacucaggagguagaggcugggggaucucugaguugaaggccagccuggucuguagagugaguuucaggaagcugucucaaaaaacuggguaggacuaacucucuccaaauuuuguuuuuucuuguuugaccuuugauguccacaugcaugcacucuacaaaccugcaccugcacacacagacacaaaucuuaguagucacaugcaauuacuuuuuuccauuuacauacauuuaugugaauguuugagacuguaugagaaacauacacaguuuaaauauuuuugauguauuugugucauugucuaguccagcaaaucaaaauauccuauuuuuaucuuuacuuuguuaauauaugucccuuuguagaagcuuuuguccuaauucacaaacauaaccuuguuuaacuccuuccuuuuucuuuuucuuggugagaaggaaugaacuuaaaacccugugcuugcuuucuggucauauacuuugcuacugcugagcaaaauccuugacccaauccuucaugauuuuaaaugccaguaguauauucuuaaauacuguaguucuccuuauuuuuaaacguaugagcugaauaacucuguauauuuuaugugauagaaauugaguucaucauaguaauugcaaaauuaauuacagauuauuguagucauaauuuauuagaucucacugagguaaaucuauccauuagauuauaugccaauuagccauucugguuuugaugaucauugaauugauuuuaauuucuugcccuuauaagacaaugauagaauggugugcaugcuuauaucuaauaauaacacauuugcagauacuuuugaaaauuugugugagcagaauugcuuggucacaagagaagauaggucauaaagaaugaacaaauuaaaacuuagaugaugacagagggguuuuaguuuuuacuuuuaccaacacaguauaugagaauuuuccuuggacuggauccaccucaaaacuagauacuguagauuuaaaauuuuuugccaacugauaguaucucaugauuuaaauuacugaaacuauaucuuuuccaccuuuuacuuuucuuucuucuugucugucugucuuucuuuguuucuuucuguuuuuauuuuuuuuuagcuuagucuuauguaguucaggcuaaucuaaaacuggcuuugaagccuagauugguuuagaacuccagauccuccugccucagcuucuugcuugcugagguacaauucuauaccucauuguuugaauuucuuuuuguaaauuacauucaaguuguuuacuuauuuuuuuuuccauuaaggguucugucuuuauuacacuuauugcuaggaauucuauauguguuuuagauauuaguucuucuauaucuauauaguuauaucuguagcaaguuauuuguuucugccccuccucccaaauagcacaggcuggccucagacuugcuguguuguugagggugaacuugucauaagaucuucugccucuaccgccagaguccuuaucugucuguuguuucugaugcauauuguccuggcaagcuuuuauuuugguucuggagaucugaacucauguauguagucaaugcuuguucaacuuuauccaggacuagagacaucucucuaguccucuaaaucacauauuuggauccaguuagaaauagcuauaucuuuaaaauauuauuuucuaguuauauaaaagcaauauccuuuauauuuuuuaaaauuacagaauuauagguuaucuuggguucuuuggguuucauacaguuuuauuucuguugggacgaguguggugguacaggccuuuaaucgcagcauuaagguggcagaggcagguggaucucugugaguuggaagccagcauggucuacauagcagguucuaggacggccaggauggguaugugccugaguaugcaggugaccaggaaagccaaaagauccucggaagcuguaguuacaggcaguugugaggcgccugaccugggugcugggaacuaaauuggaguuuucuguugugcuuuugguguauucuuaagaauuauaaucuaaacuaaacuaaacuuacacucacccucugcuguuauacuguaggagcuuacauuuuuauguuuuauugaacacuuuuucuuuugucugucaaaauuugguugaaugauauuuguaugggucuauuuuguuuuuuguuuuuuucugugccauugacgacuuauuuugaaguauuauucuauuacguuuauuauuguggcuuuuguacuguaguaucuaaucuuguuugcuucuucacuaugauguuagcuauuguuagccauuuauuuacuuauuuguuuguuuauuggcagggucucauguagucaagacuggccucgaacuugcuauauagcagagacuggccuuuaacuccuucuguuucuaguuuccaaguacugggcuuuuugaacauauaccaucauaccugguuacuuucuuucuuuucuuuucuuuuuuuuuuuuuaacuaggcaaagaauuuuauuaacccuuuccaaacuuuauucccaggcuucuucagcuuuauuugccgcaaagaaugaauuagguauaagcgaaaacuuaaaagagcugcagugucccgggggcuugggcuuaaaaauauuagagaucuagauuuuaucagacccauaauaaacaaaaaaaauuaaaaagcagucaugauauaaaauagcagcuccuguaauuucugcgaggaucauuuucuucagaaguugcuucaauucaguuugccucauucuuagaagucucaucaaaauucuccaccagaucaggaacuucaucaucaucaaccucuccaguagcaaguggcgcuuuuccauccacagauuguuugggcagagcuucagccaggcuccuuaaacuagucagaccgucugcaccgagcugguuggggaugcugggaagcauuucuguccgcugccuugucucagcguggccuguaauggugaagguguucgcugccagagacgccugaacuuuaggguuguuaaaauggaucacuguuccuugguuuguaaacguguucaccucuucaauaccagagauauugucuaccccuaacuucuuuaaggagaacugcaguuuuuuuaucgucugcuguggcuguucucugaaccaccuucuucuuuuugcgagcaguuccuuucccaccaaugcgcacuugugccugcaguuuggugaguaguucuccugguucaugaucgguucuuucaucuuguuggaguggaaauggcgccgcgcugggaacuaagguucacgcucagggggucucaggcagaccagcugagagaaggcgcacauacgccuccugguuacuuucuuuuuuuuuuuuuuuuuuuuuuuuuuuuuuuuuuuuuuuuugguuuuucgagacaggguuucucuguauagucuuggcuguccuggaacucacuuuguagaccaggcuggccucgaacucagagauccaccugccucugccucccaagugcugggauuaaaggcgugugccaccaccgcccggcuccugguuacuuucuauauuaacuuuuuaauaaguuugcccauauccagaaaguaacuuugcugaauuuuucuucgucuuuuuuccuuuagcuagggauugagccuaagagcccuugaacaaugcuaggucaacacugucauugaauuagacuuccagaccuuuauuuuuuuauuuuuauuuugcuguuugagaugaucuuguuacauuguuuggauuccuuuacuugcuauauaguccauaugaacguuaaaccucccaccacagguucucaaguaacuggaauuacaguuaguuucuuguuaguagcaaggcccugucuugcugagguauugauuaggauugauuaggauugcauugaguuuacaauuuguguaaaauuugcauuguaaggauauuuaucuuuaugucuauauuuacauuuguuggcauuuauuucuuucaagaaaguuuuauaguuuucaguuuggagguuuucuguauuuuuuuguuaguuuuauugcuaaauacucuuuuauuuaaaaaaaaauuuuuuuuuugguuuuucgagacaggguuucucuuuauagccuuggcuguccuggaacucacuuuguagaccaagcuggccucgaacucagaaaucugccuccucugccucccgagugcugggauuaaaggugugugccaccaccgcccggcuaauacucuuuuuuaaaaaaaucuuuuguagcuacugcuauucaaauuucccuuuucaucauugagaaauauauuugcuuuuuguguauagacauguguccuuugaacucuauggauucauuugccaauuuuacauguuuguguauuccuuuggguuuaaaaaaaauauauauauaucauauagucugagacuagaggugauuuuaauuuuucccucaugacuucauuucuuuuucuugcaucuugucacugucugucaccucuauuacaauagugaauagaaaugaugagaguagauauagcuaucagguuuuuaguguuucuaguauauuccuuccuguagauuuagaauucuuuuugacauaauuuucuuucugcuauuaaugaacuaaaauucuuuuuauauuuuaugaauuugauguguauugguauugauucucuugucuuuugucuuucugaaaauaaacauuuuaaucuaaauguauaaaggacauuuuuauugcuuucucuuuuuuuaaaaaaauuauuuauuauuauacauaaguacacuguagcugacuucaaaugcaccagaagaggucgucagaucucauuacaggugguugugagccaccaugugguugcugggauuuugaacucagaaccuucagaaaagcagucauugcucuuaccugcugaaccaucacgccagcccuguaaaggacauuuuaaucccaucacgcaggagguagagguggguagaucucugaauuugaggacagccaagacuacacagagagacccugucuggaaaaguaaaaacaaaacaacaacaaaaaccaaaccaaagaaaaggauauuuuuuuagaguuuagauuucuauguuggcaaauuguuucuuuuagaaauguguuuucucuuauuuuuuagcuucgguuguuucuuaugaaaagcagcugucaauauuguuacucucaaaguaauguguuguuuuucuugggguacauuacauuauuauuuaaaaauauuguuuuauauguaugggucuuuugcuugcauguguuuguguauaccacacucauucuuggugcuugcagagaucagaggaggagguuuugaucucuagagcuggaaguacagacaggccugggccuccauguggugcugggaaucaaacucagcuccuccagaggaguuuucagggcuuuuuacucugcugagccaucucucagccuuucuuuucuuaucuuuucuuuuuuaaccuuugauuucccauagaaagcccaguuugcuaauuugucuuguuuuguuuagcugaguuugggaccuguggguuuauguaugaauuuuggaaaaguucugcaaacuugagacuugugugcugcucacucccuuuauuuguccuuuaggaugguuuggaauugucucacuugucugacucugauccugaucccuuuuuguuucuccuucucucucucucucucucuuuuauuuuagaugcugugcauugaucuuuuugaaucugaauuuauaauuuaugcauguauauauauguguguguuguuaagccuauucaguaacuuuuuucaguaacuuuuucaucuuaaauguuggguuuuuuucuuguuguuguuguguuauuuuuuuugagauagucucacuauguaguucuagaacuugcuaaguaguagaacaggcucaccuuaaauauauauuuuuugcugagucuuacucuuugggucuuuuuacuuuaaacuuauacuucucugccaaaauaaaucauuuccccucccuauugguauguaaaauauauuuuuauaagauuuguuuuaaaagccauucuauuugaguaauaaguuuuuuuuucuuuuucuuguuucugcaucacaguuuccugguuucuuagguauauaaauauuauaggugcuaagaacaguacauuucuaacugcugauucuuggaaaaaggcauguuaacuaaaaggguuuuaaacuaauguauuuuuuuuccugaccugaaauuuacuuauguacugguaugcuacaaccauaguuaguuuagguuuuauuuuauguuguguuuauucaguuuccacuuuguaacaaaauaugcuauuuaaguuagcuaguuucucuuucucuauuugcuuuauguuauaccucuguuuuuggcuuuucagucugggagacuuacuuuaucuuccucuucuuuuuuuuuuuuugguuuuugagacaggguuucucuguauagcccuggcuauccuggaacccauucuguagaccaggcuggccucgaacucagaaauccaccugccucugccucccgagugcugggaucaaaggcgugcgccaccacgcccggcugucuuccucuucuacucuuugauuaguacacagugauuuacguucccauccaaguacuagccaggccugaccaugguuauuuuccaaggucaggcaagauggaauuaauucaguguguuguggccauagauuaacugcuccauugcaaagacuuuagcuuauguuggguagcuuugcuucugaaacuccugaauuuaaaucugucaugucagucuaaggauugauuguuugccccucugcucaucuugaguuuaagaguugaauuauacucuuuacuguuuacuuagaaaguaaagucuagaauugaacuuguuuagguuuuggguuuuuguuuuuguuauucucagcugucagaugaguuuuacaauuuugauuuuauaguauauccagcccuuucuuuuucuauaaguaagagauuuuguuaugacccauauucagacuagaaugaaaauucucagaauuucauuuuauuaguuucuuaauuuuuauagauucaaaagcuguugucaugcucuuaaaaacuaauagauuugcuggaacgauggagugacuuaaguauuccauuuuucaguuuuguuucugauuuucacugaagauaguagaaacuacaggaguuuaugguuaauuuuauuuauuuuuuuaaaauuuauuuauuuuuauauuuugguuuuugagauagggcuucucuguauaguccuggcaguccuggaacucacucuguagaucaggcuggcaucaaacucagaaauccaccugccucugccucccaaguucugggauuaaauucgugcaaccaccacugcccagcuuuuuuauuguuaguuaaguauaguaauaaugcuuugucaaaccucccuucccauaacuuauuuuuuuccccaugagauaaucagcuuuuaaaaaggcaagugaugugaaggaaaguuuuucuuuuguuuuuggaaauguguguguuguaucugagcuuuauuguaauugauuccauaauuuucagagcaauacugcaacuagaaacuuguaugaaaguaaguuuguuuauagcuacuuucauacuguaaaggcagacugaguaggauagagacuacaugaccugcaaaaacauaacauauuuacuguaugaacuuuacacacacacacacacacacacacacacacacacacacacacacacacucacacuuaaugacuuuggaacuagacuuugagcaaauacccgugaguagcauuucaaguuaaguaagugcuccauauuccagauacugcuuuuuaccugucuuuccaaaaaauuucauggagugucuuugauguacuagacuguaauaguaaguucacagucucucucucaauguugucauuucuuguugguuucuuucaauuaguaccuaccucaguucuacuuguaaaaguugucuaaauagggaagaauuucuguauaauacaagugcauuuuuuuaaguccccuagggcuuugcuaugaaaucauugucaugucaaacauuguuaaauagcuaaugcugucuauacuuaugugcucgugucaaugugucgcuuuuccuaaucuauauuuuucuuuuacuaguuuaguuugugcuuauaauccuccuauaggagucucucgaauccuguaguuguagccuuguacuauccucuugaguuugaucaguuuuucagagauuaucuacuuacuguaucuuaagguagauucuauugagacaugaguaaaaggauaugcaggcucaaugagucaaauucacuacaguagaauguauaagacguaaugguuauagugccaaauguauuauuuuuuauuuuuuuugaaguucguagauacagauaauuguggugauaguuaauugagauaguugugcuuucugacuuguuguaggagcauauaaaugauuuuuaauuaucugggggcagaggugggaaauguuugggucuugguauaaaucuuaggaucuuuagagcuaaaaugauuaauguaaagucauacuugagcuuuaccuacaacuauccccccuccaacuuuaaucuauuauccuucaagaaauuagaguaucuugguuauaugaguauacauguugguguauauuuguauguacaugugugcaguugcauauauacauuugcacuuuuauguggagggcagaauugauguuggaaugucuuccucaguuguuguccaccuuauuuuuuuaaaaagagauuuauuuaggcaaaacauucauacauaaaauauuucuuauagccuggcaguaguggugcacaccuuuaaucccaucacucagagucagaggcagguggauuucugaguucaaggucagccuagucuacauagugaguuccaggacagccagaaaacagagaaacccugucucaaaacaaaacaaauaauaaaagauucagcuauuuauauuuuguaugugugugagaaugauuugcuugcaugaauaucuuuauaccaaaaauaucuuuauaucaugugucagugcccaugaagauuagaggaggguguuaguuaaaccccuggaacuggaguuauagacagcuucuagccaccuuguggaugcuggaguugaaccucuugaagggcauccaguccucuuaacugcugagacaucuuuccagcuccuccaucuuauauuugagacaguuuuuuuuuuuuuuccuaauuuuagauaggcugguuggccaacaagcuucagggauccccuuuucucuaccugucuaguucugggggacuauagacagucccuuguuuuuugaauauuugucugggaaucccaauucagauuuuuaguuuguauggcaaaacacuuagaccaagucaucuccucaguucccaacuggaauauuuuuuaaaaacuggcuaucauuauuaucauuuuuaaaaauuaugaaaaucuuacacuuauggguauuuugccugcaugugugucuguguaccauauacauucuuggguagccugcagaaggcagaacugucgaucaagauuucccagagcuggaauuacagugaugggauuuuugaacccagguccgcuuggaagaacaguauguauccuuaauucaaggcuaucucucuaugccccguuacagcucuaugugugugguugugcuauaaucccagcacuugugaaaugaaggcaagagaaucagaaauucaggacagucaauagcauuuaaggauaaucugggauuuaugagacugccuuaaaaaaaaaaacacaaaagacaacaaaaacagaagcagggacuauucuuuuacacuuauuucuuuaaacguguguguguguguguguguauguguguguguguguguguguggguggggcgggcgugggcacgugugcacucccccugccugugugcgguggggcacaguagaguucagaggacagcuugaauccuuccaucugggucucaucuugagccaucuucuuaguaucuucuuuugcauuuagaauggaaccccagacuacaaagcacuguguaauaugaucuuuuugaaugucugaccucaucuuuuuacuacuuuccuucuuggcuugaacuacagugauuccuuuucauuucucaaaaguuccaaauuuguucuugauugagacauuuugccuucuucacucuuuguagcuugaagcaucucuccaaauuaguauaauuggcuuccacaugcccucuaggcuuuacugccuuggagaaacuucugaaugucucugauaaauaaauuagcgugcuggagcucuuuaguauaauaaugauaggcaaacuguugccuacaagccgaauccugauggcggccugauuuuuguccugagagcuaaaaauaguuuuuuuguuuuuuuuuuuaauuuuuaaggcuacaaaaacagcaaacaaacaaaaaacauuaaugugaaagauucuuuguucuucaaaguauaaaauauuuacuguuaauccuuacuuuuacagaaaaguacuuucugaaauuauuuuguuaauuucuuuccuaguuuugcucauuacuccacccucaugcuuucuuguugagucuuggaauguugauugugugaaagaacugagccaauauauauauauauauguauauauauguguguguguguauguauguguguguguguguauguauauauauauauauauauauauauauauauauauauauauauauauauauauauauauauauauauaaaauugcaguugaaaggucagaaaaagcaagugauaaaaaaugguaguugaagccgggugguaguggcgcacgccuuuaaucccagcacuugguaggcagaggcagguggauuucugaguuuaaggccagccuggucuacagagugaguuccaggacagccagggcuacacagagaaacccugucucgaagaaaaaaaaaagguaguugauacuucuuccaaaauagacagaaguggugucuauuuaaacaaucagcucauacgacugaacaacucucauaauuauauauauuaaaggugcaaaugugagucuacauaguauaucucuuacauuguugagcugauuaauaguauacauaucugaaaagucacugaccgcaugcagacaguccuauuauggaagcauauguuccacagaaaaaccacuugaguugggagaugucacacaucucaaauaaguacuguauccuuauggauagguaugagacuguggaaagugaugcucaauauuaauacuuugaugcucauuuuauaguuaguguuggcuaguagacagccaauagcuuaaagaauuucacacucuuaugaaucccacuaaagcaaagcugacuuuuuggcuaugccauagacuacagcaaaguuggugaguuuauuaaguagagauaagggaaacuauuugccuuauguuuuuuuguuuguuuguuuguuuuggugguuuuuuuuuuuuuuuuuuuuuuuuuuuugagacagggauucucuguguagcccuggguguccuggaacucacucuguagaccaggcuggccuugaacucagaaauccaccugccucugccucccaagugcugggauuaaaggugugugccaccauaccaggcucucugccuuagauuugaaaaugcacaggcauuuagggaaagggacaugaaugaaguauacauuacauuuccugagccauggguauaagcuucuggagagaagauacuuucagugucuuuauaguagcugugucuguguguaauuaugccuuuaugaguuucuaaggauauaauuuacaagauuuaaaaauuaagcaaaguucaaaaaaaauaaaguuuaaauuaaguaagaauuauaugaggcuacuuuucuuaaauaugaguuacuuaaagaauuuggguuuaagaauaagaggagugcucuuacacuuaaacucaagguuacaaguauuuuguuuucaagcaaacauaguuuauuguuucagacauccuuauuuaagaggucuuuagaaaaaugagcauaauaucauuaguugagaaguuuuuuugagucuuaggcaacuggaaucacaaacuagaucccaaggugaauggguucuuuucauuucugcaccccaguaauuuuuccucuuuuacugucuugccucaauuaaguauaucugucuuuaacaagaucuccaaaugugcgaacuuuauggaagacauaaguagcuauggauauauucacuguaguucugauucccaagacacaucaaaagaaguacuuaagugcagguuaaucugaaauaaauuuuaggauaaaaauaaaaugugaagagaguaacucuuauuuugcuuuaccucuaaauuugcuccugcauguaaguauuauauauuauauuccuaccuauaauugccauuuccugauuuuucuucuaacccugucuuacuucaaaugcuaaguucuacucauuccaucugaucuguugccuauguugacaguuguaauaguuugacauuuauuguauuaauccaaaccucuuuuuuaaaagcuugaggacaaauuuuuguuacagccugaaagaaaaauccaaaggcaagaaaguugccuggaggaaggagauggagaaaaggaagagagaaaaccaugacuuucugaguuaggcagggaggguugguacgcagccacaugcacaaaggagggggaguagaagcuucagagaaagaguaaggaguccuaaagugucaggaaguacauaccuacacaugcuuacauacuuacauauacaucauuaaagcacacacaauaccguucauuauuaauaauuauuaauuauaugauuaauaacaacaauugcucacuacuaauacaucauuaaaaauaguaaugcuuuugaaaauuuuuaaauacuguuauuaggaggaguaaguauuuugaagcuucugacucuccucuccuccauuuugguggugauuguguuaaauauauagcucacuuuugguuacauccaaauuuuuuuauguuugccagaaggauagcaagugaucuuggccugagccaucucucaaauccuaacaaagccaauuuuacgauauuaguuuuuuucuguauguuuggaaguucugcaugcauguauguaugaaaguucauuugugugugcagauguguguaggcucuuuggugucucuuaauaauauucucuauccuaucuauuacgguaacuugucuuacuuaauuuggggcuuguuguuuuaguuagucuugauugucaguuuguauuggagagacccugucuuugcugcucacaugcuggguugccuugcuuaucuaccuuugaauguggcuucuggagcucucagcucuugagaugcuugugucacagggaugaacuuguugagccacuucuuuucccaugguacuaguuuugauccacgagcauuggauauuuuuuuauauucuaaugucuucaguaaaacgucuucauuguagcuauucaccucuuuuuaggcugcugugaaugggguuguuugcugauuugaauuuuuuucccagcuugcuuauuaaugcuguaugaaaauggcuuguuuccuauauguugauuauuaauuuauuuuaucuugcuacugcugaaaguguuuaucggaacugagaauuuucuggcugcaucaucuuuagugguuuuuuuuuuuuuuuugauccccccccucuuugucuuucuaugguguguguaugaguguguguggguguuugcacuguguguguuugaauggaggcuuugaguguccucucauuauugugcaccuuuuuccuuugaggaaggauucccugaacuuggagcuuauuuuucaucuagcuuggcagccagcaacuuacuugcaacucucucaucuguagcugcucugcuauuuuacuacuuuguuuucaauacuucaaauucucuuuaauagucaaaagaugcucauguaaggaaaaaaaaaucaaguuucaaaagugcauaauagguuugcaguaaggcuuaagcgaugaaaaaauauugcuuaaaaagcauaccuauaaugcucauucaaauugauaaggaaaagagaauucaugaaaagggaaaaauaaaugaucagcugacauggcaaaugaaaggauuagaguaacccagacuuacuaauaaucagagagaugcaaaauagaaugaacuagcccuuuuaaauguauuuugacugugugugugcaugcauaugcaguguaccacagcaccuauguagaggucaguggacaacuugaaugaguugguucuuuucauuccaucauagaguuugccaggcaucaaacucaggucaucaggccugggagaaggaccuuuauccaaauagccaguuuaccagaccucuuuucauauauuagacucaguucugacaaaauuaauguuugauauggaggcagaaaauuugaacucuuucauucuugcuuccagaacuauuguucaaauaacuuuuuaaaaauaucugccuucuuccauguuuuuauauagcagaagguccauggcccauauuaaagguguaucccccugccucaagguccagaucaaaagguguguugucuuuccaccucaaagggaacuagucauaaaucacccacuucaaaccaaguaguaaauuucuuucuuucuuuuuaaauuauuuucuuuauuuacauuucaaauauuauccccuuuccccguuucccuucugaaaacucccaucccauucucccucacccugcucacccccuaccccuccaccacacacacaccugcuucuuggcccuggcauuccccuguacuggggcauagaaccuucaccagaccaagggccuuuccucccauugaugaccgacuaggccauccucugcuacaugugcagcuagagccgugagucccaccauguguuuucuuugguuggugguuuagucccagggagcucuggggguacugguuaguuuauauuguuguuccuccuaugaggcuucagaccccuucagcucccuggguacuuucucuagcuccuuuauuggggaccuugugcuccauccaauggauaauugugagcauccacuucuguauuugccaggcacuggcagaagcccucaggagacagcuauaucgggguccugucagcaggcuccuguuggcaucugccauagugucuggguuuggcuuaugggauggauccccaaguggggcagucucugaaugguuguuccuucagucuuugcuccaaacuuugucucuguaacuccuuccauggguauuuuguuuccccuucuaauaaggauucugaacuucugggcuaauauccacuuaucaaugcauaucauguguguucuuuugugauuggguuaccucacucaagaugauagccuccagauccauccauuugucuaagaauuccauaaauucauuguuuuuaauagcugaguaguacuccauuguguaaauguaauacuuguucuuauacagugaguuuauguucagaaagcuguagucaauaugguuguuaaagcuuucauuuuugaaaacaauauucaaugugacugcucaguguuucuaucuuuuguguuccaguucuuuugccaagaaaaugguuugcccaguccugaccacauacuguccuuucugaugggacaagauccaauaugaauguaagugauggaggaagacgacgcuuugaggauaaugaacacacauugcgaauauauccugggacaauuucagaaggaacaauuuacuguccaauuccugccagaaaaaauuccacagcugcugaggugauugacucccuuauaaacagacuucaccuagacaagacaaaaugcuauguuuuagcagagguaaaggaauuugguggagaagaauggauacucaauccaaccgacuguccaguucagcgaaugauguuguggccccgaauggcuuuggaaaaucgcuugaguggagaggacuaccguuuucuucugcgagaaaaaaaccuugaugggucaauucauuaugguagccuccaaucauggcuacggguaaccgaagaacgccgcaggaugauggagcgggguuuucuuccacagccucaacagaaagacuuugaugauuuauguagcuugccugauuugaaugagaaaacucucuuagaaaaccuacggaaucgcuuuaagcaugaaaaaauuuauacuuauguuggcaguauucuaauagcuauuaauccauucaaauuucuuccuauuuauaaccccaaauaugucaaaauguaugauaaccaccaguugggaaaacuugagccccacauauaugcuguggcagauguagcuuaucaugcgaugcuucagcgcaaaaagaaucaguguauugugauuucaggagagagugguucugggaagacucaaagcacaaacuuucuuauucaccaccuuacugcucucagucagaaaggauuugccaguggaguagaacagauuauucuuggagcuggaccaguacuugagguaagguauauagaaauaguuuucucucccccugccccccuuuuuaaaaaaagauaaagucuuucuacauagcucuagcuuuccuaugcccagcaacucucuauguagaccaggcuggcccugaauuuacagagauccacauaucuuugucuccuuagugcuaggauuaaaggcaugugccaccacacucagcuagaaauaauuuucuuaaaucuucaaggaaagauugguaaaugugagaagaugacaucauuuuuaguggccaggggaagcucaaaguggcaaagaaacaaggcagauaggauacuaauuuaucuuuggaagugauucuuacaggaguuaggauugcuugucacucagugauaagagcacuacuugauauguguaagccaugcauucuaacgcuaguacuaucaaaagaaaaaagcuaaaaagaguuucuuuugagucacuggaauaguagccuaucucuuuacaaagaagcaggacaaaauucuauuuguauuuggcuugacaaagaacaugaaaacugggauucaauauaaugugauacuucuggaaauaaaguuucucuagggugugauuauuaguuuugcuacuuguucuugguuguuuugugacuucugaacuaauaucuuaaauacuguauucuuuuguacaugggaucauauaauucuccauuguuuuuugugguugugaauggaugggaacauuuaaagaugcccacacauauuaaugcucucagguuuuucuuugaggguuuguauucuuguugaagcauucuuuuuacccuuauuaagcugcuaagaaucaacuucauuuucucuuuuauuuucuguuucauacagccucaaauucaaauacaagucugagcucuuuucugaauauacauauauauuccuugacguuugcaaacgucgugcaugcacauagcuuucuacauguauagcaaucuuuaaugcuuuuuuaaagaaauuuuguauuauuauuuuaugaauaugaguguuuuggcugcaugcauguuugcaugugugcagugcuggcagagaccagaagaggguauuggauauccuggagcuaaaguuuucaguggguauuagccccauuagaauuaaauacugguucuuucagagagcagccagugccuuuaacugucaagucaccuaucuuagcccugucuuucauaccuuuuuuuuuuuuaagauuuauuuuauuuauuuuauguauauggguacacuguagcuguacugaugguuuugagucaucauguggaugcugagaauggagguugcuuacucuggucagccccgcucgcuccugccuaaagauuuauuuuuauuauaucuaaguacacaauagcugucuucagacacaccagaagagggcaucagaucucauuacagauguugugagccacuuugugguugcugggaauugaacucaggaccuucagaagagcagucagugcucuuaacugcugagccaucucuccagcccuuucauaccuuuucaagccuguuuuauacauguaauuaugagguccacuuuauuauuaccaccuuagguauuuuuaguacuuaaacaguugccucugauuguuuuggagaaacaaacaugaugguguaauggguguggagaggcuauuuucagugagugaucaguaagucaguuuagaugaagacaacacuuugagauuuuuuucuggaaaugcuagacagguuaaauuguggugaccagugcuguggaagaaccucagccuuguucuaguggugucaacacugcuugucauuauccccuugccugguauacacuuugggugaugauacagaggacauauaguugucuuaucaucuguacaauagcuuuguuuuaaauagauaauuauaguacuuuacuugaauuucauuuguguacuucuagaaugaucaguuuuuauguaauuauuuucuuagccuuuucugcuuugcaaaaugcuuuaguauaaacuuaagaaauuugcugcccuuggaauaugaagaaaucuugacauuaaugagauuauuuuauuuuaaaagaauuuguuguauuuaaugagccucuuuguguggcuucaagccaccagcauacuccaacccuuccuccuccagaaaaacaaaaacaaaacaaaacaaaaaaacccuacuccacauccugaauuuccuccuuagcuuuucugcauaugcauuuugucuucacaaugacaggcugcuuaugcagaaucauguuagugauggggcagcccugguccuguuuuuggcaucauuuacccacgucugcucacucaccaaucuccaaaguuuuccaaaguugacagguagaagcuuugguuccucuuuaucugguaaugcugguaaugccauuuagaaucaucugaccauauucguuguauuugguccuguggugauuuaagccaucagcauuuccugggccuccuggguacuucugguguuuacaaauguggcuauugcuauggcuuccaugacucugaaguugcugggaacaaaaaaccauguguuuguuuguuuguuuguuuguuguuguuuuucuagauaggguuucucuguguagucuugacuguccuggaaugaucuguagaucaggcuggccucaaauucacagagaucuaccugucucugccucccgagugcugggauuaaaggcaugggccuggcaaagaaacauauuuucauuuuauuacuuuuguguauguguauaugaauauauguguuauauguacacauguauguggguggaggaaguaccuguagacauagaaguagaaacaagacaagcauauuguucuacacugucacugucuaucuucauuccuuugaggucuuucacuaaaucuggaaccaauuaaauggccagcaagucucaaccuuccuccucuccaucugccuauuguguuggaguuacagguguugugcauccccauaaugggcuuuuuaacgaauguuuaaaaauuauuuuuaaauaaaaacuauuuauuuuuacaggccuuuggaaaugcaaagacagcucauaauaacaauucaagucguuuuggcaaguuuauucaaguaaauuaccaagaaacaggcacuguacuuggguaaguacugccacuuuagaagcacccccccacacacauguauauauauuauauaugcacauaugcuugguacauauacacauacacacauuaaaaucuaauuuauuuucaguguauguguauaccauguaaauucagugcucuuggaggauagaagagagggcaucaaauacccuggaacuggaguuacagaugguuguuagcugccaugugagagcuaggaauuguacacaaauccuuugaaagagcagccauugcucuuaauugcugaguuauuucuccagcuccuggagcauauuuguauuuuaguuauuacuaguuucauaagcuaugauuaugauauugauaucugcauaaauuuuuucccacauuuuuaguggguucaaacugaaaaaguuguaggacuaauuauaaugagaaaguuguaagacuaauuauaauucuuaacaugcuuauacuuguuaccuguugacaguugcauguauuuauguuuauauuguaaauuuucuaaaauuuauuuucaaguuaggaacugauccuuuauuuuauuucugaagauaaucacauuuuucuacauaucuaaguuaguauucucccaaucaagguauuugauuuugauacaauaaaaagccguauauuuucugugaugagucaucugauuuuccuagcaauguauuuuauagguuaaagauuaacaguauucuuuagaccagcuuuagauuuucaacagaaggaaauggaaauuacagaguucccauauaucauuuccaucucuuccagcauagcuuuccuuguuagaaauuuuguguuggugugcucuguuuguuaaaguugaugagcaguguuguuacuauauuuuuauuaauugugaaauuuauaacuuguauuaauguuugcucauuguguuuuacauucuuuuggcuugagaacuacagagaugcuauuuacaguuuccauuuuaguacagacaauauaguuuuacugugcuaaaaaucuuuuguguuuggcuuauucagccuuuuuaccuucuaggucuuuguaacuacuggucuuauccugucuccauacuacuuuuuccaaaauguagaguuggaaucguauuguagccuuuucaguagcugaaaugcauauuauguuaauguugcauauuaaaucucaucaaaguuguguuugggaucuauauagauaaacaugucuuccuucugaaaugcauuguacuuuuuuucucucucuaauauugaacuauuuugcauuucaggaaaauuucucaauacaaacucauacauauauaccauacauguaaauuguuauucuucuaauuuaugguuauuauuaugauuuuuauacccauauuaauagguagaugauagcuuauuuuuuaugcuauuugaauuauaccucaaucuuauguauuucuuguuuaaaaaaaaaacauggccaaaacuacugugcauauaauguuuuugcccaccuuugaagaaccuaaaaccaauguuaucaacaaccacaaaaguccaugggagauguucaauagcaguuucauaggucauuucuuuucuugauucuugagacuuaccaguuuacaaaggcucaguugguacuuuuucucuuaaagugggauauggucaaggaguuaggcuuauaguuguguuucagaagagaauggcaauagguaaagccauauguauugcuuuuaaccccaaauguaauaagaaucuucauugcuuaagauaguuuugugaauuagaaaauauaugucuaguuuccuuuauugaaggaaaugcaggcucuucuguugauuucauaaaaauguuuaaacauuuuuucuauggggaacacaaaccgaguaaacaauauauuuggauugaacauuauuaacucauuuuuuuauuuauugagcauagauuuguggggugcauuuugaguaucaggcauuguuuuaaauauugaagauuaagaaaaccuauguaaacauguuuuuugccuuggacuuuuucauugucuuuuggggaaauaugaauauaggcugauuauaguaaaugauaauucguuugagguauguuucuggaggccuuaugaaaaacauugguauuuauguugaguauuaaaaauuugccaagugaaaggacaaggaaauaauuuuaugaagugagaaauugucuuuaguaaaugacugucaucauaacaagaacuuauauuugaagaggcaagaaaaauauguguauagcauuaucauagagguuagauggucaaauugaauauaaaacuaauauaauuaucuugacaucgugagguaaauuuuagauaauuuuauuuaaaaagucaaauauacacaaaguagaaaaaaauagagcaaggacauccuagguagauucaauaaugauuaugucuuaacauauuuaauucauuugucucuucuuuuucuucaacaaugauuaagucuuaaccauauuuaauucauuugucuuuucuuuuucuaagcuggcuuuaaauaaagucucagacauaugugaucuguucagcacugugcugagcagauaaauguagaagcauaauaugaccaucucauucucuguacugauagcuuguguucuaguagaacucauggauuaggauggaagaaaaagagaugucuaggaaguaguaaaacugaaagucaggcuuuguagugaaaucagacaugggcucauauucauaugaugacuguugcugauugcuaguagaugauuuugauuuuuuuuuuuuauuuuuaaaacaggguuucauuguguauuuacucuugauauguucacuuaucucaugcacuagccauuugaugacuuaggauuuugagaauuugggcuggugagauagcucaguggguaagagcacccgacugcucuuccgaaggucagguguucaaaucccagcaaucacaugguggcucacaaccaucuguaaugagaucugauuccgucuucuggagugucugaggacagcuacaguguacuuacauauaauaaauaaauaaauaaauaaauaaauaaauaaaucuaucuuaaaaaaaaagaaagaaaggauuuugagaauuuaacauggauaaugcuaauaucaucucuaacaguuagaaugguggauguguagcugucaucugauaaaugauccuuacaguuuugaacugucuaaauaaauaaaaucuauguuauauuaaacuuuauuauuuauauaaacuaauuuuuauuauaucaaccaauuuuauuuuuuuccagggccuauguugaaaaauaucuucuggaaaaaucuagacuuguuuaucaagagcauaaugaacgguauauguuuuuauuuguauucugugguccuuauuccacuguauauugugcacagauuuuauauuuauauuaacuacuauuucuuucuuggguggaaugcuauauuuuuuaauucaguuggaagauuuuuauuggcuauugucuuagucagggucucaauuccugcacaaacaucaugaccaagaagcgaguuggggaggaaaggguuuauacagcuuacacuuccacacugcuguucaucaccaaaggaagucaggacuggaacuuaagcaggucaggaagcaggaacugauguagaggccauggggggauguuucuuacaguaggcuugcuuccccaguuugcuuuuuuuuuuucuuccuucgagacaggguuugcccuggcuguccuggaacucacucuguagaccaggcuggccuugaacucagaaauccaccugucucugccucccaagugcugggauuaaaggcaugcgccgccacugcccggcuaaaccuuguauucuugaaugaguuucauaggcacagugcguaucuaagaguaacaaaauuaauuuaaaauuuuugucaauauacaaagauuuauaccaaugaaaacuuuaaaccuguaucauaucaauucuguaccaauauaagaauaauguaacuucaauucuguaucagaaauuagagauuucuaccauuguaaaauuaugacuauaaaauuuuuuguauaagaguaaguuuagcaauccaucccauauaucuauuuucuuauaauauuaugcugucccccuuuuucuuuucaacccccuucccuuuacuuaagaaagaaaagauagagaagaaggaaagacagaaauccccaagucuaaguucuuuauuuaguuuucucccuguccaaaauuaugaccauuuccaaauuaucucuuaaaauaccagucuauuuauaauuuacaaaauaaccauaaccagacacccaaacccaaggaauugggaugaugauccuccauagcuucuuccugcugaauuggggcaauggauauuauuuuuuuuaagggguggggaaggguagaaguauuggaaaaauagguuagacuuaagaaagcuagcuuuagcauuuguuauccagucuguguaugcuuaaaaaguacagggcuugacugauauucugacuggaucugucugcaagucuggaugaaccgaggucaucgggaaucagcagcuauuucugaagcuguucgaggagcaagucucuggaagcagcaucaagugaggcaggauuacgcagggagcuagaacagcaggucuuuucagcaucccugaggaugaaucuugacagagcugcgucuuguucauucugaaauauaugaaucuuacaacaaaauuuuuaguacuguaagguauuuguaugaauugugcaagguguacagauaaguuaaggauacauauuugcuccuuguuugagcaggugaaagacaacugucuuuuuuaugaccaaacaaaauaaaaaauguuucuagaauuagucauguucauuauauguuuuguucccaacaggaacuaucauguauucuauuaccuucucgcaggagcaagugaggaagagagguuagcauuccaccuuaaacagccugaggaguaccauuuucucaaccagguaagaacucaugaaaaacauuuugaaauguagagcaugauuaaauuuuaguuacugaggaaguuuuguagugcuuuuauauauagauauauuuugccuuuauguagacaguccaaaaaaauuauguggcauauccuccaaauuuaaaaaggauuaucuacuucauauaagggguaaaaauuauguauguuuuaugugcauuuugugagauucuuuuaauaauauuaaacuguuuuaucauacuuucuuaucagaaaaauguuacauucuuuuugucaugaaugaccuuuaacauacccaggauguuaaguauaacuguugauuaaugcuugcgaauugcagagagauugcuuugaacuugauuugcauguuuuguacucuaaugcacauaugucugcaugcuaugauacuagcauagaauauuacuguauaauuuaaugaacaguccucuuaaacauucuauagaacccgggcauaauggcucauuccuguaauccuaagucauuugggaagcugaugcaagaggauuaccaugcuuggucucuauaaugaaucccagggcagcuugugcuacauugugauuucuugugguuaaaaacaaaacaaaauagaacaaagcaucaguaugaaauuucucaaaggcaaaugauguagagaauguauuuuuuuucuuuaaaauucagaauucagcuuuaagcuuucauauugaggaaugaucuucauacauuuuucagauauagauuucucuauuuuucuauuccucauauuaaaauuucaaauccaauuauuaguggaauuguuacuauaguauauuacuuaaagaauaaaauaaucccucauuuuuuuguuugagggaaaauauuauauuuauaggaaaaaugucuuuaugacaaugaaaaguacccuuaggauuuuuuuuaauuuaauuuacacuugagugaguaaaaaauuuucaguuaaauauuaucaaaguaacaccauggacuuuucuucaaauguacaguaugcucuaccugguauuuuuuaacuuuacaacuucauauuaauauaaacuuccuuaacuucauguuaauagaucuagaacuuagaaauuauaucacuuucuguuugacugcuaggguauuuuaacuauacauaauuaaguauauuuuuaaaaaauuacuaauucagccugaguaauuauuuuuuuuaaacaaaguuguaagcacuuagaaaugagauaauuuuuacugauucaguauuuuauagucuuucugacauuuuuuguguaaggaguaguaacagcauacaugcauaauaucaguacugauaggauaaagaacuuagugauuaauacaaauaucaaagccacugggcaaugacauguauaaguugaauagaauaauaauaaucucccagaauuucaauauuuauuuaguuuuuauuagaguauguugcuauacaaaaugcaucucagagaucauuacagaaguauaauuccacccuaauaacuucuaccuaacuaauguaccuuacuuucagauaacaaagaaaccucucagacagagcugggaugauuauugcuaugauucugagccggucaguacaaguaccuaaauauuuuuuguuccuguuaaagggacuucacauugcucauucucauucaucuuuaucagucagcaugaagaugagcugauacaucaacaaugcaaggaaagaggaucacuaguuuuuauuacuuugaaugguugauuuguguguaauaguuuguugcuagaccaauuuacuauuuuuauauauugagcuuaauguuuaaucuucauuaaacauuuacuuucacagagaguacauugacugcaucccugauggccagcacuguaguggcuguuucaacuccaguaauuccccuuuccccucaagguuuuuauuguuuuuguuuuagugcagugugacugcuaguuacacucuuuaccauuaagcuucauccuuaguuugaugcuuacuuuuuggaauuauuuuuaguggcuaaaucgauagcuuagugguuaagaguguuugccucuuuucuagaggaugagaauuuaguuccaaggacagugucaaauggcuuguuauagcuaccuguaacuccagcuccaggugauguaaugccaagcacccaguguaaaguggcuuguuacaacugucuguaacuccagguccaggugaucuaaugccccuuggccucugagaacacacaccugcauccacauguacacacacacacacacacgcaugaaucaaauaaaaauaagucuuuagaaaaugaagugacaucacuuuuuaggaacuagggagauagcucauuagaggaaaugcuucuuguacaaacaugaacacuaaaguucagauucuguacuccacagcugaggguauaaaaaggcagaaaccaugagcucuuuggcuaauuaaccuaacccuaacugaaauaauaagucaaguucaaugagagacccuguagcagauaaauaagguggagaaugauagaggaugacaccuguuguaaauuucugccuuccacauguauuggguauuaaucuuuuucauauaaacugaauguuuauaaugaauguucuuuuucucuguuuuuuuuguuuuguuuuguuuuuguuucuguuuuuuauguguaauagaagcuccuauaaaaacuuuugucuggcagggaaaaagugucuuuaaucucagcacuugggaggcagaagcaagggcagaggcagaggcagaggggcagaggcagaggggcagggccagaggggcagggccagaggggcagggccagaggggcaggggcacagaggggcaggggcacagaggggcaggggcgcagaggggcaggggcgcagaggggcaggggggcagaggggcaggggcagaggagaaggggggcaggggagcagagaggggcagagaggggcagaggcaucucugagcuugagaccagaauggucuacagagggaguuccaggauacccagaaccacacagagaaacccuaucuuaaacugauaggcaaacaaacaaauauacauacaaacaaaaaaccuuugccuuaaucaccgcuaaauuauugauauucuuauaagcaagauuauuuuaugggacuggucagauggcucagcaguugaccauugauucauugacugcuuuuucagagaacucagguucaauuuccagcacccacauggcagcucacaacugucuguaacuucaagaucugacaccuucgcgcagacaugcaugcaggcaaaacaccaaugcacauuuuaaaaaaagauuauuuuguggaacuagaaagauggcucaggccaggcagugguggugcaugccuuuaaucccagcacuugggaggcagaggcaggcggauuucugaguucaaggccagccuggucuacagagugaguuccaggacagccagagcuauauagagaaacccugucucgaaaaaccaaaaaaaaaaaaaaaaaaagaaagauggcuuagagguagcacuuuuuuuuuuuuuuuuaagauuuauuuauuuauuuauuacauguaaguacacuguagcugucuucagacacuccagaagagggcgucagaucucguuacagaugguugugaaccaccaugugguugcugggauuugaacucuggaccuuuggaagagcagucgggugcucuuacccacugagccaucucaccagcccgagguagcacuuuuugcuacugcagaggaccaugacuuaguuccuagcacccauguuugacacccguuacucaaguuucagggauccuguggccucucuuagucucugaaggcaccuaaauucauguguauauacuuacacauagacacauggacauuacacagaaauaaaaaauuuuuaaaaauguauuuauuuauuuauuguauaugaguacauuguuacugucuucagacacaccagaagagggcaucaaaucucauuacagaugguugugagccaccaugugguugcuaggauuugaacucgggaccucuggaaaaagucagugcuguuaaccacugagacaucuuuccagcuccagaaauaaaaaucuuaaacgauuaucauagguuuuaaacugaguuauaggaaggcauaugugguagaaaauggcuauguguaacuguguucuauuuuauauaaguacaaauuugaaaccauaaagugaugacaaaaaugccuuucuuuccuucuuucugucuuucuuucuuccuuucuuuuuuucuaagucacuuauaaaggcuaaaagcauagauaacaucuagcuauacuuauuaacuaaugaauuagguuuuaaaauuacucuucccauaaacauagcaugucuuaaucuuugcuuucucauugcaugucauuguaaacaauacuaauugcaaaguuugccuaugccacuugugaaacaucagcauguguaggugcuagguuuuuccuccagacaaaguauacuuucaucaccauuucaagaaucauuucauuacauaaucaagaauguauugguuuuggauuuaauaguucuggaaauagauaucucaguuuauauauuauugaugaauuauaauauaaaaaguauaauuuauuuuacucccaagaagcucuucuggucuauauuucauuuaucacaccaagugaaucaugccucuuuggaaagcagguaggccacugcaaacucucugcaaauaugauugauuacuuguacauacuuugcuauggaacuguagauuggucugcauuugucugaaauuaaagugcugcuuaagaauaugaugugagaauacuagcucauccacuuacugauauugagacccucagaaggucacuuaauuuuuuucuuugcuuuuuuuuuuuaguuaauccuuuuauucuugccuucuauuucagagaacaguggucuuugaucaucucagcauguauguguucuuugcacuuuggguuauauuauauagcaagacuuugucucagaaagaccaaaaagucacagaccuguaaucuagcacucaggaaggcugaggcaggaaugucaaguuuagacuagccuaugcuacuuaacaaauaugaggccagcuugaacuaaauagugaaauuuucuaaaaacaaaaaccaauaacaacaacaacaauaacaaaauaaacaaaaaucaagcaaagaaaaaaaaucuucaaaaauggucuucagaauuuguauuaaauuugauaauagguaugaagaauuugcuagagaacugaacacugaagugcuagggaaaaaugucacuucuauaguugcugccaucauuggaaucagaguacaucuuuuuuauuuaaaggaauuuuguagcuauaauuuacacgugugugcaugugcgcccucaugugugccuguuuguuuuuuuuuuuuuucuauuuguuuagguauacauauguagaagguagagaacaauuuuguuguucucagcuguuuuccacaucuauuugucuguuuauuuuaagaccuugccuuucacuggccugcaacuuguaaguaggcuagaguggcuagccagcaagacccacccaucgccaccuucauagugacacuugcuaccauguccagcuuugaaaaauguggccccuagagauuaaacucaagcuugaagagcaaguauuuuaccuaauggaauacuaccccagccuauaauuuccuguucuuaauacuccuuucagcacaguuaguccuguuuauuauacuuuucaaauagcuagagcucgacuuugauugccucucuauuuaguccuggcugucuuaggacuugguagguaauguaauuuuuaaaaguuuuuucuaaaauuaaaaaaaaaaaaagaguaaaaaaaaaaaaguuuuuucuguuuuauuuuuccaagacucuaguuuaugauuuagaaaaaaaauaaucuauaaaaaacuaggauggggaauggagagagggcucagggguuaagagcacugauugcuuuuccagagggccugaguucauuucccagcauccacaugguagcucucaaccaucuguaaugggagcugauacccucuucugguguguaugaagauagugaccaugugcucauauacauaaaauaaaacuuuauuaaaaaaaaaccuagggauaaguauacauuucuacuuauauauguuuauguuuauacugcccugcuagccccaaacucacagagauccuccucucucugccuuugggauuaaagguauuugucacuacacccagcuccugauucuuuuucuuccaggugaauucuaaaaaucaacuaaucauucuguguaucuguguaguguauucuuuccuauuagguuuccuucauuguauguuugggggaauaaauuaaaccuaauuuucccauguaaguuauuugaacuuacaugacuaguauuguccaguuauugaacuuguaaucuguuuuauuauauaagauuauuucuucaucuuuugagacuauagagacuauaucugacuaagagaugauaugacugguggguagauauuuaguaaaugcauauuuuccaucuucaauggcuaauaguauauucaaauuaaggcuuuuuauuaucauuagguucucuugaccuuuguuuugucaauuauaaaauauggaugauaaauaaaauaccuagacuaugugguguuuuuuguguuuguuauuuuugucccaccuugaacucucugcugcccagaaugaucuccaagucugagguaaucucagagcuuuagcugaccucaugcuuagauaauaggccaccauguccagcuugauaauauguuaauauguuaucauugugacuuaaccugcucugugcaauuucaaucuaaagaucuaacugcuuaaagucuuuuauguuuguuuauuuucccaaacauacaguucauucaugauuuagcaaaaaaaaauuauaaaaaacuagggauaaauauacauuuauaguuaauauauguuuauguuuacacuuaccagcgcuuacaacucucucaguucuaguuuuauauuguuucccagagauaaguuugagaucaagcucuaguuauauacugggaugguuguuuuuaguuuguucuagccuagacucaccugucaaaagagucucaguugaggaauuaucaagauuaauugucuucugggcauuauacagaaagaucuaguccauugugggcggugccauuacauaauuucgggcccuuuccuguauaaacauagagaguacuaggugagcacuacuaauaaacaaccaaacauggaggaucauacauuaauuuucucucugcucuugacugaugugaugcuuuaaguuccugccuugacuuccuugaaaugauggguuuugcccuggaacuguaagcucaauaaauacucuuuucccuccaaauugcuguuuaucagguuguuuuaucacagcaacagaaaugaaacagagcacucacugugguggcuacuuuuguuaugguuuauguuuagcuuaccuuuuccacauuuuagguuuuuucuuccccuaguuauuuuugaaucuugguguguuuaaagacuggcuucuagaaaagacucauauaagauaaggauaguuuuggucuaggaaauuaagucuauccuugcuuuuucucugcaacugucauuacagaaacaguuaaggaaaucaagguaguuuaaaaaaguaaauugugaauuugguauuuccugagaccauaugauacugugugaauaaauauuugauugaggaugacugcaaaucugaaagguuucucuuucagcauguuuuuuacuucacuuucccaguauguuagguuccuguuucauucacuuugcagcaaauaagaaccaccucaauuguaagacuuacugcuguguguguugcauuuauauaaacauguuuacacucucugucauauuauuaaaaauguaauagucuuuaaaauaaauaauggaggucuuggguuaaauaaaagaaaaucccaacacacaugcaguagaggacugcagagucuguguucauucagagaugaugcaccuaacccucuagagacuggaggccccagggaguuuagaugucaggugguggugguggggcauccacguggagacaggggugugggcaggaggugugggauguggaagaauuggaggguagacagggcguggggguauaaaauauagaauguaaaaaaaauauuaauuaagaaacuuuaaauuuguuuuccuuuuuaaauauguuuacuaagugugauaguacauaucuguaauccuaguacuuuuagguugaagcaagaaguuugcuggggguugaggccugccugaauuacagugugaaauuuuguuuauuuuuauuuaagauauuuuuuauuauauacuugaucauauucuuuuuccucuccuuaauuccuccugcaucuuuucaaccuuccuacucaccuagcuugauucacacacaacucucaaaggaaaaacaaaauaaaaaaaaaccacaaaaagacaaaauaauagaaauaaaucaaaagcuaaauaaauaaaucaaaaaacuaaacugaaaaauacccagaaaaucuggaauccucuuuguguugucuggcuacuccugggcauuggaccuguuuggaguuuuguugauauacccagugucaccccauuggagaaaacggauacccccuuucccagcaguuaucauuuccaaguagcuuuuugguaccugguguaacuuuguggucacuucuucaugcugggauuuugucugguuugaauguuuuuagauuuuauguugucagucucugaguuuauuccuguuuugucuguaaaugcuguuucuuuccagccauccaccaccucugcuucuuauaauauuucugcguguuucauguagauccuugauccuugagaggagggcuuugaugaaggcaucccauuuaggguugcauucucuaaagcuucuuacuuuuuugcauauuguaggucuccucugaauuucccaucuacugcaagaagaagcuuaucugauaagggcugaucuuugugcaauauagcaauaugucauuaguagucauucuacuguuauauuccuuuagcacagugguucacaaccuuaccaaugcuguaacccuguaaugcaguuccucuuguuguggagguucuuggguuaaaaacaaacaaacaaaaacaaaacaaaacaaaaaaaccccauacaauuauuuuuuguugcuacuucauaaguguaauuuugcuacuauuaugaauuguaguauaaauaccugauauuuagcauggucuuaggugaccccugugaaagggucgcucaagcccccaaaggggucucaucccacagcuuuagaacugcuguuguagcagaauaguaguaguaguaguaguaguaguaguaguaguaguaguaguaguaguaguaguaguaguaguaauaguguuuucuguccugcccagaacagucuagucucaguuucuuagccacugcaacagugucagguauguuuccaacucaugaaacaggccuuaaacccauucaagaagugguugguugcucccauaacguuugugucacuauugcaucaguguaucuugcagccaggucacacuauuguauguugcaggauuuguagcuggguaauauugaugacuuucuucucuuguaguaugcaaaaaguagcaccuuucagcccuaugaacucuagucaguaguacugaaguuuauagugggcaccagcuugauuuuccccccuuuuuuuucuuuuugguuuuucgagacaggguuucucuguguagcccuggcuguccuggaacucacucuguagaccaggcuggccucgaacucagaaauccaccugccucugccucccaagugcugggauuaaaggcuugugccaccacgccuggcugauuuucccauuuuugaugguguaaguggugucuucagcaauagggccuugcuauuuuuagguuguggaguauaaucaauagccuugacaauagccagugauauuugggaggagauucuguaggaccccuuuugcuagcacaauaagauguaaccuauucccgacacuaagggcuuuacuugguggcuuaaaauuaguugguguauuguuucccauauuaugugguuucuucauuuaaauucuuuucuuuuuuuuuuuuuuuuugguuuuuuuuuucgagacaggguuucucuguauagcccuggcuguccuggaacucacuuuguagaccaggcuggccuugaacucagaaauccgccugccucugccucccgagugcugggauuaaagacgugugccaccacgcccggcuuuaaauuccuuuuuuuauguauauauuuuaagaaguuucuacaguuguaggguuccauaugguauuccaaagggcuuucaguguuaguuuuuaauucccauauucucuuuuuuacccuggccucuuguuuaccucccauuuuaacccuucuguucuaguuuccuuguuaacuaacuccuuacaacauuauauucuguuugcccuuacuuggaagauucucuuucccuccuggcccauuacuagguacccaaacucugagguuauucuaaaugaaacauaugugucuaaaucuuaaaaguaguauccccauauaagaaaguaugcauuguuuguuuaaaaauaacaaagcacaaauaaacaagacuuuauugcaggccaaagaaaauuauuuaaacuuuuggagugugcauguguaccuuuccacauggaaaauuaaaauacauuaguguucuaaacucaaauuaugaauuuuagacuuuguuucaagauguaauugucaaaucauaauaccuaguaaguuuuuugaacauguuguagauacucuguaaauauauuuacaaaaugaagaagcacuuuauuucucaaggucaugcaguucaguaugugauucaaugauuguacaugaaguuaugggagugaaaguauuuauagaccagaagagacacagaaaauuuauuuaagaaaaugacauugucauaagagacagucucaauaggaguauuguccucugagaauguggguuccauauguuaguagauagacauauuucacuaucuuguuaaacaguaaacuucacauaucugucgucuuccaauuggcuauuugcguagaucauuuggaguuagacuccaaauguuugcugagguuacugaaaucaggucccacguagucagggucugauuguuuggcaguuucuguuuuauuuucaacccccuuuucccccacauuuauuucagcaauuugaucucagcacugacuugaugcuuacaauaaaacagaugauuucuuugaauaauuaauguaucauuugcuaggaagauaggcaguaaaaaggaaauugaagaccaagggaagggacguuagggggauggaacggggaguugguagaaggguaaccaggaagggggauaucauuugaaauguaaacaaauaaaaugauuaauaaaaaagaaaaauaaauugaaguuugagauguuuuagauaaccucuuuauaaagugguaugugaacauguaaagggauuguguauguaauauuacuguugacuguuuuuugagcugaaacgcaaaaguuauacuaaaaagcauucuuugguuaguuguuaccuuucauguuuuuuugagaugggaucaugcucuacaguccaggcuggcauagaguuugugauuccccugccuuuguaucuggaguguugggauuauaggcauaugcuacuauauccauagacgcacacagacacacacauuuuaaaauuuucaugauauuuguuuuguguacauguguauaugugguuaccucuuuguacaugugaguaccugcaaaaaucagaagacaucagauucccuugaguuggagucauauguaagcauccagugugagugcugggagcugaacuccagucuucucuaagaguagcaagcacugcuaaugucagcaucaucuccccagcucauaaaauguuuaauguaaauauagugcucaacaaccauauucuuucuuccaucuggccuuaaacucuguguguaguugaggcuauccucacauuccucauucuccuccuccugccugccuaggucuaggauuauggcacaugcuaccccuuuggaguucauaucuacuuuuuaaaauauaauuuaaaacuuuuauauuauauauuauauaauauauuauguauugucuguacauauguguggaggugcauguuugugugugccacagugcacauuccacugcguaggaguguaggucaaagaauaacuuguggaguuaguucuucaguuucccuuuguguauucuagugaucaaacuugggacaucaggcuggucaauaggggcccuuaaccuucagagccauuaugccagcuaaagcuauuuuuuuaaaaaaauuauuuauuauuauuucaugcauguuugaugugugaauguggauacacaggugucaggcauguauguggguuuuuuuuuuaaguuaccaguuuuuacuuuuaugugguuugauuucagguuugucaggcuugaaugauaagugcuuuuuuucuguugaauuaucuugccaucccauaacaacuaaaaaauacuuauuuuuauuuuauuuauguguaugugugugugcuuguuuaugugaaugugugccaaauauaugccugugcccaugaaggccagaaaggagcguuggaugccuugaagcuggaguuccaggugauuguuagacaccugaugccagcacaaggaacuaaguugcuucuucuggaaaaacagcaaguuuucuuaaaugaucuuuccagcccgaauaacuuuuuacugauuucaugugacauguuuuucuagggucuucuauuuugacauaaugcuuucuaggggucuucuauuuugacauaaugcuuuuccccacucucaugaucauuaugguguguguguguguuuauuuuuacuauuauuauauuuucuuuauauaucuacuauaacaccaacugguuuauauuauauaaaucuaggcuucacuucucaaccauauacuauccugauuuuuuuuuuuuguguguguguguuuaauucaagacccuacuuuugagugcuauuaaaaucaaacuugcuauccacauauuuuauaaauacugcuggcuuucuaacuugucucuuuugacauccuaagcugguuauuguuaagggaagauuaaaaaguacuauuaauauuugguagguauguuuacuuuaucuuuacucagaagagagguuuaaugggucagauuauauuuaaauauucuguuuuacuuugcauuuacacagggcccuacuuaaauuaauggguggcuuacauuguuuuuaacaaguaaaugugauauauauuuucuuccaccucuugucuuaagcaggauugcuucacaguggagggagaagauuugaggcaugacuuugaacgcuuacaguuggccauggaaaugguaggauuucuucccaagacacgaagacagugaguuuuaaauuuuuucauuuacuguaguuuuauuaucuacaguaguauacaaaacaugaugcgucuguaagagaucuccaucuuaguucuuuuaaaaacauuuuguauucuuugacaguuuuauacauguauacaucuuuauuauuucaucuuuagcuuccuuuuccuccuucuauaacccaacaaauagaauuaguauugcuugcauaggcauggagccuaccugcagucacaucuaugaagaaagaugacuuccucucccucaguagccaccaaauuccaauaacuccucugcuagcaauggagccuugcgaauacuucccuuagccaugcugagauuauucacuagcuugacuuugcucagguuuuugcagguuaccauggagucucugaguugguaaguucagugaccacguaauguucagaagauaccaucuugcagcacagcucuccauuguuuggcucuugacccugucuucuauaguauauucugagcauugugggauuuauauacaagucucuuuagggcaguccucaauaguuacuuauucuuaacacuuugaccauuuaugagucucugcauugacugcccacugccagaagaaucuucuuugacuauaguugacagcagcacuaaucuauggguauaacauauauuuagaaggcaguuugacagaaagucuuuagcaaaauaaugguagugggucccucuacuggggcuaugacugcuuaauuuccugggcccuuggcuaugguuacaguauuagccaugcauuuccccccccuguggagcaggccucagcuccaucaaaaaaaauaguuggcuaucuucacagcagucauuccauauucuuugguucuuuugaacaguuuuauaaauggcaucacuauugccuuagucauauuaaggcuggugagauagcucaguggguaagaguacccgacugcucuuccgaagguccaaaguucaaaucccagcaaccacaugguggcucacaaccaucuguaaugagaucugacucccuuuucugggguguccgaagacagcuacaguguacuuacauauaguaaaaauaaauaaaaaauucuuuaaaaaaaaaaaggguuugaguguccuccugcuccccuuuucacuauauaaucuuugagaaacugauggaagcuaaaauacuuuauuaagauguauguucauaaacauuugcauauaaauugaggacuucaugaagcuucuugaagcuguauauagacauaacuuaaaaacuacuauuuuuacuauauuacuauauuacaguguuuuacuuucuauaucugaucuuuaguguuauacauuucuauauguaauauuacaugcauauuuucauguuuucucuuauuuuaaaauuucuucauauguaacuguagccccaugauaauaaagugcuuuccucccauacacaaaaccauagacucaaucccuggcagcagcacccucaaaaaucaggcaauaaaacaaaacagaaaaaacaacaaaguuuuuauacaugguaauauaagcagaaugauaauguaaaaacuuuugauagggcuggagagaugacuccuuggauugaagugcuugcuauggaaacgugagagauggaguucagauccuuagacacuuuuauaucuagccaauuuuagaacaguuucugaagugugugugagauucauguuacauguaauuuguuuaauauuuaacauacaguuuaaauaauaaaguuuaaaauuacuaaucuuuugugaagauuaaauacuucauacuuuguaugggugaauuuguuuuggauuuuggaguaaaaugagcuuugagaauacacacugcaaacuuuaaucugugcuuuuauuuucauaggauuuucucucugcucucagcaauacuacauuuggguaauaucucauauaaaaagaagaccuaucgggaugacucuauugauaucuguaauccugaaguacuacccauugucucagaauuauuagaagugagucauuugauuucgguucuuauuuuagauacuggguaaugucuuacuuuuauuuuauauauccuuuaacuuguaaguggguuuauuuacuuaaaauuuaacuuauuugauacuauuuuaaaguaauguuuccagaaguuggaaucucucuggaucccugccuuacuugccaggauccugaggacuguguuuucuuccuugccuucacuugcucccaauacauauaaucucucaguuauuugauuagaaugaguauuuccacucuagauuguauaauguccugggcacaugccaguguuggucuuucaauuugagauuuuucaaauugugguuagaugauuugauuugaagauggguaucuuggugaguagagagaauagguagaacuaccaauuuuuuuucuuaagcggcuugaggaggacuuaaaggucaggucccaugcuucuuuguacaucaggcucuuuuccaccguucuucucagaguuaugguguguuguaauuuccagauaacucuucaucuuuccagauuuacccccaucaaauuaguauuuuucuuuuagggcugucucaccugacagaugaagugaauauauggguguauuuuaacuguuuaucuacaacaaauuuucaugcguaaucauuuguaccuguauaaaaauaaugauuucauacucauaucuguaaauucauuuuucaaacuaguguucaauuuuuuccucuuacauguguauaaacucccacuaccucagacagaaaucuaccauuucacccucuauuacucauauacuucucacuaacaggauucauuuuauaacaguauugaauaacaccaguuuccuugugagaaaugguuuuagauuagaaaccaguuuuuacaggugcuccuuuggcuuuaguuguggauugcauuugucuuaaguguuauuucgcucuucaucuuuucuuccucuuucuuccguugagaugauaucauauauuuguuauauagcuagaguaucucaucaugcccuguacuccuucuggaaucccuuucugccuuaaguaauuuuuaaaaauuuguauacaguagggcccacuuuuugugccgaauguuuuuuuacaaauauauaaagucaugcauccacuauuauagucuuagacagaaucuuuucacugcucuaaaacuccucuucacauuaauuuguauuuuucacauguaauauaauuguaguuauauagauauuaguauuuuuggaaugacuuacuuuacuugguagagugcauuuaagaugcauucuuuuagccuagguaguagugguggccgcagcagcagaacaugcacuccauuaaucccagcacuugggaggcagaggcagguggaucucugugaguucagugccagccuucucuacauaguaaguuugagaacagccaggacuauauaaagagaccuugucacaaaaacaaacaaacaaaaacaccauucuuuuaccucuggguaauauuuauaguguguguguauacuauaauuguuaauccacuuaugaauugaagaacugucuuacuuguuucugguuuggagcagucaggauuagcuugauguguuuuuugguuuuuuauuaauuaauuuauuuuuuuacacucccuauuuuauucccaccuacccacccuccaaauguuccacaucauaccuccucccuacccccuaccccaccuuaccucuaaacuuccuggggccuccagucucuugaggguuaggugcaucaccucugaaugaacacagacccagaaguugucuacuguauauguguugggggccuccuaucagcugguauaugcugccuguuuggugguccaguguuugagagauccaacacuggggguccagauuuauugagacuucuguuccuccuacagggucgcccuucuccucagcuucuuucagccuucccuauuucaacaacagaggucagcugcuucuguccauugguugggugcaaauaucugcauuuuuuuuuuaaguauagucuagaguuuauuuagggcauggggaggggaguugagagaguaguagaggcagagaaaggcagacaaaaggagagaguagauaaguggaggcuggccaugaccacguggagagagggcggggggggggaagggaauggagauagagggggcacaaggcggagggggagaggcaagaguguaagaggguaagagagcugcaucugacucagcugcuugcugggucuucuggaguguggucaugcuagguugugagugcuuuguagccucagugaggccuugggaccuccccuugagcuucuuuuccugaggcuccucuccauuuccaucccuguaauucuuccagacaagaacaauuagggaucagaguugagacuguaggauggcaaccccauccuucacuugauguccugucuuccuguuggagguagagucuauaaguucccucucccuacugccuggcuuuucaucuaaggucccucccuuugaguccugggagucuuucaccucucaggucucuagugcauucuggaggguccuccaaacuccuuccuguguuugccuguuuacauucuuucugcuggcccucagggcuucaguccuuuuuucuccucacccaauaccagaucagguuucccucucucccccauuuauccccuaccccauccacuuucccucccuggucccucccucccucccuuccucuccccccacuugugauugcuuucuuuucucucccaagugggacugaguugucuucauuuggacacuucagcuuguugagcuuuuugaguucuguggaauguaucuuggguagucuguauuuuuauuuuuuauuuagcuaaaauccacuuauuagugaguacauaccacgcaugucccuuugggucugaguuaccucacucaggaugauauuuucuaguuccauccauuugccugcaaaacucaggauguccucauucuuaauagcugaguaguacuccauuguguaaaugaaccacauuuucuguauccauucuucuuucgugggacaucuagguuguuuccagcuucuggcuaucaugaauaaggcuacuaugaauauaguggaagacuugccccuguggcauggugggacaucuuuuggguauauucccaagagugguguagcugggucuucagguagaucuacuuccaauucucugaggaaccuccagauugacuuccagagugguuguaccaguuugcaaucccaccagcaauggaggaguguuccucuuucuccacauccucuccaacauguguugucaccugagguuuugaucuuagacauuuggauugguguaagguggaaucucagagucguuuugauuugcauuucucugaucacuaaggacuuuggauauuucuuuaggugcuucuccaccaugcgauauuccucaguuaugaauucuugguuaaguucuauaccccauuuuuugauuggguuguuugauuuuuuuggugauuaacuucuugaguucuuuauauauuuuggauauuagccucugucagaugugggguuagugaagauuuuuuucccaaucuguagguugcugauuugucuuaucgacuauguccuuugccuuacagaagcuuuccaguuucaugaagucccauuuaucaauucuugauccuagagcaugagccauuggaguucuauuuaugaaauuuccccccccccccccccccgugccaaggaguucaaggcuccuucccacugucuuuucuauuagauucaguguaucugguuuuauguugagguccuugauccagcugcuaaagugcuuguuauacaagcaugauuaccugaguuuggauacacauacucaaggaaaagcugguuuugucaugaaucuaggguaaagcuagcacugggcagguaaaugugggagaggauggcaggaaagccaaauauccugagcuuacuggacaaucaggauagccagccagucagugagcucugguuccauaagagagaccuugcccgaaaaaauaagguagaaugugguagaguggccaugucuuaaaucacagugcucaggaagaagaggcagauggaucuuuugugaguucuaggucaaccuggucuacauaguuccaggucagccagggcuauauagagauauccugucucagaaaacaaaaaagcaaaacaaaauaaaaucugaugggcagaaauaagccuaauauugauuccugucuuauuaauuaauuaauuaauauugauuccugucuucuauagcaccuguauacauauacacauccacucacacacccugcacacauacacagcaaauauuuuguacugaaaauuauuuuaugaugggcagaaauaagccuaauauugauuccugucuuauuaauuaauuaauuaauauugauuccugucuucuauagcaccuguauacauauacacauucacucacacacccugcacacauacacagcaaauauuuuguacugaaaauuauuuuauguguauaaguauuuugcuuguauguacauaugugugccacaugugugcuugauugaccaagaaguuuacaagaagaugucaaaauauuuggaacuggaauuaugaugguugugagccauuacaugggcaaucagaacugaaaccuuauccucugcaagaacaaguuuuuaaccacugaucaccagucccccuuuuuauucauuuuuuaaauaauucagucagguguugaugguacaugcuuggaaccccagcacucaggaguuuaaaccagucuaggcuacaaagugagccccugucauaaauaaacaggauaguauugacuucugugguaagaguaaaaacaaagagucaucucuaucucaaaguauaauauucauauuuaaaaauauauuucuggaacauauguacucggaguauuccucaaauuuaaggagugcuccuauccuuuagucuuucuauucauuagauugugaagucuagaaaagcauguguguaguuacauacauacauacauacauacauacauacauacauacaaacauauguguaugugauagcugucugugauucuggugagaacucaugaccuuuuacaggcuagacaagcucucuagaguuaaauacucacuuggaagcaugcauugaaaagauaccauuuguuacccuuuuaucuauuuuagguagaggaauuauggauuagugauaugcuuaaauucuacuuuagucauuauuaggauugccuauguauuuucuuugcauuucuuuauauugauugcauauuucuaacuuucauuaaaguuuuuuuuuuuuuuacuuagcuuuucaauauaagucguuuucucucauaaaucuuacauguugaauauauuauucugcuuucuagguuaaagaagagaugcuauuugaagcauuaguuacaaggaagacggugacagugggagaaaagcuuauuuuaccauauaaacuggcagagguaugauuuucuugugcacaaaguauuuugaauauucuagaauagaguuucuaggggguuuuccuuuccccuuuuuaaaagugaagcugacauuagguaaaauguauuaauuaaaauauuuucuaggaaaacugaauuucccauacauuugaaagcuuaaaauuuugcguggcuuuauauuuacuuacauauuaaaauguaauaagacaaaacaaaaauugucacauugaagugacaagccagcagcaagaaaagaguccaagagaaggcuuaaaaaucagagacccacucauuugcauacuuaagaguccaauaaaaacacaaauuugaagaccauagaagaccugguacaggcccuguguaugcugcuuccgucucugaguuucaugugugcuuugcucauacugauuuagagaaccuucuuuucuucauucccauuggcucuuacaguauuucugccuccuuuuccacggggagggauuugaugaagacaucucauuuagggcucaguguuccaaggucucucacuuugugucuggcugugggucucuguauuuauuuccaucugcugcagaaggaaacacugaugauggcugauuuuuuggguuuuuuuguuuguuuguuuguuuguuuguuuuaagaccaguauauuugguuuacccuagguuccugggauuucuaguucuuguucauucaugcaggguuagguauggauuccauguuguggaguagguguuaagucaaaucaaauauugguuaaccccacaagcuuugugccaacaaugcccuaccauaucuugcaggcaggauacaaguguagauccauggguuuguggccagcuugguguuuacaguucuccuuugguaauuugcagaguaccuuucuguagcagagacuuggugugguuuuaaauaguaagcuuucauuuuuuuuccucaagguucuuugauaaaaaauaguuauuaauuuaugcguaucguuguuucgucugcauuuaugucuuaguaacguauguaugcagugccuauggaauacagaguuagagacgugugagcugccuuguaggugcugggaacugaauccagguccacuagaagaggagucagugcucuuaaccgcugagcagucuuuccagucccucuuaaggauuuuaauuuuuguuuaucuuuccauccuauugaacuguggaucugguauauauuagauaaguauucuaccacagaacuaaauccccagccucucuuaauuauucuauuucauuuuaauauuguagggcaaacagaugauagauagaauuauaauugagagcaauauuucaccccagcgguuauuucuucuuccuuauuauuuuuccuuagucauuuucugcucagcauacuuugucuuauuuccuuuuuuuuuuuuuuuuaacugcuggccagucuuuuaaaguuuauuuaacauccuuuuuguuucuuacuaaauucuuuguuuuucuuuuuucuuuuuuccuaaaaauacaaaaaacaaaggaacaaacaaaaaaaccucaccaaaauccauggugggaacaaagcuauucguggcagcuaagaaucagugcauaucacaagaaaggauuagggcaagauauaauccccaagacacacuccagugacccacuuccccccuccaggcaccuuuuauaguucucccacuucucauaaauccaucaguggaauuaauuauugauuccauuagaguucuuauaauauuaucucugcagaugccccuguggacacauacagacauguaaauuucuaacaucucagucaucuuaaguccagucaggcuaguagugaacauuaacugucacaggagggaaauaugcacagcaugucuguagggaauuggauauuugagggccaugcuagucacugaagauaagaccagaagcuacgauagaagaugcuuuuugugcagaguggugacaugcuaaucaaaggaaaaacaaaugucauuugaaaugaccaguaagacugaguaaugacuuaaauaaugggagacaugguagaaauggauaugguaggccagacugcauagcauauggaaugacuagagaguauagcaugagguagaaguuacagggcuauaaguauagacuaauuugguaguuugguguguguggauuuuuuuuuaauuuuaagauuuauuuguuuauauauaugagugcucuauuguauacugucaugacuacaugacagaagaaggcaucagaucccauuauacaugguugugagcuaccgugugauagcugggaauugaacucaggaccucuggaagagccagccagugcucuuaaccucugagccaucucuuuagccucuguuacuguaucuuauugaaauuauuaccauucuacuuugcacuuaugauucucuuuguguuuuguaggcugugacagugagaaacuccauggcuaagucuuuauauagugcucuguuugacuggauaguguuucguauuaaucaugcacuucugaauaguaaagauuuggaacaagauacuaagguaaagaucuguuguauuauauuuuaccugaagacuauuuaauaaacuggugaguacuugaacuuuuaagggauagaauuauguaguuguaucaacuuaguuauuuauuuuucuauucagguuaaccauuuugugugucuuugcacauauuuacaugcuaugaacauuauacacagaguuguauauuaaaaguagaaauagaaacaaaaucagauuuuguauuguuuuaguguuugcuuuccauauaaaaacucuucaaauagauuucuguaaaaauacauuuuaacauaagauuucuuggacuauaucauuauauauuuuaauaauuguguaauacuagcugggcaugaugguucacaccauuaaucccaguacuugggagacagaggcagguggaugucuggguuugaggacagccagcaggucgacugacagagagaguuccaggacagugaggguuacacagagaaauccugucuggaguguguguguguguguguguguguguguguguguguaauuguaacaguuagugugauuuuuaccuuagaugggcuaaugagagaaacuauccuucugucucauuuguugcccugcuuuuugggaaugaaagucaaacacuuguuauguuuuucuuaaucuuguuucuccucuguauuauuuauuuauaucucgguugaauuuuaucuuucuacuuuuuucuuucuuaggagcuauugugaacauuuuggagauuuaguuugaugcauacuguuuucucucuuaaguacuuuuaaaauauuuacucaugcuguaaguuucuguucauccauucugucauucuuuuaucaucuuucacuuacacauuuacuuauaagaagguuucuuccagcccaaguuuauaaaauauuuaguauuaugcuuuuagaauuuuuuuaaauuggaacuuuuguuuuguuuuuguuacuuuuugaaauagggucugucuacauagccuuggauguccuggagcucacuauguaugccugacuggucucaaacuaacagaucuaccuguuuuugccuguuguguucugggaguaaaggcaugugucccaugcccugccuuuuguuuguuugcauuuuuaaggcaagauauugcagcuuagguaugacuugaccauucuccugcuucuuccucgugagugauggaauuauagguauaugcuaccacaccgucucuggauuuuauuuuaaugugauggguuacauacauauaguuuuaauaauuucagguccauuuuaauuuuuaauagccauuaguguccaguuugcuuaaucugcuuaaaauguuauuuuuauuguuuacuccuacugacucaaggaaaaauuuuuuauauuuuugaaaagauuuauuuauuuaucuuaugucugugaauacaaggucacugucuucagacaaaucagaggaggacacuggaaaucauuacagauguugugagccaccaugugguugcugggaacugaacuuaaggccucuagaagagcaguuggugcucuuaaccucuaaguuauuuuuucagccccuauucuuauuuuuuuuuauaguucaaguaguuccauaguuauaaaauuaaaucucagucuuauuauucagugaacuuacuugugaaggacauuauuuccuucuauauaucuagauuuuucaguagccccaacuaaguaaaucucucuugauacauuuucaaaauguccugcauguucaucauaauaguuugcuuacugugucuguuaguaccagugggguguggggaguuaauucccuuucagagcuaauggugguuuucaacguuacucauuuuuugacccagcaucccuauaaugcucaugcuggcuuugacucacauuccucuugccucugauucuagaguguuuuguuuuuccuuucuuuacauugauugauuauuugauuguuuguaucugucuggaggucagaggacaacugggagucaguucucucuuuccaugagguggauucugcagcuagaauuuagguugucagguuuggagucacgugucuuuaccugcugagcuaucuuguauaccuaauuuaaugcugauugcaaaauuaaucguuauugauaccaaauuaagaauugcauaguuuucuuguuauaacuaaaaauaauuuuaucuugcugaucuuugacuuauguaaccuuuugauuuucucauaaccuguuguuucuguucuaucauaggacuuaagaauguuucaguuuauuugggauuucuugacucucucaauuuaagauaauagcucauucacccuuuccaaaguagugcagaaauuacauauauucaaauuugucuuauuaaagaaauccuuacaauggaaacaaagcuuacuucaaguuaauuugccuuuuaaccuuaagacccuaaauuaugaguucuuagauaauuaagaauaucaacuacacugcuauugaugaguuaaggugaugccucccucauccccuuuacuacuaaaaaucuaaucucuuuaaucaguucuugauaacuaauuguuauuuuaaaauuugagaaaagcuguuaaacacugauguaaauuaucauaugauaaccacuguaacaggaaaauaaaauuugcucugauugccauuuuacauguuuaaccaucugucacaagucaguuuuccuaaaaauccacucaguuuuaaguccagugauuaauaaauauccuuauauuuaauguaaaugaguaaauaccuaauaaaaaauuggaaaaaaaacaaaaaaagaaacaaaaaacaaaauauuucuaauaaauuauauagguaucauugcaguuaauauuucuaaauuuaagaauuauuuuuuaguuauacaugcaugcguuugugcgugcgcgugcguguaugugugcgcaugcauguguguauucaauaccacaaaugccagagguaucagauucccugaagcuguagucacuaugauuuuucuauuaccugauguggguucagggagaagaauguggguccuuugcaaaagcaguauguuuucuuaaucacugagccaucucucuaaccccaaaauuagaaugaaguauauuuuccuauuacaguaguuuuaccuggugauuuacaucagugauuauuugaauacuggacagaaccagaacuguuacagaaaggaguauuuuacuacuuguaauauaaguaaauuugagacuuguuuuuaaauuaaauuucucuugucuuacagacuuuguccauugguguucuugauauuuuuggguuugaagauuaugaaaacaauaguuuugaacaguucuguauuaauuuugcuaaugaacguuuacagcacuacuuuaaucagcauaucuuuaaguuggagcaagugaguaucuaaauauauaguuacccuccugcuuaaacuuuugaaucaauuucauaacuguuuucuagccugcauuuugauucagacagugcauggucauaucacuauaaggaaaugacaaaucagagcagagcuuuucagcuauauuauacagauuuuuuuuaauaguugccagauguaucuguuaauuuguguuuguuuacauguaucuuuggaugaaucaugcaucuuuuuuaaugcacccuuuuuaaggguguuguauaucuguugcuaucgaguguggucacuuacuaucuuuaguauuuauuuaacugcuuuggucuccacuucuuaucugagaucaaagacucuugaggagcagaguguggaugcaaagguguauucugggguuggagguaauaguucagcaauuuagaacauuuguuuuucucgcugaugaccaggguuuaguuccuagcauccaucuguaacuucaguuccaaggggucuaacacccucuucuaacuucucauaaauacuugcuggcaaaacauucauacaccuaaaauaaaucuaaaaaguaaaaauaaacaaaccaaguaaaccacaauggcauuucuuaugagaaucuuaagauugaugacaauuuaguuuuuauuacaauuauuaugagaagaggacccaaaagaugugagguuuuccuccaaauuuaguuggaaaucaguuuuugacccaguuuauaagccagaacuucaguuuauuuaguaaugacauaggcaacuauacuaagauuuaucacagucaacuuaaaugcuaacuaauggaaagugaaugcaaaccccaaaauaguuaguaggucuacugaauaauuuaaaagaaacuucuaccagcuagcuucuacaaaguauaauaauauauauauaaauucuauaguaaaguuuauugcucuauaugcugacuuaaaaauuaaaauuuauuauuauuuguguguguguguguguguguguaugugugcauguacuuguauggguguguauguauguauagacaugugcuguggcacacgggugaagggaggucagaggaaaaccucguggauucauggauucaguucuccuccucuaccuauguguguuguaaggauugaccucagaucauuaagaguguggcaagauccuuuuacugaaccaccuucugacugguuuuguuguuuuuugguuuuuuuguaaaggguaguuguguaaaauguuuuagggcuggcuacuuugaugaaugcuuaaaguauucaauauaauugaaguucuagacauaauuaauucuuaugugugugauuguaauugugugcauagugauaugaguguauggaagucagaggacaauguggagauucucugggucgaacuuaggucaguugaaguagucuuggugauugauucagaaucauguugaauaaaagacaaacugaaaggugucugauauuugaaaaugcucauguuagcauuuuuaauguugcccauuucuuuccuuuacaugcucugaauuacccuuaccaucacugauuuauuaguaaauauaaugacaauugaguuacauaugucaggcauugugguaagcuccgaaaacaaaaaguuuggagcuuuggaaucuuacugaggaguuuguaccuaacaauuuuuguuuugauggcagauugguggugugagacuaccauugucuuugaggauagucuuccucaccccacucugcuccacauccuaauaaaaacccaaacaaaaaaacuaaaaagagugaacuucaaggcauugguuuucuuucuuucuuucuuucuuucuuucuuucuuucuuucuuucuuucuuucuuccuuucuuccuuucuuccuuucuuccuuucuuccuuucuuccuuucuuccuuucuuccuuucuuccuuucuuccuuucuuccuuucuuccuuucuuccuuucuuccuuucuuccuuucuuccuuucuuccuuucuuccuuucuuccuuucuuccuuucuuccuuucuuccuuucuuccuuucuuccuuucuuccuuucuuccuuucuuccuuucuuccuuccuuccuuccuuccuuccuuccuuucuuucuuucuuucucuuucuuucuuucuuucuuucuuucuuucuuucuuucuuucuuucuuucuuucuuauguauuggucaauguuuuauuguuaucuuuaacuccucuuuugucaacauggauagauacguauugucucaggcaucauuuguucugguuuacuuucagauaagugaaaaccuaggucuguaaggacaaaccuguguaaggagcccagaaguugaagguugcuuucuuucuaaaaacauuucccuauuuugguaaaagguuucugagccagugauaaggguucaaagagcaaaguagaaacccauggucacuguuaacuuccagcuuagugcacucagagggcaugguacccauuaggaauaaaauaagcgagaaagagcugcagcauccuagaaacugcguuccuaugcuuccugcauacucaaauaauauuuauaccuucucaauuuucagaugggauuaaagacuagagaguuacagucuuacaauuaaacuuaugcuguuuaggauuuaaaaagauuuccuagguguaaaaagauguuuuuaaaaugguaauacagguuaaaauaauaaaugauauagauaaaauuuuaaacucauuaagauagaauagaugguaaaauaccuuaucuaaguugccaaauacaaacagacuggacauuuaaauguaacuuauaccuaaucauuuucauaauuguucguacuguauguuuauuauuauaagaaaaagagccuuuucaauuagacaaaaaaauuguucagguuuggucuuuugcuaugcuaaauauugguugcucccagagaccacacauagacccaggugaugcuaugugacauugccccccaaguuuccugauugguaaauaaagauggcagcagccaguagcuggucagaagagacacaaugugggguuuaggguuggagaaaaccaugagggaaaaagagaaaaagguggagcgaagagaagccuccauugggcugagaaucuuaaaauaauggccaugugagucagcuaguuggagcuacgagcagcccagacaaaacaugguaaauuauauaauaaaaauuauuugauaggaaauagacauaauagcauagaggauaaauaucuauccaguucugugcugauugaggcucauuauaaauacaaaggucaaauguaucuuuuacucacaaaccaaguggucaaagggaggauaaaaauccuggauugagauuaaauauuuuuacaacaguguggucucagcuugucauggucuauaucucuugagcugccucaucuaaccugcucuuuucagggcaaggagcuugaugcagcuuuaaggucagauucagucucccccuuuucacaguaaaaugcaauccuugugcuuguuugggagugccaagggugcaauggaguaacugagggcucaggaaugucccugauuuaccacugauuggguucagauacuuuuaagccuguucagggguuaauucaccauagauaccugccauauccuuuauaauucuguaggauuuauucucuuggguacuaggugaguuccuucaguuacuccaaaaguauuagauauuacccuaaaaggcuugcuugaaggaauggauacuuccaaaaacaaacaacaacaaaaaaaccucaguucucuuucaagggacuucaugucuggagucuaaccaacaauauucacuauggaacaugucaccucuuccccaaaaccccuguucauucguucguucguuuguucauucucucucucucucucucucucucucucucucucucuguauguguguguagcaguaguaaguucuucagaguaaacaugggagacagaagacaguaggauauuuuccuuaaaaguaaagcucauuauuuaggccuguguauuaguuauauuccuaucauaauucuuauuauagaacaacuguuaaaaauugaaggaaaaauagugaaauugcuuuuuaaaguaggugaauauaaaagacuauucuacuaaauuugacagaaauggaauuuuauaauguuuaaauagacuuaaaauacacacggacaauagcauaugcauaaaguugugacaucucuguauuaacuguaaguuauagaaaauuuuauuuguguuauuugauaaguuaaagaugcauguuauaauuucuagaauauccacaaaguaguaaguaaauauaaaauauuugccagaaaaauguagauucuaaguaaagcaaaaacaaccaaagcaauccaaacaguaacaaaguaaguauagaagaacugcccaagacugaugcauauggcacuuauguguaauccagcauuuugggaagaccugggcaacaaaaugagaaggaaugcugagaaaagaggauaauugagagaaagaagaaauaguaagguaccagugagcauucacuuuauaugaguugauugcuuuaguaucuaacaaucauuagauugaugaauagcaaacaguuuaucagaggcaguccaaacauuauacccaaagcuaaaaguaaaaaggcauauaagguuuaucgaacauuagcagaaacuauuuguagcuuuauuacuaaguauaaaaggaaauagcucauaaugcuaagaacaguuuuuuaaaguaaaugcacagucccaaauuuauagguaccagauaaaauaucuucaaaaugcaugaagcaaaauuuaauaaaaguauaaugaggaauauagcuuauaaaugggguauuuuuaacuuauuaucuugaauaacuuaacuaacauuuuauggguauccauugcucucugccuugcauaucaauauggacaguuaccuuggacuuaacugguuauugagacccgcuaaauaauauguagcauauugaacccuaucugaagaauacauaguuacaaaaguaaugcuuguguuaguuuggaagcaagggucagcuucccaaauauuaacacauauuuuaauacuauaauaaaauuacaagucaggugguggugacacacuccuuuaauccuggcacuugggaagcagaagccaguggauuucuugaguuugaggccagccugguuuacagaacaagcuccagcacagccaauguuaaacagagaaacccuguauucaaaaacaagaacaaaaacaaaccaaaaagaaaaaagaaaaaaacauuuucauuuaaggcuggggauauauuaucuauccccagguuaacaugugugagauucccaaaguucagcauacacugcugccaaacaauucccuccagaaaaccaaaacuaaguaaauaugcuuaauaguuuaaaaggugaaugaggccgggugugguggugcacaccuuugaucccagcacuugggagucagaggcaggcggauuucugaguucgaggccaagccuggucuacagauugaguuccaggacagccagggcuacacagcgaaacccagucucgaagaaaaaaaaaaggugaaugaacuagaaacuagccacaguuaaccagcaugcuguggggguguagcugacguuaauaguuaaguuuaaaccuauuagaaaauuuucauguuaagaauaugugauuguuccuaaaaccuuggaaaauggucagcaaaauaagucugggaaauaauuccauucuuaauuaucucagaugaaagaaaaauaccuuaauauaaaccuaaccaaggaagugaaagacuuguacagcgaggucuugagaauacuguacaaaggaacuggaagcacccacaauuggaaugauuuuucaugaucaugaauuagaaggauuacuguuguaaagaaaaccauacuguuagaagugggauguaaauucauuguagucaccaacauucacucuucgcagaaauaagugauuuaaaauucacacagcaguguaaaagucuccaaguagccauaaugguccucaacauaaagaaugaugaaggagauaccacuauaccugauuucaaguuauaguagagucauaauaacaaaaaccauguacagaaacagacaugccgaucagaaucauaggucagaugguuuagauaaaaccacauguagacgcaccuuacuuaaaacuuugucauauguuauuauuuucuguaagauaaguugauauuuuguuuuuucuaggaggaauauagaacugaagguaucaguuggcauaacauagauuauauugauaauacuuguugcauaaaucuuauuagcaaaaaaccaacaggacugcuccaucuuuuggaugaagaaagcaagugaguauagugcuuuucaguuucauauuugaccauuaugcuuuuugagugcuucaccuuuauuugugacagagcuucacuguguaacucugaccagguuggaauuagggcugcugcagucccagaguagccucagacucauagcaguccuuagccuuaggcuccccaguguuagcuguauaaguauguaccaccaaccagcuuauaucuaaguaagcguaaguguucugauaauguuuugaauaaagacuugugguuuuucuguauuugucuggaaaaaaauacauuuuuguguaauagauuguacuuuacucuugaacaauuuuuuuucagauuucucuuagaaaauuugauguuaaaucuuuugaugcucauuucuuuauucuugagaacuucauaaucuaugcaaugaaauaugauuacaucuacccuuuuucccccccuccaacuccuuccauauuaccucuaacauuccaaauuucauauccuguccucuuuacccacuuuuuuuguuggcauggaagaccuacugccucugccucccagauacuggaauuaaaggaguguacacuuagcucuuguuuuguuuugauuauccacuaagucuauguaauuuugcccaaauaugcauggauguagagccauccacuggauaaugggaaacuuaacacuggucacauccugaugcacauuuaaaaaaaaaaaagauuuuuccccccauuucucccucuuuucuguccuguagacagggucuuguuacguaaccuggucugcucuugaaguugagaucuuccuucccugccucugaguggugacauuacaaagauguaauaauucacguagccuuuaaauugaguuuuauuuauuuaucuacauuuuauuugagggugaaguauguaugugugcuauucuguuuauauggaggucagaggccgauaugcaggaagaguuucucucaucacauggauccuccagaucaaauugaaguguucaggcuuggaagcagaugccuuacccauuaaacuaucuuauuuguuagucuuugaauuaacuuuuauacaggagaaauaugggguggggaggagguaugggauguggagcagucggaggguguaugggagggauggggaaugauauggaguguaaaaaaauaaaauuuuuaaaaaaugaaaaaaaaaugaauaaaaauuucagauacacuuuuuuuuuuaaacaucaaaguuucuaagagaaaucugguagaauuucucauaaucccgcaacucauauuuuauaucuuuguaaaaccuucauuauguggaugacacuaaaaacuucauuuugugcaaaauuuccuguuugggccugcuuauccuuggcuguaguaccuggacaccagucauggguaaucaauucuuggggaaacaguuuuguagaaggcucuguuugaauaaucucuucuauaugugugagccuucaguguccuggaaguuagccaguuccugcaaugccuuuuaucaccauggaauccacuuggugccaaauaguucuuugcuuuaacuugaaaugugaucuuuuuuugccugaauuacaaguuuaucaaaucugucuguucugauuuuuuuuuuuuuuuuggugcuaauucucacugugaguaugagaaaaaaauaggcaacaguauccaucagcaaccugaauucauguuuuguaauguccucccagauaaguuagucuguggucuuuaagcucagcuuuaugaaaaguuucuggggaugaacaaaaaauagaagaguuauuuuucuagaauguaagaaaaauuaucaaacccaguuuccaguagagguccccauuuccaugggaaacuuuauucuacauucugacuuugugagucccacuaaaauccccaaguaagccauguuucagcauucuaacacaguaauugauauagauaggaaaguuauuccuuauucaugugugagaaaauaagaaacaaaaaaugaguaucuacuuuaaggauugaggaaucagagauuauuuccuuuuugaaagauaauugaccccaaagaacauaugauuuugguuuuuauuuuccuuugagcuguacaguauuucugcacaguguaacuuuuaauaccaagugacuugggcuuauuucucggccuaacuguaaaaugugacuccacaucuauaaaauaggaaccucaguucuuuagcuuguuacaagagucugauuuuucuuggguacgguggcacauaccuuuaaucccagcacucaggagaguggaucccugggaguucauagccaaccuggucuacauuuuaaguuccaggccagccaaggcuacauaguaagccucacucccaucccucucuucucccaccccugccaaaaaagggaaagaaucugauuagaugcuguagguaaaaacuuuucauuaauuguauaguauauuaauauuaugccuuauaaaagacuguaucuuucacauuauuuguucaauucagcuuuccacaggcuacaaaccaaacauuacuugacaaguuuaaacaucaacaugaagagaauucuuacauugaauuuccugcugugauggagccugcuuuuaucauaaaacauuaugcuggaaaaguaaaauauggaguaaaggucaguaaguuucuuauugaauauggcuuuagagcagagguauguauuuuaaaauauagaacacuuuuuauucuuugacaguucuaugcauguaaacauuguuuucugaucauaacuacacucccaauucuucccccagauguaucauuacuauuucuggcauguuacccuuucuuauaguuuuuggaggcucuggauuaguugccuuugaagacauuuuguaagguuagaacuagaaucaagaucuacuuuucaguauauuaccauuuagauaauguuucugcugguuuccuucuauagauaaaccuauuagguuguuuuagugaacuuuuaaaaccuagaacagauagugucugugugucucaaacucauuguucauccucauaauucauuuguuuuucuuuaaugauacucauaagggucuuuuagaagcuucuguucugagcaccaauagguaguugugagcuuucauucuuacuagguauaguaaguaacucuugcaugagauggcuaacucuuaaaucuugggaagcuuaaacuugccacuuaugauacuuaguuuccuuguaaugcaguaauaaaaugauauaaaucaaugacucauugaguuuuguuuuguuuuucuguuuuugagacaguuucauguacuuaggcucaaauucucuguguagcagaggauguccuugaacuccuaauuuugccucuuauccuaagaggcuaggauuauugagcugugucacuguguccagcuuugguagacauccuaauuaauuauuuaagcauuuacugauucaucuuuuaaagaauuauuuauuaaccagcguaugucaguuuccuguccaguauuugcuauuauauagugauaagauagacagacagauuuguaaguauauguaucauauacauagcauauaucauauuuauuucuagugauguuguauaaauuuuucugugaguuaaaguauugaaguaauuaccucuuuguaaauuuacaaggauuucucuaaaacucuuaagaguugaacuaaaguaaagguuauacuggugaguugagauagugaguuauaggcuauaaaaugagaaaggaguuacauauguugaaauaguguauaaaaggucacugagaugagacuuuuaaggacaagugagauauuuuugugaauuccaagagcagacauuagguuaaaucuugaagggcuucuaggccacauuaaaggagcuuagguguuuuguuuuuaaugaaauucaggagucccuguacaacgcauacuguuaguaacaguccugugucagccuuauuagcaaccucccugcuggaguauaguuuuuuuuguuguugaaauuauuauaggaacugugaaacuauuaaagcagauuuguguuuucaaggacagcagagagggugagacuggauucuuagaauuuauuaauucucccucuuuaucuccuuccccuuuuaaauugaggugaaauauuaaauugaaccauaagaguagcaguagaaauggggaaaaccuuauauaagguauaguguugagaucuccauauacuuuauagaaguuguaaaugaauauuuuuuucuuucuuucuuuuuuuuugguuuugguuuugguuuuuugagacaggguuucucuguguaguccuggcuguccuggaacucacucuguagaccaggcuggccucgaaaucagaaauccaccugccucugccucccaccacugcccgggguaaaugaauauuuuauggugggaaguaauugaaucucuuugagaugucauaucugagauggaauacacaggugagaagcagauuuuagauauaauuuauaaaguuaaacaaagcagaaaucuugauccuguuguuaaaugauuuuguaguuacuuuuccagugugguaguaaaacaacaugaucaaggcacuuuguagaagaaaaaguuuauuuagcuuaccauuccagaaggguaagagaguccaucaugguagggaagcagcaggcaugguggcugaaggugaaacugaguugcucauguuuuuaacugcaagcacaaagcagagaguuggaacaagaaauggugugagucuuuaaacucacaaccugauuacugcuggcuugcuucagcaagaccauaccuggugaaccuacccagacagcaucaccaagugggagccaaauaugcccaagauuugcagggacauuuaucauauaguauacacacaccuguuucucugauguuuaaguauguuauugaguagauugaaacuaaaaaaggugauuaaaaggugaaauuauauacucacuaaagaagcuagagcuauuccuggagauaaaaagggauauuucacaauaagaaaagugucuaguugauaaaacguuaaucaaaaguuauuuauagcugggcguggugacgcacccuuuaaucccagcacuuaggaggcagaggcaggcggauuucugaguucgaggccagccuagucuacaaagugaguucuaggacagccagcgcuauacagagaaacccugucucaaaaaacaaaaacaaaaaaaguuauuuauacccaguaauuuugauucagauguuuaaacuugucagguaauguuugguuuguagccuguggaaagcugaauugaacaaauuaugugaaagauacagucuuuuauaagguacuuggcccagguagcucagaauagaauucaguucuauaaucucuauucacccccaccauucaaaccuacuaucuucuugauuuuaauaguccuuuucagaaauaacauugguacuuuuuucauaggauuuucgggaaaaaaauacagaucauaugcguccagacauuguggcucuucugagaaguagcaggaaugcuuuuguuucugggaugacuggcauugauccuguagcuguuuuccgaugggcaguucuucgagcauuuuucagagcugugguugcuuucagggaagcugggaaaagacauauucagagaaaaagugguaagccauucuugcuaguauucuuccaugauaauacuuuuuauuuuuuccuguuuacuuaccauaaucuguaauuauguuucauagcugauaaaucacauaccuuuaagugauuaaauguauguuucuguauguaugcaggccuauguugcuauauuuuuauuaauagauauugauaggaauaaugagcgucuuaggguuacuguugugugaagaaacaccaugaugaaggcugguuauaaaggggagcauuuaauuggggucauguuuacaguuuuggagcauuaguccauggccauuaugguguaggcaagcauggugccuagagcaauauuuaagugcucacaucugaucugaaaggugcaggcagacagugaaacugagaguuuuucaaaccucaaaagcccagcuccagugacaccucuuccaagaggucauaccuacuaauucuucucaaacaaucucaccuacuauagaccaaguauucaaauauaugagcauacaggggcuacucucauuaaaaucaucacagugaauguaaggcauauaguaguuaugaacaaaaaugcaagcugauaaucauaugaugauucagaauuugauuuuaauguuuucuccauuuuuccaucucuauguuuuuuucuacaaauucaaucaugauuuaauauaaaaaagcaaauuaggaaacaaacagggucaggcaguauaauaugguagacuuuucugcuccagucaccuuuucuauugaccaguuuuguaaguaagaacauuuuuucuuuccuaguaaagaauuauuuguuuaguaagguuuuuguuuuguuuuucuuaaccuguuaacuugguuuauugaguuuuuaguuugaauuuuauaaaugauuuuuuuuuucuggguccuuccuuuuucuuuaagccugagacacuccauuuuauauuguacaugaagucaaguucauaggcacauguggccauuuggaauguauauaguuaaaaucuucuaacuuauauguaguugagacaugccuuucaguaggauuauacgagugcuuccuuguucuucuguguuuccaaacuaacuuguauguuguaggaguaaacaaacuuucaaagucagcuuuuaaauuucaguucugauuuuucaccugggauguugucagucacucuucaacuuccaggccaguuuagucuacauagugaguuccaggacagccagggguauuuagagggacucugucuuaaagacaaaacaaaacaacccaaagacaaaaucaaaaaauaguccuaggaauccuaaguuuacuugauuauuaguagacucucccacugucuuaguuaguguucuagugcugugaagagacaccaugaccacaacaacucuuauaaauaaaagaaacccuuuaauugggguuggcuuuagagguuuaguucauuguuguuauggcuggaaucgugguaguaagcaggcagacauagugcugggaagguagcugagaguucuacauccagaugggcagggacagagaaacacugggugggccuaccuugagcauuugaaacugcgaagccccgccaccgccccacacacauacuuccucuaacaaagccacaugugcuccuacaacccugucaaguagcccuauucccuaaugaccaagcauucaaacauacacaccuauggggacuauuccuguccaaacuaaccacacccucuuuggaaauaugaaagggaguucuugugguugaaaugguaagaugguaguaauggccugaagagguaacucaguaguuaagugcacuugcugcuuuucuagaggacccgauuucauuucccagcauccauguuagguggcucacaaccacuggcaacuccagcucuagggggaaaucaaauguccucuucuggaagaguugcacucaagugugcgcauauacacagaaauacauauacauauacauaaauacaguuuuaaaaagggauaguagaaacauuagggaagaaauaaagagcaccauuauacuuaacuacaaaauauagaauaaacauaacuuuuacauuuucuagcacucuaauuugagagacagcugcuuaaagcaacaacucuaauucuauguggauggucauacugcuuaaaagauauuacuuguuuaauaguaaccguguaaagaacgugauaugggcaacuuucgaagcaauugaaaugguuuuuuaacuuagacuagauauaaauuacuauguuaauucuaauuuucacaucaacugcuaacuuuuaaaaacauuugauauaagagggcagugauggcgggcgugguggugcaugccuuuaaucucagcacuuggaaggcagaggcagguagauuucugaauucgaggccagucuggucuacagagugaguuccaggacagccagggcuacacagagaagaccugucucaaaaaaucccccccccccaaaaaaaaaggguagugaugaaaggaaagaaaacuaaaaaugucuuaauauguagaaagcaaauaaaacauccuuccaaggaguucaagaaagaaaucacaagaaaagguagaagauaauauugagcuggagauaagaaggaacaaacacagucuguacuaaucccugcuuggucaguuuauguccuuucauuuuguuuuugggccagaggaauguggaaguuuugccugaaaaugauuauugguuacauaagucaggauauagguguuuuaugcacuacuaggagaaaaccaagcaguaugucacaguguaugaaagauagcucaaaaagggcuuauagaaagguuuauagcuuucaaaacaccugcauuauaaauuaaaaugucaagcaauuaacccaguauucuacuguuucuaaggaggcuuagauaaaaggauaaacacaaccuaagcagggcauuguaaacuagacuggauauaaaugaguacggaguaaaaaacaagcaaacccagaaaaauauagcaaacaauauaacaguauuauugauugaguggauuauuaguucacacaguauccucuuucucuacuccccaaacuuguccacucuaccugaauguccaugugcaggcuagucugauaccuagccauuggggguaaauuacaguaauaaugaagauugaguauuuucuauuaaagugucuugugacaaugaagugacauuaagcugacuuuuuauaaauauucaaauauuucuaauuauuaauuuucaucuuugcuaaaugauccauuuaaaaagaaguugcuuuuuuacuaucagcuaguuaaaaugauugcaauggauuuuuuaagucugcaauuuuuauguacuaccugauuaauuauaagaugauauuuucucugcuaaaugauuuuuuaacauaacauuuuaguuuuuaucaauuugauaaaauuuuugaagcauauuuccucuuuuuaaaaaggaugcuacauuuauguacuaucugaugauuaauaagauuguguuuuucgaugauaaauguagguaauauauucuaaauucagaaaucuagguuauauaauuucaauaagauaaaaaaauacucuguaggaguuuuggaauuaguguuucuuugagcuuuaaaaugacuaucuugagaacuauuuauaacauaugacauugagccccauuccuaaguguacaguaaauuguacuuauagagaucaguuacuaugcaucacuucauugcuccuagauuauauaguugucauucuuuuuuuuuuuuuuuuuuuuuuuaaagauuuauuuauuuauuauauguaaguacacuguagcugucuucagacacuccagaagagggcaucagaucucauuacgggugguugugagccaccaugugguugcugggauuugaacuucggaccuucggaagagcagucgggugcucuuacccacugagccaucucaccagcccauauaguugucauucuuagaagcaaaauuguuaaauguaaccauuccuccauaagucuuuuuuuaauuuucuuuaauaaauuuuuaauucuuuauaucauacuguguauuauaaagacauuuucaaccccucccccccccacacacacacacauacacacacacuauuuuuccugcggaacucuuaagguaaucucuugaacucaagaauucaucuuuucugaaauauggaaacucugucuucuaucuuaaaucaauuucuugcugauauuuauguuauuguaauugccccucccccaugccuuacugcucaaaugacucacuugguuagcauucaucugagugcuuuggucuuuauucuugucucuucuuuuuccugcuuguaauucacuuuaucuccuuuuccaguagugagguauggguucuucagcaauuuuucagauuuauaaaugcauagugcugcucaggcucccucucuguggugugcuacuacuuauucuuagcacacacucggcagacauugacaaaacacaugugccugauugucagauuuguaaaagacaggguacccuuucucauaauuuuuuggguauaauuucucucagauucuaucaauguugccaacuauaugcuaaaaauauuucagaaagaaauaauuuuccaagaacaaccauaugauacuaauuguuugaaauguuccuuauacuuuaaucuagaaauuuuaauauggcauuaacucagaauacuuugauuaauaaaauagacauuuggcauauuugaaaagaauauuuuuucuuauuauuuguuaguuggggagaguuauucacaugguuuaauauuuuaaaauauaucaagauaguuggcaucauugucuuugauuuuucuuguugguuugggcuuacauaaugucuuuuucuuuuuuccauuuuuuauuuuguuuugcuucuuaaggacaugaugauacaacaccaugugcgauuuugaaaaguauggauaguuuuagcuuucuccaacacccaguccaccagaggagcuuagagauucugcagaggugcaaggaagagaaguacaguaaggcuuuaaguccucuuaacccuguauugucacaucuauuuggaaauggaaaucaagaguauucaugagggaugcauggagauugcauaggaacaugccuuucacaauucuuuaugcagacuguauugcuuucucuugaaauugcugaaccuguucuuugaugugggugauuuugacugucccauuugcuaugcaccacauuguuaauuauuuaggcuaccauugaauugguuuccaaauucaucuuggaaguaucugauuaauuacauaaaaauaagcaguaauuuuauucuugcuuuuggaaacuuuuagugaaauguaauuaaaguaaaauacgagaacaauuugguaaguuuuauauauauagaaacucaugaaauuaacacagugauuaugauauucaacacuccccaaagcuuccucauaucuggcuaaauuuuguacuugauuauguuugauuucuacaucagcaauguuacaauuuugaaucucuagaggauucauuuaaguugaauauaaaccuugacucagacuuucuaugucuaagagaaauaccagaauuucagcauaaaaaauaucauucagaauacauaucuguuuauuguuuaaaauugauauaaaagaugcacuuggucuccauuucuuccuuggcuuuauguuagucugcaugaaauagguccuuuggucugcugugugguuacaauaauuggguguacuccuauugugauaaaaaaugaguuuuuuagaaaauuaagucauuuguuuauagugggucaaauuuacucaagaucugcauuguacauuuaauaaauugcaauacauuuaggucacuacuuuuauuagaguuuucuaacugaaacuccauaauauuugacuuaauaaaacaacaauuuaaguggaauuugcuuaaaaauaaaugcaguguguucuuuuucacucuaaugguauaagaaaauguguaauguauguauauuuccuugucggaagaauaaagguaagucauuuuuaaaagcugucuuuagaguuuauccuuaguuauuaaaauuauuucuaaagauacacaguccucauucugauuauucauuuugauauucuuaaucuuucaaaacagucuacaaaucauuugagaacagcuuaaaagagcuuaaaucuaaaguaguuauauguaguucaguugcuuuauuuguuucuucaugauugagcuugguaacugcagacuggaccauauuguaguuuaugggucugguuacagcauacgcugcaugaggaaguuaaacuggcaauucccuguauauugaugccuucauuuauuuuauauauguauuccauuuuccacugcagauauauucaggugcugcuuuuuguuuuguuuuguuuuguuuuguuuuuguuuguuuucuuauuuuauuuuuaauuuauuuuuuacacuccauauuccauaccuuaucucccauccaccgacugcuccacaucccacaccuccaucccaccacacucuguuuccaugugaaugucccuccccacccccaccuaaccucuaaacucucuagggccucuagacccuugagaguuagaugcaucauuucugaaugaacacagacccagaaguucucuauuguauguguguugggggccucauaucagcugguguaugcugucuguuuggugguccaguguuugaaagauaucagaguuccagauuaagacugcugguccuucuacagaaucacccucuucuccucagcuucuuucagccuucccuaauucaaccacaggggucagcugcuucugucaauugguugggugcaaauaacugcauuugacucuuucagcugcuuguugggucuucuggagugcagucaugauagauuuugggaguucuccauagccucaguaguaguguuaggccuugggaccuccccuugagcucaaucccacuuugggccugucacuggaccuucuuuuccucagacuccucuccauuuccaucccuguaauucuuccagacaagaacaauuagggaucagaguugagacugugggauggcaacccuaucccugacuugauguccugucuuccugcuggaggugggcucuauaaguucccucucccuauugucuggcauuucaucuaagucauuuugaguccugggaguuuuucgccucccaggucucugaugcauucuggaggguccuccaaacuccuuccuguguuugccuguuuacauucuuucugcuggcccucagggcuucaguccuuuuuucuccucacccaauaccagaucagguuuccccucucccccauuuaucccguaccccauccacuuucccucccuggucccucccucccucccuuccucuccccccacuugugauugcuuucuuuucucucccaagugggacugaguugucuucauuuggacacuucagcuuguugagcuuuuugaguucuguggaauguaucuuggguagucuguauuuuuauuuuuuauuuagcuaaaauccacuuauuagugaguacauaccacgcaugucccuuugggucugaguuaccucacucaggaugauauuuucuaguuccauccauuugccugcaaaacucaggauguccucauucuuaauagcugaguaguacuccauuguguaaaugaaccacauuuucuguauccauucuucuuucgugggacaucuagguuguuuccagcuucuggcuaucaugaauaaggcuauuaugaauauaguggaagacuugccccuguggcauggugggacaucuuuuggguauauucccaagagugguguagcugggucuucagguagaucuacuuccaauucucugaggaaccuccagauugacuuccagagugguuguaccaguuugcaaucccaccagcaauggaggaguguuccucuuucuccacauccuccccaacauguguugucaccugagguuuugaucuuagacauuuggauugguguaagguggaaucucagagucguuuugauuugcauuucucugaucacuaaggacuuuggauauuucuuuaagugcuucuccaccaugcgauauuccucaguugugaauucuugguuaaguucuauaccccauuuuuugauuggguuguuugauuuuuuuggugauuaacuucuugaguucuuuaucuauuuuggauauuagccucugucagaugugggguuagugaagauuuuuuucccaaucuguagguugcugauuugucuuaucgacuauguccuuugccuuacagaagcuuuccaguuucaugaagucccauuuaucaauucuugaucuuagagcaugagccauuggaguucuauuuaugaaauuuccccuccaugccaaggaguucaaggcucuuucccacuaucucuucuauuagauucaguguaucugguuuuauguugagguccuugauccacuaugacuugagcuuuguacaaggugacaaauaugggucuauuuucauucuucuacauacagacagucaguuagaccagcaauauuuauugaagaugcuuuuuuuuuuccauuguauauuuuuggcgucuuugucaaagaucaagugaccauaaacguaugguuuuauuucugggucuucuauucaauugaucaacaugucugucucuguaccaauaccaugcaguuuuuuaucacuguugcucuguaauaaagcuugagguuaaggaugugauuccucuagcuguuuuuauuguuaagaguuguuuuuguuauucugggauuuuugccuuuccagaugaauuugagaauuucucuuuccguguccuugaagaauuauguuaggcuuuugauggggacugcauugaauuuauagauugccuuugguaggauggccguuuuuacuuuguuaauucugccaauccaugagcaugggagaucucuccauuuucucgauuucuuucuugagagaauugaaguuauugucauacaggucuuuucacuuguuugguuagaguuacccaagauacuuuauauuauuuguggcuauugugaagggaguuguuucccaaauuuuucacucagccuguucauuauuuguauaaaggaaaguuacugauuuauuugaguuaauuuuucuuauuuauuuauuuauuuauuuauuuauuuauuuauuuauuuauugagacaggguuucuuuguguaguacuggcugucuuggaacucacuuuguagaccaggcuggccuugaacucagaaacccaccugccucugccuccuacgugcugggauuaaaggcauacaucaucacuguccggcaguugaguuaauuuuccacuuugcugaaguuguucaucagcauuuugcuguauauaagacucaauaucaaagacagauacuaucucagaguaaaaggauggaaaaaggucucccaagcaaauggucccaggaaacaagcaggaguugccauccuaauauccaauaaaauagacuuucaaccacaaguuaucaagcaugaugaagaaggacacuucauauucaucaaggagaaaauacaccaagagaaagucucaguucugaacaucuaugccccaaaugcaugagcacccaaauucauaaaagaaacuuuacuaaaguucaaaacacacauugaaccccacacaauauuagugggauauuucaacccccccccucucaccaaucgauagccaugaaaacagaaacuaaacaaagacacagugaaacuaagagaaguuaugaaccaaaucgauucaguagauaucuacagaacauuucacccuaaaacaaaugaaugcaccuucuugucaauaccucuuggaaccuucuccaaaaucgaccauauaauuggucacaaaacaacccucaacagauacaaaaggauggaaauaauaccaugcaucguaucagaucaccauggcccaagacuggucuucaauaacagccaaaacuacagaaagcccacauauacuuggaaacugaaaaacucuuuacucaaugauaaauuggucagggaagaaauaaagaauuuaaaagacuuccuggaauuuaaugaaaaggcugacgcaucauacccaaacuuaugggacacaaugaaagcagugcuuagagaaaacuucauaccaagugcccugguaaagaaacuggagagaucuuacacuaacaacuuaacaguacaccugagagcucuagaagaaaaagaagcaaacucacccaaaaggaguauaaggcaggaaauagucaaacucagggcugaaaucaaccaaauagaaucaaagaaaacaauacaaagaaucugcaaacccaaaagcugguucuuugagagaaucaacaagauagauaagccccuauccaaacuaacuaaagggucaagaggcaguauccaaauuaauaaaaucagaaaugaaaagggagacauaacaacagaaauggaggaaauuaaaaaaaaaaucaucagauuccacuauaaaaaccuauacucaacaaaaugggaaaacucuagaugaaauggaugguuuucuagacagaugccacaaacuaaaguuaaauuaagagcauguaaacuaucuaaacaggcccauaucacacaaggaaauagaagaagucauuagaaaccucccaaccaaaaagagcacagggccagauggauuuagugcagaauucuaccaaacugucaaagaagauuggauaccaauuuuccucaaacuauuccauaaaauagaaacagaaggaacacuaccuaacuuguucuaugaagccacgauuacucugauaccuaaaccacacaaggacccaaccaaaaaaagagaacuucagaccauucuugcuuaugaauaucgaugcaagaauacucaauaaaauucuugcaaacugaaucuaagaacacaucaaaaccaccauucaccauaaucaaguagguuucaucccaggggugcaagguugguuuaauauaugaaaauccauuaauauaaucuaguauaaaaacaaacuaaaaaaaaaaucacaugaucaucuccuuagaugcagaaaaagcauuugacaaaauacaacacaccuucaugcaaaaauauuggagagaucaggaauucaagggccauaccuaaacacaauaaaaucuauuuacugcaaacuaauagccaauaucaaauuaaaugaagauauacuugaagcaaucccacugaaauugggacaagacaaggaugcccacucuccccauaucucuucaauauaguccuugaaauguuagcgagaacaauaagagaacaaaaagagaucaaggggauacaaauugguaaagaagaaauaaagguaucacuauuugcagaugauauaauaguauacauaaguaaccucaaaaauucuaccagagaacuucuccggcugauaaacaccuacagcauauagacccuuaaaaaggaaaaggaagcacaugauguugagagcuaaauaucagugauauagaaugcaaauaacaggggcuggugagauggcucaguggguaagagcacccgacugcucuuccgaagguccagaguucaaaucccagcaaccacaugguggcucacaaccauccgcaacaagaucugacucccucuucuggagugucugaggacagcuacagcuacaguguacuuacauauauuaauaaaauaaaucuuuaaaaaaaaagaaugcaaauaacaaucuguaauauguuuguuuauaccuuugcuuuaaauaaggcaccauacuauaagauaaacaugaagcauuaacaacacguacuuuaagguuaggaaacaagaagaggcuggaguuccagaaccaccuuuguauauucacuauuaauauuccaaguucauaugaccagcccaacuauuuuaaaaaauucuaccaccaugacaaacagagucaaacuucuaacuuagggggacaguggagauccaaaacauguuaacaaucaaguuaacucacuuuguuaacuuuguauaaaagaaaaagauugccaaauucugaaccuguuucuuuuaagacuuggcaacuaagugcccccaguuucuaaaguuuuguaugaaaaaucuuagaguuucuucaaauacuuagaauuaagguaaagauauuccauauacccaccuugauacaacaacagagauagaaaaggaacugaaagugaggacuuauuuaaucuauuaaaaugguaaaaagcuaaaaaaagaugguuuagaauuaaaacgugaacucaguaaucuuguaggguaccuaauacauauacagaauuuauuuuuaacccugaauacuuggaaaaugaaguuuauaaaugccugugaggcagccaguccucucccauauuuuacaagaaugggucugugugacaaaagaacuuggcaggugugucaaucuaauauuagaaaagauuaccauucccaucuuuggaaugccuuuaauugguagcuuuuacaucucuguuagagaagccacuguuuauguugugaguagcuccauucaguguuucaacagagucuucagucaauagguaauaaggaaauggguuuccuuagcaacuugacuggaugaccugagagugaaucuuccuucauucuagucccaggaggauugcaaucuuguuuggcagcuugaguacaaucuaauuagagacccugacuuagaaugaccugauaagcaccuccuaauucucugucuuuuggauagugguauauaugagccugguagcagacuuaaaaucucaucuuccuguggagaguggcccagugguaggccucuuguauagcauacccaaagcccuggauuuaauacacgguauugcaaaaagggagggaaaugaaaggaagggaacagaggaggaaaggaaaucugugaaccaaauaagaaguacaaaaauagauucauguaaacauaguaugguguugagauaguuuaguggaaugaaggauuagcucaacaaacuaauggcauugaacaccuuguuauuuuucuguuaaaggagaacucucuugccaugaaaaguuaccuugaaaugagucaugcugauuuaaggauuaaagccauuaaauuuguaagaaaauuuaagaaaaaaaaaacaggcaaagauuuuuuuuaggauuuauaaucaacuaaaaguagaagaaagugauguuagaguucccuaaauugaaaacuuaaugcuuuucaaauaauauuaagagaauaaugguuggcuguaaguaucugcaucugucucagucaccugcugguagagacugucaaaggacagccauccuaaacuucuguuugcaaacacaacacagcaucaguaauaguguuaggguuugaugacugccuguggaauggaucccaaguuggacuggucacugaauggccuuuccuucagucucugcuccauuuuugucccugcauuucuuuuagauaggaacaauucuaggucagaaauuuugaagguggguuggugagccuaugccuccauugggggcucugucuguuggucucuucagauucccucuucccacugcuggaaauuucaguuaaggucacccccauuguauccugggagcucucacaucccaggucucugagacuuucuagagauucuccccugauucuuagaggcuguauauuuccauucauucuccugccuacugggcuucucuccuguuucucccccauaccagauucugcccccuucccccacuucacccaguuccaucccucccucugccuccuguaguuauuuuguuccccuaagugugauugaagcauccucacuugggccuuccuucuuguuaaacuucuuagaguuuguggguuguaucauggguauucuauacuuuugauuaauauccacuuaucagugaguauauaccauguccuuuugggucuggguuaccucauucaggauaauaaccccuauggaaguguugggggaaggauugaaggagcugaagugaaggggauggcaaccccauaggaagaccaacagugucuacuaaccuagaccccugggagcucccagagacuaaaggaaugaccaucuagagacugccccaccuggggauccaucccauauacaguuaccaaacccagacacuauuguggaugcuaacaagugcuugcugacaggagccugauauagcugucuccugagaugcucugccaguaccugacacauacagaaguggaugcuuauagccauccauggaacugagcacaggguccccaaugaaggagccaaagaaaggacccaaagaguugaagggguugguagccucauaggaggaacaauaauacaaacuaaccauuccucaccccugccccccccccccccccaagcucucagggacuaaaccaccaaccaaagaguacacauggugggacucauggcuccagaugcauauguaguagaggauggccuaguuggacauuagugggaggagaggcccuugguccugugaaggcucuaugccccaguguaggggaaugccaggcccaggaagugggagugggucaguuggugagcagggggagggacuaagagaggggacuugggcggggggaccaggaaaggggauaucauuucaaauguaaauagagaaaauauccaauuaaaagggggaaaaacacuuagaaaacaaaacaaacaaaaacaaacaaagagcauacauaggcuggcaugggcuggugugagacucuuggaacauauguagcagcgaacugccuugucaggucucaguuggaaaggaugugccuaauccuguagagacuuguagcccuaggauagaggaugccugggaagggggugcagagaggagggugcccucucagaggcaaaugggagggggaaugggauaaagaauuccaggaaaggggaccaggaaccaaggaacauuaguuucuugaaaauauauuuuauagucaugagcuggguaucauuucacugauuugacccuguuuucuuuuagugauguuuuauaauucucaauguagacaucuuuacuuauuccauuaaguuuauauuauuuugauuuuaugaauggaauuacuagucuuugaucauuuguauagaaauagaguugauuacuccauaucaauuuaauuucuuuuauuuuuacugaauguauuagcuauaaaagguuuuguagauucucuuuaggacugucucugugugauugggccauuuuucauaaagucuucuguaaagaugcuugauuuauuuuucccaauggaucuuaaauguuuauaugcauauauacauuaugaaauugaugaccuuauauuuacugagucuguaagaaaaaucgguuuuaaaauauuauuuuuaauauuucaaauauccauaaggaaaaaacauucuuugguuuucagucuuuauuuguaagauaaauagaucucuaaaguauaugcuacaucucagcaguguauuuguugccaaaaggugauacaaaggggucauguucauuauguuuuggugucaaaauagaugaauuuuauauauauuuagcuuuuggccugcuuacuuuuauauuuccuagugguaaugcuuaaaugaaguaaauaagaauuuucuguugaauuuccuuuuuggcuucacuuaaucaagugcuggugauaguuacagaacuuuucuuaguaucugacauuuaucaaauguuuaaaacuuaguuuauuaauucuauagaauuuuuuucuuuaguauuuugaaagugcacuaauuuguuuccauuaucuauguuuuuuuuuguuuguuuguuuuuuguuguuguuguuagguauaacccgaaaaaacccaagaacaccccuuucugaucuucaaggcaugaacacucuaaaugaaaaaaaucaacaguaaguuugguauauguuuacaaggcaagaugaaauaaauaacuaucucauauuuuuagauauuaguauauagccugguagccugugauuuuucugccucaggcugagugcuaggauuauagauaugugcaacccacucagauuuauguuuuuguauauuugugagaauguguuguguguauguuuguguggguaagggugaauguaucauggcacaugugugaugcucagaagacagccuuggaugucaggucuguguuuuaccuuuuuuguggugacuggaucucuuuuuuguucacuacuguauacaucaggcuauuuggcuuacagguuucuggagguuguucugucuuugccuugugucuuagcauauggguacuggguuuauagauauguuauggcaucuaacuuuuccauuaguugugggguucuuucucagauucuuggacuuaugcaccaaguacagaaugcacugaguugccucuccuguucacagauuuuguuuuaaaauuuuauuuauuuacuuugucuuuguugggauuggaaaaugugcauaggauguguuugaaaauucgaggaaaauguggaggaccaauuucuuuccuucacccauugagaacccagauaucacacuaacauuaucaaucuugacagcaaguaccuuauucuuugggcugucuugcuauucccacccugggauuucuauucuguuugcuucuugguuugugugagacaguguaucauauuguauagucugucuuagagcuugcuauguaagcggagaugaucuugaauuucugauccuccaacucugaaguguugggaauguagaccugaauuacccaacacgaggcuuugauaguuuuucaugucuuugacuuguguauuugccaagacaucuuuuuagagauaguuucuuuugacuuguuuuuucccucugaguaggccaugcuuucugaguauguuguaugugugugaauaugauuucuaauuuguaauguuuguauugguaugcagugagcauuugaacauaauguaguaacuauauaucagaucagucuuccuuugcacaugucaucugcucuucgauuugguuugucuuuuucuucuucuguuguuugcuuguucuuucuuuuucuuuuuguaaaccagaacauuuauuuuauuacugauugaaauccucaagaugaacuggaugcugcaacagcugcucucuuggguuuuggucuugugcccucguggaauacaugucugaaucugcgguagacaaucuuuaggugccucauccgaccagucccgguaguguuucaucucuuagccuuggcacuccaguuauaguuucucuugugcuuggcaggggaaccauacuugccacugguugacuucugaaggugguaggccuuggagccacagcgacagcacagugugugcaacgcucaccaaaggaugacguuccuuuugucaucuugcuucuacuggugaggccaaagagacuggaagagcuuguuuuuucaacuguagacucuuuucugugcccaagaucagcuaaaggaauaccaucaagaacuucucagcucuuucauguuucuuuuccuuagacacauaguuauuuucuaauuuuauauacauaugugaguuauuguuaauaucugaucuucaaaauagaaaaggagaauguugaaggcuggugguagaaauggugauuaccuuuuaaguccacugaaggcauucaagcuugcagcauuguagaacauacaacagcguucacuaugcaguuguuuucuucuugcaugauuaaagcauuuauugccacauaaaucucugauauauggaggagaaaguucuuuuggcccauguuggcuaugagcugguugaaaacuauuccaagaaaagaugcacauaacucucuccuaccucuugugauguaaagguuaaauaacugcuaaauguccagacuuaguuuugguuuagcagagaaaccuuucucuggaaguuacaagcuauuaugguugacuguagccuuggaaauacuacauagggaauucuaaaaauaaaaaaauuccccaauuuaaaauuaugugcaauucuucauuuucugaauguugacucuuaucauuguucuauuuuuuugaauauuuuuuucagguuuuuuuuuugguuuuucgagacaggguuucucuguauagcccuggcuguccuggaacucacucuguagaccaggcuggccucgaacucagaaauccaccugucucugccucccaagugcugggauuaaauuuuucaguuuuucaugacaggguuuucucuguugcuuuggcuguccuagaacuugcucuacagaccagacaggccuugaacuuacagagauccaccugcaucuguuuuccacaugcugagauuaaagguaggggccaccuaugcacuguucuauuuuauuauuaauauugacuauuucuuaccauggcucauuuagaaaugaaacuuaccauaaguauuugucucaguauucauugcuuugaggagacaccaugacuauggcaacucuuauuaaagaaacauuuuaacuguaagcuugcuuacaguuucagaaguuuaguccauuuucaucauugcggagccauggugguaagcaguagacauggugcuggagacauagcguugaguucuacauguggaucuguaggcacaaggaagagaggaagcuucugagccggguuuggguuugaaaccgcuaagccuacucccagugacauacuuccuccuaaucccugucaaguauugucacuccccagugaucaagcauucaaauauuugcaucuaugggggccauucuuauuuaaacagcuauaguauuuauauauaagaagugaauacagacuguggugaacuuggaagauauauuccuugugaaaaaagggagaguccucuauaguuuuauuagaauauguucagccagugaaguugucucaagugaggagacauaucuggugcuucuucccugucaugagaugggaauauuaucccacuccauaacuuuuuuucccaacccaacaccaaggguuggauuuagaaccuuguucaugucaggccagcacucuacacugagcaauauucccaguuccagcccucuuuuugcuguguuuguuuuugguaagaucacacuaaauugcccuagcugauuuucaacucacucacaucauagcccagguagaccuuaaacuugugauccuccugccuuagccucuuaaguaagcaaaauauaggccuuuguuguaaggucuuggcaucacggugauacuuuuuuuuuuuuuuuuuuuuuuuugguuuuccgagacaggguuucucuauguagcccuggcuguccuguagaccaggcuggccucgaacucagaaauccgucugccucugccucccgagugcugggauuaaaggcaugcgccaccacgcccaguuaucacugugauaauuaaugagcugguagucuugcauuugcuuuuaacuucuuaaauuguugcuuuguuaaggcuucuucacuuuaugcuguugaucaaauuuucauuuuuucuuucuugccauuuucuuuuauuuuguuugaaacagaucuugcuguguaguccagacuaaccuggaauucaggcaauaguuucaccuaagcuuccaaaugcuaggauuuauagacguguacaauuauaucuggcuuuugauuaaaauuuuaugguuaaauuuuuacauguuuccuuuuuuaaaauugcuagaaauauaucauuccacaugguuuuggccauguacuuuaucguuuguuucuuuuuaagguguaucuuucugguucccgagccuuuucugugguaauuccacuuuuccaugugcuggacagucuuuacuaaagcauuugggcuccuuugauguccucuuuuaucugauuuucuguuucuuuuugguuuucuuuaucucucucauuucuucaccucuaaggcugcuggcacuggauuaaaaagaucuuggagugaucuguaauugucucucaugcaauauacauuugcuggagcaucaagccaugccagcuuuaaccucaaaugagaguugggaauuguuaucaccacucacuucuuccaucaucacuucaguugaagcugucaucccauuuugcauggauuauucuaacuuaaccagguuuuguccucagccuccaaagcuauauuuucuacaguagucagaugacuguuuuauaagaugaaucauguuaauguuuuacuuaaaauccccauguuuucucucauccauuccaguaaaagccaaaauccuuaggcuaccuaaaaaggcacaauauaucauggccucuuuuucaguguuucucagacucaacagcagcauguccaucuuaggaauuuuguguuuguucucucuuaaccagauaacugcuuaaucuuuuuuauuuuuuucuaauuuccauuuaauuaauauuuuuguggcugucuuuuuauacuaauacuaaggcugacuuugcgcuccucaauguaaccuugccuguaauucaugaaccuccugccucacuuucucaguuuuggaauuacaggccuguaauuguaauugaccuccuuauuuaaggugaaccuuuucuaugagaccuucccuaacuacuauauuuuaaaagcuuauuguauuuucuuuuguuuaguuuuucuccuucaucugguuacuugacccugagcgugguuuccuauaugcuuauuagucuccuuauacuuauuauaaaucucaugaugguaagaauuuuaguuuggcuuuuuaauguuguaugugcagugauagaagaauaauugacauguguuuuaagcuaaugaacgaauauauucuacauguucaaauguuacuaguguacuuuauuuucaagaguuucaaguuuuccuucucaguauuuauaggacucuuuccuuucucuuaagaauauuacuuguacccucuuaccuagauaguuuucuuccuagguuuuuugcuguuuguuuuuguuuuaauucuguuuuuugacacagggucuuuguagcuuucugugugcuggaacucacuauguauaauagccuggcccuaacucccagagaucccucuguccauugcuccagagggcuggaaccacaaugccuggccuccuucaaguuuuuuguuuugaacuggucaacuauucauguuuacgauugacuuguuguccccaacauugagaguaacuggguccaguaggacccaggcacacaggaauuuugcccgaccagaggcacagguuccuucuggucuggucuguugcccugagcagaccuuucgugggaacucugcagccagucccacaauacccagaggaagcuccauucucaggggcucuaacacacccaggaucauaggaucacaggaucacaggagcuugaccaaaccaggaucucagagucccagaggcagcuugacucccaggagcucugacauacccagcaucucaggaucacaggaucccagaaucacagaaccacagagagagcuggauucugaugaaguucagacauaaccaggaucacaggaaggacaggcuccagucagauauaccaaaguuacauagcauuagagauaaccagauagugggaggcaagcguaagaacauaaguaacaaaccaagguuacuuggcaucgucagaacccaauucucccaccauaggaaguccuggauacacuaucacucuggaaaagcaagaucuaaaggaucuaaaaaaucacuucucaugaugaugauagaggauuuuaagaaggacauaaauaacucccuuaaagaaauacaggagaacacagguaaaaagguacaagcccuuaaagaggaaacacaaaaaucccuuaaagaauuacaggaaaacaaagagguaaaggaaaugaacaaucuugaaugcaaaaucuaaaaauggaaauagaaacaauuaagaaaucacuaaaggagacaaccuuggaguuagaaaaccugggaaaaagaucaggagucauagaugcaagcaagcaucaccaacagaauacaagaaaauucaaaaaacaauaaguuccuauaccaaaacauucaggaaaucgaggacacaaugagaagaccauaccuaaggauaauagguauagaagagagugaagauucccaacuuaaagggccaguaaauaucuucaacaaaauuaaagaagaaaucuucccuaaccugaagaagagaugcccaugaacauacaagaagccuacagagcuccaaauagacuggaccagaaaagaaauuccucccgucauauaauauucaaaacaccgaaugcacuaaacaaagaaagaauauuaaaagcaguaagggaaaaaggucaaguaacauguaaaggcagaccuaucagaauuacaccaggcuucucaccagagacuaugaaagccagaagauucugggaagaucucauauagacccuaagagaacacaaaugccagcccaggcuacuauacccaacaaaacucuuaauugccauagauggagaaaacaugauauucaaugacaaaaccaaauuuauacaauauuuuuccauaaauccagcccuucaaaugauaauagauagaaaauaccaacacaaggagagaaacuauauccuagaaaaagcaagaaaguaaucuugcuuuuuagcaagaagauagcuacacaaacauaauuccaccucuaacaacaaaaauaacaagaagugacaaucacuuuuucuuaauaucucuuaauaucaauggacucaauucuccccgcaaaaagacauagacuggauauuaaacaggacccggcauuuugcugcauacaggaaacacacuucaaugacaaagacagauacuaccucagaguaaaugguuggaaaacauuuuuccaagcaaauggucccuagauacaagcuggagaagccauucuaauaucaaauaauaucaacuuuuaaccaaaaguuaucaaaaaagauaaggaagaacacuucauacucauucaccaaaggacaaaucuaccaaggugaacucugaauucugaacaucuaugcuccaaaugcaagggcacccaaauucauuuuuaaaaaaaaaacaacuuuacuaaagcucaaaauacacauugaacuccacauaacuauaguaggagacuucagcuuuccacucucagcaauggacagaucauggaaacagaaacuaaacagggacacagugaaacuaacagaaguuaugaaccaaauggaucuaacagauacuuauagaauauuucauccuaaagcaaaagaauguaccuucucagcaccucaugguaccuucuccauaauuagcaauauaauuggucacaaaacaccucgacagauacaggaagauugaaaugauccuauucauccuaucagaucaccauggacuaaggcuggucuucaauaccaacaaaaccaaggaaaagcacacauauauauggaaucugaacaaugacaacuuggucaaggaagaaauacagaaauuaaagaauuuuuagaauuuaaugaaaaugaaggcacaucauaccaauacuuaugggacacaaugaaagcagugguaagaggaaaacucauagcucuaagugccuucaaaaagaaacuggagaaagcuuacauuagcagcuugauagcacaccugaaagcucuaaaacaaaaagaagcuaauacacccaagaugaguagacagcaggaaauaaacugagggcuaauaucaaccaaauagaaacaaaaagaacuauacaaagaaucaaccaaaccaggagcugguucuuugagaaaaucaacaagauauauaagcccuuagccagacuaaccagagggcacagagacaguauccaaauuaagaaaaucagaaaugaaaagggagacauaacaauguaaaccauagaaauuuaaaaaaaucaucagauccuacaacaaaaucuuauacucaacaagauuggaaaaucuggaugcaauggacaauuuucuagacagauaccaagugccaaaguuaaaacaggaucagauaaaccaucuaaacagucccauaaccuccuaaagaaauagaaguagucauuaauagucucccaaccaaaaaaaaaaaaaaaaaaaaaagcccaggaccagauggauuuaguggagaauucuaucagaccuucaaagaaaaccuaauaccaguacucuuuaaacuguucuacaaaaaaagaaacagaaggaacacuacccaauucauucuaugaagccacaauuacugugcguauuuucccuuggagauggaaugguuuuugucuaaucagaagcuugucacaauuuccuuucauagagaacuucauaagagauuuuuucuacuucuaucauguuuaauguuuugaauagauuuuaaaaacuuguugaguacauauuacuuuuagcuucagaagauaucauguauauuuaagaggcauuuaacuacaauaaauuacuuugaugacuuaaaaauguuaauaaugaguuguauauuuuaaaauaaauauauguauauauauauauguauuuauguguguauguguauauauauguauccuauaggguugcagaccccuuuagcuccuuggguauuuucucuagcuccuacauuaggggcccuguguuacauccaauagaugacugugagcauccacuucuguauuugccagguacuggcauagccuugagagccaugucaggguccuuauccacacuuugguuuuccuucuugaguuucauguguuuugcaaauuguaucuuggauauucuaaguuuccaggcuaauagccgauuaucagugagugcauaucauguguguucuuuugugauuggguuaccuaacucacgaugauauuuuccagaugcauccauuugccuaagaauuucaugauuucauuguuuuaaauugcugaguaguacuccauuguguaaauguaccacauuuucuguauccauuccucaguugagugacauauggguucuuuccagcuucuggcuauuauaaauaaggcugcuaugaacauaguggagcauguguccuuauuacaaguuggaacaucuucuggguauaugcccaggagaggaauugauggaucuucugguaguacuaugucuaauuuucugaggaacugccagacugauuuccagagugguuguaccagcuugcaaucccaccaacaauagaggaguaucccucuuucuccacauccucaccagcaucuguugucacuugaauuuuugaucuuagccauucugacaggugugagguggaaucucaguguuguuuugauuugcauuucccugaugauuaaggauguugaacauuuuuuucaggugcuucucagccauucgguauuccucaguugagaauucuuuguuuaggucugcaccccauuuuuuaaauaggguuauuugauuuucuggaguccaucuucuugaguucuuuacauauauuugauacuaguccccuaucugauuuaggauugguaaagauccuuucccaaucuguugguggccguuuugucuuauugacaguaucuuuugccuuacagaagcuuugcaauuuuaugagguuccauuugucgauucuugaucuuacagcacaagccauugcuguucuguucaggaauuuuucuccugugcccauaucuucgaggcuuucccccacuuucuccacuauaaauuucagugucucugguuuuaauguggaguucuuugauccacuuagacuugagcuuuguagaaggagauaagaauggaucaauuugcauucuucuacaugauaaccaccaguuguugccagcaccauuuguugaaaaugcugucuuuuuuccacuggaugguuuuagcucccuugucaaagaucaaaugaccauagguguguggguucauuucugggucuucaauucuauuccauugaucuaccugucugucacuguaccaguaccaugcaguuuuuaucacaauugcucuguaguacagcuuuaggucaggcauggugauuccaccagagguucuuuuaucauugagaagaguuuuugcuauccuagguuuuuuguuauuccagaugaauuugcaaauuaccuuuucaaauucguugaagaauugaguuggaauuuugauggggauugcauugaaucuguagauugcuuucugcaagauagccauuuuuacuauauugauccugccaauccaugaguaccuccaaaaagaaaguagacagagcauacacuagcagccugauagcauaccuaaaagcucuaguacaaaaggaagcaaauucauccaagaggaguagauggcagaaaaugaucaaacucaggguugaaaucaaccaaguggaaacaaaaagaacuagucaaagaaucaaccacaacaggagcugguucuuugagaaaaucaacaagauagauaaacccuuauccagacuaacuagagggcacagggacaguauccuaauuaacaaaaucagaaaugaaaagggagacauaacaacagaaccugaggaaauccaaaacauccucagauccuaaaacaaaaggcuauucucaacaaaacuggaaaaccuggauguaauggacaaauuucuagacagauaccagguaccaaaguuaaaucagcaucugauuaaugaccuaaacuguuccauauccccuaaagaaauagaagcagucauuaauagucucccaaccaaaaaagcccagggccagauggguuuagugcagaguucuaucagaccuucaaagaaaaccuaauucuaauucuucucaaucuauuccgcaaaauagaaacagaagauacucuacccaauucauucugugaagccacaauuacuuugauaccuaaaccacauaaagacccaacaaagacagagaacuuauuaccaauuccccuuaugaauaucgaugcaaaaauacucaauaaaauucucgcuaaccaaauucaagaacacaucaaaagaaucauccaucaugaucaaguaggcuucauuccagcaaugcaggaaugguuuaauauacggaaauccaucaacguaauccacuauauaaacaaauucagacaaaaaccacaugaucaucucauuagaugcugagaaagcauuugacauccauucuugauaaaagucuuggaaagaucagguauucaaggcccacauuuaaacauaauaaaagcaaaauacagcaaaccaguagccaacaccaaacuaaauggagagagcuggaagcaaucccacuaaaaucagggacuagagaaggcugcccacuuucucccuaccucuucuauacaguacucgaaguccuagccagaguaauuagacaacaaaaggaggucaaggagauacaaauuggaaaggaagaagucaaaauaucacuauucgcagaugauaugagaguauauauaagugauccuaaaaaucccaccagagaacccguaaaccugauaaacagcuucagugaaguaacuggauauaaaauuaacucacacaaaucaguggccuuucuuuacacaaaggauaaacaggcugagaaaggaauuagggaaacaacacccuucacaauaguaacaaauaauauaaaauaccuugggugugacucuaaggaagugaaagaucuguaugauaagaacuugaagucucugaagaaagaaaucaaagaagaacucagaagaugcaaauauuaguuguauuuuuuaauguggagauuuaaauguacuaucuuuaccuggaaagccuuucauuaaaucuuaugcuauaauuacugguaauuuguucauccucugccucuagugcugauaauagcacuaagucuguaguaacagcucaauauguuugauugauguaucaggagcauguguguuuaugaauaagauguuucaaaaagaaauggauauuccguagauucauguauccuauuaguauuauagaucccaaugggaguuuuugaaaguucuggaaaaaaagaaagccauagagucuauuauauacuaaagcacacagauuacauauaacaguauguuaacgauaucaucuauaugauguauucauuuaccuauacauuuguauacgaaugugucugaauccacuaaaacuuuuuucugagugacagggaaguuccacuugauugguagucauuguaauaaaacuauuuuaugcuuguuagcaucuuuuaguguuccauuucaauaauauacuaacuuaagcaaauuauacuaauuuuuuucagugacacauuugauauugccuggaaugucagaacuggcauucgccaaagcagacuaccagcuagcaauacuuccuugcuugauaaagaugggauauucgcucauucagcaagcagcaaacuccuggaaagagcucauggaauucucacgucaguauugguuauuaauagacuuuuaaaaggaccauuuuacuaaauuuucugacugaacaaauaaugagagauuaaguauuauuuucauggguauaauuuugauggaaaaaguaaaaaauguacuucguuuuuaaaacuaugagucuaaugcauuauaucuauuauuacuuuguuuuauuuuucaguuucccuauucacuaguaaaacucagaauugguuaaauguguuaauuucagagaauguuuauuauuauuucuucuagagaaauaaaaaacucagcucuuuuaggauuuccuguccuuuuuacaauuacuauucuucagaucuagcacuuggacaggaaaauccgaugcacauggugagugguagcauguguagugucaucucaugcucaccuuucacuaccugauggaagaacuaguuuggacauggaaauaacuaggcaugauguuccauuaaacuccaauagauuuuaguugauagaauuaacguauuuuaggcauuuucuaagcauuuauuuuaaugugucauaaacuagauuuauaccugaauugguguccugaaucucuauggaaguaauugcuuaguaguaauuuacauaagucuugcucuacucuggcaaugugucuuaacucacuuaauucuuucaacaaugcuaagaaacguguugucucacuuuccucacuuuauagucuaucauaguaaacccaaggguuagaggaauucuccuuugguaugggaaccuauucauggcaggccuuuauaaccucucagccaguguucuaaccauugagcugcauuugcuccuuuucugaacucuuaauaaaaaaaguucauuuuuguuuaugagaaggaaaaaugaauagaaaaaauuuaauuucuaaaaugaaagauguuuuguugaaauguauauuuuuaacuauuaaugaaauuuaggcacaucuuaaaaaucuuaaaaugguagaaauaaaucuugguagguguuggaaaguagaauccuaacuacauauaagaaaucgaaauuucggguucaaaaguacagucccacaucacuaaucuucagguacaacucugcuuacucccaaggugcaaugcugguacucccuccaugucuugucuucucuuacuuuuuucucaguaauaucugcuugauuaagucagauaagguuuuguguagagagcccacauucuccaaaggagggguuuugguguccugagaaggcucuuuuaucacucauuuauaauguagauuuuuaauuuuucuucuucuaaugaauguuugucuuuauaggagaaacaaaaauuuccggucaaaaccuguucuuccaaaggugaguacuauggaaaaacuucuuuuuuuuuucuuucuuuuuuuuuuuuugguuuuucgagacaggguuucucuguguagcccuggcuguccuggaacucacucuguagaccaggcuggccucgaacucagaaauacgccugccucugccucccaagugccgggauuaaagguguguaccaccacacccggcuuggaaaaacuuuuuuuauuugcuuguugaguaaguauuuuuuuaauauuugugucaccaauguuuauaaaucaaggauaagaaaaaccuuauuuacuuccaaaauagagacuauauguacuuuguugacuacauuuuauucauuuauuuuuaaaagauuucuuuauuauuauaucuaaguacacuguagcugucuucagacacccagaagagaucaucagaucucuuaaggaugguugugagccaccaugugguugcugggauuugaacucaggaccuuugggagagcagucaguacucuuaacugcuaagccaucucuccaaccaguugauuccauuuuaaaaguaacaaagucuuuuaggaaauggacaagccuaauaguucagguagauaauuacuugugacaaauaccauccuuuaguuucuauaaaagcucugaauaugcaaguucuguuuuauaauugguacuuuaauuuuucuugagccagcuuaaagugaaaaucugaauucugagaacauuucuaauuagucauuauauaacucucauuuauuacagauauuacacaguauuacuauaaagaguuaaauagucuguuguaaauacuuaggucugcuguuguaguauaaacacaacuuuagauaauaugaaacugaacaaguauguccauaugcugauaaaacuuuucuuaugaaaauuacaguuaugaaguaguaacaaaaauaauuuuaugggugaggucacuagaacaugaggaacugaauuaaagggucauagcauuaggaagguugagaggcauuccucuagaccauggggagaggcuuuaagcagguauuuaagggauccauuuuuuauugcauuuccuuuccaaaauaagagauauagaagaaguagaagucuagcaauucaauagagagauucaugagaaacaagaucaaggagaagaaaugacaaagacugaaaauggcccgagggacuuaagggacaccaucaaauggacgaaucugcauauuauuaauguaucugaagacagaaagaaagggacagaaaauuauuucaagaaauaauggcaggaaaguucccaagucuagggaaguaaauaagaauccagagccaaggcaguaaauaauauaaaucuagagagaccuauacaagacauauuauaaucaaaguaguaagauaaaaacgcuguaucuuuuuguauauaugucccauaacccccuuacuuaacaauccugccuuucaaaauggaaccaaauuguuucagacaaaagcugagagaguuuagaacaugauacauguccuuuguuagaaauacuauaagcaguucuucaagcugcauacaaauggugcuaauuaguaauaugaaaacauaaaaguauaaaacugaaugguagggaccaaaaaccauuugguaccuaggugauaacacacugaaggcuauguauuuuguagcuaggcacuucuuaucaaauggggaaaagauaggguuaugauacaugucuuaggguguuacugcugugaacagauaccaaugcaacucuuaaaaggacaacauuuaauuggggcuagcuuacagguucagggguucaguccaguaucaucaagguggaagcauggaggcauccaggcaggcauggugguagaggagcugagaguuuuacaucuucauuugaaggcagcuaggagaagacuggcuuccaggcagcuaggaugagggucuuaagcccacgcccacagugacacacccacuccaacaaggccacaccuccuaauagugccacucccuagggcaagcauauacaaaccaucauaacacagaugccuauuuaugccacuucuaguaaguuaaugucaaaagucugugccagagaaauuaggcaaucuucuuuauaaaaaaaccccaaaaguuacuuaacuuguaauggaagcagugaaauagucucuguuaacuugugacauguuauuaaagcgaucucuaaagauccucuaaauaacuguuagaaauaauuucugaauucaguaaaguuugagaacagauauaauguaaaaaagucaugcuuuaauagacuaccucuacuaucugaagaaauuauaaaagcaauucuguuuauaauagcaccauaaaauagaauacuuaauaguaaaauuaaucauggaagugaaagaucugucuauagaaaauuguaaaauauugaugagacgaauuaaauacaacacgaagaauggaaagugagcuuuauaauuuauggcuuagaaaaaaauacgaagauaaucucuagcaccuauugggacugacagauuuuuauaugggaugcagucccuauaauuuucaugucauuuuacacagaagugggaaaaaauaguuuuaacauaaauacacaaaguuccucaauagugaaagcaauguugaauaaaaagaaugaagcuugagaugucaugcugucuguugcuacuuaaagagccuuaguaaucaaaugaacuaaaaagcuguaguaaucaaaauuggguuaaauaccauuuuaaaacaaugacagacuugaaaggugagucauugaguaaaaguacuuguugcauaaccccaaggcccugaguuuaaaucccaagaaaucacauaugauuguuauaauaaguagcaugcaucuauauauauuucuaauguuuauauagcaagaugggaauuagagacaagaauucccagaagcucaugaucugucuggcauauguaguagcagaauaaggaacuguuucaaacaaggugaauguugaaggguaugccagaacccagaucucaaaaguaaacaccuuugcuaaaauuaaauggcuuugccuuuuauacuucauguagauggugucucaucccauugaugaguggugagcuucacacaugauuaaucaacacagaggaaaagcgguagagccuaucagucuaagcacuucgaugaaaaaacauuuuucacaauuggaaagaauuaaagcugucugaugauauuuuuuauguauuacacauacacuuauauaauguuuuucccuugucuuuagcauuugcuggagguaaauucuuugaagcaucugacaagacugacccuucaggaucgaauuaccaaaucucuucuucauuugcacaagaagaagaaaccucccaguaucagcgcucaguuucagguuauuaccuauucuacugaugccaaauaaaaucuguuucuuuuuuuucuugauuguugaagaaucaaagugaauuauaagaucauugaugugauauguuucauaugcguaagaagccauaguauugagugcuuuuaugagaaagggaguuagauuguauuuccaagaaucaaagguuuuucuuuaauaaaauagaaaguggaguuagaaagguuuaacccaaaggaaguagacagaagaaaaaacauaaauagaauucugugaagcuaugaacagaagaggggcuggagagauggcuuagcagugcuugcagaggauucaaguuggguucuuagcacccacauaaggugacucacaaccuuaguccaccucccgaggauaagguucuuugggccuuuaugggcaacggugcuauauaguacauagauacauacagacacacagagacacauauacagacacacgcauacacacacacauauaaauaaaauaaaucuugaaaaaaguuuuacaaggaaaacaaaaccuaaagacuguuggaguaaguaaacaaaaagcuuugguucuuuagcaaaaacuguuaugccacuagccagaauaacuggaauauauauacaaaaccagcuauagaagagagagcaucacugcauccucuacagacauuaaauuaagguugugcuucuuuucuggaugacuuuaaaagcuugucagaauggaagaauaucaggguagagcauggucacauaagcuguaauaugagcacucugaaggcugacauaggaacaucaaaaguuaaggucagccugagcuacauagcuuguuacagguaggucaaccuugaacaaauauaaagguccuaccuaaaaacagagauaggagcaaggaacaaaauuacccaaaaugugcauuugaauaaaguuacuuaaugaaugugaaaagcagugaauaauuagucucucuuuagaguguucugaaaugcaucugcaauaauaacuauugcccgaguaucuauuuuuaagauuaagauuaaacuguauuaguuauccucagcaauucuugauuuaaccugaaugggaauacacacaauuuccuuuucagaaacaaauuuuucuauguauguauagaagguuuuuuuuugcauauuuugccacaguuguuuauaagucacuuguugucaacucuugaguaaaagagcauucuaaugacacaacuuuuauugcaggccuccuuaagcaagcugauggagacacuuggucaagcagaaccauauuuuguaaaauguauucgcucaaaugcugaaaagguaaaaguacuguauacaugacagcauaucacucagcuuacuucaaaaugaagucugaauuuccuucaagauagagaagaacugugcauacuuuuuguacagaaaauaauacuccauaaaaauuaucuauagcuagccuuuauauuuccacacuuaugcaucuauaaguuauuuguggauuugacucaguauauacuagaauuugagaggcaaguauuacuaccccuugaaauuccaugagaaaaaaaauuuauuuccugaaaauuuuauaugcucuuaaaaacuaauuagccuccucuguuguauauagucuaugucucuugcuuagaaauuuuaccugcugggcggugguggcacaugccuuuaaucccagcacucgggaggcagaggcaggcguauuucugaguucgaggccauccuggucuacagagugaguuccaggacagccagggcuauacagaaaaacccugucucaaaagagaaaaaaaaaaaaaaaagaaaaaaagaaagaaauuuuuaccuauaccuuuucuauugcaguaccuuuaauuagcaauuaaaggaaaaauagcuuguaucuaaaaagcuuaaauacaguagauauuaaguucaucuuucuugauuauuuauuugcaugcauauguacacauugccacaguacacauguggcggucagaggacaacuuguaggaauuaucagcuauauuuuacuuuauuuuaauaaucagucugcauuucugcuguuuaaagcuuuguguuggggcugguuagauggcccagugaguaaaggcucuugagucgagcuuuaucaccuuuguguucuuagaacccacaugagaaggagacugauucucauaaguuguccucugacuuccccauguguguuaugguauacauauacucgcacauacacacacucacagacacacacgcacacacuguaguugaguuguuucauuauuccauggcuuacauauuucaucuguguaaugaucuacuguaauuauaauauuaaauucauaguccuuucuugaguauuaauagcuuacagcuaugaagugcuuacuuccugcuuguauugaauagaaguuuaaguuucaauuauugagaccucgcuguucaaaaguugaguuaauaaaauguaucaggucuuaggauaaguucugaauauaugugacauauauuuagacauauaacacauacauauuugcuguuuuuaacaaaaucucaaucauucaauuuuaccaaugaagacucagaaugcagauguuguggugaaagccugcuagcucagagaggcagagaaaacacccagcccagaagggggaguguccuuuucagccccuaucccagaaggaaaaggaaguuguucuucuccacaaugucucagaacccccacaaacugaauguccuucccuucuacuuccugugcaucucucuauccauccucuugacuuccucuuaaucacuauguuuuuucuauuuucacuccugucaguugccuguuugcuucaccucuuguccuaagguugacuuuauuuaauccugauaacaauaaacagaaagcucuuggauuaauuaauuucuaacaacuagaaacagauuuuuuccaguaaaaaagaaaaauacaauuuugaguuucacagugugauuaaauauccugcagcauauguuagcuuucauuauuauuuaacauaaauuauucauuugauuuuuuuuuccuugauagauuguauguuccauuugggauugacuuagaagauuauuaaaacuaagauuaugagacugaccuggaaguaauauaagaagcuacaaauacaucucuuuagaaugcuuagaaaaguaguuucugagauaccuagggguggugggccucuuuccugugagugccuguguauuaaaggaguuucacauucccaggacuauaggauucuuuccccucuuuuucuguuugaugccuaugucguaagcaaaaguauuauagaaauaaacaguuuuugccuuuuaguaggagaauuuugucaguucuaagccaagaugacaaaugaaguagguaaguuauuuucuuggugacaguacuagauaaacaucuugaugagacacaaaauucuaaacauguaucaguuuaaauguaucagugccguuaguuuguagugacugagcugugugugagggcuuuggacacuuacauuucuacugaguauugcugguccuuugccuuuaugacuagaggagcuuagaaaguugauuucuccuucauuacucuaaggcaagcagucaucuucucauaaguuaccacuucaacugcaucuuaaucccuuagucagucccuggauacuuaaaguucagcuguacuuuuaagauaaaucugaauuuggagaauacuaacauuuuucuuuguuuguuuuagcugccguuaagauucagugaugccuugguacuaagacagcuucgguacacugggaugcuggaaacaguuagaauucgccaaucuggauauagcuccaaauauucuuuccagguuauauguuucuuucauauauuuaaauauacacacacacauauaaacacauauauucacaucacauauuguuucuacauaucuugauuuauauaucuauagauauagauaucuucgggacucauuugccucuuuuacuauuuuuauacaaguuguaaaagcauuaagagacuaccagcaguauguuggacauaugucaugauagaauauaguacuuggcuauccucauuugcucugaauguuuuccaauguuuaguuuaaccauaauucagcaguuuucacacugauuuuuuuccauaauugaaauaauucaaugagaauuaacuagucaaauaaaauguuucaguugguuuucccugaaguuuucuuagucagaugucuuaucuaugaagcuauagaauguuauucagcaaucuguucuguguguaaaaauuauauuggaaccuuucaggaacugagcaguuuuugcuguguggaaagagaaaacuugauucucaauuguauguuccaauagcugcuguauuuccuauuaccccuuuacuaagauuucaguuucuugcuaaauaacuuuuuuuuuuuuuuggacuuucucaaaaagaauaacaaacuucugcccuucuuuuuaaauucaacuuccauuugguagcauaauguuucaaacucaguaucuuuccuuuuguugguuuuaaaacuauguuuuuaaaagguguuuuuaguuuuauuuuauguuuauggguguuuugccugcauggugccucacaugcaccauguaaguauaauucuuuugaagagcagaagcaggugucacauucuccccaacaaguuacagauuguuguuagcagguguguagauaccuggacuauaacccagaccuuggaagaguguccaguguccuuaaucauugauucaucuuuccugccccuccuauuuauaauauuuuaaaguaauacucugucuuguucaccuuacuuuuuuauuaauguuuuauucuuugacaauuucauauauaugcacauauauauacauacauacacacacacacacacauauauauauaugcagauauauauaauuauuucugguuauucccauaccuacucucucucaucaguuuucuaccccucccaguuuaccuucuacuuuuaaaagaaugagaaaacaggcccuagaauaccuucacuuguguggcucacuacucucuuacagaguauucugcuauuuucccccauugccucacuuuauuuuuuuuuccauuuuuuauuagguauuuagcucauuuacauuuccaaugcuauaccaaaagucccccauacccacccacccccacuccccuacccacccacucccccuuuuuggcccuggcguuccccuguacuggggcauauaaaguuugcaaguucaaugcauugccucacuuuaaauaaaguuuuauuuuuauuaaaaggcugagaaacccaucaauaagaggauagucuguuuaggguauauuacucaucuaguacuuuguaaucugauaccauuuuuguuuuacuuuuuuaggauuuuguuagccacuuucauguacuucuuccucaacauauuauuccaucuaaauuuaauauucaagauuucuucagaaaaauaaauauuaauucugauaauuaucaaguuggaaaaaccaugguaaguguguauggccuuaguuaaaauugaguuuuuuauauuuuaauaauaccuuucuuugucuaugauuuuuaugaaaagauaguuugcuucagguuauuacaaggaaauugauuaagcuagaugguuuuuuguuuacauaucuaucuuucuaucuaccuaucuuccuuuuuauaucugucuaucuaucuaaucuaucuaccuaccuuucuuuaucuguuuaucuaucuaccuaccuauauaccuuccuuucuauaucugucugccucucucucucucucucucucucucucucucucucucuuucucucucucuuccucucucucuuucucucucucccucuguguguguguguguguguguguguguguguguguguguguguguguguguguguaagucagaggaaaacauguggaucaguucucuuuaccaugugaguccuagggaugagacucaaguuuuuggucuugguggcaaguaccuuuacccacucugcuaucuugguugcccauaaauuugauuuguuguuguuguuguucuauuuguauauggauaaugugugaaugcuagcacacccauggaagacaauuuucaggaguugguucucccuuuauuuuagguucauaacugaccccaggaccuuuauuuuuuuuuuauuuauuuuuuacuuuuaaugacuuagcaauaaaagugcuugcugucaagccugauaaccugaguuuaucccagaucucauauaauagguagaauagaacugacgucuauaguugguaacugaccuacauacaaccuaaaauaaaauguaauuaguauuaaucauuagaauuucuggccaauguucugacuacagcuucaucuauauuucagacuauuucuaagauauuauauaguaaugaccaacugccauuuucaacuauuuauuaccuuuuauuuauauuuuuucuuccucuuccuucuccucuuccaauuuucaaggagaaaaaccaugaucaucuugggcuuacccugugauuuaauccuuuuguaaaaacuuuuuugauucccccccccccagguuaggaaugaaucucauauuucagccuguuucucuauucugauucccccuuuuauuuuucuccuuagcuccuuuccucuguauuucuuugacaauauuaaacugcuguuuuugcuauauuuuagucauuuuauuuaauuuauucuacccauuuauuaaaauuacuuaaauauggugcuuuuuugaguuuuccaauuuuuuaaaacaauuuuuauuagauauuuucuucauuuacauuucaaaugcuaccccgaaagucccauauacccucccuggugcuuucuuuauauugaccucauguucaauuauaaucucaauggauuacauuuauauaucuuccucacuugcacugucugauccuccuuguuguuggggcaacaguacuacauaccuacaaucuaaacacuagauugcaguaucaggaaaaucacuuauucaugaccauucuuggcugcauagaaauuuaaggccagcuugggcuauaugagcauuugucacaaaacauaagacaauauaacccccacuuucauacuguagcuucauaauaucucacaguacuuugugaagauuaacauugagucuuuuuaguuuuuuuaacuuuucaaauugcucagguaagaucgucuaccuccaguucucucucucucucucucucucuuuuuuuuuuuuuuuucgagacaggguuucucuuuauagcucuggcuguccuggagcucacuuuguagaccagacuggccucgaacucagaaaucugccugccucugccucccgagugcugggauuaaaggcaugcgccgccaugcccggcuaccuccaguucuuaguaguuuacucuuuaacucuuguuauauaauaucuguaguucuaguucaaagagauuugucuaauuuauacuuuguauauaccugcuucuggcucuggggaguacgaagccuuuaauguacacuagacuugaaguagaugguuaucguugguuccuucagguuauaaucacuuuuuaagaucuguggcuuuuaguuuuccccuuaauccaacauuuucaaaaauugugccacacaauccggugguauucugaucuuuuauaguaauauuuuuuuccauaugagaggcaguaauguagcauagugauuugacaguggaaaguuggugcuuuucucacuuucccauuucuucucucaugugcaaguaucuuuuuuuuucaguuugagagugguuacuucaauccagaugauagaugauuggugcuuuguuugcauuucugccauuacauguguucucugaaagcuuaccacagaaauaauaaugcaugaauaauuuucaauuuuucuuaagcuuuauuccuugucuaucuucauucuaauagguuuuccuaaaggagcaugaacgacagcacuuacaagaucugcuucaucaggaagugcuucgcagaaucguacuguugcaacggugguuuagggucuugcucucuaggcagcaguuccuucauuugagacaggcaucuauuauuauucagguaugaugagaaagggauucucuaugugaaagugacuuuguuucaccuuaauuaauuaaccagaaccauuuuacugugaaacauuaauaaugaaauuuuagugaugagaaugaaucaugcuuauuucuuuuuuuuuccuuuuuauuuauucuucucucauauauuacaucccaacugcaauuucccuucccccucccuaccacccuuuucuccuggauucacacgcccccacucuuaaccuccccucagauaagaguggccauguagggacaucaaccaaauauggcauuacaagcuauaaauagggcuagguauauauucucacaucacagcuggaugaggcauccaguaggagaaaaagagucagagauugucucugcucccccuguuaggaaucucacaagagcacugagcuacacaaccauaacauacauagagagcacuuaggucagacccauacugugagcccacuugaguccuggucaguuguauucuguaggcuguguuuuugugguggucuugaucccuuuggcuccuccaauccuuacaccccauccuuuaugggacuccccuaggguuucuguuuucuaaagagccaaguuuuuacucauuaucuuacauuugagguguccuuggauaaguagucugaccugugggucucguuuugcuuuuguuuugccauaauccucaauggcuacuuuauggaauuuuucccuugaugaauuuuugcagaggccuuuccauucucuuaguuuccuguugucaucagcuuuaguaagguugauuuagugcguaccauaaaggguuuccauuaacauggcagguaggcucaucaguuggcugcaaguccacaaagaugggcauggcacuugcuuaaggcuuuggcaauucuguggaucccaucuguuaaggcauuucagucuuagaagaggugaucuuuugcaccuccugugaaguaguauuaaguuccaauacaccuacagcagcagugcuuuguuugggcacagcagcagcuuauaggugagaccaaaccuggaccagccaaagcaucaacacaacucaguggcagcauagaaagagcuguuguuauuuuuaaccaccaacaaguuagcuacauauacuuaaaauguagauguagaaauuuagccuguuuuacuuuuucuaugaaacgagugguaaugugacagccauuuucucuuuucuuuucccuuagcgauuuuggaggaauuaccuaaaucagaagcaagucagaaaugcggcuguggagaaagaugcuuucauaauggcuagugcagcuucccuucuucaggcauccuggcgugcucacuuagagaggcaacgguacuuggaauuacgagcugcagcugucauuauccagcagagauggagggaacucuauagguguaggcacaaggcugcuaccuguauacaaucaagauggaggggcuacaggcaaaggaagaaguacaaagaacaaaggaauaaaauuauccuguuacagucaauauauagaggauuccgagcacggcaaagguaaucuuauuuuaaugaagcagucguuccuucugauuucauaguuccuuuguuuaaaccucugcuuuaauacuuuuauuauuauuauguuuuuaucacuagacugugauaaaacucuacuaguuccaaccuguauugucugugcaaaauuaaauaaauguucauugaauuaaaucagauuggaaaccucuaugaccuaaggucauaacugcuaagaauaaacuuguacauuugguuuaaucguauaaauuuggaaauaaucaacuuuuuuuuuuaccucaagaacauugaucucuauuguacuguauuaaauuaaugauauuaauggauuuuuaauacaguuaacauuuugucuaggcuauucaguuaggaauuauucauauaaagaagagacuaaugugaacaaguacaaucaaauuaguuuuagaaacauauucaugaguacagaggugcauacuaguccuaccuaaauaagggaucuaggcaggaagauuacuugagccugaaguuuaaugccagcuuugaacauaguaaggcucuaccuccaaaaaguauuucuauuaaaaaaauauauaguaaauguaauugucuuuauugguaaccaagagcugucuauaacccacuuugucuauuuuuguauagauguaaugcuuuaaaagaggaaaagcugagagaagcaaaacuagagcauggacuggugcaugucaaggcauguggaccucuagaaauccaggguucagauccuucugagugggaggaucguuccuuugacaacagagugaaagccauagaagaauguaaauaugugauagagaguaaucgaauuagccgugagaguucaauggacuucucaaaggagucuccagacaagcaacaggagagaggcagacgccaaagugguacagacuuacaggaagaugugauuguaagacagaggcccaaguccuuggaggaucuacaucagaaaaaaguaggucgggccaaaagagaaagucggagaaugagagaauuagagcaagcuauauuuagcuuagaauuacugaaaguccguucucuugguggcaugucuccuucagaggaacguagauggucuacagaauugaugccugaaggccuucaaucuccacaugguacuccugauagugagagcucucaagggagcuuagaacuuuugaccugugaugagaaccaaaagagcaaaccagagucucucauuuuagaugagggagaauugaaaauuucaucacccaauacauuuaccaauccaaaaucacaagauaaugcccucagugccucaagugagacaagcucuacauuagcuggaaaaggagcauccucugacucagagcauuugaagaaugggacugcaaaggaaaagcuugucuguaguucugaaccuaucaccuguaaaccccagcugagagacucuuuuguuucaagcagucugccuacauuuuuuuauauuccucaucaagaagcucugaaaacaaguucccaucuugacacaaguauccaaagaaacaaacuaccagaaagagaagccauuuugaagacgacucuuacucaggauauuaacagagaagccaggaagugucaguuuucaggagaucagaugacuccuuugaauacggauucuucaugcacugugcuuaagaaguuagaaaagcugaauauugaaaaagagaaaaggcaaaagcaguuacaacagcagaaugaaaaagaaaugauggaacagauucgucagcagacagauauuuuagagaaggaacguaaggccuucaagacaauugaacagucacgaacugaggccucugucuuggcaccauccuuuuaucagccaagacaaaaaguagagaggccauguucucuguauauccagaauacuccgaguaaaggagaagcugguguacuagguuccccaucagcagucacuaaaagagacgcagcucuugccacaaaagauagucccuccauucauuuacccccaaaagaccgaccugucacccuguucuuugaaaaaaaaggaagcccaugccaaucuagaacugucaaggaauuaccgaagacagaaagaacgggcacccaacaugaugcugccuauaaacucucuaauaaucgcaguacagaaagagaccacuuuaagucaacacacuuuuacagccacagaucugaugacccuuccagagagggaaguucaagagccauuuuuuucacaccaaaagacaauauuacuccccuguaagugaaauugguauuuuuauauguuaagugggggaauuucucacauaaguuuguugaagugcuuuguguucugcucuguguacaugaaugcugcucuaaucugaguuuuuucccccucuguguaaaguauagauaauuauauccuagaaauccuuggauguagauaacacauuuuuuuugguauucuuccauauuaauugaaaaaucauuuguaaaaggcaauguugugcuuauaaguguaccaggcauucaacaguucugguugcuguaggacuaugaaguauagugauccaaacugauuauugugaggcuuuucagaacuuagcauguuuucucacagcuguuggccuauuuauggucuucauuaaugucuucguuuuuuguaugauaauuacauauaaagcuuaguaucauaaauuuuaaguguaugguauaguaguaguuguuguguaaguuguuuuacaacaugucuuuuucaucuuacagugcugaaauuuacucacucuucuuuuuccucucuucaguugcugacaacuaucuucuacuuuaugauuuuuuuguuuguuuguuuuuguauuuuugagacagggucuugccguguauccuuugcuggccuggaauuugcuauguggaacaggcugaucuugaacucauagggaucugccugucucugucaaccaaaggcaugugccaccaugcccaaaucugacuuaauuuccaagagucaaaugcaucuauuauaagugggaauucuuuuuaguuuuuauaauuagccacagaagcauuuuaacucauagaggucaugagaagcuguuuucugguuuagguuguuuguuuguuuuaaauucugauguuugugaucaaaccugggacaucaugcauguuuaucaagcaagcaccaggcuuacacagcuggcacucacugagucaucuccccagacuccauuuaugagaguuaaggaaacgauuucuaauggaaaacaauuaacuuaacagcuaguguuauauguuauugucuauuuuaaacuagucagaugcuaguaguuaagucauaacuccuaaggaguuugaagucuaaggaugaauuuuaaaacucauaauacuaaauuaauuagugccaugaaaaucuagguacugcucaaauuuucaccagauucugacagucuauuucaauauagaaauuuaaugguaaaauagucuugccacuguuuuuuuuuuagacaaaauuaaacuuucauaacccagucuuauaguauuuguauuguuuggcgcauacuucauuuugcuuauuaacaauucuuauucugccauuguuagcauuagccucacauuuuaaagguaagauagugguuagaaacuuagaagaguucagaaagugauuuuuuuucuaaccaauaggaacaucccaaaguaaaacaagaucuucauuacuaucauauuuuauaauuaugugaaaagccuguuuaagacaagaauccuaaagauggaagggauuuagaaauuuuauuuucuuauuauugaauugacuuugguucuuuuuuaaaaauuauuuauuuucauuuucuuuucauuggugucuugucuacauguagguguaugugagggugucagauugugaaguuacugauaguugugagcugccaugugggugcugggauuugaaccugagucuucuggaagagcagacagugcucuuaaccacugagccauuccuccagccccuugacuuuuguuuuuaucuaauuuugcugcuaccuuucuuaaauguaugccaccauaguggaauauauccagugauuaucacaggagccucugugaauucaucuugcauguagauucuugauuauacuguugauuggauacgaaaaauaaaucuggggacuugggagguggcucaguggcuaagaacacuuguuauacaagcauaaagaccggaguuuggaucuccagcauccacauuaaagcagaguguggcuguacacauauguaacccuaguucuguggccaguggagacaggaacauugcuggagauuucuggccaguaaucuuagccaaaaaaaagaauaaagaauaaagaaaaaaguacacuccagguucaguuagagauccuaucuaauggagacaggcagauaauaacacagcagaacauccaguguuguccucuggcuuccacaggauaaugcagacaugugcaacuaccuacuuauaugcauguguguaugccugcauacacacauacauauacaugauaugagauuaaauauaauaaaugagauucuggauugacuaagauuuggaauuauuuauagaauuugauagacuucuuugacuuguucuguacuuuuaaauuauacuucauaguagggugugguggcacaacacucaguaggcagaggcaggcagaugugagcccaaggcuagaacuacuuggugaguucugagauaaccagggcuacauagagagacacugucucaaaaaacaaagacaaacaaaauuauaauucaugcuauacuuuaggaauaucugcuaggaauugaaacacaauccuguuuauuuuauuuaaaguguacacaguggaaauccucaagcccacaaacaagaugaaucagcuuggaaaccuaaguuagcagggcccgggcaacaagagguaaguauuggaucuuauuuaucuuuuaauuagaauaauugcacauuauuuuggaauuuacuguuuuuauagguagaacaccuuaucuacccauuuauuuuauucauucauucauucaaaaggaagcuguaggcuaauaagccuuuuauaauuaggaagguguguacuagucaagaaugguaccuuaaaaguacaaauuauaagauaguaguugcuaaggcaaaaaaggacaguuuguugaggugauuuuggugugaccugugguacugaagggugaccuagcucacuauggagaagaaugguauagacuuaacuuggacccuuaucuguuguucacaauaaugaguauggguucuuuuugguccucccuguuacuucugcuaauagacagggcauagggcacggugggguggagggaaguuuccagacacucaugagcccucuuucauuggcaucuucucccaaauuacaaaaacaaaacauuguuguguuauuuguuuuaucauuuggucaagcagguugccagaccggcccauaaaaagaaagcucgaauggcgcggacgcgcuccgauuucuugacuagagguacuuuugccgaaggggagggggauacagaggaagaugauuacgaugacauuauugagccccuucucucccuugaccaagcuucucacucugagcuagggccuguauccagccugggucaggccucucacagugacuccgaaaugguaauuuuuacagcaauaagaaaaaacagcaagcacaucugcucggaguagucuuugcuaaucuaaagcuaaccuucacagcuuuuuuccauauaauggcuuguacaugagaagccucaggacacagcaacaaaagcuaagucuaauuuaauagaacucaaauaaggggcacuuuaguuguaucuaucaaaugauaaauuaggcaaaauugagauuaucuaaauuagcacugauguagaaauguugacucucuuaccuuuaaaggucuagaguaggaaucauaaguuuuuaauuuuaauuuuuauaaaggaccagauaauaaauauuuuagacuuuguagaucuugguuuuaguuucuugaagcuacuuaaucuugaccacuaccacgugaaagcaauaauagauaauaagaugaaaaugggcauggcauuuuaauaaauaugcagaacuaggcaaugggcuuuauuugacuuacuggucagagcuuucugaccuaguauauagaguaagauaacuguuaaauaaacucauacuuuaacugaaagacuauucccuuauaaauuagggguaggggaagcuuuacaguuccuaucuucuccuuucugguaagaaauagaaaagaaacaugaauuuuguauaaugaaagugggcaugguggaacacaguuaucucaaggucaaggccagcuugaacuauacagugagaccaugucucucaaagacuaagauggauaugaucacacguuuagaaggcuggggaaggaggauugccaaauuuugguaccaacaugcacuacauaguugaaggccaagcuagauuagaaagcaaagcccuaucaaaaacacuaacagaaucaagcauauacaugcaaaccugaucucuaacacaguacagacuauauaauuuaaugagcaaaauguguuauccugggccaagccagccauauagguuauguauaguaugaauuuguuuuaaacagaaauuaaaacauuucaguugaguuuuuaaaaaccuguacuuauuuuggcuaagaauauaacuuuauuauuaucugaacuaaaauuagggcaccauauuacauguacuugcaguuaucuuaggguaaagaguuuaauucuuggggccaagauaguugcuuaggagguaaagugcuugcuguucaagguccugaguuuagacuccuaguacccaauguaaaagccaaccaugcugguaugagcccuuaaucucagagcuagauagagauagaagaauuacagggguccugugguuagucagcuuuaccaaauggucaagcuccagauucagugagagacucuaaaaaaaaaacgagauagccgggcauugugacaugugccuuuaauccuagcgcuuggcauuuuaguggcagaggccacuuuggucuacauauugucaggccaggcuauccagguuacauagugagaaaaagagugauagaagaagacacacagacacacgcacacacacuuuauucuauuauuguucuaggaaaugacaguauagagacccuaauuaagucuauuaggaacuaaaacaacugugauugaugaaauaguuauuucccuauauaaauuggcccucuaaucuuuaaugucuguuuacuguagaagagucuuacgaugaucuuugagucauuacauauuugaggguuaaacuguuauguuucaauuauauuuagauccaguuagaauuuuucuauauuucucaaauguucugauuguauucaucucuuaugaaaggcuagauucaguuuuuaaguaauaauguugguauucuguggaggacaaaaccaaaaaaaugcagggcaugcucccugauaaaacaaaauaaguuauagaccugaaaauuguagaaguuggaaaugaucuguacuccuaauguauguaaauagagcucagaucucuuuuuuuuuuccauuuuuauuagguauuuagcucauuuacauuuccaaugcuauaccaaaagucccccauacccacccacccccacucccguacccacccacucccccuauuuggcccuggcauuccccuguacuggggcauauaaaguuggcguguccaaugggccucucuuuccagugauggccgacuaggccaucuuuugauacauauggagcuagagucaagagcuccgggguacugguuaguucauaauguuguuccaccuauaggguugcagaucccuuuagcuccuuggguacuuucucuagcuccuccauugggagcccugugauucauccauugagcucagaucucuugacaguaggauuaaguaacuuaugaaagugcccuggggcuggugagauggcucaguggguaagagcaccugacugcucuuccgaagguccggaguucaaaucccagcaaccacaugguggcucacaaccaucuguaaugagaucugacucccucuucuggagugucugaagacagcuacaguguacuuacauauaaccaauaaauaaaucuaaaaaaaauugcuuuaaaauaaaaaaaaaagaaagugcccuauacuugaguuauaauaaugaauauguauauacagugaacaauauauauauauauauguauuaguuaaaauuuuauauguaacaaacaaaucuuacugaaaaauuauguucucuagucuguauagguuuauuguuuauggaagaacuuagcacuuuauaacugcugcucuguuccugagaguuucuuguguaacaauccuuagucuuuucagugguagaauacuauucacacugggaacucucgcugggaucaaccaggaaguuaggcuuucugcuuggagcuuuuagcuccuuuugguguuguagccucuguucaccugcuugacagucacugcaugcccguaguuguagagcaccuuccugcacagugugucggucaccucuagcucucuuacucuccugauuagccuauuuuaggaacaggugguggugcugguuucugguggaugcuugcaugaggaagcuuugcuuuguagaauaagcuaguagauauuuacuggaguggggguguagagggaagggaagaaaugguuuuaaaauguguuuuucugaugcuucugaaaaugugucauauucuaacuaugauacugugauggugaaucuuacuguuuaguuuauaaggcaaauguauugcauucuuaaaaugcuuguuuuuuaaaaguggauuuguguuuauugggugcaugaauuucuaaaaaauggauuuuuuuuccuuggguagaauggugcugucaccaauauuugcugacuggggagcaugguaugaguucuuagcagaaauggccaucugcuauuuuaguuuuaaauucaccaaucuuacaggauuaaaaccaauugcaaauuaaucaccuaaagggaauuugaaauaaucacuacaucugaagaugguuaauuaauaaucauugauguuguaggagaguguaggcaagaguuauaauuucccacugcugugacuuuuauacuuuuuugaaagcuuauauuucauuggauauuuucuuuauuuacauuucaacuguuauccccauuccugguuuccccuccgacaaacacccuccccuuuguguuuaccuuugaucuacaaauuucuuugcuuagaugaagcucuucuagcagucaguaguuacucaggaaggacauaaaaugcuguuaagucauaucucaguuauggaaaucuagaacacugcuaacuuaccuaacuuuuuuucuguagccuugauauuuuaggaaccaucuugacuacauuaaauccaugauuuaggugcuauagaaauggcucagugguuaagagcacugauugcucuuguaccuauguggcaguuugcaaccauccaggcaauccuacaguuauacauugucaugcauacaagcaaaacuuucauauacauaaaguaauaaaauauuuaauguaucuaugauuuauauuuuaagucagugguucaugauugcuaugccuauuugaaaaugcuguuuuauagauaucuuuauguaguauugucuuugccaauucuaauucucuuuuaugugugauuuauuugaucuuuugguuuggaaugaucacuuuuguuucagguguaggauaugauuucaaguugaucauuuuagauuagugauccacuauaccuacuagaaucuguauguaaauucuugucuuaguuuugucuuuggagaaguuaucuuuauauuuacuauuauuuuguuucuuguuuguagugacuuuuguuugucuuugucuugucucugacaauuuuugcuuuuauauccuuuaguaguucccaauuaaaauuuuguguuuuucuuucccucuuugguaccuuauacauuauuuucaaguuaauuuuacuuuauugauugcauuuguuuuuugauaguugauacauguuuauucaaaguaccuaccuuuacuuaucucucccccucuuccacuuccguucucaccuucuuccuuauagacuccuuuccuacauucacuuuguuuuguuuuguuuuguuuugugcccacugaucuuaacaaaccauguagccccaaguuuggaacuauuuuguacacuacuaaagacaaugacuguuccuuucuuagaaccuaucaguugccagugguucaucauggagggagugagccccaugagccccucccaucuaagauuggugguugacaggcucaguguaggcaacuccugcuaccuuaagaucauguuugcaguuguggcaugcuuugaagagaguguuuuauagcccuccccuccuuaugcuaugcuccucccuuuuuagaugcuccaugaaccuuagaugggaugguaaaaauguccuguucaggguugagcugucaacuaucauuuauucuaugccucuugaguggcaaggagacucuuuaaucacugcuguucacugcaaagagaagccucucugauuaaggaugagaauagcauuugucuauggaaauaaacauaaauacugagaauauaguugagugccuugccaguuuacuugaaagacaguaaugaggucuucacuuaccugugaccucagccauuucuuuuucuuuuucuuuucuuuuuuuuuuuuuuuuuuugagacagguuuuuuauuauauagauagugcuguauuguagcuuucuagaccagguuggccuuaaacucacagagauccucuugccucugccucccagccauggguucuugaccagauuuacaguaucagauauauacuuucucccauggagcagcaagcuguuccccugcuaacuaccuuucauaauguuagaaggugcuguguauacugcagggguagauacagcaucaacagucuuacccagcuggaaacccuaagaacuuaaauaccaguggcagaaagaauguacccauugguguaauacugacacaccuguucuagguuguaaugacuaaauuguuugauucuuauuuugguucuaacuuaauacucuauuucuuaauuauuguaccuuuguauaggaguuguauguuuuaauuuauucauuuuguacauuuggauugguuuauaagauuaaaaaauuaugaaugucuucucuaucaguguaacaaaauacaguuucuuuauggaaagccuguucucuuuuggugaucaagcaauguuucauuccccuuucucuuuuaacauuuugauucuggauuuuugagcuuuuuauauuuauaauauagucuccaaaaagaauuuuuccuuauccuuuuacaaauuuaccuuccucuagaagcaauggcuuuagcaauuucaagucuuuuauuuucugaggcagaaguuucacucuguaaugaagucugguccaaauucacagcaguuuuucaguguuaaccuuucaaaaacugggauuucagguaugagcuacuuauguucagcuucucuuuuguguuucaugcuucagguaggccuuuucuuucugccauuuacuuucagucaaucauaaggccacuuccaguuuuacccuuuguucuucuacacaguuuccuuagacuaacuuuauucuugauaaaaguuuaugcugggauuauguuucacuaugugucugcaagugauuugaaguuugcauguacucuuauuuucaguugucuacuagguuuuguuauuuucuuguuugauaguuuuucagaaugucacuauguauuuaagcuacuuggggaguuuauaguuugaauaucuuaaguauuccuuuuuccccccucuaagcaauuuacuuguuugggaauauaggguuauuuugucuuguugaguuuccucuacauugcuaguauuuacuaauugcaaccuugugccaucauuuaaaauagcauuuaccagauaucagaaauauaagaggggagcaggaguagugcacaucucuaacccuagcagucgggaagcagaggcagcuagaucuuugugaguuccaggccagccugcccuauguagaguguuccaugccagcaaggacugcauagugauacccugacuuaaaacaaugaagcuaggaaguaguucuuguacugaucuugcagaggacccauguucaggcccuaauaccuaugccaggccacucuccacugauucuaccuacaguuccaggaacaugugacacauugccacccccuguacaaaccuaugcucacacacaugcaauuaaaaaaugaaaaugaaaaaaaaaagauuaggaguaugaauaugcaggcaucuucuagggccagcaccaacaguagcuugguggauuuggcuuccauauaaaaggccuuugugguaguagagcuccacccucucaaaaggauuugaugcuuuagcagccacuggcccaguuggaguccaccuugaugaagucucuaggcaguuauuuaauuuuuuaaauuuauggcaacauucugggacacuuccucuucuuauuucuucugcagagaaagaaagauacuuagcuaggcuuauauauaguucauauaucagaagaauugcuuucucaauucaaaguauaguucugaucuggugugauuuccuagcacaaaauucaugauucccaagauccuccuagagcauggagcacagucaccacacccuuaccgaaucaucauacaggugucuuuaggaacagcaacucuuuucaguacccuacuguuuugugugugugaauuugaguauucauacaugagugcaugucugugcacucgcauagagcuuaaccauuaauuuuugguguugcucuucaguuacagucuacauuaguuuuugugugaaagagacuuuuauuggaguagaaauucaacaauuuggucaggcccagcaaacaccagggaucagccuguuucugccuucccacugcuagaauuuuaaguaggcaccaccuuacuugguaauccaucaccaccaccacccaccaccaccaucaucaaauauuuguguucuggggcuagagcucaggccuucaugcucucaugcuugucuaacacuuuauggacuggggaucuguaagguuuauacuuuuuuauuuucuuccugaaaucuugauuugcuuucaguaucuugauucaccuucaguaucuguaucccauaaucagucaucuucagcuuuuuuuucaguagcuaugccaacaugcauauucuguguucuaaacaaggauaaacaguaagcuugcugauuggcagucucaaugaauuugaaccaaaaauaaugccuccacuuuuuuuccccugggggaaaaaguauguguacacacaaaugugagagauaaaugcccauguaaaucuaguuagaauaauaucugacuuuaauguuuuucugaggaauauaguuuauagauaaugaauauauccuuuugaaucacauuaagugcuacaucuuuuauccuucuaaaauugaauguauuauuguauuguuauugacuugauaauugauuuauuagcuguuuauaaaugaggucuaguacauacagugacacauacagaucaucauuugacaguuugcucuuugagaaguauguauacaacuaugaaaccuauguuucaagugucaauauuucuguaacaucaacaauuuccucauguuucuacucaaauuccuccuucacuucauagaacuucauagaaauguaauuagacaauauguagaaggaagauuuuuuuuuuuuuuuugguuuuuuuuuuuuuugguuuuucgagacaggguuucuguguguagcccuggcuguccuggaacucacucuguagaccaggcuggccucaaacucagaaauccaccugccucugccucccaagugcugggauuaaaggugugugccaccaccucccggcuuggaagaauuauuuuuuaaaauguauauugaggugguaucucuggaaguuugagucuuuuuacauaaauuuuuguuuucuauuuccccuuuucaucuauguaaaguucaauuauaaguacuauuuuacuauccuucuaauugaauaauucagucauuguaaauggcuugauuuuuuucuucuuguuaaauauauauuccuaucuuuuauuuuucuuuuuaaaauuauauaguuuacauugugaaauuuuucugguuaguugaagaauuuuuuuccuuccuaauuaacuuucuguauacuaugguuuucugguaauauuccagaucuggaauacaacuguuuugggaacaguugccaaaagaauuaauugccaaaagaaauugaagugguaguuugauaaaaauuguuuauaauuuagaacauaagugauguuuugguuuucuuuuguguagccuaguucuuuuaaacuuugaauggauauaaaaauaaucuauaacccauaaaaagaauaaccucaaggaaccaaaaaaaaauaagagagagauacagaacauacuaaucaguguuguguuauuucucagauuuggauucuuuugaguuugugaauggucuugacuguuucccugacuuccugaugagauacuugcugaauugccaggaauugugaacugaugauuacuaaguuguaagucagucaugcuaucauauauuuaccugauuuuaagccuuugccauguguaauuccuacagacaucacaacgauuuucuucaguugaugagcaagcaaagcuccauaaggcuaugucucaaggagagauuacaaaauuggcaguaagacagaaggcuucagauuuggacauaagguauguaugagguauauaaagaaauagaaguuucuuuguuucaguuuuuaaaagauuauuuaacuuuauaggcaacaguguuuugccugaauguguguuucuaugagggugucagauucuccuggaacuggugauuuagauagcugugagcugccaugugggugcuaggcaacaaaccuggcuucucuggaagagcagccaaugcugucaacagcugagccauuucuccagcccuaaguaauauaauaauuucaaugauuuuauuuaauaauuuauauacuaaauuuuaagcaauuugcuuuuaagaaaaacauuuuacagucuaugucccuuuauuucucuuuguacacuuaagucuuaaguuuauaggccaugggcuuuagcaccuaaccuuucuguuuguucuuauacaguguauuucucuugguagagcaguggugcuucagcuauuuuguggguuuuguuuuguuuuguuuuccugaucauuucccaucaccuguuuaagggggcugucuccuagagugcuuaauaggcucaguucuuagaucaucucucuuuacaagaaucuucccuuauccugcuuguuuauaauggugcccauggcaugcugggugauauguacaguucuuguuuuguaaaugaauuccacuugugaggcauucuuuucuuaacagugcucacuccccugaugucugcaucaauauccuuuauagauuugcauguauguggccaaaggaauaccuucauguuuccuuaaaggcauagagaacagguaauaggugccacuccuuuuucccuuuguguuuuaucacuuuggcaaguuacuggaagauggcuguuauggccgaagugcuuuugcuuuaauuuuuaagaaguaauacuauagcuaaguacauuacuaugcugacacacauacacacacacacugaacuuugucuucuuauguggauaacuaugacuugggggagguuucuuaaucauuaugugaucuauuauugugaaaggugagggaaauugauauuuuucaguuuuaagcuuguaguauauguaauauacucuguacuaaauugcuuuaggaaaauacuuuugaguacaggacagccagccacagcuggcucaaaaccuccacccauccguucauccaagaaaagcgagaaaagaaaaauacuuucagaaaauaauuuuguuuucuuuaaguugcuugugggggagcuggggugaagcugcagcagaguguuugaugaagagugagggacuaaaagaguuuaggguugaagagaugccuuagcaguuacaaguacuuacugcuuuuucagaggaccuguucaguucucagcaccccuaagauggcucacaauuguuuguuacuuuaauuugagacucgaaugcccuauucuggccuccaaggacacuaggcauucugguggugcauauacauacaugacaggcuuuuaaaacaucccuaacacugugaagggaacagacaucgaagcaucacuagagcuggcuagucacuagucaaggaacuagagagugguagagcagguaaaauccuccuuuggccucuaguacacauagggauguuuaucaguaugcauagguguguguauacacccaaacacacauagaaaguucauguaauuuuuauuuuugaauaaauaucuuuuaaaaauuauauaagcauuuggacccuuagugaagauauuaagguauauuaaaaauauuuuuucuuuuuuaauuguagacuacuuuuuauaaacuuaaagaaauuuacaagggacuuaaaucuagaaaagauuauacuacaagucagaauugaaaaagaagauauguauauaauaauauaauagacuaaaggacauauaauuggagauaguuauauaaauuuaauuuccaauuuauuugcccaaaugaccaaucccauaaaugaugaaacaaaagagacaaaaucaaaauguaaauaucuuaauagaugagagaagucugaaaacuaaccaaguauguaaaacugagaaagacacaugcagccaacuggcccucucuauucuuagcagaaaauaauaaacuaaggacacaugcuccacuauguucauagcagccuuauuuauaauagccagaagcuggaaagaacccagaugucccucaacagaggaaugaauacagaaaaugugguacacuuacacaauggaguacuacucaguuauuaaaaacaaugaauuuaugaaauucuuggacaaguggauguaacuggaggauaucauccugagugagguaacccagucacaaaagaagucacuugauaugcacucacagauaaguggauauuagcccagaaaccuagaauacccaagguacaacaucuaaaacacaagaaaaucaagaaggaagaccaacguguggauacuucauuccucccuagaauagggaauaaaauauccauggaaggaguugcagagacaaaguuuggagcuaagaugaaaggauggaccauccagagacuaccccaccuggggauccaucccauaaucagccaccaaacacagacacuauugcauacgccagcaagauuuugcugauacaaauacagaaguggaugcucacaaucaucuauaggauggaacacagggcccccaauguaggagcaagagaaaguacccaagagcugaaggggucugcaacccuauagguggaacaacacuaugaauuaaucaguacccccagagcucgugucuccagcugcauauguagcagaagauggccuaguuggccgucauugagaagggaggccccuuggucuaguaaacuuuauaugccccaauacaggggagugccagggccaagaaguaggagugaguggguaggggaggagggcggggggagggcauaggagacuuuugggauagcauuugaaauguaaaugaagaaaauaucuaauaaaaaauuuaaaaaauaauaaacuuauuuucagggaaagauaaaaaugaagaucucuagacuuaacuuuauauccaguauacaccacacacaaacacauauacacaagacaggauuucuguguagcccuggaugucuuggaacuugcucuuuaaaccagccuaacuucaaauucacagagauccaccuccuuuuacuuuccgagcacugagguuaaaggcguguacuaccaucgccuggcaaguuuaccaauauuuuuaagguguggaccacauuuuuaaauuaauuaauuuuuuacuuauucacugucuuuccccccacccccccaccccuaucacccucucccacaauccuucccccauuccuccuuuccuucuccucugagcagguggggccucuccuucauuauuccucccacccuggcacuuaaaauuucugugaagcuagguacuuucucucccacugaggccagacaaggaagcccaacuagaagaauguaucccucauauaggcaacagcuuuugugauaguccccacuccaguuguauugggccuuuucuuuuuuuaauaugcguguacaauguaaaugcaugaguguacugguauaugugugcaggagcauguauguagagaucaaaggucaaccucauucaguugcuggccaccguuuuguuuuguaagacagggcucuuaaugaguucuugggcuuugugguuugguuuggcuagggugacuagccagcagcuagcuccagaaaucuaccugucuccaaccuuucuaguacuagaauuaucagccugcuguaccauaaccauaggcucuggggacuaaacucaugcuuucauuuuguguagcacuuuacuauuaaccuaucccugguauuuacuuauuuuuuaaaugaauuuuacacuuuaaaugcuuaugccucuccgcucuuuuccuuugcucaguuaauacauuuuuuuuauauacccuuugaguagauaguucaaagaaucuuugggaauuuguucaucuauugaggaaagauuagaagagauuuccuugcaaaauuccccagccagguaacccuauaaggaagacuguaguuuaugagcucagcuaguacccacuggagcuucuaagcaacucuuuaaacccaacauaguguagcacacuuacuucccagccuaauggcacagaccauuaaucccaguuguuugaagaugaaguaggaugaacacaagcucaaggcaugccugaaccgccugaaccuauagaguuuaaggucagcaauggaugcugucucaaaauaaaagaacaaaaggaggacagagguggagcucaguguugcauuaguuacuuucuguugcugugguaagacaccaugaucaaggcaguuuauggaaggaaaagauuauguugguuuauaguuccauagggauaagaguccaucauggaagggaaaagagacauggcagcucgaucagaaaaguucuuacucauaucuuuaacagcaagcagaaagcagugaauggauaggugaagugguguaaaacuauaaacaaaguuuucuuuauuguaaguuacaugugagauauaaaaaugaaaugauggcaguuugcugucaguaagcuuaagcuagaaucuuuguuacauugcuuugaggcugcuuuaucaaaggauuuaaaauuucagggucuuuaauuuuauauucaacaugaguugggauuguggcuccgaaguagaguauugccuaacacguguccagcauguguccugcccccaaacacaccaaaguuaaaauagaaaacuacauaaaaaguauguaaaagcuuaaaggaggauacacaaguauuacagugacaucugauuuccaucuuaucuuuauuuuguuuuaaaaacagaccccagagagcgaagaugagauucugggccaaagggaaacaaggagagaagaagacaacuagaguaaaaccugcuucccagucggagaucucaucauucuuuccuggcccagaugugacaccugcucauccauuuucugacgguaaaaauggacaaaggguggagcuucuucauguguuacucuuucugaacuguacugugccucucuucuucugaaugacauuccaauuggaaugauauuuucauaagauaggacuaagacaagaacauguaacaaagaacaaugaagcauagaacagugauauauaagcacuucagagaugaugaaucuugggcuagcccuuuuuuuuaauuagauauuuucuucauuuacauuucaaaugcuauccugaaaguccccuauaaccucuccccgcccugcuccccaacccacccacuccugcuuccugucccugacauuccccuguacugaggcauauaaucuucacaagaccaagggccacuccucccaguaauggcugacuaggccaucuucugcuacauaugcagcuagagacacaagcucuggggguacugguuaguucauauuguuguuccuccuauagaguugcagaccccuuuagcuccuuggguacuuucucuagcuccuccauugggggcccuguguuccauccaauagaugacuaugagcauccacuucuguauuugccagggacuggcaaagccucacaggagacagcuauauuagggcccuuucagcaaaaucuugcuggcauaugcaauagugucugcauuugguggcugauuaugggauggaucccuggguguggcagucucuggauggcccuuccuuccgucucagcuccaaacuuugucucuguaacucacuccauggguauuuuguuccccauucuaaggaggaacgaaguauccacacuuuggucuuccuucuucuugaguuugauguguuuugcaaauuguaucuuggguauucuaaguuucugggcuaauguccacauaucagugagugcauaucaugugaguucuuuugugauuggguuaccucacuaaggaugauauccuccagauccauccauuugccuaagaauuucauaaauuuauugcuuuaaugaaagcauuccuaagaggaaaacucauagcuuugagugccuccaaaaagaaacuagagagagcauacauuagcagcuugacagcacaccuaaaaauucuagaacaaaaggaagcaaauucacccaagaggaguacacugcaggaaauaaucaaacucagggcugaaaucaaccaaguggaaacaaaaaaaacuauacaaagaaucauccaaaccaggagcugguucuuugagaaaaucaacaagauagauaaacccuuagccagacuaacuagagggcacagggacaguaucuuaauuaacaaaaucagaaaugaacagggagacauaacagaaaccauggaaauuuaaaaaaucaucagauccuacuacaaaaucuuauacucaaaaagauuggaaaaucuggaugcaauggacaauuuucuagacagauaccaggugccaaaguuaaaacaggaucagauaaaccaucuaaacagauccauuaccuccuaaagaaagagaagcagucauuaauagucucccaaccaaaaaaagcucaggaccagauggguuuagugcagaguucuauuagaccuucaaagaagaccuaauuccaauucuccucaaacuauuccacaaaauagaaacagaaaauacucuacccuauucauucuauaaagucuuuuucuaaauuguaaagguuuggccuugauucauuuauuuaauaaauauguaauauucauaauaauucauaacauuagcucauuguuuagugcuauguaaaaccauaauaaacauguuauauauauuaaaucuauugauuuuaagaacaauuuuucugguauuaguacaauuauuauucaugguauaaugaugagaauaucaaaguauaagaaguuaucuauuuacacagacugaaauaagaagaccuaagauuuggauuugaguucaagcauuuaaacuccagacuugacauugguuuuuauuauugucuguuuuguuuuguuuuuuggguuuuuuuccucuguuuguuuuaagguaaggucucucuguagcuuuggcugucuuggaauuuucuuuuuuuuuuaauuuuuauugauucuuugugaguucuauaucaugcaucccagucucgcucaucucuccauccccucauaucugccauuugcccuugcaaccuucccccuaccccaaauuaaaaaaaaaaacauguaaacaaaugaacaaaacaaaagcauagacaguaucucaucauggaugcuguagugugucacaguguguccuacauuauauccuucaguccauacaucuucacuugcaaauguuuguugcagugaaucauuucuuugcuucauggucucuggcuucugugacaccaucaauauauauuggaucaacaccgggacuccuccugguuacccuguuguugcugugugucauggagaucugcagcuuuagaucaccaguacugcccuuuuacacaucccauccauguguagaugguauagauuuuagggugggccaacucaagaguguaguaucugggccugggugguagcugaguuggucaggguguuggcucccccuuauccacacugccaggaucagcucuccagcacugcucuugcuagaccacccagugcugugaucaucaggaggcagggucagugcuccugcucuuauguucucagggccugcucagccacacccacaucuccagcucuagugugccacccagugaaggugugggguccacucucacaagugcuacaguuuaugaggggcugggacaacucuccugccucacacccucagggcuggcucaccugaaugagccuucaccaccagggccagcuccacuguguuucacaggcaaggugcagggccuguucuccugaguuccacggggcuagcucuccugacuuguuuguuucuuuuccuuccuccaucccucccuuccuuucuuaaaacaaagucagacuguaucccaaacuggccuugaauuugagacaauccugccauggcuuccugagugcugagauugugugcaugagcuaccuugcuuggugcagagccuccaucugagccacuguaauacacaucaacuauuuacuuuguuaguuaccuuccucauugcuauggcaaaauacuucaugcaauuuuaaaauggaagaguuuauucugguuuauaguuucagggcuuugcaagucuaaucuguuucuggacuguaauggucugcauagaauuuuauauacuagugugaagaaauacaaaaaaaaaguggugcuuuucucuguaauauacauuaccugcccaguucccuuuuaaugcagucugggacccuagcucauggaaugguaacuaccuauauuuaauuggauagugguccuccuacucaaccuaaucucaguaaucccucccagucaugcgcagagaugcucuccaaaguuauuuuagauccugucaaguucacaauaucaacuguuacaucuacugcacauuaaugucuuguauuucauaagguagccauucuuuuaacuuuuaaaauguaccacucaagagaagcaauuagcacuugaagaaaaugguagagaugaaauuaaccccucaauuuguauauuguggcuuuguucuggucaacuaauaaaaugcuacagauaaaaaaaaaauucugugguuaucuaacccuaaucuaacuaugagauuggaaaaacuuaaauguucccaauuguauuacucaaguguucauuuucuuaauaucuucucaaauugacaaugaucauucuaaauuuaucauuuucaguaauuauagucuaauauaauuuccaaaaaagagugauaagguucauuauuugaaaauauacauuuuaagcagauauaaggaccuucauaaaaauuaggauuacugcuuuuuaauuuuuguuugaauaaaaaucuaguaagauagccuuuguuuuuaaugcuaaacugagauuacaacuuauugaauaaaauuauaagaaggauaaugacuuuguaaaaggaaguaacuacuuaguaaguuaaaacgaagucaguuuauaucaauauucuccucaggcuucagauagggcuuugcaagucuaaucuaguucuguucuaaauuuuaaugguuuacauagaauuuuauucucuagugugaacaaauauaaaacauuguacuuuucucuguaauauauacuaccuguuuacuccccaaauucuaugagaauuaagacaguuuuaaggaauauguauaagaaaacacuaaauaaaauauuagagcaaaagcaauccaggugagcaacuugacucccuaacaaguuguuaacuaucaacagacuauauugcugauauguucaugguuuuacacuacaguaaaaauuguacuuaucaaauucuccuuuuugguugcuuagacuuacauauaacuggacauucuuucaaacaaguguaacacaguugcaacuaaaugagcaguauaauauagcuaguuuguugcuuauucuucuuguucaucuuugggacugagguuuuuacaauaagguuggagauuuucaauuuuuuuuuuacuaaguauaucuuuuuacuuauuacuuacccuauuuugaauuguagaguuaacucaguaccacccaacaccuccuuugaguccagaacugccugggaguugucgaaaagaguucaaagagaauaaggaaccuucuccaaaggcaaagcgcaagagagguguaaaaaucagcaguguggccuuggacucuaugcauuggcaaaaugacucuguccaaaucauagcaagugccagugauuuaaaaaguauggaugaguuucuucugaaaaagguacaguuugcuugcugagauuugauuaaagaauauuuauuauaggauaugcuguuacaguaagagaggcuaaaacuucuucaguaacucaagcaauggguuuguuaucaaaagcuuauauaguaggacacucaaagugagacaggauuuuagccaccucuaugauuucuuaaguguccaauaugaaggugaggcuguagcugaucugucaacuguagugucaaaauguuagaagagaaauuagaugugauaaagugcacucuccuuuucuuagguccuguaauguccaguggcuuguacuuuuagaauauugcuuaagagacauuucagccuuugcauuugcaucuuuuugaugaguaauuguguauaacaaccuuuucugugguuggucccuagaugaaugaccuagauaaugaagacagcaagaaggauacauuaguggauguuguauuuaaaaaagcccugaaagaauuucggcagaauaucuucagcucuuauucaucugcauuggcgguaagcuuaggccauguuaggagauagaguauagcaugguuuguaguuuuaauaaucuauaaagcuagacucaagggaacauuuuuuaggacuuaauuauuguauuacuucaacuguuaggucuuuuacugauacuuaauagguuuauccugccuauacuuuauacuaugaugggauuuugcaaaugcuagauaaugccuugaguuggcucauuauaagcuauauuaagauuguaaucuauauuccccaguacaaguugaauuagucuuuaaagaguauuuccauaaaacuuaacaguuuuuuucuucuccuuagauggaugaugggaaaagcauccgcuauaaagaccuauaugcgcuauuugaacagauucuggaaaaaaccaugagauuggagcaacgugauuggaaugaaucuccagugagaguuuggguuaacacuuuuaagguguuuuuagaugaauacaugaaugaauucaagacuuuggauagcacagccccaaagguaauuugaguuagaauuauagaaguacuaaauaaauuaugaauucuuuguaaggaaucugccuaagaaacauuuuuuuuaaauuaguauuaguauauuuuacuugugcaaaguagguuucauuaugauuuuucuacaucuuuacaauguauuuuugauuaugcuguucauggugacacauucuaguagucaaaauacuguagaggaugugguaggagggucauaguucaacaccagccuagacugugacugagaguuaaaacaguguauuucaggaaaauaucgcagagaccauaccaauuuaucauuaauuuagauccucuaaacucuguucuaauaauuuuuccauguauuuuuucugaacuugcugcauuggacauguccuucacaauuaaaacauaauagugugcccucaauauuacacuucuaguuuuaauggagauuaauauauaaauugacuucugaaaaauaaugguuaaagaucaaaugaauuauauaucacuuagcuuuuaccuaagaaccuacaaauuagaucucucuugaauuaguuuuugggaaaaauguguuuccugggaaauauaaacaucagcaaucuuaaccuucacuuuuugguuaagagcugggaauuuuacugcuugauauuuaauuaaauuuugcuuuaaagcuaucaaacauuuuguaguuggguaggaguuaggaacauacuuacuuaacuuacugaagugcuugacaaauauuuauaaagcccagaucugaguaccauauaaaauguggugguccacaucaccaucccagcacucuggaaguagaggcagaaugaucaguucaggcucauccuuggcaacacagugaguuugaggccagucuggaaaacaauauauacuuuugacuugaguguggaggcacauauuauaguguuucauuuagaacugacauuuaaaagguaaucagucucuaaaucugauaaagauuuacuucagcucugcacaguuccucuugaagaauaaagaacuuuuuauuaucuguugaagcuguucaaacauuuucaaagaagagaauauguuagucuuuguaaucuuaaauuauguuucuccuuaccuccuuccaggugcuuaaaacagaaagaaagaaaaggaggaaaaaggaaaccgauuugguaaguuacaucauugguauaacacuuucuagcucaguagguugaaguagaucuuuuguucccauggauagauuuaguagcaaguuuaccagaucccaggacauacucacaugccuuuaacaaaguuagaaugacaguggaccugaaauaucaugaauaccuacuuucaaaguaguuuucuaaaauggaauuucucaaaauaguguaaauaacuguuucuaacauguuuacuauuucuaugguuuagcucuuugugaacaucucaugaaaauggaauuguauaauuucuuguuuuugcuuaugguuucuuaccgugauguucuugagauucauccauaauguugucucaguagucagcuacauugaguauucaguagaauuacguaccacuuuggauuaugcugaggaccuuggccaugcuagguaauuauucucucacugaguuguagcccuaaccuuuuccuucacaauuuauuuacuguuugaugggauuugggauugguuuauggacauaugcuaugauuugucuuuugcauaauaaucuucgacguauaauuuuggaucauaugauuuuaaguuuagcuaaaauuucagagucugcuaacauguuuuccaaauaagaaaugcuaccuacaaugcugauagaguucuaaucucaacuuuuuuuuuaccauccuacguuacugugugucuuuuuguugcagacauucuuuugguuguguaacccuauugugauuuuaauuuguauuccccucaugucuaaugauguuuaacauuuuuucaugugucugauaguuauuuauacuucaucgaugggauauucagcguuuaguuauuuuuaaguuguuuuuccugauuuaguuaauaaccuuaacauauuagaauggugcugagaaagcuggugugcuacaugugaagaaugaaacuauauucuuaucucuguccacauaaaggucaacuccagaugaaucaaagaccuuagcauuaggccugauacuucucgagaauaaaguugagacaacacuucaagaugugggcauaggaaaaaaaaaaucaacaauugacagaaucuugugaaauugaaaaguuucuguguugcaagaaaacaaauaucccagagaaaaaguguucuggacauagaguucucaguagaaauucaaaugagcaauagauauuguugaaagcaucaacauccuuagccaucaggagaguguauacuguaacuacucagguacuccauauuaccuuaccaaggaggaagauacuugagcauggaaaaaggucucccaugcuuauggacugauagaguuaacaauuugaaaauaagacuguauuaccaaaacucaucuacacauuaaaugcaguuuacuucagaauucuaaugacuucuuuuuagaacuagaaaaaaaaaagacuaaaauucaauuggacacacaaaauaccucaaaagucagagcaauucuaagaagaaagaacagugcuggagguguugcaauacuugggcucaaacugagcuacggagccacaauaacaaaacuaacguggaagggaggaugggauagggaguuucuggaggggaaaccaggaaaggggauaacauuugaaauguaaauaaauaaaauauccaauaaguuuuucuaaaaaggaaaaaaaagaauaaacauuaaaaaaugugaugaaacuauuuaaccaagacuuuauccugaauaauuuuugaguucaugauacuauauauaagguuauagaaauaauuauuaucaauuuaaugcauuucauuaucaauauuauaaaaacaaagauuuaaacacauugaaacaauuuuuauuuaguuuauuaaaauugauuacauuggcauuuuaaaaaaagauuuuaaaaauggaguugcacaaaacucaaaagcuauccaacacacacacaaaaaucaucauaaaugaagacaaagggggaccugccaacuauacaucugauauaucacucaguaaauuacuucaaaaauuaaaaaccaaaacaagauauuugcaaauuaauagucaacugaaauuuaucaacauaaaaaaaaaaaggaaagauuuuaaaagguuaacacacaaaaaauauucaacaaccuuagucaucagggaaauacagauuaaaacuacuuugagauucuacuucaacccauuucaaaugacugucauuaagugaggauaugugcaaagaggaggaccccuuguacacuucuuguggaaauguaaacugguacagccaugauggaaaucaguaugguaguuccucaaaaggaacuagcuaugucuucguuuggguuuaauugcuauaacaccaugaccauagcaagucuuauaaagaaaaacauuuaauuggagcuggcuuaaaguuucagagguuuagucuauuaucuucauggcagggaacaguggucugcaggcagaccugguguuggaaaagaagcuaagaguucuaugucuugauccacaggcagcagaaagagacugugccacacugggcauagcuugaacauaggaaaucucaaagccugccuccagagugacauacuuccuccaacagggccacaccuccuaauaagugccauuuguuaugggccaagcauucaaacacaugagucugugggggcuguacguuuucaaaucacuacaacauauaaucuggcugugccuguuuuggguguauaaucaaaagauuuaaucuggcauaccacagagauacuuguccagccaugauuauaaugauucacaauuuuaagauaugaagucaguuacuuguucagcaaacagacacuaaugguaaagaaaaugcaacauauacaucaugaaauuuuauaugauugaaaagaauggaauugugacacuugcagucagauggaugaaacugccauacuaagugaaauaagugggucugaaaccaguaccacagguuuuaucucauguagccuauagauauaaauuuuuauauguguaaauauauauguacaacaugaaaguagaaacugaauugugagaaugaaguucaaaauugggaguaucaagagaggguuauguaugugucaugaaagcaauaacgggaacuaguucaguggaaggaaagcagcaagaacaguaagcaugcaaacaaaaacaaggauacaccaggcaugggggauggccuuuaauccuagcacuugggugacacagaaaaguaggucucagaguucaaggucagccuggucuacacagggguuuucaagucaaccagggcuacauugugaggcccugucucagacaaauaaacaaagauaucuauguauugauaaugucacaaccauuuucuuuuuaauggaaagcaaaaaaguugauuaggagaaagaaaaaaacauaaaaauuauuauuuauguuaauacauaaugugcuuauuuuuucaacuuuaauuucuaaauagcaguagguauaacucauaaaaacagaagucuuuucaggucaugguugauuuucaauaauguaaaacauuccuggaagugaaaaacaacauuuuagaacugcugcuuucaauuuaccuugcaagugagucauagacagccagccaucuuacgcuuauugaauugcguuguuuuugauacugauaauaucuacauuguuaguuaaauuuaggacaggcuauaucuuauuuucauuauuucuuggaggaucauaauucucuaccuggaauagauacccagugaagucuuagcaagcgguuggaggacuucccauuuaccaaccauacuagggaagcacuuacuucauuggcuauaguauaaauagugaaauuucuucauucagguggaagagcacaauggccacaucuuuaaggccacccaguauagcaucccuacauacugugaauacuguucuuccuugauauggauaauggacagagccucuguuugcaaauguaaguauuagacaucuuugaggaaaagcuuucauuguccucuuuguguucacuugucugcaaaacuaguaccaugaacauguuaaguuccguacccacuuagaauaauaguuaagcucucuuagcuauaauugcaauacuucuuagugcuugagcagcuggauuuucacuuugcuagcuaacccuuuaugaguuuaacacaaugauuuauacccuuuuuuuaaaugcagucuuucaaaugaauugaagguuuaugccacccuggaaguugcucugggcaggcugucaugacugccugaaaugucuucaaggaucccucccuaugguuccagugcaaauuuacuaucuucuuuuuaauggugcuaaaacucuauagcaaccaaggucuuuuuguccauaccuauuuuucccuugccugaccaaacugaauauguauuuaauuucguuuucaaguuaucauuauaaaauuugcuaaauguagccagcaauaaccacacuacaugaauucuguauucucuugaaauuucuucuaccauauuacuuagcccuuuaauucagccucacucagauuuucagaaccuaguucaauguagauaguuuuggguuuuuugccaaaaauauaaaugaccucuacuccaacucucuguagggccauuguuuacacauagaacauaugagccuggcucuccacugucuucauccuuauuagcagucuggcuuuccagccuccuuccacaauaucccaucaaggucuguuugcagcacuccgggacuuggcuuuucuacccugaaguuccauacuuuuccauagcccucucccaaaucaguuucaaaggcuuaaaaaugacuuugucaaguuuagucaagacaacaaccccacuucucugguaccaguuuucuguauuaauuuuguguuggugucugauagaaaugacuuaaggaaagaaacauuuguuuuggcucaugucuucagagauuuuaguccuucaugcacagugggcuaugguagaggcaaaccaaaaagcaaagauucugacccacaugaggggcaagauguacccuucaaaugcccacaccucuagugaccuaguucaaccagugaguuuccacuguguaaguauucaacgggcuucccaaaaugguggcacuagauggugaauaaacauuuaaauaguaauccuguggagauuucagauucaaauuugaaugaagcaagaacuuccuuuauuuuucuuaucaguggucuuaaaaauuauacuauugauaaugggaaauagucugaaauguaccuaauucaaacacugguuuuaggcuaagcagugauucucaaccuucuuaaugcugugacccuuuaauauaguucuucauguuauggugaccccgaaccacaaaaugauuuuuguugcuacuucauaacuguaauuuugguacuguuaggaaucguacuguaaauaucugauaugcgaaccccaaaggguugagacccaaagguugagaaccacugauuuagagaauuugcuuuuuuauggcuaauguggauuuagauugauucuuaaagaauuaauuguuuuuuauaacuguaugaccucaccauuauaauagcauggccucuauuacuugaucuagcuuugaaaacauaaaagauuagaaguuuaagaaagaauauuuuuguuaguuugcaagaacugguaggacagauugacagaagugaccuuguucucagcaucccucugugcaaaugucuuguucucaccaucugucuggguaccuuguuacugggcacucuuuguuuuguuuguuuguuguuuugucuuuauguaguccuggcuggccucaaucucucaaagaucugccuaccuuuuccucccaagccuaaaaaauuauuuuugcucugaacuuuuuuuuaaacuuauguucccuacuauaacuaauacucugcuuauauuauuuuaucuaagaacucuauucugguccuucagggauaauaaauaacccucuucuauuuuuaucaauauacugccaauuucaguuuauuucuguaagcauuucuugacaauaaucccuucuuugccuauaguuauaauucuuaauugggauuucugggacuuuaacagguuuuagagcaccugggaggacauacauacuacuuugugaaucaaacuauaaagauagauaaauaaccuguuggaauugaguguuggggguagaagacaugagugcaguagcaagacaggcacccuagaaagaagagagagcuuguucauugacacugacugaaaauguuaggcaaguuuucaacauuucccuuaacagagguuagcauuaacaaaauguguuuaauuaccuuaaagcagggucagccucaaaaaacaaaguugugaacuugauaaguucuugccauugauuugcacacuaaaauuguuguaugcuuaaccuguuuuccaguguguaaguacgcuugccauaagaagugcugccuaaaaaccacagccaaguguucuaagaagguaaggcauuacuuacugccccuuaguaccuuaauaguacacagcaugucugcaaauuuuuuuccauacggaaaguaguuggggcuucuuuaguagcuuuauaauacaguguuuuucaaacuucaugaccucaaauaacauugagaaguauguuuuaugucacaauccaauauacauguauggagauguauggauauaacugaauuaauuuucuugaaaccuuuaaucuugacuuuauguaagcugcuaaguugaugaguuaagcauucauaaauucuucugaggaauuuucuuugauguucacuauuaacauuuaaccaugagcaacagcguauacuaaaaaagcugguauuuucaaauaccuaguuguauuuguguacguaagucuaaaaaguacuaaauauauaucuucaaggaaacaaccuuuuugaugguuuugauuuugguuuuuuugagacagggucuuucuauuauguaucacuggcugucuuagaacuuacaauguagaccagaccugcuuugaacucacaggauccaucugccucugccucuggcaugccaggauuaaaagcaugagccaccaugccagacuauuuuuaaaaaguuguuagugacugauaaugggaaggcccagcuuaccuugggcguggcuaacccugggcagauagucuccugaguuuuguaagaaagcaggcugaagaagccaugagagaaacaagccaguaagcaguguuccuccauuacuucugccucagauccugccuggaguucuugccauaacuuccuugaugguggacugugauguggaaguuuagacaaaauaaacccuuccccacuaguuucuuuggucaugguguuuuaucacagcaauagaaaccuaaaaaagaaaaccaccaccaaacaguauucuguguacagaucuuacauaccaaagucagagacgaugauugaaguuucagcaaucucuuagaacuauagauggugggaaagauuucccuacugucaagauuugaaccacugugguuuguuuguucauuagaggaauaagccuaaauuuagaaauauuucauuucauuucaggacuuuuuuuuuuuuaacuuccaagcuauuuaacauagauggcuaagaagcuaauuagaauaggauuuuccagagucuccaugcuaagaagagaaaagagaauuuaaaauuuuaagauuaguaaugacagagaaaucaguucuccagacucucagugagagcuaugucuagagauccgcccuaugaaugggaguggggagugagucauugauagacugagcuuaacaaacuuaccaguuagcuuugaggugguccuuaauuagaucauggugggguuuuguuuuuuuuuuuuuuuaacauuacuuauuguguggguggguauagccuauuucacaugcuguuacacacaugaggaagucagagaacaauuugcaugugccaguccuaguucaacucagguucaauuuagcaagugccuuuccccugugcucucuugcaagcccuaauaauauguagaguuuuggugcauguuuguuucaggucacuuggguucaaaccugacugcacuucaaguuguuguguaguagccucaacuguuuucuaguuuuucuuucacaguuuucagcuauuaacuauuugaugcuguaggaagaucaucuuuuaauauguuaaggcuaaguauguaugaugcauguaucguauuaauagcgaaacuuugguuaauguauauuuuugcuuaaauaauuucaguaacauuauuauguuuuuuucuuuaauaaauuauuauuugcuucauaccagguuuuaccaugccauauauucuuagaaacuaaguagaauauaauaguuuauugcaaaaguuuagccaaguugauguaguaaaaguacuaacauuuaauaugcauccuuuaaaugcucuaaauauucugccuaguaguaguauuagagauguuauuugauacuaguuuaacaucauucaaauuaaauuuggaguuaauucucugagaauuaacugcuaacauacaaaauguauagauggacgauaacagaaaacugacucuugucguggcaguuuaaaauucuccaauagugucucuuagcugucagaauaaaguccaagugcacuugauagccuuuaccuagcuuuucauucauucuuaguuuaugacuuaguaucacagauuccagggcucuguguuuccucagccccucuugcuuucuuagauaaaaucugcuuccuaacaucagaucuuuuuugagguccuuaguugcuauuuugguggugguggugguuuuggguggaugguuuuaauuuggguuugguuguuaugagauagggucucauuuaucucagacuggccuggaacucuguauagccuaggaugaaucggaacuucugauucuccugcuucuuucucucaaguguuggggaucaaacauaaggcugcaagcaagcuaagcguacucugccaaccgagcuacugcccagcccagacuuuccuguguuaucaucugugucuuuauaauugccuaguaaaucugucauuuuacuuauuuccacaugcuaauguaguaucuuagcauuaguuuuaggggaaaugcgcucucuuacuuuuguuucccugguaccuagaucauaaugacaaauguaucgauuuagauaagaaaccaaaaucaauucaaggucuuaaguaucaucaacaaugcauguacuucacuugugucuauacuagcuagccacugaaaaugucugagaauaguaagggagaugacauguaaaggauguguuaaagggggagaaaauucauauggggagacuagucuugauacuguuagaguaguucagacaagcaguucuauaguauaugaauacauuuagaaacaaaacuugucuuucauuuaguaugauccagagcugucaucucggcaauuugggguugagcugucccguuugacuagugaagaccgagcuguuccuuuagugguagagaagcucauaaacuauauugaaaugcauggacuuuauacugaagguauuuaccgaaagucugguucaacuaauaaaaucaaggagcuucgacaaggucuagauacagguaagauaguaugcccugaaucaagauguaacacuuauuuuaaaaguuauuucacuuuuauauucugcuucucuaaauguagggccagaacauuuugggguauuucuuugccauuuuugagucuuuggcuguauuuaguaaauucaucaaacauguaccaacaguaucaauuauagaaaguuuguuagguacuugaaaaagaucuuaaucuauuuaacagacuaauuagauccuguuauccuuaauuuauggggaagaaaaauguagguucaaggaaauuaauagaauguugaugcaagguaacaaagauucuuagaaacaguuuugagaacucagagacgucauuuaucugcauuuaaagguaaggaaucaaacugacaaaggaauucaucuaacugcuuaucaccaaccagugacaacaauuuaaucccguguucucugaauccauacuuuaaagugcuuccuguuaagucuucaguguccugaccacagacaggauucuuuguaauagauaucccuagugcccauguauauugaggacuugguuaugaguguaccauuuagucccaggguacauacaagggcuugccuuugguuucauuaaccaaauauauucuucaacauuguuaaaagaaaauaguucuuuuaaaaccaaacuuagauacacaaguugucuuugugugaccaagaacuccagugguuuuucucaccaucagugaaaaaugaauuauugugaaaauaacaagaaauuccugauaaaacuugauaaauucugacugagagaacuuuguauacgauaguuuggggcauuuuucagguuuggcucacucuugaacugugcaacaucaaacaggauguagauguuuccaucacauuuuccugccuucucaucuguaagaaugacuuaaauucagccuugcauuuaguccccuuagacuucugacgcauugguacucaagugugugguacguaguccaaucuacaagacagggacaaaaaucaaaagcaagcaaauagacaauucugcaguaguuugauccuucaugaaacgugaucuuuuacauuuguguucacaaacacagacaccaaaacuauuucuucaggguuagaaguggcaauuccaagcauggaaugaaauuguagaaaguauacauuguuuaauuaagaaauaugaaggcuucauuuaguagguuuauuuugugaaguguauugcuuaaaucuuuugcauguuugcuuuguuaccuaacucuugucucuaaauagaugcugaaaguguaaaccuagaugacuauaacauacaugucauugcaaguguauucaaacaauggcuucgugauuugcccaauccacucaugacuuuugaacucuaugaagaauuccuucgagcuauggguaagcacaagcuucuuggauuuaaaggaaaggccuauacuugguaaagccaugccauguguuauguucauuauuaaggccuccuauaguagauugauuagccuuuauggguccuaaauuacgcugugacaguuaauacaaaacugcaguguauuauuaccuauucaaauguuaacuuuucuguagacucuucuaaaaguaucugaauaagccacuuuguugcuucuuguaaguaacugaaagauguggguaucaaaacaguaaaauaucaagugggagauuuuaggguaggucagaacauucauucaguuguaaaucuaagcaagaacuguguuggaagcuaacugucuuguuuguuuucuaccagaugggcucugugcuuuagcuguguaguauauugguaaaaguuuguguagagguauuuaggaccugaggauuuauuauuaucuagaacaguugguuaauuuuaaugggacacuagucugucacauaacaacuaaaauacuagaacaccugugcccuugcuaucgucaagggcuguuggggaacaaacucaacuuugggaauucaaauacagggagcuaauagcuuagaaccaugguucugccuccccaagcuggagccaucauucucuacuguagaguuuccaucaggaaggagauacagcauguaacagggauauucaguauaauuugcuauuuuuaccauuuuucuuaggccuucaggaaagaaaagagacaauccgugguguguacucuguaauugaucagcucucccgaacucaucucaauacacuggaacgccuuaucuuucaucuaguuagguaacuuauucaagacagguucucacuauguaucuuuggcugucuuggaacucacuaucuagaucagucugaacuugaaaucauagcuaucuuucugccucuacuucucaagugcugggauuaaaggcauguaccaauaugccuuuuggggguuauggucaggauuccauuuaaaugaagaacuugaauauauaaagacagugucuugccuaggaauguaguuuagcaguggaauacuuaccuagcaugcacaaagcccuugguuuggucuuuacuaugcuuacaaaacaacaccucucaccuccaaugaaaccccuuucugccguaaauuggggggggggggguguuaagauuccuucaagcagaaaucugcuaaauugaguacuguugaguaaugcauaaagcaguucacaccucaugguggcacgaaguaacagccauuuugauauuugaacuagaagaguuuuugucucugaacauaacuuacuucaugagagcugaguucagauuauacucaggaauugacugacucuagaggcuucaggaauagauaucuuucccuguguaaauauuugaagugguugcgacuacagcccucuuucugguuagaugugggguauguugcaaaugccuuaaaauaucuacucuagggguuagagagaagguucagagguuaauagcauuggcugcucuuucagagaacauggauucaauuacagguccccacacaguaggucacagcuaucuguaacuccaguuccaggggaucuaacaaugucacacagacauacaugcaggcaaaacaccaaugcacauaaaauaaauaguuuuuugucuuagucaggguuucuauuccugcacaaacaucaugaccaagaagcaaguuggggaggaaaggguuuauucggcuuauacuuccauacugcuguuuaucaccaaaggaagucaggacuggaacucaagcaggucagaaagcaggagcugaugcagaggccauggagggauguucuuuacuggcuugcuucccuggcuugcucagccugcugucuuauacaacccaagacuaccagcccaggaaugguuccacccacaaggggccuuuuccccuugaucauuaauugagaaaaugccuuauagcuggaucucauggaggcauuuccucaacugaagcuccuuucucugugauaacuccagcugugucaaguugacacaaaacuagccaguacaaccacacaacucugcauuugcagacauguuauaauguugggcuuaaacagcagguuauagacuucucuuaauaggcuauacguugaccuauggcccagacuauuucaggaaguaguaaaaguccauuuuccagguaaagggauagcucuagggaagucuacagugucuuccuuaagcuuaggugguuaucuaugcaauacuaugggguugauggcauauuguccucucuuccuacuauuauguuauuuuauccucuuuucacuuguguugguuuugcuuuauuccuuaggauugcucuacaggaagacacuaaucgaaugucugcuaaugcuuuggccauuguguuugcaccuugcauucuccguugcccugacacuacugacccacuacaaaguguacaagauaucaguaagacuaccacguaaggccagccccuaucaucucuauaggaccuuaguugauguaguccauuuuauccaaauaucaaacacagcaaaugauuucauaaguuccagugcauuuaagcagauuauugguuauucuaaaacuuguuucaauuuaggacuacuuacaguuuuuaaauggauuucuguuuugucaaguucugucucucucucucccacccccgccccacucuccuagucuaaucgugaucucaucacucagucucuuugguuguaauaguucaguauucccguauuuuacccucaacuuuuuucuuuaauuucuuuuuuuuuuuucucaaucugacugcagcaggaacuuuggaaaauguaagggcuugagucuaucccccagauucauucauuaauuuauuaauugaucugggauuauagccugagaguuaagauuuguaauuauuuucaguugguuucuaaaauacagacaaaguugucaaccaccauucugaauuuuuucagggcucauaaaauaaaggaugcuuccuucaucccaaaacugucuaggacaccuaguuacaaaguauucuagagauacaacacuucauuugauuuacuucugcuuguaacaguuuuuuuuuccuaucuucccauuucagauguguggagcugauagugguagaacaaaugaauaaauauaaggcucgucucaaagacaucaguagccuggaauuugcugaaaauaaagcaaagaccagacugucacugauucguagaucaaugguaagaugcagaauauggagcacagugaaaaggugggagaggggcuucuugugacuucuuuuuaaguaauguuugugacauauauggguuaugcccagaggagcuucucagaaggaauacaggugcuaugaauaucugaugaucuuuaaauuauuuuagcuauguguacagaggacauuuaauguggagaauuuuaaaauauuuugaauaaaacauugguggcuuauaaucuucccugcuuaccuuacccauccaugacaugaaaacuuaacuuuaucuuaacuuuuucucuacauccuuccauuaucuuuucuuacucugagccauaucauuuuggugguucuuccaagauuccugauaguagagaacuuaaucauuuggaguuuaauaugaacuaaagcguuugauccauacagaagcagaauuccauuuaagagucuucuaugaucaaauaaagacuuuauuuaggauuuguuguuggguuugagaugagccuaccaagugauaauuucuuuuuucauuuauugacuuuuguauuuagugucuucuguugaaacuagugaccagcaauuauguagauaacucuaguuagcauuaacuaagaaucaguaggaucugugguucugguaaacaacugacagauuaaaguuuaaccuuuaccugcuuguuacuccuccuuucaguaagauaacauuaucacaacagccacauauuucagacccccagcaaaucucucaaaacaccaacuucccaguuuucuuacucauauuuucuagagcccagaaguacuucuuccauaccauuauaaucuguauuuagacugaugcugaaaugacucuccuucuuccuuuucuauuuaagcuuccuugcacaaaacagauguuccacagaggucuauuaauaggucuauuaguggaugaucucuagaaacaaacauaagcauaaccuuucccaggcauuaaauaaaguucauugucuuaguuaggauucccauuucuaugauuuaaaaacaaaaaacaacacacacacacacacacacacacagagagagagagagagagagaaacaugaccaaauugaugggggaaggguauauuccagcuuagauuuuucuaguccauuauucuaggaagucaggagagaaaccuaaaggcaaaaacuaaaaaagagacuaugggagaagugcugcuuacaggcuugccccuuauggcuugcucagccugcuuuguuauacagcccaggacaaccuacacagggguaauaauagccacaagaacugggcccuuucacacagucaucaaucccaagaaauguaucacaggcucgcccacagaccaagcugaugaaagggcauuuuucucaauagagauuuuugucuuugaauuacucuggcuugugucaggcugacauaaaacuagccaugcagucaucauaggauacuaucuaaaucucuuuccaggacuuuaaaaaugaaaauaccacuuaaaagugaaauuugggccuaagguguuacauuaguugguagagugcuugucuuuaagacaagguugaucccugagacugaacaaauagaaacauuuucucugugagaauuugagcucagucuucagagguuuaauuuauuaguacccuccuaggagggagaggaagagcuucuuuaccgcagaacuuuauucuaaagcaagugggaaagcuguggacccccuccuccucaguacugcagaaauggaugcauucaucccacugaacgauuuagccuucucuuuaauggagcaaugacauguacgugcuaaccuucugcuuuccuuuucauguccuuccuaauccagaaaccuguacuaauugcaguuagauuuaugagcauuacccgcaguucagucucgguauguauuaauauugcaaugugucacagucacuucacaccauugugucucauucauccaggaauuguucugcucugucagucaucugugccugucugccuuacauguucaaacuuuguucagggcccacuuuuugaucagccuucacuuacuuuuuucuuaaucucuuucuuuagguccuucacuuuccuuucuuguguuauacaggugaacagugaucauuugaaauacacuguuuuuccuucccagauaauccuccuuuagaauuucuguuuugguugaaucuuuaaagaggguggggucaaagauacugcgguaucaaguucauucugcucugugagcugcauuccuagcaaaucuacuuuauuauuugaaauaccuguuaugauuuucaguaucuaucaugaauaaugcuuauauaucugcucauaacugacucuggagguaucuucuaagauguagacauaaggcucuuaaauacuuguuuaucagacaggauucuguuuuuuacugccucuuuauaaacaaguguuuauacaaaggagaaaaugaaagguagaaagcuaaaacaccaagcuauguggaaacuaauuuuagaauaccugucuguguguacuuguugaucuauaaauacagauaccaauucuaucauaaaguugcccuuucccauggaauaucaaccuagcaacauguuaguauuacauuucuuuccaaugcuucugucuccuguaagaugaaguacacuuuauauauucaaauuucagucauaaccuugauauucuguauucuucuacuuccuuagagacuauaccuuuaacuggagaguuguaggguaagcuuccuuucaggguagacuagacuuuuaucuagaauuguaggauaaacagaauucuacaugcuguuccaguguuggguuggaaguucaguuugacuguuuuacacuacuguucuguugguaguccaacugaagaugagugguaaccccaaauucacucuccugacagucagaccagaucugucaucucccuuacauuguuaguaccauuuaaggcaguacuccucaaccuuccuaaugcuguaacucuucaauacaguucauguuguggugacccuaaccauaaaacuauuuuuguugcugcuucauaacuguaauuuugcuauuaauaagcauaguguaauauuuuuggauauugaaguuuguuaaagggguugagauucagcaucuucugucuaaauuuugacugauuacauugauaugguaugggaaccugucagggcaguuacauguuuuccaaaacuuuuccaaaacucgguuucuuagaaagcuuaaaguguuauugcugacaaaaacaaaaaacaacaaaaaaaaaccucacuugaaauaauggguucuuuuuaaaugaggucaaacaaaaucuaugcagcauacuuaaauaugaauaguuauacuuggucaaauaucccaguguuugaagauaaaagcagcugaguuguucagcuguuauucaggucauuguacaaacacuguuuacuaggacaacccucagcauggugcacuucucacuuuuaucauacacaaauaaaacaaccuagcccuuaaggguuaauaaugauaugauuuaacugaugagcgaaacuaauuuuuaccugugaauacaugguauuaaagacuaugaagcauagucauacuaguaguacaguuuuguaccgucaccuugaucauguagagguguugacaauuuguuuucacccacuauugcuuuuaauuaauguaaauguuaauaaguggaaagggugaauggcauuuuagcacuauuauaaaagcagugucugcauuguagauccuuugggagugcuuccauaccucuacuggaaaccugggaaccguguucagaaccaguauucuaaagcuagaaauauagcuuggugguagacuacuugccuugaggcccaaguuucaagucucagcuguaggugggaggaguaccauggcugguuuccucuacuacacagaaagucugaagauauaugcaagcauacaguggcuauauuuaaagucuuuauuaacuugcauuauaguuauagguguugggauaaaacuuuuaaaucagccucaaaaccuacuacaguagguagcucauuccucaauaucauacaaagcauggacuuuaugcaagacuaccaugcaaggcugauagaaaaaccuuagauaaagagccuuacuuucuacaaaagaagaucccuuauagucuaagaauucaguucuuuucugguuuuguggcucaaugaauggcaacagugaucuguuaucuucuuuuaccuuccuuguuugggguaaauuuucuguuaagauucuaagauuugugcuuucagcuaguuaugucuaguucuaucuauauguuaguuacacaguucuuccuuuugauaaauucaacccacagaaaaacugcccacuacguguacuuucuuugaucaucagaaaguaucauaacuccucaugugggaagugucuuccuacauacucaaaauccauauuucaucaucauucuucaacuauguaggcuuauauugauugacaauauuaaguuuauaucaugugaucugucucgcuauuccuuccgguguccuugucauuaugaacuuuagcagacucucuucacaggccauaaccauuuuagcacuguaguaugcuuucuagucaucuucauuguuaccuacuuaaaucuuaaggaaaaauugaacuguuagguaaacuuucaaaagguauuuuuacuuaggauccuuagcauuaaagcauuuggaccacgguguuuuuguuaguuuuaaaacccaacuaugggauagccuuguagcauucuaacccagaucuguuugucagagcucucuguuucugaaaaaaauuuuuuuccacugcauaguucaggcagcuuugacuugaguccucuuuccugagucuccugaguacaguagguacuaucaauauaagauggucaaaaucaaaacgguguacuagaaaacagcccaggcagcuaaugacuauugcagcaaauacucuugcuuucuuuguuguuugccaccaaaauugguauccuugagcacugugcuguuuuguucuugagucacauaugaaugaaguugucuaauauggauuguuuuguaucugauguuaacuuuauguguguaagacuuauccauagcaugccuaguuguggcucagcuuacucuuguugcugucuccugcuccagaauguacaugccacaguuuacucaguguacuguuuaugggcgguaggcuuuuguuugggggaauaggcaauaugugugcauuuuuguuaggguauauacauaccuaaggguagaauuucugagucaugggauauaucuuuaacaauuuccaaucaguguacaggaauuucugaaugauuagccaccuccccaauacuuacauugccauauaucauauauauacuguuagucauuauaaaaugcaugacacuucuuaaauuuggacuucuguucauuuaaugugcacaaauagguuuagccuucagauacuuuguuuucugaacaugcuaaacauacuuucuguuuuucuauacuugcuugggugguuuaauuuuuuuuccuaauucuuucugaacccugcauauaaucuuuugaucaguuauuucuguugcaagcaucuugcacucuguaguugguuuuucuacucucucaaaagugucuuucaagccaggcaugguagcauauacaagcagucauagcacuaaguagaggcugaggcuaaaugaucaccagaugaagccuggcuuucaaaaacuuucauuacaaguuucugccuuuaaaaaaaaaaaaaaaaagauaaaguaaauugugaugguuuguauauccuuggaccagggaguggcaccaucugaagguaugaccuuguuggaauaggugugaccugguuggaaugggugugucacuguggguguggguauaagauccucacccuaguugccuggaagucagucuuccacuagcagccuuuagaugaagacauagaacucucagcuccuccugcgccaugccugccuggauacugccaugcucccaccuugaugauaauggacugaacaucugaaccuguaagccagccccaauuaaauguuguuuuuuauaagacuugccuuggucauggugucuguucacagcaguaaaacccuaacuacgacauaaguaaaugaaacugucuugauggacagagguuaauuuuaguaauuaguacauuaguaauuuaguaauguaguuuuauugcuacuugauguaguuuuaggaauuuuucuuacuaagguuguaaucauuuuuaucuucucaaagcuucauuauuuugucuauauggcuggucugucuuaaggugcuucauuuugacuaucauacugacagugcuaauuacuuuaucuagcuuuuaaaaguuguuguauugugugugucauauauaagaggcauugauaugcuauagcauguauauggaagucagaggacuuuggggagucuauucucuccuggaacuuuguuuugagacagggucuuuccuguuucugucauguugcuuacuccagacuaucuucccagcaauucugucucugccucuuaccucacuacagauaugcuggaauucuagaugcaagcuacuacaucuggcuuuuuaaugugaguuuugggaucaaacucaaguugugaacuuguguagcaaaugcugagccaccucacugacccauuuacuucaauuuuuuaauaaacugguuuaaagagucauccucucuucuuuaguuuuuacugcuugugacucauauugucauacaaaguaugaagucaccuucacaaaauacccuggguuuuuuuguccgcguguuuguuuuuggagacugcucuguguaaauugcuuuuuagaaauuugauguuucagcgguauugauuuucccacccaugaacauaaucucuccauauauaucauuaguuauuuuaaguguuuuauuuuauauguugagaucuuaucuuuaacuuuaguuauuaucauauaacauuuuaaaauaucaguuuuacuuaaaaguuuuauuuuuuguugcuuguugcauaaaauauccaauuuacuuugguguaauuaucuaacaaguagugacuuugcugaagucaccuuuucuaauaauuguucugaguauaccuuuggguuuccuagcuguagauuuuuaaaauacaguuuuauuuguccuuuuaagguccuugaaccuccucuuuguuuuucuaaagaaacuagaaccuucaguacaguguugauugaaacugugguagugaucacucuuagcauguccaccaccacuuagcaugauguuugcuauagaauuuuuauucuuuaugauauuaagcauguuuauuugauuccuaguuuucugaguuguuauuaugauguaaugcuaacauuuauguuuuuaauauauccacauuuaaguauuuuaugccauuuugaggugucucacaauguagaacaaacuggccuagaaauugcagugaucuaccaccccagcuucaggagcacugguguuaccaugccuggguuaggcauuguaaauuuuauugauguuaaauacucauuucccaguucaguuuguaaugcaucaagauauuuugcuguguuuauguauaaaauuguccuuuaaugcccuuccauuaaaugaccuuguuaauguuuuacuaauuuguguaaaaacaacuuaugccaggcaugguggcacaugccuuuaauccuucagaacuggggaggcagaggcaggugggucucuguaaguuugagccagccuugucuauauaaugaguuccaggcuaaucaggacuacauagucagaaccuuccaaacaaaccaacaaacaaaccaagaaauaaauugggauguaguccuuuuuauuucuguagaagaaugcaucuguuauaucucuuacacgucacuguacauacaugcuuaaucccuuggugcugacuacagcuuugucuaugucuuuacuucugcugcuaauuuacuucagaucuuuugaaaucauuaagaaaugauuauagauauauauuagaaaugcuauaaucuucauaauuuuagcauuagucacugugaaauauacuuuuauuauaaaugacaccucucacuuuaugcucuuuuuaauauuuaguuuuuugagauaagaucucucuguguagaagggagguggugaggcacgccgauuucugaguucgaggccagcuuggucuacagagugaguuccaggacagccagggcuauacagagaaacccugucucgaaaaauuaaaaaaacaaaaaaacaaaaaagaucucucugugugguccuggcugucauggaacucacucuauagaccagaccggacuggugucaaaaucagagagauucuucugccucugccuucuaaggguuggagugcugagacuaaggaguacaugcccuauagcuuuucauuauuuuuuuaacuuuguuuuuguuugagacauaauaucaaucuggccuggaacucacuauguaguuuaggaugguuucaaccucacagccucacaagugcuaggaugacagaggagccaccacauccagcugcuuucauccauuuugaauaauauuuuauacauagcccuuaaaugucauguuucugacaguuuuccaauuuuaacaagagcauuugaucuaucuauauacguuuuguugauacuauauuuggauuuuuguuuuguuuuguuuuguuuuuuuuugagacaggguuucucuguauagcccuggcuguccuggaacucacuuuguaguccaggcuggccucaaacucagaaauccgccugccucugccucccgagugcugggauuaaaggcgugugccaccacaccgggcuuauauuuggauuuuuuaagauuuaaaaaaauaauguguauaaauauuuugccagcauguacaucuguguaccacaaggcaugccugguaucugaggaggccagaagguggugucugaugcccugaaacuggaguuacaaugguuguaagccaccaaguagauucuggaacugaacccaguuccuuugcccagagcagccaguguucuuaaccacugaaccauacccagccucuguguuuauauuuaaaucuguuuuauuguacagguuuuguuuggccugucauucguucccuuuucuuuucuggcuaccuuuauucuuuuuuuuuuuaauuuuuuuccuugccucccucuugauaguaucucauuuuuuauucuguuagaggucuuagauucuuuuagucugaaggucacaucauuaacccuuucaaugcucauuaaucaauacuuuuuaucuuuuuuccuagauaaagugcaaguacuuuaauaugcuagucauugucugacuucauugcuauuagauuuuuuuuuugagcuauuuguaaauuuugaaaaccaaacaucugguauuauaauauacauugucguuguguguuuucauuccugcuucucguaacuguuguucuuggauguuucauacuugccguugagaauaccauauucucauaucaaugucuacugucuuuuugccucauguucauucacauaguauuuaaacauaugacggaucauuucuuacuguuuucucuuuucccaucauuuaugaaguucccuuuugcauuuguuuguccugguuugguucuggauuuucuuccgaucuaacuuccauucuguuuagugaaauuaaguuuuuaccagcuuucauuugcauuguuuuaucguguuuuauuccugauuacuuuuaauuugaaaaugauuuguagaaaguauuuugaggccugggaugacauugcuuaccuacaaaaaauaacuuuauuuuucugacagauccuuaggcacuagcaguuguaucauuuuaauccagucuuagaaguuuaacauuuguauaccaagcacacacacacccuuccuuuagaugaccugaagcuaggccacuccuucugugagaacugugguaauuuuaguuuaccuuucugucuagaauccaacuguuugagaucccaguguuaggcaugaagguucuguggggcagcaacucauaucucuuuauucuauacuucagggguugucaaguuuuuuucucugaagggucauagaguaaguauuuuagauauuguaagccauaaacccuguuccacacucaccccugccacuguugaacaaaacagccauagauaauuaaugaguuuauucuaguaaagacauagacauguauacaggcuagauguaacuccaaacugauacuauaauugucaacuauaguguguucaaagcucugcucagacucugccaccucuucugaaguugcaaaucagcaguaacagccgggccagccuuuccugccccuucacgauccagcaucuacguguguguucauuuuuaauauugaucuaguuguuccuggcaggagauuuaaucuuuugaacuuaguuggcuguuaccagaaaguaaagauaaaaguaagguaaccaaguuaaaacaauagguuuuuuuuucccccuuccucauuucaagaauagaaaguucuuaagaaagcauauuacaauagcaaucucauauaugacuuuuuuuccuccaaaacuuaaguguuugggcauguuucucugaucuuccuagagagauuguccugacaagguugaagcuguuaagcauugucagaacuucuuauguugaaaauaaugagugccuucaguguuagugugguggccacuaucugccuguggcucuugagcaccugaagucuggcucccauggucacagaauucgguauuaauuggcuugaagcuguuuaguauacaguuagauuaaaagaagauucucaucgcagcacaaugguucuuauuacccagagcuagaauguguguccauuuuuucaaugaucuugauauaauucuuuuaaccuaauuuguuggacuuuugauaucuugcuaaauauccuaugccuguugaauccuaucauucucaugaugugauggaaggacacuuguuauccaaagucaucaacauaaaacuggcagacuuuguuuacuuucuaaaaugaaugcucucugcagggaaaggggcguauacaccgaggaaacuauccaaguccaucuuccccuguuauaguccgauugccuuccaugucugaugucccagaagagaccuugucuagugagacagccauggaaacugaccucacagaccagcagcaagcagcaaugcagcaggaggaaaaaguacugacugagcagauugagaaccuacagaaagaaaaguaagugcccagagaggauaccaguuguuguguuuccuuccuucuaccuuuuuuuuccuuauucauuaaauaucucuugugucaagcacugugucagaugccccaggggaucugacagagacuuguugccucuacuaaggguaaguguggaaguuuucaccucagggaaggaaauuccauaguauaggaaucuugcugcugagcaguacuagaauaaggaggguacacauauacaggguauaccagcuuaguucagauucauaaggcaauggacaauggagagcaaagaugagguauuauaguccugacgggucagggaccagcuuccguaagcagauggguuuugcaaaaagaaguguacgagucccuugacuaaauaagacaaaguuaauuucaaccauagguguuaguugcaccuucauaaaugaauguuacuguuuaaaaaucaguaugaccaugggcccaacaacuagauagaacaaggcaguacuggguucugggauacuggguagagaaaucuguuaugauuuaaaagagaaaguuaagaaacucuguuaucuccaucaucacucuggcaggaguggguugacauugauuacucucugagaauuccuaaaggucuugagucccuggagcucaucucgucagucugagaacuugauucacgaagaaucaagaaacuuuaguaucagaauugguucuagaauuuagggcaacugaaaagcagcuaagacucagcgguggaaaaaguaaggcaguaguuacuaaccaggggcugaaaagaugacccaccucagcucugauuaacaugauauugaagauagagagggauaaaaaggaaauuguuaggaaagagaaaguacagaaguauaagcauaaguuucaaagaugugacugcuuuuggaaauagugagcuacugggaaggcuguacuugaaaagaugggucuguggauuucaggcuacuuaaagaggaaaaauaauuagauucagagcuggcuuauuucuaggaauugacaagcuguaugauccguucauugaaggaaguuaauuguguggagggaaaacgcuggagacauaaagaugcuuugguacuaggauuuugacgugaguuuuguuucuuuuuaagguacuaacugaauuuugaucaaacuguggucagugcccuaauuaagaaaauaacguuagaagccaaaucuuaguaacuauaaaacaugaagggacauuacugaaacaagugggugauccugauaaauuagaauguacuguagccagagauaaugcaagcuucacaggucaguguuuuacuuauccaaaagccuugauauggucaagauagaagauaaacucuuuaagagccaaaaagaaauuuggagacaaucuaguuuguuuucuagaugaggaagcugaaauccagaaauuaaugaauuuggaaucuugaacucaguccaaaguucaucucagaauaucucagcauuuauagaaacuugccucaaccuacccacccccagucccaugacuacucauagauuuguuaucaccuuguacuuucauccauacugcuuuccugcuuuucaucaucaccauggugggacaguaagagaugccuuugcuauuuagcuucuuugcuuugauggaaggucuuccugucaucuuucucauaccauguuaauggauuuguugauugugucucauagggaagaacuaacauuugagaugcuuguauuggaaccucgugccucugaugaugaaacccuugaaucugaggcuucuauugggacugcugauaguucggaaaauuugaauauggauucugaagguaccauuuuuugagauauucaauaaauuaauauauuauacuagaaauacaguuuguuuuguaaaaaggaauaagaauucccaacuuaaggcuggaggggguggcucaguacuuaggaacacucacucggugcucuuucagaggagcuagguucaauucccaguaccuacauggcaguucauaauuaucuguaacgccagucccaggaaaucugaugcccuuuucuggccucucugaggguaccaggugcucuuuuguuguauauguuguauauacauauaugcaggcaaagcauccacacauguaaauauauguguguguguguguguguguguauguauauauauauguguguguguguguguguguguguauauauauauauauauauauauauauauauauauauauuuuuuuuuuuuuuuuuguuuuuguuuuucaagacaggguuuccuggcuguccuggaacucacuuuguagaccaggcuggccucgaacucagaaauccgccugccucugccucccgagugcugggauuaaaggcgugcgccaccaugcccggcaauuuuuuuuuuuaauguuaaaaaaaacuuucucagguucagucugguugguggugcauacuuuuaaucccagauucaggagacagaucgcuguaaguuugaggccagcuccaagacagcuuuuacaauaaugauucugcacaaaagagauugacuaaauccucagaacuuuuuacccauucaguuucacaugugaacaguagcuucauuacaugauguugcauagguagacacuauuauguacaacuuuauuuucuguuuuuagagagaaguuuagcccuuagcucccugaaagcagcuggcaagucugaaccuucaagcaagucgcggaagcagcuaagaaagcagccagacucucuagacuccgucagcuccuccguuucuucaugucuaucaaacacuacaucaucucauggcacuagaaagcgauuucagauuuauuccaagucuccauuuuaccgagcugcuucagcuugugaggcccagggaacggaaggaccgcuaggccaagccaaaucccuagaagacaggccucaguucaucagcagaggaaccuucaacccugaaaagggcaaacaaaaacuaaagaaugugaaaaacucaccucagaaaaccaaagagaccccagaggggacagucacaucuggccgaaagaaaacuguggacucagacugcagcuccacacagcaacuaccacuguuuggaaauaaugaguuuauggucuaaauggacagauguguccccagaucucaucuuuggggccucuucuggucaccuuguuuguaacagucgguccuaaugguccugccucguuucagcagacagauuguaugcuggaucacugggcuucuggcaaaaguggccgcuuugaaguuugcuagggaugggccagcugugccuuggcugcuguauuugauuugagaguccacugaacaaagccaccugggaccugggggauuuuggccaauaauaguugcuucuugcccaccuacuuuucccuucccacagauaguugcugaacuagggagcuauugugauccugagguaugcucucauuucuagcauuuaaagaaaacauacaaaccucuguuaaccauggaaacaaaagcuuuugaguuuguauuggaauaguuaggaacuguguuagaauauaaaaauuuccccaaggauuuauaagcccucuauuuuaaauuuaauuacaaaacauucaauguuaucuuuuggaaaccuaaacugauuuccauuaagcccagagugucucagcuacaggaaugugaagagaccaugcuuugucucuuguugauauuugguauuauagucagugcugguuuaacgcuugguuaauuccugccaaauauauuucaugggguaaaguucugguagccauacuguauugguaugcccugauuauagaucagacuccucuagguuuuuguuugaaauaugucacaggcacauuuagguaauuccuaaaugugaacgcaucauccugauugauccaagcuuuucuuuuuguauaaacugaagacuguauccgagccuacucaucugcugguggaguaccaccauagauguaaccauuucaucacuuaucuaggaguacucacauacauacaacugugcaugaguguuauagaaaaagccgccaaaagaagucuagaaaguuuaaauaugaucuauuuaauuuuugucuucuuaucagaccaucaguauuagaugaaaaaaaucaaggacuacuugaagcuauuuuuguuaauauucuuguuccugaaguuuacuguaaauacacauguauaauaugccuaguucuuuuuaaccuugugcuuuccccuuauucccauugaguuucucccuacagauaagaggccauuagacagguggugagagccauucacccccggggugaggaauaaguaagggcaucuuuuucaucacugguaguuuccauaaguuauaaugucagaagcaucauguacuagcaauugugggacuagaacucuguuuuugcuauuuauguuaugugaagugaaacaugauaccauuucuuaaguauaugaaauguuuauuuuuaaagucacuaaauacauuuugucuaacuaccacaugcacuguuacaagaagagccuuuaauauccauaaccugaauuuugguuuucuccuccuccucuucuuuuccuucuccuccuucuccuuuuuugguuugaaguuacaggaauagaagucuuuuguuaaggcaaggucucuccuccuacacaacacugaaccucacgccacugcaauaguggucauuggccggcucuagagaugagacuuguagcauuauuuugcacagcagcucaugguggcuggagucuucccucuccaugguauggguucagcauugagacacaugaaggaaguuuugaaaaucuccccgaugaugauggucauucaguaaaugcuaacuuuuauaucccuccagcauuaacaauaagaguuuuggaaacuguucuacaggaagccagcauggcugugauaugguggggugcuguuuugggccuuucuggcuauacagucuguuauaguauuuggggaaaguagcugcuacugggugguaacuguugcuaacuguugcucuccacuuggcucagaacaauuuccuuuguuucagaggaauguccuggaacucagcacuugacacacauucucccuccuaaaguuuuacagcucaguuuuuuguuuuuauuauuucuauaaaguaaauuuggggcugagaaaaaaaaaaaaccaaccuaccuacauaggucaccuuguaggaacuagguaaucaauauuaaagacuuuauaauuuuucucagggaccuaaaaccugaauuugaauaaaguuaaauaaaaacuuuuuuuuucauuugcuagauuuguggauuuuuuaaucauuuaacaagccgccaggaugggugggggaaauccacacaacuauaagaaugucucggcaaaguguaggucccuguaaggaaaagagugcuguuguucuuggguuagcaggcacuauugaucugauagagacgaagccauaacucaguagugucagaugucuggcuccaucaguucuuaacagagccucugaauccucacccaugauacagauccacauagaguucacuguuaugucugucuagcugcuuuucuucagucuuaaaaugcaccaaaagaaacucucuggcagcagcagagugucucacauguggaaccugugcuccaaacuucagagcauccuaguuaugucacauacuucuaguccacaauaacuccuacauuuuucccuacucauuaauaugugucuguagcugugugucauagaaaauguagcagaagcaaacaauacauuuugcaucacagacugaagcaaauuacagcaaaugcaggcaggauucagggaggugacacacuuaguuugcacauauuuguacuuccugccauuuugauuauaugaccauucuaggucauacacacaaacggagauaugaguauugcuaggagagacaaaaggaugugaguucagggcacaggucacuagggccagcucucaggcuuuggaaaccuaucacucucaccuugcauaggguaugaagacuguucugugucucaaucaaagacagugucacggaaaugugcucauaugaggugauacauugaggcuguaucauuccaccuuugugccugugagcuguguuuucaacuguaacuaauaagcuagagcgaaggaaggauucucaggugugugacgcugagaguuauaacuggagaaagaaguuuguccagauggcuuucucacuuuaaaaauucuugguggggaaauagaugugggcccugcauucuucuguguugaaugguguguuauaugcacccacacacuugugauaacuuccuagcacugugucccaacaccaugcuggccuuaguaguaaaauuuuuuagguauuuguagaagaccugacuuucugcaucccuaagagaccacauuucucuggaacauucucacacuuuugguguuaaguggguaaucuccaguguauuagaucuuacugaucuccugguuuaaacuucaaaaaagcccuagcaaugggucugucaccuugucaccuguccacucuuaaugccuauuuaucagcccucuuaggucauauaagaguugcaccucuugaaccaaguauuuguauuuacuaugggaaagguguagacuacagauuaguauuauauuauuuuaauggacucaaaguaauuuauaaguauggugaguguaaaguuuuaaaauacuguguauuauaaaaggacacaaccugugaaauaugccacuuuacuguuuaagaauucuauaagaaugacuuauucacagaacugauuacauuccugaugaaaucagcagcacuuuguaauuuccuuuuuuuuuggaagggggcaagacauuuguauaaagugcaguuugugucacucagaguaugcacuguauagcuacacaaaagcagccugcugaacaaaucacuccauggcucauuaaagaacaaagcuuccagaagugcaau

SEQ ID NO: 5151 - RNA, 158249 nt, Mus musculus
guauuugguccuguggugauuuaagccaucagcauuuccugggccuccuggguacuucugguguuuacaaauguggcuauugcuauggcuuccaugacucugaaguugcugggaacaaaaaaccauguguuuguuuguuuguuuguuuguuguuguuuuucuagauaggguuucucuguguagucuugacuguccuggaaugaucuguagaucaggcuggccucaaauucacagagaucuaccugucucugccucccgagugcugggauuaaaggcaugggccuggcaaagaaacauauuuucauuuuauuacuuuuguguauguguauaugaauauauguguuauauguacacauguauguggguggaggaaguaccuguagacauagaaguagaaacaagacaagcauauuguucuacacugucacugucuaucuucauuccuuugaggucuuucacuaaaucuggaaccaauuaaauggccagcaagucucaaccuuccuccucuccaucugccuauuguguuggaguuacagguguugugcauccccauaaugggcuuuuuaacgaauguuuaaaaauuauuuuuaaauaaaaacuauuuauuuuuacaggccuuuggaaaugcaaagacagcucauaauaacaauucaagucguuuuggcaaguuuauucaaguaaauuaccaagaaacaggcacuguacuuggguaaguacugccacuuuagaagcacccccccacacacauguauauauauuauauaugcacauaugcuugguacauauacacauacacacauuaaaaucuaauuuauuuucaguguauguguauaccauguaaauucagugcucuuggaggauagaagagagggcaucaaauacccuggaacuggaguuacagaugguuguuagcugccaugugagagcuaggaauuguacacaaauccuuugaaagagcagccauugcucuuaauugcugaguuauuucuccagcuccuggagcauauuuguauuuuaguuauuacuaguuucauaagcuaugauuaugauauugauaucugcauaaauuuuuucccacauuuuuaguggguucaaacugaaaaaguuguaggacuaauuauaaugagaaaguuguaagacuaauuauaauucuuaacaugcuuauacuuguuaccuguugacaguugcauguauuuauguuuauauuguaaauuuucuaaaauuuauuuucaaguuaggaacugauccuuuauuuuauuucugaagauaaucacauuuuucuacauaucuaaguuaguauucucccaaucaagguauuugauuuugauacaauaaaaagccguauauuuucugugaugagucaucugauuuuccuagcaauguauuuuauagguuaaagauuaacaguauucuuuagaccagcuuuagauuuucaacagaaggaaauggaaauuacagaguucccauauaucauuuccaucucuuccagcauagcuuuccuuguuagaaauuuuguguuggugugcucuguuuguuaaaguugaugagcaguguuguuacuauauuuuuauuaauugugaaauuuauaacuuguauuaauguuugcucauuguguuuuacauucuuuuggcuugagaacuacagagaugcuauuuacaguuuccauuuuaguacagacaauauaguuuuacugugcuaaaaaucuuuuguguuuggcuuauucagccuuuuuaccuucuaggucuuuguaacuacuggucuuauccugucuccauacuacuuuuuccaaaauguagaguuggaaucguauuguagccuuuucaguagcugaaaugcauauuauguuaauguugcauauuaaaucucaucaaaguuguguuugggaucuauauagauaaacaugucuuccuucugaaaugcauuguacuuuuuuucucucucuaauauugaacuauuuugcauuucaggaaaauuucucaauacaaacucauacauauauaccauacauguaaauuguuauucuucuaauuuaugguuauuauuaugauuuuuauacccauauuaauagguagaugauagcuuauuuuuuaugcuauuugaauuauaccucaaucuuauguauuucuuguuuaaaaaaaaaacauggccaaaacuacugugcauauaauguuuuugcccaccuuugaagaaccuaaaaccaauguuaucaacaaccacaaaaguccaugggagauguucaauagcaguuucauaggucauuucuuuucuugauucuugagacuuaccaguuuacaaaggcucaguugguacuuuuucucuuaaagugggauauggucaaggaguuaggcuuauaguuguguuucagaagagaauggcaauagguaaagccauauguauugcuuuuaaccccaaauguaauaagaaucuucauugcuuaagauaguuuugugaauuagaaaauauaugucuaguuuccuuuauugaaggaaaugcaggcucuucuguugauuucauaaaaauguuuaaacauuuuuucuauggggaacacaaaccgaguaaacaauauauuuggauugaacauuauuaacucauuuuuuuauuuauugagcauagauuuguggggugcauuuugaguaucaggcauuguuuuaaauauugaagauuaagaaaaccuauguaaacauguuuuuugccuuggacuuuuucauugucuuuuggggaaauaugaauauaggcugauuauaguaaaugauaauucguuugagguauguuucuggaggccuuaugaaaaacauugguauuuauguugaguauuaaaaauuugccaagugaaaggacaaggaaauaauuuuaugaagugagaaauugucuuuaguaaaugacugucaucauaacaagaacuuauauuugaagaggcaagaaaaauauguguauagcauuaucauagagguuagauggucaaauugaauauaaaacuaauauaauuaucuugacaucgugagguaaauuuuagauaauuuuauuuaaaaagucaaauauacacaaaguagaaaaaaauagagcaaggacauccuagguagauucaauaaugauuaugucuuaacauauuuaauucauuugucucuucuuuuucuucaacaaugauuaagucuuaaccauauuuaauucauuugucuuuucuuuuucuaagcuggcuuuaaauaaagucucagacauaugugaucuguucagcacugugcugagcagauaaauguagaagcauaauaugaccaucucauucucuguacugauagcuuguguucuaguagaacucauggauuaggauggaagaaaaagagaugucuaggaaguaguaaaacugaaagucaggcuuuguagugaaaucagacaugggcucauauucauaugaugacuguugcugauugcuaguagaugauuuugauuuuuuuuuuuuauuuuuaaaacaggguuucauuguguauuuacucuugauauguucacuuaucucaugcacuagccauuugaugacuuaggauuuugagaauuugggcuggugagauagcucaguggguaagagcacccgacugcucuuccgaaggucagguguucaaaucccagcaaucacaugguggcucacaaccaucuguaaugagaucugauuccgucuucuggagugucugaggacagcuacaguguacuuacauauaauaaauaaauaaauaaauaaauaaauaaauaaaucuaucuuaaaaaaaaagaaagaaaggauuuugagaauuuaacauggauaaugcuaauaucaucucuaacaguuagaaugguggauguguagcugucaucugauaaaugauccuuacaguuuugaacugucuaaauaaauaaaaucuauguuauauuaaacuuuauuauuuauauaaacuaauuuuuauuauaucaaccaauuuuauuuuuuuccagggccuauguugaaaaauaucuucuggaaaaaucuagacuuguuuaucaagagcauaaugaacgguauauguuuuuauuuguauucugugguccuuauuccacuguauauugugcacagauuuuauauuuauauuaacuacuauuucuuucuuggguggaaugcuauauuuuuuaauucaguuggaagauuuuuauuggcuauugucuuagucagggucucaauuccugcacaaacaucaugaccaagaagcgaguuggggaggaaaggguuuauacagcuuacacuuccacacugcuguucaucaccaaaggaagucaggacuggaacuuaagcaggucaggaagcaggaacugauguagaggccauggggggauguuucuuacaguaggcuugcuuccccaguuugcuuuuuuuuuuucuuccuucgagacaggguuugcccuggcuguccuggaacucacucuguagaccaggcuggccuugaacucagaaauccaccugucucugccucccaagugcugggauuaaaggcaugcgccgccacugcccggcuaaaccuuguauucuugaaugaguuucauaggcacagugcguaucuaagaguaacaaaauuaauuuaaaauuuuugucaauauacaaagauuuauaccaaugaaaacuuuaaaccuguaucauaucaauucuguaccaauauaagaauaauguaacuucaauucuguaucagaaauuagagauuucuaccauuguaaaauuaugacuauaaaauuuuuuguauaagaguaaguuuagcaauccaucccauauaucuauuuucuuauaauauuaugcugucccccuuuuucuuuucaacccccuucccuuuacuuaagaaagaaaagauagagaagaaggaaagacagaaauccccaagucuaaguucuuuauuuaguuuucucccuguccaaaauuaugaccauuuccaaauuaucucuuaaaauaccagucuauuuauaauuuacaaaauaaccauaaccagacacccaaacccaaggaauugggaugaugauccuccauagcuucuuccugcugaauuggggcaauggauauuauuuuuuuuaagggguggggaaggguagaaguauuggaaaaauagguuagacuuaagaaagcuagcuuuagcauuuguuauccagucuguguaugcuuaaaaaguacagggcuugacugauauucugacuggaucugucugcaagucuggaugaaccgaggucaucgggaaucagcagcuauuucugaagcuguucgaggagcaagucucuggaagcagcaucaagugaggcaggauuacgcagggagcuagaacagcaggucuuuucagcaucccugaggaugaaucuugacagagcugcgucuuguucauucugaaauauaugaaucuuacaacaaaauuuuuaguacuguaagguauuuguaugaauugugcaagguguacagauaaguuaaggauacauauuugcuccuuguuugagcaggugaaagacaacugucuuuuuuaugaccaaacaaaauaaaaaauguuucuagaauuagucauguucauuauauguuuuguucccaacaggaacuaucauguauucuauuaccuucucgcaggagcaagugaggaagagagguuagcauuccaccuuaaacagccugaggaguaccauuuucucaaccagguaagaacucaugaaaaacauuuugaaauguagagcaugauuaaauuuuaguuacugaggaaguuuuguagugcuuuuauauauagauauauuuugccuuuauguagacaguccaaaaaaauuauguggcauauccuccaaauuuaaaaaggauuaucuacuucauauaagggguaaaaauuauguauguuuuaugugcauuuugugagauucuuuuaauaauauuaaacuguuuuaucauacuuucuuaucagaaaaauguuacauucuuuuugucaugaaugaccuuuaacauacccaggauguuaaguauaacuguugauuaaugcuugcgaauugcagagagauugcuuugaacuugauuugcauguuuuguacucuaaugcacauaugucugcaugcuaugauacuagcauagaauauuacuguauaauuuaaugaacaguccucuuaaacauucuauagaacccgggcauaauggcucauuccuguaauccuaagucauuugggaagcugaugcaagaggauuaccaugcuuggucucuauaaugaaucccagggcagcuugugcuacauugugauuucuugugguuaaaaacaaaacaaaauagaacaaagcaucaguaugaaauuucucaaaggcaaaugauguagagaauguauuuuuuuucuuuaaaauucagaauucagcuuuaagcuuucauauugaggaaugaucuucauacauuuuucagauauagauuucucuauuuuucuauuccucauauuaaaauuucaaauccaauuauuaguggaauuguuacuauaguauauuacuuaaagaauaaaauaaucccucauuuuuuuguuugagggaaaauauuauauuuauaggaaaaaugucuuuaugacaaugaaaaguacccuuaggauuuuuuuuaauuuaauuuacacuugagugaguaaaaaauuuucaguuaaauauuaucaaaguaacaccauggacuuuucuucaaauguacaguaugcucuaccugguauuuuuuaacuuuacaacuucauauuaauauaaacuuccuuaacuucauguuaauagaucuagaacuuagaaauuauaucacuuucuguuugacugcuaggguauuuuaacuauacauaauuaaguauauuuuuaaaaaauuacuaauucagccugaguaauuauuuuuuuuaaacaaaguuguaagcacuuagaaaugagauaauuuuuacugauucaguauuuuauagucuuucugacauuuuuuguguaaggaguaguaacagcauacaugcauaauaucaguacugauaggauaaagaacuuagugauuaauacaaauaucaaagccacugggcaaugacauguauaaguugaauagaauaauaauaaucucccagaauuucaauauuuauuuaguuuuuauuagaguauguugcuauacaaaaugcaucucagagaucauuacagaaguauaauuccacccuaauaacuucuaccuaacuaauguaccuuacuuucagauaacaaagaaaccucucagacagagcugggaugauuauugcuaugauucugagccggucaguacaaguaccuaaauauuuuuuguuccuguuaaagggacuucacauugcucauucucauucaucuuuaucagucagcaugaagaugagcugauacaucaacaaugcaaggaaagaggaucacuaguuuuuauuacuuugaaugguugauuuguguguaauaguuuguugcuagaccaauuuacuauuuuuauauauugagcuuaauguuuaaucuucauuaaacauuuacuuucacagagaguacauugacugcaucccugauggccagcacuguaguggcuguuucaacuccaguaauuccccuuuccccucaagguuuuuauuguuuuuguuuuagugcagugugacugcuaguuacacucuuuaccauuaagcuucauccuuaguuugaugcuuacuuuuuggaauuauuuuuaguggcuaaaucgauagcuuagugguuaagaguguuugccucuuuucuagaggaugagaauuuaguuccaaggacagugucaaauggcuuguuauagcuaccuguaacuccagcuccaggugauguaaugccaagcacccaguguaaaguggcuuguuacaacugucuguaacuccagguccaggugaucuaaugccccuuggccucugagaacacacaccugcauccacauguacacacacacacacacacgcaugaaucaaauaaaaauaagucuuuagaaaaugaagugacaucacuuuuuaggaacuagggagauagcucauuagaggaaaugcuucuuguacaaacaugaacacuaaaguucagauucuguacuccacagcugaggguauaaaaaggcagaaaccaugagcucuuuggcuaauuaaccuaacccuaacugaaauaauaagucaaguucaaugagagacccuguagcagauaaauaagguggagaaugauagaggaugacaccuguuguaaauuucugccuuccacauguauuggguauuaaucuuuuucauauaaacugaauguuuauaaugaauguucuuuuucucuguuuuuuuuguuuuguuuuguuuuuguuucuguuuuuuauguguaauagaagcuccuauaaaaacuuuugucuggcagggaaaaagugucuuuaaucucagcacuugggaggcagaagcaagggcagaggcagaggcagaggggcagaggcagaggggcagggccagaggggcagggccagaggggcagggccagaggggcaggggcacagaggggcaggggcacagaggggcaggggcgcagaggggcaggggcgcagaggggcaggggggcagaggggcaggggcagaggagaaggggggcaggggagcagagaggggcagagaggggcagaggcaucucugagcuugagaccagaauggucuacagagggaguuccaggauacccagaaccacacagagaaacccuaucuuaaacugauaggcaaacaaacaaauauacauacaaacaaaaaaccuuugccuuaaucaccgcuaaauuauugauauucuuauaagcaagauuauuuuaugggacuggucagauggcucagcaguugaccauugauucauugacugcuuuuucagagaacucagguucaauuuccagcacccacauggcagcucacaacugucuguaacuucaagaucugacaccuucgcgcagacaugcaugcaggcaaaacaccaaugcacauuuuaaaaaaagauuauuuuguggaacuagaaagauggcucaggccaggcagugguggugcaugccuuuaaucccagcacuugggaggcagaggcaggcggauuucugaguucaaggccagccuggucuacagagugaguuccaggacagccagagcuauauagagaaacccugucucgaaaaaccaaaaaaaaaaaaaaaaaaagaaagauggcuuagagguagcacuuuuuuuuuuuuuuuuaagauuuauuuauuuauuuauuacauguaaguacacuguagcugucuucagacacuccagaagagggcgucagaucucguuacagaugguugugaaccaccaugugguugcugggauuugaacucuggaccuuuggaagagcagucgggugcucuuacccacugagccaucucaccagcccgagguagcacuuuuugcuacugcagaggaccaugacuuaguuccuagcacccauguuugacacccguuacucaaguuucagggauccuguggccucucuuagucucugaaggcaccuaaauucauguguauauacuuacacauagacacauggacauuacacagaaauaaaaaauuuuuaaaaauguauuuauuuauuuauuguauaugaguacauuguuacugucuucagacacaccagaagagggcaucaaaucucauuacagaugguugugagccaccaugugguugcuaggauuugaacucgggaccucuggaaaaagucagugcuguuaaccacugagacaucuuuccagcuccagaaauaaaaaucuuaaacgauuaucauagguuuuaaacugaguuauaggaaggcauaugugguagaaaauggcuauguguaacuguguucuauuuuauauaaguacaaauuugaaaccauaaagugaugacaaaaaugccuuucuuuccuucuuucugucuuucuuucuuccuuucuuuuuuucuaagucacuuauaaaggcuaaaagcauagauaacaucuagcuauacuuauuaacuaaugaauuagguuuuaaaauuacucuucccauaaacauagcaugucuuaaucuuugcuuucucauugcaugucauuguaaacaauacuaauugcaaaguuugccuaugccacuugugaaacaucagcauguguaggugcuagguuuuuccuccagacaaaguauacuuucaucaccauuucaagaaucauuucauuacauaaucaagaauguauugguuuuggauuuaauaguucuggaaauagauaucucaguuuauauauuauugaugaauuauaauauaaaaaguauaauuuauuuuacucccaagaagcucuucuggucuauauuucauuuaucacaccaagugaaucaugccucuuuggaaagcagguaggccacugcaaacucucugcaaauaugauugauuacuuguacauacuuugcuauggaacuguagauuggucugcauuugucugaaauuaaagugcugcuuaagaauaugaugugagaauacuagcucauccacuuacugauauugagacccucagaaggucacuuaauuuuuuucuuugcuuuuuuuuuuuaguuaauccuuuuauucuugccuucuauuucagagaacaguggucuuugaucaucucagcauguauguguucuuugcacuuuggguuauauuauauagcaagacuuugucucagaaagaccaaaaagucacagaccuguaaucuagcacucaggaaggcugaggcaggaaugucaaguuuagacuagccuaugcuacuuaacaaauaugaggccagcuugaacuaaauagugaaauuuucuaaaaacaaaaaccaauaacaacaacaacaauaacaaaauaaacaaaaaucaagcaaagaaaaaaaaucuucaaaaauggucuucagaauuuguauuaaauuugauaauagguaugaagaauuugcuagagaacugaacacugaagugcuagggaaaaaugucacuucuauaguugcugccaucauuggaaucagaguacaucuuuuuuauuuaaaggaauuuuguagcuauaauuuacacgugugugcaugugcgcccucaugugugccuguuuguuuuuuuuuuuuuucuauuuguuuagguauacauauguagaagguagagaacaauuuuguuguucucagcuguuuuccacaucuauuugucuguuuauuuuaagaccuugccuuucacuggccugcaacuuguaaguaggcuagaguggcuagccagcaagacccacccaucgccaccuucauagugacacuugcuaccauguccagcuuugaaaaauguggccccuagagauuaaacucaagcuugaagagcaaguauuuuaccuaauggaauacuaccccagccuauaauuuccuguucuuaauacuccuuucagcacaguuaguccuguuuauuauacuuuucaaauagcuagagcucgacuuugauugccucucuauuuaguccuggcugucuuaggacuugguagguaauguaauuuuuaaaaguuuuuucuaaaauuaaaaaaaaaaaaagaguaaaaaaaaaaaaguuuuuucuguuuuauuuuuccaagacucuaguuuaugauuuagaaaaaaaauaaucuauaaaaaacuaggauggggaauggagagagggcucagggguuaagagcacugauugcuuuuccagagggccugaguucauuucccagcauccacaugguagcucucaaccaucuguaaugggagcugauacccucuucugguguguaugaagauagugaccaugugcucauauacauaaaauaaaacuuuauuaaaaaaaaaccuagggauaaguauacauuucuacuuauauauguuuauguuuauacugcccugcuagccccaaacucacagagauccuccucucucugccuuugggauuaaagguauuugucacuacacccagcuccugauucuuuuucuuccaggugaauucuaaaaaucaacuaaucauucuguguaucuguguaguguauucuuuccuauuagguuuccuucauuguauguuugggggaauaaauuaaaccuaauuuucccauguaaguuauuugaacuuacaugacuaguauuguccaguuauugaacuuguaaucuguuuuauuauauaagauuauuucuucaucuuuugagacuauagagacuauaucugacuaagagaugauaugacugguggguagauauuuaguaaaugcauauuuuccaucuucaauggcuaauaguauauucaaauuaaggcuuuuuauuaucauuagguucucuugaccuuuguuuugucaauuauaaaauauggaugauaaauaaaauaccuagacuaugugguguuuuuuguguuuguuauuuuugucccaccuugaacucucugcugcccagaaugaucuccaagucugagguaaucucagagcuuuagcugaccucaugcuuagauaauaggccaccauguccagcuugauaauauguuaauauguuaucauugugacuuaaccugcucugugcaauuucaaucuaaagaucuaacugcuuaaagucuuuuauguuuguuuauuuucccaaacauacaguucauucaugauuuagcaaaaaaaaauuauaaaaaacuagggauaaauauacauuuauaguuaauauauguuuauguuuacacuuaccagcgcuuacaacucucucaguucuaguuuuauauuguuucccagagauaaguuugagaucaagcucuaguuauauacugggaugguuguuuuuaguuuguucuagccuagacucaccugucaaaagagucucaguugaggaauuaucaagauuaauugucuucugggcauuauacagaaagaucuaguccauugugggcggugccauuacauaauuucgggcccuuuccuguauaaacauagagaguacuaggugagcacuacuaauaaacaaccaaacauggaggaucauacauuaauuuucucucugcucuugacugaugugaugcuuuaaguuccugccuugacuuccuugaaaugauggguuuugcccuggaacuguaagcucaauaaauacucuuuucccuccaaauugcuguuuaucagguuguuuuaucacagcaacagaaaugaaacagagcacucacugugguggcuacuuuuguuaugguuuauguuuagcuuaccuuuuccacauuuuagguuuuuucuuccccuaguuauuuuugaaucuugguguguuuaaagacuggcuucuagaaaagacucauauaagauaaggauaguuuuggucuaggaaauuaagucuauccuugcuuuuucucugcaacugucauuacagaaacaguuaaggaaaucaagguaguuuaaaaaaguaaauugugaauuugguauuuccugagaccauaugauacugugugaauaaauauuugauugaggaugacugcaaaucugaaagguuucucuuucagcauguuuuuuacuucacuuucccaguauguuagguuccuguuucauucacuuugcagcaaauaagaaccaccucaauuguaagacuuacugcuguguguguugcauuuauauaaacauguuuacacucucugucauauuauuaaaaauguaauagucuuuaaaauaaauaauggaggucuuggguuaaauaaaagaaaaucccaacacacaugcaguagaggacugcagagucuguguucauucagagaugaugcaccuaacccucuagagacuggaggccccagggaguuuagaugucaggugguggugguggggcauccacguggagacaggggugugggcaggaggugugggauguggaagaauuggaggguagacagggcguggggguauaaaauauagaauguaaaaaaaauauuaauuaagaaacuuuaaauuuguuuuccuuuuuaaauauguuuacuaagugugauaguacauaucuguaauccuaguacuuuuagguugaagcaagaaguuugcuggggguugaggccugccugaauuacagugugaaauuuuguuuauuuuuauuuaagauauuuuuuauuauauacuugaucauauucuuuuuccucuccuuaauuccuccugcaucuuuucaaccuuccuacucaccuagcuugauucacacacaacucucaaaggaaaaacaaaauaaaaaaaaaccacaaaaagacaaaauaauagaaauaaaucaaaagcuaaauaaauaaaucaaaaaacuaaacugaaaaauacccagaaaaucuggaauccucuuuguguugucuggcuacuccugggcauuggaccuguuuggaguuuuguugauauacccagugucaccccauuggagaaaacggauacccccuuucccagcaguuaucauuuccaaguagcuuuuugguaccugguguaacuuuguggucacuucuucaugcugggauuuugucugguuugaauguuuuuagauuuuauguugucagucucugaguuuauuccuguuuugucuguaaaugcuguuucuuuccagccauccaccaccucugcuucuuauaauauuucugcguguuucauguagauccuugauccuugagaggagggcuuugaugaaggcaucccauuuaggguugcauucucuaaagcuucuuacuuuuuugcauauuguaggucuccucugaauuucccaucuacugcaagaagaagcuuaucugauaagggcugaucuuugugcaauauagcaauaugucauuaguagucauucuacuguuauauuccuuuagcacagugguucacaaccuuaccaaugcuguaacccuguaaugcaguuccucuuguuguggagguucuuggguuaaaaacaaacaaacaaaaacaaaacaaaacaaaaaaaccccauacaauuauuuuuuguugcuacuucauaaguguaauuuugcuacuauuaugaauuguaguauaaauaccugauauuuagcauggucuuaggugaccccugugaaagggucgcucaagcccccaaaggggucucaucccacagcuuuagaacugcuguuguagcagaauaguaguaguaguaguaguaguaguaguaguaguaguaguaguaguaguaguaguaguaguaguaauaguguuuucuguccugcccagaacagucuagucucaguuucuuagccacugcaacagugucagguauguuuccaacucaugaaacaggccuuaaacccauucaagaagugguugguugcucccauaacguuugugucacuauugcaucaguguaucuugcagccaggucacacuauuguauguugcaggauuuguagcuggguaauauugaugacuuucuucucuuguaguaugcaaaaaguagcaccuuucagcccuaugaacucuagucaguaguacugaaguuuauagugggcaccagcuugauuuuccccccuuuuuuuucuuuuugguuuuucgagacaggguuucucuguguagcccuggcuguccuggaacucacucuguagaccaggcuggccucgaacucagaaauccaccugccucugccucccaagugcugggauuaaaggcuugugccaccacgccuggcugauuuucccauuuuugaugguguaaguggugucuucagcaauagggccuugcuauuuuuagguuguggaguauaaucaauagccuugacaauagccagugauauuugggaggagauucuguaggaccccuuuugcuagcacaauaagauguaaccuauucccgacacuaagggcuuuacuugguggcuuaaaauuaguugguguauuguuucccauauuaugugguuucuucauuuaaauucuuuucuuuuuuuuuuuuuuuuugguuuuuuuuuucgagacaggguuucucuguauagcccuggcuguccuggaacucacuuuguagaccaggcuggccuugaacucagaaauccgccugccucugccucccgagugcugggauuaaagacgugugccaccacgcccggcuuuaaauuccuuuuuuuauguauauauuuuaagaaguuucuacaguuguaggguuccauaugguauuccaaagggcuuucaguguuaguuuuuaauucccauauucucuuuuuuacccuggccucuuguuuaccucccauuuuaacccuucuguucuaguuuccuuguuaacuaacuccuuacaacauuauauucuguuugcccuuacuuggaagauucucuuucccuccuggcccauuacuagguacccaaacucugagguuauucuaaaugaaacauaugugucuaaaucuuaaaaguaguauccccauauaagaaaguaugcauuguuuguuuaaaaauaacaaagcacaaauaaacaagacuuuauugcaggccaaagaaaauuauuuaaacuuuuggagugugcauguguaccuuuccacauggaaaauuaaaauacauuaguguucuaaacucaaauuaugaauuuuagacuuuguuucaagauguaauugucaaaucauaauaccuaguaaguuuuuugaacauguuguagauacucuguaaauauauuuacaaaaugaagaagcacuuuauuucucaaggucaugcaguucaguaugugauucaaugauuguacaugaaguuaugggagugaaaguauuuauagaccagaagagacacagaaaauuuauuuaagaaaaugacauugucauaagagacagucucaauaggaguauuguccucugagaauguggguuccauauguuaguagauagacauauuucacuaucuuguuaaacaguaaacuucacauaucugucgucuuccaauuggcuauuugcguagaucauuuggaguuagacuccaaauguuugcugagguuacugaaaucaggucccacguagucagggucugauuguuuggcaguuucuguuuuauuuucaacccccuuuucccccacauuuauuucagcaauuugaucucagcacugacuugaugcuuacaauaaaacagaugauuucuuugaauaauuaauguaucauuugcuaggaagauaggcaguaaaaaggaaauugaagaccaagggaagggacguuagggggauggaacggggaguugguagaaggguaaccaggaagggggauaucauuugaaauguaaacaaauaaaaugauuaauaaaaaagaaaaauaaauugaaguuugagauguuuuagauaaccucuuuauaaagugguaugugaacauguaaagggauuguguauguaauauuacuguugacuguuuuuugagcugaaacgcaaaaguuauacuaaaaagcauucuuugguuaguuguuaccuuucauguuuuuuugagaugggaucaugcucuacaguccaggcuggcauagaguuugugauuccccugccuuuguaucuggaguguugggauuauaggcauaugcuacuauauccauagacgcacacagacacacacauuuuaaaauuuucaugauauuuguuuuguguacauguguauaugugguuaccucuuuguacaugugaguaccugcaaaaaucagaagacaucagauucccuugaguuggagucauauguaagcauccagugugagugcugggagcugaacuccagucuucucuaagaguagcaagcacugcuaaugucagcaucaucuccccagcucauaaaauguuuaauguaaauauagugcucaacaaccauauucuuucuuccaucuggccuuaaacucuguguguaguugaggcuauccucacauuccucauucuccuccuccugccugccuaggucuaggauuauggcacaugcuaccccuuuggaguucauaucuacuuuuuaaaauauaauuuaaaacuuuuauauuauauauuauauaauauauuauguauugucuguacauauguguggaggugcauguuugugugugccacagugcacauuccacugcguaggaguguaggucaaagaauaacuuguggaguuaguucuucaguuucccuuuguguauucuagugaucaaacuugggacaucaggcuggucaauaggggcccuuaaccuucagagccauuaugccagcuaaagcuauuuuuuuaaaaaaauuauuuauuauuauuucaugcauguuugaugugugaauguggauacacaggugucaggcauguauguggguuuuuuuuuuaaguuaccaguuuuuacuuuuaugugguuugauuucagguuugucaggcuugaaugauaagugcuuuuuuucuguugaauuaucuugccaucccauaacaacuaaaaaauacuuauuuuuauuuuauuuauguguaugugugugugcuuguuuaugugaaugugugccaaauauaugccugugcccaugaaggccagaaaggagcguuggaugccuugaagcuggaguuccaggugauuguuagacaccugaugccagcacaaggaacuaaguugcuucuucuggaaaaacagcaaguuuucuuaaaugaucuuuccagcccgaauaacuuuuuacugauuucaugugacauguuuuucuagggucuucuauuuugacauaaugcuuucuaggggucuucuauuuugacauaaugcuuuuccccacucucaugaucauuaugguguguguguguguuuauuuuuacuauuauuauauuuucuuuauauaucuacuauaacaccaacugguuuauauuauauaaaucuaggcuucacuucucaaccauauacuauccugauuuuuuuuuuuuguguguguguguuuaauucaagacccuacuuuugagugcuauuaaaaucaaacuugcuauccacauauuuuauaaauacugcuggcuuucuaacuugucucuuuugacauccuaagcugguuauuguuaagggaagauuaaaaaguacuauuaauauuugguagguauguuuacuuuaucuuuacucagaagagagguuuaaugggucagauuauauuuaaauauucuguuuuacuuugcauuuacacagggcccuacuuaaauuaauggguggcuuacauuguuuuuaacaaguaaaugugauauauauuuucuuccaccucuugucuuaagcaggauugcuucacaguggagggagaagauuugaggcaugacuuugaacgcuuacaguuggccauggaaaugguaggauuucuucccaagacacgaagacagugaguuuuaaauuuuuucauuuacuguaguuuuauuaucuacaguaguauacaaaacaugaugcgucuguaagagaucuccaucuuaguucuuuuaaaaacauuuuguauucuuugacaguuuuauacauguauacaucuuuauuauuucaucuuuagcuuccuuuuccuccuucuauaacccaacaaauagaauuaguauugcuugcauaggcauggagccuaccugcagucacaucuaugaagaaagaugacuuccucucccucaguagccaccaaauuccaauaacuccucugcuagcaauggagccuugcgaauacuucccuuagccaugcugagauuauucacuagcuugacuuugcucagguuuuugcagguuaccauggagucucugaguugguaaguucagugaccacguaauguucagaagauaccaucuugcagcacagcucuccauuguuuggcucuugacccugucuucuauaguauauucugagcauugugggauuuauauacaagucucuuuagggcaguccucaauaguuacuuauucuuaacacuuugaccauuuaugagucucugcauugacugcccacugccagaagaaucuucuuugacuauaguugacagcagcacuaaucuauggguauaacauauauuuagaaggcaguuugacagaaagucuuuagcaaaauaaugguagugggucccucuacuggggcuaugacugcuuaauuuccugggcccuuggcuaugguuacaguauuagccaugcauuuccccccccuguggagcaggccucagcuccaucaaaaaaaauaguuggcuaucuucacagcagucauuccauauucuuugguucuuuugaacaguuuuauaaauggcaucacuauugccuuagucauauuaaggcuggugagauagcucaguggguaagaguacccgacugcucuuccgaagguccaaaguucaaaucccagcaaccacaugguggcucacaaccaucuguaaugagaucugacucccuuuucugggguguccgaagacagcuacaguguacuuacauauaguaaaaauaaauaaaaaauucuuuaaaaaaaaaaaggguuugaguguccuccugcuccccuuuucacuauauaaucuuugagaaacugauggaagcuaaaauacuuuauuaagauguauguucauaaacauuugcauauaaauugaggacuucaugaagcuucuugaagcuguauauagacauaacuuaaaaacuacuauuuuuacuauauuacuauauuacaguguuuuacuuucuauaucugaucuuuaguguuauacauuucuauauguaauauuacaugcauauuuucauguuuucucuuauuuuaaaauuucuucauauguaacuguagccccaugauaauaaagugcuuuccucccauacacaaaaccauagacucaaucccuggcagcagcacccucaaaaaucaggcaauaaaacaaaacagaaaaaacaacaaaguuuuuauacaugguaauauaagcagaaugauaauguaaaaacuuuugauagggcuggagagaugacuccuuggauugaagugcuugcuauggaaacgugagagauggaguucagauccuuagacacuuuuauaucuagccaauuuuagaacaguuucugaagugugugugagauucauguuacauguaauuuguuuaauauuuaacauacaguuuaaauaauaaaguuuaaaauuacuaaucuuuugugaagauuaaauacuucauacuuuguaugggugaauuuguuuuggauuuuggaguaaaaugagcuuugagaauacacacugcaaacuuuaaucugugcuuuuauuuucauaggauuuucucucugcucucagcaauacuacauuuggguaauaucucauauaaaaagaagaccuaucgggaugacucuauugauaucuguaauccugaaguacuacccauugucucagaauuauuagaagugagucauuugauuucgguucuuauuuuagauacuggguaaugucuuacuuuuauuuuauauauccuuuaacuuguaaguggguuuauuuacuuaaaauuuaacuuauuugauacuauuuuaaaguaauguuuccagaaguuggaaucucucuggaucccugccuuacuugccaggauccugaggacuguguuuucuuccuugccuucacuugcucccaauacauauaaucucucaguuauuugauuagaaugaguauuuccacucuagauuguauaauguccugggcacaugccaguguuggucuuucaauuugagauuuuucaaauugugguuagaugauuugauuugaagauggguaucuuggugaguagagagaauagguagaacuaccaauuuuuuuucuuaagcggcuugaggaggacuuaaaggucaggucccaugcuucuuuguacaucaggcucuuuuccaccguucuucucagaguuaugguguguuguaauuuccagauaacucuucaucuuuccagauuuacccccaucaaauuaguauuuuucuuuuagggcugucucaccugacagaugaagugaauauauggguguauuuuaacuguuuaucuacaacaaauuuucaugcguaaucauuuguaccuguauaaaaauaaugauuucauacucauaucuguaaauucauuuuucaaacuaguguucaauuuuuuccucuuacauguguauaaacucccacuaccucagacagaaaucuaccauuucacccucuauuacucauauacuucucacuaacaggauucauuuuauaacaguauugaauaacaccaguuuccuugugagaaaugguuuuagauuagaaaccaguuuuuacaggugcuccuuuggcuuuaguuguggauugcauuugucuuaaguguuauuucgcucuucaucuuuucuuccucuuucuuccguugagaugauaucauauauuuguuauauagcuagaguaucucaucaugcccuguacuccuucuggaaucccuuucugccuuaaguaauuuuuaaaaauuuguauacaguagggcccacuuuuugugccgaauguuuuuuuacaaauauauaaagucaugcauccacuauuauagucuuagacagaaucuuuucacugcucuaaaacuccucuucacauuaauuuguauuuuucacauguaauauaauuguaguuauauagauauuaguauuuuuggaaugacuuacuuuacuugguagagugcauuuaagaugcauucuuuuagccuagguaguagugguggccgcagcagcagaacaugcacuccauuaaucccagcacuugggaggcagaggcagguggaucucugugaguucagugccagccuucucuacauaguaaguuugagaacagccaggacuauauaaagagaccuugucacaaaaacaaacaaacaaaaacaccauucuuuuaccucuggguaauauuuauaguguguguguauacuauaauuguuaauccacuuaugaauugaagaacugucuuacuuguuucugguuuggagcagucaggauuagcuugauguguuuuuugguuuuuuauuaauuaauuuauuuuuuuacacucccuauuuuauucccaccuacccacccuccaaauguuccacaucauaccuccucccuacccccuaccccaccuuaccucuaaacuuccuggggccuccagucucuugaggguuaggugcaucaccucugaaugaacacagacccagaaguugucuacuguauauguguugggggccuccuaucagcugguauaugcugccuguuuggugguccaguguuugagagauccaacacuggggguccagauuuauugagacuucuguuccuccuacagggucgcccuucuccucagcuucuuucagccuucccuauuucaacaacagaggucagcugcuucuguccauugguugggugcaaauaucugcauuuuuuuuuuaaguauagucuagaguuuauuuagggcauggggaggggaguugagagaguaguagaggcagagaaaggcagacaaaaggagagaguagauaaguggaggcuggccaugaccacguggagagagggcggggggggggaagggaauggagauagagggggcacaaggcggagggggagaggcaagaguguaagaggguaagagagcugcaucugacucagcugcuugcugggucuucuggaguguggucaugcuagguugugagugcuuuguagccucagugaggccuugggaccuccccuugagcuucuuuuccugaggcuccucuccauuuccaucccuguaauucuuccagacaagaacaauuagggaucagaguugagacuguaggauggcaaccccauccuucacuugauguccugucuuccuguuggagguagagucuauaaguucccucucccuacugccuggcuuuucaucuaaggucccucccuuugaguccugggagucuuucaccucucaggucucuagugcauucuggaggguccuccaaacuccuuccuguguuugccuguuuacauucuuucugcuggcccucagggcuucaguccuuuuuucuccucacccaauaccagaucagguuucccucucucccccauuuauccccuaccccauccacuuucccucccuggucccucccucccucccuuccucuccccccacuugugauugcuuucuuuucucucccaagugggacugaguugucuucauuuggacacuucagcuuguugagcuuuuugaguucuguggaauguaucuuggguagucuguauuuuuauuuuuuauuuagcuaaaauccacuuauuagugaguacauaccacgcaugucccuuugggucugaguuaccucacucaggaugauauuuucuaguuccauccauuugccugcaaaacucaggauguccucauucuuaauagcugaguaguacuccauuguguaaaugaaccacauuuucuguauccauucuucuuucgugggacaucuagguuguuuccagcuucuggcuaucaugaauaaggcuacuaugaauauaguggaagacuugccccuguggcauggugggacaucuuuuggguauauucccaagagugguguagcugggucuucagguagaucuacuuccaauucucugaggaaccuccagauugacuuccagagugguuguaccaguuugcaaucccaccagcaauggaggaguguuccucuuucuccacauccucuccaacauguguugucaccugagguuuugaucuuagacauuuggauugguguaagguggaaucucagagucguuuugauuugcauuucucugaucacuaaggacuuuggauauuucuuuaggugcuucuccaccaugcgauauuccucaguuaugaauucuugguuaaguucuauaccccauuuuuugauuggguuguuugauuuuuuuggugauuaacuucuugaguucuuuauauauuuuggauauuagccucugucagaugugggguuagugaagauuuuuuucccaaucuguagguugcugauuugucuuaucgacuauguccuuugccuuacagaagcuuuccaguuucaugaagucccauuuaucaauucuugauccuagagcaugagccauuggaguucuauuuaugaaauuuccccccccccccccccccgugccaaggaguucaaggcuccuucccacugucuuuucuauuagauucaguguaucugguuuuauguugagguccuugauccagcugcuaaagugcuuguuauacaagcaugauuaccugaguuuggauacacauacucaaggaaaagcugguuuugucaugaaucuaggguaaagcuagcacugggcagguaaaugugggagaggauggcaggaaagccaaauauccugagcuuacuggacaaucaggauagccagccagucagugagcucugguuccauaagagagaccuugcccgaaaaaauaagguagaaugugguagaguggccaugucuuaaaucacagugcucaggaagaagaggcagauggaucuuuugugaguucuaggucaaccuggucuacauaguuccaggucagccagggcuauauagagauauccugucucagaaaacaaaaaagcaaaacaaaauaaaaucugaugggcagaaauaagccuaauauugauuccugucuuauuaauuaauuaauuaauauugauuccugucuucuauagcaccuguauacauauacacauccacucacacacccugcacacauacacagcaaauauuuuguacugaaaauuauuuuaugaugggcagaaauaagccuaauauugauuccugucuuauuaauuaauuaauuaauauugauuccugucuucuauagcaccuguauacauauacacauucacucacacacccugcacacauacacagcaaauauuuuguacugaaaauuauuuuauguguauaaguauuuugcuuguauguacauaugugugccacaugugugcuugauugaccaagaaguuuacaagaagaugucaaaauauuuggaacuggaauuaugaugguugugagccauuacaugggcaaucagaacugaaaccuuauccucugcaagaacaaguuuuuaaccacugaucaccagucccccuuuuuauucauuuuuuaaauaauucagucagguguugaugguacaugcuuggaaccccagcacucaggaguuuaaaccagucuaggcuacaaagugagccccugucauaaauaaacaggauaguauugacuucugugguaagaguaaaaacaaagagucaucucuaucucaaaguauaauauucauauuuaaaaauauauuucuggaacauauguacucggaguauuccucaaauuuaaggagugcuccuauccuuuagucuuucuauucauuagauugugaagucuagaaaagcauguguguaguuacauacauacauacauacauacauacauacauacauacaaacauauguguaugugauagcugucugugauucuggugagaacucaugaccuuuuacaggcuagacaagcucucuagaguuaaauacucacuuggaagcaugcauugaaaagauaccauuuguuacccuuuuaucuauuuuagguagaggaauuauggauuagugauaugcuuaaauucuacuuuagucauuauuaggauugccuauguauuuucuuugcauuucuuuauauugauugcauauuucuaacuuucauuaaaguuuuuuuuuuuuuuacuuagcuuuucaauauaagucguuuucucucauaaaucuuacauguugaauauauuauucugcuuucuagguuaaagaagagaugcuauuugaagcauuaguuacaaggaagacggugacagugggagaaaagcuuauuuuaccauauaaacuggcagagguaugauuuucuugugcacaaaguauuuugaauauucuagaauagaguuucuaggggguuuuccuuuccccuuuuuaaaagugaagcugacauuagguaaaauguauuaauuaaaauauuuucuaggaaaacugaauuucccauacauuugaaagcuuaaaauuuugcguggcuuuauauuuacuuacauauuaaaauguaauaagacaaaacaaaaauugucacauugaagugacaagccagcagcaagaaaagaguccaagagaaggcuuaaaaaucagagacccacucauuugcauacuuaagaguccaauaaaaacacaaauuugaagaccauagaagaccugguacaggcccuguguaugcugcuuccgucucugaguuucaugugugcuuugcucauacugauuuagagaaccuucuuuucuucauucccauuggcucuuacaguauuucugccuccuuuuccacggggagggauuugaugaagacaucucauuuagggcucaguguuccaaggucucucacuuugugucuggcugugggucucuguauuuauuuccaucugcugcagaaggaaacacugaugauggcugauuuuuuggguuuuuuuguuuguuuguuuguuuguuuguuuuaagaccaguauauuugguuuacccuagguuccugggauuucuaguucuuguucauucaugcaggguuagguauggauuccauguuguggaguagguguuaagucaaaucaaauauugguuaaccccacaagcuuugugccaacaaugcccuaccauaucuugcaggcaggauacaaguguagauccauggguuuguggccagcuugguguuuacaguucuccuuugguaauuugcagaguaccuuucuguagcagagacuuggugugguuuuaaauaguaagcuuucauuuuuuuuccucaagguucuuugauaaaaaauaguuauuaauuuaugcguaucguuguuucgucugcauuuaugucuuaguaacguauguaugcagugccuauggaauacagaguuagagacgugugagcugccuuguaggugcugggaacugaauccagguccacuagaagaggagucagugcucuuaaccgcugagcagucuuuccagucccucuuaaggauuuuaauuuuuguuuaucuuuccauccuauugaacuguggaucugguauauauuagauaaguauucuaccacagaacuaaauccccagccucucuuaauuauucuauuucauuuuaauauuguagggcaaacagaugauagauagaauuauaauugagagcaauauuucaccccagcgguuauuucuucuuccuuauuauuuuuccuuagucauuuucugcucagcauacuuugucuuauuuccuuuuuuuuuuuuuuuuaacugcuggccagucuuuuaaaguuuauuuaacauccuuuuuguuucuuacuaaauucuuuguuuuucuuuuuucuuuuuuccuaaaaauacaaaaaacaaaggaacaaacaaaaaaaccucaccaaaauccauggugggaacaaagcuauucguggcagcuaagaaucagugcauaucacaagaaaggauuagggcaagauauaauccccaagacacacuccagugacccacuuccccccuccaggcaccuuuuauaguucucccacuucucauaaauccaucaguggaauuaauuauugauuccauuagaguucuuauaauauuaucucugcagaugccccuguggacacauacagacauguaaauuucuaacaucucagucaucuuaaguccagucaggcuaguagugaacauuaacugucacaggagggaaauaugcacagcaugucuguagggaauuggauauuugagggccaugcuagucacugaagauaagaccagaagcuacgauagaagaugcuuuuugugcagaguggugacaugcuaaucaaaggaaaaacaaaugucauuugaaaugaccaguaagacugaguaaugacuuaaauaaugggagacaugguagaaauggauaugguaggccagacugcauagcauauggaaugacuagagaguauagcaugagguagaaguuacagggcuauaaguauagacuaauuugguaguuugguguguguggauuuuuuuuuaauuuuaagauuuauuuguuuauauauaugagugcucuauuguauacugucaugacuacaugacagaagaaggcaucagaucccauuauacaugguugugagcuaccgugugauagcugggaauugaacucaggaccucuggaagagccagccagugcucuuaaccucugagccaucucuuuagccucuguuacuguaucuuauugaaauuauuaccauucuacuuugcacuuaugauucucuuuguguuuuguaggcugugacagugagaaacuccauggcuaagucuuuauauagugcucuguuugacuggauaguguuucguauuaaucaugcacuucugaauaguaaagauuuggaacaagauacuaagguaaagaucuguuguauuauauuuuaccugaagacuauuuaauaaacuggugaguacuugaacuuuuaagggauagaauuauguaguuguaucaacuuaguuauuuauuuuucuauucagguuaaccauuuugugugucuuugcacauauuuacaugcuaugaacauuauacacagaguuguauauuaaaaguagaaauagaaacaaaaucagauuuuguauuguuuuaguguuugcuuuccauauaaaaacucuucaaauagauuucuguaaaaauacauuuuaacauaagauuucuuggacuauaucauuauauauuuuaauaauuguguaauacuagcugggcaugaugguucacaccauuaaucccaguacuugggagacagaggcagguggaugucuggguuugaggacagccagcaggucgacugacagagagaguuccaggacagugaggguuacacagagaaauccugucuggaguguguguguguguguguguguguguguguguguguaauuguaacaguuagugugauuuuuaccuuagaugggcuaaugagagaaacuauccuucugucucauuuguugcccugcuuuuugggaaugaaagucaaacacuuguuauguuuuucuuaaucuuguuucuccucuguauuauuuauuuauaucucgguugaauuuuaucuuucuacuuuuuucuuucuuaggagcuauugugaacauuuuggagauuuaguuugaugcauacuguuuucucucuuaaguacuuuuaaaauauuuacucaugcuguaaguuucuguucauccauucugucauucuuuuaucaucuuucacuuacacauuuacuuauaagaagguuucuuccagcccaaguuuauaaaauauuuaguauuaugcuuuuagaauuuuuuuaaauuggaacuuuuguuuuguuuuuguuacuuuuugaaauagggucugucuacauagccuuggauguccuggagcucacuauguaugccugacuggucucaaacuaacagaucuaccuguuuuugccuguuguguucugggaguaaaggcaugugucccaugcccugccuuuuguuuguuugcauuuuuaaggcaagauauugcagcuuagguaugacuugaccauucuccugcuucuuccucgugagugauggaauuauagguauaugcuaccacaccgucucuggauuuuauuuuaaugugauggguuacauacauauaguuuuaauaauuucagguccauuuuaauuuuuaauagccauuaguguccaguuugcuuaaucugcuuaaaauguuauuuuuauuguuuacuccuacugacucaaggaaaaauuuuuuauauuuuugaaaagauuuauuuauuuaucuuaugucugugaauacaaggucacugucuucagacaaaucagaggaggacacuggaaaucauuacagauguugugagccaccaugugguugcugggaacugaacuuaaggccucuagaagagcaguuggugcucuuaaccucuaaguuauuuuuucagccccuauucuuauuuuuuuuuauaguucaaguaguuccauaguuauaaaauuaaaucucagucuuauuauucagugaacuuacuugugaaggacauuauuuccuucuauauaucuagauuuuucaguagccccaacuaaguaaaucucucuugauacauuuucaaaauguccugcauguucaucauaauaguuugcuuacugugucuguuaguaccagugggguguggggaguuaauucccuuucagagcuaauggugguuuucaacguuacucauuuuuugacccagcaucccuauaaugcucaugcuggcuuugacucacauuccucuugccucugauucuagaguguuuuguuuuuccuuucuuuacauugauugauuauuugauuguuuguaucugucuggaggucagaggacaacugggagucaguucucucuuuccaugagguggauucugcagcuagaauuuagguugucagguuuggagucacgugucuuuaccugcugagcuaucuuguauaccuaauuuaaugcugauugcaaaauuaaucguuauugauaccaaauuaagaauugcauaguuuucuuguuauaacuaaaaauaauuuuaucuugcugaucuuugacuuauguaaccuuuugauuuucucauaaccuguuguuucuguucuaucauaggacuuaagaauguuucaguuuauuugggauuucuugacucucucaauuuaagauaauagcucauucacccuuuccaaaguagugcagaaauuacauauauucaaauuugucuuauuaaagaaauccuuacaauggaaacaaagcuuacuucaaguuaauuugccuuuuaaccuuaagacccuaaauuaugaguucuuagauaauuaagaauaucaacuacacugcuauugaugaguuaaggugaugccucccucauccccuuuacuacuaaaaaucuaaucucuuuaaucaguucuugauaacuaauuguuauuuuaaaauuugagaaaagcuguuaaacacugauguaaauuaucauaugauaaccacuguaacaggaaaauaaaauuugcucugauugccauuuuacauguuuaaccaucugucacaagucaguuuuccuaaaaauccacucaguuuuaaguccagugauuaauaaauauccuuauauuuaauguaaaugaguaaauaccuaauaaaaaauuggaaaaaaaacaaaaaaagaaacaaaaaacaaaauauuucuaauaaauuauauagguaucauugcaguuaauauuucuaaauuuaagaauuauuuuuuaguuauacaugcaugcguuugugcgugcgcgugcguguaugugugcgcaugcauguguguauucaauaccacaaaugccagagguaucagauucccugaagcuguagucacuaugauuuuucuauuaccugauguggguucagggagaagaauguggguccuuugcaaaagcaguauguuuucuuaaucacugagccaucucucuaaccccaaaauuagaaugaaguauauuuuccuauuacaguaguuuuaccuggugauuuacaucagugauuauuugaauacuggacagaaccagaacuguuacagaaaggaguauuuuacuacuuguaauauaaguaaauuugagacuuguuuuuaaauuaaauuucucuugucuuacagacuuuguccauugguguucuugauauuuuuggguuugaagauuaugaaaacaauaguuuugaacaguucuguauuaauuuugcuaaugaacguuuacagcacuacuuuaaucagcauaucuuuaaguuggagcaagugaguaucuaaauauauaguuacccuccugcuuaaacuuuugaaucaauuucauaacuguuuucuagccugcauuuugauucagacagugcauggucauaucacuauaaggaaaugacaaaucagagcagagcuuuucagcuauauuauacagauuuuuuuuaauaguugccagauguaucuguuaauuuguguuuguuuacauguaucuuuggaugaaucaugcaucuuuuuuaaugcacccuuuuuaaggguguuguauaucuguugcuaucgaguguggucacuuacuaucuuuaguauuuauuuaacugcuuuggucuccacuucuuaucugagaucaaagacucuugaggagcagaguguggaugcaaagguguauucugggguuggagguaauaguucagcaauuuagaacauuuguuuuucucgcugaugaccaggguuuaguuccuagcauccaucuguaacuucaguuccaaggggucuaacacccucuucuaacuucucauaaauacuugcuggcaaaacauucauacaccuaaaauaaaucuaaaaaguaaaaauaaacaaaccaaguaaaccacaauggcauuucuuaugagaaucuuaagauugaugacaauuuaguuuuuauuacaauuauuaugagaagaggacccaaaagaugugagguuuuccuccaaauuuaguuggaaaucaguuuuugacccaguuuauaagccagaacuucaguuuauuuaguaaugacauaggcaacuauacuaagauuuaucacagucaacuuaaaugcuaacuaauggaaagugaaugcaaaccccaaaauaguuaguaggucuacugaauaauuuaaaagaaacuucuaccagcuagcuucuacaaaguauaauaauauauauauaaauucuauaguaaaguuuauugcucuauaugcugacuuaaaaauuaaaauuuauuauuauuuguguguguguguguguguguguaugugugcauguacuuguauggguguguauguauguauagacaugugcuguggcacacgggugaagggaggucagaggaaaaccucguggauucauggauucaguucuccuccucuaccuauguguguuguaaggauugaccucagaucauuaagaguguggcaagauccuuuuacugaaccaccuucugacugguuuuguuguuuuuugguuuuuuuguaaaggguaguuguguaaaauguuuuagggcuggcuacuuugaugaaugcuuaaaguauucaauauaauugaaguucuagacauaauuaauucuuaugugugugauuguaauugugugcauagugauaugaguguauggaagucagaggacaauguggagauucucugggucgaacuuaggucaguugaaguagucuuggugauugauucagaaucauguugaauaaaagacaaacugaaaggugucugauauuugaaaaugcucauguuagcauuuuuaauguugcccauuucuuuccuuuacaugcucugaauuacccuuaccaucacugauuuauuaguaaauauaaugacaauugaguuacauaugucaggcauugugguaagcuccgaaaacaaaaaguuuggagcuuuggaaucuuacugaggaguuuguaccuaacaauuuuuguuuugauggcagauugguggugugagacuaccauugucuuugaggauagucuuccucaccccacucugcuccacauccuaauaaaaacccaaacaaaaaaacuaaaaagagugaacuucaaggcauugguuuucuuucuuucuuucuuucuuucuuucuuucuuucuuucuuucuuucuuucuuccuuucuuccuuucuuccuuucuuccuuucuuccuuucuuccuuucuuccuuucuuccuuucuuccuuucuuccuuucuuccuuucuuccuuucuuccuuucuuccuuucuuccuuucuuccuuucuuccuuucuuccuuucuuccuuucuuccuuucuuccuuucuuccuuucuuccuuucuuccuuucuuccuuucuuccuuucuuccuuucuuccuuccuuccuuccuuccuuccuuccuuucuuucuuucuuucucuuucuuucuuucuuucuuucuuucuuucuuucuuucuuucuuucuuucuuucuuauguauuggucaauguuuuauuguuaucuuuaacuccucuuuugucaacauggauagauacguauugucucaggcaucauuuguucugguuuacuuucagauaagugaaaaccuaggucuguaaggacaaaccuguguaaggagcccagaaguugaagguugcuuucuuucuaaaaacauuucccuauuuugguaaaagguuucugagccagugauaaggguucaaagagcaaaguagaaacccauggucacuguuaacuuccagcuuagugcacucagagggcaugguacccauuaggaauaaaauaagcgagaaagagcugcagcauccuagaaacugcguuccuaugcuuccugcauacucaaauaauauuuauaccuucucaauuuucagaugggauuaaagacuagagaguuacagucuuacaauuaaacuuaugcuguuuaggauuuaaaaagauuuccuagguguaaaaagauguuuuuaaaaugguaauacagguuaaaauaauaaaugauauagauaaaauuuuaaacucauuaagauagaauagaugguaaaauaccuuaucuaaguugccaaauacaaacagacuggacauuuaaauguaacuuauaccuaaucauuuucauaauuguucguacuguauguuuauuauuauaagaaaaagagccuuuucaauuagacaaaaaaauuguucagguuuggucuuuugcuaugcuaaauauugguugcucccagagaccacacauagacccaggugaugcuaugugacauugccccccaaguuuccugauugguaaauaaagauggcagcagccaguagcuggucagaagagacacaaugugggguuuaggguuggagaaaaccaugagggaaaaagagaaaaagguggagcgaagagaagccuccauugggcugagaaucuuaaaauaauggccaugugagucagcuaguuggagcuacgagcagcccagacaaaacaugguaaauuauauaauaaaaauuauuugauaggaaauagacauaauagcauagaggauaaauaucuauccaguucugugcugauugaggcucauuauaaauacaaaggucaaauguaucuuuuacucacaaaccaaguggucaaagggaggauaaaaauccuggauugagauuaaauauuuuuacaacaguguggucucagcuugucauggucuauaucucuugagcugccucaucuaaccugcucuuuucagggcaaggagcuugaugcagcuuuaaggucagauucagucucccccuuuucacaguaaaaugcaauccuugugcuuguuugggagugccaagggugcaauggaguaacugagggcucaggaaugucccugauuuaccacugauuggguucagauacuuuuaagccuguucagggguuaauucaccauagauaccugccauauccuuuauaauucuguaggauuuauucucuuggguacuaggugaguuccuucaguuacuccaaaaguauuagauauuacccuaaaaggcuugcuugaaggaauggauacuuccaaaaacaaacaacaacaaaaaaaccucaguucucuuucaagggacuucaugucuggagucuaaccaacaauauucacuauggaacaugucaccucuuccccaaaaccccuguucauucguucguucguuuguucauucucucucucucucucucucucucucucucucucucuguauguguguguagcaguaguaaguucuucagaguaaacaugggagacagaagacaguaggauauuuuccuuaaaaguaaagcucauuauuuaggccuguguauuaguuauauuccuaucauaauucuuauuauagaacaacuguuaaaaauugaaggaaaaauagugaaauugcuuuuuaaaguaggugaauauaaaagacuauucuacuaaauuugacagaaauggaauuuuauaauguuuaaauagacuuaaaauacacacggacaauagcauaugcauaaaguugugacaucucuguauuaacuguaaguuauagaaaauuuuauuuguguuauuugauaaguuaaagaugcauguuauaauuucuagaauauccacaaaguaguaaguaaauauaaaauauuugccagaaaaauguagauucuaaguaaagcaaaaacaaccaaagcaauccaaacaguaacaaaguaaguauagaagaacugcccaagacugaugcauauggcacuuauguguaauccagcauuuugggaagaccugggcaacaaaaugagaaggaaugcugagaaaagaggauaauugagagaaagaagaaauaguaagguaccagugagcauucacuuuauaugaguugauugcuuuaguaucuaacaaucauuagauugaugaauagcaaacaguuuaucagaggcaguccaaacauuauacccaaagcuaaaaguaaaaaggcauauaagguuuaucgaacauuagcagaaacuauuuguagcuuuauuacuaaguauaaaaggaaauagcucauaaugcuaagaacaguuuuuuaaaguaaaugcacagucccaaauuuauagguaccagauaaaauaucuucaaaaugcaugaagcaaaauuuaauaaaaguauaaugaggaauauagcuuauaaaugggguauuuuuaacuuauuaucuugaauaacuuaacuaacauuuuauggguauccauugcucucugccuugcauaucaauauggacaguuaccuuggacuuaacugguuauugagacccgcuaaauaauauguagcauauugaacccuaucugaagaauacauaguuacaaaaguaaugcuuguguuaguuuggaagcaagggucagcuucccaaauauuaacacauauuuuaauacuauaauaaaauuacaagucaggugguggugacacacuccuuuaauccuggcacuugggaagcagaagccaguggauuucuugaguuugaggccagccugguuuacagaacaagcuccagcacagccaauguuaaacagagaaacccuguauucaaaaacaagaacaaaaacaaaccaaaaagaaaaaagaaaaaaacauuuucauuuaaggcuggggauauauuaucuauccccagguuaacaugugugagauucccaaaguucagcauacacugcugccaaacaauucccuccagaaaaccaaaacuaaguaaauaugcuuaauaguuuaaaaggugaaugaggccgggugugguggugcacaccuuugaucccagcacuugggagucagaggcaggcggauuucugaguucgaggccaagccuggucuacagauugaguuccaggacagccagggcuacacagcgaaacccagucucgaagaaaaaaaaaaggugaaugaacuagaaacuagccacaguuaaccagcaugcuguggggguguagcugacguuaauaguuaaguuuaaaccuauuagaaaauuuucauguuaagaauaugugauuguuccuaaaaccuuggaaaauggucagcaaaauaagucugggaaauaauuccauucuuaauuaucucagaugaaagaaaaauaccuuaauauaaaccuaaccaaggaagugaaagacuuguacagcgaggucuugagaauacuguacaaaggaacuggaagcacccacaauuggaaugauuuuucaugaucaugaauuagaaggauuacuguuguaaagaaaaccauacuguuagaagugggauguaaauucauuguagucaccaacauucacucuucgcagaaauaagugauuuaaaauucacacagcaguguaaaagucuccaaguagccauaaugguccucaacauaaagaaugaugaaggagauaccacuauaccugauuucaaguuauaguagagucauaauaacaaaaaccauguacagaaacagacaugccgaucagaaucauaggucagaugguuuagauaaaaccacauguagacgcaccuuacuuaaaacuuugucauauguuauuauuuucuguaagauaaguugauauuuuguuuuuucuaggaggaauauagaacugaagguaucaguuggcauaacauagauuauauugauaauacuuguugcauaaaucuuauuagcaaaaaaccaacaggacugcuccaucuuuuggaugaagaaagcaagugaguauagugcuuuucaguuucauauuugaccauuaugcuuuuugagugcuucaccuuuauuugugacagagcuucacuguguaacucugaccagguuggaauuagggcugcugcagucccagaguagccucagacucauagcaguccuuagccuuaggcuccccaguguuagcuguauaaguauguaccaccaaccagcuuauaucuaaguaagcguaaguguucugauaauguuuugaauaaagacuugugguuuuucuguauuugucuggaaaaaaauacauuuuuguguaauagauuguacuuuacucuugaacaauuuuuuuucagauuucucuuagaaaauuugauguuaaaucuuuugaugcucauuucuuuauucuugagaacuucauaaucuaugcaaugaaauaugauuacaucuacccuuuuucccccccuccaacuccuuccauauuaccucuaacauuccaaauuucauauccuguccucuuuacccacuuuuuuuguuggcauggaagaccuacugccucugccucccagauacuggaauuaaaggaguguacacuuagcucuuguuuuguuuugauuauccacuaagucuauguaauuuugcccaaauaugcauggauguagagccauccacuggauaaugggaaacuuaacacuggucacauccugaugcacauuuaaaaaaaaaaaagauuuuuccccccauuucucccucuuuucuguccuguagacagggucuuguuacguaaccuggucugcucuugaaguugagaucuuccuucccugccucugaguggugacauuacaaagauguaauaauucacguagccuuuaaauugaguuuuauuuauuuaucuacauuuuauuugagggugaaguauguaugugugcuauucuguuuauauggaggucagaggccgauaugcaggaagaguuucucucaucacauggauccuccagaucaaauugaaguguucaggcuuggaagcagaugccuuacccauuaaacuaucuuauuuguuagucuuugaauuaacuuuuauacaggagaaauaugggguggggaggagguaugggauguggagcagucggaggguguaugggagggauggggaaugauauggaguguaaaaaaauaaaauuuuuaaaaaaugaaaaaaaaaugaauaaaaauuucagauacacuuuuuuuuuuaaacaucaaaguuucuaagagaaaucugguagaauuucucauaaucccgcaacucauauuuuauaucuuuguaaaaccuucauuauguggaugacacuaaaaacuucauuuugugcaaaauuuccuguuugggccugcuuauccuuggcuguaguaccuggacaccagucauggguaaucaauucuuggggaaacaguuuuguagaaggcucuguuugaauaaucucuucuauaugugugagccuucaguguccuggaaguuagccaguuccugcaaugccuuuuaucaccauggaauccacuuggugccaaauaguucuuugcuuuaacuugaaaugugaucuuuuuuugccugaauuacaaguuuaucaaaucugucuguucugauuuuuuuuuuuuuuuuggugcuaauucucacugugaguaugagaaaaaaauaggcaacaguauccaucagcaaccugaauucauguuuuguaauguccucccagauaaguuagucuguggucuuuaagcucagcuuuaugaaaaguuucuggggaugaacaaaaaauagaagaguuauuuuucuagaauguaagaaaaauuaucaaacccaguuuccaguagagguccccauuuccaugggaaacuuuauucuacauucugacuuugugagucccacuaaaauccccaaguaagccauguuucagcauucuaacacaguaauugauauagauaggaaaguuauuccuuauucaugugugagaaaauaagaaacaaaaaaugaguaucuacuuuaaggauugaggaaucagagauuauuuccuuuuugaaagauaauugaccccaaagaacauaugauuuugguuuuuauuuuccuuugagcuguacaguauuucugcacaguguaacuuuuaauaccaagugacuugggcuuauuucucggccuaacuguaaaaugugacuccacaucuauaaaauaggaaccucaguucuuuagcuuguuacaagagucugauuuuucuuggguacgguggcacauaccuuuaaucccagcacucaggagaguggaucccugggaguucauagccaaccuggucuacauuuuaaguuccaggccagccaaggcuacauaguaagccucacucccaucccucucuucucccaccccugccaaaaaagggaaagaaucugauuagaugcuguagguaaaaacuuuucauuaauuguauaguauauuaauauuaugccuuauaaaagacuguaucuuucacauuauuuguucaauucagcuuuccacaggcuacaaaccaaacauuacuugacaaguuuaaacaucaacaugaagagaauucuuacauugaauuuccugcugugauggagccugcuuuuaucauaaaacauuaugcuggaaaaguaaaauauggaguaaaggucaguaaguuucuuauugaauauggcuuuagagcagagguauguauuuuaaaauauagaacacuuuuuauucuuugacaguucuaugcauguaaacauuguuuucugaucauaacuacacucccaauucuucccccagauguaucauuacuauuucuggcauguuacccuuucuuauaguuuuuggaggcucuggauuaguugccuuugaagacauuuuguaagguuagaacuagaaucaagaucuacuuuucaguauauuaccauuuagauaauguuucugcugguuuccuucuauagauaaaccuauuagguuguuuuagugaacuuuuaaaaccuagaacagauagugucugugugucucaaacucauuguucauccucauaauucauuuguuuuucuuuaaugauacucauaagggucuuuuagaagcuucuguucugagcaccaauagguaguugugagcuuucauucuuacuagguauaguaaguaacucuugcaugagauggcuaacucuuaaaucuugggaagcuuaaacuugccacuuaugauacuuaguuuccuuguaaugcaguaauaaaaugauauaaaucaaugacucauugaguuuuguuuuguuuuucuguuuuugagacaguuucauguacuuaggcucaaauucucuguguagcagaggauguccuugaacuccuaauuuugccucuuauccuaagaggcuaggauuauugagcugugucacuguguccagcuuugguagacauccuaauuaauuauuuaagcauuuacugauucaucuuuuaaagaauuauuuauuaaccagcguaugucaguuuccuguccaguauuugcuauuauauagugauaagauagacagacagauuuguaaguauauguaucauauacauagcauauaucauauuuauuucuagugauguuguauaaauuuuucugugaguuaaaguauugaaguaauuaccucuuuguaaauuuacaaggauuucucuaaaacucuuaagaguugaacuaaaguaaagguuauacuggugaguugagauagugaguuauaggcuauaaaaugagaaaggaguuacauauguugaaauaguguauaaaaggucacugagaugagacuuuuaaggacaagugagauauuuuugugaauuccaagagcagacauuagguuaaaucuugaagggcuucuaggccacauuaaaggagcuuagguguuuuguuuuuaaugaaauucaggagucccuguacaacgcauacuguuaguaacaguccugugucagccuuauuagcaaccucccugcuggaguauaguuuuuuuuguuguugaaauuauuauaggaacugugaaacuauuaaagcagauuuguguuuucaaggacagcagagagggugagacuggauucuuagaauuuauuaauucucccucuuuaucuccuuccccuuuuaaauugaggugaaauauuaaauugaaccauaagaguagcaguagaaauggggaaaaccuuauauaagguauaguguugagaucuccauauacuuuauagaaguuguaaaugaauauuuuuuucuuucuuucuuuuuuuuugguuuugguuuugguuuuuugagacaggguuucucuguguaguccuggcuguccuggaacucacucuguagaccaggcuggccucgaaaucagaaauccaccugccucugccucccaccacugcccgggguaaaugaauauuuuauggugggaaguaauugaaucucuuugagaugucauaucugagauggaauacacaggugagaagcagauuuuagauauaauuuauaaaguuaaacaaagcagaaaucuugauccuguuguuaaaugauuuuguaguuacuuuuccagugugguaguaaaacaacaugaucaaggcacuuuguagaagaaaaaguuuauuuagcuuaccauuccagaaggguaagagaguccaucaugguagggaagcagcaggcaugguggcugaaggugaaacugaguugcucauguuuuuaacugcaagcacaaagcagagaguuggaacaagaaauggugugagucuuuaaacucacaaccugauuacugcuggcuugcuucagcaagaccauaccuggugaaccuacccagacagcaucaccaagugggagccaaauaugcccaagauuugcagggacauuuaucauauaguauacacacaccuguuucucugauguuuaaguauguuauugaguagauugaaacuaaaaaaggugauuaaaaggugaaauuauauacucacuaaagaagcuagagcuauuccuggagauaaaaagggauauuucacaauaagaaaagugucuaguugauaaaacguuaaucaaaaguuauuuauagcugggcguggugacgcacccuuuaaucccagcacuuaggaggcagaggcaggcggauuucugaguucgaggccagccuagucuacaaagugaguucuaggacagccagcgcuauacagagaaacccugucucaaaaaacaaaaacaaaaaaaguuauuuauacccaguaauuuugauucagauguuuaaacuugucagguaauguuugguuuguagccuguggaaagcugaauugaacaaauuaugugaaagauacagucuuuuauaagguacuuggcccagguagcucagaauagaauucaguucuauaaucucuauucacccccaccauucaaaccuacuaucuucuugauuuuaauaguccuuuucagaaauaacauugguacuuuuuucauaggauuuucgggaaaaaaauacagaucauaugcguccagacauuguggcucuucugagaaguagcaggaaugcuuuuguuucugggaugacuggcauugauccuguagcuguuuuccgaugggcaguucuucgagcauuuuucagagcugugguugcuuucagggaagcugggaaaagacauauucagagaaaaagugguaagccauucuugcuaguauucuuccaugauaauacuuuuuauuuuuuccuguuuacuuaccauaaucuguaauuauguuucauagcugauaaaucacauaccuuuaagugauuaaauguauguuucuguauguaugcaggccuauguugcuauauuuuuauuaauagauauugauaggaauaaugagcgucuuaggguuacuguugugugaagaaacaccaugaugaaggcugguuauaaaggggagcauuuaauuggggucauguuuacaguuuuggagcauuaguccauggccauuaugguguaggcaagcauggugccuagagcaauauuuaagugcucacaucugaucugaaaggugcaggcagacagugaaacugagaguuuuucaaaccucaaaagcccagcuccagugacaccucuuccaagaggucauaccuacuaauucuucucaaacaaucucaccuacuauagaccaaguauucaaauauaugagcauacaggggcuacucucauuaaaaucaucacagugaauguaaggcauauaguaguuaugaacaaaaaugcaagcugauaaucauaugaugauucagaauuugauuuuaauguuuucuccauuuuuccaucucuauguuuuuuucuacaaauucaaucaugauuuaauauaaaaaagcaaauuaggaaacaaacagggucaggcaguauaauaugguagacuuuucugcuccagucaccuuuucuauugaccaguuuuguaaguaagaacauuuuuucuuuccuaguaaagaauuauuuguuuaguaagguuuuuguuuuguuuuucuuaaccuguuaacuugguuuauugaguuuuuaguuugaauuuuauaaaugauuuuuuuuuucuggguccuuccuuuuucuuuaagccugagacacuccauuuuauauuguacaugaagucaaguucauaggcacauguggccauuuggaauguauauaguuaaaaucuucuaacuuauauguaguugagacaugccuuucaguaggauuauacgagugcuuccuuguucuucuguguuuccaaacuaacuuguauguuguaggaguaaacaaacuuucaaagucagcuuuuaaauuucaguucugauuuuucaccugggauguugucagucacucuucaacuuccaggccaguuuagucuacauagugaguuccaggacagccagggguauuuagagggacucugucuuaaagacaaaacaaaacaacccaaagacaaaaucaaaaaauaguccuaggaauccuaaguuuacuugauuauuaguagacucucccacugucuuaguuaguguucuagugcugugaagagacaccaugaccacaacaacucuuauaaauaaaagaaacccuuuaauugggguuggcuuuagagguuuaguucauuguuguuauggcuggaaucgugguaguaagcaggcagacauagugcugggaagguagcugagaguucuacauccagaugggcagggacagagaaacacugggugggccuaccuugagcauuugaaacugcgaagccccgccaccgccccacacacauacuuccucuaacaaagccacaugugcuccuacaacccugucaaguagcccuauucccuaaugaccaagcauucaaacauacacaccuauggggacuauuccuguccaaacuaaccacacccucuuuggaaauaugaaagggaguucuugugguugaaaugguaagaugguaguaauggccugaagagguaacucaguaguuaagugcacuugcugcuuuucuagaggacccgauuucauuucccagcauccauguuagguggcucacaaccacuggcaacuccagcucuagggggaaaucaaauguccucuucuggaagaguugcacucaagugugcgcauauacacagaaauacauauacauauacauaaauacaguuuuaaaaagggauaguagaaacauuagggaagaaauaaagagcaccauuauacuuaacuacaaaauauagaauaaacauaacuuuuacauuuucuagcacucuaauuugagagacagcugcuuaaagcaacaacucuaauucuauguggauggucauacugcuuaaaagauauuacuuguuuaauaguaaccguguaaagaacgugauaugggcaacuuucgaagcaauugaaaugguuuuuuaacuuagacuagauauaaauuacuauguuaauucuaauuuucacaucaacugcuaacuuuuaaaaacauuugauauaagagggcagugauggcgggcgugguggugcaugccuuuaaucucagcacuuggaaggcagaggcagguagauuucugaauucgaggccagucuggucuacagagugaguuccaggacagccagggcuacacagagaagaccugucucaaaaaaucccccccccccaaaaaaaaaggguagugaugaaaggaaagaaaacuaaaaaugucuuaauauguagaaagcaaauaaaacauccuuccaaggaguucaagaaagaaaucacaagaaaagguagaagauaauauugagcuggagauaagaaggaacaaacacagucuguacuaaucccugcuuggucaguuuauguccuuucauuuuguuuuugggccagaggaauguggaaguuuugccugaaaaugauuauugguuacauaagucaggauauagguguuuuaugcacuacuaggagaaaaccaagcaguaugucacaguguaugaaagauagcucaaaaagggcuuauagaaagguuuauagcuuucaaaacaccugcauuauaaauuaaaaugucaagcaauuaacccaguauucuacuguuucuaaggaggcuuagauaaaaggauaaacacaaccuaagcagggcauuguaaacuagacuggauauaaaugaguacggaguaaaaaacaagcaaacccagaaaaauauagcaaacaauauaacaguauuauugauugaguggauuauuaguucacacaguauccucuuucucuacuccccaaacuuguccacucuaccugaauguccaugugcaggcuagucugauaccuagccauuggggguaaauuacaguaauaaugaagauugaguauuuucuauuaaagugucuugugacaaugaagugacauuaagcugacuuuuuauaaauauucaaauauuucuaauuauuaauuuucaucuuugcuaaaugauccauuuaaaaagaaguugcuuuuuuacuaucagcuaguuaaaaugauugcaauggauuuuuuaagucugcaauuuuuauguacuaccugauuaauuauaagaugauauuuucucugcuaaaugauuuuuuaacauaacauuuuaguuuuuaucaauuugauaaaauuuuugaagcauauuuccucuuuuuaaaaaggaugcuacauuuauguacuaucugaugauuaauaagauuguguuuuucgaugauaaauguagguaauauauucuaaauucagaaaucuagguuauauaauuucaauaagauaaaaaaauacucuguaggaguuuuggaauuaguguuucuuugagcuuuaaaaugacuaucuugagaacuauuuauaacauaugacauugagccccauuccuaaguguacaguaaauuguacuuauagagaucaguuacuaugcaucacuucauugcuccuagauuauauaguugucauucuuuuuuuuuuuuuuuuuuuuuuuaaagauuuauuuauuuauuauauguaaguacacuguagcugucuucagacacuccagaagagggcaucagaucucauuacgggugguugugagccaccaugugguugcugggauuugaacuucggaccuucggaagagcagucgggugcucuuacccacugagccaucucaccagcccauauaguugucauucuuagaagcaaaauuguuaaauguaaccauuccuccauaagucuuuuuuuaauuuucuuuaauaaauuuuuaauucuuuauaucauacuguguauuauaaagacauuuucaaccccucccccccccacacacacacacauacacacacacuauuuuuccugcggaacucuuaagguaaucucuugaacucaagaauucaucuuuucugaaauauggaaacucugucuucuaucuuaaaucaauuucuugcugauauuuauguuauuguaauugccccucccccaugccuuacugcucaaaugacucacuugguuagcauucaucugagugcuuuggucuuuauucuugucucuucuuuuuccugcuuguaauucacuuuaucuccuuuuccaguagugagguauggguucuucagcaauuuuucagauuuauaaaugcauagugcugcucaggcucccucucuguggugugcuacuacuuauucuuagcacacacucggcagacauugacaaaacacaugugccugauugucagauuuguaaaagacaggguacccuuucucauaauuuuuuggguauaauuucucucagauucuaucaauguugccaacuauaugcuaaaaauauuucagaaagaaauaauuuuccaagaacaaccauaugauacuaauuguuugaaauguuccuuauacuuuaaucuagaaauuuuaauauggcauuaacucagaauacuuugauuaauaaaauagacauuuggcauauuugaaaagaauauuuuuucuuauuauuuguuaguuggggagaguuauucacaugguuuaauauuuuaaaauauaucaagauaguuggcaucauugucuuugauuuuucuuguugguuugggcuuacauaaugucuuuuucuuuuuuccauuuuuuauuuuguuuugcuucuuaaggacaugaugauacaacaccaugugcgauuuugaaaaguauggauaguuuuagcuuucuccaacacccaguccaccagaggagcuuagagauucugcagaggugcaaggaagagaaguacaguaaggcuuuaaguccucuuaacccuguauugucacaucuauuuggaaauggaaaucaagaguauucaugagggaugcauggagauugcauaggaacaugccuuucacaauucuuuaugcagacuguauugcuuucucuugaaauugcugaaccuguucuuugaugugggugauuuugacugucccauuugcuaugcaccacauuguuaauuauuuaggcuaccauugaauugguuuccaaauucaucuuggaaguaucugauuaauuacauaaaaauaagcaguaauuuuauucuugcuuuuggaaacuuuuagugaaauguaauuaaaguaaaauacgagaacaauuugguaaguuuuauauauauagaaacucaugaaauuaacacagugauuaugauauucaacacuccccaaagcuuccucauaucuggcuaaauuuuguacuugauuauguuugauuucuacaucagcaauguuacaauuuugaaucucuagaggauucauuuaaguugaauauaaaccuugacucagacuuucuaugucuaagagaaauaccagaauuucagcauaaaaaauaucauucagaauacauaucuguuuauuguuuaaaauugauauaaaagaugcacuuggucuccauuucuuccuuggcuuuauguuagucugcaugaaauagguccuuuggucugcugugugguuacaauaauuggguguacuccuauugugauaaaaaaugaguuuuuuagaaaauuaagucauuuguuuauagugggucaaauuuacucaagaucugcauuguacauuuaauaaauugcaauacauuuaggucacuacuuuuauuagaguuuucuaacugaaacuccauaauauuugacuuaauaaaacaacaauuuaaguggaauuugcuuaaaaauaaaugcaguguguucuuuuucacucuaaugguauaagaaaauguguaauguauguauauuuccuugucggaagaauaaagguaagucauuuuuaaaagcugucuuuagaguuuauccuuaguuauuaaaauuauuucuaaagauacacaguccucauucugauuauucauuuugauauucuuaaucuuucaaaacagucuacaaaucauuugagaacagcuuaaaagagcuuaaaucuaaaguaguuauauguaguucaguugcuuuauuuguuucuucaugauugagcuugguaacugcagacuggaccauauuguaguuuaugggucugguuacagcauacgcugcaugaggaaguuaaacuggcaauucccuguauauugaugccuucauuuauuuuauauauguauuccauuuuccacugcagauauauucaggugcugcuuuuuguuuuguuuuguuuuguuuuguuuuuguuuguuuucuuauuuuauuuuuaauuuauuuuuuacacuccauauuccauaccuuaucucccauccaccgacugcuccacaucccacaccuccaucccaccacacucuguuuccaugugaaugucccuccccacccccaccuaaccucuaaacucucuagggccucuagacccuugagaguuagaugcaucauuucugaaugaacacagacccagaaguucucuauuguauguguguugggggccucauaucagcugguguaugcugucuguuuggugguccaguguuugaaagauaucagaguuccagauuaagacugcugguccuucuacagaaucacccucuucuccucagcuucuuucagccuucccuaauucaaccacaggggucagcugcuucugucaauugguugggugcaaauaacugcauuugacucuuucagcugcuuguugggucuucuggagugcagucaugauagauuuugggaguucuccauagccucaguaguaguguuaggccuugggaccuccccuugagcucaaucccacuuugggccugucacuggaccuucuuuuccucagacuccucuccauuuccaucccuguaauucuuccagacaagaacaauuagggaucagaguugagacugugggauggcaacccuaucccugacuugauguccugucuuccugcuggaggugggcucuauaaguucccucucccuauugucuggcauuucaucuaagucauuuugaguccugggaguuuuucgccucccaggucucugaugcauucuggaggguccuccaaacuccuuccuguguuugccuguuuacauucuuucugcuggcccucagggcuucaguccuuuuuucuccucacccaauaccagaucagguuuccccucucccccauuuaucccguaccccauccacuuucccucccuggucccucccucccucccuuccucuccccccacuugugauugcuuucuuuucucucccaagugggacugaguugucuucauuuggacacuucagcuuguugagcuuuuugaguucuguggaauguaucuuggguagucuguauuuuuauuuuuuauuuagcuaaaauccacuuauuagugaguacauaccacgcaugucccuuugggucugaguuaccucacucaggaugauauuuucuaguuccauccauuugccugcaaaacucaggauguccucauucuuaauagcugaguaguacuccauuguguaaaugaaccacauuuucuguauccauucuucuuucgugggacaucuagguuguuuccagcuucuggcuaucaugaauaaggcuauuaugaauauaguggaagacuugccccuguggcauggugggacaucuuuuggguauauucccaagagugguguagcugggucuucagguagaucuacuuccaauucucugaggaaccuccagauugacuuccagagugguuguaccaguuugcaaucccaccagcaauggaggaguguuccucuuucuccacauccuccccaacauguguugucaccugagguuuugaucuuagacauuuggauugguguaagguggaaucucagagucguuuugauuugcauuucucugaucacuaaggacuuuggauauuucuuuaagugcuucuccaccaugcgauauuccucaguugugaauucuugguuaaguucuauaccccauuuuuugauuggguuguuugauuuuuuuggugauuaacuucuugaguucuuuaucuauuuuggauauuagccucugucagaugugggguuagugaagauuuuuuucccaaucuguagguugcugauuugucuuaucgacuauguccuuugccuuacagaagcuuuccaguuucaugaagucccauuuaucaauucuugaucuuagagcaugagccauuggaguucuauuuaugaaauuuccccuccaugccaaggaguucaaggcucuuucccacuaucucuucuauuagauucaguguaucugguuuuauguugagguccuugauccacuaugacuugagcuuuguacaaggugacaaauaugggucuauuuucauucuucuacauacagacagucaguuagaccagcaauauuuauugaagaugcuuuuuuuuuuccauuguauauuuuuggcgucuuugucaaagaucaagugaccauaaacguaugguuuuauuucugggucuucuauucaauugaucaacaugucugucucuguaccaauaccaugcaguuuuuuaucacuguugcucuguaauaaagcuugagguuaaggaugugauuccucuagcuguuuuuauuguuaagaguuguuuuuguuauucugggauuuuugccuuuccagaugaauuugagaauuucucuuuccguguccuugaagaauuauguuaggcuuuugauggggacugcauugaauuuauagauugccuuugguaggauggccguuuuuacuuuguuaauucugccaauccaugagcaugggagaucucuccauuuucucgauuucuuucuugagagaauugaaguuauugucauacaggucuuuucacuuguuugguuagaguuacccaagauacuuuauauuauuuguggcuauugugaagggaguuguuucccaaauuuuucacucagccuguucauuauuuguauaaaggaaaguuacugauuuauuugaguuaauuuuucuuauuuauuuauuuauuuauuuauuuauuuauuuauuuauuuauugagacaggguuucuuuguguaguacuggcugucuuggaacucacuuuguagaccaggcuggccuugaacucagaaacccaccugccucugccuccuacgugcugggauuaaaggcauacaucaucacuguccggcaguugaguuaauuuuccacuuugcugaaguuguucaucagcauuuugcuguauauaagacucaauaucaaagacagauacuaucucagaguaaaaggauggaaaaaggucucccaagcaaauggucccaggaaacaagcaggaguugccauccuaauauccaauaaaauagacuuucaaccacaaguuaucaagcaugaugaagaaggacacuucauauucaucaaggagaaaauacaccaagagaaagucucaguucugaacaucuaugccccaaaugcaugagcacccaaauucauaaaagaaacuuuacuaaaguucaaaacacacauugaaccccacacaauauuagugggauauuucaacccccccccucucaccaaucgauagccaugaaaacagaaacuaaacaaagacacagugaaacuaagagaaguuaugaaccaaaucgauucaguagauaucuacagaacauuucacccuaaaacaaaugaaugcaccuucuugucaauaccucuuggaaccuucuccaaaaucgaccauauaauuggucacaaaacaacccucaacagauacaaaaggauggaaauaauaccaugcaucguaucagaucaccauggcccaagacuggucuucaauaacagccaaaacuacagaaagcccacauauacuuggaaacugaaaaacucuuuacucaaugauaaauuggucagggaagaaauaaagaauuuaaaagacuuccuggaauuuaaugaaaaggcugacgcaucauacccaaacuuaugggacacaaugaaagcagugcuuagagaaaacuucauaccaagugcccugguaaagaaacuggagagaucuuacacuaacaacuuaacaguacaccugagagcucuagaagaaaaagaagcaaacucacccaaaaggaguauaaggcaggaaauagucaaacucagggcugaaaucaaccaaauagaaucaaagaaaacaauacaaagaaucugcaaacccaaaagcugguucuuugagagaaucaacaagauagauaagccccuauccaaacuaacuaaagggucaagaggcaguauccaaauuaauaaaaucagaaaugaaaagggagacauaacaacagaaauggaggaaauuaaaaaaaaaaucaucagauuccacuauaaaaaccuauacucaacaaaaugggaaaacucuagaugaaauggaugguuuucuagacagaugccacaaacuaaaguuaaauuaagagcauguaaacuaucuaaacaggcccauaucacacaaggaaauagaagaagucauuagaaaccucccaaccaaaaagagcacagggccagauggauuuagugcagaauucuaccaaacugucaaagaagauuggauaccaauuuuccucaaacuauuccauaaaauagaaacagaaggaacacuaccuaacuuguucuaugaagccacgauuacucugauaccuaaaccacacaaggacccaaccaaaaaaagagaacuucagaccauucuugcuuaugaauaucgaugcaagaauacucaauaaaauucuugcaaacugaaucuaagaacacaucaaaaccaccauucaccauaaucaaguagguuucaucccaggggugcaagguugguuuaauauaugaaaauccauuaauauaaucuaguauaaaaacaaacuaaaaaaaaaaucacaugaucaucuccuuagaugcagaaaaagcauuugacaaaauacaacacaccuucaugcaaaaauauuggagagaucaggaauucaagggccauaccuaaacacaauaaaaucuauuuacugcaaacuaauagccaauaucaaauuaaaugaagauauacuugaagcaaucccacugaaauugggacaagacaaggaugcccacucuccccauaucucuucaauauaguccuugaaauguuagcgagaacaauaagagaacaaaaagagaucaaggggauacaaauugguaaagaagaaauaaagguaucacuauuugcagaugauauaauaguauacauaaguaaccucaaaaauucuaccagagaacuucuccggcugauaaacaccuacagcauauagacccuuaaaaaggaaaaggaagcacaugauguugagagcuaaauaucagugauauagaaugcaaauaacaggggcuggugagauggcucaguggguaagagcacccgacugcucuuccgaagguccagaguucaaaucccagcaaccacaugguggcucacaaccauccgcaacaagaucugacucccucuucuggagugucugaggacagcuacagcuacaguguacuuacauauauuaauaaaauaaaucuuuaaaaaaaaagaaugcaaauaacaaucuguaauauguuuguuuauaccuuugcuuuaaauaaggcaccauacuauaagauaaacaugaagcauuaacaacacguacuuuaagguuaggaaacaagaagaggcuggaguuccagaaccaccuuuguauauucacuauuaauauuccaaguucauaugaccagcccaacuauuuuaaaaaauucuaccaccaugacaaacagagucaaacuucuaacuuagggggacaguggagauccaaaacauguuaacaaucaaguuaacucacuuuguuaacuuuguauaaaagaaaaagauugccaaauucugaaccuguuucuuuuaagacuuggcaacuaagugcccccaguuucuaaaguuuuguaugaaaaaucuuagaguuucuucaaauacuuagaauuaagguaaagauauuccauauacccaccuugauacaacaacagagauagaaaaggaacugaaagugaggacuuauuuaaucuauuaaaaugguaaaaagcuaaaaaaagaugguuuagaauuaaaacgugaacucaguaaucuuguaggguaccuaauacauauacagaauuuauuuuuaacccugaauacuuggaaaaugaaguuuauaaaugccugugaggcagccaguccucucccauauuuuacaagaaugggucugugugacaaaagaacuuggcaggugugucaaucuaauauuagaaaagauuaccauucccaucuuuggaaugccuuuaauugguagcuuuuacaucucuguuagagaagccacuguuuauguugugaguagcuccauucaguguuucaacagagucuucagucaauagguaauaaggaaauggguuuccuuagcaacuugacuggaugaccugagagugaaucuuccuucauucuagucccaggaggauugcaaucuuguuuggcagcuugaguacaaucuaauuagagacccugacuuagaaugaccugauaagcaccuccuaauucucugucuuuuggauagugguauauaugagccugguagcagacuuaaaaucucaucuuccuguggagaguggcccagugguaggccucuuguauagcauacccaaagcccuggauuuaauacacgguauugcaaaaagggagggaaaugaaaggaagggaacagaggaggaaaggaaaucugugaaccaaauaagaaguacaaaaauagauucauguaaacauaguaugguguugagauaguuuaguggaaugaaggauuagcucaacaaacuaauggcauugaacaccuuguuauuuuucuguuaaaggagaacucucuugccaugaaaaguuaccuugaaaugagucaugcugauuuaaggauuaaagccauuaaauuuguaagaaaauuuaagaaaaaaaaaacaggcaaagauuuuuuuuaggauuuauaaucaacuaaaaguagaagaaagugauguuagaguucccuaaauugaaaacuuaaugcuuuucaaauaauauuaagagaauaaugguuggcuguaaguaucugcaucugucucagucaccugcugguagagacugucaaaggacagccauccuaaacuucuguuugcaaacacaacacagcaucaguaauaguguuaggguuugaugacugccuguggaauggaucccaaguuggacuggucacugaauggccuuuccuucagucucugcuccauuuuugucccugcauuucuuuuagauaggaacaauucuaggucagaaauuuugaagguggguuggugagccuaugccuccauugggggcucugucuguuggucucuucagauucccucuucccacugcuggaaauuucaguuaaggucacccccauuguauccugggagcucucacaucccaggucucugagacuuucuagagauucuccccugauucuuagaggcuguauauuuccauucauucuccugccuacugggcuucucuccuguuucucccccauaccagauucugcccccuucccccacuucacccaguuccaucccucccucugccuccuguaguuauuuuguuccccuaagugugauugaagcauccucacuugggccuuccuucuuguuaaacuucuuagaguuuguggguuguaucauggguauucuauacuuuugauuaauauccacuuaucagugaguauauaccauguccuuuugggucuggguuaccucauucaggauaauaaccccuauggaaguguugggggaaggauugaaggagcugaagugaaggggauggcaaccccauaggaagaccaacagugucuacuaaccuagaccccugggagcucccagagacuaaaggaaugaccaucuagagacugccccaccuggggauccaucccauauacaguuaccaaacccagacacuauuguggaugcuaacaagugcuugcugacaggagccugauauagcugucuccugagaugcucugccaguaccugacacauacagaaguggaugcuuauagccauccauggaacugagcacaggguccccaaugaaggagccaaagaaaggacccaaagaguugaagggguugguagccucauaggaggaacaauaauacaaacuaaccauuccucaccccugccccccccccccccccaagcucucagggacuaaaccaccaaccaaagaguacacauggugggacucauggcuccagaugcauauguaguagaggauggccuaguuggacauuagugggaggagaggcccuugguccugugaaggcucuaugccccaguguaggggaaugccaggcccaggaagugggagugggucaguuggugagcagggggagggacuaagagaggggacuugggcggggggaccaggaaaggggauaucauuucaaauguaaauagagaaaauauccaauuaaaagggggaaaaacacuuagaaaacaaaacaaacaaaaacaaacaaagagcauacauaggcuggcaugggcuggugugagacucuuggaacauauguagcagcgaacugccuugucaggucucaguuggaaaggaugugccuaauccuguagagacuuguagcccuaggauagaggaugccugggaagggggugcagagaggagggugcccucucagaggcaaaugggagggggaaugggauaaagaauuccaggaaaggggaccaggaaccaaggaacauuaguuucuugaaaauauauuuuauagucaugagcuggguaucauuucacugauuugacccuguuuucuuuuagugauguuuuauaauucucaauguagacaucuuuacuuauuccauuaaguuuauauuauuuugauuuuaugaauggaauuacuagucuuugaucauuuguauagaaauagaguugauuacuccauaucaauuuaauuucuuuuauuuuuacugaauguauuagcuauaaaagguuuuguagauucucuuuaggacugucucugugugauugggccauuuuucauaaagucuucuguaaagaugcuugauuuauuuuucccaauggaucuuaaauguuuauaugcauauauacauuaugaaauugaugaccuuauauuuacugagucuguaagaaaaaucgguuuuaaaauauuauuuuuaauauuucaaauauccauaaggaaaaaacauucuuugguuuucagucuuuauuuguaagauaaauagaucucuaaaguauaugcuacaucucagcaguguauuuguugccaaaaggugauacaaaggggucauguucauuauguuuuggugucaaaauagaugaauuuuauauauauuuagcuuuuggccugcuuacuuuuauauuuccuagugguaaugcuuaaaugaaguaaauaagaauuuucuguugaauuuccuuuuuggcuucacuuaaucaagugcuggugauaguuacagaacuuuucuuaguaucugacauuuaucaaauguuuaaaacuuaguuuauuaauucuauagaauuuuuuucuuuaguauuuugaaagugcacuaauuuguuuccauuaucuauguuuuuuuuuguuuguuuguuuuuuguuguuguuguuagguauaacccgaaaaaacccaagaacaccccuuucugaucuucaaggcaugaacacucuaaaugaaaaaaaucaacaguaaguuugguauauguuuacaaggcaagaugaaauaaauaacuaucucauauuuuuagauauuaguauauagccugguagccugugauuuuucugccucaggcugagugcuaggauuauagauaugugcaacccacucagauuuauguuuuuguauauuugugagaauguguuguguguauguuuguguggguaagggugaauguaucauggcacaugugugaugcucagaagacagccuuggaugucaggucuguguuuuaccuuuuuuguggugacuggaucucuuuuuuguucacuacuguauacaucaggcuauuuggcuuacagguuucuggagguuguucugucuuugccuugugucuuagcauauggguacuggguuuauagauauguuauggcaucuaacuuuuccauuaguugugggguucuuucucagauucuuggacuuaugcaccaaguacagaaugcacugaguugccucuccuguucacagauuuuguuuuaaaauuuuauuuauuuacuuugucuuuguugggauuggaaaaugugcauaggauguguuugaaaauucgaggaaaauguggaggaccaauuucuuuccuucacccauugagaacccagauaucacacuaacauuaucaaucuugacagcaaguaccuuauucuuugggcugucuugcuauucccacccugggauuucuauucuguuugcuucuugguuugugugagacaguguaucauauuguauagucugucuuagagcuugcuauguaagcggagaugaucuugaauuucugauccuccaacucugaaguguugggaauguagaccugaauuacccaacacgaggcuuugauaguuuuucaugucuuugacuuguguauuugccaagacaucuuuuuagagauaguuucuuuugacuuguuuuuucccucugaguaggccaugcuuucugaguauguuguaugugugugaauaugauuucuaauuuguaauguuuguauugguaugcagugagcauuugaacauaauguaguaacuauauaucagaucagucuuccuuugcacaugucaucugcucuucgauuugguuugucuuuuucuucuucuguuguuugcuuguucuuucuuuuucuuuuuguaaaccagaacauuuauuuuauuacugauugaaauccucaagaugaacuggaugcugcaacagcugcucucuuggguuuuggucuugugcccucguggaauacaugucugaaucugcgguagacaaucuuuaggugccucauccgaccagucccgguaguguuucaucucuuagccuuggcacuccaguuauaguuucucuugugcuuggcaggggaaccauacuugccacugguugacuucugaaggugguaggccuuggagccacagcgacagcacagugugugcaacgcucaccaaaggaugacguuccuuuugucaucuugcuucuacuggugaggccaaagagacuggaagagcuuguuuuuucaacuguagacucuuuucugugcccaagaucagcuaaaggaauaccaucaagaacuucucagcucuuucauguuucuuuuccuuagacacauaguuauuuucuaauuuuauauacauaugugaguuauuguuaauaucugaucuucaaaauagaaaaggagaauguugaaggcuggugguagaaauggugauuaccuuuuaaguccacugaaggcauucaagcuugcagcauuguagaacauacaacagcguucacuaugcaguuguuuucuucuugcaugauuaaagcauuuauugccacauaaaucucugauauauggaggagaaaguucuuuuggcccauguuggcuaugagcugguugaaaacuauuccaagaaaagaugcacauaacucucuccuaccucuugugauguaaagguuaaauaacugcuaaauguccagacuuaguuuugguuuagcagagaaaccuuucucuggaaguuacaagcuauuaugguugacuguagccuuggaaauacuacauagggaauucuaaaaauaaaaaaauuccccaauuuaaaauuaugugcaauucuucauuuucugaauguugacucuuaucauuguucuauuuuuuugaauauuuuuuucagguuuuuuuuuugguuuuucgagacaggguuucucuguauagcccuggcuguccuggaacucacucuguagaccaggcuggccucgaacucagaaauccaccugucucugccucccaagugcugggauuaaauuuuucaguuuuucaugacaggguuuucucuguugcuuuggcuguccuagaacuugcucuacagaccagacaggccuugaacuuacagagauccaccugcaucuguuuuccacaugcugagauuaaagguaggggccaccuaugcacuguucuauuuuauuauuaauauugacuauuucuuaccauggcucauuuagaaaugaaacuuaccauaaguauuugucucaguauucauugcuuugaggagacaccaugacuauggcaacucuuauuaaagaaacauuuuaacuguaagcuugcuuacaguuucagaaguuuaguccauuuucaucauugcggagccauggugguaagcaguagacauggugcuggagacauagcguugaguucuacauguggaucuguaggcacaaggaagagaggaagcuucugagccggguuuggguuugaaaccgcuaagccuacucccagugacauacuuccuccuaaucccugucaaguauugucacuccccagugaucaagcauucaaauauuugcaucuaugggggccauucuuauuuaaacagcuauaguauuuauauauaagaagugaauacagacuguggugaacuuggaagauauauuccuugugaaaaaagggagaguccucuauaguuuuauuagaauauguucagccagugaaguugucucaagugaggagacauaucuggugcuucuucccugucaugagaugggaauauuaucccacuccauaacuuuuuuucccaacccaacaccaaggguuggauuuagaaccuuguucaugucaggccagcacucuacacugagcaauauucccaguuccagcccucuuuuugcuguguuuguuuuugguaagaucacacuaaauugcccuagcugauuuucaacucacucacaucauagcccagguagaccuuaaacuugugauccuccugccuuagccucuuaaguaagcaaaauauaggccuuuguuguaaggucuuggcaucacggugauacuuuuuuuuuuuuuuuuuuuuuuuugguuuuccgagacaggguuucucuauguagcccuggcuguccuguagaccaggcuggccucgaacucagaaauccgucugccucugccucccgagugcugggauuaaaggcaugcgccaccacgcccaguuaucacugugauaauuaaugagcugguagucuugcauuugcuuuuaacuucuuaaauuguugcuuuguuaaggcuucuucacuuuaugcuguugaucaaauuuucauuuuuucuuucuugccauuuucuuuuauuuuguuugaaacagaucuugcuguguaguccagacuaaccuggaauucaggcaauaguuucaccuaagcuuccaaaugcuaggauuuauagacguguacaauuauaucuggcuuuugauuaaaauuuuaugguuaaauuuuuacauguuuccuuuuuuaaaauugcuagaaauauaucauuccacaugguuuuggccauguacuuuaucguuuguuucuuuuuaagguguaucuuucugguucccgagccuuuucugugguaauuccacuuuuccaugugcuggacagucuuuacuaaagcauuugggcuccuuugauguccucuuuuaucugauuuucuguuucuuuuugguuuucuuuaucucucucauuucuucaccucuaaggcugcuggcacuggauuaaaaagaucuuggagugaucuguaauugucucucaugcaauauacauuugcuggagcaucaagccaugccagcuuuaaccucaaaugagaguugggaauuguuaucaccacucacuucuuccaucaucacuucaguugaagcugucaucccauuuugcauggauuauucuaacuuaaccagguuuuguccucagccuccaaagcuauauuuucuacaguagucagaugacuguuuuauaagaugaaucauguuaauguuuuacuuaaaauccccauguuuucucucauccauuccaguaaaagccaaaauccuuaggcuaccuaaaaaggcacaauauaucauggccucuuuuucaguguuucucagacucaacagcagcauguccaucuuaggaauuuuguguuuguucucucuuaaccagauaacugcuuaaucuuuuuuauuuuuuucuaauuuccauuuaauuaauauuuuuguggcugucuuuuuauacuaauacuaaggcugacuuugcgcuccucaauguaaccuugccuguaauucaugaaccuccugccucacuuucucaguuuuggaauuacaggccuguaauuguaauugaccuccuuauuuaaggugaaccuuuucuaugagaccuucccuaacuacuauauuuuaaaagcuuauuguauuuucuuuuguuuaguuuuucuccuucaucugguuacuugacccugagcgugguuuccuauaugcuuauuagucuccuuauacuuauuauaaaucucaugaugguaagaauuuuaguuuggcuuuuuaauguuguaugugcagugauagaagaauaauugacauguguuuuaagcuaaugaacgaauauauucuacauguucaaauguuacuaguguacuuuauuuucaagaguuucaaguuuuccuucucaguauuuauaggacucuuuccuuucucuuaagaauauuacuuguacccucuuaccuagauaguuuucuuccuagguuuuuugcuguuuguuuuuguuuuaauucuguuuuuugacacagggucuuuguagcuuucugugugcuggaacucacuauguauaauagccuggcccuaacucccagagaucccucuguccauugcuccagagggcuggaaccacaaugccuggccuccuucaaguuuuuuguuuugaacuggucaacuauucauguuuacgauugacuuguuguccccaacauugagaguaacuggguccaguaggacccaggcacacaggaauuuugcccgaccagaggcacagguuccuucuggucuggucuguugcccugagcagaccuuucgugggaacucugcagccagucccacaauacccagaggaagcuccauucucaggggcucuaacacacccaggaucauaggaucacaggaucacaggagcuugaccaaaccaggaucucagagucccagaggcagcuugacucccaggagcucugacauacccagcaucucaggaucacaggaucccagaaucacagaaccacagagagagcuggauucugaugaaguucagacauaaccaggaucacaggaaggacaggcuccagucagauauaccaaaguuacauagcauuagagauaaccagauagugggaggcaagcguaagaacauaaguaacaaaccaagguuacuuggcaucgucagaacccaauucucccaccauaggaaguccuggauacacuaucacucuggaaaagcaagaucuaaaggaucuaaaaaaucacuucucaugaugaugauagaggauuuuaagaaggacauaaauaacucccuuaaagaaauacaggagaacacagguaaaaagguacaagcccuuaaagaggaaacacaaaaaucccuuaaagaauuacaggaaaacaaagagguaaaggaaaugaacaaucuugaaugcaaaaucuaaaaauggaaauagaaacaauuaagaaaucacuaaaggagacaaccuuggaguuagaaaaccugggaaaaagaucaggagucauagaugcaagcaagcaucaccaacagaauacaagaaaauucaaaaaacaauaaguuccuauaccaaaacauucaggaaaucgaggacacaaugagaagaccauaccuaaggauaauagguauagaagagagugaagauucccaacuuaaagggccaguaaauaucuucaacaaaauuaaagaagaaaucuucccuaaccugaagaagagaugcccaugaacauacaagaagccuacagagcuccaaauagacuggaccagaaaagaaauuccucccgucauauaauauucaaaacaccgaaugcacuaaacaaagaaagaauauuaaaagcaguaagggaaaaaggucaaguaacauguaaaggcagaccuaucagaauuacaccaggcuucucaccagagacuaugaaagccagaagauucugggaagaucucauauagacccuaagagaacacaaaugccagcccaggcuacuauacccaacaaaacucuuaauugccauagauggagaaaacaugauauucaaugacaaaaccaaauuuauacaauauuuuuccauaaauccagcccuucaaaugauaauagauagaaaauaccaacacaaggagagaaacuauauccuagaaaaagcaagaaaguaaucuugcuuuuuagcaagaagauagcuacacaaacauaauuccaccucuaacaacaaaaauaacaagaagugacaaucacuuuuucuuaauaucucuuaauaucaauggacucaauucuccccgcaaaaagacauagacuggauauuaaacaggacccggcauuuugcugcauacaggaaacacacuucaaugacaaagacagauacuaccucagaguaaaugguuggaaaacauuuuuccaagcaaauggucccuagauacaagcuggagaagccauucuaauaucaaauaauaucaacuuuuaaccaaaaguuaucaaaaaagauaaggaagaacacuucauacucauucaccaaaggacaaaucuaccaaggugaacucugaauucugaacaucuaugcuccaaaugcaagggcacccaaauucauuuuuaaaaaaaaaacaacuuuacuaaagcucaaaauacacauugaacuccacauaacuauaguaggagacuucagcuuuccacucucagcaauggacagaucauggaaacagaaacuaaacagggacacagugaaacuaacagaaguuaugaaccaaauggaucuaacagauacuuauagaauauuucauccuaaagcaaaagaauguaccuucucagcaccucaugguaccuucuccauaauuagcaauauaauuggucacaaaacaccucgacagauacaggaagauugaaaugauccuauucauccuaucagaucaccauggacuaaggcuggucuucaauaccaacaaaaccaaggaaaagcacacauauauauggaaucugaacaaugacaacuuggucaaggaagaaauacagaaauuaaagaauuuuuagaauuuaaugaaaaugaaggcacaucauaccaauacuuaugggacacaaugaaagcagugguaagaggaaaacucauagcucuaagugccuucaaaaagaaacuggagaaagcuuacauuagcagcuugauagcacaccugaaagcucuaaaacaaaaagaagcuaauacacccaagaugaguagacagcaggaaauaaacugagggcuaauaucaaccaaauagaaacaaaaagaacuauacaaagaaucaaccaaaccaggagcugguucuuugagaaaaucaacaagauauauaagcccuuagccagacuaaccagagggcacagagacaguauccaaauuaagaaaaucagaaaugaaaagggagacauaacaauguaaaccauagaaauuuaaaaaaaucaucagauccuacaacaaaaucuuauacucaacaagauuggaaaaucuggaugcaauggacaauuuucuagacagauaccaagugccaaaguuaaaacaggaucagauaaaccaucuaaacagucccauaaccuccuaaagaaauagaaguagucauuaauagucucccaaccaaaaaaaaaaaaaaaaaaaaaagcccaggaccagauggauuuaguggagaauucuaucagaccuucaaagaaaaccuaauaccaguacucuuuaaacuguucuacaaaaaaagaaacagaaggaacacuacccaauucauucuaugaagccacaauuacugugcguauuuucccuuggagauggaaugguuuuugucuaaucagaagcuugucacaauuuccuuucauagagaacuucauaagagauuuuuucuacuucuaucauguuuaauguuuugaauagauuuuaaaaacuuguugaguacauauuacuuuuagcuucagaagauaucauguauauuuaagaggcauuuaacuacaauaaauuacuuugaugacuuaaaaauguuaauaaugaguuguauauuuuaaaauaaauauauguauauauauauauguauuuauguguguauguguauauauauguauccuauaggguugcagaccccuuuagcuccuuggguauuuucucuagcuccuacauuaggggcccuguguuacauccaauagaugacugugagcauccacuucuguauuugccagguacuggcauagccuugagagccaugucaggguccuuauccacacuuugguuuuccuucuugaguuucauguguuuugcaaauuguaucuuggauauucuaaguuuccaggcuaauagccgauuaucagugagugcauaucauguguguucuuuugugauuggguuaccuaacucacgaugauauuuuccagaugcauccauuugccuaagaauuucaugauuucauuguuuuaaauugcugaguaguacuccauuguguaaauguaccacauuuucuguauccauuccucaguugagugacauauggguucuuuccagcuucuggcuauuauaaauaaggcugcuaugaacauaguggagcauguguccuuauuacaaguuggaacaucuucuggguauaugcccaggagaggaauugauggaucuucugguaguacuaugucuaauuuucugaggaacugccagacugauuuccagagugguuguaccagcuugcaaucccaccaacaauagaggaguaucccucuuucuccacauccucaccagcaucuguugucacuugaauuuuugaucuuagccauucugacaggugugagguggaaucucaguguuguuuugauuugcauuucccugaugauuaaggauguugaacauuuuuuucaggugcuucucagccauucgguauuccucaguugagaauucuuuguuuaggucugcaccccauuuuuuaaauaggguuauuugauuuucuggaguccaucuucuugaguucuuuacauauauuugauacuaguccccuaucugauuuaggauugguaaagauccuuucccaaucuguugguggccguuuugucuuauugacaguaucuuuugccuuacagaagcuuugcaauuuuaugagguuccauuugucgauucuugaucuuacagcacaagccauugcuguucuguucaggaauuuuucuccugugcccauaucuucgaggcuuucccccacuuucuccacuauaaauuucagugucucugguuuuaauguggaguucuuugauccacuuagacuugagcuuuguagaaggagauaagaauggaucaauuugcauucuucuacaugauaaccaccaguuguugccagcaccauuuguugaaaaugcugucuuuuuuccacuggaugguuuuagcucccuugucaaagaucaaaugaccauagguguguggguucauuucugggucuucaauucuauuccauugaucuaccugucugucacuguaccaguaccaugcaguuuuuaucacaauugcucuguaguacagcuuuaggucaggcauggugauuccaccagagguucuuuuaucauugagaagaguuuuugcuauccuagguuuuuuguuauuccagaugaauuugcaaauuaccuuuucaaauucguugaagaauugaguuggaauuuugauggggauugcauugaaucuguagauugcuuucugcaagauagccauuuuuacuauauugauccugccaauccaugaguaccuccaaaaagaaaguagacagagcauacacuagcagccugauagcauaccuaaaagcucuaguacaaaaggaagcaaauucauccaagaggaguagauggcagaaaaugaucaaacucaggguugaaaucaaccaaguggaaacaaaaagaacuagucaaagaaucaaccacaacaggagcugguucuuugagaaaaucaacaagauagauaaacccuuauccagacuaacuagagggcacagggacaguauccuaauuaacaaaaucagaaaugaaaagggagacauaacaacagaaccugaggaaauccaaaacauccucagauccuaaaacaaaaggcuauucucaacaaaacuggaaaaccuggauguaauggacaaauuucuagacagauaccagguaccaaaguuaaaucagcaucugauuaaugaccuaaacuguuccauauccccuaaagaaauagaagcagucauuaauagucucccaaccaaaaaagcccagggccagauggguuuagugcagaguucuaucagaccuucaaagaaaaccuaauucuaauucuucucaaucuauuccgcaaaauagaaacagaagauacucuacccaauucauucugugaagccacaauuacuuugauaccuaaaccacauaaagacccaacaaagacagagaacuuauuaccaauuccccuuaugaauaucgaugcaaaaauacucaauaaaauucucgcuaaccaaauucaagaacacaucaaaagaaucauccaucaugaucaaguaggcuucauuccagcaaugcaggaaugguuuaauauacggaaauccaucaacguaauccacuauauaaacaaauucagacaaaaaccacaugaucaucucauuagaugcugagaaagcauuugacauccauucuugauaaaagucuuggaaagaucagguauucaaggcccacauuuaaacauaauaaaagcaaaauacagcaaaccaguagccaacaccaaacuaaauggagagagcuggaagcaaucccacuaaaaucagggacuagagaaggcugcccacuuucucccuaccucuucuauacaguacucgaaguccuagccagaguaauuagacaacaaaaggaggucaaggagauacaaauuggaaaggaagaagucaaaauaucacuauucgcagaugauaugagaguauauauaagugauccuaaaaaucccaccagagaacccguaaaccugauaaacagcuucagugaaguaacuggauauaaaauuaacucacacaaaucaguggccuuucuuuacacaaaggauaaacaggcugagaaaggaauuagggaaacaacacccuucacaauaguaacaaauaauauaaaauaccuugggugugacucuaaggaagugaaagaucuguaugauaagaacuugaagucucugaagaaagaaaucaaagaagaacucagaagaugcaaauauuaguuguauuuuuuaauguggagauuuaaauguacuaucuuuaccuggaaagccuuucauuaaaucuuaugcuauaauuacugguaauuuguucauccucugccucuagugcugauaauagcacuaagucuguaguaacagcucaauauguuugauugauguaucaggagcauguguguuuaugaauaagauguuucaaaaagaaauggauauuccguagauucauguauccuauuaguauuauagaucccaaugggaguuuuugaaaguucuggaaaaaaagaaagccauagagucuauuauauacuaaagcacacagauuacauauaacaguauguuaacgauaucaucuauaugauguauucauuuaccuauacauuuguauacgaaugugucugaauccacuaaaacuuuuuucugagugacagggaaguuccacuugauugguagucauuguaauaaaacuauuuuaugcuuguuagcaucuuuuaguguuccauuucaauaauauacuaacuuaagcaaauuauacuaauuuuuuucagugacacauuugauauugccuggaaugucagaacuggcauucgccaaagcagacuaccagcuagcaauacuuccuugcuugauaaagaugggauauucgcucauucagcaagcagcaaacuccuggaaagagcucauggaauucucacgucaguauugguuauuaauagacuuuuaaaaggaccauuuuacuaaauuuucugacugaacaaauaaugagagauuaaguauuauuuucauggguauaauuuugauggaaaaaguaaaaaauguacuucguuuuuaaaacuaugagucuaaugcauuauaucuauuauuacuuuguuuuauuuuucaguuucccuauucacuaguaaaacucagaauugguuaaauguguuaauuucagagaauguuuauuauuauuucuucuagagaaauaaaaaacucagcucuuuuaggauuuccuguccuuuuuacaauuacuauucuucagaucuagcacuuggacaggaaaauccgaugcacauggugagugguagcauguguagugucaucucaugcucaccuuucacuaccugauggaagaacuaguuuggacauggaaauaacuaggcaugauguuccauuaaacuccaauagauuuuaguugauagaauuaacguauuuuaggcauuuucuaagcauuuauuuuaaugugucauaaacuagauuuauaccugaauugguguccugaaucucuauggaaguaauugcuuaguaguaauuuacauaagucuugcucuacucuggcaaugugucuuaacucacuuaauucuuucaacaaugcuaagaaacguguugucucacuuuccucacuuuauagucuaucauaguaaacccaaggguuagaggaauucuccuuugguaugggaaccuauucauggcaggccuuuauaaccucucagccaguguucuaaccauugagcugcauuugcuccuuuucugaacucuuaauaaaaaaaguucauuuuuguuuaugagaaggaaaaaugaauagaaaaaauuuaauuucuaaaaugaaagauguuuuguugaaauguauauuuuuaacuauuaaugaaauuuaggcacaucuuaaaaaucuuaaaaugguagaaauaaaucuugguagguguuggaaaguagaauccuaacuacauauaagaaaucgaaauuucggguucaaaaguacagucccacaucacuaaucuucagguacaacucugcuuacucccaaggugcaaugcugguacucccuccaugucuugucuucucuuacuuuuuucucaguaauaucugcuugauuaagucagauaagguuuuguguagagagcccacauucuccaaaggagggguuuugguguccugagaaggcucuuuuaucacucauuuauaauguagauuuuuaauuuuucuucuucuaaugaauguuugucuuuauaggagaaacaaaaauuuccggucaaaaccuguucuuccaaaggugaguacuauggaaaaacuucuuuuuuuuuucuuucuuuuuuuuuuuuugguuuuucgagacaggguuucucuguguagcccuggcuguccuggaacucacucuguagaccaggcuggccucgaacucagaaauacgccugccucugccucccaagugccgggauuaaagguguguaccaccacacccggcuuggaaaaacuuuuuuuauuugcuuguugaguaaguauuuuuuuaauauuugugucaccaauguuuauaaaucaaggauaagaaaaaccuuauuuacuuccaaaauagagacuauauguacuuuguugacuacauuuuauucauuuauuuuuaaaagauuucuuuauuauuauaucuaaguacacuguagcugucuucagacacccagaagagaucaucagaucucuuaaggaugguugugagccaccaugugguugcugggauuugaacucaggaccuuugggagagcagucaguacucuuaacugcuaagccaucucuccaaccaguugauuccauuuuaaaaguaacaaagucuuuuaggaaauggacaagccuaauaguucagguagauaauuacuugugacaaauaccauccuuuaguuucuauaaaagcucugaauaugcaaguucuguuuuauaauugguacuuuaauuuuucuugagccagcuuaaagugaaaaucugaauucugagaacauuucuaauuagucauuauauaacucucauuuauuacagauauuacacaguauuacuauaaagaguuaaauagucuguuguaaauacuuaggucugcuguuguaguauaaacacaacuuuagauaauaugaaacugaacaaguauguccauaugcugauaaaacuuuucuuaugaaaauuacaguuaugaaguaguaacaaaaauaauuuuaugggugaggucacuagaacaugaggaacugaauuaaagggucauagcauuaggaagguugagaggcauuccucuagaccauggggagaggcuuuaagcagguauuuaagggauccauuuuuuauugcauuuccuuuccaaaauaagagauauagaagaaguagaagucuagcaauucaauagagagauucaugagaaacaagaucaaggagaagaaaugacaaagacugaaaauggcccgagggacuuaagggacaccaucaaauggacgaaucugcauauuauuaauguaucugaagacagaaagaaagggacagaaaauuauuucaagaaauaauggcaggaaaguucccaagucuagggaaguaaauaagaauccagagccaaggcaguaaauaauauaaaucuagagagaccuauacaagacauauuauaaucaaaguaguaagauaaaaacgcuguaucuuuuuguauauaugucccauaacccccuuacuuaacaauccugccuuucaaaauggaaccaaauuguuucagacaaaagcugagagaguuuagaacaugauacauguccuuuguuagaaauacuauaagcaguucuucaagcugcauacaaauggugcuaauuaguaauaugaaaacauaaaaguauaaaacugaaugguagggaccaaaaaccauuugguaccuaggugauaacacacugaaggcuauguauuuuguagcuaggcacuucuuaucaaauggggaaaagauaggguuaugauacaugucuuaggguguuacugcugugaacagauaccaaugcaacucuuaaaaggacaacauuuaauuggggcuagcuuacagguucagggguucaguccaguaucaucaagguggaagcauggaggcauccaggcaggcauggugguagaggagcugagaguuuuacaucuucauuugaaggcagcuaggagaagacuggcuuccaggcagcuaggaugagggucuuaagcccacgcccacagugacacacccacuccaacaaggccacaccuccuaauagugccacucccuagggcaagcauauacaaaccaucauaacacagaugccuauuuaugccacuucuaguaaguuaaugucaaaagucugugccagagaaauuaggcaaucuucuuuauaaaaaaaccccaaaaguuacuuaacuuguaauggaagcagugaaauagucucuguuaacuugugacauguuauuaaagcgaucucuaaagauccucuaaauaacuguuagaaauaauuucugaauucaguaaaguuugagaacagauauaauguaaaaaagucaugcuuuaauagacuaccucuacuaucugaagaaauuauaaaagcaauucuguuuauaauagcaccauaaaauagaauacuuaauaguaaaauuaaucauggaagugaaagaucugucuauagaaaauuguaaaauauugaugagacgaauuaaauacaacacgaagaauggaaagugagcuuuauaauuuauggcuuagaaaaaaauacgaagauaaucucuagcaccuauugggacugacagauuuuuauaugggaugcagucccuauaauuuucaugucauuuuacacagaagugggaaaaaauaguuuuaacauaaauacacaaaguuccucaauagugaaagcaauguugaauaaaaagaaugaagcuugagaugucaugcugucuguugcuacuuaaagagccuuaguaaucaaaugaacuaaaaagcuguaguaaucaaaauuggguuaaauaccauuuuaaaacaaugacagacuugaaaggugagucauugaguaaaaguacuuguugcauaaccccaaggcccugaguuuaaaucccaagaaaucacauaugauuguuauaauaaguagcaugcaucuauauauauuucuaauguuuauauagcaagaugggaauuagagacaagaauucccagaagcucaugaucugucuggcauauguaguagcagaauaaggaacuguuucaaacaaggugaauguugaaggguaugccagaacccagaucucaaaaguaaacaccuuugcuaaaauuaaauggcuuugccuuuuauacuucauguagauggugucucaucccauugaugaguggugagcuucacacaugauuaaucaacacagaggaaaagcgguagagccuaucagucuaagcacuucgaugaaaaaacauuuuucacaauuggaaagaauuaaagcugucugaugauauuuuuuauguauuacacauacacuuauauaauguuuuucccuugucuuuagcauuugcuggagguaaauucuuugaagcaucugacaagacugacccuucaggaucgaauuaccaaaucucuucuucauuugcacaagaagaagaaaccucccaguaucagcgcucaguuucagguuauuaccuauucuacugaugccaaauaaaaucuguuucuuuuuuuucuugauuguugaagaaucaaagugaauuauaagaucauugaugugauauguuucauaugcguaagaagccauaguauugagugcuuuuaugagaaagggaguuagauuguauuuccaagaaucaaagguuuuucuuuaauaaaauagaaaguggaguuagaaagguuuaacccaaaggaaguagacagaagaaaaaacauaaauagaauucugugaagcuaugaacagaagaggggcuggagagauggcuuagcagugcuugcagaggauucaaguuggguucuuagcacccacauaaggugacucacaaccuuaguccaccucccgaggauaagguucuuugggccuuuaugggcaacggugcuauauaguacauagauacauacagacacacagagacacauauacagacacacgcauacacacacacauauaaauaaaauaaaucuugaaaaaaguuuuacaaggaaaacaaaaccuaaagacuguuggaguaaguaaacaaaaagcuuugguucuuuagcaaaaacuguuaugccacuagccagaauaacuggaauauauauacaaaaccagcuauagaagagagagcaucacugcauccucuacagacauuaaauuaagguugugcuucuuuucuggaugacuuuaaaagcuugucagaauggaagaauaucaggguagagcauggucacauaagcuguaauaugagcacucugaaggcugacauaggaacaucaaaaguuaaggucagccugagcuacauagcuuguuacagguaggucaaccuugaacaaauauaaagguccuaccuaaaaacagagauaggagcaaggaacaaaauuacccaaaaugugcauuugaauaaaguuacuuaaugaaugugaaaagcagugaauaauuagucucucuuuagaguguucugaaaugcaucugcaauaauaacuauugcccgaguaucuauuuuuaagauuaagauuaaacuguauuaguuauccucagcaauucuugauuuaaccugaaugggaauacacacaauuuccuuuucagaaacaaauuuuucuauguauguauagaagguuuuuuuuugcauauuuugccacaguuguuuauaagucacuuguugucaacucuugaguaaaagagcauucuaaugacacaacuuuuauugcaggccuccuuaagcaagcugauggagacacuuggucaagcagaaccauauuuuguaaaauguauucgcucaaaugcugaaaagguaaaaguacuguauacaugacagcauaucacucagcuuacuucaaaaugaagucugaauuuccuucaagauagagaagaacugugcauacuuuuuguacagaaaauaauacuccauaaaaauuaucuauagcuagccuuuauauuuccacacuuaugcaucuauaaguuauuuguggauuugacucaguauauacuagaauuugagaggcaaguauuacuaccccuugaaauuccaugagaaaaaaaauuuauuuccugaaaauuuuauaugcucuuaaaaacuaauuagccuccucuguuguauauagucuaugucucuugcuuagaaauuuuaccugcugggcggugguggcacaugccuuuaaucccagcacucgggaggcagaggcaggcguauuucugaguucgaggccauccuggucuacagagugaguuccaggacagccagggcuauacagaaaaacccugucucaaaagagaaaaaaaaaaaaaaaagaaaaaaagaaagaaauuuuuaccuauaccuuuucuauugcaguaccuuuaauuagcaauuaaaggaaaaauagcuuguaucuaaaaagcuuaaauacaguagauauuaaguucaucuuucuugauuauuuauuugcaugcauauguacacauugccacaguacacauguggcggucagaggacaacuuguaggaauuaucagcuauauuuuacuuuauuuuaauaaucagucugcauuucugcuguuuaaagcuuuguguuggggcugguuagauggcccagugaguaaaggcucuugagucgagcuuuaucaccuuuguguucuuagaacccacaugagaaggagacugauucucauaaguuguccucugacuuccccauguguguuaugguauacauauacucgcacauacacacacucacagacacacacgcacacacuguaguugaguuguuucauuauuccauggcuuacauauuucaucuguguaaugaucuacuguaauuauaauauuaaauucauaguccuuucuugaguauuaauagcuuacagcuaugaagugcuuacuuccugcuuguauugaauagaaguuuaaguuucaauuauugagaccucgcuguucaaaaguugaguuaauaaaauguaucaggucuuaggauaaguucugaauauaugugacauauauuuagacauauaacacauacauauuugcuguuuuuaacaaaaucucaaucauucaauuuuaccaaugaagacucagaaugcagauguuguggugaaagccugcuagcucagagaggcagagaaaacacccagcccagaagggggaguguccuuuucagccccuaucccagaaggaaaaggaaguuguucuucuccacaaugucucagaacccccacaaacugaauguccuucccuucuacuuccugugcaucucucuauccauccucuugacuuccucuuaaucacuauguuuuuucuauuuucacuccugucaguugccuguuugcuucaccucuuguccuaagguugacuuuauuuaauccugauaacaauaaacagaaagcucuuggauuaauuaauuucuaacaacuagaaacagauuuuuuccaguaaaaaagaaaaauacaauuuugaguuucacagugugauuaaauauccugcagcauauguuagcuuucauuauuauuuaacauaaauuauucauuugauuuuuuuuuccuugauagauuguauguuccauuugggauugacuuagaagauuauuaaaacuaagauuaugagacugaccuggaaguaauauaagaagcuacaaauacaucucuuuagaaugcuuagaaaaguaguuucugagauaccuagggguggugggccucuuuccugugagugccuguguauuaaaggaguuucacauucccaggacuauaggauucuuuccccucuuuuucuguuugaugccuaugucguaagcaaaaguauuauagaaauaaacaguuuuugccuuuuaguaggagaauuuugucaguucuaagccaagaugacaaaugaaguagguaaguuauuuucuuggugacaguacuagauaaacaucuugaugagacacaaaauucuaaacauguaucaguuuaaauguaucagugccguuaguuuguagugacugagcugugugugagggcuuuggacacuuacauuucuacugaguauugcugguccuuugccuuuaugacuagaggagcuuagaaaguugauuucuccuucauuacucuaaggcaagcagucaucuucucauaaguuaccacuucaacugcaucuuaaucccuuagucagucccuggauacuuaaaguucagcuguacuuuuaagauaaaucugaauuuggagaauacuaacauuuuucuuuguuuguuuuagcugccguuaagauucagugaugccuugguacuaagacagcuucgguacacugggaugcuggaaacaguuagaauucgccaaucuggauauagcuccaaauauucuuuccagguuauauguuucuuucauauauuuaaauauacacacacacauauaaacacauauauucacaucacauauuguuucuacauaucuugauuuauauaucuauagauauagauaucuucgggacucauuugccucuuuuacuauuuuuauacaaguuguaaaagcauuaagagacuaccagcaguauguuggacauaugucaugauagaauauaguacuuggcuauccucauuugcucugaauguuuuccaauguuuaguuuaaccauaauucagcaguuuucacacugauuuuuuuccauaauugaaauaauucaaugagaauuaacuagucaaauaaaauguuucaguugguuuucccugaaguuuucuuagucagaugucuuaucuaugaagcuauagaauguuauucagcaaucuguucuguguguaaaaauuauauuggaaccuuucaggaacugagcaguuuuugcuguguggaaagagaaaacuugauucucaauuguauguuccaauagcugcuguauuuccuauuaccccuuuacuaagauuucaguuucuugcuaaauaacuuuuuuuuuuuuuuggacuuucucaaaaagaauaacaaacuucugcccuucuuuuuaaauucaacuuccauuugguagcauaauguuucaaacucaguaucuuuccuuuuguugguuuuaaaacuauguuuuuaaaagguguuuuuaguuuuauuuuauguuuauggguguuuugccugcauggugccucacaugcaccauguaaguauaauucuuuugaagagcagaagcaggugucacauucuccccaacaaguuacagauuguuguuagcagguguguagauaccuggacuauaacccagaccuuggaagaguguccaguguccuuaaucauugauucaucuuuccugccccuccuauuuauaauauuuuaaaguaauacucugucuuguucaccuuacuuuuuuauuaauguuuuauucuuugacaauuucauauauaugcacauauauauacauacauacacacacacacacacauauauauauaugcagauauauauaauuauuucugguuauucccauaccuacucucucucaucaguuuucuaccccucccaguuuaccuucuacuuuuaaaagaaugagaaaacaggcccuagaauaccuucacuuguguggcucacuacucucuuacagaguauucugcuauuuucccccauugccucacuuuauuuuuuuuuccauuuuuuauuagguauuuagcucauuuacauuuccaaugcuauaccaaaagucccccauacccacccacccccacuccccuacccacccacucccccuuuuuggcccuggcguuccccuguacuggggcauauaaaguuugcaaguucaaugcauugccucacuuuaaauaaaguuuuauuuuuauuaaaaggcugagaaacccaucaauaagaggauagucuguuuaggguauauuacucaucuaguacuuuguaaucugauaccauuuuuguuuuacuuuuuuaggauuuuguuagccacuuucauguacuucuuccucaacauauuauuccaucuaaauuuaauauucaagauuucuucagaaaaauaaauauuaauucugauaauuaucaaguuggaaaaaccaugguaaguguguauggccuuaguuaaaauugaguuuuuuauauuuuaauaauaccuuucuuugucuaugauuuuuaugaaaagauaguuugcuucagguuauuacaaggaaauugauuaagcuagaugguuuuuuguuuacauaucuaucuuucuaucuaccuaucuuccuuuuuauaucugucuaucuaucuaaucuaucuaccuaccuuucuuuaucuguuuaucuaucuaccuaccuauauaccuuccuuucuauaucugucugccucucucucucucucucucucucucucucucucucucuuucucucucucuuccucucucucuuucucucucucccucuguguguguguguguguguguguguguguguguguguguguguguguguguguguaagucagaggaaaacauguggaucaguucucuuuaccaugugaguccuagggaugagacucaaguuuuuggucuugguggcaaguaccuuuacccacucugcuaucuugguugcccauaaauuugauuuguuguuguuguuguucuauuuguauauggauaaugugugaaugcuagcacacccauggaagacaauuuucaggaguugguucucccuuuauuuuagguucauaacugaccccaggaccuuuauuuuuuuuuuauuuauuuuuuacuuuuaaugacuuagcaauaaaagugcuugcugucaagccugauaaccugaguuuaucccagaucucauauaauagguagaauagaacugacgucuauaguugguaacugaccuacauacaaccuaaaauaaaauguaauuaguauuaaucauuagaauuucuggccaauguucugacuacagcuucaucuauauuucagacuauuucuaagauauuauauaguaaugaccaacugccauuuucaacuauuuauuaccuuuuauuuauauuuuuucuuccucuuccuucuccucuuccaauuuucaaggagaaaaaccaugaucaucuugggcuuacccugugauuuaauccuuuuguaaaaacuuuuuugauucccccccccccagguuaggaaugaaucucauauuucagccuguuucucuauucugauucccccuuuuauuuuucuccuuagcuccuuuccucuguauuucuuugacaauauuaaacugcuguuuuugcuauauuuuagucauuuuauuuaauuuauucuacccauuuauuaaaauuacuuaaauauggugcuuuuuugaguuuuccaauuuuuuaaaacaauuuuuauuagauauuuucuucauuuacauuucaaaugcuaccccgaaagucccauauacccucccuggugcuuucuuuauauugaccucauguucaauuauaaucucaauggauuacauuuauauaucuuccucacuugcacugucugauccuccuuguuguuggggcaacaguacuacauaccuacaaucuaaacacuagauugcaguaucaggaaaaucacuuauucaugaccauucuuggcugcauagaaauuuaaggccagcuugggcuauaugagcauuugucacaaaacauaagacaauauaacccccacuuucauacuguagcuucauaauaucucacaguacuuugugaagauuaacauugagucuuuuuaguuuuuuuaacuuuucaaauugcucagguaagaucgucuaccuccaguucucucucucucucucucucucuuuuuuuuuuuuuuuucgagacaggguuucucuuuauagcucuggcuguccuggagcucacuuuguagaccagacuggccucgaacucagaaaucugccugccucugccucccgagugcugggauuaaaggcaugcgccgccaugcccggcuaccuccaguucuuaguaguuuacucuuuaacucuuguuauauaauaucuguaguucuaguucaaagagauuugucuaauuuauacuuuguauauaccugcuucuggcucuggggaguacgaagccuuuaauguacacuagacuugaaguagaugguuaucguugguuccuucagguuauaaucacuuuuuaagaucuguggcuuuuaguuuuccccuuaauccaacauuuucaaaaauugugccacacaauccggugguauucugaucuuuuauaguaauauuuuuuuccauaugagaggcaguaauguagcauagugauuugacaguggaaaguuggugcuuuucucacuuucccauuucuucucucaugugcaaguaucuuuuuuuuucaguuugagagugguuacuucaauccagaugauagaugauuggugcuuuguuugcauuucugccauuacauguguucucugaaagcuuaccacagaaauaauaaugcaugaauaauuuucaauuuuucuuaagcuuuauuccuugucuaucuucauucuaauagguuuuccuaaaggagcaugaacgacagcacuuacaagaucugcuucaucaggaagugcuucgcagaaucguacuguugcaacggugguuuagggucuugcucucuaggcagcaguuccuucauuugagacaggcaucuauuauuauucagguaugaugagaaagggauucucuaugugaaagugacuuuguuucaccuuaauuaauuaaccagaaccauuuuacugugaaacauuaauaaugaaauuuuagugaugagaaugaaucaugcuuauuucuuuuuuuuuccuuuuuauuuauucuucucucauauauuacaucccaacugcaauuucccuucccccucccuaccacccuuuucuccuggauucacacgcccccacucuuaaccuccccucagauaagaguggccauguagggacaucaaccaaauauggcauuacaagcuauaaauagggcuagguauauauucucacaucacagcuggaugaggcauccaguaggagaaaaagagucagagauugucucugcucccccuguuaggaaucucacaagagcacugagcuacacaaccauaacauacauagagagcacuuaggucagacccauacugugagcccacuugaguccuggucaguuguauucuguaggcuguguuuuugugguggucuugaucccuuuggcuccuccaauccuuacaccccauccuuuaugggacuccccuaggguuucuguuuucuaaagagccaaguuuuuacucauuaucuuacauuugagguguccuuggauaaguagucugaccugugggucucguuuugcuuuuguuuugccauaauccucaauggcuacuuuauggaauuuuucccuugaugaauuuuugcagaggccuuuccauucucuuaguuuccuguugucaucagcuuuaguaagguugauuuagugcguaccauaaaggguuuccauuaacauggcagguaggcucaucaguuggcugcaaguccacaaagaugggcauggcacuugcuuaaggcuuuggcaauucuguggaucccaucuguuaaggcauuucagucuuagaagaggugaucuuuugcaccuccugugaaguaguauuaaguuccaauacaccuacagcagcagugcuuuguuugggcacagcagcagcuuauaggugagaccaaaccuggaccagccaaagcaucaacacaacucaguggcagcauagaaagagcuguuguuauuuuuaaccaccaacaaguuagcuacauauacuuaaaauguagauguagaaauuuagccuguuuuacuuuuucuaugaaacgagugguaaugugacagccauuuucucuuuucuuuucccuuagcgauuuuggaggaauuaccuaaaucagaagcaagucagaaaugcggcuguggagaaagaugcuuucauaauggcuagugcagcuucccuucuucaggcauccuggcgugcucacuuagagaggcaacgguacuuggaauuacgagcugcagcugucauuauccagcagagauggagggaacucuauagguguaggcacaaggcugcuaccuguauacaaucaagauggaggggcuacaggcaaaggaagaaguacaaagaacaaaggaauaaaauuauccuguuacagucaauauauagaggauuccgagcacggcaaagguaaucuuauuuuaaugaagcagucguuccuucugauuucauaguuccuuuguuuaaaccucugcuuuaauacuuuuauuauuauuauguuuuuaucacuagacugugauaaaacucuacuaguuccaaccuguauugucugugcaaaauuaaauaaauguucauugaauuaaaucagauuggaaaccucuaugaccuaaggucauaacugcuaagaauaaacuuguacauuugguuuaaucguauaaauuuggaaauaaucaacuuuuuuuuuuaccucaagaacauugaucucuauuguacuguauuaaauuaaugauauuaauggauuuuuaauacaguuaacauuuugucuaggcuauucaguuaggaauuauucauauaaagaagagacuaaugugaacaaguacaaucaaauuaguuuuagaaacauauucaugaguacagaggugcauacuaguccuaccuaaauaagggaucuaggcaggaagauuacuugagccugaaguuuaaugccagcuuugaacauaguaaggcucuaccuccaaaaaguauuucuauuaaaaaaauauauaguaaauguaauugucuuuauugguaaccaagagcugucuauaacccacuuugucuauuuuuguauagauguaaugcuuuaaaagaggaaaagcugagagaagcaaaacuagagcauggacuggugcaugucaaggcauguggaccucuagaaauccaggguucagauccuucugagugggaggaucguuccuuugacaacagagugaaagccauagaagaauguaaauaugugauagagaguaaucgaauuagccgugagaguucaauggacuucucaaaggagucuccagacaagcaacaggagagaggcagacgccaaagugguacagacuuacaggaagaugugauuguaagacagaggcccaaguccuuggaggaucuacaucagaaaaaaguaggucgggccaaaagagaaagucggagaaugagagaauuagagcaagcuauauuuagcuuagaauuacugaaaguccguucucuugguggcaugucuccuucagaggaacguagauggucuacagaauugaugccugaaggccuucaaucuccacaugguacuccugauagugagagcucucaagggagcuuagaacuuuugaccugugaugagaaccaaaagagcaaaccagagucucucauuuuagaugagggagaauugaaaauuucaucacccaauacauuuaccaauccaaaaucacaagauaaugcccucagugccucaagugagacaagcucuacauuagcuggaaaaggagcauccucugacucagagcauuugaagaaugggacugcaaaggaaaagcuugucuguaguucugaaccuaucaccuguaaaccccagcugagagacucuuuuguuucaagcagucugccuacauuuuuuuauauuccucaucaagaagcucugaaaacaaguucccaucuugacacaaguauccaaagaaacaaacuaccagaaagagaagccauuuugaagacgacucuuacucaggauauuaacagagaagccaggaagugucaguuuucaggagaucagaugacuccuuugaauacggauucuucaugcacugugcuuaagaaguuagaaaagcugaauauugaaaaagagaaaaggcaaaagcaguuacaacagcagaaugaaaaagaaaugauggaacagauucgucagcagacagauauuuuagagaaggaacguaaggccuucaagacaauugaacagucacgaacugaggccucugucuuggcaccauccuuuuaucagccaagacaaaaaguagagaggccauguucucuguauauccagaauacuccgaguaaaggagaagcugguguacuagguuccccaucagcagucacuaaaagagacgcagcucuugccacaaaagauagucccuccauucauuuacccccaaaagaccgaccugucacccuguucuuugaaaaaaaaggaagcccaugccaaucuagaacugucaaggaauuaccgaagacagaaagaacgggcacccaacaugaugcugccuauaaacucucuaauaaucgcaguacagaaagagaccacuuuaagucaacacacuuuuacagccacagaucugaugacccuuccagagagggaaguucaagagccauuuuuuucacaccaaaagacaauauuacuccccuguaagugaaauugguauuuuuauauguuaagugggggaauuucucacauaaguuuguugaagugcuuuguguucugcucuguguacaugaaugcugcucuaaucugaguuuuuucccccucuguguaaaguauagauaauuauauccuagaaauccuuggauguagauaacacauuuuuuuugguauucuuccauauuaauugaaaaaucauuuguaaaaggcaauguugugcuuauaaguguaccaggcauucaacaguucugguugcuguaggacuaugaaguauagugauccaaacugauuauugugaggcuuuucagaacuuagcauguuuucucacagcuguuggccuauuuauggucuucauuaaugucuucguuuuuuguaugauaauuacauauaaagcuuaguaucauaaauuuuaaguguaugguauaguaguaguuguuguguaaguuguuuuacaacaugucuuuuucaucuuacagugcugaaauuuacucacucuucuuuuuccucucuucaguugcugacaacuaucuucuacuuuaugauuuuuuuguuuguuuguuuuuguauuuuugagacagggucuugccguguauccuuugcuggccuggaauuugcuauguggaacaggcugaucuugaacucauagggaucugccugucucugucaaccaaaggcaugugccaccaugcccaaaucugacuuaauuuccaagagucaaaugcaucuauuauaagugggaauucuuuuuaguuuuuauaauuagccacagaagcauuuuaacucauagaggucaugagaagcuguuuucugguuuagguuguuuguuuguuuuaaauucugauguuugugaucaaaccugggacaucaugcauguuuaucaagcaagcaccaggcuuacacagcuggcacucacugagucaucuccccagacuccauuuaugagaguuaaggaaacgauuucuaauggaaaacaauuaacuuaacagcuaguguuauauguuauugucuauuuuaaacuagucagaugcuaguaguuaagucauaacuccuaaggaguuugaagucuaaggaugaauuuuaaaacucauaauacuaaauuaauuagugccaugaaaaucuagguacugcucaaauuuucaccagauucugacagucuauuucaauauagaaauuuaaugguaaaauagucuugccacuguuuuuuuuuuagacaaaauuaaacuuucauaacccagucuuauaguauuuguauuguuuggcgcauacuucauuuugcuuauuaacaauucuuauucugccauuguuagcauuagccucacauuuuaaagguaagauagugguuagaaacuuagaagaguucagaaagugauuuuuuuucuaaccaauaggaacaucccaaaguaaaacaagaucuucauuacuaucauauuuuauaauuaugugaaaagccuguuuaagacaagaauccuaaagauggaagggauuuagaaauuuuauuuucuuauuauugaauugacuuugguucuuuuuuaaaaauuauuuauuuucauuuucuuuucauuggugucuugucuacauguagguguaugugagggugucagauugugaaguuacugauaguugugagcugccaugugggugcugggauuugaaccugagucuucuggaagagcagacagugcucuuaaccacugagccauuccuccagccccuugacuuuuguuuuuaucuaauuuugcugcuaccuuucuuaaauguaugccaccauaguggaauauauccagugauuaucacaggagccucugugaauucaucuugcauguagauucuugauuauacuguugauuggauacgaaaaauaaaucuggggacuugggagguggcucaguggcuaagaacacuuguuauacaagcauaaagaccggaguuuggaucuccagcauccacauuaaagcagaguguggcuguacacauauguaacccuaguucuguggccaguggagacaggaacauugcuggagauuucuggccaguaaucuuagccaaaaaaaagaauaaagaauaaagaaaaaaguacacuccagguucaguuagagauccuaucuaauggagacaggcagauaauaacacagcagaacauccaguguuguccucuggcuuccacaggauaaugcagacaugugcaacuaccuacuuauaugcauguguguaugccugcauacacacauacauauacaugauaugagauuaaauauaauaaaugagauucuggauugacuaagauuuggaauuauuuauagaauuugauagacuucuuugacuuguucuguacuuuuaaauuauacuucauaguagggugugguggcacaacacucaguaggcagaggcaggcagaugugagcccaaggcuagaacuacuuggugaguucugagauaaccagggcuacauagagagacacugucucaaaaaacaaagacaaacaaaauuauaauucaugcuauacuuuaggaauaucugcuaggaauugaaacacaauccuguuuauuuuauuuaaaguguacacaguggaaauccucaagcccacaaacaagaugaaucagcuuggaaaccuaaguuagcagggcccgggcaacaagagguaaguauuggaucuuauuuaucuuuuaauuagaauaauugcacauuauuuuggaauuuacuguuuuuauagguagaacaccuuaucuacccauuuauuuuauucauucauucauucaaaaggaagcuguaggcuaauaagccuuuuauaauuaggaagguguguacuagucaagaaugguaccuuaaaaguacaaauuauaagauaguaguugcuaaggcaaaaaaggacaguuuguugaggugauuuuggugugaccugugguacugaagggugaccuagcucacuauggagaagaaugguauagacuuaacuuggacccuuaucuguuguucacaauaaugaguauggguucuuuuugguccucccuguuacuucugcuaauagacagggcauagggcacggugggguggagggaaguuuccagacacucaugagcccucuuucauuggcaucuucucccaaauuacaaaaacaaaacauuguuguguuauuuguuuuaucauuuggucaagcagguugccagaccggcccauaaaaagaaagcucgaauggcgcggacgcgcuccgauuucuugacuagagguacuuuugccgaaggggagggggauacagaggaagaugauuacgaugacauuauugagccccuucucucccuugaccaagcuucucacucugagcuagggccuguauccagccugggucaggccucucacagugacuccgaaaugguaauuuuuacagcaauaagaaaaaacagcaagcacaucugcucggaguagucuuugcuaaucuaaagcuaaccuucacagcuuuuuuccauauaauggcuuguacaugagaagccucaggacacagcaacaaaagcuaagucuaauuuaauagaacucaaauaaggggcacuuuaguuguaucuaucaaaugauaaauuaggcaaaauugagauuaucuaaauuagcacugauguagaaauguugacucucuuaccuuuaaaggucuagaguaggaaucauaaguuuuuaauuuuaauuuuuauaaaggaccagauaauaaauauuuuagacuuuguagaucuugguuuuaguuucuugaagcuacuuaaucuugaccacuaccacgugaaagcaauaauagauaauaagaugaaaaugggcauggcauuuuaauaaauaugcagaacuaggcaaugggcuuuauuugacuuacuggucagagcuuucugaccuaguauauagaguaagauaacuguuaaauaaacucauacuuuaacugaaagacuauucccuuauaaauuagggguaggggaagcuuuacaguuccuaucuucuccuuucugguaagaaauagaaaagaaacaugaauuuuguauaaugaaagugggcaugguggaacacaguuaucucaaggucaaggccagcuugaacuauacagugagaccaugucucucaaagacuaagauggauaugaucacacguuuagaaggcuggggaaggaggauugccaaauuuugguaccaacaugcacuacauaguugaaggccaagcuagauuagaaagcaaagcccuaucaaaaacacuaacagaaucaagcauauacaugcaaaccugaucucuaacacaguacagacuauauaauuuaaugagcaaaauguguuauccugggccaagccagccauauagguuauguauaguaugaauuuguuuuaaacagaaauuaaaacauuucaguugaguuuuuaaaaaccuguacuuauuuuggcuaagaauauaacuuuauuauuaucugaacuaaaauuagggcaccauauuacauguacuugcaguuaucuuaggguaaagaguuuaauucuuggggccaagauaguugcuuaggagguaaagugcuugcuguucaagguccugaguuuagacuccuaguacccaauguaaaagccaaccaugcugguaugagcccuuaaucucagagcuagauagagauagaagaauuacagggguccugugguuagucagcuuuaccaaauggucaagcuccagauucagugagagacucuaaaaaaaaaacgagauagccgggcauugugacaugugccuuuaauccuagcgcuuggcauuuuaguggcagaggccacuuuggucuacauauugucaggccaggcuauccagguuacauagugagaaaaagagugauagaagaagacacacagacacacgcacacacacuuuauucuauuauuguucuaggaaaugacaguauagagacccuaauuaagucuauuaggaacuaaaacaacugugauugaugaaauaguuauuucccuauauaaauuggcccucuaaucuuuaaugucuguuuacuguagaagagucuuacgaugaucuuugagucauuacauauuugaggguuaaacuguuauguuucaauuauauuuagauccaguuagaauuuuucuauauuucucaaauguucugauuguauucaucucuuaugaaaggcuagauucaguuuuuaaguaauaauguugguauucuguggaggacaaaaccaaaaaaaugcagggcaugcucccugauaaaacaaaauaaguuauagaccugaaaauuguagaaguuggaaaugaucuguacuccuaauguauguaaauagagcucagaucucuuuuuuuuuuccauuuuuauuagguauuuagcucauuuacauuuccaaugcuauaccaaaagucccccauacccacccacccccacucccguacccacccacucccccuauuuggcccuggcauuccccuguacuggggcauauaaaguuggcguguccaaugggccucucuuuccagugauggccgacuaggccaucuuuugauacauauggagcuagagucaagagcuccgggguacugguuaguucauaauguuguuccaccuauaggguugcagaucccuuuagcuccuuggguacuuucucuagcuccuccauugggagcccugugauucauccauugagcucagaucucuugacaguaggauuaaguaacuuaugaaagugcccuggggcuggugagauggcucaguggguaagagcaccugacugcucuuccgaagguccggaguucaaaucccagcaaccacaugguggcucacaaccaucuguaaugagaucugacucccucuucuggagugucugaagacagcuacaguguacuuacauauaaccaauaaauaaaucuaaaaaaaauugcuuuaaaauaaaaaaaaaagaaagugcccuauacuugaguuauaauaaugaauauguauauacagugaacaauauauauauauauauguauuaguuaaaauuuuauauguaacaaacaaaucuuacugaaaaauuauguucucuagucuguauagguuuauuguuuauggaagaacuuagcacuuuauaacugcugcucuguuccugagaguuucuuguguaacaauccuuagucuuuucagugguagaauacuauucacacugggaacucucgcugggaucaaccaggaaguuaggcuuucugcuuggagcuuuuagcuccuuuugguguuguagccucuguucaccugcuugacagucacugcaugcccguaguuguagagcaccuuccugcacagugugucggucaccucuagcucucuuacucuccugauuagccuauuuuaggaacaggugguggugcugguuucugguggaugcuugcaugaggaagcuuugcuuuguagaauaagcuaguagauauuuacuggaguggggguguagagggaagggaagaaaugguuuuaaaauguguuuuucugaugcuucugaaaaugugucauauucuaacuaugauacugugauggugaaucuuacuguuuaguuuauaaggcaaauguauugcauucuuaaaaugcuuguuuuuuaaaaguggauuuguguuuauugggugcaugaauuucuaaaaaauggauuuuuuuuccuuggguagaauggugcugucaccaauauuugcugacuggggagcaugguaugaguucuuagcagaaauggccaucugcuauuuuaguuuuaaauucaccaaucuuacaggauuaaaaccaauugcaaauuaaucaccuaaagggaauuugaaauaaucacuacaucugaagaugguuaauuaauaaucauugauguuguaggagaguguaggcaagaguuauaauuucccacugcugugacuuuuauacuuuuuugaaagcuuauauuucauuggauauuuucuuuauuuacauuucaacuguuauccccauuccugguuuccccuccgacaaacacccuccccuuuguguuuaccuuugaucuacaaauuucuuugcuuagaugaagcucuucuagcagucaguaguuacucaggaaggacauaaaaugcuguuaagucauaucucaguuauggaaaucuagaacacugcuaacuuaccuaacuuuuuuucuguagccuugauauuuuaggaaccaucuugacuacauuaaauccaugauuuaggugcuauagaaauggcucagugguuaagagcacugauugcucuuguaccuauguggcaguuugcaaccauccaggcaauccuacaguuauacauugucaugcauacaagcaaaacuuucauauacauaaaguaauaaaauauuuaauguaucuaugauuuauauuuuaagucagugguucaugauugcuaugccuauuugaaaaugcuguuuuauagauaucuuuauguaguauugucuuugccaauucuaauucucuuuuaugugugauuuauuugaucuuuugguuuggaaugaucacuuuuguuucagguguaggauaugauuucaaguugaucauuuuagauuagugauccacuauaccuacuagaaucuguauguaaauucuugucuuaguuuugucuuuggagaaguuaucuuuauauuuacuauuauuuuguuucuuguuuguagugacuuuuguuugucuuugucuugucucugacaauuuuugcuuuuauauccuuuaguaguucccaauuaaaauuuuguguuuuucuuucccucuuugguaccuuauacauuauuuucaaguuaauuuuacuuuauugauugcauuuguuuuuugauaguugauacauguuuauucaaaguaccuaccuuuacuuaucucucccccucuuccacuuccguucucaccuucuuccuuauagacuccuuuccuacauucacuuuguuuuguuuuguuuuguuuugugcccacugaucuuaacaaaccauguagccccaaguuuggaacuauuuuguacacuacuaaagacaaugacuguuccuuucuuagaaccuaucaguugccagugguucaucauggagggagugagccccaugagccccucccaucuaagauuggugguugacaggcucaguguaggcaacuccugcuaccuuaagaucauguuugcaguuguggcaugcuuugaagagaguguuuuauagcccuccccuccuuaugcuaugcuccucccuuuuuagaugcuccaugaaccuuagaugggaugguaaaaauguccuguucaggguugagcugucaacuaucauuuauucuaugccucuugaguggcaaggagacucuuuaaucacugcuguucacugcaaagagaagccucucugauuaaggaugagaauagcauuugucuauggaaauaaacauaaauacugagaauauaguugagugccuugccaguuuacuugaaagacaguaaugaggucuucacuuaccugugaccucagccauuucuuuuucuuuuucuuuucuuuuuuuuuuuuuuuuuuugagacagguuuuuuauuauauagauagugcuguauuguagcuuucuagaccagguuggccuuaaacucacagagauccucuugccucugccucccagccauggguucuugaccagauuuacaguaucagauauauacuuucucccauggagcagcaagcuguuccccugcuaacuaccuuucauaauguuagaaggugcuguguauacugcagggguagauacagcaucaacagucuuacccagcuggaaacccuaagaacuuaaauaccaguggcagaaagaauguacccauugguguaauacugacacaccuguucuagguuguaaugacuaaauuguuugauucuuauuuugguucuaacuuaauacucuauuucuuaauuauuguaccuuuguauaggaguuguauguuuuaauuuauucauuuuguacauuuggauugguuuauaagauuaaaaaauuaugaaugucuucucuaucaguguaacaaaauacaguuucuuuauggaaagccuguucucuuuuggugaucaagcaauguuucauuccccuuucucuuuuaacauuuugauucuggauuuuugagcuuuuuauauuuauaauauagucuccaaaaagaauuuuuccuuauccuuuuacaaauuuaccuuccucuagaagcaauggcuuuagcaauuucaagucuuuuauuuucugaggcagaaguuucacucuguaaugaagucugguccaaauucacagcaguuuuucaguguuaaccuuucaaaaacugggauuucagguaugagcuacuuauguucagcuucucuuuuguguuucaugcuucagguaggccuuuucuuucugccauuuacuuucagucaaucauaaggccacuuccaguuuuacccuuuguucuucuacacaguuuccuuagacuaacuuuauucuugauaaaaguuuaugcugggauuauguuucacuaugugucugcaagugauuugaaguuugcauguacucuuauuuucaguugucuacuagguuuuguuauuuucuuguuugauaguuuuucagaaugucacuauguauuuaagcuacuuggggaguuuauaguuugaauaucuuaaguauuccuuuuuccccccucuaagcaauuuacuuguuugggaauauaggguuauuuugucuuguugaguuuccucuacauugcuaguauuuacuaauugcaaccuugugccaucauuuaaaauagcauuuaccagauaucagaaauauaagaggggagcaggaguagugcacaucucuaacccuagcagucgggaagcagaggcagcuagaucuuugugaguuccaggccagccugcccuauguagaguguuccaugccagcaaggacugcauagugauacccugacuuaaaacaaugaagcuaggaaguaguucuuguacugaucuugcagaggacccauguucaggcccuaauaccuaugccaggccacucuccacugauucuaccuacaguuccaggaacaugugacacauugccacccccuguacaaaccuaugcucacacacaugcaauuaaaaaaugaaaaugaaaaaaaaaagauuaggaguaugaauaugcaggcaucuucuagggccagcaccaacaguagcuugguggauuuggcuuccauauaaaaggccuuugugguaguagagcuccacccucucaaaaggauuugaugcuuuagcagccacuggcccaguuggaguccaccuugaugaagucucuaggcaguuauuuaauuuuuuaaauuuauggcaacauucugggacacuuccucuucuuauuucuucugcagagaaagaaagauacuuagcuaggcuuauauauaguucauauaucagaagaauugcuuucucaauucaaaguauaguucugaucuggugugauuuccuagcacaaaauucaugauucccaagauccuccuagagcauggagcacagucaccacacccuuaccgaaucaucauacaggugucuuuaggaacagcaacucuuuucaguacccuacuguuuugugugugugaauuugaguauucauacaugagugcaugucugugcacucgcauagagcuuaaccauuaauuuuugguguugcucuucaguuacagucuacauuaguuuuugugugaaagagacuuuuauuggaguagaaauucaacaauuuggucaggcccagcaaacaccagggaucagccuguuucugccuucccacugcuagaauuuuaaguaggcaccaccuuacuugguaauccaucaccaccaccacccaccaccaccaucaucaaauauuuguguucuggggcuagagcucaggccuucaugcucucaugcuugucuaacacuuuauggacuggggaucuguaagguuuauacuuuuuuauuuucuuccugaaaucuugauuugcuuucaguaucuugauucaccuucaguaucuguaucccauaaucagucaucuucagcuuuuuuuucaguagcuaugccaacaugcauauucuguguucuaaacaaggauaaacaguaagcuugcugauuggcagucucaaugaauuugaaccaaaaauaaugccuccacuuuuuuuccccugggggaaaaaguauguguacacacaaaugugagagauaaaugcccauguaaaucuaguuagaauaauaucugacuuuaauguuuuucugaggaauauaguuuauagauaaugaauauauccuuuugaaucacauuaagugcuacaucuuuuauccuucuaaaauugaauguauuauuguauuguuauugacuugauaauugauuuauuagcuguuuauaaaugaggucuaguacauacagugacacauacagaucaucauuugacaguuugcucuuugagaaguauguauacaacuaugaaaccuauguuucaagugucaauauuucuguaacaucaacaauuuccucauguuucuacucaaauuccuccuucacuucauagaacuucauagaaauguaauuagacaauauguagaaggaagauuuuuuuuuuuuuuuugguuuuuuuuuuuuuugguuuuucgagacaggguuucuguguguagcccuggcuguccuggaacucacucuguagaccaggcuggccucaaacucagaaauccaccugccucugccucccaagugcugggauuaaaggugugugccaccaccucccggcuuggaagaauuauuuuuuaaaauguauauugaggugguaucucuggaaguuugagucuuuuuacauaaauuuuuguuuucuauuuccccuuuucaucuauguaaaguucaauuauaaguacuauuuuacuauccuucuaauugaauaauucagucauuguaaauggcuugauuuuuuucuucuuguuaaauauauauuccuaucuuuuauuuuucuuuuuaaaauuauauaguuuacauugugaaauuuuucugguuaguugaagaauuuuuuuccuuccuaauuaacuuucuguauacuaugguuuucugguaauauuccagaucuggaauacaacuguuuugggaacaguugccaaaagaauuaauugccaaaagaaauugaagugguaguuugauaaaaauuguuuauaauuuagaacauaagugauguuuugguuuucuuuuguguagccuaguucuuuuaaacuuugaauggauauaaaaauaaucuauaacccauaaaaagaauaaccucaaggaaccaaaaaaaaauaagagagagauacagaacauacuaaucaguguuguguuauuucucagauuuggauucuuuugaguuugugaauggucuugacuguuucccugacuuccugaugagauacuugcugaauugccaggaauugugaacugaugauuacuaaguuguaagucagucaugcuaucauauauuuaccugauuuuaagccuuugccauguguaauuccuacagacaucacaacgauuuucuucaguugaugagcaagcaaagcuccauaaggcuaugucucaaggagagauuacaaaauuggcaguaagacagaaggcuucagauuuggacauaagguauguaugagguauauaaagaaauagaaguuucuuuguuucaguuuuuaaaagauuauuuaacuuuauaggcaacaguguuuugccugaauguguguuucuaugagggugucagauucuccuggaacuggugauuuagauagcugugagcugccaugugggugcuaggcaacaaaccuggcuucucuggaagagcagccaaugcugucaacagcugagccauuucuccagcccuaaguaauauaauaauuucaaugauuuuauuuaauaauuuauauacuaaauuuuaagcaauuugcuuuuaagaaaaacauuuuacagucuaugucccuuuauuucucuuuguacacuuaagucuuaaguuuauaggccaugggcuuuagcaccuaaccuuucuguuuguucuuauacaguguauuucucuugguagagcaguggugcuucagcuauuuuguggguuuuguuuuguuuuguuuuccugaucauuucccaucaccuguuuaagggggcugucuccuagagugcuuaauaggcucaguucuuagaucaucucucuuuacaagaaucuucccuuauccugcuuguuuauaauggugcccauggcaugcugggugauauguacaguucuuguuuuguaaaugaauuccacuugugaggcauucuuuucuuaacagugcucacuccccugaugucugcaucaauauccuuuauagauuugcauguauguggccaaaggaauaccuucauguuuccuuaaaggcauagagaacagguaauaggugccacuccuuuuucccuuuguguuuuaucacuuuggcaaguuacuggaagauggcuguuauggccgaagugcuuuugcuuuaauuuuuaagaaguaauacuauagcuaaguacauuacuaugcugacacacauacacacacacacugaacuuugucuucuuauguggauaacuaugacuugggggagguuucuuaaucauuaugugaucuauuauugugaaaggugagggaaauugauauuuuucaguuuuaagcuuguaguauauguaauauacucuguacuaaauugcuuuaggaaaauacuuuugaguacaggacagccagccacagcuggcucaaaaccuccacccauccguucauccaagaaaagcgagaaaagaaaaauacuuucagaaaauaauuuuguuuucuuuaaguugcuugugggggagcuggggugaagcugcagcagaguguuugaugaagagugagggacuaaaagaguuuaggguugaagagaugccuuagcaguuacaaguacuuacugcuuuuucagaggaccuguucaguucucagcaccccuaagauggcucacaauuguuuguuacuuuaauuugagacucgaaugcccuauucuggccuccaaggacacuaggcauucugguggugcauauacauacaugacaggcuuuuaaaacaucccuaacacugugaagggaacagacaucgaagcaucacuagagcuggcuagucacuagucaaggaacuagagagugguagagcagguaaaauccuccuuuggccucuaguacacauagggauguuuaucaguaugcauagguguguguauacacccaaacacacauagaaaguucauguaauuuuuauuuuugaauaaauaucuuuuaaaaauuauauaagcauuuggacccuuagugaagauauuaagguauauuaaaaauauuuuuucuuuuuuaauuguagacuacuuuuuauaaacuuaaagaaauuuacaagggacuuaaaucuagaaaagauuauacuacaagucagaauugaaaaagaagauauguauauaauaauauaauagacuaaaggacauauaauuggagauaguuauauaaauuuaauuuccaauuuauuugcccaaaugaccaaucccauaaaugaugaaacaaaagagacaaaaucaaaauguaaauaucuuaauagaugagagaagucugaaaacuaaccaaguauguaaaacugagaaagacacaugcagccaacuggcccucucuauucuuagcagaaaauaauaaacuaaggacacaugcuccacuauguucauagcagccuuauuuauaauagccagaagcuggaaagaacccagaugucccucaacagaggaaugaauacagaaaaugugguacacuuacacaauggaguacuacucaguuauuaaaaacaaugaauuuaugaaauucuuggacaaguggauguaacuggaggauaucauccugagugagguaacccagucacaaaagaagucacuugauaugcacucacagauaaguggauauuagcccagaaaccuagaauacccaagguacaacaucuaaaacacaagaaaaucaagaaggaagaccaacguguggauacuucauuccucccuagaauagggaauaaaauauccauggaaggaguugcagagacaaaguuuggagcuaagaugaaaggauggaccauccagagacuaccccaccuggggauccaucccauaaucagccaccaaacacagacacuauugcauacgccagcaagauuuugcugauacaaauacagaaguggaugcucacaaucaucuauaggauggaacacagggcccccaauguaggagcaagagaaaguacccaagagcugaaggggucugcaacccuauagguggaacaacacuaugaauuaaucaguacccccagagcucgugucuccagcugcauauguagcagaagauggccuaguuggccgucauugagaagggaggccccuuggucuaguaaacuuuauaugccccaauacaggggagugccagggccaagaaguaggagugaguggguaggggaggagggcggggggagggcauaggagacuuuugggauagcauuugaaauguaaaugaagaaaauaucuaauaaaaaauuuaaaaaauaauaaacuuauuuucagggaaagauaaaaaugaagaucucuagacuuaacuuuauauccaguauacaccacacacaaacacauauacacaagacaggauuucuguguagcccuggaugucuuggaacuugcucuuuaaaccagccuaacuucaaauucacagagauccaccuccuuuuacuuuccgagcacugagguuaaaggcguguacuaccaucgccuggcaaguuuaccaauauuuuuaagguguggaccacauuuuuaaauuaauuaauuuuuuacuuauucacugucuuuccccccacccccccaccccuaucacccucucccacaauccuucccccauuccuccuuuccuucuccucugagcagguggggccucuccuucauuauuccucccacccuggcacuuaaaauuucugugaagcuagguacuuucucucccacugaggccagacaaggaagcccaacuagaagaauguaucccucauauaggcaacagcuuuugugauaguccccacuccaguuguauugggccuuuucuuuuuuuaauaugcguguacaauguaaaugcaugaguguacugguauaugugugcaggagcauguauguagagaucaaaggucaaccucauucaguugcuggccaccguuuuguuuuguaagacagggcucuuaaugaguucuugggcuuugugguuugguuuggcuagggugacuagccagcagcuagcuccagaaaucuaccugucuccaaccuuucuaguacuagaauuaucagccugcuguaccauaaccauaggcucuggggacuaaacucaugcuuucauuuuguguagcacuuuacuauuaaccuaucccugguauuuacuuauuuuuuaaaugaauuuuacacuuuaaaugcuuaugccucuccgcucuuuuccuuugcucaguuaauacauuuuuuuuauauacccuuugaguagauaguucaaagaaucuuugggaauuuguucaucuauugaggaaagauuagaagagauuuccuugcaaaauuccccagccagguaacccuauaaggaagacuguaguuuaugagcucagcuaguacccacuggagcuucuaagcaacucuuuaaacccaacauaguguagcacacuuacuucccagccuaauggcacagaccauuaaucccaguuguuugaagaugaaguaggaugaacacaagcucaaggcaugccugaaccgccugaaccuauagaguuuaaggucagcaauggaugcugucucaaaauaaaagaacaaaaggaggacagagguggagcucaguguugcauuaguuacuuucuguugcugugguaagacaccaugaucaaggcaguuuauggaaggaaaagauuauguugguuuauaguuccauagggauaagaguccaucauggaagggaaaagagacauggcagcucgaucagaaaaguucuuacucauaucuuuaacagcaagcagaaagcagugaauggauaggugaagugguguaaaacuauaaacaaaguuuucuuuauuguaaguuacaugugagauauaaaaaugaaaugauggcaguuugcugucaguaagcuuaagcuagaaucuuuguuacauugcuuugaggcugcuuuaucaaaggauuuaaaauuucagggucuuuaauuuuauauucaacaugaguugggauuguggcuccgaaguagaguauugccuaacacguguccagcauguguccugcccccaaacacaccaaaguuaaaauagaaaacuacauaaaaaguauguaaaagcuuaaaggaggauacacaaguauuacagugacaucugauuuccaucuuaucuuuauuuuguuuuaaaaacagaccccagagagcgaagaugagauucugggccaaagggaaacaaggagagaagaagacaacuagaguaaaaccugcuucccagucggagaucucaucauucuuuccuggcccagaugugacaccugcucauccauuuucugacgguaaaaauggacaaaggguggagcuucuucauguguuacucuuucugaacuguacugugccucucuucuucugaaugacauuccaauuggaaugauauuuucauaagauaggacuaagacaagaacauguaacaaagaacaaugaagcauagaacagugauauauaagcacuucagagaugaugaaucuugggcuagcccuuuuuuuuaauuagauauuuucuucauuuacauuucaaaugcuauccugaaaguccccuauaaccucuccccgcccugcuccccaacccacccacuccugcuuccugucccugacauuccccuguacugaggcauauaaucuucacaagaccaagggccacuccucccaguaauggcugacuaggccaucuucugcuacauaugcagcuagagacacaagcucuggggguacugguuaguucauauuguuguuccuccuauagaguugcagaccccuuuagcuccuuggguacuuucucuagcuccuccauugggggcccuguguuccauccaauagaugacuaugagcauccacuucuguauuugccagggacuggcaaagccucacaggagacagcuauauuagggcccuuucagcaaaaucuugcuggcauaugcaauagugucugcauuugguggcugauuaugggauggaucccuggguguggcagucucuggauggcccuuccuuccgucucagcuccaaacuuugucucuguaacucacuccauggguauuuuguuccccauucuaaggaggaacgaaguauccacacuuuggucuuccuucuucuugaguuugauguguuuugcaaauuguaucuuggguauucuaaguuucugggcuaauguccacauaucagugagugcauaucaugugaguucuuuugugauuggguuaccucacuaaggaugauauccuccagauccauccauuugccuaagaauuucauaaauuuauugcuuuaaugaaagcauuccuaagaggaaaacucauagcuuugagugccuccaaaaagaaacuagagagagcauacauuagcagcuugacagcacaccuaaaaauucuagaacaaaaggaagcaaauucacccaagaggaguacacugcaggaaauaaucaaacucagggcugaaaucaaccaaguggaaacaaaaaaaacuauacaaagaaucauccaaaccaggagcugguucuuugagaaaaucaacaagauagauaaacccuuagccagacuaacuagagggcacagggacaguaucuuaauuaacaaaaucagaaaugaacagggagacauaacagaaaccauggaaauuuaaaaaaucaucagauccuacuacaaaaucuuauacucaaaaagauuggaaaaucuggaugcaauggacaauuuucuagacagauaccaggugccaaaguuaaaacaggaucagauaaaccaucuaaacagauccauuaccuccuaaagaaagagaagcagucauuaauagucucccaaccaaaaaaagcucaggaccagauggguuuagugcagaguucuauuagaccuucaaagaagaccuaauuccaauucuccucaaacuauuccacaaaauagaaacagaaaauacucuacccuauucauucuauaaagucuuuuucuaaauuguaaagguuuggccuugauucauuuauuuaauaaauauguaauauucauaauaauucauaacauuagcucauuguuuagugcuauguaaaaccauaauaaacauguuauauauauuaaaucuauugauuuuaagaacaauuuuucugguauuaguacaauuauuauucaugguauaaugaugagaauaucaaaguauaagaaguuaucuauuuacacagacugaaauaagaagaccuaagauuuggauuugaguucaagcauuuaaacuccagacuugacauugguuuuuauuauugucuguuuuguuuuguuuuuuggguuuuuuuccucuguuuguuuuaagguaaggucucucuguagcuuuggcugucuuggaauuuucuuuuuuuuuuaauuuuuauugauucuuugugaguucuauaucaugcaucccagucucgcucaucucuccauccccucauaucugccauuugcccuugcaaccuucccccuaccccaaauuaaaaaaaaaaacauguaaacaaaugaacaaaacaaaagcauagacaguaucucaucauggaugcuguagugugucacaguguguccuacauuauauccuucaguccauacaucuucacuugcaaauguuuguugcagugaaucauuucuuugcuucauggucucuggcuucugugacaccaucaauauauauuggaucaacaccgggacuccuccugguuacccuguuguugcugugugucauggagaucugcagcuuuagaucaccaguacugcccuuuuacacaucccauccauguguagaugguauagauuuuagggugggccaacucaagaguguaguaucugggccugggugguagcugaguuggucaggguguuggcucccccuuauccacacugccaggaucagcucuccagcacugcucuugcuagaccacccagugcugugaucaucaggaggcagggucagugcuccugcucuuauguucucagggccugcucagccacacccacaucuccagcucuagugugccacccagugaaggugugggguccacucucacaagugcuacaguuuaugaggggcugggacaacucuccugccucacacccucagggcuggcucaccugaaugagccuucaccaccagggccagcuccacuguguuucacaggcaaggugcagggccuguucuccugaguuccacggggcuagcucuccugacuuguuuguuucuuuuccuuccuccaucccucccuuccuuucuuaaaacaaagucagacuguaucccaaacuggccuugaauuugagacaauccugccauggcuuccugagugcugagauugugugcaugagcuaccuugcuuggugcagagccuccaucugagccacuguaauacacaucaacuauuuacuuuguuaguuaccuuccucauugcuauggcaaaauacuucaugcaauuuuaaaauggaagaguuuauucugguuuauaguuucagggcuuugcaagucuaaucuguuucuggacuguaauggucugcauagaauuuuauauacuagugugaagaaauacaaaaaaaaaguggugcuuuucucuguaauauacauuaccugcccaguucccuuuuaaugcagucugggacccuagcucauggaaugguaacuaccuauauuuaauuggauagugguccuccuacucaaccuaaucucaguaaucccucccagucaugcgcagagaugcucuccaaaguuauuuuagauccugucaaguucacaauaucaacuguuacaucuacugcacauuaaugucuuguauuucauaagguagccauucuuuuaacuuuuaaaauguaccacucaagagaagcaauuagcacuugaagaaaaugguagagaugaaauuaaccccucaauuuguauauuguggcuuuguucuggucaacuaauaaaaugcuacagauaaaaaaaaaauucugugguuaucuaacccuaaucuaacuaugagauuggaaaaacuuaaauguucccaauuguauuacucaaguguucauuuucuuaauaucuucucaaauugacaaugaucauucuaaauuuaucauuuucaguaauuauagucuaauauaauuuccaaaaaagagugauaagguucauuauuugaaaauauacauuuuaagcagauauaaggaccuucauaaaaauuaggauuacugcuuuuuaauuuuuguuugaauaaaaaucuaguaagauagccuuuguuuuuaaugcuaaacugagauuacaacuuauugaauaaaauuauaagaaggauaaugacuuuguaaaaggaaguaacuacuuaguaaguuaaaacgaagucaguuuauaucaauauucuccucaggcuucagauagggcuuugcaagucuaaucuaguucuguucuaaauuuuaaugguuuacauagaauuuuauucucuagugugaacaaauauaaaacauuguacuuuucucuguaauauauacuaccuguuuacuccccaaauucuaugagaauuaagacaguuuuaaggaauauguauaagaaaacacuaaauaaaauauuagagcaaaagcaauccaggugagcaacuugacucccuaacaaguuguuaacuaucaacagacuauauugcugauauguucaugguuuuacacuacaguaaaaauuguacuuaucaaauucuccuuuuugguugcuuagacuuacauauaacuggacauucuuucaaacaaguguaacacaguugcaacuaaaugagcaguauaauauagcuaguuuguugcuuauucuucuuguucaucuuugggacugagguuuuuacaauaagguuggagauuuucaauuuuuuuuuuacuaaguauaucuuuuuacuuauuacuuacccuauuuugaauuguagaguuaacucaguaccacccaacaccuccuuugaguccagaacugccugggaguugucgaaaagaguucaaagagaauaaggaaccuucuccaaaggcaaagcgcaagagagguguaaaaaucagcaguguggccuuggacucuaugcauuggcaaaaugacucuguccaaaucauagcaagugccagugauuuaaaaaguauggaugaguuucuucugaaaaagguacaguuugcuugcugagauuugauuaaagaauauuuauuauaggauaugcuguuacaguaagagaggcuaaaacuucuucaguaacucaagcaauggguuuguuaucaaaagcuuauauaguaggacacucaaagugagacaggauuuuagccaccucuaugauuucuuaaguguccaauaugaaggugaggcuguagcugaucugucaacuguagugucaaaauguuagaagagaaauuagaugugauaaagugcacucuccuuuucuuagguccuguaauguccaguggcuuguacuuuuagaauauugcuuaagagacauuucagccuuugcauuugcaucuuuuugaugaguaauuguguauaacaaccuuuucugugguuggucccuagaugaaugaccuagauaaugaagacagcaagaaggauacauuaguggauguuguauuuaaaaaagcccugaaagaauuucggcagaauaucuucagcucuuauucaucugcauuggcgguaagcuuaggccauguuaggagauagaguauagcaugguuuguaguuuuaauaaucuauaaagcuagacucaagggaacauuuuuuaggacuuaauuauuguauuacuucaacuguuaggucuuuuacugauacuuaauagguuuauccugccuauacuuuauacuaugaugggauuuugcaaaugcuagauaaugccuugaguuggcucauuauaagcuauauuaagauuguaaucuauauuccccaguacaaguugaauuagucuuuaaagaguauuuccauaaaacuuaacaguuuuuuucuucuccuuagauggaugaugggaaaagcauccgcuauaaagaccuauaugcgcuauuugaacagauucuggaaaaaaccaugagauuggagcaacgugauuggaaugaaucuccagugagaguuuggguuaacacuuuuaagguguuuuuagaugaauacaugaaugaauucaagacuuuggauagcacagccccaaagguaauuugaguuagaauuauagaaguacuaaauaaauuaugaauucuuuguaaggaaucugccuaagaaacauuuuuuuuaaauuaguauuaguauauuuuacuugugcaaaguagguuucauuaugauuuuucuacaucuuuacaauguauuuuugauuaugcuguucauggugacacauucuaguagucaaaauacuguagaggaugugguaggagggucauaguucaacaccagccuagacugugacugagaguuaaaacaguguauuucaggaaaauaucgcagagaccauaccaauuuaucauuaauuuagauccucuaaacucuguucuaauaauuuuuccauguauuuuuucugaacuugcugcauuggacauguccuucacaauuaaaacauaauagugugcccucaauauuacacuucuaguuuuaauggagauuaauauauaaauugacuucugaaaaauaaugguuaaagaucaaaugaauuauauaucacuuagcuuuuaccuaagaaccuacaaauuagaucucucuugaauuaguuuuugggaaaaauguguuuccugggaaauauaaacaucagcaaucuuaaccuucacuuuuugguuaagagcugggaauuuuacugcuugauauuuaauuaaauuuugcuuuaaagcuaucaaacauuuuguaguuggguaggaguuaggaacauacuuacuuaacuuacugaagugcuugacaaauauuuauaaagcccagaucugaguaccauauaaaauguggugguccacaucaccaucccagcacucuggaaguagaggcagaaugaucaguucaggcucauccuuggcaacacagugaguuugaggccagucuggaaaacaauauauacuuuugacuugaguguggaggcacauauuauaguguuucauuuagaacugacauuuaaaagguaaucagucucuaaaucugauaaagauuuacuucagcucugcacaguuccucuugaagaauaaagaacuuuuuauuaucuguugaagcuguucaaacauuuucaaagaagagaauauguuagucuuuguaaucuuaaauuauguuucuccuuaccuccuuccaggugcuuaaaacagaaagaaagaaaaggaggaaaaaggaaaccgauuugguaaguuacaucauugguauaacacuuucuagcucaguagguugaaguagaucuuuuguucccauggauagauuuaguagcaaguuuaccagaucccaggacauacucacaugccuuuaacaaaguuagaaugacaguggaccugaaauaucaugaauaccuacuuucaaaguaguuuucuaaaauggaauuucucaaaauaguguaaauaacuguuucuaacauguuuacuauuucuaugguuuagcucuuugugaacaucucaugaaaauggaauuguauaauuucuuguuuuugcuuaugguuucuuaccgugauguucuugagauucauccauaauguugucucaguagucagcuacauugaguauucaguagaauuacguaccacuuuggauuaugcugaggaccuuggccaugcuagguaauuauucucucacugaguuguagcccuaaccuuuuccuucacaauuuauuuacuguuugaugggauuugggauugguuuauggacauaugcuaugauuugucuuuugcauaauaaucuucgacguauaauuuuggaucauaugauuuuaaguuuagcuaaaauuucagagucugcuaacauguuuuccaaauaagaaaugcuaccuacaaugcugauagaguucuaaucucaacuuuuuuuuuaccauccuacguuacugugugucuuuuuguugcagacauucuuuugguuguguaacccuauugugauuuuaauuuguauuccccucaugucuaaugauguuuaacauuuuuucaugugucugauaguuauuuauacuucaucgaugggauauucagcguuuaguuauuuuuaaguuguuuuuccugauuuaguuaauaaccuuaacauauuagaauggugcugagaaagcuggugugcuacaugugaagaaugaaacuauauucuuaucucuguccacauaaaggucaacuccagaugaaucaaagaccuuagcauuaggccugauacuucucgagaauaaaguugagacaacacuucaagaugugggcauaggaaaaaaaaaaucaacaauugacagaaucuugugaaauugaaaaguuucuguguugcaagaaaacaaauaucccagagaaaaaguguucuggacauagaguucucaguagaaauucaaaugagcaauagauauuguugaaagcaucaacauccuuagccaucaggagaguguauacuguaacuacucagguacuccauauuaccuuaccaaggaggaagauacuugagcauggaaaaaggucucccaugcuuauggacugauagaguuaacaauuugaaaauaagacuguauuaccaaaacucaucuacacauuaaaugcaguuuacuucagaauucuaaugacuucuuuuuagaacuagaaaaaaaaaagacuaaaauucaauuggacacacaaaauaccucaaaagucagagcaauucuaagaagaaagaacagugcuggagguguugcaauacuugggcucaaacugagcuacggagccacaauaacaaaacuaacguggaagggaggaugggauagggaguuucuggaggggaaaccaggaaaggggauaacauuugaaauguaaauaaauaaaauauccaauaaguuuuucuaaaaaggaaaaaaaagaauaaacauuaaaaaaugugaugaaacuauuuaaccaagacuuuauccugaauaauuuuugaguucaugauacuauauauaagguuauagaaauaauuauuaucaauuuaaugcauuucauuaucaauauuauaaaaacaaagauuuaaacacauugaaacaauuuuuauuuaguuuauuaaaauugauuacauuggcauuuuaaaaaaagauuuuaaaaauggaguugcacaaaacucaaaagcuauccaacacacacacaaaaaucaucauaaaugaagacaaagggggaccugccaacuauacaucugauauaucacucaguaaauuacuucaaaaauuaaaaaccaaaacaagauauuugcaaauuaauagucaacugaaauuuaucaacauaaaaaaaaaaaggaaagauuuuaaaagguuaacacacaaaaaauauucaacaaccuuagucaucagggaaauacagauuaaaacuacuuugagauucuacuucaacccauuucaaaugacugucauuaagugaggauaugugcaaagaggaggaccccuuguacacuucuuguggaaauguaaacugguacagccaugauggaaaucaguaugguaguuccucaaaaggaacuagcuaugucuucguuuggguuuaauugcuauaacaccaugaccauagcaagucuuauaaagaaaaacauuuaauuggagcuggcuuaaaguuucagagguuuagucuauuaucuucauggcagggaacaguggucugcaggcagaccugguguuggaaaagaagcuaagaguucuaugucuugauccacaggcagcagaaagagacugugccacacugggcauagcuugaacauaggaaaucucaaagccugccuccagagugacauacuuccuccaacagggccacaccuccuaauaagugccauuuguuaugggccaagcauucaaacacaugagucugugggggcuguacguuuucaaaucacuacaacauauaaucuggcugugccuguuuuggguguauaaucaaaagauuuaaucuggcauaccacagagauacuuguccagccaugauuauaaugauucacaauuuuaagauaugaagucaguuacuuguucagcaaacagacacuaaugguaaagaaaaugcaacauauacaucaugaaauuuuauaugauugaaaagaauggaauugugacacuugcagucagauggaugaaacugccauacuaagugaaauaagugggucugaaaccaguaccacagguuuuaucucauguagccuauagauauaaauuuuuauauguguaaauauauauguacaacaugaaaguagaaacugaauugugagaaugaaguucaaaauugggaguaucaagagaggguuauguaugugucaugaaagcaauaacgggaacuaguucaguggaaggaaagcagcaagaacaguaagcaugcaaacaaaaacaaggauacaccaggcaugggggauggccuuuaauccuagcacuugggugacacagaaaaguaggucucagaguucaaggucagccuggucuacacagggguuuucaagucaaccagggcuacauugugaggcccugucucagacaaauaaacaaagauaucuauguauugauaaugucacaaccauuuucuuuuuaauggaaagcaaaaaaguugauuaggagaaagaaaaaaacauaaaaauuauuauuuauguuaauacauaaugugcuuauuuuuucaacuuuaauuucuaaauagcaguagguauaacucauaaaaacagaagucuuuucaggucaugguugauuuucaauaauguaaaacauuccuggaagugaaaaacaacauuuuagaacugcugcuuucaauuuaccuugcaagugagucauagacagccagccaucuuacgcuuauugaauugcguuguuuuugauacugauaauaucuacauuguuaguuaaauuuaggacaggcuauaucuuauuuucauuauuucuuggaggaucauaauucucuaccuggaauagauacccagugaagucuuagcaagcgguuggaggacuucccauuuaccaaccauacuagggaagcacuuacuucauuggcuauaguauaaauagugaaauuucuucauucagguggaagagcacaauggccacaucuuuaaggccacccaguauagcaucccuacauacugugaauacuguucuuccuugauauggauaauggacagagccucuguuugcaaauguaaguauuagacaucuuugaggaaaagcuuucauuguccucuuuguguucacuugucugcaaaacuaguaccaugaacauguuaaguuccguacccacuuagaauaauaguuaagcucucuuagcuauaauugcaauacuucuuagugcuugagcagcuggauuuucacuuugcuagcuaacccuuuaugaguuuaacacaaugauuuauacccuuuuuuuaaaugcagucuuucaaaugaauugaagguuuaugccacccuggaaguugcucugggcaggcugucaugacugccugaaaugucuucaaggaucccucccuaugguuccagugcaaauuuacuaucuucuuuuuaauggugcuaaaacucuauagcaaccaaggucuuuuuguccauaccuauuuuucccuugccugaccaaacugaauauguauuuaauuucguuuucaaguuaucauuauaaaauuugcuaaauguagccagcaauaaccacacuacaugaauucuguauucucuugaaauuucuucuaccauauuacuuagcccuuuaauucagccucacucagauuuucagaaccuaguucaauguagauaguuuuggguuuuuugccaaaaauauaaaugaccucuacuccaacucucuguagggccauuguuuacacauagaacauaugagccuggcucuccacugucuucauccuuauuagcagucuggcuuuccagccuccuuccacaauaucccaucaaggucuguuugcagcacuccgggacuuggcuuuucuacccugaaguuccauacuuuuccauagcccucucccaaaucaguuucaaaggcuuaaaaaugacuuugucaaguuuagucaagacaacaaccccacuucucugguaccaguuuucuguauuaauuuuguguuggugucugauagaaaugacuuaaggaaagaaacauuuguuuuggcucaugucuucagagauuuuaguccuucaugcacagugggcuaugguagaggcaaaccaaaaagcaaagauucugacccacaugaggggcaagauguacccuucaaaugcccacaccucuagugaccuaguucaaccagugaguuuccacuguguaaguauucaacgggcuucccaaaaugguggcacuagauggugaauaaacauuuaaauaguaauccuguggagauuucagauucaaauuugaaugaagcaagaacuuccuuuauuuuucuuaucaguggucuuaaaaauuauacuauugauaaugggaaauagucugaaauguaccuaauucaaacacugguuuuaggcuaagcagugauucucaaccuucuuaaugcugugacccuuuaauauaguucuucauguuauggugaccccgaaccacaaaaugauuuuuguugcuacuucauaacuguaauuuugguacuguuaggaaucguacuguaaauaucugauaugcgaaccccaaaggguugagacccaaagguugagaaccacugauuuagagaauuugcuuuuuuauggcuaauguggauuuagauugauucuuaaagaauuaauuguuuuuuauaacuguaugaccucaccauuauaauagcauggccucuauuacuugaucuagcuuugaaaacauaaaagauuagaaguuuaagaaagaauauuuuuguuaguuugcaagaacugguaggacagauugacagaagugaccuuguucucagcaucccucugugcaaaugucuuguucucaccaucugucuggguaccuuguuacugggcacucuuuguuuuguuuguuuguuguuuugucuuuauguaguccuggcuggccucaaucucucaaagaucugccuaccuuuuccucccaagccuaaaaaauuauuuuugcucugaacuuuuuuuuaaacuuauguucccuacuauaacuaauacucugcuuauauuauuuuaucuaagaacucuauucugguccuucagggauaauaaauaacccucuucuauuuuuaucaauauacugccaauuucaguuuauuucuguaagcauuucuugacaauaaucccuucuuugccuauaguuauaauucuuaauugggauuucugggacuuuaacagguuuuagagcaccugggaggacauacauacuacuuugugaaucaaacuauaaagauagauaaauaaccuguuggaauugaguguuggggguagaagacaugagugcaguagcaagacaggcacccuagaaagaagagagagcuuguucauugacacugacugaaaauguuaggcaaguuuucaacauuucccuuaacagagguuagcauuaacaaaauguguuuaauuaccuuaaagcagggucagccucaaaaaacaaaguugugaacuugauaaguucuugccauugauuugcacacuaaaauuguuguaugcuuaaccuguuuuccaguguguaaguacgcuugccauaagaagugcugccuaaaaaccacagccaaguguucuaagaagguaaggcauuacuuacugccccuuaguaccuuaauaguacacagcaugucugcaaauuuuuuuccauacggaaaguaguuggggcuucuuuaguagcuuuauaauacaguguuuuucaaacuucaugaccucaaauaacauugagaaguauguuuuaugucacaauccaauauacauguauggagauguauggauauaacugaauuaauuuucuugaaaccuuuaaucuugacuuuauguaagcugcuaaguugaugaguuaagcauucauaaauucuucugaggaauuuucuuugauguucacuauuaacauuuaaccaugagcaacagcguauacuaaaaaagcugguauuuucaaauaccuaguuguauuuguguacguaagucuaaaaaguacuaaauauauaucuucaaggaaacaaccuuuuugaugguuuugauuuugguuuuuuugagacagggucuuucuauuauguaucacuggcugucuuagaacuuacaauguagaccagaccugcuuugaacucacaggauccaucugccucugccucuggcaugccaggauuaaaagcaugagccaccaugccagacuauuuuuaaaaaguuguuagugacugauaaugggaaggcccagcuuaccuugggcguggcuaacccugggcagauagucuccugaguuuuguaagaaagcaggcugaagaagccaugagagaaacaagccaguaagcaguguuccuccauuacuucugccucagauccugccuggaguucuugccauaacuuccuugaugguggacugugauguggaaguuuagacaaaauaaacccuuccccacuaguuucuuuggucaugguguuuuaucacagcaauagaaaccuaaaaaagaaaaccaccaccaaacaguauucuguguacagaucuuacauaccaaagucagagacgaugauugaaguuucagcaaucucuuagaacuauagauggugggaaagauuucccuacugucaagauuugaaccacugugguuuguuuguucauuagaggaauaagccuaaauuuagaaauauuucauuucauuucaggacuuuuuuuuuuuuaacuuccaagcuauuuaacauagauggcuaagaagcuaauuagaauaggauuuuccagagucuccaugcuaagaagagaaaagagaauuuaaaauuuuaagauuaguaaugacagagaaaucaguucuccagacucucagugagagcuaugucuagagauccgcccuaugaaugggaguggggagugagucauugauagacugagcuuaacaaacuuaccaguuagcuuugaggugguccuuaauuagaucauggugggguuuuguuuuuuuuuuuuuuuaacauuacuuauuguguggguggguauagccuauuucacaugcuguuacacacaugaggaagucagagaacaauuugcaugugccaguccuaguucaacucagguucaauuuagcaagugccuuuccccugugcucucuugcaagcccuaauaauauguagaguuuuggugcauguuuguuucaggucacuuggguucaaaccugacugcacuucaaguuguuguguaguagccucaacuguuuucuaguuuuucuuucacaguuuucagcuauuaacuauuugaugcuguaggaagaucaucuuuuaauauguuaaggcuaaguauguaugaugcauguaucguauuaauagcgaaacuuugguuaauguauauuuuugcuuaaauaauuucaguaacauuauuauguuuuuuucuuuaauaaauuauuauuugcuucauaccagguuuuaccaugccauauauucuuagaaacuaaguagaauauaauaguuuauugcaaaaguuuagccaaguugauguaguaaaaguacuaacauuuaauaugcauccuuuaaaugcucuaaauauucugccuaguaguaguauuagagauguuauuugauacuaguuuaacaucauucaaauuaaauuuggaguuaauucucugagaauuaacugcuaacauacaaaauguauagauggacgauaacagaaaacugacucuugucguggcaguuuaaaauucuccaauagugucucuuagcugucagaauaaaguccaagugcacuugauagccuuuaccuagcuuuucauucauucuuaguuuaugacuuaguaucacagauuccagggcucuguguuuccucagccccucuugcuuucuuagauaaaaucugcuuccuaacaucagaucuuuuuugagguccuuaguugcuauuuugguggugguggugguuuuggguggaugguuuuaauuuggguuugguuguuaugagauagggucucauuuaucucagacuggccuggaacucuguauagccuaggaugaaucggaacuucugauucuccugcuucuuucucucaaguguuggggaucaaacauaaggcugcaagcaagcuaagcguacucugccaaccgagcuacugcccagcccagacuuuccuguguuaucaucugugucuuuauaauugccuaguaaaucugucauuuuacuuauuuccacaugcuaauguaguaucuuagcauuaguuuuaggggaaaugcgcucucuuacuuuuguuucccugguaccuagaucauaaugacaaauguaucgauuuagauaagaaaccaaaaucaauucaaggucuuaaguaucaucaacaaugcauguacuucacuugugucuauacuagcuagccacugaaaaugucugagaauaguaagggagaugacauguaaaggauguguuaaagggggagaaaauucauauggggagacuagucuugauacuguuagaguaguucagacaagcaguucuauaguauaugaauacauuuagaaacaaaacuugucuuucauuuaguaugauccagagcugucaucucggcaauuugggguugagcugucccguuugacuagugaagaccgagcuguuccuuuagugguagagaagcucauaaacuauauugaaaugcauggacuuuauacugaagguauuuaccgaaagucugguucaacuaauaaaaucaaggagcuucgacaaggucuagauacagguaagauaguaugcccugaaucaagauguaacacuuauuuuaaaaguuauuucacuuuuauauucugcuucucuaaauguagggccagaacauuuugggguauuucuuugccauuuuugagucuuuggcuguauuuaguaaauucaucaaacauguaccaacaguaucaauuauagaaaguuuguuagguacuugaaaaagaucuuaaucuauuuaacagacuaauuagauccuguuauccuuaauuuauggggaagaaaaauguagguucaaggaaauuaauagaauguugaugcaagguaacaaagauucuuagaaacaguuuugagaacucagagacgucauuuaucugcauuuaaagguaaggaaucaaacugacaaaggaauucaucuaacugcuuaucaccaaccagugacaacaauuuaaucccguguucucugaauccauacuuuaaagugcuuccuguuaagucuucaguguccugaccacagacaggauucuuuguaauagauaucccuagugcccauguauauugaggacuugguuaugaguguaccauuuagucccaggguacauacaagggcuugccuuugguuucauuaaccaaauauauucuucaacauuguuaaaagaaaauaguucuuuuaaaaccaaacuuagauacacaaguugucuuugugugaccaagaacuccagugguuuuucucaccaucagugaaaaaugaauuauugugaaaauaacaagaaauuccugauaaaacuugauaaauucugacugagagaacuuuguauacgauaguuuggggcauuuuucagguuuggcucacucuugaacugugcaacaucaaacaggauguagauguuuccaucacauuuuccugccuucucaucuguaagaaugacuuaaauucagccuugcauuuaguccccuuagacuucugacgcauugguacucaagugugugguacguaguccaaucuacaagacagggacaaaaaucaaaagcaagcaaauagacaauucugcaguaguuugauccuucaugaaacgugaucuuuuacauuuguguucacaaacacagacaccaaaacuauuucuucaggguuagaaguggcaauuccaagcauggaaugaaauuguagaaaguauacauuguuuaauuaagaaauaugaaggcuucauuuaguagguuuauuuugugaaguguauugcuuaaaucuuuugcauguuugcuuuguuaccuaacucuugucucuaaauagaugcugaaaguguaaaccuagaugacuauaacauacaugucauugcaaguguauucaaacaauggcuucgugauuugcccaauccacucaugacuuuugaacucuaugaagaauuccuucgagcuauggguaagcacaagcuucuuggauuuaaaggaaaggccuauacuugguaaagccaugccauguguuauguucauuauuaaggccuccuauaguagauugauuagccuuuauggguccuaaauuacgcugugacaguuaauacaaaacugcaguguauuauuaccuauucaaauguuaacuuuucuguagacucuucuaaaaguaucugaauaagccacuuuguugcuucuuguaaguaacugaaagauguggguaucaaaacaguaaaauaucaagugggagauuuuaggguaggucagaacauucauucaguuguaaaucuaagcaagaacuguguuggaagcuaacugucuuguuuguuuucuaccagaugggcucugugcuuuagcuguguaguauauugguaaaaguuuguguagagguauuuaggaccugaggauuuauuauuaucuagaacaguugguuaauuuuaaugggacacuagucugucacauaacaacuaaaauacuagaacaccugugcccuugcuaucgucaagggcuguuggggaacaaacucaacuuugggaauucaaauacagggagcuaauagcuuagaaccaugguucugccuccccaagcuggagccaucauucucuacuguagaguuuccaucaggaaggagauacagcauguaacagggauauucaguauaauuugcuauuuuuaccauuuuucuuaggccuucaggaaagaaaagagacaauccgugguguguacucuguaauugaucagcucucccgaacucaucucaauacacuggaacgccuuaucuuucaucuaguuagguaacuuauucaagacagguucucacuauguaucuuuggcugucuuggaacucacuaucuagaucagucugaacuugaaaucauagcuaucuuucugccucuacuucucaagugcugggauuaaaggcauguaccaauaugccuuuuggggguuauggucaggauuccauuuaaaugaagaacuugaauauauaaagacagugucuugccuaggaauguaguuuagcaguggaauacuuaccuagcaugcacaaagcccuugguuuggucuuuacuaugcuuacaaaacaacaccucucaccuccaaugaaaccccuuucugccguaaauuggggggggggggguguuaagauuccuucaagcagaaaucugcuaaauugaguacuguugaguaaugcauaaagcaguucacaccucaugguggcacgaaguaacagccauuuugauauuugaacuagaagaguuuuugucucugaacauaacuuacuucaugagagcugaguucagauuauacucaggaauugacugacucuagaggcuucaggaauagauaucuuucccuguguaaauauuugaagugguugcgacuacagcccucuuucugguuagaugugggguauguugcaaaugccuuaaaauaucuacucuagggguuagagagaagguucagagguuaauagcauuggcugcucuuucagagaacauggauucaauuacagguccccacacaguaggucacagcuaucuguaacuccaguuccaggggaucuaacaaugucacacagacauacaugcaggcaaaacaccaaugcacauaaaauaaauaguuuuuugucuuagucaggguuucuauuccugcacaaacaucaugaccaagaagcaaguuggggaggaaaggguuuauucggcuuauacuuccauacugcuguuuaucaccaaaggaagucaggacuggaacucaagcaggucagaaagcaggagcugaugcagaggccauggagggauguucuuuacuggcuugcuucccuggcuugcucagccugcugucuuauacaacccaagacuaccagcccaggaaugguuccacccacaaggggccuuuuccccuugaucauuaauugagaaaaugccuuauagcuggaucucauggaggcauuuccucaacugaagcuccuuucucugugauaacuccagcugugucaaguugacacaaaacuagccaguacaaccacacaacucugcauuugcagacauguuauaauguugggcuuaaacagcagguuauagacuucucuuaauaggcuauacguugaccuauggcccagacuauuucaggaaguaguaaaaguccauuuuccagguaaagggauagcucuagggaagucuacagugucuuccuuaagcuuaggugguuaucuaugcaauacuaugggguugauggcauauuguccucucuuccuacuauuauguuauuuuauccucuuuucacuuguguugguuuugcuuuauuccuuaggauugcucuacaggaagacacuaaucgaaugucugcuaaugcuuuggccauuguguuugcaccuugcauucuccguugcccugacacuacugacccacuacaaaguguacaagauaucaguaagacuaccacguaaggccagccccuaucaucucuauaggaccuuaguugauguaguccauuuuauccaaauaucaaacacagcaaaugauuucauaaguuccagugcauuuaagcagauuauugguuauucuaaaacuuguuucaauuuaggacuacuuacaguuuuuaaauggauuucuguuuugucaaguucugucucucucucucccacccccgccccacucuccuagucuaaucgugaucucaucacucagucucuuugguuguaauaguucaguauucccguauuuuacccucaacuuuuuucuuuaauuucuuuuuuuuuuuucucaaucugacugcagcaggaacuuuggaaaauguaagggcuugagucuaucccccagauucauucauuaauuuauuaauugaucugggauuauagccugagaguuaagauuuguaauuauuuucaguugguuucuaaaauacagacaaaguugucaaccaccauucugaauuuuuucagggcucauaaaauaaaggaugcuuccuucaucccaaaacugucuaggacaccuaguuacaaaguauucuagagauacaacacuucauuugauuuacuucugcuuguaacaguuuuuuuuuccuaucuucccauuucagauguguggagcugauagugguagaacaaaugaauaaauauaaggcucgucucaaagacaucaguagccuggaauuugcugaaaauaaagcaaagaccagacugucacugauucguagaucaaugguaagaugcagaauauggagcacagugaaaaggugggagaggggcuucuugugacuucuuuuuaaguaauguuugugacauauauggguuaugcccagaggagcuucucagaaggaauacaggugcuaugaauaucugaugaucuuuaaauuauuuuagcuauguguacagaggacauuuaauguggagaauuuuaaaauauuuugaauaaaacauugguggcuuauaaucuucccugcuuaccuuacccauccaugacaugaaaacuuaacuuuaucuuaacuuuuucucuacauccuuccauuaucuuuucuuacucugagccauaucauuuuggugguucuuccaagauuccugauaguagagaacuuaaucauuuggaguuuaauaugaacuaaagcguuugauccauacagaagcagaauuccauuuaagagucuucuaugaucaaauaaagacuuuauuuaggauuuguuguuggguuugagaugagccuaccaagugauaauuucuuuuuucauuuauugacuuuuguauuuagugucuucuguugaaacuagugaccagcaauuauguagauaacucuaguuagcauuaacuaagaaucaguaggaucugugguucugguaaacaacugacagauuaaaguuuaaccuuuaccugcuuguuacuccuccuuucaguaagauaacauuaucacaacagccacauauuucagacccccagcaaaucucucaaaacaccaacuucccaguuuucuuacucauauuuucuagagcccagaaguacuucuuccauaccauuauaaucuguauuuagacugaugcugaaaugacucuccuucuuccuuuucuauuuaagcuuccuugcacaaaacagauguuccacagaggucuauuaauaggucuauuaguggaugaucucuagaaacaaacauaagcauaaccuuucccaggcauuaaauaaaguucauugucuuaguuaggauucccauuucuaugauuuaaaaacaaaaaacaacacacacacacacacacacacacagagagagagagagagagagaaacaugaccaaauugaugggggaaggguauauuccagcuuagauuuuucuaguccauuauucuaggaagucaggagagaaaccuaaaggcaaaaacuaaaaaagagacuaugggagaagugcugcuuacaggcuugccccuuauggcuugcucagccugcuuuguuauacagcccaggacaaccuacacagggguaauaauagccacaagaacugggcccuuucacacagucaucaaucccaagaaauguaucacaggcucgcccacagaccaagcugaugaaagggcauuuuucucaauagagauuuuugucuuugaauuacucuggcuugugucaggcugacauaaaacuagccaugcagucaucauaggauacuaucuaaaucucuuuccaggacuuuaaaaaugaaaauaccacuuaaaagugaaauuugggccuaagguguuacauuaguugguagagugcuugucuuuaagacaagguugaucccugagacugaacaaauagaaacauuuucucugugagaauuugagcucagucuucagagguuuaauuuauuaguacccuccuaggagggagaggaagagcuucuuuaccgcagaacuuuauucuaaagcaagugggaaagcuguggacccccuccuccucaguacugcagaaauggaugcauucaucccacugaacgauuuagccuucucuuuaauggagcaaugacauguacgugcuaaccuucugcuuuccuuuucauguccuuccuaauccagaaaccuguacuaauugcaguuagauuuaugagcauuacccgcaguucagucucgguauguauuaauauugcaaugugucacagucacuucacaccauugugucucauucauccaggaauuguucugcucugucagucaucugugccugucugccuuacauguucaaacuuuguucagggcccacuuuuugaucagccuucacuuacuuuuuucuuaaucucuuucuuuagguccuucacuuuccuuucuuguguuauacaggugaacagugaucauuugaaauacacuguuuuuccuucccagauaauccuccuuuagaauuucuguuuugguugaaucuuuaaagaggguggggucaaagauacugcgguaucaaguucauucugcucugugagcugcauuccuagcaaaucuacuuuauuauuugaaauaccuguuaugauuuucaguaucuaucaugaauaaugcuuauauaucugcucauaacugacucuggagguaucuucuaagauguagacauaaggcucuuaaauacuuguuuaucagacaggauucuguuuuuuacugccucuuuauaaacaaguguuuauacaaaggagaaaaugaaagguagaaagcuaaaacaccaagcuauguggaaacuaauuuuagaauaccugucuguguguacuuguugaucuauaaauacagauaccaauucuaucauaaaguugcccuuucccauggaauaucaaccuagcaacauguuaguauuacauuucuuuccaaugcuucugucuccuguaagaugaaguacacuuuauauauucaaauuucagucauaaccuugauauucuguauucuucuacuuccuuagagacuauaccuuuaacuggagaguuguaggguaagcuuccuuucaggguagacuagacuuuuaucuagaauuguaggauaaacagaauucuacaugcuguuccaguguuggguuggaaguucaguuugacuguuuuacacuacuguucuguugguaguccaacugaagaugagugguaaccccaaauucacucuccugacagucagaccagaucugucaucucccuuacauuguuaguaccauuuaaggcaguacuccucaaccuuccuaaugcuguaacucuucaauacaguucauguuguggugacccuaaccauaaaacuauuuuuguugcugcuucauaacuguaauuuugcuauuaauaagcauaguguaauauuuuuggauauugaaguuuguuaaagggguugagauucagcaucuucugucuaaauuuugacugauuacauugauaugguaugggaaccugucagggcaguuacauguuuuccaaaacuuuuccaaaacucgguuucuuagaaagcuuaaaguguuauugcugacaaaaacaaaaaacaacaaaaaaaaaccucacuugaaauaauggguucuuuuuaaaugaggucaaacaaaaucuaugcagcauacuuaaauaugaauaguuauacuuggucaaauaucccaguguuugaagauaaaagcagcugaguuguucagcuguuauucaggucauuguacaaacacuguuuacuaggacaacccucagcauggugcacuucucacuuuuaucauacacaaauaaaacaaccuagcccuuaaggguuaauaaugauaugauuuaacugaugagcgaaacuaauuuuuaccugugaauacaugguauuaaagacuaugaagcauagucauacuaguaguacaguuuuguaccgucaccuugaucauguagagguguugacaauuuguuuucacccacuauugcuuuuaauuaauguaaauguuaauaaguggaaagggugaauggcauuuuagcacuauuauaaaagcagugucugcauuguagauccuuugggagugcuuccauaccucuacuggaaaccugggaaccguguucagaaccaguauucuaaagcuagaaauauagcuuggugguagacuacuugccuugaggcccaaguuucaagucucagcuguaggugggaggaguaccauggcugguuuccucuacuacacagaaagucugaagauauaugcaagcauacaguggcuauauuuaaagucuuuauuaacuugcauuauaguuauagguguugggauaaaacuuuuaaaucagccucaaaaccuacuacaguagguagcucauuccucaauaucauacaaagcauggacuuuaugcaagacuaccaugcaaggcugauagaaaaaccuuagauaaagagccuuacuuucuacaaaagaagaucccuuauagucuaagaauucaguucuuuucugguuuuguggcucaaugaauggcaacagugaucuguuaucuucuuuuaccuuccuuguuugggguaaauuuucuguuaagauucuaagauuugugcuuucagcuaguuaugucuaguucuaucuauauguuaguuacacaguucuuccuuuugauaaauucaacccacagaaaaacugcccacuacguguacuuucuuugaucaucagaaaguaucauaacuccucaugugggaagugucuuccuacauacucaaaauccauauuucaucaucauucuucaacuauguaggcuuauauugauugacaauauuaaguuuauaucaugugaucugucucgcuauuccuuccgguguccuugucauuaugaacuuuagcagacucucuucacaggccauaaccauuuuagcacuguaguaugcuuucuagucaucuucauuguuaccuacuuaaaucuuaaggaaaaauugaacuguuagguaaacuuucaaaagguauuuuuacuuaggauccuuagcauuaaagcauuuggaccacgguguuuuuguuaguuuuaaaacccaacuaugggauagccuuguagcauucuaacccagaucuguuugucagagcucucuguuucugaaaaaaauuuuuuuccacugcauaguucaggcagcuuugacuugaguccucuuuccugagucuccugaguacaguagguacuaucaauauaagauggucaaaaucaaaacgguguacuagaaaacagcccaggcagcuaaugacuauugcagcaaauacucuugcuuucuuuguuguuugccaccaaaauugguauccuugagcacugugcuguuuuguucuugagucacauaugaaugaaguugucuaauauggauuguuuuguaucugauguuaacuuuauguguguaagacuuauccauagcaugccuaguuguggcucagcuuacucuuguugcugucuccugcuccagaauguacaugccacaguuuacucaguguacuguuuaugggcgguaggcuuuuguuugggggaauaggcaauaugugugcauuuuuguuaggguauauacauaccuaaggguagaauuucugagucaugggauauaucuuuaacaauuuccaaucaguguacaggaauuucugaaugauuagccaccuccccaauacuuacauugccauauaucauauauauacuguuagucauuauaaaaugcaugacacuucuuaaauuuggacuucuguucauuuaaugugcacaaauagguuuagccuucagauacuuuguuuucugaacaugcuaaacauacuuucuguuuuucuauacuugcuugggugguuuaauuuuuuuuccuaauucuuucugaacccugcauauaaucuuuugaucaguuauuucuguugcaagcaucuugcacucuguaguugguuuuucuacucucucaaaagugucuuucaagccaggcaugguagcauauacaagcagucauagcacuaaguagaggcugaggcuaaaugaucaccagaugaagccuggcuuucaaaaacuuucauuacaaguuucugccuuuaaaaaaaaaaaaaaaaagauaaaguaaauugugaugguuuguauauccuuggaccagggaguggcaccaucugaagguaugaccuuguuggaauaggugugaccugguuggaaugggugugucacuguggguguggguauaagauccucacccuaguugccuggaagucagucuuccacuagcagccuuuagaugaagacauagaacucucagcuccuccugcgccaugccugccuggauacugccaugcucccaccuugaugauaauggacugaacaucugaaccuguaagccagccccaauuaaauguuguuuuuuauaagacuugccuuggucauggugucuguucacagcaguaaaacccuaacuacgacauaaguaaaugaaacugucuugauggacagagguuaauuuuaguaauuaguacauuaguaauuuaguaauguaguuuuauugcuacuugauguaguuuuaggaauuuuucuuacuaagguuguaaucauuuuuaucuucucaaagcuucauuauuuugucuauauggcuggucugucuuaaggugcuucauuuugacuaucauacugacagugcuaauuacuuuaucuagcuuuuaaaaguuguuguauugugugugucauauauaagaggcauugauaugcuauagcauguauauggaagucagaggacuuuggggagucuauucucuccuggaacuuuguuuugagacagggucuuuccuguuucugucauguugcuuacuccagacuaucuucccagcaauucugucucugccucuuaccucacuacagauaugcuggaauucuagaugcaagcuacuacaucuggcuuuuuaaugugaguuuugggaucaaacucaaguugugaacuuguguagcaaaugcugagccaccucacugacccauuuacuucaauuuuuuaauaaacugguuuaaagagucauccucucuucuuuaguuuuuacugcuugugacucauauugucauacaaaguaugaagucaccuucacaaaauacccuggguuuuuuuguccgcguguuuguuuuuggagacugcucuguguaaauugcuuuuuagaaauuugauguuucagcgguauugauuuucccacccaugaacauaaucucuccauauauaucauuaguuauuuuaaguguuuuauuuuauauguugagaucuuaucuuuaacuuuaguuauuaucauauaacauuuuaaaauaucaguuuuacuuaaaaguuuuauuuuuuguugcuuguugcauaaaauauccaauuuacuuugguguaauuaucuaacaaguagugacuuugcugaagucaccuuuucuaauaauuguucugaguauaccuuuggguuuccuagcuguagauuuuuaaaauacaguuuuauuuguccuuuuaagguccuugaaccuccucuuuguuuuucuaaagaaacuagaaccuucaguacaguguugauugaaacugugguagugaucacucuuagcauguccaccaccacuuagcaugauguuugcuauagaauuuuuauucuuuaugauauuaagcauguuuauuugauuccuaguuuucugaguuguuauuaugauguaaugcuaacauuuauguuuuuaauauauccacauuuaaguauuuuaugccauuuugaggugucucacaauguagaacaaacuggccuagaaauugcagugaucuaccaccccagcuucaggagcacugguguuaccaugccuggguuaggcauuguaaauuuuauugauguuaaauacucauuucccaguucaguuuguaaugcaucaagauauuuugcuguguuuauguauaaaauuguccuuuaaugcccuuccauuaaaugaccuuguuaauguuuuacuaauuuguguaaaaacaacuuaugccaggcaugguggcacaugccuuuaauccuucagaacuggggaggcagaggcaggugggucucuguaaguuugagccagccuugucuauauaaugaguuccaggcuaaucaggacuacauagucagaaccuuccaaacaaaccaacaaacaaaccaagaaauaaauugggauguaguccuuuuuauuucuguagaagaaugcaucuguuauaucucuuacacgucacuguacauacaugcuuaaucccuuggugcugacuacagcuuugucuaugucuuuacuucugcugcuaauuuacuucagaucuuuugaaaucauuaagaaaugauuauagauauauauuagaaaugcuauaaucuucauaauuuuagcauuagucacugugaaauauacuuuuauuauaaaugacaccucucacuuuaugcucuuuuuaauauuuaguuuuuugagauaagaucucucuguguagaagggagguggugaggcacgccgauuucugaguucgaggccagcuuggucuacagagugaguuccaggacagccagggcuauacagagaaacccugucucgaaaaauuaaaaaaacaaaaaaacaaaaaagaucucucugugugguccuggcugucauggaacucacucuauagaccagaccggacuggugucaaaaucagagagauucuucugccucugccuucuaaggguuggagugcugagacuaaggaguacaugcccuauagcuuuucauuauuuuuuuaacuuuguuuuuguuugagacauaauaucaaucuggccuggaacucacuauguaguuuaggaugguuucaaccucacagccucacaagugcuaggaugacagaggagccaccacauccagcugcuuucauccauuuugaauaauauuuuauacauagcccuuaaaugucauguuucugacaguuuuccaauuuuaacaagagcauuugaucuaucuauauacguuuuguugauacuauauuuggauuuuuguuuuguuuuguuuuguuuuuuuuugagacaggguuucucuguauagcccuggcuguccuggaacucacuuuguaguccaggcuggccucaaacucagaaauccgccugccucugccucccgagugcugggauuaaaggcgugugccaccacaccgggcuuauauuuggauuuuuuaagauuuaaaaaaauaauguguauaaauauuuugccagcauguacaucuguguaccacaaggcaugccugguaucugaggaggccagaagguggugucugaugcccugaaacuggaguuacaaugguuguaagccaccaaguagauucuggaacugaacccaguuccuuugcccagagcagccaguguucuuaaccacugaaccauacccagccucuguguuuauauuuaaaucuguuuuauuguacagguuuuguuuggccugucauucguucccuuuucuuuucuggcuaccuuuauucuuuuuuuuuuuaauuuuuuuccuugccucccucuugauaguaucucauuuuuuauucuguuagaggucuuagauucuuuuagucugaaggucacaucauuaacccuuucaaugcucauuaaucaauacuuuuuaucuuuuuuccuagauaaagugcaaguacuuuaauaugcuagucauugucugacuucauugcuauuagauuuuuuuuuugagcuauuuguaaauuuugaaaaccaaacaucugguauuauaauauacauugucguuguguguuuucauuccugcuucucguaacuguuguucuuggauguuucauacuugccguugagaauaccauauucucauaucaaugucuacugucuuuuugccucauguucauucacauaguauuuaaacauaugacggaucauuucuuacuguuuucucuuuucccaucauuuaugaaguucccuuuugcauuuguuuguccugguuugguucuggauuuucuuccgaucuaacuuccauucuguuuagugaaauuaaguuuuuaccagcuuucauuugcauuguuuuaucguguuuuauuccugauuacuuuuaauuugaaaaugauuuguagaaaguauuuugaggccugggaugacauugcuuaccuacaaaaaauaacuuuauuuuucugacagauccuuaggcacuagcaguuguaucauuuuaauccagucuuagaaguuuaacauuuguauaccaagcacacacacacccuuccuuuagaugaccugaagcuaggccacuccuucugugagaacugugguaauuuuaguuuaccuuucugucuagaauccaacuguuugagaucccaguguuaggcaugaagguucuguggggcagcaacucauaucucuuuauucuauacuucagggguugucaaguuuuuuucucugaagggucauagaguaaguauuuuagauauuguaagccauaaacccuguuccacacucaccccugccacuguugaacaaaacagccauagauaauuaaugaguuuauucuaguaaagacauagacauguauacaggcuagauguaacuccaaacugauacuauaauugucaacuauaguguguucaaagcucugcucagacucugccaccucuucugaaguugcaaaucagcaguaacagccgggccagccuuuccugccccuucacgauccagcaucuacguguguguucauuuuuaauauugaucuaguuguuccuggcaggagauuuaaucuuuugaacuuaguuggcuguuaccagaaaguaaagauaaaaguaagguaaccaaguuaaaacaauagguuuuuuuuucccccuuccucauuucaagaauagaaaguucuuaagaaagcauauuacaauagcaaucucauauaugacuuuuuuuccuccaaaacuuaaguguuugggcauguuucucugaucuuccuagagagauuguccugacaagguugaagcuguuaagcauugucagaacuucuuauguugaaaauaaugagugccuucaguguuagugugguggccacuaucugccuguggcucuugagcaccugaagucuggcucccauggucacagaauucgguauuaauuggcuugaagcuguuuaguauacaguuagauuaaaagaagauucucaucgcagcacaaugguucuuauuacccagagcuagaauguguguccauuuuuucaaugaucuugauauaauucuuuuaaccuaauuuguuggacuuuugauaucuugcuaaauauccuaugccuguugaauccuaucauucucaugaugugauggaaggacacuuguuauccaaagucaucaacauaaaacuggcagacuuuguuuacuuucuaaaaugaaugcucucugcagggaaaggggcguauacaccgaggaaacuauccaaguccaucuuccccuguuauaguccgauugccuuccaugucugaugucccagaagagaccuugucuagugagacagccauggaaacugaccucacagaccagcagcaagcagcaaugcagcaggaggaaaaaguacugacugagcagauugagaaccuacagaaagaaaaguaagugcccagagaggauaccaguuguuguguuuccuuccuucuaccuuuuuuuuccuuauucauuaaauaucucuugugucaagcacugugucagaugccccaggggaucugacagagacuuguugccucuacuaaggguaaguguggaaguuuucaccucagggaaggaaauuccauaguauaggaaucuugcugcugagcaguacuagaauaaggaggguacacauauacaggguauaccagcuuaguucagauucauaaggcaauggacaauggagagcaaagaugagguauuauaguccugacgggucagggaccagcuuccguaagcagauggguuuugcaaaaagaaguguacgagucccuugacuaaauaagacaaaguuaauuucaaccauagguguuaguugcaccuucauaaaugaauguuacuguuuaaaaaucaguaugaccaugggcccaacaacuagauagaacaaggcaguacuggguucugggauacuggguagagaaaucuguuaugauuuaaaagagaaaguuaagaaacucuguuaucuccaucaucacucuggcaggaguggguugacauugauuacucucugagaauuccuaaaggucuugagucccuggagcucaucucgucagucugagaacuugauucacgaagaaucaagaaacuuuaguaucagaauugguucuagaauuuagggcaacugaaaagcagcuaagacucagcgguggaaaaaguaaggcaguaguuacuaaccaggggcugaaaagaugacccaccucagcucugauuaacaugauauugaagauagagagggauaaaaaggaaauuguuaggaaagagaaaguacagaaguauaagcauaaguuucaaagaugugacugcuuuuggaaauagugagcuacugggaaggcuguacuugaaaagaugggucuguggauuucaggcuacuuaaagaggaaaaauaauuagauucagagcuggcuuauuucuaggaauugacaagcuguaugauccguucauugaaggaaguuaauuguguggagggaaaacgcuggagacauaaagaugcuuugguacuaggauuuugacgugaguuuuguuucuuuuuaagguacuaacugaauuuugaucaaacuguggucagugcccuaauuaagaaaauaacguuagaagccaaaucuuaguaacuauaaaacaugaagggacauuacugaaacaagugggugauccugauaaauuagaauguacuguagccagagauaaugcaagcuucacaggucaguguuuuacuuauccaaaagccuugauauggucaagauagaagauaaacucuuuaagagccaaaaagaaauuuggagacaaucuaguuuguuuucuagaugaggaagcugaaauccagaaauuaaugaauuuggaaucuugaacucaguccaaaguucaucucagaauaucucagcauuuauagaaacuugccucaaccuacccacccccagucccaugacuacucauagauuuguuaucaccuuguacuuucauccauacugcuuuccugcuuuucaucaucaccauggugggacaguaagagaugccuuugcuauuuagcuucuuugcuuugauggaaggucuuccugucaucuuucucauaccauguuaauggauuuguugauugugucucauagggaagaacuaacauuugagaugcuuguauuggaaccucgugccucugaugaugaaacccuugaaucugaggcuucuauugggacugcugauaguucggaaaauuugaauauggauucugaagguaccauuuuuugagauauucaauaaauuaauauauuauacuagaaauacaguuuguuuuguaaaaaggaauaagaauucccaacuuaaggcuggaggggguggcucaguacuuaggaacacucacucggugcucuuucagaggagcuagguucaauucccaguaccuacauggcaguucauaauuaucuguaacgccagucccaggaaaucugaugcccuuuucuggccucucugaggguaccaggugcucuuuuguuguauauguuguauauacauauaugcaggcaaagcauccacacauguaaauauauguguguguguguguguguguguauguauauauauauguguguguguguguguguguguguauauauauauauauauauauauauauauauauauauauuuuuuuuuuuuuuuuuguuuuuguuuuucaagacaggguuuccuggcuguccuggaacucacuuuguagaccaggcuggccucgaacucagaaauccgccugccucugccucccgagugcugggauuaaaggcgugcgccaccaugcccggcaauuuuuuuuuuuaauguuaaaaaaaacuuucucagguucagucugguugguggugcauacuuuuaaucccagauucaggagacagaucgcuguaaguuugaggccagcuccaagacagcuuuuacaauaaugauucugcacaaaagagauugacuaaauccucagaacuuuuuacccauucaguuucacaugugaacaguagcuucauuacaugauguugcauagguagacacuauuauguacaacuuuauuuucuguuuuuagagagaaguuuagcccuuagcucccugaaagcagcuggcaagucugaaccuucaagcaagucgcggaagcagcuaagaaagcagccagacucucuagacuccgucagcuccuccguuucuucaugucuaucaaacacuacaucaucucauggcacuagaaagcgauuucagauuuauuccaagucuccauuuuaccgagcugcuucagcuugugaggcccagggaacggaaggaccgcuaggccaagccaaaucccuagaagacaggccucaguucaucagcagaggaaccuucaacccugaaaagggcaaacaaaaacuaaagaaugugaaaaacucaccucagaaaaccaaagagaccccagaggggacagucacaucuggccgaaagaaaacuguggacucagacugcagcuccacacagcaacuaccacuguuuggaaauaaugaguuuauggucuaaauggacagauguguccccagaucucaucuuuggggccucuucuggucaccuuguuuguaacagucgguccuaaugguccugccucguuucagcagacagauuguaugcuggaucacugggcuucuggcaaaaguggccgcuuugaaguuugcuagggaugggccagcugugccuuggcugcuguauuugauuugagaguccacugaacaaagccaccugggaccugggggauuuuggccaauaauaguugcuucuugcccaccuacuuuucccuucccacagauaguugcugaacuagggagcuauugugauccugagguaugcucucauuucuagcauuuaaagaaaacauacaaaccucuguuaaccauggaaacaaaagcuuuugaguuuguauuggaauaguuaggaacuguguuagaauauaaaaauuuccccaaggauuuauaagcccucuauuuuaaauuuaauuacaaaacauucaauguuaucuuuuggaaaccuaaacugauuuccauuaagcccagagugucucagcuacaggaaugugaagagaccaugcuuugucucuuguugauauuugguauuauagucagugcugguuuaacgcuugguuaauuccugccaaauauauuucaugggguaaaguucugguagccauacuguauugguaugcccugauuauagaucagacuccucuagguuuuuguuugaaauaugucacaggcacauuuagguaauuccuaaaugugaacgcaucauccugauugauccaagcuuuucuuuuuguauaaacugaagacuguauccgagccuacucaucugcugguggaguaccaccauagauguaaccauuucaucacuuaucuaggaguacucacauacauacaacugugcaugaguguuauagaaaaagccgccaaaagaagucuagaaaguuuaaauaugaucuauuuaauuuuugucuucuuaucagaccaucaguauuagaugaaaaaaaucaaggacuacuugaagcuauuuuuguuaauauucuuguuccugaaguuuacuguaaauacacauguauaauaugccuaguucuuuuuaaccuugugcuuuccccuuauucccauugaguuucucccuacagauaagaggccauuagacagguggugagagccauucacccccggggugaggaauaaguaagggcaucuuuuucaucacugguaguuuccauaaguuauaaugucagaagcaucauguacuagcaauugugggacuagaacucuguuuuugcuauuuauguuaugugaagugaaacaugauaccauuucuuaaguauaugaaauguuuauuuuuaaagucacuaaauacauuuugucuaacuaccacaugcacuguuacaagaagagccuuuaauauccauaaccugaauuuugguuuucuccuccuccucuucuuuuccuucuccuccuucuccuuuuuugguuugaaguuacaggaauagaagucuuuuguuaaggcaaggucucuccuccuacacaacacugaaccucacgccacugcaauaguggucauuggccggcucuagagaugagacuuguagcauuauuuugcacagcagcucaugguggcuggagucuucccucuccaugguauggguucagcauugagacacaugaaggaaguuuugaaaaucuccccgaugaugauggucauucaguaaaugcuaacuuuuauaucccuccagcauuaacaauaagaguuuuggaaacuguucuacaggaagccagcauggcugugauaugguggggugcuguuuugggccuuucuggcuauacagucuguuauaguauuuggggaaaguagcugcuacugggugguaacuguugcuaacuguugcucuccacuuggcucagaacaauuuccuuuguuucagaggaauguccuggaacucagcacuugacacacauucucccuccuaaaguuuuacagcucaguuuuuuguuuuuauuauuucuauaaaguaaauuuggggcugagaaaaaaaaaaaaccaaccuaccuacauaggucaccuuguaggaacuagguaaucaauauuaaagacuuuauaauuuuucucagggaccuaaaaccugaauuugaauaaaguuaaauaaaaacuuuuuuuuucauuugcuagauuuguggauuuuuuaaucauuuaacaagccgccaggaugggugggggaaauccacacaacuauaagaaugucucggcaaaguguaggucccuguaaggaaaagagugcuguuguucuuggguuagcaggcacuauugaucugauagagacgaagccauaacucaguagugucagaugucuggcuccaucaguucuuaacagagccucugaauccucacccaugauacagauccacauagaguucacuguuaugucugucuagcugcuuuucuucagucuuaaaaugcaccaaaagaaacucucuggcagcagcagagugucucacauguggaaccugugcuccaaacuucagagcauccuaguuaugucacauacuucuaguccacaauaacuccuacauuuuucccuacucauuaauaugugucuguagcugugugucauagaaaauguagcagaagcaaacaauacauuuugcaucacagacugaagcaaauuacagcaaaugcaggcaggauucagggaggugacacacuuaguuugcacauauuuguacuuccugccauuuugauuauaugaccauucuaggucauacacacaaacggagauaugaguauugcuaggagagacaaaaggaugugaguucagggcacaggucacuagggccagcucucaggcuuuggaaaccuaucacucucaccuugcauaggguaugaagacuguucugugucucaaucaaagacagugucacggaaaugugcucauaugaggugauacauugaggcuguaucauuccaccuuugugccugugagcuguguuuucaacuguaacuaauaagcuagagcgaaggaaggauucucaggugugugacgcugagaguuauaacuggagaaagaaguuuguccagauggcuuucucacuuuaaaaauucuugguggggaaauagaugugggcccugcauucuucuguguugaaugguguguuauaugcacccacacacuugugauaacuuccuagcacugugucccaacaccaugcuggccuuaguaguaaaauuuuuuagguauuuguagaagaccugacuuucugcaucccuaagagaccacauuucucuggaacauucucacacuuuugguguuaaguggguaaucuccaguguauuagaucuuacugaucuccugguuuaaacuucaaaaaagcccuagcaaugggucugucaccuugucaccuguccacucuuaaugccuauuuaucagcccucuuaggucauauaagaguugcaccucuugaaccaaguauuuguauuuacuaugggaaagguguagacuacagauuaguauuauauuauuuuaauggacucaaaguaauuuauaaguauggugaguguaaaguuuuaaaauacuguguauuauaaaaggacacaaccugugaaauaugccacuuuacuguuuaagaauucuauaagaaugacuuauucacagaacugauuacauuccugaugaaaucagcagcacuuuguaauuuccuuuuuuuuuggaagggggcaagacauuuguauaaagugcaguuugugucacucagaguaugcacuguauagcuacacaaaagcagccugcugaacaaaucacuccauggcucauuaaagaacaaagcuuccagaagugcaauaugugugguuuguuuucuggcuuccaaucagacucauagcccaaaggaacaccacuuacuacuuauacuaauaaaauuaaaggaaaggauccaauucccaacugaugagugcagaaaugacagcuguuagaacucaacugaagaagagcaagccaaggucaaggagagaacuagaggcaccuagcagucacuuccugugaagaaaaaaacccaaacaacaauguauaguugaauuuuccagugagggacaguugaaagaaggacuucagaaucuuaugagauucagaggccugggacaaagcuacaguaaaaaacaaauauucugacaccuggagacccugccucacaacagggaaggaaagcugaugcagcuuuauagagaugcagggggaaaagucucagcucacacaaccagucuggauucuggcaaucccagcuguuggaaugauucacaacccacaccagcuuagauagcuaaccuaaagacuguacaguagccuugcuuugaaaacaauucuuauaucaucuuccugugagcccucagugcuguaacuaggagcuaccuaagaagaggacuucuguuuuaaucaggauggcuccagggaucagaaaaccuuacacauuccuggcucugagaacccauagauguauuguguuagcucaucagcuggcugccuugugaucccaacguugcuggagaaguaccucugagucaaaugcacugcugaguacaugguacaaaggggaugguaguagaggguguugccuauagugucacgagugacugcuuuccaggauaggggugggggcauauugcgcuaucugaagauggcuaggcaggcagacccuuuaguggugauaggccugagcucuauagguucacaagcuagguuccuaaauccagacgcuuagcucucuuaagucuugagaacaacuaggagcuuaugguucucaaccuucaaagcuuuggcugcucaaggcagaagcuuacuucccuggacuuaugagaaguaacaucuaguggcuggaauucuaacucgcaagugguguuggaacccuuggcucuugaacccuucucagcucucuccagagucagcuagggaguggcaugugcaguccuuguagacucggcuuccucauccauaaucagagcuucuccaccugcagcuccuccaccauacuuuauaguuugcuucuugcucucuggaauucuuagccaacccuugauaucauaguucuggguuuucugaggguauuagagccuucagaacucuggaacucaucaccugccuucucacugugccacccggguauuugucuauuuuucaugccacauguaggcaaaagaccauucacaagauacuuuuauuagagccuaaugaugcaauaccuaauagugcacaagguaggaggagcuucccagguuagcccagggaguggaaaauagccugcuuuauacagcaagaugaugauuguggcaugcuuaugcacagauuauaauuuuagcagucacagcuaugcaugugauucuggcucuaccaaucacaagcuucgcugcacuaauguuuugcugagucaugucuucccaucucagcucugagcuuucugagagaaucagagcccucagcuccuggugacucugaaacuccagccaccuccucuguuccugaaugagaauagcugcuucaagguaagcuggcuaaucuaaaacucgccaaaaggcucguuuucccuagaguggcaucuucuacaguuggugcuuguugccuagagccaggcuuccugacucgagagugauaaauucuguagugguguggaugcaguuguccuaccaacuguagugacuuuuccucaguguucaaaacaggcagacagguuuaccaaagaaagggcugccuagaugcuuggugggugaagucacuuacagccaaggcuaaugaacuaacucuuuuaggacccauaugguggaaagaaaacugacucccacaaguuguccucugaucuccacaaguuacacugacaugugcaccuauacauauauacaaacaugcaagucaauaaaugaggaucauagcucuaguaauaaacccaaagaaacaguaacagauggaauuauuguuuuaaagcucaguaaaauugaagagaacacaaacauuuaaauaaucacauaugacaagguaggauaugaauaagauacuuggcaaagaaaaaauuaaaaaaaaaaaucuuaggaguaagggauccauaauauaucaacuaaaaauuuugguugagagcuucaacaauagacuagauuaggugggagaaaaaauguuuaugcuugaagauaagucuucuuaaauaacucauggggguggggagaggaagagaacaaaucuguggcauacuauuaaaucaccaaacauccaugaauuaucuaaaggcaaagaagcagacauuugcaguauggaaaaacucucaagggaaauaguaguggacagcuuuccuaaucauggauaagacaugggcauccauaugcaaggggcuuacagauaugaccagaaaggaccuuuaccauaauauaaaauucaaaauauaagaauuuuaaagucuacaagaaaaaaaugcacaagacaucuaagugaaaccucacuacacuuacaguaaaauuuccagaagaaacccuacaggauaccaggaaauggaaugucacucuccauguucugaaagaaaaauuacugccaaucaagauuauuauacccagcaaggcuauccuucagaagauuuucugagaugaggagaagcuggggaaauucaugacugcaugacuuaaggagguacugcaucuagaaaugaaaggaagggaacugccccacaacagcaugugaaagugugaguuccacuggaagaauaaacacacaaaaacggaaucagacuaucaaauacagcaagaaaacugcaaagaugucuaagaugaggaaaaguaaugcucugaauaacuagaaaaaucaagacaggcauaaauaaguuccuacauuucaauaauaaccuugacuauaaauggacuaaauuauucaaucgaaagcuauagucugaucaaauggauuuuuuuuuuaaagccagauguuauggcacacaccuuucaucccagcacucaucuggaucaccaugacuuuaaggcuagccaggguuacauaguggauaccagaccaugcaagguccugucucaaaaacaaaauaagacuaaaaaauaugcuguguauaagaaacuuaguucaucaguaaagucacuggaaaugaaaggcuggaaaauauuucaagcaaaugggauccuaaaguaagcaguacuuuuuuuuuuuacuuuuuuuuuuuuuuuacuuuuuuuuuuaacuuuuuuuuguauuuauuucauuuacauuuccaauguuaucccaaaagccccccacacgcuuccccacccagccacucccacuucuuggcccuggcauuccccugugcugagucauauaaaguuugcacaaccaaugggccucucuuuccacugauggccaacuaggccaucuucugauacauaugcagcuagagacacgagcuccggggguuacugguuaguucauaauguuguuccaccuauaggguugcaguucccuuuagcuccuuggguucuuucucuagcuccuccauugggggcccugugauccauccaauagcugacugugagcauccacuucuguguuugcuaggccccggcauagucucauaagagacagcuauaucuggguucuuugagcaaaaucuugcuaguguaugcaauggugucagcauuuggaagucgauuaugggauggauccccagauaugauagucucuagaugguucauccuuucgucucagcuccaaacuuugucucuguaacuccuuccauggguguuuuguucccaauucuaagaaggggcaaaguggccacacuuuggucuucguucuucuugaguuucaugcguuuggcaaauuguaucuuauaucuuggguauucuaaguuucugggcuaauauccauuuaucagugaguacauauugugugaguuccuuugugauuggguugccucacucaggaugaugcccuccacguccauccauuugccuaggaauuucauaaauucauucuuuuuaauagcugaguaguacuccauuguguaaauguaccacauuuucuguauccauuccucuguugaggggcaucuggguucuuuccagcuucuggcuauuauaaauaaggcugcuaugaacauaguggagcauguguccuucuuaccaguuagaauaucuucuggauauaugcccagaagagguauuuugggauccuccaguaguacuauguccaauuuucugaggaaccgccagacugauuuccagagugguuguacaagcuuguaaucccaccaacaauggaagaguguuccucuuucuccacauccuugccagcaucugcugucaccuguauuuuuuaucuuagccauucugacugguaugagguggaaucucaggguuguuuugauuugcauuucccugaugauuaaggauguugaacauuuuuucaggugcuucucugccauucgguauuccucaggugagaauucuuuguuuagcucugagccucauuuuuuaaugggguuauuuguuuuucuggaguccaccuuuuugaguucuuuauauauauauuggauaucaguccccuauuugauuuaggauagguaaagauccuuucccaaucuguugguggucuuuuugucuuauugaugguaucuuuugccuugcagaagcuuugcaauuuuaugaggucccauuugucgauucccgaucuuauagcacaagccauugcuguucuauucaggaauuuuuccccuguacccauaucuuugaggcuuuucccuacuuucuccucuauaaguuucagugucucugguuuuauguggaguuccuuaauccacuuagauuugaccuuaguacaaggagauaggaauggaucaauucgcauucuucuacaugauaaccgccaguugugccagcaccauuuguugaaaaugcuguuuuuuuccacuggaugguuuuuucucccuugucaaagaucaaaugaccauagguguguggguucauuucugggucuucaauucuauuccauuggucuacuugucuauugcuauaccaguaccaugcaguuguuaucacaauugcucuguaguaaagcuuuaggucaggcauggugauuccaccagagguucuuuuauccuugagaagaguuuuugcuauccuagguuuuuuguuguuccaguugaauuugcagauugcccuuucuacuucguugaagaauugaguuggaauuuugauggggauugcauugaaucuguagauugcuuuuggcaagauagccauuuuuacuauauugaucuugccaauccaugagcaugggagaucuuuccaucuucugagaucuucuuuaauuucuuucuucagagacuugaaguucuuaucauacagaucuuucacuuccuuaauuagagucacgccaagguauuuuauauuauuuguggcuauugagaggguguuguuucccuaauuucuuucucagccuguuuauccuuuguguacagaaaggccauugacuuguuugaauuaauuuuauauccagcuacuucaccgaagcuguuuaucaggcuuaggaguucucugguggaauuuuuaaggucacuuauauauacuaucauaucaucuccaaaaagugauauuuugacuucuuccuuuccaauuuguauccccuugaucuccuuuuguuguagaauugcucuggcuaggaauucaaguauaauguugaauagguagggaggaagugggcagccuugaguacuuguacuuuuaucugagaaacuagacuaaaagaaaaagaugucaaaagagacaagguugcuaaauauugauuaaaggaucaguucaucaaaguagagaaagaaaaauggcugggacuugcuaaaaaaaacacagccuagccaaaaaacacaagcuguagguucaagagauuuaaagaacaaugcagaaggcaucugacacccuccucuguucaugaaauguguacaaguacacaccaucagcacauacacauacaauguacacacauguaucacacacacagagacacagggucaucagagggguuggcaggucgucauuugcugccaagccugaugcccugaguucaacccccaggaucuaggcaggaucuacguggugaagaagagaauaaccuccugcaggcuauccucugaccuccacacacucacugcggcacacacacaaauaaaaauuuacauaaaauaaaaauuugaaaguauaugauuguaaauacaugcacauaaugcuggagccccuaaguuuagaaaauaaacacuggagagguagagaggaaguucaguacuccacucuaaucaacagacaaggcaucuagacaagaaaaaacaagcaacauccgagucaaauuauucuuuacaugagauggaccucacagacacguguagaauauuccauauagaggcugcagaauguacauucucaguuaaaucuucuuuuggauauuccaaauguuagaggccauagaacaaauucuaauaaaucacaaacauuuuuuugugauguuugugguuuugaucucaguagaauggcacuaccauucaaugaaagguacuucagaaaaucugcaaguucauggagaccaaccaacaauaugucacugaagaaguuagaaaaaaaauguaaauuucuggaaacacauggauagaaauguaaauccaacaugccagagccugugguguggcugcacacuccgauauagaagugggaagugucuaauggugacuucacaccuuuaaaaagaacagggggaagguuuuugaacaaucuuugcaaagacuuacagaagcaagacaaacccaaaauuaauaggacgaagaugauaaaaaucagaguagagcugagcauaguagcacuugccuuuaauuccagcacucagaaggcagaggcaggcagaucugugugaguucaaggccaacuggaucuacaaaucgaguuccaagacagacagggcuacacagagaaaaccugucucagaagaaaaaaaaaaauucaaguggaaauuauagucuccccucccccagccugaaaccugcuugcuccgggguggagcuuccugcucauauguucugccacgcccacugcuagaaccugcggagccacacacgugcaccuuucuacuggaccagagauuauucggugggaaucggguccccucccucuucuuuuauaacugagugucgcaacaguaaaauuugagcuuugaucaaaauaacugucuuggcuacauuucuuucucuugccaccuagccccucuucucuuccagguuuccaaaaugccuuuccaggcuagaacccagguuguggucugcuggccagacacaacaauuggcgccccacguuuacuguugcgacacucaguuaugaaggaagggggaggggaccugauucucgccgaauaaucucugguccaguagaaaggugcacauguguggcuccacagguuccagcagugggcguggcagaacgaaugagcaggaagcuccaccccugagcaaguagguuucaggcugggggaggggaaacuacaggaaauaaaauauagaguaaaaagacaguaucaaagaugaauaaguuaaggaguaauuguguugaagagauaaacagaaccgacaaauuuuuagcuuaacuaaucaagagagaaaaagacuaaagaugagaaagacauuucaaguaauaucacagaccuacaaaggauugucggggguugcuuugaagaguugauaugcuguacaacuggaagaucuauaagaaaagaacaaauauuuggacacauaugaccuaucaaaacugauccaagaaguucagaaucagaacagaccuguagcugauaagcuugaaucaacauuaaacccuuuucccaagaaagaaaauuacagaaucgaguggcuucacugcgaaauuucaucaagcuuuuagaguucucccaggcuguuauuccacagcuuuggaagagagggaauccuuucaaacuggcuccaucagaucagcagcuuccuggcggacacagaugcaaaaacccucaacaaaaggagagagaaugauauucaacaggacaacaaaacaguccuacaacaagaaggcaggcagggugggacacccugagaacccagcccuguggacggaagcaggaagaacaagguuugagauaggccuuagcuucauagugagguccagaccaauccauaaugaaguuaacauuaucaaguuaauuucauuccagggaugcaaaaaaugauuccauauauucaaaugaauaaggcaugcaaacaggguacagaguuaagaaucaaguugauguagaaaaaguauuugacaaaauuuuaaauuucuuuaugauuuaaaaaacaacaacaacaaaaaccagaucuuacuggccaguggugguacaugccuuuaaucccagcacucaggauucagaagcaggaucucugaguucaaggccagacugaucuacaaaguaaguaaguucuaggacagccagagcuacccagagaaccccugacuugggggcuugggggaggcacuaaacaaauaagguacagaggaucagcccucaaugugacaaucuuuguagaauaaauucacagccaggaucauacugaauugggagaaauggagugcugucucuaagaaacaagacaaggcugucuguccacuuucacagaucuuauucagcacaguacuagacauuuuggccauagcuauuaggcaagaaaaggaaagaaaaaagguaugcagaugggaaagacguaaaauguccauuggcagaugaauguuuuuauauauugaaaaccgcaaagucccccaaaagaugauuagaaaugaagauauauaguaaacuaucgggauauauauuuuuaaaaacccaauauaucaaaucaauguauuuccauaugucaauaauaaauuugcugacaaugaaaucacucuuauucacaauagccauaugaacaaagcuaaggaaguaaagauuucuauaaugagaacugcaaagcugauggaagaaauggaagaaaacauuuuaaaagacucccuuagaaugagggguuuacauaauuaacauuauuaaauuacauaguauacaaagugaccuacagagucaacgucauucacaugagagaguaucaugaugaacagauccuaaaauucauauggaaacagaaacaauuccaaauagccaaagcaagcuuguuuaaaaaccagcaagacguuggaggccucauaauaccucauuucaagacauuuuacagagccacaggucaauaaaacagcauggcauggacauacaaacacuuggaccagcaggacagaauccugucccagacaggccuggacacacaagaucagucgacugguucaaaaaaaaaaaauggcgcuggggacacuggacaucuucaagccaaagacagaaacucgacccagguucuucacuuuguacagcaggaaaucaaaauguaucuaaagcccaaauuugaaaucugaaaauuuaaaacuacugggagaaaacauggaggaaguauuucaacacauuggcgcaggcaaccuuguuccuggauaggacuccaaagcacaggaaauuaaggcuaaaccugacugacugcaauaaacuucaaagguuccaccugacaaugaacacagcgguggccgccuccaggcuguggaugcagcuccgugcugguuggugcagcuacgagacuuccaugucgguggccaacacccaaaaaaaugccaacaaaacagaaaccuucaacagcaccaaaaaaaccauacggaauggaagauaauaucugccagccaauaucugccucagucugacagaggauuaaaagcuagaaaauauuuugaaaaaugucuguuuuaaaggccaucuaacccaguuuuaaaaucagcaaacgaucuaaacagacaccucucaaagcaaaaagcaaauggcaaauaaauacaugaaaaaugcucaauaucauugaagucagagagggugugggauucccuggagcuggaguuccaggcaguugugaaguacaggucacccuggaaguacaugaacaauuacuguggaccacaaaaagacaggaagaaggcaaggguagacagaggaggugcagugaagacaauuguuccaguuuggucucccuugcuguaaccaaagcaacaccaggaaggaaggacuuguuuccacucacaguuugcagacuauccccaaggaaagcugaggcaggacuucgaagcagacaccacagaggagaacaucucuuacuagcuuguacaguuccuuauucagcccaggcccacuugcccagggacugcacuacccacaaugcacuggcccaccuacaacaauuagcaaucaagaaaaugcccacacagaccuacucacagcugaaucuaacggaggcaaucccucaguggugauuccguuuucccaagugacuaaggguugugucaaauugacagguaccaauguuaacuacgcugugcauauuuaaugcaauuagagcuucccucauuaaacagccaucucaugaggcaggagaccacacuucagcgagaugaauuuuauuuuccccgaauggcagaguaacacauagcaaugggaagaauucagccauguguugucaguuucugcugcccuacugugugacaucagggaaagucaucugcccuuccugagugucaguuguccuaucaggccauuuauuaucuuccccagguguccucugcuaauucagacugauuccauucucugaguuaaggacaguggcucuaggacuuguccucugcccccuucaacugggucugcugucuccagcucucacuagcugccaggguuaagagucaauaggcggcagcuucccaggagaagaauuuccuguccuggguccuuuggcgaggugcuuacauccugaauaagaagccugacugggagcaagccaggucuaaggugaaauuaaaaagaaaaaaaaaaagugaauuuaccuuugaucuuuaagauucugagacagccucuuacugcuucaagaauaagaagagggaguguucuuucuuacaccaucuguaguuggccaaauaaaaccgagaaaugauaguuuugagacuugcccagagaugacagaauccacaaaagcccuuucugauuccaaagcccugagaacagaaaggcgugagaugaccuuacaggcagaucacaucacauggggcuuguuuuucuuuuauuuauucuuucccuagguuggcuggcaguaugacucuuugagccacggacaucuguuacagagaguguguggcuucaggcuccagguggcuacuacuuaagccaccucggaccacccacauccaacacccucaugcuucugcuacuacuuggagcagagcaggcacaacaaagguccccagcccauaagagcucccagucuugugacaaaguccaaggacacccaccgaggcagggcagcaguggugggccuggcuuucacucucuggcuuuaguuacuaauuuugaucuuucuggucaucuugaagucuuucccagcccuuccugaaaaugaaauuucccaagaaaagaaaaggccuggguaagccagaggcacuuuuguggugcuucacaacugagcacgcuucuggcacugaggacagaaaccaaaacaagccaaaccaaacaagucucuuagaaaggacccaaagaaagccauuaccaucagcauaugcucggcaaccguguauuagcagauaaaauacugaguucagcuccuagcacccauuuugggcggcucacaacugccuguaauuccagcucuagaggaucuaaagccucugaacucuauaggcgccuacaccaacgagcgacacacacacuuuaaaauaacucuuaaaaaagaaagaaagaaagaaagaaagaaagaaaaaaagaaagaaagaaagaaagagauagagaaagagagagagaaagaaaaagguuuuagcucacaguuucauccaggguugacugucucguugcuuucacuuggcagaggaagaggcagccggucagguguucugaggacaaagugcuagaggaggagccagagccccagaugccgccca

SEQ ID NO: 5152 - RNA, 6747 nt, Mus musculus
ggggcaucccugcucacuaggcugugauuggcacuuccugaacaacagcccuuaccucauugcaacccacaguuuucagcucugcaaaggaggccagcagaauuguagggcaagcagacagccuacagccacuugguaaggaagcacuggucugcuucaaggucugcuacagcgacaggcagggcacucagugacaugggaagggaagggugugccugacuuugugucccuucugcugagaagccugggcugagcagagcaguagugguaaaugaccagugggugugacaagaacaguccccgcagcucuguggagagugacucacagccacgaagaggggacaaggagacacagccuuggcucccaggguguuugccgccugugaggcuguggacgugaauuaugggcggcgauucgaggcugcugcuuugugacagggccggcucuacuuacugugugauggugagccaaccacuggaccucucugauucuuuccucaucugugagauuggggaaauggguccggcuccuuggaaaggcucuccgugaggacagugugucagacaguggcaggacacaguaaguaacuuacugcguguuggccaugcuccacacugagaucaucugguggguggguggagcuaaggagauacucugcugggaucugccuccccauucugggccuggaguccuccucaggagacugaagacuugucagcacuccugaugaucccuccagcuuaacacccagaggaccagaaccaagaccccagaacagaagaggaaagcaaagggcaaaccccuagggugugcccagagggaccacaaaggcagcugcugucaaucucucccaugcuccagccggaggauacuguucacaucacagaugaggaccaccacgucuuuuggguuagucuauuauauuuuuaaaaacuuacuggguaaauacuuuggaggauaaauuacuauuuuguaaacaguuuaauuugggagccagugagaugguucgguguguaaaggcauuugcugugcaaggcuggugauuuaacauagauccuugggacccacauaaagguagaugagagagccaaccccaucagauuguccucagaccuccacacaugcaccaugguucacccgccccaucucucucuccucucucucucucucucucucucucucacacacacacacacacacacacauacaugcacacacacacacacacacacacacacacacacacacacacacacaaauaauuaacuucaaguauuugacuuggguggcugaggcgauagcucagucauuaaaggacaaggagagcacaggacgcugaguuugagcccccaaacccaugauacuaaucugggcacacauaguuccaguacuggaggaggaacaggcagauccacagggcucccuggcuauuugguaaguuccaggccagcgagacugucuuuaaagccaaugugaaugauaccugaagaacggcagucaagguuggccuauggcuugcacacguucauguacgcaugcgcaccugcacacauaugcgugcacacaggcaugcacaggcacaucgcuguuuucaauuuccuguauguuuauguuccuuguacacuccaugaucucugucuguuacguguacuuugggaaggaaggcuucccaggaugcuuagcguggucuuugaauuagaacugagcucuggaaacaaaguggaaacaaagcccaggcccaagacaggauagagccaauaagcccuuuucuuuccuugguccaaagucaaugguguugauguggagcuuucuaggguugcucucugggaaccagugcugaccugccaaccuuccucuuguggucagcagaagaagcacugcuaucacaaagcuaaggggguuguauguguacauacauguauauauguguacacagauguuggaaagaacagaagagccaagaauggaguguguacucguaagccuaucgggucaggagcaugaagaguacaaggccaaguguuuuguucuuucuguccucuugacacaagcuagagucucccaggaagauggaugcucaauugagcaaaugucuaaacagacugaccuguggguaagucuaucaguauuuuuuaaaauugauuauugguaugggaugccccaacacacuggaugguucuaccccuagaaagguggucuuggguuguguaagaaagcaggcugagcaagucaugaguaacaagcccaaaaaaccagcaucccuccauggcgucagguucugccucgagguuccuacgcugacuucccuuccugaugaacuaaaccauaagauuaaauaaacccuuuucuccccauguuguuuuuggucaugguuuuugucuugacaauagaaagcaaacucaaacaccaaccuccuuacauaaggaguuagaagccagccaggccaugcgagcccuagccucaaacaugugaaguggagaguaauugaggcaaacaccuggugccauuuggucuccacaugcacgcacacucacacacacacacacacacacaaaagaaaaaacaggaggaagaugaagaugaaacagagaaggcacuauagaacgaggccuauagucauugccaugcugaaaguaacaggcccacaucuuccuuacacuucagcccaucaugcuggauguuuucccuggucucagccacuuggagcaaaagacugaagucugagcaguagauagacaccauggaggcugguucaucaacauuugguacauucauagcucaauggccuaaccaagccaaauaaguuacgggcuggaccaacuucaaccuaaagcucacuggccaugagauugccuuugcccaugagcgcaugugggggucagcugauccuucugguggaugcaaaggucauagcagguuugugugacacaacugaaaggagguaacaacagcuuucccaauggcagguuagaugucacccccccuuaccuuacaaagacguagacccugucagguuucauugguuuuugacgaagccagcaaaggaccaaacuucuccaucacucuucugggauggagaccuccacagcccuggaaggucugcacuugagugguguccaacaaggacaagugggaccuggguggagugggaacuggcucugguuuagauucaaagacuugaaguucuaaguagaggaugggggauagacacuggcaugcaaauggucugucuaagagcuguguguguguguguguguguguguguguguguguguguguguguguguguguguguuagcagcaagaucaauagaggucauaguauaugauccaacugcuaaaccaaggagguuugccucucagugcccuagccagagcuggcaccuccagcaucagugggugacagccucauuuuugguuugugcuguuggcugcuuuccagaguuuucacuuauuucuaggugucacagauuuaaaagcacaucaagguuugaagaguguggaaaggagacuggcugaguugcgggaggccuaagggggccugccagagacccuguuagagcgguaaagaccucugccugggaacgaggacaaguauaagaggugugagcuccgucuugaguuuaugagggugcugucaugagacaaaggcugguucaguggaugcaguaggcaaggcugagacucaacagugagggguagugcuucguaaaauggggaggcagagucuaacaagaaaaggagugugugugugugugugucugugugugugucuguuauacccuuauguauuuuggagauucagagcuauguccuagugcaugucguguguguguguguguguguguguguguguguguguaucaauaaguagacuccaugggaaaauccaaaaccccaaaagagcuuguccuugccugagucccuugacuaaaagcgagggccuggugcugagcugacugcaggaaacugaugcugguagccagggcuccaguccccaugaagccuuacuaauauaauaggcuuuuucaggaucaccaguggacaaacugaucaggcccuuucaccagugggcuauaccugggcauagcacacuguguugcuaguguccccugggauccuggauuggagagaaagggggaacaagaggcaaagugaacucugugaaacagacuggagcacacaaaagcccguuagugcuucaggauggccucuucaagcauauguauacaucaggaccaguauggccucuucuuucugcugucuaccucccagggcuggucagaggcaaauuuauuuuugugcaaagccuucuguauagggugagcuuguauacccaccaacgugugaugugugauauauaugcacaaaauuauuuucauaaacaugggggucuuuggugacacaggcccuguuuaacauaacagucugucucagcacacagagugcuggagugccucugaauagcugcauggaacucuguucuaaugaugccuguaauuuauuaaaguguccuauuaauggacguuaggaugucacuagucuccugguauugcaauuaugguggcagugaauauucucacacguaagucauucugcagcccccagagcugaucaguuacgcuaaauaacaugaaaccaagagcugggcagaaagggcugugcacucgguguaucaucaggguugccacgaugccuuccagggcugcuguaccauacucccccucacaggaugccagaacugccuaccucccccauccucaccagcgcagcaucagcacccuucugauguuugccaaugcgaagguggaguaugauauuucugcuuguuugaauaucauuuuguguguaugugugggugcacucagggagccuucauaagcaagaaccaaccuaccaugugauucagaaccuugcucagccguuauaugaugccacacaggacccuccccaaaaauguccaggcccuccccaaaaauguccaggccccagcuucucagaaagcuagcugcugacuuuguccucaccuugcccauugugguuugcuauaaugauaggugggacugaauaucucaacacaugcacacgcacacacacauacacacacauacauacacacacauauauacauacauauacauauauacacauacaugcacacacacaugcacacacaaacacacauucacacacauacaugcacacacauuacacacacaugcacauacacauacauacagacauauacacacauacauacaugcacacacauauacacauacaaacacacauauacacauacacuuccugucuaggcucccaucauuguuuagauccaggugugaaauugcugucaguuugaauggccaaaucaaagcugaugaugacagcaaacuugguuggagcucugagugugggcagcucugagcacaggauucugggaagaccaucacauuguccaucacagacaaugccauggagguguggugaccaucaauucuagugaagcagcaugugugugugugugcauguaguuuguguauacuuguguucacgugucuacaugguauguaugugugugcacauguauguggaggccuaagguuaaugccagauguccuccuugguugcucuuuuucuuauguucaaagcagggucuuucacugaacagagagcucacagauuuagacagccuagccagccaccuagugccagggaucuucugccucugcuuccagagugcuaaaauuacaggcagccaccaugcccgccaggcauucacauaagugccgaggaucugagcuuucccagcaugcccuguguucaggggguucacccccucucccccuagcccaucaccucuauuuugcagaacugagacugagcgaagcaaucaaucguuuguagccacucagugguggaggcuugaacucacagagcaucaucccacguuccucaccagauggaugagccaguggcccccgacuagcagaugccacgccuaguucuggaacuguccugcgguggacagcaacacugcaccagcccagaggcucucauccaguacugcagaggagcucgccccugggaacugcuagccaugacuuggagacccugguucugguccucugccccgucccuugcucccggccuggaagaaaucaccggccaagcccaaggccaccacuuaaggcugaggccaaggagcgucccaguuuauggaguaguugacaguugcuuugggcgagcugcaagcaaacagcugugacuucaguccccaaagcucccccuucuccuuaccugugucaacauuuuuauuuuuuaaagcaauacagccaagguggggguugggagugggcaauggggagggagggagccagggccucuaucagcucugggguccuugcauauguaacacugucguauaauuaacagugaagaucauuuacauugucgcuuagcuaauuuucauaauguuuucuuuauuaucagaggaagaaauuaacccaagaauuuauuuacauagcagccucaaacaguaacagcuugcuaauugccuguuaggugauuaauaagcuuacagcagaugcuaaugcgucgugggcucccguuucaaaggugcucuuccugcacgccuguguuuuuggcagcuuaauuagugcaauaauuauguacuuguugcuccuucuuucgagcaaauacugucaaaugcuuaaaagauuaaagugaauuauauccugagaacu

SEQ ID NO: 5153 - RNA, 1399 nt, Mus musculus
uaauggaugcuuuggccagaugcucgcaucugucgagcuaggcuucucccugcccccucccccuuuucggugcgcaucguacacgauuuauguuuuuauuuaggagaauaaauaaaugaagaggggagcguggucgaggccggagcgggcgcugagaggcuccaucucggggcggccgcucacguggagguccccgcgcgcucccagcuacucauuaagaugcaaacgcgaaacucaggcuccuaaugaggggaaaauauagauuccgggggcgcgcggccggcucgcgcgcgcccgcaacgggccaggagcgugugcuugcgugcaagcuuggugggaaagccgggagggacccgaggacaccugggcggcccacucggcguugguucuccgaggccggcggaccuagggugggcagugugcccugacgugacccuugucugcgagcagaugggccccagagucgaauaucuacgccuccuugggugucuaugcuggugaccagggacgcuccaggcucgcagucgcucuuccacggguggcugccgaugcaugugcccaggcaggccaucaggccaagaaacggggucggaacucugggucguagccaggagggccccaacuccgugcuuucccuucuucaccaucucgggcccggagcacugcugaggaacccgccuuggcaaggcugcggccaggacguagcuguccccaaagggcaagagccccaaauggggcuagccgcacuacugagccuguuguccgcagacugccaggcccuuccaucugcgcggcccgccaagccagaguucucagacuucccccucgccggcagccgccuugcaucagaggcgcuguuuauuuggcuuucugaaaagaagggcgaaugaacaaaggagaaaagcggggcgcccaagggugggagagggggcagaaacggauaaaagaaagagaaacucaguuuggagaacagucuuagaggucggagguaacuuugggugccagcauuuuaucgguccuaaaucuuuugaagugaaaacauuaaacugacaaagugauucuguuuguuuuauaguaucuaauugggcugcuuugcaacccuaaugagauuagaggggggcaaucguucgccgccucugcagaaucaacugauccauuacuaccagccacagguuuuaaggauuguacagcuuguccuuuuuucccccccuuuuguuguuacucguuuucuccuucuccccucccgccaaauaauuauuugcuaguagaucgugggaaaaaaagaagaaaaaaaaccuagcagcccaggacuauaauauauaucuauuuauuauaugucuuucgguuaauuccugaugugaggagcgcuguuuuucacucccaagcgaaagucaccagc

SEQ ID NO: 5154 - RNA, 65411 nt, Mus musculus
cggcggcucggcuccccaguagcgcgccgagcgggcgggcucuccucacacgagcgcuuccucgccgagaggcuggagcugcggcagcgcaggccugggccgccgugucucugccgcucgcuucaguuuuccucagggcucugggggccgcucguccgccgacgcgccucaggugagggagcucgucgugucguggcugaggggcggccguggcaagugggcucgcgacgggggcggcucccggggaugcgcggcguuccgagugcggggaucuugggugacgcggcgggggcuggggucucggggcuucuuuggcuuuggaguggggguggguggcugcccaggcggucccgggucucuagggucgcgggagcgcguccuguguccugccugagagcccgggugcuggcauagcgcgguucugggacuuggagaccauuucuggcgaucccgugcaguugaggggcuugggauacaguuuagccuuguccggagggcacggggagaccuaugagcggagagggguccgcuuggcauuccugggguaaagcaggaggaugucaggguuccagagacuuggguuuguuuaaggucgccauggggugauaagacgaugcccgugucccucccgggaaggaacggacugggugggugugggugggggcgggaagcgugcauggggagaccaacauuuguauugggguuucugcuucgcccagaggggggcgguaacugugcgugaugguccccauucuuuuucggggcgacaaggagggugauuuugccgugugggcgcggcucagcggucucugggucuccaggggugccagacccgguuucaggagccaccccauggcacugcuuguggcuuucgguaucugacggucucgaucuggucucucucucuuucucgaugagauuuaacucagugcuucuucguuggacgcuugaucggggcaguugccuaguuggagacacagugggcuuguucugcaguuuucuuuucuuugccccaggauaccuuuggggacgcgcuggugucgccggagcucugaucuccggaggagaggagaggagcgauaccagacuugagcauguugucuggaauaccugacuguugagugaggguuuagaucugaggguagggcggcugugcgauuugggcuuucuguuuuagguaguguuugauggucuugcaugguuaaaucuguccugaauuugccuggguguuagguagugccaagaagcauccuuucuaaagguuuuguggaagagggguaauuaaaaacaaaaguguagcauauuauguauguaugucucaaguccagauuucuacaaaagcgucauuggcaaccuguuaaugaugcccuauugagcuucuuuagagaauucugguacaucaguuuuuaccgugguuugaaucuuacagaguucuugaagacucugccagacuuagguggaacuuaaaaugacuuauagguaucugccugugagugguuuaaaaacgugugucagaaugucuguacauuugccugagaauucuccugguuaggcagucuaaugucacuuuagucuaaggaaacauugcugaggugcuuguaaacagaaaauaugauauaagcaggcaaauugaaguaucuuugcuuugucagucuuuuucuugucaguuuuuuuuaaagauaauuucuucugucuuuuuaauuagaaagauuggggacaaguuacuaaagcuuugaauuuugcaaucauguaaaaacaaacaaaggaauguacugcagugcuaauuugggcuuuggggcuggguauuagguuaguuuucauuuucucacaccuaaguaugggaucaucuuuuaugaucaucaaaacugaucaauugagcaaauauuugguugaaaccaaagcccaaaaacucaguuugaaagacaaaugacaaaguagccaaauuucagaagcuucaaucucaaucucucucucucucucuccucucucccucucuuccagacccucucucuucucucucucucccucucucccuccaucccuaccucccaaggcuuucaaacuucaaaauaagcauagacuaacccaucagcaaaggcaggaucaucuguuaggcgucaugaugcuaugauugcaguaaugccuccuaugucaagaaggaagcaacagauaaauaaaaccaugaugacauuucagugcugaugaggaaaacaguguccuugggaaucagcauuucuuuuccuuaaauaaucccgaguuaugauuaacaucuguugagauaaccggaagcugagcucuauaccugcaaaauuauuuuuucaaaaauuaaauucugaucaguagaguuugaacauuaauuaaauguugccucuuugaaaaauguuuuuugugauguaagcaugaagaaaaucuguagaaacacaaauggaacuuaaccauguuugcagguguacuuaggaggggaauggaugguagagagcugucugacuuuaaacuuuaauaguccuugaauucauuucagugagcaauguugcucgaaagaacauuagauaaauccagaaauaaaaacauuuucuacacugcaagcuugugaacuauacaguauuugcaggccuuugucaguguugcuacauuugccuguuuguacuaaugaaaaacaaaagucuuuccauuaccuaaacaauaugggagguacauggacaagugagguggggagcacaacaugauaaaaaauguacagcuaaauguuaaacacuugaaagauacuggguauuugauuauauagaaaguauuugugugugugugccugcacacugaccagaaagauuuuuuuauucuuuggucaaacauaggcacauuuaauggauguguuuuucuugugaggcauaugaaccauaaacauaguuuuauaguuucauuauuacaaugcugcaaaugagaguaccagaguggguuuuguauuaucacucacaauuccagaaccauaauguuauauacuaaagcaguuucuagaaagggaauuaugaggcaugcgugcuagcaucacuguacugcuaauagugugaccuuugauaauucuuggucucucagggccuugguuuuccauguguaaguauauauauaaauaauagaugcaagaaaagccuugucaauacuuuguacaaaccucaguuccagagauuguacuacauugguuuuucuguugcagacucuacaauaugacauauacaaaagcaaagagaaugaguggcucauucucaggauauaacuaguucuauauuauacauauacauauauauauauccauuauauaugauuucagaaacuucuuuauagagauaggaaguauuuaauucuagaauacacauucaugaagguaagugcuuuucuuuggaucauuuaguuuugcauauuacaauggucuuauuuuuagcaucuuuguuuuuuguaucugaucccuuacugugugacagaauacccauacaauaaugcuagguucuuuuucaauucugugguagaaugggugcacucucuagucaauggcccuaggcuugccccuugauuuccauccuuauacugcuuucgauguggaucuguucauugugccuuacuuaauacccauuguucuuuagcuccaggauuuaguccuaacugucauuacaaggccuuucaucaucccuuugacucaucugcauuuuucucuaccguaaaccucaagcuccaguugcacuaaugagagcugcuuacugaaugaaccauccuguuuccgucacucagccugcaguuagauucuuuccacugcuuagcaugccuuuucuacugcuguaaaaacuacugauuuuucauucugcuucacacugugcauuuuagauccuuucuggcucuucuucccucucccuggguuauucucucaaguauuuuuguucauuccuucuguaaguuuauuuuuuacuguaauuguaucuuuuucuaaauucaaggacaguuuuuuucaucccucuuucuuguuuacacagagguggcucucuucuuacauguuugaaaucuagaagccaggugcagugucuucauaauguccaagauuaauuaaccucauaugucuggccuguccugcuuuccuaaacucagcuucuucuagaugaucuuuucaugccucauccacagacugauauuagaacuguaguucuaagccucaaauuaagaagugagacugccaguacaauaggaguuaaguuauacaguaaaauugacaggaaaguccuguagaauuuugaggcaaguacuauuccuuagcucuuaggugggaugccagcuuuccaguucuggacauaggugauugauagguguuguaccuugacugcuucuuacauggaaaacaguguuugcuaauguguguguguguguguguuuacauuggcuucauaguuguuuucaauucguugccuuucauuuucaaagcaaauuaugacauuaacaugcucucagauauuaccucccaagaagcaggcagugagugugcguagaggucugauuuauaccauguuuuaugcuuuuucauacuacuauacugcuuccugaauuagguugcuuauuugauguuuuuaauuacugauagguauuuuacucacuuuauaaauggagaaguagguuauaaaguuugucuauuugguacccccccccccaauaccucaaaaggagaauuugugauacuuuggcuuuaaagacuagccauaaagcuuuagcauaugaggauauuucauaugcaguagugguugaauagcuuccucagaaucacagaaccuaucuguaagauauuuucugcuggguuggcgggauggcucagcagauaagaguacugacugcuuuuccaaaggucuugaguucaaauuccagcaaccacauugguggcucacaaccacccguaaugagaucugacacccucuucugguguaucugaagucagcuacaguguacuuauguauaauaauaaauacaucuuugagcuggagcaaguggaguugaccagagcgagcagagguacuaaaaucaguucccaacaaccacaugaaggcucacaaccaucuguacaacuacagaguacucacauacauauaauaaauuaauaaaucuuuaaaaaaauaaauauuuucugccaaacuaguugugaacacugauguaaaccuauuauuugagcugggaaugguggcaaauaccgacgagccuucacugagaaggcugagacaggauuuugaauuugaagucacccugagcuaaauaauaaauaaaugagacuuggucucaaagaacaaaccccucguauuuuaaaggacuacuagagaccugauuuuuuccuuccaagaaaagugaugcugaggauuuuagagucuuaaggacaugacucagagaaaauccugaacuuggaucaugucaugugggccuccucagugccuuuacucaucuacuucccugaucuuguuuuuuuuuuuccccuuccuuuuuuuccuuaaaaaaauuauuaguaucaggcuaccaauaaucuuuuaugugccuugauaugugccaacucuaugucaacuaagagggcuacaaagaaggcauaaaaccuaaucacuuuccugaagggacacaguguggagguauuugaauaaaguuaucuuccaguccagcauuuaacuuucccauugcuacuacccuuuaacacaguuccuuauguugugguaauacccaaccauaaauuuauuuucauugcuucuucauagcuauaauuuugcuacugguaugacuuguaauguaaagaucugauaugcuagauaucugauaugcaaccucaaccacagauugagaacuggucuucugguucuuagcccaggaaugauuuuuagugguuagcuuaaugaauuuuuauacauguaaccacuaauccaguaaagauacagaauauauaugauauaauaaaacuucuucauuuucuguccuaguuaguacuuuccgaagguaauuugccuaccucaucaccauuaaucuagauuguguuugcuguuugcucuugaacuucauuuuuuuuaaaaaagcaaguuuuuuuuaaaugauuuucuuuauucaaccuagugucuguaagauucauucuuuuuguuuguuuguuugauuuguuguuuguuuuuguuuuuucaugacaggguuucucuguguaacccugguugucccugaacucacuuuguagaguaggcugaccucaaguuuuugugugacacagcuucauucauuuuucuuuaaauuagcaauaguuuauuuuuuguccauuacuauauauuauuucauugcauguggacauauauaccuauucuguuguuggauauuugggcuauugacaguucuuagcucuuaaaaacacagcuacuaauaaaaguuuuguacauguuuuaguggacauauugauucauuccuuggcuagaaucaguaguacuuucauuucaauauauuugacacauaagcacauauagaguauacauagaagauucugagcugcaaaagcuuuauauagaucucuagacugacaaugagguauuuguagcaggucacgucucugcaugaucuccagaguccagauggugcucuaccuagaagaaggcaugucucuucaggccuuugucuuuugcuuccuucucagucccucccggcugauuuacaggguagagaaaagaugcucauauuuccauuggagcuucuagaaagaugccagucccuaugcugcgagaauugaguauuggguuuguuuguuuguuuuuuaauuguaaucugauaaacaaaagauuuuacuuuguauuuuuuauuauaaugaaauugagcaugauaaacagauuuuuuaaaaagaacaauuaaauguuaaaauauuuauaagaaagauucuaaaaagacuuccucaaguacuauuuuagaggauauuuuaaacuaggaagcuuguuauguggaccccaacucauaugaguuggcuggccuccaacucauagaucugucuauguuguguaccaccacuccugacccauuuuccccuuaaauggagaaaaguuuugaaugguuaucacaaaaaccauaacauuucaaagaccuaagucucagaugcagucauuguuaucucaaguuuuuguguguccuucuaccgauaguagauguucauguguauucauccauuucucagcaugcucagggaguagucuauaaauagucuuguauaugaaguggucuagugcccauuuucaauauucuuuagguuacuuauauuagcuccuuauacaauguaaaagcuauacaaauaggugucagauucuauuuuuagggaauaauguuuagaaaaaaauccauauauguucaguguaggauuuuucccucuaauauuuccaacccuggguuaguugaauccucagugugaaaccaguaaauauggaagacuaacuauguauguaauguauguguguacaaauguguauguacauauaaauauguauuauauaauguaugugucugcauauggguaaagucugaacaugcauauauaugucagaauaugagaugaauuuuagagaacauucauuuaaaauacugucugcuuuagaugugguauaguauaucauauugcauaccaaaaauuagaaagggucuaaaaaugauuaguaucuggcuaguggcccagaaggaagaaaagcagagucuggaagcauugggcaguaauuuucuaugagacaaguggccauagcucuuuuuauuauuagaucaauucuuugacaguagcgcuucuguuuauaguacugauucaguacuucuguuauuuaaaggaaagcuguggguccauguugugcccuguggcugggguguggggcauuuuuuuaaaauuacacagucgauaccuaaaagaaauuauuuaaaguacaaaagcuauuuggugguauucagaagaacaucuagggggaaacuuuaucuuucuuugcuugcaguuaaagaguuuuagcagaauuuucaugauauuuuugguuaacagugagagauugagguagaaaaguugcaaauaaaagucaucauuuuucuaaacuuacuuggcuaauuaaaaagcuaaccagccuugggauuaacauuuuaaaguauguauuucauaagauucuaugcuaauaauauagaaguaauuuauaucauacaucaaagaucuuuuuaagcuugacuuaaaugugauugcugaauaaguggcuugagcaauaagagucagauggggaauggagagauggcuuagcaauuacgaaggcuugcaaagggcccagauucaguucccaggacccaugucagauggcuuacaacuaacuccagcuucagaaaauaugacacccuuucaugaacacuucgacuucgacacacaugcauauacuccagcaggcgcacacacguacccagaaauauauaauaacagaaauaauaaaauauaccuuuaaaaaaguuguacagaaauuguauauuuuguacaaaaauuuagauucugcagcguuuuaauaguuuagggagaagauacuugcuuugucaguaagcuuuuagaaagucuucuauuucuaaaaauaaaauuuggggaugacuuuauuuacugaaaacugucuaguuaugucacucaggaucaguagggauaauaucagauguccuguucaagauggauuauaaaguaaaagggccacuuaaagaauuuauuccuaauagagauauauaauauuuauuagagguagaaaaugcucacuguuuuuuaauguucaguauuuuuuuggucauuguuuuuguuuuuugagacagggguucucuguguagcccuggcuguccuggagcucuguagaccaugcuagucuggaacucagagaaccaccugccucugccucccaaaugcagauuaaagguguguucuauuuugaaauuuuauuuuauuuuuuuguaaaauugaauaguguagagaauuacuuuuaccauauacccaucuugguauccccuaaugcuagcaccuuauauaauugugcauuuaucaaaaccaauaaaugcaggcugaguuuugaacaacuuuuggugggaacaccuguuacauaugaagcauguuagcuucugaaguauguacaguguuggaaaacaaguucuuuacauguaauauuacuaacaaacugguaagcuuaguguugugaccucguaguguuuuuccaaguucuuuuugggacugcaauauagaccacaaauaaaagcuauguucacauaacuuuauuguuuuguucauuugguuuguuuauuuuuugauugauugauaucccaaggcugguagucuuucucuguguagccuugacugucccagaacuuacucuagaccaggcuggccucaaacucagagauauaccugccuuugccucccaagugcugggauuaaaaguguguaccaccaccuccuggucaacuuuauuguuaaguacacauaauuuuaacuucuaaggucagccagugacuuugaggguagacccuuaaguuaucuuuauuaucucagaacccuguugcuuauuauuuuauucccagcacuuuaauagugucuaauagauagcagaugcuacauguuguauuagugaguacaucagugacugacugaagccauauggauacacccaggaucuaagauagaagaauugaaugaugauuacaguuucuccaucucugcauuaaguuuauuucuucucuguuuugucucaauuauacaauguuugccaaaacuagaaacuuguuuuguuuguugucuuaggguuucuauugcuaccaugaaacaccucaaccaaaaagcaaguuggggaugaaauuguugauuuaguuuacacuuccacauugcuguuuaucaccaaaggaaguuagaacuggaacucaagcaagacaggagccugaaagcaggaacugaugcagaggccauggaggagugcugcuuacugacuugcuucauaucgccuacucagcuugcuuucuucuagaacuuaguacugcuagcccagggaugacgccacccacaguggguuaggcacuucccaguugauaacuaauugaaaaugccuuacagcuggaucuuauagaggaaauuccucacgacucuuugaugacucuuaacuugugucagguggauauacaaaaccauccaguuauuacacuuggcuucugagacuuaccuaaaacgauugauaagaguguuaguuucaccaggcaguggugguacaugccuugaauuucagcacuuggaaggcagaagcaggugaaucuuugaguucagccuggucuauaaagcgaguuuuagguggucaaggcuacacaaagaaacccugucuccaaaaaacaaaaaaauaguuuaguuucugaggccggagagauggcucagcaguuaaaagcacuggcuguucuuuucugagguccugaauucaauucucaguacccacauuguggcuuacaaccaucuauaacuguagccuccuguaauucucauagaaucuaaugccucuuuuuggcgugcagaugcacaugcagacaaaauacccauauacauaaaauacauaagcaaaagaauacuauuuucugagaaucaaggcauuccuugucaaauugaacuauaacaaugauagggaaguggaaaauauuucaaagcagaauuagaagcaguaauuuacauuuguuuauguugcauaugaugaauauaaaugcggucaaugaaaugaaguaccacuguuuauauuuggaguccaccugcuuuuuuuuaaauagcuucacugagguauaguugacuuauaauaaacugcacccacuuaaaacauacacucuaauaaauuuuugaaaccuuuguauucaggauuguaaauaaacuuaccaucuccagaaaugucuaaauguaaucuuuuugucaugccucuucacauacccauauuccacuaccucaaaccauuggccugccaucugucacuacguuguuuugcauuuucugaaguuuuauauguauguagucagucagauacuaugugaugugggaaggagaggucuggcuuauuucacuugacauaaucuuuuagauucuuuucugcuguccaucucagugauuuauuucuacuguuauugauguuagucucacuggugcacugucuggcacauugcaauccaggcugggcccacaaucuccuuauagcagcucaagugcugaaauuauaaggguaugucuuaggguuucuuuugcugugugugaugaaacaccagagcaacuugaggaaaaagugguuuauuucaucuuacaguuuguaaauccaucaugaaggaaagacagagcaggaauucaggcaugguaggagcuaaugcagagagaggcuauggagagaugcugauugcuggcuugcucagccugcuuuuuuauagcacucaggacuaccagccugggagugccauugcccacagucagcugggccuucccauaucaauuaucaauuuagaaaaugcaccacagauuugaccaaaggcuaguuugguagaagcauuuuuuucaauugagguucccucuucuaaaauuauucuagcuuuugucaacuugacauaaaacuaaccaacacaagugcaucaucaugcuugucaauuuauuauuuuuaaauucuuuaguacuagagcuucaugguacauauacaccaauauuuguguaucauuuauuuguugacuuuggaauucuuuaaaauuuuauuuauaaauauagccacugugaacaguaguguaucaaucuaauauaaaguuuucuucuuuuuuuuuuuuuaagauaaauacuuaggaguaguaaugacugggguccaagguaguacauucauguuuuaauuuuguggaggaguagcauuauuauaaaaggccaauuuucuuaauacugcagagauagcuuguaaauuaauaagaguguaaagaaaaagccaacagaaaaaugguagaaaccauaaacaugcacuucaugucaaaagaaauacaaaugauguuaagcauagaaaaaauuuccuuggaggcuaaagauauuuuaggaaaacauuugucucucugucucugucugucuauaucucucucccuccccccuugcuuaaauucgugugcacaugugugugccugccugucucucugcuggagagugugugcgugugugcgucugucugucugucuauguauauacagguuagagaccagcuuguagacacuggcuaucuccucuuaccuuauggauuccagggguugaaaucaggucaugagguuugguggcaaacaccuuuauccacugugucauauuaccagcugaaaacuuaaaaaaccuuaaaguaguguuccauguucagaccgcaagauaagaaugcuucgguuuguacauuuuuuuuucacuugaaauguaaucuguaaugucaaguuuuaaaaaacuauuuugugauucaguuuccuugccaauaaaaugaaacaauaauauuuccuugaaggaauguaaugauaauuagaugaguuaauauacaugaagcccucacaguaauccuugacacacauaugucuucuuugaaaaaaauuauuuugaaccaggagugguggcacaugucugucaucccagcaucaggcaacugacacagaaucgugauuuggauguuguucuuggcuacagaaugagaucuggucucaaagagcacaaaccaaacuaagaaaacaaaauagcuaauuacuguuaucaaaguacagauuuaaacaggggcauuuucacuuaccagauuaagcaguaauggcaaggauauguacaaucccucuucuguacugugggcaggaauggaagcaugugcaauuucuuuggaagaugaguugacuuacugaaaugauaaauggucaugcuuuuuaauucggucauuuaaaaagauuucuuuuguucauuauagcauuaauuauauuaucaaaagcuauaaaugacucuuaauaugaucuagcuaaaaaauaauggcacagcuacacaaugaggugucauauagccauaaaaagaaagacaaggagcauuaaugccugggcucauccucaaacauuuuuuuuuuuuuaagacaguauguaccccgaccaucuuggaccucacuguguagaccaaacugaccuugaauucaaagaacuaugauggcuuugaccuccugauguaccacuaugccuggcucuacucuuuagacauguuacugaguggggagggaaaaaaugcuguguaaauguuuaugacaugccaguauaauuauaagaaaauuaauuguauaugugugaguguacauaaacauguacacaguaaaacacauuuauuauuuaguaugcauugacuucuuuaaaaauaugaguaaaaaggagacuaauucuagagggaccaaagaaaaaggacuggaagauugaaagucugggaugcuacacuggcuuguguuuauauuuaaauugcuacaguggcucuguguuucucuuuaaaucuugcccccccccccuuuuaaugguuuuaaaccuuuauuaaagaaaggcagggggaagaaagaaaauaaagagagagagagagagagagagagagagagagagagagagagagacuggccauggccaagaggagaggaggaggaagggaaagagagaaagagaguuagagaguaagaaaggugaaguccuagagagagagagagagagguaaaagcuuagagaguaagaaagcaaggagagaggagagagcgugaggaaaguaaaagcuuaagagcaaaucuugccguuuuuugaagcauuuacagauccuuagaaaguugauaccuugauacagacaaguccuacuuaucccucuggugguaacauuuuauaucauucuaguacaguacaaaaacuaugacacaugaugcagugugcauacuuuucucaaauuacaucgguguuuacauauauucacuguguguuuauauguuauacaccuccaaaaucaaauuuuaucacaucaguuuuacaaucgcuaacauagucaacauacacaacugucuucucaccacaaaaaaaaaaucucugagucauccuguaauagucauauuugucauccuaaccucaagccuuaaaaagcauauaguuuucuuuuuaauuguauuauuauuauuuuaaguauauagauguuuugccuaaagguaugucuguucaccaugugcaugucugaugccuauagaggccagaaaagggcacuggaucucuuaaaauuggaguugcagaugguuguaagcugccauauaaaugcugggaaucauaccuagguccucuggaagaacagugauaaguugauacagucaccagaauuuguuaacagagucagaaagaaggcuccaaagaaugagggacagcaagaaguuaaguauaauauggaagucuugauuugacugccugaaggauagaguuugcugugguggguaaaacugaaggaaaagauuuuggaggagagaaguuuuggacaaaguaauuucagaauaucuauuagguaucuaacugaaaaaaacaaaaaacaaaaaacaaauugcagaugccuguaucuuaaaacaaaagagauggacuagagauuuaaguuuggaaauugaaagagauuagaugagauagcuucacagaaaaaggguagaaagcugaggucccaagacugagauuugagucacuacagaguuuaaaaguuggguaguaaggagccagaaacguaaacuuaggagcugauugaagagaaaaaacuagcaggacauuguccuggaaaccagauagagaagaaaguauuccaaagagggaggacgaaaccuugucuaauacuguuggcaguuaaagaggaggacuaguaauuaucaucauuuuuggcaauauggaguuagaauucuaguaagaacagcucugaugauguggcagugguaguaggagaucugaauggaaaggaucaaaagaaagggggagaaguuagaaauaagcaggaagcaccugaggcauuaguugaagaaaugguaguaaagagaaugagagguugggaaaauauuuguuuguuucuuagaugcaaaacugacauuuuuguaggggcugagaaagggaaauuuuaugggggugggaauagguggugaaugagaauggaaugugugacuaggagacugggcugucucugacucaacagcugaugcaguaaugagagagcugagaauauuugggcacagauguacuuagauauguuugggagcuuauggaaguuuguauugcuucuuuauuucucaguaaaaugggaaauagagucagcauaugaaagaggaaggaaugggagauuaaagaacaaaggguauaaaguagccguguaggagagggauaggaaauaaaaagguauacuuguuaggcaucauuacagagucacuugagauuucugguccugaauuuaaagagaaaguauaaaggaggagaaaacuugcugagguuuugugccagucagagaaauaauaaaugguugaauaagaacuuaaccucagguaagagugggauugagaagacaacaaaagagaaggagagaaguaguggugguagacuaagcaggugugguggcacaaaccuacagucucagcaguuaggaggauguggcaggagaacuacaaauuugaguucauucuggacuauauagugugucaguaagccaagaugaguaaguaaauuuagggagugaacugauaaagcgugguguuagaauguauauauaguuauguucauuaaauauguauauauauuuauugaauauauagcuacauucauuaaaauuaacacauuuuaagcuuugaccauggcauaaguggcuaaaauaacaauggaauuaaaauuaacucaaauuaagcuuugaguguggauacuaauggauacaauaaaauuagaauaggaucaugggaagagagacugucaaguaauacaaagccaggauuuggggaggaaucaaggauaaugguagaaugagcaagcagcuguagccuugaagaaguaaguggagcauuugagagguaauuggaacaacaauagucugguggcaguagacuccaagcugaauguuuucagggaggaugggggacaaaaauguguggaauggacacaggauacuuguccuaccucugugguaagaggagccaggagaguaaacauagcacacaaagaagcaauaauaaaagagaaccauguaacagacaaaugacauauauggauggaggcauagacaguaggaagaguugaugcugauagcaaaacuaaugcaauuuggaauuagggcuuuuuccuuucuguuugaugucuuugcaggucuucucucuuuuagaaucauauacaacuuagaagcauuugaccaucuagaauuuuaucuuuaaaaaaaugagugccagcugguguaguaguagcacauuccuuuaguuccagcacucaggaagcagaucuuugugaguuugaggccagccugguuuacacagugaauuccuggacagccagaacuacauagugagacuucuaugucaaaacaaaacaaugccauucccaagguuagcagaauauaauuuaauuuucccaggacuaauugugaacguuaauaaggauugcuguuguaacugcccaguuauuuccuccauucaguuuguaacuuugggcauucagcauagaauaaugacaggucucccucccaagcuugucuccuuccaagucugucagaauaucuaaaucagagaauaauaacagcuguaaaaaauaagcagagaacuguuccauuucuuuuccaaaguuuguucuauaauuuuaaucccugccuuuauuaauaguaucuuuaauuuuuuuuuacauuugagagaacauuuugcuucacagaugcccuuuauauaugucaguuaauauuuguuccaguuaugacuguuugaacauuaaauguaaaaagaacucaauucagguagccuuacacaauaaggagaccaaccaguuuugcacagcuagaaguagagacaaaguaggugucuuaguuaggguuuuacugcugugaacagacaccaugaccaaggcaagucuuauaaaaacaacauuuaauugggauuggcuuacagguucagagguucaguccauuaucaucaaggugggagcauggcaguauccaggcaggcauggugcaggcagagcugagaauucuagucuucauccaaaggcugcuaguggaagacugacuucuaggcaccuagggugagaguguuaagcccacacccacaguaacacaccuacuccaaccaggucacacuuccaaaugguaccacucccugguucaagaauauacaaaccaucacaguaggcuuccagguuagucagugaaugcauuaaugcagacucagaaaauuccgauucuuucuguugguccaguccacuuugcauaggaaagaaccuuauguucuucuuuuuuuuuaaucaaauuuuuauuggguauuuauuucauuuacauuuccaaugcuaucccaaaagucccccacaugcucccccacccacucccccaccuacccacucccacuucuuggcccugucguuccccuguacugaggcauauaaaguuugcacaaccaaugggccucucuuuccacugauggcugacuaggcaaucuucugauacauaugcagcuagagacacgagcuccagggggguacugguuaguucauauuguuguuccaccuauaggauugcaggucccuuuagcuccuuggguacuuucucuagcuccuccauugggggcccugugguccauccaauagcugacugugagcauccacuucuguguuugcuaggccccggcauagucucacaagagacagcucuaucuggguccuuucagcaaaaucuugcuaguguaugcaauggugucagcguuuggaagcugauuaugggauggauccccggauauggcagucucuagaugguccauccuuucaucacagcuccaaacuuugucucuguaacuccuuccguggguguuuuuuguuaguucauauuguuguuccaccuauaggauugcaggucccuuuagcuccuuggguacuuucucuagcuccuccauuggggggcucugugguccacuuuggucuuuguucuucuugaguuucaugcguuuagcaaauuguaucuuauaucuuggguauccuaaguuucugggcuaauauccacuuaucagugaguacauauugugugaguuccuuugugauuggguuaccucacucaagaugaugcccaaaccuuauguucuaaagcaaugguucucaaccuucugaaugcugcagcccuuuaauauaguuccucauguagaggugacccccaaccauagaauauuucauugcuacuucauaacuguaauuuugcuacuguuaugaauuuuaauguaaauaucucauaugcaacccuagagggguaacaaccuacaagcugagaaccacuguucuaaaagaugaaacagacugauuucuuccuaccagaaaggacagacauaaucagaagccaucagaaaaucuuguauccuacugaucugauccucuuuucaucucaaaaucaauuuauggcaaugagauaggccuauuauugagcaaagucaguucuccaaguugcugucacucaguuguagaguaaauauucaugguaacaaucauaauaucuauuacaguuucugccuugguuguguaccuagcuucuugaagcuuuuuaauguuucuauaaugagccaaaauacguuugcuucugcuuuguugccuuaguugccauggucauggguuucuaucauguaaaacaauacagcacauaucaagcauaccuuucugaacagagaacgcugacacagugagaagguaugagauagauagcaaauuugaacaagagcuucuuguaaccaacauccuuaaccuuucacaaccagagagcguugacuuagcuaccauuucaauggaagcuauagugauuugauuucuaucucuguuaaaaguugccagcacugagccaaaauaaaaaguaagcuguguuauuauugagguucuaauucuagcucuugccuucuaguaacaugugaucauaggcaaaccacuucaucucccauaccuguuccucucccuaugcaugcuucaugagcuggagaaugcuaaaucuugccaaguguuuuuauugaauuaaauaagcugaugugaaaaaauuuuaaauuuugaguaguguguaguuaaaauuuuuuuacauuaacaaaagaaugaaaguuacaagaaagaaaccuuaaugaccugagagauauuguuucuaagaaauaauuauucuuaguugcugaaugucuaagauacacuaaauauaauacuaaagagaaaauaaaaaugggaugugaacugcuucuuugaaauuaauaaagauaguuguaucagcagaacaucagcugcuugaauacuugauuuuaauuaguguauauacuagauauugcuuauaauuuuuaccuuaaaauauugccccagccaaacaugguggugcaugccuuuaaucccagcacuugagagucagaggccagcgaauaucugaauucaacuacagaaugaguuucaggacagccaggacccugucucaaaagacaaaaagcaaacuguguguguguguguguguguguguguguguguguguguguguguguguguuuucauuccuuugacguuuuaaauuuuuuaaaaaauucucuuucauuugagggaaggggacaucaacccacccacaaaacuuucuaccccaaaauuguccugccuacaagaugugcagggauaaagauggagcagaauugaggggcuaggcaaccaaugagacccaccccaugguagagagccagcccuugaaacuauuaaugauacucuguuaugcuuguagauagaaaacuagaauaauguccucugagaggcuucauccagcagcugaugggaacagaugcagaaacccacagacaaacauuaggcagaagagcucugggagucuuguggaagaguuggaggaaggguugagggagcuggaggagucaaggacaccauugucauguccgcucucgaccagcaagaacgacacgaccaccaguccuucuaacagcaguuuauucaguaaacuucagucuucaucccucucucuucaucuuuuuccucaucuaucucccccgaaccccgggccucucacccuuauauacucucaguccccauccacucauagcaggccaugucaccucaccaggcacgcagcuucagccaaucaggcggcaggggcaugucuccaccaaauauggacuuguuuaaaccggcagcaucauggugcaccugugcagcucucacauggcaguggcuuauuuucagguguaugaggaagucaggugcaagucauaagacuuauuauuagcugcagucccuggcgccuucuugggacugcugccacacccgcuccucacacaccauaaaaagauauacagagucaaauaaccugugcccaugggggcuugcagagacuaaccaccaaccaaagagcaugcaggggcuggaccuagaaccccuacacauauguagcaaaggugcagcauggucuccauauggguccucuaacaagugaagcaguggcugacucugacucuguugccuuuccuuuggaucccuuuccccuagcugggcugccuugucuggucucaguggaagaggauaugccuaguccugaugcaucuuggugugucaggguggguugguacccauugggggcggggggugucuucccuucucagaggaaaagggaaagagggaaguuggggaggcugguaugaggguggaacugggagggggcugcaauuggaauguaaaaugaaugaauaaauuaauuaaggaaaaaaauaauaaaauuuaaaacucuuuuaaaaagucaacaguggaauagauugugagcugcauugcuuuauguccuggauggcuaccuuuauuuaucucagcaauugacugcuguuuauuaugugcuguguucuuuuucuuucucagagcuuuguuuuauuuugaggucucauacugaauaacagcaaguuuguuguuaguacuagaaagacaacauuuugcuucugaaacucugaaauguaaaacuuuguguuugaagauggguggagacaagauaacaugaagaaaauugacuuuaaaaauuaauuuauucugagguaacccaaucacaaaagaaaucauuagauaugcacucacugauaaguggauauuagcccagaaacauagaacacccaagauacaauuugcaaaacacaagaauauucaagaagagggaagaccaacggguggauacuucauucuuccuuagaauagggaacaaaauacccaugaaaggaguuacagagacaaaguuuggagcuaugacgaaagggugaacuauccagagacuaccccaccuggggauccaucccauaaucagccuccaaacccagacacuauugcauaugccagcaagauuuugcugaagggacccugguauagcugucucauaugaggcuaugccagugccugacaaauacagaauuggaugcucacagucaucuauaagauggaacacagggcccccaauggagaagcuagagaaaucacccaaggaaggagcugaaggggucugcaacccuauagguggaacaacaagaugaacuaaccaguacccccagagcuugugucucuagcugcauauguagaagaagauggccuagucagccaucacugggaaaagaggccccuugguauugcaaacuuuauuauaugccccaguacaaaggaaugccagggccaagaaacgggagugaguggguuaggggagcaggguggggggagaguauaggggacuuucaggauagcauuugaaauguauauaaagaaaauaucuaauaaaaaauaauuuauucaugucuuagguuaauguuuauguugauucugaauaucuuaauuguagaauauuaauacauaugcucuaguaucuuaacugcuauuacggaccaaggcacauaagcuucuugaauugacaguguugaccuuugguuuguacuagucaguguuaucuggcaaaauagauuucaaaauuccaaaaagacaugcuucagugcaugcuuuucuuuuacauaggagguucuauauuaaccauguagauauuggugaaagagaggagcuaguaugugguggcuuugcaaccauuuacaagcauacaaaggauuuaacauuuauaucauuuaauuuuccauucaaccugguaagagguuuuaguauucccauuuugugaaagaaaauauugaaauuuagaaauuaaauaaauauaaaauucuuucauggaguaaucuuuuuucccuuucuccaagaagaagucugugauaauucucuugguuuuacuauucauaaugcaccuuuuagcccuggaaugcacuaauaauuuggccauccuuuuuggcaguuugugauaggccuuuugugugaauguguguccuaguuuacuuucugaggccuuccuugaacuuaaaacaguguguagucucaaaaguagagguuuuucucuaccauuuuuuucuaacauugccccauuuuuguuuuuaaguguccauuguacauauguuaaauuguuaauacugccccaaugggucauugagucuguucauuuguggagaacugucacacucuguuucuuucagauuuccuuuuuggucccucaccccuuggaaaaguuuuauuccauguuuuaagguuuacuguuauuuucucucucccacuuucucuccuuccuuucuacagagucucacuguguagcauaggauuuucuggcguucauuauauaucccaaguuuaucuugaacaugcaguccuuuccugucagcuucccaaguacugagauuacaggcauauuccacugugccuuugcugaaccaugguuucuugaaggagcuauaauaaaaucugguauuguaucucagucucuuaguauuggcagagaaauggaagaaagaaaagaguguauguagaagcaugugcuuugcaacaaagucaaagccauguauuaagaacccuuaucuauuuuuaguucagucuugccugguucuagaacugaauagcuuuugacaugugcuguauucaaggaguuucaugugggugcauuguccaguagauuugcagccauauuguaguuugaguaucccgaguuaauggauucugggcuaagauuaguuggagacugaugaggauuuagaaaucucgguuucuacuaagagggguuuuagcaugagggaaggugcaccagggucgaaugauucgaggaaucaugcuuucagucuuacaugacguuguuuugguuugguuugguuguuuuuguuuguuuguuuguuuuguuuuugacucguuuggcucuuuuccugccuuuaguuugccaugggauguucaugaaauuggagggcucaaagaaccuuucccucagaauauuaaagggaacagaaaguccagaugaagugaguccuggagccauuuguuuuucugaacuugagcugaagucuuuggggagaagggcaaaauaauuuauuauucuuauuuuuaaccagguuugcuaauauaaucaaguggagauaaagacucuuaacaguaauaaaaugauuugagccugaauggcuucugucaaauaccuuccucaagcacuuguucuggcaguuggucucuguuugauaguccaaaaguagucuuguauucauacugcuuuggauacucaguuuuuaauacugacuuccugagcuuuuuaauuuuuuaaaauaaggacauuaauauacuuacaccaucuacaaaguauuuuuauaauaaauaggaauaugaaaauuuccacucuacucaggaagcugcuaagaugaucaaguaagucuuuaugaaccugugcaaugguaugguacccuuagucacugaguaguggaauauguugucauagaaaacagugggcuuaaaacaaacaaacaaacaaacaauucuaguuaauuauaguucagcuugacuguguauaacuuuguaaccuugagaaaacuagcuaaaccuaagauauauuuuuccaucugaaaaauaucauguguauuuggaagguauggggagauagauacugucugcccuacauguuaauaugaagaucacaacggagguaugaaaguauuuuuggaaauguguaauuauacaacacaaguguaaaaaccguuuauaaaauuagcucagcuuaacaaagucuucuuuuuaacuguggauuuaacuucucaucuaaauacuguauuccuuuuaucgaugauaguuuaaaaaaacaaaaauaauaucuagguuggaaaauggauguaaauauuguuuuagcagaagauguaaccuaauauaaaagaauuaaauaauuuuuaacauucuuuuuuaaagaauuauuugaaaguguuuaucuuuuuaauuccuagucuuuaauaucuuuuaacuguugaauucuguggcacugcaugugaaguuuccacguuggauuaucaauagaaaauuauuguuguuuucuauauguauguaauauguaugugugggcacauauuccuauuacauacaugcuaaggccagagcagcagauggggugucuucaugaauccugaauggcucucagucuguuuccaaaccagaagcucacaguuuaggguaggggcugaccagagagcuuuugggaccugucuuucuguucuccagugcugauguuaggggcauacacagcuguauuuggauuuuuguaugaaugcuaaggauucaaauccagguucucaugccuucuuacuaccaaacuaucucucuggcccugaaaaauuaaaacaauccaguugcuuauugucugauucuaaacugauucuucuucuaauuaguauguauguauucagaagaaugcaaacuaacuuaauauaaugcuaguaugaguauaauuagggaguuaaacuugucaaaauguaaagcaaugauugaaguaugaauguaacauuuugguacuuucagaguuauucauaauauucugcuguacuggcauagaucagugagagaaucccauugguugcuauaguuauucuuaaaugcaugucaccuauggugcuuacauucuaaaagauggaguuacaaaauaaaagauaaaauacaguguaucagcaauaaauacuacagagaaaagggugaaaaagggaauguggaaagggcugagagacauggaggugggaaguaggcaggcuugagaaaguggccaucuagugaagccucaaaggaauaaucacugaguaacugaggaaggaacacggggauugccagauguagcacuaacaucuguagaaagugugccuggaugcucugaggagggaaaaggacaguauacugaauuagaaucaggcuagagcagcacuguggaggucagagaagugaaguuggaggguuuugaacagaggaacuguaugaccuuauuauuuuuaauggugagagaaacuugagaguucgaggcagaaaguuuaggauacuauuacaauaauccaugugagccucauagaagucugauuagugugguuucaagagaaagugggaaaggcugaggaaguagcuagcuaauacaguaccuaccuaguaugagcaggacccuggguugauuuccaggaauguuaaaaaaaaagggggugggaauggacaauuuugcuguagaaggaucuacuuccuagcuuguucagauggugguuggcaggauucauuucugccuguggccaaagaccuuuguucuuuaccguguguaccuauaaaacauuucacaacuugggagcugacugucagagcaagcaagaaagaaucccagcauagaacuugguagcaggaacaucagucuuuaauaaccuugucacauaguggcauccuaucauuucugccauauuugauuuuuuuuguuguugucaguagauuauuagguccauccuacuccuagaggaagaagaaauuacauaaauguguaaauaccggguagaucauaaaguacaucuuugaaguuugccacucagucuucagauacugguacuguaagaugcucaucugguugcaugaguuagccuuuuuuucuagcauacucauaacuaguaacauucauuugugagagagcugggugaaaguaagaauuugguuuaggacuauuagcuaacaugcuuuguagccauggucuuguuuuuuucuagugauuccuuuuaugaaaugaguuagcaguguuaaagucaugcuauauccagugacaugugccuaacauuguggaagcugagucaggaggggccaaguuggaggucagccugagauacauagcaaguaaaagccaucagaccacugcuaccaagaaaagaaacuaaaauuuuaucuggaagagcucaacaaaaguaggaaagcuauuaaaaucagaaaauaugcagauacuuuuauagaaauuugaaagauugcuauauuuuaagauaauucaaguuuucauacauuuccaacauagauacuauuuuaugacuuggaaggaaguggauauauaaaaaucuaugcaguugaaguauagcugaacuugauauauacuguaaaauaaucuuuccuuguaaaacuaagcuuuuaacagaccauagauuccaacuguuucuuguuacuguugcccaccccccuugacauaguuuauauauugaagucaguucaaucuuuguaggagaacuaaaaaacaucauccuagucucacagcauauuaaauauuacaaauaacuuuccagaugaggaaauggucacauagagauguacccaggcuugcucaugacagagccagugccagaugccaagccuccugauauuauaaauugcuaggaaugagccuucuguaacucuuagaauuuuaagcaccaucccagucucauacccagaccugaguuuagagugacauuugcacacugagauuuuugaaugcugcugagacaguuccacuugcagcagaauuuggggacuugugcuuuucagggaauugguguacuuuaaagacccgagucauaucaacagugcagacuauccauucugauuuuggcuagguuugaccaggguaguaagaaguaaaucuuugcauuaagaaauaaccaagaauuuugcuggguagacuuucccaauaaaguaauucugucacuaguuuguaaauaccaugugcagacuuguuaaucaugaaauagaaguuguuugacacugaugaggaaaggagaaaguguucugccaucuguguuguggcaggcuuugcuguuguguuaacuagauaaauucuagcuacuguuaaacagacuguuugugagguuguuguuaauauuuuaaagaaaguguguaaauacaaagcggcaaagaagugguuccagacuuagaaauaaaagcccuagcuuugaacguacaucaguucuaaucuguaacuagauucuuuaauaaauacauuucuuggguuuguggcaaggaacaaaauguuuacaguuuggcguaaccugucuguggugcucuucuguguucuucgugcuauagacaagauaaacugcuaacuucugauugguuuguggcauaccuuccuuucucaucagcucuccacacagcucuucccacuccuuccuuccuuccuuccuuccuuccuuccuuccuuccuuccuuccuuccuuccucucuuuccuuuggcagugggucucacuguggccuagguugccucauccuccagaguuuggguuuccagauagccccagcauuuuguucuuuuacacaugaaguuaguuuugguuuagcauguuuuccuuccuaaaggauagaugugggagugugauauaaaagaguuaagaauagcagagcagucuaugugguggugccauacaccuucaauaucagaacuugguaggucgagauaggcaggucucugauuaaaguuagccugaucuacauauagaguuaacucacaugugaacauaccccccaccccacccccacagcaauucuacaaauaauuguuacuguauaaauuagcaaaguccccucucucccauucaacaacuagcaagggguuacacaguuuuaaaaaaaaaaaucagcagugacuuggaaagcaguauccaacagugacgaaucgccaacccagaaacagauuaucuucuuagaauggaugauauaguauaggccuuuaaucccagcacugcacugugagucugcagccaaccuggucuacauaucaaauaccaagccagccaaagacuacaaaguaaaaucaugucuuuaaaaaaaaaaaaaaagaggaggaaaggggaggaagaggagagggaagaagcaguggcagcauugguaguuucucaggauagcuuuucuguaaauggucuggcuuuuaaaauaaugggauauacugucuguuugcuuuugucuucaucacauguuagugcaccacuaaucucagugagcugccauuuauuuaccucuuaagugaggaaauaaauuaaaaaauauaaauaaaauauaaaaaaauauaaauaaaaaagcaaguuugcucuauaauacauaaauguauaacuauaacauggacccuuuaaggcauaagguuccuucuuaauuuugguacauacuaagcucuuuaucuuaaacucuguacuggcugguuuugugugucaacuugacacaagcuggaguuaucacagagaaaggagcuucaguuggggaugugccuccaugagauccagcuguggggcauuuucucaauuagugaucaagggggaagggccccuugugggugggaccaucccugggcuggcagucuuggguucuauaagagagcaggcugaguaagccagggaagcaagccaguaaagaacaucccucuauggccucugcaucagcuccugcucccugaccugcuugaguuccaguccugacuuccuuuggugaugaacagcagcauggaaguguaagccgaauaaacccuuuccuccccaacuugcuucuuggucaugauguuugugcaggaauagaaacccugacuaagacaaacuccuucuugauucuucugcaauuuaacauuauuaaaaguuacauuuuuuugcuguacacacacacacacacacacacacacacacacagaguuacaugugcauaugcauguggagcccagaagucaaccucuuguaucaauaucuaggaaccauccacuuuguuuuuugagacagucucccaccaacuagccugaaacucaccaagugcacaaggcuagcuagccacugagcuuaagagauccaccugucugucucccuaagacagaaauuacaaacauaugcggggaggauccguuuucuuuuacauggguacugggaacugaacucaaguugaagcaagugcuuuacugccugaggugucacucuaucccuguggauaaauucucaacagucucacuacuugucuuucucauaaguagauacagagcuucauuucugaaagaaggacuucaguaauagugaauggaaaauucauuagauuuacuuuaaugcagaucaaccucugccguguuaauguuaagguauuaacuugggugaaggaaggcaauugcugucuucauuuugauagagacaggugguuuaaugugcuauauauucuuuaaaaugugcuugugaaauaggaacuucuuuuuagaaccugggggggcuaagaaacuauaguauccuauuggauuuaauucauguguaaaaguucuaauuacauggaacuuaaaagaaaaguagaaucuugugauaacaaugauaaugacagaggucuauuguuuuugggugcuaccauuuagucucccuaauuuagauuauuuuaaagauucuuaugguacaaagcaguuaucugguaaccuuauugucuauuagagcugcuuaaacuucuuuuccacuuauaaccccuuuuuggcaaaacauuucaugagccacauuuaaaauguguacaauucagacauuuaaugauaaccauauauuuauuuuaaaacaauuccuugguuuacauauacuuuugccauucauuaacgaggaaagcaaaguugcauacuaaugagauguguaucuuuuuucuguaagaaccguuguauaaucuuguauaaauaucugacacuccagggcacagagcauuuuaccuucguucagaguugauaaguuuuuuugaugguauaguuaucaauggugggagagcaucacuucacauaaauaccugguacaaaaugacagaaguagguuuagaaucaguucagaaguuauuggaaauuuuguauacucccauuccaaaauacauuuaacauucuuuaaaagaaacucuagacaauaaguucaaacaacaauuguuuaaauuguuuaaauaaaauacgguagcccaguguaacacaaagauauacuaauuugaugcuuccaugccgauaaaugauaggaaaauauuaaaauucuuugaguuccaugauuaaaauguuguguuucuguacaagcaguuuuuuuuaauguauauuuaaaguguugcaauucauaguguaaugguuuagaaucugagcuuagguguuugagacgguguguauuggcauugcaugacaugaaggcauguguacaaugugaauuguuuucggaaccauggcugcaguggaguccaagaacacugcuggaaauacucugggcucauugcuuguuggguuuugaaucaagccuugguuguugcacaugcagaaccuuuuauuguugccaaaguuuuugugaccuccgcuugaguuaugcaaccacagaugaggucauagcccacucuaagcagcuguguguugaccuucuuucccaucgccucuuacaucuucuaaaggccaacucuauuuacucgcuaauuuccaugaucauaggauuuugucuguuuuauuucucuuauuaaauguuuaauugacuaaauuaaaauauucaaauggcuguuauauaauggcauuacuguaugcacuaaacacagagaaguuuggugucauagguccuacacaacaaagaacagggaagaaagaaauacugauugaaguuuucuugauucuuuggaaaauggagugaaaaucucugugauucugaacauuaaaauauaggagcugcuuaaacgcauccagugccacagaggcauagacagcuaggauguaccaacccugggagagcuguuggcaggugucuugcauuuuggggaaucugauuugguuauaaaacagccuuuuaacaaguaaauugaauaucuagugagauuaugugaaacaauacuaugcacguggcuuucuaauaggaacuguaugaaugaaugauggcgcuaaacugaccuuguugaauaauuacaaauaccacauacagagaacuuugguuaaaaagaguucaguaaccaauguaaauaauuuuccucaccauguauuuauggagcaagccuaaguuauugaagcauaccauuucauuucuaauugaauguaaucuuagaacagaaggccuugggugagagcuauuccuuacagacccuuguuuuccauuugaaguuagugcaaaugcagaugagaaaagaauggcucugugagauuguugcugauguuagcagcacaggagggaacuaaguuugccuuaaauagaaguaguuggcugaauauuauuuuuuaaaauaaguaggguaaagacuaaucaaaggaauaaaugauaugaagaaaguguuugagacauggggcaguguauuuaauuuuauuucauuauuauacuguguagacacugauggucugugaccauauaugaguaauuuaauaaucaucuauuggaagcuucuaguucugcuuccuuaguggagguaagauaaacagcagaguaauuacuugugaaaucccuuuuccacuuaaucagcuugcuuuuccucacccuuuuuauucauauaccuugcuuuccccugaugauuuuccccagaauaaaaaagcaaaugaaguauuguuuuucauuuuucagaauguuuucuauguaauaccaccccuuuuucuuccuauuguagaaguuagguagaaaaguuaggaguauaugugggggauggcgggggggggggugcauaugcauuugccagagcaccugcacgugaaagccaguggucuguauugaguaucuuucuccauugcucuuucuuuuugagacaaaucucucacugcccccagagcucaccauuuuggauagacuagcuggccagaaugcccuaaggguauuccuaucucuccaugccccucccacaagcauuuggaucacaucagcuuuuuuuuucuuuuaaagauuuauuuauuauuauauuaaguacacuguagcugucuucagaugcaccagaagaggaugacagaucucacuacagaugguugugagccaccaugugguugcugagauuugaacucagggcauucagaagagcagucggugcucuuaaccacugagccaucucuucagccccauaucagcuuuuuuuauuuggcugcuagggaaucuaaauucugauccucauaucugcauagaagcacuuuacaaauugagcccuaucccugucccacaagucaguauucuuaaaaaaaaaaaaaaaaaaaaaaaagcuuuuuuggccuauucuauugugguuguguugucuuugagcugggauuucacaguauacuccugucuggccuguaaguugugauuuuccugcuucggccucacaaguaacuggauuuacagguguauaccauuaugccagcuaaguuuuauuaauugcauaaaacugguaacauuguugcuuuaauaauuugaaauuguuagaguucuauauagaaacagagccgauagaaugaaaacacacacauacacacacucgauuuauuagagugacuuacaagcugugauccugauaguccaacaauaguugcuuccugauggaaaguccaagaaucuaauacuaguuuuguccaggaggcugaagaucucagcugaccuucaguauacauuagaauccuaaagaagacucuaauaauaguuaaggaaugaauuugccagcuugaaugagggcaagcaggccaaaaaucaaaagcuuucuucuuccugagaucuucucaacuuugucacaguauuaaaauauuaagcaaaacaugcacguuuucuggguuuucacuuucaguauaauguucaguaaauuacacaagauaacacuucauuuugaaacaggcuuuuauuagaugauuuuacguacuuguggucuaggugcauauacacuaggcugugguauuugguaggcuaaguguacuaaguacauuuuguaggauauuuucagcauugggcaaauugucaguuuguaaucccaucauauuucauggugcaccuacaguaugauacuuugcuauaguguuggucuccuuguuuaguggucucugggcuccccuuuuccagucucugaucagaaaggugaagcuuuauuuguuaagguacgcucccugaagcugugcucaucuucaggacucagcaguaggaggauauaggaggggaugggggcagaaccacaaacacacuaaggauuccauauaucuauccucuuggaacuguagcaucucugaccagagagcaguguucccuugccccugaguuuuagacucaugaucuuuauugcuauugcucccacagauagcugggcugaagauggaggagagguauuuguguguguguguguguguguguguuuccuauacuuucuuguguaaagauuuaccuuagucacagcugcaacaugaaacuugucauugggcuauauacacuucaggcuggaugauacuagaugagaacaaaaugauggccauuccaaaauagugcuuugcauucuaguccucuuauaggaucugccuauugccauuacuuucuaggguucccauguauucuauuuuaggcauuuaggucuuagagcuacauucaguuggugggacaguugaaguguuguauuugcuauauuuuaucugcaacuagaaccuugcuuaaagguuuuucaauuuuuuucuaggaauuuaacaagaaacugaaguuuugauucaaauauuuuuugaauugaagccagaaauguacuaagauuuugauucuuucauuugauuaagguaagauuauuuaauaaaauguaauuguacccugacauguuuucaacauacuuuaauguuuauuuuauuaaaacguuuuuauuucuuuuuuuauuagguauuuuccucauuuacauuuucaaugcuaucccaaaggucccccauacccacccucccaauccccuacccacccacucccccuuuuuggcccuggcguuccccuguacuggggcauauaaaguuugcaaguccaaugggccucucuuugcagugauggccgacuaggccaucuuuugauacauaugcagcuaaagacaagagcucccggguacugguuaguucauauuguuguuccaccuauaggguugcaguucccuauagcuccuuggguaauuucucuagcucauuuuuauuucugagucucuagagauuuguaccuaaaaacauuuuuguggguucuuaaagcauuuuauauuugcuuggcauacacaaagccuaggguuccaucccucauaccacuuaaaccagaugugggggacaccuauaaucucauuuuggagacagaggcaggaggguuagaaauugaaggucauccucugcuccuuagcagguuggaagccucacugaaauacaugagauucugucaacagaaaguggguagugggagucuuuuaccauuuaaaugacuagugugucuuuaaauaacaacuaccagauguaaaggaagcaggauggugugaugggguguaauaaaaagaaauguuugccuggggacaaaagucaucaaauuggccuacagccuggccacuuguuuuauuuaguaaauaauguuuuauuggaacauagccauauccacucaguugucuuugucuguggcuaccuuagcacuucuaugcugaguucauuacuuuaaauuuaaauaugcauauaauugucuaaguaccuguaccaagccaaaaauccugaagugaaagccuuaggaagccuuaguuuucuagcuagaagcaguggaggcagagguaggcaaaucucuugaguccagccgggucuacagagugaguuccaggccagucaggucuacacagagauauccugucucaaaaacacacacacaaaauaaauaaauuaaaaauaaaaagcaagcucuuaagcucucaccuuucuuacucucaucucuagcuccccuucuugcucucucucccuuccccucucuccacauggccauggcuggccucucucucuuaccuucucuuuuucucucugcguuucuacaauaaagcucuaaaaccauuaaauaaauaaauaaauaaauaaauaaauaaaugacaacacuaguuuucugagauaauugguauauuaaacacagacauaaugcugucaaugguugcgugccaagugcuuauuuauuucugaguagugcucuguuuucaaaacuaaaagcuuacauaauaguguuuuguuccuauucuaaaaaagagauucauaccaacuuuacuuugcuuuaccuaguaagauuaaacagaacuaguaagacuuugagagaaugaugauugcuauuacuagcuucccugauuaaguaauuuacagcacaugaaguuuuaagugaaacuauccuaauacaaaaguuugagccaacugugguagugcguuguagguuacuuggagaggcuaaggcagaaagauugaaaguucaaggcuagccugggcuacaugacaaaaucaucuagcagcuaaaauaggcauuacauuucccucuaaaguaugaauucaaccacuuaaugugguugucccuccaucucagcaaguuccauauugguggauuugaccaacaucaacgcaaagauguuugcagggaaaacuauauaaacuuuauuuccuugugguaguuuccuaaacaauauaguauaacaaagcauuugugcucuaccaguuggugcgugaguaaucugggggugauuugcagggagaggauuuauggacauuucaugaagauagugugcucguuuacaaaagggacucagcacacagauuuuuauguucuuggguacuagaucuaauuuaauguuauuacuaaaauuaugaauguuuagaaacauuagaagaagaaauuaaaauuggaguugaguaauauauaugcugugcuucucaacaaucucuauaaugcuaaagaaaaaaauaaaagcauagaguggucuauguagaaauuauaaugcauuuccagcuucuauuaacgaauuaccuggcuuagacacuaaaaucugaaggggaaaaauaaggauugggagggaacuuauucuggauaacuuauuuuuuaaaaauaaacuuucuguaauuuucaauguauuuuaaaaaaaacaccauuggauuugaaacaauaugugacaucuagccugagagaguauuugguuuaaaauagguuuggauaugauguuuauguuuguuuuuuucucagaaaauaaauuuaaaacuuuuaaagaaagaaaacuggaaauuuaaaacauuuguaauuguauuuuaagaaacuuuguauugauucuuugugaguuucacaucauguaucccaauuccacucaucuccacacccuuucauagcccccuccacccuugccucuaccccagaagaaaaaaagcauagaaaacaucuuaucauggaagcuguagcguguuacagugugucccacagauauacccuuuuguccacauaucuuuacuugcaaguguucauugcagugagucauuggucuguuucaaggccccuggcuucugcuacaccaucaauacuggauccucaccaggacuccucgaauauccuguuguugcccugugucauggagauccugcaucuuugaucuuuagaacuagccucuucaugucuuccagugguucauaguugagguagauguugagguagacuaacucaaagcccuggaucucaggccuauaugguagagcuggucaucccgccagcucuccugcauccacaccacaggggugagcucuucagcacugccccaaugcuacagcuggcaagggguagggacaucuguccugcucuuauggccagcccacccacacccaagcugccaaagccagcucuacugugcugcccagucaaggugugggugcucucccaugugcuguagcuagcaaggggcugagccaccucuccuucuuacacccucagagcugacucaccugcgauuucaccaucagggccagcucuacuguacuuccagguaaggugcagggcccacucucgcaaguacugcagccuuugagaggggcagggccagcucuacacagcucuuggacaucaacauggucccaggcagcaacccaaaccagggaccuucacauggucuuuagugguaauaugagucacggucauagacacagacuccugcugcuauauugccacagacccagacauggcccucagcagcagcauggacuggaauuuuaccauggccucagguggcaguucacgauaggcuauuccuuuccacccucaggucuccaguucuaccucucuucauaauguucagacuguucuacuucucuuuuucucccaucuguccaccacauaauuaauuguacaucuuaguggcucccacuucgguugagccaccagcaggcagaccucuguguauucuccucugccuggauggcaucugggugcccuaggccucugagucauugacuuaucauuucuguaagcuuuucacuggacuaucacaaaguuacugagcauguguugaauuucugaauuucagcuaauaguaauacagacauguauuuucugaugguuguugauuuauuuacaagaaaaccaugugguuguugggaaaugaacucaggaccucuggaagagcagccaguacucuuauccucugagcucuagaauauuuuuauuauauuuuauuaucucuagcucuagaauauuuuuauuauuccagaaaguuccuuuuuuauuuuauuuuuuuugugcuauccuccuugauagaucucucuucuagccacuaacagaaaugggauuauauguagugaguagccuuggauuauguuuuagagauucauccauguugggggagugucuuaggguuuuacugcugugaacagacaccaugaccaaggcaacucuuuuaaggacaucucauuggagcuggcucacagguucagagguucaguccauuaucaucaaggcaggagauggcagcauccaggcagguucagacagagcugagaguucuacaucuucaucugaaggccacuaggagaagacuggcuuccaggcagcuaggaucaggguuuuaaaggccacacccacagugacacaccuacuccaacaaggccauaccuccuacuagugucacuuucugggccaagcauauacaaaccaucacaggcacagauagguauuggaaucaauauguuauuaaguuauauuccaucguacacauaagccaguuuauccugucauuaguuggacauuuagauuacuccuggccuaaacugcuguugguacucacauauaaccuguuuaacuuggaauuuugaaugauauucucuuuagugaguacuuuauagauuucuucagcuuauaucaccuaaaauagaagauacuucauugaaggcucuguuagaaauugaagacaaaaaauuucguuggcuguuuugaaauuuggagagcaaauaaaugacaucuggacaguuuuuaaaaguuuugcauguuguaguaaaacaaagauaaaugauaagaaaugaaguggagcagaaauguaguguggcaaacauuggauuaaaguuuaaaauuggcugguugugguggugcaugccuuugaucccaguauuagggagguagaggcagguggacucuugaguuguagacuggccugaucuacagugagcuccaagacagccaaggcuacagagagaaaccuaucucaaaaaacaaacaaagaacuuaaaauuguaguuaggccuauaaucuggcuuuauccauguuacuuguuagauuucuaccuguaccauuuauuaguccugagucaaauuauaauuuugaacaaauuauuaaccuauaugaaaggaaaauagaacuuugcaguuuauccaauucagucaccuucuuguuuagaaacauuuccacacuuucaucucguuuaguccuagccacuuuuggggugccagugagagagcuaguacaagcagugauuggcagcagcagcagagccugggugagucaucacuugacucgacaucuguguucuuaucuggaaaauagagccugucucucuaguucagagcagaaaaugugauagcugauaaggacucaaagcugcuggucucuuccucuucccuuuuguaagaagcucucuugucuccuacucacuauucugaugaauauuuauuauugagagaaauuuauaauauauuuuaaacaauuuuuuuuuaaguugcaaaggauuaggccagaucagaaggcuaguacuguguucccagaguagcacuguugggaggugggagacccuugagaaauaggagguccuuagguccuuggggcaugcccuccaaagggccuauggaaccucagucugucucuguguugugcagugagcacucucagaugcaugguccuguggugaugcgccaugcucaucuaagcccuaacauaggaugcuacuuaacguuggacagaaaacucaaagacaauuaacugaauaaacuuuuacuuugcaaggagguugucucagguguuuaguuguaguaacucaaagcugacacuguugcuugauauguuaucauaaauauuagaaaagugaauauaggaauagguuauuuuuauaugaugagucccauucuguccacuuuuuuuguaagaugcuuucugaaaugccucagaauugcuucccacaguaauuacauuaaaaaaaaaaaaauccugugauuuuuuuuuaaaucaucuacuauccacauagugauuuuucuacaugacagagaugucaugucuuuaguauuuuaaaaguugcuaacccaacaaaguggugcacaccuuuaaucccaguacuuucgaggucaccuucauacacaaaaagaguuacaggacaaccagaacuccacagagaaagcuugugaugguguaguggcaagauuuuaaagaucacuaucaggcuggagagaugccucagcaguuaagagcacugacugcucuuccaaagguccugaguuaaaauuccagcaaccacgugguggcucacaaccucccguaaugagaucugacacccuuuucugagaugucugaaaacagcuacaguguacuuacauauaauaaauaaauaaauauuuaaauuaaaaagaaaaagaaaaauaaagaucacugucagccaacuucugaugagccuuccuuguuucauuccugucuucacaggauggcaccaaacuugagagaagauguucugugagaacuuacugccaucagcacauguagacuuccuaggaaagcucauacugugaagucccccugugcgggaaccaugcagagcaaacacaucauuaggcucuuuuucuuagcuuuccuaaugaguggagaaaucucagaccugcagaggccugcagcuccuuucugaacugauuuauuuacauagcuuaugcuuaguuuaacacauugcuuagaagcaagcagagagccuuucccuucagugcuguacacuacuucaaagaagaauuuagugccacugcaguguugcuuuucuggaugcaaagcagcccuucgcuccuccuuaugcugcuauuggagaaaguuaagcugaagaccuuagagacucuuaaagggcagaccugguacacagugcugcucuuugucucuucacaagccaugagcaaguauuccguucuuaccuaguuggcagagauacauagugauuuggaaccagauaauaugauauuguggccugguggaaagagcuuaacccuucgaggucagauaaauaaauguuaguauaaacccuaccauguauauaacacaguauauaugaggaaugcauuuuuuuccuguaacuuccccuuccuuuaaaaauagagaauacaaaacaaucuuuuugauuuguugaggauuuuuaacccagacaugccuugauaaacagggguaacaagauuacuauuguguguugaguguugcagcugauucuuagcagcaauuuggggugaugggaagacgaaguugcuucaguaacagccugguaaaguagacugaaggguauguaacuacccacacugucaagagcaagccuucuugguuucuggaugagacauguuucagcuuacuauuuauggcuaacagugacuauuguagcaggaauugauagcaacaaaauauauaaguaaaauugcccugcaccuucaauuuagagaaugccaacaaauuuauaauaaucucagaaagacuuagcaauuuauagucuuacuaaaauguucuucgaagucuacuguacaguccuuauggaauaaggcucucuucuugcuuguaagcaaugugucaaucuaagcauaugcuaugcaaaauuaaaauuauuaauuaaauucauauuucacugugugguuguuaugagcuuauuguaauugagauauaaaaaagagguauuuggagaggaggugguuaauuugugcaucggaaagacuuuacccuggcuugcuccccauguccauguucugcuucugaaucauugaacccugcugugguuuuuuugguuuuguuuuguuuuaggucuuuuguuuuuaacuuagcacauugcugucuggaacaaaagguauuucucagucuuccuuucaacuugagguagccauguuucugagguuuggcuaaugaggugucaggaguguuaugugaaacugaagggaugucucauuaaagggaacugauuccacacaaagaugugcucuuuugcccuugggccuuucugcugcuuccugggcugcaaugcagacauaaagcagaggcuucaguagcuuucuugggucauagguugauauaaaaagauuaaaaguugcuauguccuugaugagcauguagcuacuucaauguuucagacuguauacuuuuggguuucuuuuaugugaauaaaaaguaacaauggcuaggacauauggugucuguuucuaacaguauaacccagcccucacagaccacaguguugcugggcacagguaucugauucccucuaaccccuccucuaggugcuguugaaaugaaaccagcacagcacagcacagcacagcacagcacagcacagcacagcacagcacagcaccauaugcuugaaauacugaaaugucaagaaauuucaacugaacacuugauauucacacugaaaggaaccagacccugaaauaaauggcuauuucaggucuugcacagaaaguuacaugaugaaccuaggaugucuugucaugaaaaauagcagagaagcuaucaaaagccauugagguuguuugaaaggacuuagagccaauuugaaaagagugacauuggcuaaaguuagaauaacuugagcauuaaacaccaguaacuauaguaaauugaaauucaucaaagcucugagcuucuguguugccuuuuuaaaggcuuuuugcuuauuuuagagguuauuaaacaaccaauucauuauuuuuauaauugcuaaauaaaaaaaaucaguaauuacuuuccuguacaacuauauauugucaagcuaagcaaauaguaaggcaagguuuucuuuucugagguguuccagcuaaugcauugagaaggacugauaaagugauaggcgaacugcuaauggagagcuuucuaguggcuguguggggcuggaagcaccuaccugcacauacagguuaauuuuacuaucacagagauaguucuacaucauauauacccugaauaaauuucauaccucuaucaugaauuacucccguugaacaaaaauuaaacccuacucuuaucaaaccucuagaucuagcugcugauuuaacagaaguacuggagacaggauucugcaacaguuccaaaaacaaaagacaacacaccauugaauacaaggcaaaaacauugacuuuuaauggauuuauuuuguugacagcuuuaugcauguauauaaugcauucugauaacucucuccccugccuuguuaaauguccuccuccuuccagucaguccuuuucccagauucauaauguuuugauuuguaacccaauuagcuaaaccaaggcaaguugugaucauuagauuggaacuaucccuuggagccuggaggagucacccaugcauuaauaacugaagagaguaauuaccucucuccaugaggcuagcagucaauggguagagaccccugagcuucuccaucaucuaugccccauugaugcuaggcccauucuugugcagacccaguacaggcaucuguaguugcugugaguucacaguggcaauggcuaaugugucuugucuacgagauaacauccauaguucuucuuccuaucuucuggcucuuccauucuuugcaccacucuuccacaaugcucccugagucuuagagguaauagaaagauauaaauuaaaagaguguagaaggaaugagcacuuacccaucacuuggcagcaccauauacagccaugauucuacaucacauucccugaaaauagccuucucugauuaaggccaagaguagcaguggucucuggguauaaacgucaauguuuagacuugacacaaugucaguuuagcuggacagcaguauucagcuuccccccagagccucugaucucuccuaccauggauuuuucaccagguuuaccguaccagacauggauuccauccuaugggauaggucuuuaaucagggagcaguugguaccuuccuaacaguagugauauagauagaaagguacagcuuaccuggcaaguugcucuuguaguucacaggauucacagcuagguaaguucacugaugccuuuucuccccugggagacuguguaguuccuucuuccagcucgguucuaccuugauuucuccauaacaaacgcauauacuccauauaagaguuuacuucacagaaauuuuagaaagcauuucuccucccccucccccuccugugucugucuaccuaucuaccuauuuuuguuuuuuugagauaggauuucucuguccuggaacuugcucuguagaccagacuagccucaaacucagagauccaucugccucuguccccaccccaguguugaguuuaaaggcaugcaccaucaccaccugcuggaaaucauuucuuaggcuuacguauguacucacugauaaguggauauuaggccaaaagcuccgaauacccaugauacaacucacagaccauaugaagcucaagaagaaggaagaacaaaguguagguacuuugguccuacuuaaaauggggaacaaaauaaucaugggagguagagugagggagagaagaugggggagagaaaggggaacaggaucagaugugggaggagacaggggagaaguacagagggucaggaaauugaccagagguguguagcaguaggggauagggaaccggggguagccacuagauucccagaugccagggaagcaagagauuccuaggacccaacggggaugacauuagccgaaauacugaacaaaggggagauagaaccugcagagaccauaucgguccccuguugagggauggggccacccacccaucucaaaaauauuaacccagaauugcuccugucuaaaggaaauacagggacaaagaauggagcaaagacuguaggaaaggccauccaaagacugucccacuuguggauccaucccaucugcagacaccaaacccagacacucuugcugaugccaagaagcacuugcugacaggagccggguauagcugucccuugagaagggucugccagagccugaccagauagaggugcggaugcuugcagcuaaccgccaaacugagcauggggaugccaaugaaggaguuaagggaaggaccaaaggagcugaagggguuugcaaccccauaggaacaacaacaguaucaaccaaccagagcucccaaggacuaaaccaaccaaagaauacacaugaagguugggggcggggguggagggagaaugacccaugacuccagcugcauaggaaaccagaggauggcauuaucuggcaucaauggaaggagaggcccagcauaggggaaugcaagggcggggaggugggaguggauggguggguggaagagcacccucauagaaacaggguuggggagggaugggauaagggguuugcagaggggaaaucaggaagggggauaacauuugaaauguaaauaaauaaaauaaccaauuauaaaaagagagaaaaauugcagagaucauagauauugaaaaugaauucacaaggcaguaaggcuaagaugaaaaaagaauacuagcuaauagaaagauauaaauuaaaagaguguagauaaaauaaggacaauaggauggaaacuguuuuuaaaagcauuaagcaauagaguagacauugaauuaugcagaggccaaauuaaacugcaccagaauaaagaacacauucaaaaauugaauucaugauauagaauacaaauuugagaagcuuucccaaaaugcaaaugaaaagagauguaaaauauuugaagaaaguaaagaguaaaaagauguaauauguagaauuuauauucuagagagaccagagcaaguugaauagggaucgauuuguuauuaaacacuguaggaaaaagauggaggauuacuugaugauaauucaaacaggaguauucucuaacacuugcuacguuuauuaaaugaggcaaacaagccuauucugguauuccuguuuuaaaaucaucuuuaaaaaauauuaaaaacuuaaaauuaaaaucaugcaucuaagcaagaaaagaaacaagcaaagauaccaauacagagucuugccuuagguuguuuuuacaguuaaacuguauuuauaugacaugauuuggggacagaauucagccuuguccuuaguucagcacuccugggcaggggaaggcacaucucugaauuugaggccagcuuggucuauauaaugaguuccaagccauccaggguuauacagucuccacaggaaggaagggagggaggaggugggagagagaaaggaaaagaaaagaaaagcuuguuaacauccacauuuaguugacuaucagggaaucauccaguuucugaaaggaaauauuguguaucugcucauagauauucuauaauaauaagaacgcaggccucacagucugacagccaguguucagaucccuucuuaaucuuaguuaugugauccaucaaauuuacgucuucagugucuucuuaacaucacaaagcauaaggcuugccauguguaaaaucacgcagauacaugugagucuugcugugcagcccauacuagccuggcacucugggucaucuucagccuuccaagugauaggauuacaaccuguaccaccacucugcuuuaggaauguuaucuuauuugaagcauuaugagccacggugucagagaucguguuaacuuugauacaaaaaaaauuaaaugagcuagcagagcuuacuuuugucuuauugugaaucauuucuagaguauaauuguuuauacuucuagaagggucuuaaacacccaaaauauuaggccuuuuuuuuuuuuaaguuaaauccauucuggauauuuaaccaauugacuguauaauuuaagucuucagucuugccaagcaguaaacagcaguaauuaaauugcaaaucuguuuuuaaagaguuggccaugauacaucucaguguauuuuguuaugucacuuauacucauuucuauuugauuuaugauuuucagauacccaaauacaggaaagaaaacacaguuggcugauuuaaaugccuguguuuuuaauuuguauuuuaaacaaugcuuauucauuuaacaaaucuuuaaccaaggccuccuuuggaccagauucggccuuaggcacugggagugcaguaauggguuggagauggacaauaaucuaaggaaagaagugugucagacugaguaaggagcuagagaauggugggcacauggacugaucacugaggccuuuuuaguucuaaggcaucuaagcgcuggcucaagugaaguaaggaaggaggccaaguggauaccagggaaagagaaugucaggcaaguguaaaucuccuggcuagaagcaucccugacaugagucaguuuuccccugauuauucuuugaaggguuucugguccccauuaaaaaaauuaaaagagaauuagaggcuucuuucucuuauuuugggguacauucucccuaacuuuuacaguccucauaucauaguguuacuaugauacccaucugaugaugcgcauuaauuuuuuuucucuaggcacaugguuagugucuuccuuaccugcugcauaguaacuggagaacaauugcuuaaccaguccauuugggcauguggugaucuuuuucuuauuauuauuaucuaagaauaauaagaaaaauaaauugcuugauauauuaauaaaagaacauaauaaacaaacacaggucauaacagucauauugucaaaaacugccugcaguugucauuucaggagggauugcauaaugcucaucuccuguuguuucucuucuauauuacuaacuggacuucuagaaaauagaauacuauauugacuagggcuguugaaccauucuaaaguacaguucucagaguuaguuacuaguuucacuguugguuguuguuguuguuguuguuuauuuguugggggggggcugacuuuauccuuuuugaguaauguugagacuuuggguuauuuuagguaacuucagacguaauucucucaauuuuuaacaaauaaauuugacagaggaacuuuaaggcuguccacuagucuuuuagcuacacagcacuguauuuuuuuuaauugugggaauguuuaaacauauaaauauguaacuuaguauauaauaugccuguuggucagacuuaacaguuaucaauaucuuuuuccaguguuggucuaauacccucuuaacuuuuucugaucagggucuugcuguaugccccaagccagccucaagcucagaaucuuguuuuagccuccugcgugcuaaaucacccagcuucuacagcuauuuugacccaugggcugugauuccauugauuuuugaaagucuguuaccugucacgaaccuagaaucaucuaauuuuucuaagaagucccauuuucuuuuguuuuauuuuuuaguaagaaaugcuaucagauauaaaucuuggcauugggguuauugaaaauguguugaacuauguuauuuugguuuuccuaucaugugcugugucauagaguaguguuguucaaugagcaguuacucacauuuggauagaggaggaaagauacuccucaaagauguaacaaagagccuuguauuucuguguuuacauuuuuuuauuauuguguauguucaugauauuuggguuggagugcaguaagagugggggucagaagaacuuuguaggauccucucuuccaucauggguucuggggucaaacuugguuuuauuaaauuuauguaucaagagcacccaauauuucuguuuaauggucaaaaugucuggcaugguggauguauuauauaaaugauaacacaugguucaguuugucuuuaucacaacuuuuauuuauaagcaugaccuuugacagauugcucguaccacacuuugugcuacuuuguuguuuuuaagucacuuaauacauuuucucuuaguagugauauaaaugauagaacauuauuagaaugaguauuucuaguacaagaagaaauauuaaauauaucucccagauucagauuuuuugaauacugacuugaugcuacaaguggaaaaugguaauaaaacuuccucaugcacaaagucaucaaacauacucuauaagauuuggagcuguaugauggcucaguaguuauaaucacuuacugcucuuucagaggaccugguuuggauuuccagcaccuggaucaagcagcucacaccuaccagcucuaguuccaagggguccaguacucucuucuggucucugagaguaccugcacaugacacaugguguauaagaacauacauauaggauaaauacauuuuuaaaguauauaaaguucauuuucaggcuuucucucauaauauguuuauauauguguguauauauguguguguguguauacacacacacacacacacauauucaaaugaauuuuauggcuagauuugagucccacuuccaauauagcauacaugcagaaauucaaagaccaggagagagcuaaacuuuucuggucucaaacauuucagauacucagcuuguauuacauucccagcuuucuaguucuguguauauuuucaggacaugcacacaucuuugccuccuuuccuuuuugauguuccacugaaauaacaugucuagagaucagaaaugaauagacuuaagugacuaaguggacuacaguugaacaggcccagguguaccgucuguuuaccccuacagacuucacauguuccugcucuugacugccuauaacuggcuuaauuccaggugaaacaacaggcagacuuucuguagagaaauuggaaauggccaggcuuccaaagccauguuuguucugacagagggccugcugcuuuccuguccuccacuagaaguuagcaccuucuggcccucaccgagcucucuccaccccccaucccuacagucuagccaaaaagcagaccaucuucacaauaaugaagagaagcuaauaagaggucgucaggcaugugaggaaaaugucagaaaaauagacaagauaaccaagaaaaacaccaaugcaauaaacagaaguauucacagagaacuuuauuuuuaaaaaggaacucuguaacauguagagagcuacaaagacaguacuuccauuaagccacaggaggacaaacugucagauagaaagugcacaucugguacagaaauaaucagccagcaugaaaacuggaauucauaagaugaacaaaaguuccuuaaugaagucauucauagugacagcuauuagacugcacucaaacuuuaccaguaauccuuacuauuuuaagauugugcgguucugcccuaagacuuugaagcuaaucuacauccugccaaacuguuaagggugggagcaaaagggcuggagagauggcucaguggauuugagcccuuccauagaauaauucccagaacccauauuagauggcuuacaaccaccuguaacuccagcugcagggaaccaggcacucuggccucuguagguaccuacacucaugugcacauacccauacagagcauagacacuaauaaauaauuaaaaaugaaccuuaaaaaauauuggaguuucauucagggucuaaagcuuaccuucucuucaaauuggaagaaauuaguggauuauauuaacuuucuuaacugaaauucaucauuuaauuuuucauaaaauauuuuuauuugggcauuuguuccuuuuauccugcuuaaaagguauguugcagagaaagcgagaagagauuacaaacaaguaauuguagaaucacaucgcauauuaaauuacagagugacuguggcauacauagucuaugcauuacauuauuuacucugaacaauaucaaguguuccauacuucacacauaauuucccauguuccucugggaccccuacauaucaucauagcugacugauaagccaauggccaacagggccaacgucagugucuucucccuucauaguacuggaaugauauuaucuggcuuaaacuuaaaaguauucugacugcuauauugaaaauagacuuggggauaugacacuaggcauggguagaagagggccaauuuggcuagugcugaagugcugaauguaaaaaaugaccacagcuuaucauugugacaguagugaaguuggucauuugggucucaagugagcaacaaggaauuaaaguuuuuagucugagugguagaagagugaguagguugaagaugaucuggaugaagcagugagcuuauuuggcuuacaacuaaagauaccaguuacuuggguuggcucuuggguauacaugucucuguaguuacaaaggaaaucuagcuuagauagagaauuugggauacucagcaugcaaguuccuauuaagacaugaggccugggugaggucauucagaaaugagcagagauaaggaaccuugcagucuaggacuagaaggccuggccagcauguaagggagggagggggcucagaacagacugaagggaguagccagugggggccuaagaccaguucuuuggucuuaacuacuuuaaaaauagaacuguaagauguuucuuuuaagacaggguuucucuguguagcucugguuguccuggaacucacucuguagaccaggcuggccaugaacucacagagaucuaccuccugagugcugggauuaaagguuugugccaccaccucccaacuauaagguguuucuuuaaguuaggggcauaguaaacauuguugagauacuagaggaacacugaaugaaaauuuggacaucucugcuuuagguuugugcugagcaguuugccucuuaucuucaccuaugcugaaaaguuugaguucauaauuuugaacaugcauaugauaaaauauucuggccgcacauugaauaaauauauuuuaaaugaacuuaccuuuaaaaugucaguaacaacucugcaugguuuucuucuuaccuccauagguauggucugaauaugcguuguuuggcagcucgggucaacuauaagacuuugauuaucaucugugcgcuauucacuuuggucacaguacuuuuguggaauaaguguuccagcgacaaagcaauccaguuuccucggcacuugaguaguggauucagaguggauggauuagaaaaaagaucagcagcaucugaaaguaaccacuaugccaaccacauagccaaacagcagucagaagaggcauuuccucaggaacaacagaaggcacccccuguuguugggggcuucaauagcaacgggggaagcaagguguuagggcucaaauaugaagagauugacugucucauaaacgaugagcacaccauuaaagggagacgagaggggaaugaaguuuuccuuccauucacuuggguagagaaauacuuugauguuuauggaaaagugguccaguaugacggcuaugaucgauuugaauucucucauagcuauuccaaagucuaugcacagagaucaccuuaucacccugacgguguguuuauguccuuugaaggcuacaauguggaaguccgagacagagucaaauguauaaguggaguugaagguagguaucuguuugcuguacuuggauuuuucuagcuugauuauguuaaggacuagaaacugaagguguuaguuguacaaccacuguauagcacaaugggaagaggacuuccacuguugcucugucucagcaagaaggaacagguaaaauguaaaccuauugaagcuuuccaguuggugugagguaagggcagcaguuaagaccagauugaauaaacaggcuuauuccauuaaucugccucagagucucauuagugaggucaagguaucaagcucuagaaauugugcuucaaaacaauauagguacuaggccagggaugugacuccaugauacaguguuugccuaacauauuugaggccuagaguucagucucugccauuacagaaacacauguauguagcaauaaaaaaaaaaacugugcugauacagggauuaggugggcaaggagucccaggcucugguaagcuaucaccugaauucuuucuccaaguguaauuccccaacauuaaauguuuuaucaauuaguaaaaaaucaguuuauauauaauauuuuuaaaaauaagugagagaaucaggguagcagcagccauccuccaaacggggugauugucccagagucaauaccaugagucacaauucuugcccaccaaugccagacuuccuccaagcuaugagacaaucaaagaggaguacggggugacugagcugggggaucccaacaacucagcuguugugaggaccacugugaucaacaugcccagagaggugucugugccugaccauguggucuggucccuguucaauacacucuucuuuaacgccugcugccugggcaucauugccuaugccuacucugugaaguccaggaacaggaagauggugggcgaugugauuggagcacaggccuacgcuuccacugccaagugccugaauaucagcucccugaucuucagcauuagcauccuuauggucauuaucugcaucauuauuuucucuaccaccucugugguagucuuucaaucguuuuuuuacaaagaaugccacauucuggauucuagcugcccuguguuccacaguccacaucuggcccucccccuaggcugaagccuugacccuuaacccuauguauaugcaaauguuacuucaccuaucuguucacuguggauucaauaaagugcaugugguggcaaaaaagaaaaaaaauugauuacaaagacauacaauaauguacagucagagaacaaaacacaucgcauuaaagcagaaaaaaagcuucagaguugcagauaacccuaaaacauuccucagaaguggaacagugaagagugguccucagaaugacuccucugugucuagguuuagugauguuguuuguuuuuuauaggugugccauuaucuacccagugggggccucaaggcuauuucuacccaauccagauugcacaguaugggcuaagucauuacagcaagaaucuaaccgagaaacccccucacauagaaguauaugaaacagcagaagacagggacagaaacaucagaccuaaugaauggacugugcccaaggggugcuucauggccaguguggcagacaagucuagauccaccaauguuaaacaguuuauugcuccaggugaguuucaugcuguauaucucuuucauuuaaguugaccuaacaaacugggguaccuuuaaauuuuuuuuauguuaugaccuaacaaacugggguaccuuuaauuuuuuuaauguuuauuuauguaguaacaagcccuuuauguuacauaaguaaaugauguuaucuaaauaaaauccuccaaaacagaacuggggggaaaaguauuaugaaaaggagaauuuacuaccugaugaaccaaacuguagggugauacuaaaauguagauacagcuauugugugcauccugggguuuguauacucuaaaaugaaguucuuugguuugguuuagucuuugguacugggaucuagcccagggcuuuguacauacuaaguaagcauucuuccacugagcauccuugggguguguguguguguguguguguguguguguccuaaguuaaauuuuguuuuaacugcaagagacaucauauccuuugccuauuuuuuaaccaauagaauuuucuuuuuguaaagaaauuauagcauuaccaaauaggccuguucucaaccugaauuuuguucaugcacuacauuaucugaaacuucauauaaaaccauuuucauuaauaaaaucacuuauaagaucaaauuaaccuuaugcaacauuucccuuuuacugagacagucucauuaauuaguaugugauguauuuuccuguacuaaucaauauccaugagaacuaaugaguccauuacuuaaaaagacaaugaaauaaucuuagcaccucaggcuuaaucuagaugaugaaauguugucagauucagaacucauuccucccccucgaaaccggagcagguaaauaaaagagaaguaaauaaaaguagguaaaggagaagagcuccuuuguauuuuauauuuuguuuuuguucuuuauugacaacagacuggaaagccacauauagaucugcugggucuacauuguccugaguaauacauuuaguaauguuaaugcaguacaaaagagggaugauuuuuaguuuucauugugacuagaacuucuuuucucccaugccauuuugugguacuccagugcauaggaugucuuagcguaucauaaaauacuugccauggcuggaugagagguuauaaggaaaugcucaagaauacuuguuuuauaacuagggagguuuuacagcaggaaauuauuacaugaggcaaaggaauguuugguuuugggugaacucaaggaguuuuguuuuauauugauaguguugucuagguguugguagaaaauuguacccuucauccagucuccuagaguguuuggauggucuaauucuguccuguugacaaugacagauuucauuaaugccuugcuggaugcaaagguagacucacauauuauucaaugagggaucuucaccuuagccugucauucauucaguggucaguuacuagagauaaaccacuuuugggguaguuucaagcacacaaagaacuguuggcagccauguuguuagaaggauauaccuacucaguuguucccuguugguaagucugguagcugggaauggcaugcacauguuauugugggaguuccacuauaagggugagagagaaugauugcagcuccgugagaacuagaaucaaguuagguggcaucacugaaacauggcugugaggcuugaagauaauuagaaacuccagcuugguaggaaacaauccaaggcaucauuggugagaaggugagacuugucuuaaaagcauagguguaagcaagcuaaagcucuggggcaccagggauucuucuuccuuguuuuuuaaccuccaaaggaguuugcuuucuccaagggaacaaaaucaucuugagcaaaaaacuauuuuguaagcaagauguacuagugcgauccuaacacguaggaagcagagccagaacaacaugaguuccagagcagccuagacuacauagugagacccugccugaaaagaaucacacacuggugcugaccauuuuaugucugcaacuuuuuauucuuuauugacuaaauaauaauuuccuuaaaguuuauauauauggaucugucuauuuacacagauagguagguagacagauagacagacagacagacagacagagucguggcucuagcugaccucaaacucacuauauaguugaggauggaaugaccuuaaacuccuaaucucuuuugcuucucucccaaaagacagcuacugauuuguuugaauuaauuuuauauucugccacuuugcugaaguuguuuaccagggggucacuuauguauacuaucauaucaucugcaaauagugauacuuugacuucuuccuuuccaguuuguauccccuugaucuccuuuuguugucuaguugcucuagcuagaacguccaaguacuauauugaauagauagggaaagauugggcaaccuagucuugucccagauuuuagugggauugcuucuagguuuucucuguuuaauuugauguuggcuguugguuugcuauauauugcuuuuauuauauuuagguaugugccaugaauuccugaucucuccaagacuuuuaacaugaaaggguauuguauuuggucaaaggcuuuucagcaucuagugagaugaccauauggcuuuuuuccuugaguuuguuuuuauaguguauuacauugagggauuucuauauauugaaccaucccugcaucccugggaugaagucuacuugauuguggugaaugaugcuuuugauguguccuuggauucaguuugcaagaauuuuauugaauaguuuugcaucaauauucauaagcaagauuggucugaaguucucuuuuuuuguuggaacuuuguguuucuguguagguaccagagcaacuguggcuucauagaaugaauuagguaguguuccuucuguuuuuauuuuuauggaauaguuuaaggaguguugguauuagcucuuuuuugaaggucugguagaguucuacacuaaaaccaucuggcucugggcuuuuuugcuugggagguuuuugaugacuguuucuauuuccuuagagguuaugggacuguuuagauaguuuaccuggucuugauuuaacuuugguaugugguaucugucuagaaaaucaacuacauuuuaaaauugaaugaucuagaaccucaugcuuguaauuagcuuucccaaagcauucuuuuccucccauauucaugaccucuccuccuuucucuccuguuuagcuguuuucucccaggcgucugcugaguacuucuucucccaccauuuuuccuaccucauccagguuugaauagggcgguuucucaucugauguuguaaacacguugacaaugacugaauaaaugauaguagcuuuauguaaggagacugacuuaaagacuguucuguuuuccuagcuuuacugaguguaauugacaaaugaauuuguauauauuuaggguguacaauaugauguuuugaagcagggugaaaauuguuuaccagaaucaugauagguaguuuauacagggcuggaauuuaaugcccaugucagguggcucacagacacuuagaacucuacuucuagggaucugaaacugcuggccucuagcuucccuuggcauuugcacucacauacacaacccagauacaaauacauaauuacaaauaauaaacaaaagaugauuuacauacccauugccucauagaguuaguguguauguugguaagaguguagaaaaugucagcauauuuuaggcgugugaugcauuauuaucuguuguuugccauguuauauaucaggcaucugaaagcuuauauucuugggcuuccaucucccuauuuccuccauuuucuaguuucugaauacaccauucuguuucuaugaguucagcuuucuuacuaauuuuccuguaauauuugauauaaucagaguauaguagcaauaugcaugccacauacagcaucuaccuuucugugaccaguuucauaaguauuagcucucagauggcaggauuucuuucucuuuuacaacugaaaauuacaaaugcacauuauccauucaccuauugccacacacauguuauuugcacgucuuggcuauuucuacuaaucuuucagugaacaugggguaucugucaccagcauaccucuuugagauaguaauuuugucuccuuugguaaguguagacccagaagugggauuccugguucaccugaguucugguuuuaguuuggggaaacuuuauacaaauugcuguuguaauggcuguaccaauuuacaucaugccucaaagugcacaaagauccuuuuccaccacauuugcagcaggccuugguuaguguuugugcuuuucuuggcaauccuaaucugugguggguguuguuuugcuaugguuuuguuuaucccucuuccuuugggauaagggauggacaccuuugaauauacccuguggcuauuugugacuuuggagauugccacaaauuaacuuaagaauucuuucauuuauugcuuuuguuuucuauugaguuccuuauauaucauagauauuaaccccuucucagaucuauaaugugcagauauuuccuccuuuuuucccccuuuucauuuaguugauugcuauacuuuauaguuugauacagucucacucuucuguuugguuuuggugguagugauaguaauuuugguacuuguguuuuaagugucaaaucuagaaaauaauuggcagcauguuuguccucuuuuguuaaaguacacaugugccaucuagaccaaacaaaguuuuaguagcuccugaaaaauaacugcucagaaaauagggcccaugagcuuguaggauucuguuaguagauuagaaggaggagaccccagacagcaggguguucuaaggagaacaucacaccauccuuuauucuaccacgcagaacucacuguugcagauuauauaacuucacaaauaugaccaaaaggaggacacugaaagacuguuuccugucacuguugggaagauuccaguuguugacugcugaagacugugacuucuuauugguccucugugucucagagcccuuuuguuaguguuaaggauuuagagaaauuaauaaucagaccuuuagaaagguucauucauuacugaauccuuuggacucucugguauauuaagauauaauaagaggauuaauuagacuaugucccuuaauucaauuuuuauaaauaaaaugaaaaauuagaacagaauucugggaggaaauggauuucagcuucccuuuauuuggacuuuaaagauggggcauugucuucagucugcccagauagauguaauacuuaauauugaugucagaugaaugagguauuaccccaagguaagaaaaguaagacucagcagagucuacugugccgaguguaacuuaauccugugcgagucauaugucaguucagaauucuacaguguaucaggaaguugaacucaagcuccagauuucaccuuaauggaaaggaggagaguacuaguuagagcaagcaggguagugucuugacagauaaaauggauuuuguugaacuaaguucuuacuauuguggucaguuuuuaaaacaucucagccaggcgugguggcgcacuucuuuaaucccagcacucgggaggcagaggcagguggauuucugaguucgaggccaaccuggucuaaagagugaguuccaggacagccaaggcuacauagagaaacccugucucaaaaaacaaaacaacaaaaaacaaaaaaaaagaaaaaacaacaacaaaaaauaucucccaggcauuauuugauuuguaagucggcugugguguucucauucuuaauacaauuuccauaauugucugcuuuaucaaauguagucauuaagagcuuugggcgauguguauucugguauauacugguggaauccagcauugagacauuugacuccacaggcugacgccauccaggcugaucugaucuuugcuccugaauauacucuccaggacugauagcagcagagacuugcuuuuauggcuaggucuaagagaaggaaccucuguugaguauucuuuugagcauauguuuucagugucauuugucuuccuucuugguacuugggcccagaaaccuggauuauaggcugugcuauacuuguaguuguuuaaccucauaaaaccugcaggucuucaccuuuaaaacagaaauaauccauauuuaccagccucaggaccaaaugacagucuguauguggauguguuuggggaauuuaagccauggaaggauuaagauguucauauuucccuuugaucuuuuaaaguuugugcugcaaguauuguuuauuuacucgauauguguguacuucugggcauuauccuugcugcuauuugguuuuaauaugcacagugucuuugguaacuguuaggugaguaucauucaaacaguuauccuucuaagagccaaccaucacuguccucuagcuauaugagagaaauucauaauuugcuaaauaaaauagcuuuuaucauuuuauuaguaugugauaauuaguagguagcaaaaauuaccaucauuugucacuauucuaagccacugacuuuuuaaaaaugucaaaauguacugcaaaguuaauauugucucugcuaacacuugaaacugggacuuggaaaguucuguuuugccuuuucagaccucuggcagagcaggaauugugaaggguuuuuuaauccccuuccuucuuuuuuaucuucuacacaaguccauuguuuaauuuccaguaauuuuguucagaguuccagagaauauaacgaauaaacaucauuuucaacauuaaauuaagagccagucuagacauccuggguucugcccuuuguauuuggcagguuacuugacuauguaucucaguuacacaucuguaaagugggaguaaaacagugcguacucauaaccaagugggcgccaaguaaggucagaaauguaggacacagaauaugaggagcacauagaaacugcuuuggaaaugaaauuucagauguagccauucugucuaaaacuuuaacucucuuguaauaauaugcauugaaucagcuguuggcuguuuuuucucccuuuuauggaauaaguguacuagacuuaucagugauccgugaucagguggugucaggucuagaaaagacaguuuuaucaguaauucuuaguuauuugaucagaauccuuccuguaaacccaaagagucaaagguaagcggaagucauccuuaauuuuguggaguuaauuuuguguggucaguaguguucaaggauaaacuacaauuaaauuuuaaguauaaaaauacuuuuuuuuuucuaaccaguccuuggucuguuccccacagaaaccagugaaggugugucuuugcagcugggaaacacaaaagacuucauuauuucauuugaccucaagcuuuuaacaaaugggagugugucugugguucuggagaccacagaaaagaaucagcucuucacugugcauuaugucucaaacacccagcugauugcuuucagagacagggacauauacuacggcauugggcccagaacuucauggaguacaguuaccagagaccuggucacugaccucaggaaaggagugggccuuucuaacacaaaagcugucaagccaaccaaaaucaugcccaaaaaggugguuagguugauugcaaaagggaagggauuccuggacaacauuaccaucucaaccacagcccacauggcugcauucuuugcugcaagugacuggcuagugaggaaccaggaugagaaagguggcuggccaauuauggugacccggaaguuaggggaaggguuuaaaucuuuagaaccaggaugguacucugccauggcacaagggcaagccaucucuaccuuagucagggccuaucuucuaacgaaagacuauguauuccucaguucagcuuuaagggcaacagccccauacaaguuuccgucagagcagcauggaguuaaagccguguucaugaauaaacaugacugguaugaagaauauccaaccacaccuagcucuuuuguuuuaaauggcuuuauguauucuuuaauugggcuguaugaccuaaaagaaacagcaggggagacacuugggaaagaagcaagguccuuguacgagcgcggcauggaaucucuuaaagccaugcugcccuuguaugauacuggcuccgggaccaucuaugaccuccgccacuucaugcuuggcauugcucccaaccuggcccgcugggacuaucacaccacccacauuaaccagcugcagcugcucagcaccaucgaugaguccccaaucuucaaagaauuugucaagagguggaaaagcuaccuuaaaggcaguagggcaaagcacaacuagagcucgaaaccaaaagugcauuccagccucuucugugucgcucagcagcagagcucagcagcacgucgcacacuuuaaaugcuguguucuggguuugugggucacagcacuguaagaagagacccuuaaaguuagucuucugaaacaguugcauuccacggggcaggugcuuagaaagguaucgaggagagcgcucugucagugcacugaaccaagaccucugcccucucaucauguaggccuccaugcagagucacucucagucugaggaagauacugguaagucacugcugcuagccugcugcccagcacuuaccuaaaacuuaguauggagugcuuuuaaaaugugauuauuuauauuuauacugaaagcaggcuuuuagaaaucagugugcuguauuacaguaaaugugugcguauagccuggaucguggacuuuuuuaaguguuucuuucccauagguucauuucuugagagggagugagcauuuguugcauuuguucaauuauauauggaaaauauuuugaauuaugguuuucuugaacucuguauaucuaaacacagcccguguucagguuucacggucacauacauaagcacaacugaaaugaaacuuguugacugcacaagaagucacagacaugcuguguuuuaugaaacggucuacaaucagucaaaguuugauaaucgucuuccccacgucugcucuagugcagugugucuguaucacuaucuagaaggcugcauuucauuucauacuauccuuuaguaguccuguccaaugagaggacauuacacagaauauuaauuauaagccuaaacuugugacagacuugaugcuuugaaauugaccauugguaccuccuccuuaaaagagaagugucguguucaggagucacaguaaagucucuccugccuggguugucaccauugcuuuucacgucguuucuguccuugcuguuucucugaagcuuaauuuugaacgauuccagcauugaaacagaaaagaugcuacugugucugcugucugugugccaucagaucuguaagugaguuucagaguccucaugccauggacagugucugcuguaaggcuccgggcauuagguaaaagcaacagggauugguuugcucugguuuuuguuuagggugugauaauauagagacaguuggguaacauaagccucacccuuucuaggaacaaauaaugacacuuauccaugcugcuggucagaugcauguuaaaggcgaggugggugaucugcccacacacuguacuucugcugaaaaauacacacacacacaauaauacauauguaaacuauaucagcaucaaaggagucaggaaagaagagcuguacugaagacaauauuaaacuguugaaaaauaaacuuagacucgcaguauauaugaccacaccuuacuuccaccuacaagguagcuaguguggucagucaaacggcuccccagcuuuuaccucugugguucucacacacgagguguuucagcaacaucugaacaugcacauuugucucagcaauaaaagcgaagacucccuuuuauuuucaguuccuauguugaaaacaagcuggcccaccugggaacacuguccacuucucagauuuguuacuggaguggccccgacuucugcuuucuguuugcauacuggucuucagaugagaggagucagugaaaucaucguggaacugauuuugugacaaacaccagugccuuaccaaugugguuguccuuuuccacugaagagggaaaguugguuuguuuggguuuguuuugguuucuguuucuguuuuugauguagaaauggcaguucacugcuguugcuuuuccacugccuuccacguugcaacagcuacuugacuuaucuugugaucccagaauccccuaagaggucacacugagccugugacagcacugucagugcuuggcuugucagacgugagggaggaugccucugugucacuggggguaacaaaaugagacucugggugugcaggaauucugccugugaagugggauccacagcauguucgacgggugggagaacugggcauguauggaggaacacugccagggacccaugcauuuuugccuccagaaaacuacaaaguucccuagguuuuuaaaucauguaaauguuuacuuauccugaguauagagagaauggggaggguauuuuaauuuuuuguugugauucuuuuuuuuuuaaggauauugguuugguucacuucucugaguuagcuuccauguugaaucugucaccauuucaguaguaaaacagccaaaaguuucuagaaaagagcagguuugaccuuuaggaguuacuguauauaacggcuucguucaagagccucacgacaucugugagguguguagaaaugucacaagcacucuccagaugcagggccucugucuuuguugguguacagacucuuaccaaaagcugcugguuuguucuuguaauuguuuccuugcuucuccauuguacaugugggguauaugccaugugucaaauaugcaauaauguguuuacuggaugcccuccuggagggugguccucuguaaagcuguacagccuuugcaguucaagcacaaugugcacauguuaguuuuauauacagcaaaacuugauuuuuucaaauggaaagguauuuuguuucuauacaaaguuaaauggguuguuugugcuuaauguaaagcugcuuuauaaaauuguaaaauaaaguuuuuaucucgaaaagaaaug

SEQ ID NO: 5155 - RNA, 2771 nt, Mus musculus
ugggccuccggcgccccgggaaacauggcugcucguccuaguacggcggcgucgcggccaccaguccccgagaugcgacuugggagagagguugcagaaggugggugcgugggggggacucuggggagggagguuccccggaacgaucuguuuuccaaaaacguuuauuugaaaaaagcaaaaacccagcaaaacaacaacaaaaagccaguuccuccucccccaccccuuuugucccucuuucgagagcuuucugcccuccccucccccaugcgcagcaagugcccccucccccgccacccgcgcgccccaccccgccauaagcccggaggccggcgagugggcagcagacucacggcgagggggcgaagcgugagaaaucgcgcccagcccagagcgcccgccccucccccagcgcacacacucggggaaguuuaaagagccgguucgacccgcuuuccguuucgcuccgggucagcuaguacuguggaccgcucggucggguccggcgcugcugcgcaccuacucgccgggacccugaagccccccaacuacauauaggggucuuccgggaaaguacgcgggaagucgcguucggcccccuccccccagcaccacacccagucccuuccaccccccgggaucgggcacccuggcugggucgggacgccaccgggcgaaccaggcagcccccgcggcaaguccuggugcuaggggugcccccuccuuccgcccugcgcgccauaaggcuguagcacgucuccagugcacagcugcgugaggaugggcggucggcagaaaggagcuuguuuucaaaagucuuacucagguuuagaaggaggaauuaggagaaaagaggaaaugaggccugccuuugucaggauucgaggggucaaguggcuggaggggcgacaggucagcacaacgugcuacgcgagcccccaacucgcccgagccccagacccucaggcuagacccgagaucuuucccgcccgcgagcuccugcucccuacuaccgagccuagaggggaaguuggcuaggguuuccaccgcagacccuaaggucucucgaaugggucaacucgcagacaacacgagugcgugaaagcgagagggagacaaaaauaaacaguagcuuucgagucacccaccaacccucacuuccccuugcagugggcucgcgcccagccucccuguucccaccgguguaaguuuccuccugccauacucccgccgcugcccaauccauaacggcuacggccagacgaacugcccaucccagagcugcgugccugccgugcccgcaagaauguagacugggucgguccccacagcggcacuagcucugggcagcucggguucugauaaaguuucucgugcccauuuauuaaccaagcgccgaauggcugccagggagcccaccccaggagaagcaaggaccgggaagguggggugucugcugccgaugaggcgucagggugccaaggcuggcaucuggggagggagccgggggccagaacgggacgcagccuccgggcaacuuacauuagcgacgcucgugguuggggaggcgcgaggauuaucugagcauuugcacacuucacaaucccucccccuuaaccuaagguacccccccucccuuuccgcgaggaagaagggagaaaagacagcaucuggcccaaaggugggguggaaagagugagagagaaaggagaaggaaggcagacagagaaagggagggagggagagaaagggcgcguucacgaacacgacaaaguuacaaauauggcuccccaccucucgccucauccccgcagagaaacgaagacgcgcuuuaaacucgagccaucucccaacuccgcagcagucggguccccacgcgcucuccccgggguccucgggcuacauugaucagaaacuauaccggacucgcgaagcccaaaacuuauugugugcgagcgagcgaaagagacugcaaagggagggggcaggcgcgggagggggcggaaaggggguuacgcuucuaaaauauaacaaccccuuuuuguuguuuaauccaggaggcagcccaucuucuccuccccucgaucaucuuuuccauccagaugcaagucgugggagcugagagcucggacgagggugaaauugccgccuucccuccgacccgaacgcgugcgccccgccggccccccgcugggugcacacucgcacgcacacccucgcacccauacccgcacacgcgggagcacacgcacagguagucagucacacaccaagggcagcagcgacggcggacgaaacaugcuccgguggcauugcaaccccccccacccccgccauccaaccuugcaauucauuugcagucagaccccaaaccccacaccuuccccggagccccccuccauaaaaaagugccuuccccccaaaacacacacgcacacauaacacaaaguaggagaauggaccgacagagauauuuuuggcaaaugcucacaucagagggcguccuguuccgcagcucuaaauaaauccguuuguccaucuccaucucucgcgcucucucuuucugcagaggauccugcgccagcggaauucaaucaauaaaccccgaacccacggccgcgcguuuuaggacuuugaaggcucaaccagcuccgcucgguucucgagcccccagcacccgcggcgcacacuaaccugaucgccguagaggcgggaccugcggcuccuugcguggagcggcggcaacaagagccaaucaaauggcgagg

SEQ ID NO: 5156 - RNA, 37522 nt, Mus musculus
cucccaaaaaauuguauaaaaaagauuuauugaaauuuaucaaugacaaacagacauaaaacucaaaguuuggcucuucucaagggcgggagaaaaaugaguggcaguuguucuguaccaaugagacgcaggguaggagggacacagcacgucacuucuaaagcgaucuggaagagggaugcagaaggcacacagcauucccuaggagaaaccugcggccauuucagagucccaccggguaagaaaauacgaguuugcauuccuuuccugugcuccaauguaugugagaaggaaaacaagcagaacaaaaccccagaggacucuuggagggagcuccagagcguagauuuguaaaaggguucuaagcuggagcgccugagaugcguccuccugucauuucugcaaaaccaguugcucuaauauuuuacagaaccaaauagaacaguuuuuuuuguuuguuuuuguuuuuaagaagcugaaacaugaagguucacuucuuucccauuuuacaaguaucuccuaacccugccguuuuuuguuuuuuucuuguuguuguuauuuugauuuuuucuuuuuggcucucgggaucauagccccagaguaauaagaguucucuuugcaaaaagcaaagcccacugccaucuguggagggagggaaaagggaugcgagauggggacuguccccaaaccagugccaaaauacgccuuuugguugcuauuuacaaaccggggugcugggugccucuggcagcgaccacacgaaccggaaccagaacaggaguuagugaagaugacaggggcugugagucaccuggcagaggccagccacggccucccgaucaacucuggggauguaggacauaccagaaaauguuagaccuccaagccauccucuccagagaguaagaacaaacacuugcuuggugugcacuaagcuauugcauuuauggggacaaaaccagacacaaggaaaaaggagggggggaaauaaaguguggcaguaaaaauaguauuuuauuccuccccucccccccacccccaccccccaucaacccccaguacacuuuuccccucuccuucccacagcaaugcuacaaucagaaaaaaauaaguuucggggggcaggaauaggagggggaggggauauggguaaaaacagucaaaucacaauaggaauuuccccaaacagguucauuccuuagucauccucuucgcccucaucguccgguucucguuuucgcuucugacucccuucuucuucuggaaaaauggagggaaagggagaguuaucaggcagccaucuucccggcagccccacccccacugggaaccagaacacauccaggaagcgugggugcccccucccaucgccuggcccuuaaagcccaagcagggcaaugcuagagucaaaggggucaggcugccacugggagagagaaggcugacauaccaccagcuucuucuucgucuuccucgucauccacuuccccgucauuguaaccuuccucauccuccuaggggcaaagaaagacagcaggguauuagcagugccccugcuggaucuggggaggcagcucccagucccacugauccaagcuccaccccagccccuagguaaaggcagggccuagcagcacacauuuguauuccagcaccuuggagacacagacagguggaacccuggagcucaccggcagccggcuuagccaaaccagugagcuccagguucaacaagagacccuggcucaaaauauaaggcggagaaauugagaaauaaaauugacacuaacuucuggccuacacacaugguacaugcacaaacaaacacaugugcacacacgcaagcacauacacuauacccgcacaccuacaugaguuagagaugucccugccuagaaaggccuuucaucccaucucagagcccacaauaaggccugcagcucagggugaacacacacaguagggcuuuuuacuguuuuguaucaaggaaccaccugagucagaugacuuucaauaugugggugaccuaagacauuucccacauuaaauaagauacugaggguuaccugggcugugggguaguuuuggacuaccccauguuagaaacacuggaugugaagccccuagaaaagaggcagcuugcuagcaugcaggcuuuuaggagaccaggcucccuaggcagguagaugcccugucauugaaaguaggccauccuuucuugcaucuguccucaauaugguuuuagcuucaaggaaagaccccaguuucagcaaguccagaaucaagugggcaagccuagcucuccuuucccgggcccuccccacagccaagccuaggcagcuaaaggguuuggguguggcggauagacucaaggguccuugagaaccucacuucaaccugcuugggauucagccagcccugugacuucauccucccauccuaggguccuuguucugggucauucccuggguuccaugcugguagcuucucuguaccugaaggccugguuucuaugguuucacagcggcuguuucuaagaacaguugaaguaaauucacuuuuacaucauuggauaguucucucccuggucuguuugcgaagacucuguguguguguguguguguguguguguguguuuguggguguguauuuaagagcucuuucauugguaacugagaaagggcagauggucaaugagauuacaaaaaaguagaacaaaguccacacguggggcucuuaugacagcaggcaggaaugguacaagggacaguccaccagccaguaugucccauuaccuuguccucaaggaaagagguucccuccugcaaguaucccuuaaagguggggcugucagccuaaacccagaagacagagaaaccgcagguacagaugggagccuggccuuucugcuggcauccacccuccugagcccugggguaggcaggccaggaacccggcucaggagcugugugggcauguguacuacaagcaaggaggcagaaaaccaggagaaggagagacuauggccuguguacugcgcaugugugcccgaaggcaucugguucaugagugugcacugcaaaucuuucuugguuaccauuuacuagugacaagaacagauucagcauucuaaacaacucauggaaaacuacccugcuuugagagacccugagccuccaaacucauagaaccccaacacauggagcaaggaggaagguguggguaccugagaccuguggcugcuguaccccucaccagacuccuucugucgaugugacuuuacucucaauaacccagugagagaggucccuacgucacagaugacaagaaacccagaaaaaaacaagaaaucuguccaaacgagcacagcucaggacagggcuagaaccagcuauugcaaugauaagcagaagcuggggagugguggcaaacaccuuuaaccccagcacucgguaaguggaggcaggaggaucucuacaaguuugaagccagccaggucuacagaguaaguucuaagauagccagagcuacacaaggaaacccagucucaaaacaaaaaagagaaagaaagaaagaaagaaagaaagaaagaaagaaagaaagaaagaaagaaagaaagaaagaaagaaagaaagaaagaaagaaagaaagaaaacaaaagguaggggcuggcaagccggcucagcgaguuaagggugcuugcugccaagccuggcaaccugaguccaauccccagaaaucacacagugaaaggacagaacugacucccaaaaguuguccucugaccuccucagcgacaggccccgcccaaagcacgcggagccucugcuuccgguauccccucccuuuccuuacucugacacaacuuccucagaacggcagcugaggucugugcagcaaagucugugccauagaaguuuuggaaaacggaccccuuuuccuuccccgccagcgggcaggagguagacaaccaaggcuccuuccuggguugccucgacugauaaugaggcaccugccaggucagaggugggacugcacaggugcccagccccgucuccuuaccuccuccucuccacucacauccucuuccuccccuucuuccuccucauccucuuccucuucaucuuccacuagcugggcauauucaucauacuccuccucuguggggguggccagcaagaagacaacucggauugagaugacugggggugggaggguccaugucugccccaccccccagcaaagcucagagcccgacugcucuaauaaugcacacaggugguguucacacaaaaaaugacucaugcuauaagccuuccuccaagucagauauguagaagaaccucuguguggguaaggccacagagacacggagguuugagcaagaagcuuaagucaacauaacuaaucccucuucagagaacugcccuguucaaggccacaaguggccuguguaguggagcaacuggccaggggcuuggaggacuggccccggggcuguacuacagacccaugccacauaucacaacaccauacugugugcaacaggggaacacguauaaucuaauccuugggcaaaggauauccaccgaugcugacagaauauaugaacauuucacagaagaacccagaccaacaaggacaaaagaauuuuaugucuacaucgacuggcacuaucugaguacuucuguuugagcuauaaagcccugcagaagagcugcagggugccaacugcagggggccuguggagauagggggaugggguagggaggagagacccuuagccuuuccuuccuucccaagggaucugacauugacuauagcccccaacuucccuagggccacggaagggcccaacacaggccagugguccugcaugcugcaaccaccagggggcgccacagccucuccagcagaagacccuggucucucagauggagaaaaggcccuggggaguccaccccuacaacuggucucuucucccacgucugggaucacacuauagagauauacauaguguucuucucuggggggacuugaggccaccagucccucuucccuuugaaaaccgguggcagauggcuugccagcuugucuagagugagcucugcaucccaggauccccaggacaccuaccauccucaucuuccucgucgucauccuccacguagcccucaacaucggagucgggggccuccuuguugucccugucauagccaucgagguacaugaccuggggcaggagcuugaacacguuuucucgguaggcauucagguuggucaccucacaguuaaacaggucuaggcucuugagauucucuaacuucuucugcaaguggagaaaggcagucaacggugagggugaccgugggaaaggggcgggaagggggaaacgcccuaucgaggccccaggaagugaggaggcccacagcuagcaagaaaugcagcugaaucuugaccucucaccucauucaggggaucucaccgagucccuguugccauggggaccaagucaaacuaggaagaguagaccccucagagucagucuugauucucuacuauuuuguauauaggcccagguaauucuuaguggaggggccaaaggccaagaggacaucugagcucuggucuguguuaagacagacuguauagacucagcuguauucacacucccaacacaagugagucagaacuucgaagagguuucucuuccuaacaaaaugaugacaucagggcuucccagcagaugaaagcagcucugccuucacuuaggucagugggagaccuggaaagaacuuccuguggucagugugcuuuauuagcaagacagacagacagucugagcuugaaaaagcaacgccugcuugcuguuaugaccaccuggccccaugagcucacuauguccagagacugaugagugcuuugugaacccggaacagucacuuuugccgcaucccuggcccuuccucaagucaagcuuugcaacuuuucuccauuuccaauggauucuuuuugucacaucuucgggcgguuuccuuaaaaaccaaaagaacgcugcaccugggacguugguaacaagaaacugccauucugacuaaaauuucccuaacuggaaaaugaguaaagcaagaaccagaagugucauccauccugucucugaggcccuggucaccaagacagacacucuucucuccauaugcaaaugaaggccugcacugggcuuucccacccacagccucagacuccaggaaugccacgucugugucagcacuaaacccuaacccuuggaagaaaugauagcugauguacauccagagucagcuuacaucuagguuugcuccucuccucaaaggguggcaagccagccaggcugugagcccagacauaccacaacccgggcugaagggcacacaccacaccaggcuccauucccugccccacacugggugcccauucugaccaggugaccuugguccaacugaauucuccgugaacuaagcagaaauaguacccauguuagcucacagcacaggacgagagucaaagaaaaacagugauaaauaaauaaaaccaugaaagucgggcuccccaccgcccccaaggaaaggagaggaccccaagggacucaccagcggcucuauugugcugagaucuuuuauuuuguugccacuuaaauuuagaugcuuaagguucggacauuucucugccaauacuuccagguccccugagauucuguuuucgcuuaauucaagcuguaugaggcaggaagggaaaguacacuuaacacccagcucggggcuacucuccccaggcagccagcgggaagggaacauccccagggacccugccagcaaguugaagcaagcaccuggccuaccccuuaauuaugcucucggagcacaaggcgcccccacccggagccucccagcucccagccuguuuaccuucuugaguuuguuuaacuuugguaaguuggaaauggaggugaggccuacguugauuguacuuaggaauuccaguucuucaaacucauccgugaggccuucgauuuugccuucaauugacuuacaguuauccaggaccagcucuuucaccuggaaaaggaagguuggugugagugaaggggucagagaggcgguccaacuccagcgucccaucaauugccuuauccagaucagcacugccucggagcaaagggugaccgggcuacccaucuuucuaccauuaagaaagacagacccagauggagaauguuggauaagcacaccucuagaacuggggagccaugggcuggcucagugguuaagugcacugacuacccuuccgaagguccugaguucaaaucucagcaaccacaugguggcucacaaccacccauaaugagauccgacacccucuucuggugcaucugaagucagcuacagugaacuuauguauaauaauagauaaaucuuugggccagagugagcagggacugagguagcgggauugacuggagugagcagagguccuaaaaauucaauucccgacaacuacaugaaagcacauaaccaucuguacagcuacaguguacucaaauacauaaaaucaauaaauaaauauuuagaacuggggaaccucugcagagaacauauccaguaggcuuugcugucaccaaggcuggugugugugugugugugugagugugugcacgugcucgcacaugugugaauaagccccugcuacacaucccaguauacaauaaaaaugacagucccuacugcccacaggcaucagccacaauggagguagccaugacaccugguaucccugccuacgaaugcccaggccagauacucccuggaggcaggcuacucauuucaguccacaccuugugguccccaucccuguccccaccaccaccaccucccccacacccccuugccaaaugcucguggcuugcacacaauacacucaugcuugcucucccuccucccucuggccucagccuguucacugaggccuggcccuuaucacuguaaucagguccccagccugcuccaccacaggggcagcauagcagagaacccucguccacauccucaugccuagacagcacuguccagcagauggucccaccagaaaggaaguguuuggugcuguccaagaauggagccacaagccucgugugguccugaacacuugguguuauuuuaaucuaagguauacagagauacaaggcacaguuacgggaccacauggcucuuggaugucuuccuuggucccugcuucauagaggaugagagagccuguacuccuaagacagcccguacuuaaaugugagggucccuacccacuuccucuccaaggacagggaggguggugcugggagguauuucucuguuucugacaaaaaguggcaagagacgguagaaguuacucgugaggauccaaaccacacccacugcaggggcaguugcuggcucggguaaacaccgcaaauggaugcuaggucagggggaaagccagugggucucagaaaaggcgcaaacagccaaaggaguccgcaggccaacgaagguaauccugggcaagccaggugcuuggggaacccagucucuuggugauaccaggaaccuuacagugguauagaagcgaggguugagccgaggugcucacauaugcaaggcaagcaagcaccugcucccuuuaguucacucccccccccucuuuuuacuuugacacagucuuucucugagucgccuaaacuggaucugaauuguccuugcacauagcuuuaaaaggccuucaauuuguaauccugacucgcuucugaaauaguugggauuagagaucuuagaguuggcuugaggcugaaaggacucuaaaaggagaagacugaccccucccgauggcacuugucccccaugcaccccugcaccccaggacuccgccucagaaucagcuucuacccugcagcuucugggaaacauggaaaauacugacuggacgugcugcacccuccauccaugggguucuccacaggcccacacaucucacagggucaccacuguccuccccaccaccacccugcauaaacagaucacgagccaguccccacccauggcugcacuucuccucuaagaggaccuugccuagagaguccucuggucuuccagagaccacuugucuucagccacucuguaaagguacaacaggguucacuccaggcuaauaagcagggcagggacuauggggcaccugggucccugcagagacagcgagugcuccaugcaggacagccccaucccuagcagggauucacaguucuaucugaaggaaagaaagccaggaacaccacaccaccuuccuccccgaaucaugagcuccaagccucugcccuggccaugcuccauccaucuucucaauggaucuaagaggccacggguccaggucaagccacucccgguuagaguguaagaaugaagcucuuggggcccuucaccccagggcaagacaguugcagagaaaggccuggcugugggcaucgagcaaauggaggaagagcggcugugggcaagggacacaagucugagguguugggcuccugugcacaggcuuucuccuuaacuggcuuuccagggaaucccugcuuccaagggcagaucccggugucuccucagagacugcagucaucugugguuuuccuagagugguucgacggccucuccccuuaaugccauuagcaagcauaagaggaccuggggugggaagguaaugcugggcagucaagggaaugucuagagaaguugccucuaugugugugugugugugugggggggagagacauggggacggggacacggcaccuccucaguuacuccccaacucucgcuaccaggacaggcugccuugcauuucuacaaacagcuggccaggacagucuucaccacccagaaccacacccaaacugggagccucuacucucagggacaauauguaagucaucacagcuacuguuuacacacacacacacacacacacacacacacacacacacacacacacacacacacacacucugaaugcccuccccauaacaggcacacacccuagcuacaccauggagggggagucccuccauuuacaaccacauucagaaacaccagugugggucggaagaccuggcucagucggcagugccuggaucggaucccuagcagcucacaaacugugcucaaaaucaccaauggcuacaaagccaaguuugaggccuaccuggauuauacaagaagucucaaaaaaaggaguaagaaaaagaaauacuuagccugaaaugcaggcccagcagguggcugccuaggcaaacaggucaaugcaggcuggccgcucaauguagcgcgguccccugaggcaucucugacauuccaagguauaggaacugugccugcccagagaucacccaacuccauagguccccauggcuguaauggcuuuccuucagcccuuuccuguuccaccagcuuggugggcaucacacccaccuccucagucaccaaggugcagagcucaaccuggccuccuccggcuggguguggggcccccaagaguuuccucucccuccggcaaagucucagguagccuuucccagucuccuuugcuuuucugcaccuccuccuuccugacagagaguaagggugcccggcacuguuuagggggugccagggcauagacccgaagaucgcaguauuguguagaaagcucaagccucgcaggccgagaaguggcucaaaccggacaaagcggaaaacccuagccaucgucugccugagucuucugccugcccucucucuacccccacccccuccucucucccaaggccugcgaccaaggggacucacccugcaacuguuaucauuucuaacccacuuccuccguccuuggcagccucuucucuagcccuuccaugugacagcaucccuuuuguauccaagaagugcugugcuuaaaaaaaaaaaaauagaauaaaggcccacuuccccugccaaguccugagugugagcgaacugcaaguuaaaauuaaacugaauauuuguacuuuggguuuagaugcccucccgguuccagcagcccuuaacacacaacagcaacugccacuagcccuuaaaacaacaacaacaacagcaccccagugcacucaguuaccucuguagccccagaggccagggcuauucugcuuacacaggaucguucagccccaggcaggaggcugacauucacauucugcuggcuguagggaggcaccacacauucacauaagaagccagccuggucuggcucucccguucguaaaccuuacccgagacccccaccccagacuugggucugccuucguuccuugccagugaaagcugaacuucauaauaaacacaaacacauucacgcaacacaacaacucguuuguuucaaaaccaccaagucugauccuuacgaaguucucagaugugaccuuucuucucucuaacgcugcagccuucgucacagcccuaguuacuucaggcguguuugucuugaaggucgugaccucagggaaggaugugguuaugagauagccugggcuacuguugaccaaccucacccuggaugcaagacccccugaucugggcugaaugauaucauguucucuggaguccaagauuccaccucuuuaggaaaaggacgguggcaucggcuuagccuauuauaaacugcaaacucuagccagcuucugaaacacucacggcugguuagugaccuacuagccggccgcuucccccucccccaagucaccuacccauugcacccaaaucuaauucaagacucccuccuaggaagccgucccuguagcuggcucuaagaacccaaggcugggcagcgaucucagaggcagcagcaugaaucauuuaaucguguauuaagcaucugacccuccuagaggucagagacuguccuuccccauaaucagccuagagggacgcaugggacagcacugcuuagcaaaugucccucuuacugggccaggcacaauauaauaaguacugggaauacagagagaggggggaggggcccaaacagcucauaagcauaaacagugcacuauagcaggugggaucaacgcucaugcuuucccgcaacagcuuugggcgcaacagcuuugggcgugugccuaugccaaucaagcaccagcccugacaggggaugggaucagccacuaaaauaccaaacugacgcagcacucagcacacuccagucaguucucccuacauaagacacuccugccgcauaguuggcugaagggucacagaauccauggugauccaagaugggggguagaggaggagucggacagagagagagagagagagagagagagagagagagagcugguggcaggcuggaaauccacagcuggcugguaaacagcccugaaaggccacgaggggagauaagagguacccggagaccgggaagagagaggcgcugucuugaucaggaauggcuauguaacuauagcccagugcaaaaugagauggugggccccuugcuggaaauuuaccugguagauagcauaugcuuuccuagccuguacuagucucuuguuugauuuuuccaauacuacauaaacuugguagaagauggaugacaaguucaauaccauccccaguuauacacugaguuugagaccagccugggcuaugugaaacucaucucaaaacaaaacacaaaacaaagccucacauagaauucuaagacagugacagccaacuauguguguaggucacauggcuguggcgcuggcucugauuagaauggacaucuugggucuacgacaggccuucuaaaaaaaauaaugacccagggggaaaggacacuuuaagagccgccccuuacuuuuucagaacuucuauggcaacucaggaugggcagaaggcggacucuagccaaacagaccuggcucuaguccaaguuccucucucuagcccagcuguuccuaaccuguaggucuccaccucucugggguuaaacaacucuuucacaggggucugccuaagaccagcagaaaacacagauauuuacauugugacuauagcaaaguuacaguuaugaaguagcaacaaaaaauuguaugguugcaaucaguuaagaagaguggggaaccacuggucucucgcccuucucaccucucugggcuuccaguuuccucucagaauucuagugccaacgacccagggccggauuacacaauaagaagucuagccuagaauuuugccagcuugaagaaaaaaaagcuacccaccauccccuuuaccacuggcucuacugaugguguccacacugaagaugguagcagggaaugaaggcuccuaaccaggcccaguccuccaugccuuccugccacaggcucugagcccaacaccccaagccucccacccugcucuggagccguggagagcauuuaaaacaaacccucuggguucaaccucuacaucuugcuuugccugguuuucuacccccaaccuccagacaugauuugcgcuuccuuuacugaacaagaauuggauaaauauaugugguuugguuucaaccuugucagucccugaccaauuuagguuccagguuccaggcuucgaacagaagacucaaaucagauugacccaguguuuuuuggugcuccuggauuuuaacuaggucagcuuuuaaaugggccacccccugcugcagaucccauuccuagcuagaaggccacgcugugugagucacugagguuugaggcagagcuaauaaacggacacuugcguuuguuuuaacgguaaaaucuacuuaccgaccugugugggaagggacacagcucuggggggaaaggcuggauguuuugaaaguuaccgagaucuuacugaacagaggucaguguuuucugaucauaacccacugaaagggauacauuuuaggagcuggagagauggcucagcaggcaagccacuugcagcucuugacugaguuugguacccagcaccagggucagaggcucacaauugccuguagcuccagcuggggaggggaguggauugauucugcacucucucuagucuccccaggcacaugcauacgcauuaauuacacagccacauuaauacaaauaaaacaaaaagcaagcaaacaaacaaaaccuacuuuacucagagcacacacaaacuguuugccuguaggcacacuuggugaaaauaaacacuacacauagaaucccaucuauagauuuaaaaaaaaaaaacuuaaaaguuucauuuaugugucucugugagagaaugccacuuguguaggggagccugcagagggcaaucucuuggaggaauuacagggggcugugaggggccggaucugaguccagagaacagaauccaaguccucugcacgugccccaagugcucuuaacugcugagccaucucuccagcccucuuauuacuucaauuuuuaaaauguggcccacaguauggggugaagugggccagagagauugauguucggcagaggacggggggggggggggggggcggaagaugggcggcugggcagagaacucuggcccgggugauuaauuuuaauuuuucuuuucugccacaacacgccuccuguccuaggucagaaucugccccccaccgccauccccaaaaguaagagaacccacggcccauccaccauccucccaaguuccugcagccuuguggcugccagggcuuggggguuucaacgccucucaggaucuuccguagucuuagccaggggcaagagccuucuucgcuuuaaaaacaaacaaaacccuccccgagaauugaaagccucuccgggccucggauuuuugcugcuacguacaaagcagcucugcaggcaggcggcgggggagcacguggcgcgggcaacggugaugccauccucauuacuuagaggcaggagggcgggccgaggaagaucaggcuggcucauagguccagcuggcagggcaggcugagacugcaccagcccgccagcccugcgacucgcucuugucccuggcuccuccccacucuuccccgcgcggucgggugauuucgccugugcuuuccuugcaggaguauucggugcuagggacgcuuccacucacuggaaaggcucggugcuggccaggcuugcucaaaaggauaccuagcuucugcccccagccuuugcguuccucuuaucuuuaauuuuuaaaaaagauuuaaaaaauguguuaugagugcuuugccugcaugccuuguacugugugcaugcucacaggggacaguuaucagauauuuugaaacugguguuacaaacgccagugagccacaaguagauucugggaaccaaaccggggucuucgacaagagcagcaagcaagcgcuguuaacugcugaggcgaacuccugccccaaguagcccuccauuuaaagccucguuccugccucccaucucaaccaagccuucccugguugccuggcccugcccuggucccgcucaacuuucaaguaacagaaaguuaccaaagaagcuggaaacagccuagagagcagcuguggggucugacuggcuguccaaggaggagaguacggugaugaaagagagauggagugcggagagagagcuugggaggccggaggugauggucaaacguagcaggcuccauucacuuaacaguucccuuccugucuuccgguaggggcuggcauauagucagccgcagagcacuaguccagauagccgaaaagggccgguuagucaaaaggcacccacacacugcaagaugcuuggcuucugucccugcuguaucucugaauuugcugugugcccugguagaaguugcuuccccacucugggcuucugccccauccucccuccagccuacacacugggcaguggggcuggaauaaagagaugagguccuaaaauuccaugucuaugaacauccccucagccaggacucccuaaaggaggcacagggaccuuagacguggaagagcucagguuucagcgugcaaaacuacaaaacuguucauuuuucuagguaauaacuaaaacggagaaacggaucagcuaggcucuuucugcacaccacgauuauaaaaguaguccccagcggcccagguugugagguuccaaaugugggagugucaucagucaucucagagagcaagcacccaauggcacccaagccccgacugugguagggggaacgggcagaaaccaccuccacuaacaagaccccacaccucaccucacucacccacaguguaauuccugauaaaaaccuacggugguugauauguucgcacuaaagagcugcagcacugucccugugcaauagaaaagcuggauucagaaggguugggccacagauccagugauguuacauuguggagcauuauuccuccccaaaacuuuuaauggccauggaggucaagugcaaauccaaagcaggauucccaggcccccaaccucacacgucuucccaaggcagcuagcggucuaugccucaccccacaugacauugcaggucacaggaaggcuaccuucccuccccuaccauucccaggagccuguuccuguccaccaaggcccucugagagccucugacaggucuaaagacucaguccaccuucccaggcucccugcacagaggggcuggcaucagucugugcuccuggucacaugggaacaaagccacucaggcuggaggugggcaaucguucuagagaaauuucuagauggccgacucccuuucuacucgaaccacgguugggcagagcagaugugccaacugagggaugccaguaaccagcugcugaaaucagacaggagauuuagaccuaagugaugcugugaccacuagugggcucaugguugccuguugugggaagcugggcacacucccugggguuucuaccuugagauguugacugaaagauacaagugagaucacuuccccagauucacuguucaaaggcccacagacuggcaacucaaggacugugaccaccccaaacccugaaggcaaaaagcauucagacucacaggccaggacacuggagucuccugguuuggagaucuaccccacuuccaauuggcuuugcaaaaaccaaaacaaacacacucacuuaggggauguugcuacagcuaaguugguagaauguuuauuuagcacacaugagacccuggguuugaucccaagcaccagauaagccacgccugaugaagugccaguagucccagcucucaggagguaguugcaggagaaucaagagguuaaagcuauccucagccacauaaugagcuggaagccaaccauuauauaugcaaagaucagaguuagucugugauggaaaccuugggcuguuccccguccucucagccuagggcucagcuauccagggggaacugcuugaagcaggagaaaacuggaacaaauaaaaggaacggagaggguagugcccagacuagagcuggaccuccucucaaccaggccuuacacucccccagaaggcauggaaauagacaagaagucuaauaaccucagagaagaaauuuugcccuuggcuuccuuccugccaccuugaccaggccugacaagcagccuccucaaucacacgagcugagcaauuccuggugcugaagucuggcacccaagcuccaauggggagcagaugauuugggcagcaaucacgcagaagagccucgccuauuagccacggucaugcauaagaagugaguuaaucagcccuuucccccuagccuaacaggaugcauucaacuugccuaaguggacaaaucaaauacuuaugcuaaaacuccugguggaaggagcaggggagggcagggagaaggggcaaaaggagaaggaagaggagggcaauaagggggaagaaagggaggggaaagggaggaggggaaggaaagggggaaggggaacgccuggcuuggcuuagcuccagagugccguuuuuucuccgccuggucuugcuaguggaaccugaccuauacuuaauuauuuuaaaaauagaaugcagauugaguuagcuguuguucacaggucuauagcugcuuuaauuuuguuucauuucuugucaagacagaauuucucuguguagcacuggcuguccuggaacuugcucuauagagcaggcuggccuugaacucacagagauuccacucaccugccucuaccucccaagugcugggauuaaaggcgugcgccaccaacugcccagcaacugcuuuaauuuuuguuuguuuguuuuuguuuuucaugacagaauuucucuguguagcccuggcuguccuggaacuuacuuuguagaccaggcuggccuugaacucagaaauccaccugccucugccucccaagugcugggauuaaaggccugaaccaccacuaccgggcuugcuuuaaucuuaaaaugcuaaagaacaaaauguuacaacuuuuaggacugugagagucagggaggggcuaguuggcuggaaauaggugacaaugcuggggagaccagucuccgagagagcacaccccaccuaccucagucacuggagcccacacagacaaagcuaagcucuucaggcuggguugagagaaaaaagagcaggcaugguggggguguggcucacugauagaaugcuugccuagcagguacuaacaagccuuauuauauucaagcucuccuaccaaggaugggaguggggggcacucgguggcugaagcugcuugucaccaagccuaaugaccugaguuugacuuuugaagcauacauguggaaagaaccagccagcuccugcaaguuguccucugaccuccacaugaugcuaugacaccgaugucugagcacacaacugcccagaaaacguaacaaaaacuuuaagacaaguggggaaaaacccaaaggcacuugauggcagcgucccaaaccccauuugcaccuccaagaccaaacuguaaauuccagaacuucaagggcagacugcgaggaagaagacaaccagggugggaaggcaucugagaaccggggugaugacaaggaacuagggaugcuuaggcagaaaggugggagacccacgcuaaucaaaacccuaagcaacuaucuguaagaagagcuuuguauacaaacugugcugagcacccgcuauauggaugaguaaugucuuaugaagcgcugcuaaguguguguugugggucacuucuaaaaaugcugcuuggguuuucuuuuuuuccucuggaggaaaguuaccugcuuagaccacaggcccaguaugccagacaucaagcuaggcgguaagaaauagcauggcagacaaccaaugccaaugcccuccgacgugcagggggagucagauccuaagucagugagugauaaauacacgauugaugcucaaaggaaaacagaaaaucaucagugacagagaacagcacuggaggguggccagcaacacuacccaaggcccgucuucugcgcauacuugacccuaagaguaucugaccagggagggcucuuacaauggaaggagcagcuauggcuaagacgcuaagugggaaccaggcuuggccacacgcugcagcuggguagucugugggagggcuggagagauggcuccgugggcuucugucacccugaugaacugaguucaaucccuggaccccacacagggaaggagagaagugacucagacaaacagaacucugaccuuuacaguggcuccacgacacgugagcaaaaggcugcaaauagccacauuuucugguggaaguggccucugccacacgauggggacacccuauggaaugcugcuuugauuauuagcacagggacacguugagauggagucagucugguuuggcgcuagacuuuucuacuaagaaucuagacauauuuuuguuugucguuuugagacagggucucauguaggccugguggucauaaagucucuguugcaauugaagaagaaacuucugauccucuugucucuucuauccaaguaccaggaagucaggggcguauccgguuucagcugagcuggagaugaacccaagacuuuggcaugcuacgcaaacucugcaaacugaguuacauacagccccagcccagaacuguggcuuuggucaagacuucgccaacucagagugaucaccacuagaaugggaagaagaucuauccccgcagaggaauccagggaacgaggcuagaugcuggguaggaaggcacuuggggagacugugcugugcuuggcauuacugcaauacauuucacaagcauguuccuuaccaagcaagaugcuguacccagagaacagagaugacguacuguccgccccaguccccuacuccuccuugugcuuagcaccuaggaaauucuguagaucagaaaggcaucaaaaauaaccugggaagacauccuaaggccugacuuccccacuauauaugcucccuguuggcccaguaacuacuccaccuaucuccaggguguguuuagaacucuggaaucuuauuuuucuugccuuuacccucaaacuaaccuauaacacugacuuuggggcugaggguguuuuggguggcuucugaucuuuaguguaauaaaggaaccauggaauacaauaagcuggcacaugucacuuuauauccccuggcuuagggacaaguacuuaaaucagaucccacccugauuguaaggucacaguccucaaaguccuacaaaucuaagggccucaucaccuuucccgauuagaagguuacucagccucaauuuaucccucaaugcuagaacucacucaauggagacuacaaccgggggggggggggaccacaguggaaacgguguccuugccuccugacccaagggugucuagucuggaaggggcaucacaacacaggaucgagguucaguuagccaaucugaccucucugggccugucuuccuuaucucaaaaacaaguggcccagccuauaccucgggaugugcuaauagauccaaaagguaauguuuaccaaguaucuaacaacaagcacuaccgcaaacucacccuaggcacuuaguaaaggucaaggaagccaccucuuaucccaggagagggcuuagcuuaacaggguagggaggugcucugcauacacgguugccacgccgagucacaggggugcuacucugcuccugcuaaagaggcugccuauccgaucccugcuccuguuugcggaggcaggcccuaggccccuaauuacaccuuagccuacuuuuauuggaaaacuaugcaucuuuuccuacuuucuagaccuaggucaaaaccucuggguauguuucucaucugugagcacaaaccugacuguauaaaguaugucagucaugaagggaaaggaccuucccuaagaaccuggcacauccugagagcaccaggagaacccaagcucauagugaggaaagaugaaggaaagugugugugugugggguggggugggggugucagacagacagacugacagacuggaggaccucucucuaggcuaucaccggaguggcuggaaggcgcagaucgaagcuaagguuccagguugcgugcacagcucugaaguuggccuggcugugcacccgggacagcuccucaguagccaugaccuggagcaagcuacccacucaaacuuuccagccccacccacucaccuguuccauaggaagaagaagaaucuuaacucuuccacaguaguucuguccuuuaaauagguacguggcacacaggcacguuacaguaacaagcagacaaaacacaacuuuaaaggacaugccuuucccccucacagcguagaaccaagucgcaagccuagaaaagcucagagcacagcagcacaguguuaggaaucagcgcgcgcagcaggaagcuucgcgggagccagaagcaccguucagauuuuucuggguaaaauccaguggcccaagauggcccacucuagcccuucagacaagcuggucagguucucuccccacaaaauaccagugccgagggcaacaggaauccugcaucaacacguugacuaacagcagcagcagagaauacuguccagcccaccucggagcaccuggaccuccaccccacccacacacacaggcacacgcacacacaauauauaaacaaacaaacaaacaaauaaacaaacaaacaaaccuagaaaaacauacuucaaaguucagauuauuuaaggucugagccuuaagagaguaacaagacauucuaccauggcaagguccugucuaaggcugcagugcacagaguacuggccagccccaacauaauuuugcauuucccacucuuguaccaguuuauucguguuuguccaucccaucccuuuucucuccucccuccuugaauuuuccugacucaaccucccuagugauggaacacaucaccaacccuggucuuggguagugcugcggcuugaacccaggguucuguugcggcuaggccagcacuccgccgcugagcuacagcccggcucucuguuuuacuucuuaauuaacacagaguaucacuaaguugcccagguuagccuggaacugccucuagucgauccccgucucagucuugccauguccucuuggccuugccucuggugucacaggcaugucaauccacauccuauucuccugggaucccuugaguguucuuaugcuguccauuagaaugucaccuccuccaggaagccuucccugagccacagguuuguuuucauggcacuuaguggggccuuugccaugaauggaggcugugugugcucaggacuggugaugugcucaucugcauaacugucauauacagacagccugcaaaaaacccagcagacagcagguguucaaucucugugcggaaagaaagaacagaaaccaccaaggccgggagucacggugggaagggauuccagaccugcacugcuguuugccagcugggaagcacuggacaagccgcauagaacugguuaaugucaaauaucgagcagccaagcguugcuuaccacugagacauccaugcccuaacuuccauggagcucaugcacucagaagauacaagucuauguucuggugcagugggcaccccucucccucagacagggucuacagccacuggucaacauguaaacauguccugugccacuccuaucgaugaccacacaggccacuagaguggacagaaaguuccugaaugcucccagagaacaaacauggucugaauucaauacccuuguggcuuaggacagacagccugcaauccaauugggcuccugccaccacaucccacucggcagcccagaguguugcuccagaaaccaccccagacuccuccuuggaagaacagauacaccaccggcauucaccccaagacguauacaagcaugucuguaauggagccgcaaacuagccgguguucagagaaguagcugcuugcgauggcugcaggccagccucugcagaagcuucuccagccucucagagcuggcgaggggaggcuggcuagcacacucacagcucgacguccucauggcaaggggggacaugcaacagaggaggaaggccagcucccacuccugcauguggauggauggggcugcuucucacaagcaguugggcagaagcugagaagcaccuuggucaccagggagccuuccugcuccagcugugggggagccacacuaaacucagcauaaccuuggaauguucccuggcaagugcgcaaagaaacacugaccaggugaaccggggagagcaaccagcacgugagacacgaugggaauccacuaggggacaaaccacgccuucacauccuguaugccaccuggauagacgcagagggucuccucccuccacugaguccaggaggagcucuuucugagcaugguguggaccaacaucagauguccuccucaauggcucuucaucaaauuuucuaaagcagggucucucacugaaacgagcucagugacugggcugagccggugcacucaggaauccucuuguuucugccaagccccuagaacugguauuauagauauacacuaccaugcaugggcaucuggguccugaugcucagagggcaggcacuucagcaacuaagccaucucaccaggccuauucuauuguuuuuuuauagauuuauuuauuauuauaaauaagugcacuguagcuaucuucagacacaccagaaaagggugucagaucucauacggaugguugugaaccaccaugcaguugcugggauuugaacucaagaccuuuggaagagcagucagugcuuuuaaccacugagccaucucuccagcccaaccaggcccauucuuggucauacucugguagcagcagccucauggaacacagguacauagauacaaguuugauaagcacaauguaggaauguuuaaagacugccuuuagcgggggugaggggugcgguggcgggggaggggaggugcaggggacagacacaggcggagaaaugggcccuugcagcccagcacauuaaaagccugaaccauucuuuaguuccacucucuuuugcuucccuuuagcuugcuucuacugugaagaucugaauccugcuucagugugccuuaguauccccccuagggcuuuaaaaacacaugcauugggguaccacgcagagacagauucagcaguuggggaagagccugggaagucccucagauguuccucggguaguucugaugccagaugaggcugcaaucugagucauuaaccacauucuuuccuccugucuaucacacaggcuccaccgcaagacaugggcaucaccgcccucggcaaucuaguccucccauaccucugccccacccaagccacagaaagagaaugcaauuaaguaagucagcugugcacauggcuuaggagaauaacucagccuucuuccaaggccaguacguugaacccaacugacggacagguaauaugacuguggggguccucugauuucccucagaggccacaccauguugguuuccuguaaagucaagggaagaugguggaccaguugcaaaaaggaggacugaaucccuuccccaaaugucugguccuucuaaauuuacuauaacagguccuggccuccaccuugccaguccccuuauccccaugguccucaugacuuuagcaggacacagaccaauggagaaauccaggccugggcccuauggcuggcugcagaguccuauguacacacacacacacacacacacacacacacacacacacacaccaucagacccucauccuucccucccaucgcugaucuuccagccugcugcagaaccuucccugguaacauucucagacauagaaaagcaagagaaaaaaaaaaaaaacuaccuagguaucauugguccugagccucugguauggggccucucacuaggcccacuccuggguucucaggcuaucuguggggagaacacagggcagauccccuggaagccucaagagcaucagagugggcuuugguggaucugcacacacagacuaaucagucaaucaagcugccaugcagcaguggccuuggaugagcuggguaccugagacaggcuggcuuagaaguggaggcugugacuauccucaacccugccuuccaugccaggggugggaaguucagcccguagacagcguuuggcaugguacaggcacuucuuuuacaccguggacuuuuacaaccaaauuaaaaauaaagcaagcaagccaggcgugauagcauagaccuguaauccgaacacuuagaggguaaaggcaggcagaucucugugaguucaaggucuacauagggaguucuaggccaauuggcacuacaaggaaagaccugucuugaggaagagagggagggagggagggagggagggagaaaaacaaaagaaggaaagaaggaaagaaagaaggaaaaggaaagaaggaaagaaggaaagaaggaaagaaagaaggaaaaggaaagaaggaaagaaggaaagaaggaaagaaggaaagaaagaaagaaagaaagaaagaaagaaagaaagaaagaaagaaagaaagaaagaaagaaagaaagaaaggaaggaaggaagaaagaagaaaggaagagagggaaggggaagggaagggaagggaagggaagggagggagggaggaaggaaggaaggaaggaaggaaggaaggaaggaaggaaggaaggaaggaaggaaggaaggaaggaaggaaaggaaaauauuuugaacacugacuuuuuaaccgaacuguuaaacugaacaggcuaauccacuaggcacagggaaggaauaauacuacuuugaauauuuuuaaaaugucuccucauuuauguucucugagauacuuaacacauacuuacacguaaacaauccauaguuaacagacagaacaaugguuggguugcaguggcacacaccuauggucacagcuacuugauuagacuggggcagaggcauaauaaauccaugaauccaaggccagccauggcaauauagcaaggugaucuugucacagaaaaaaagggggagggauaaggagcaugggaguacaaaucuauaaucccaucauuuccaaagcugaagcagaaggaccacaaauuaggaguguaucucaaaagaauaaaaauuuaaaauagugacuagguauggcaacgugucuauaaccucauugcuugggaagcugagaagggacaacugccuagagcucaggguuugcuugggcuauauagggauuaugagacuagcuaggucuaugugacaggaccucugacugcaucccagcauccauccuucagauggggccuggaaguaagauaaccaaauagcauucaucugaugguaauaaacaaaugggaggcagagacucuagcauuuggauucuaacuuuuuaacucuaagaaauuuaaaagaaaaucuggaaaaaacuggaagcccacuguuguacugagagugcuaagagauuccaccucaccuucccuggagcaccucacuccggaugguggguauaaagaagagaccagucaccagggcgugguggugcucaccuuuaaucccagcauuggggaggcagaggcaggcaucucugugaguuugaggccagccccaucuacaaaccgaguccaaaacagucagaacuguuaugcagagaaacccuguagugaacaauaacagaaagagaccagaccacgugcauacagguucuucacuccaaaaacacuagagaaugcuugugaauacagugccgagcccuggggauacccaggggugaaggaaacccaggucccuuuaaagcacacagcauacuggcuucccagggggaagagaugcuaauuaauagaaaugugcaauuacaaggaaaacuccuaugaaaguuucacaacaaaagaaucugacuuagacucucaggaaggaaggggaggagucaacugcgaagugggaugggagugguuugggaagggguugggggggggggcggggagaacagugccagagaggaaagaccaguuagaaggccagcaggggcugacuuacaguacuaaggauuuuuuaaggauuuuuagacuuuaucccgguggugaauuuuacacacaggauuuaaaaaaaaaaaaaaaaaaaaaaaaaaaaaaaaaagacacugucaaccgucaucugugcuuugauuggaucauaguuuuguuuuuuggcuaaaguuggaauccuggcuucaaagagaccagaacugugguauggggaaguuaucugggauggacugaacaguguuguaaauaggaccugugguagguagaaggggagggggugguugacaggguacagaggccauggguucccugaggacagggcgcugcugagauccagauacugugacugagagguaaacaccccagcccagacagcaugugguauucguacacauccacuaaggagaagcugucuuagggaagaaggauagaauaagggcaccugggucccacauccaacugaguuuaaaauauuagaagcuugagaaauagacagaccauaagaagcaugcccagaaagauggaauuuuuuuucaccaaagucuaggacuccaaauaccucaggacucaugaaagagcugacggauucccagagccauauccaaaaaucacagcuacuuagaggagacagggaggguaaacccaguuacaauaaucuaaaagacaggaggcagcggcuauggagggauccagcucaaucaagggggucuggucuuuuuguuuuguuugaggcaagguuccgauuguagagcccuggauaacuuugugauccuccugucucaguugccaaauugcuucccccguccaggaccaguucucuaaagccagagaagcauccucagcugaaaaagaaucuauauagaaagagaaccaguggggcaguggaguuggggagagaugccucaacagguaaaugaacucugccugcuaccaacucuguuugauuccccaaacucacauggugaaaggagagaacuaacucccccaaacugccuuugaccucuaggagcauggcacccaugcaaaugcacaggcaaacacacacacacacacacacacacacacacacacacacacacacacacacacacacacugcagggaaaggacuuccuaggaaaccaggagauaggcauuucuuacggaagcugccgcaggcugggagaaggugaaggaccaggaggcgaucugagagaaugccugaagcagcagaugugcagugaaaaaggagcuuccagagagagggcaguggauagaguggauaggcaucgaccucuacagaaacccuggugggaaggcagugcagagccaagggcugggcugcucugcacugcugcagcugaucccgaacagacaguggcaucuggaugccaucuccagauucaaaccuccuuuccuacagaaacaaguaccacuuuaaugucagccuuuguguguguguguguguguguauguauguauguauguguguguguguauacacacacgugcaacaacaggugcugguccuucaauuccuccuuuuuugagacaggcccuguugauuuucuguugcccgcagcaaccuuccggaguuugccuagccucuugucuggagccccggauuccagcugcccacgucgcaucuccacaccuccagcuuuuauguggguuuugaggaucugaacucaggucaaggccgcguggcaaguguuuuuaccacugagccaccucacaagccucacuuucucuuuuuaagcgccugccagcucgcacacucuagcacaucggcagugacgcaucuggugccugagacuguugguggugacagccucacuuuggagaccccaguccacacugugaggcaacucgccaggacugggagugagagacaggcacguaccaggcaccgcucucuaaaacgcucugacucaguaaaagaaagugugggugcucuucauagugcacagcaggaggggcuaggggacgcgguagcaaggagaacugguguagccaauaacugcaggcaccauggagaauacacacuuaagcuaauggcuacuuuuaccaugagguugucugggguagaccagagagcagcuggagaccagaggacccagcagugagcugccaugaaauugggaaauugggaaaagcccuguuguguugcugcacacacuacacaaggcucgggagggcaagcuccagccccacaccaaaaggcaaaaccguggaaggaagcuuaaucuccaaccuuuaauauuuuccaaacgguaauagagugaaaucaacuuaugagucugagcuaucauauuuuucaaugaaucaaaaguguucacguuuuaaaaaauaauaugcaugugcugagcaacggugugaauccuguuacuaguggguucaaaaaaucugaacaccacugggcuugaauucagcacccucggguuauuuauuuggacagggucacauguagcacaggcuaaccuugaacuugauauggagcagagaaugaccuucaacuucucccuccuccaccccccccccaggugcugggauugcaguaagugcuggcauuacaucugccuuacaaaguacaaaaaacagaaccuagggcucuguauguucuagauaagaacucuaguaauuguguuacuacaauuacuacaacuacaacagucacuacaaccccagcccgaccccccucccacuccauuuuagacgacaaggagagaagcugaacaccuuguccaacucaaguuaaugaccaagcugagaagugcguccaagucuuuaaugguucuucucaauaauuuccucacuaaaccagacucucaaaaugcaaauaccucugggagaaaggcagggacugcaauccacgcuggaguaaguaagugaucaaguaggcucaucguuuagaccuacugccuggagccaguuugguaaagaaaaugguagacugggcgugucaggggugaggggaguugcacagaacagaguaaaaacaagaucaguuugaagggaccucccggaaggugcuguggagcaccgcagaggacagggcgugaagaaagauaccggugucacugggacacgugguucuauacuaggaggcaguuuccaggucuggaauuggacguguugaggccauggguguuuugcucacauggcuucaaccaauucuaucacugaaauguucugaauaacuaccuccgguccagucaggagcccucucuuuaacucaguauuuguuguauaauuauaugccaauguaauauaagacucaagucaggggcuggagagauggcucagagguuaagagcacggacugcucuuccagagguccugaguucaauucccagcaaccacaugguggcucacaaccaucuguaaugggggucugaugcccucuucuggugugucugaagacagugacaguguacucauauacauaaaauaaaaauaaauauaucuaaaaaauuuuuaaaaaucaauauguuuaaaaaaaaaacucaagucugguucauguuuuucuucuuaccugucuaugggaagcaggugcugagcaccgauggagaguaggucccaagagacacagccuaaaaggggaugcuccaaggaaaacacccuuuuagacaccguagcaaugagcugcuucucucaggucagaauucaggccagaaugcuaggccaaguucauuccaucagacccccaccacagccacucagcaacaagcccugggcuccgacauagaagggagagaggagaggagagcagacagcuggcagacagcuccugccuggcucuucagaguggugaguuaguacugagucaggcaccucucccacagugcugcacggaugaugccuaacugcaccagucccaaguaagucaccuugagaggccgcuaauguggccccagcccagggaggggacagggucugacacugcugccgggaacuucacguuccacacacuucugcuuaguggcccaagcauuaagaggcaauuagacaaagguuuugaacccaaagccauuucugcuuugcuaugugcugucuuccccccccccccccagcagcaggccugggacggaggugccagggugaccuggggacuguggugauauguccugacccucacuagucacuagguauacagcaagcagcuuugcaaacuucaguagcccuggacuuaaauuuccuccucucuaccucugagacagagaggacugcuccauagggagccaggaaugagaacaacuucucaugaaggccugugaacgggagcccauuucuaugaggaucaaaaguuguuuaaucgcauauucagaaggucuuggaaaauucacagugcaccaucaaauguaggacuugccacauuccuaaaagaacaaagcacaggaccccagggaccuccccugccugcuaaacaaagagaacuaacuuuccagguaguaaacuucaagaagcaaaauugagaacauaacacaggugcuuuuauaacaaaaggauacacaucucccucuuaauucuuuuauugaucaaguucaaaauaaguacaauuuuuuuucucauuaauacaacuuuguuaacucgacgagcgagauuuguagggaggaggaucauucaaagguucgcucccagauucccaaaucucuuagugguuagacauacaaacuguuuucaacucagcagcauaaagagcgaaccauggugaccugguacuaagcccacacccaggggguggagcccagacauuugcauuuuaccgguucccuggaugaucugguaauauaggucauguaugggccuuggucaacuacagaaccugcauucucuccuguccacagacuaccuugggaggcugacucugaguccuaagugauccauccacagaacagagagguuggcuaucuuuaaggaacuucaggcaggguuaggugaguggcucuaggcaguauuacuagcauggcuacaucccaacacugagguccugucuauucuauccugagauuguuuuuucuuucuacagaaaggcuaaugaaaaaacuacuuauauaagacaccuaaauaaccacuaagaauggcuccugcuugucuucucauuaccggaaacaucuaacagugcauacugaauauuccaaaccagggucaggcucccccuuaaaaugccuacccacuccacuugucuguuucaccuaacgcuccaccaggaagcuaugcuuuguuucugugcccucaacaccaacaaacccaaacccacccucuugcuaauagguggccucacuccaaaacuggaggagaaaaaguccuuucccguggugcuucagggcaguacagaggcugagucuaacggaguuagaaucccaguucuguaccgaccggcggugaucuggagcucugacucaauuuccuugcauuuaguauaagaauaacaacaguacuuaacauagugcccuugugaggcuaaauuaacugaugucuguaauccacuuagcaacaugccagacacaguaaggaguuaugugagcaucugcuauuauugcuggaguuguuauuuuaaaccuccaaggggcccuaaauuauuccuccccacuccccaguaucugcgacuauaucaagcaccugcgaagggccaacucaagccaauagugacuuauugauaaaaacagaacuguccagucuuacaggacacauguacaaaacguuggauguagacuaagguaaucugucccagaccacagguuggcaggauccuaccuccuuguagcuggugaacucaagccagggucuguguggcuucagaagccagccucaccauggaaccuucagaucaaaaacaagccucagcagcugccagucacaagagucaacugaucaccccauaccaaggccacauucaguucucugcccccaauccccgcuuggcuugcauaaauuggagcaaaccgccaggccacucuccugaacccaauuaggcaguaagucaaccuggacggaaaaaaaaaaaugcaacgcauuccagaggucaaaguagacucccggcuccgauagcagccuuugcccgacacuuccauggaaguuagucucuacaugcagacaccagccuacagccugcgaugugccuagcacacgcuugagucccacaucggggccugcauuaggaacaaacugcccgagucugaaggcaauacaaaaggacaguuuacuuuuuuuuuuaaagaaaaauccuauuucucuuucgguuuaagguagcguuuacuauguaguuaccuaccuuccccgccaaaacaaaaauggggggcggggugggaggcgcggggugaggaacuggauaaagagcgagagagcucccucagccugcagagugcugcgacacccaccugaaacucgaccaaccuuucuagagagcccagccccggagggcguuuccccagcgcauccaacaacucgucccucccggguagaaggcugacgcccucggcauuacagagggccaccagauuaaagagccugagccccucccgcccucuaguuucacccccacccccauacaccacccaaucauuuccgcugaaggcgcaaacaccagcgcaaucguuucgccuucaaggccaccuuucacuacgugccgagcgcagcaggagccacggcggaaagccgaacgggggggggggggcagggaguuggggcgggggccgcuggauaagauagaccgucaccuuuucggggcuacuacagcuucgggauccuuggacccugggugggagccccuauaaggccgaaugcgaaaauggggugggggugucccaggggccagcuccuccagcagccaccucgcuagagggcggccgucggggcgauggcgcaagcuucucaccacccccaccccccaagcgcgacaacagccacggugacaaaauggcagcucggcgcccgacuggcgagccaccggcacacagccggggacugcugccccugcacccuaagaaugccagggcacccuggggauaggucucccaauggccuaguagugcaaauggcgagagcagacgggccuguagauccuaggaggucgaggguccccggcacgccgcgcccucuccagaccagauccucaggcccgcgccgagguucgacugugccugugugcucucaggcccccaccgcugggcgccacgguccccgcggagcccgguccgcggccgccgugggggaggggugggccuccggcgccccgggaaacauggcugcucguccuaguacggcggcgucgcggccaccaguccccgagaugcgacuugggagagagguugcagaaggugggugcgugggggggacucuggggagggagguuccccggaacgaucuguuuuccaaaaacguuuauuugaaaaaagcaaaaacccagcaaaacaacaacaaaaagccaguuccuccucccccaccccuuuugucccucuuucgagagcuuucugcccuccccucccccaugcgcagcaagugcccccucccccgccacccgcgcgccccaccccgccauaagcccggaggccggcgagugggcagcagacucacggcgagggggcgaagcgugagaaaucgcgcccagcccagagcgcccgccccucccccagcgcacacacucggggaaguuuaaagagccgguucgacccgcuuuccguuucgcuccgggucagcuaguacuguggaccgcucggucggguccggcgcugcugcgcaccuacucgccgggacccugaagccccccaacuacauauaggggucuuccgggaaaguacgcgggaagucgcguucggcccccuccccccagcaccacacccagucccuuccaccccccgggaucgggcacccuggcugggucgggacgccaccgggcgaaccaggcagcccccgcggcaaguccuggugcuaggggugcccccuccuuccgcccugcgcgccauaaggcuguagcacgucuccagugcacagcugcgugaggaugggcggucggcagaaaggagcuuguuuucaaaagucuuacucagguuuagaaggaggaauuaggagaaaagaggaaaugaggccugccuuugucaggauucgaggggucaaguggcuggaggggcgacaggucagcacaacgugcuacgcgagcccccaacucgcccgagccccagacccucaggcuagacccgagaucuuucccgcccgcgagcuccugcucccuacuaccgagccuagaggggaaguuggcuaggguuuccaccgcagacccuaaggucucucgaaugggucaacucgcagacaacacgagugcgugaaagcgagagggagacaaaaauaaacaguagcuuucgagucacccaccaacccucacuuccccuugcagugggcucgcgcccagccucccuguucccaccgguguaaguuuccuccugccauacucccgccgcugcccaauccauaacggcuacggccagacgaacugcccaucccagagcugcgugccugccgugcccgcaagaauguagacugggucgguccccacagcggcacuagcucugggcagcucggguucugauaaaguuucucgugcccauuuauuaaccaagcgccgaauggcugccagggagcccaccccaggagaagcaaggaccgggaagguggggugucugcugccgaugaggcgucagggugccaaggcuggcaucuggggagggagccgggggccagaacgggacgcagccuccgggcaacuuacauuagcgacgcucgugguuggggaggcgcgaggauuaucugagcauuugcacacuucacaaucccucccccuuaaccuaagguacccccccucccuuuccgcgaggaagaagggagaaaagacagcaucuggcccaaaggugggguggaaagagugagagagaaaggagaaggaaggcagacagagaaagggagggagggagagaaagggcgcguucacgaacacgacaaaguuacaaauauggcuccccaccucucgccucauccccgcagagaaacgaagacgcgcuuuaaacucgagccaucucccaacuccgcagcagucggguccccacgcgcucuccccgggguccucgggcuacauugaucagaaacuauaccggacucgcgaagcccaaaacuuauugugugcgagcgagcgaaagagacugcaaagggagggggcaggcgcgggagggggcggaaaggggguuacgcuucuaaaauauaacaaccccuuuuuguuguuuaauccaggaggcagcccaucuucuccuccccucgaucaucuuuuccauccagaugcaagucgugggagcugagagcucggacgagggugaaauugccgccuucccuccgacccgaacgcgugcgccccgccggccccccgcugggugcacacucgcacgcacacccucgcacccauacccgcacacgcgggagcacacgcacagguagucagucacacaccaagggcagcagcgacggcggacgaaacaugcuccgguggcauugcaaccccccccacccccgccauccaaccuugcaauucauuugcagucagaccccaaaccccacaccuuccccggagccccccuccauaaaaaagugccuuccccccaaaacacacacgcacacauaacacaaaguaggagaauggaccgacagagauauuuuuggcaaaugcucacaucagagggcguccuguuccgcagcucuaaauaaauccguuuguccaucuccaucucucgcgcucucucuuucugcagaggauccugcgccagcggaauucaaucaauaaaccccgaacccacggccgcgcguuuuaggacuuugaaggcucaaccagcuccgcucgguucucgagcccccagcacccgcggcgcacacuaaccugaucgccguagaggcgggaccugcggcuccuugcguggagcggcggcaacaagagcca

SEQ ID NO: 5157 - RNA, 1080 nt, Mus musculus
acgaguuuggggcagagcgggaaagagaagaggagggcagaaaggagcugaaggaggagccugggguccagggcagacccuggcagcugaggggucaccgcccagcccaguccuggagcuagcucuagccuacgcaaucuccaggaagcugcuggaaacagaagcgguccuccccagcucucuuccucccgcccaggaaaacacaaacguccagggccagaggugaagguggagcccaccagggacgcuugcacuccucucugggugagaagcagaggaagggccuggagugaacugauacugguuucgcucgcugcuucgaccuggggguggggguaaggguggggguggggauacaagggcaucauucaagcaucaacaccagguccaguucgggagcuaguggccuggauaacguugugagagagcgugcugagcuaugggauugaccuugacugaaggagagagggggcacaaggacacguuagaauccucgguaacagaacuagagauggaugagaugauccccacuauccaaggggacacaccauugaacuuagcaaacgcccccuugagacacccaaaggaggagacagucuuaagaaacugcagaguguuucucugugccguuuaguccagauguaaaagauuugcccaguacuuuuaucccccugaaagacagggugcagaguuucuuggagcccaaaguguccuugagcucagacgguagcugaagaggacuuuggguuccugauccuucugcugauccuccuagugcugaggucguccguaugagucaucacaccugacgaauguccugcuggagauccacucccugggcuucaugguggacaagcauccuaccaacugagcuacaccccaacccugcuggcuccuuuuaucucguagagaccugugcugccccuuggcgcuuccuagcaguauaauuagaaagucccuuuauaccuuacaggucuccuucccugacaucaugcccugucggcuucugaagaugcgugaauuccacaguuccccacaaaaucauuuggaaaaaagauaauaaauucacauucuuugccc

SEQ ID NO: 5158 - RNA, 20116 nt, Mus musculus
guacuuuuuuuucaaacauuuacugaacacaacaccauuuuuccuuuuacacagcaaaguuguuaguuucaaauuagcugagccauuaggacugucaauugccaugaaaucaaaggugauucuacaugucaaacucaaguugaagacaucaugcaauauauaagucacugauaggccccggugcagucagcaaaguuacuaagcuuauuaaagucacauaaauggcuugacaagagcgcacgauagaaugacaucacuggcucgcaguaaaccacggugaauuacuagacuacaacuauguagcuccucugcaccaaggacugcagggugcggugaacauuacaaaggacaggguccugccaguagguuaaggccagauuuuacuucccagcuauguacuucugaaaagacugguuaggaaagcuugcagggagagguccccucaucucuucucuaccgauuacugagcaacaacaaaaaaagccaugcacacauuuuacaauaccugauaggaaauaggugcaaagccugccuguguccucaccuggcagaccugcaucuucaugccuucauuuuucugaugaggcuacucaucccaugauucaccccuaaaggaaagcuguaaagcuguaauuuagcaguauucagcccugcagauuuaucagugacgugcuccccauaaccaucaaaccgcugucccuucccuacacauuaacacaaagguacacuccacaaaccuaggacuagagaccacauuuacuuuacauuuguaguagucaaccaaucagcauugucacuauagaauuuguuccagaucccaggcuugagaaaggggcugcuguaugccuggcccaucucuggcagguuugccagaaacuucaaagaaagccccucaguguauguacauauugaggggcugucagaugauauccagaauggagcugugcacuuucagaguaagagugagcacagcuuagaaucugacugaaaucaguucagagccaaaggcagaguugaggguuuuacucuucccuauuucugcugcaguuaagucaugagaagggugcacuucugcgugcacugacaucuggguagcugagaaaguacacuucggauuuuuacaauugucaugaggcacagauacuuuaacccgcccacucaaguucagccacuggcuucuucucagcccacagaguucaaguagcacgcguccuuuggcuuccauauucccagaacacggguauucugcugcuuggauuauccaaagcaaccucauuuuaaccugaugccucaauuacaaugaguaacuccucucuaggacuugaguuuucagaaauguuugucuaaaacaguguuggcuuuagggagguuuuaaucccuuaaccacaguuuaugucaaacaaugcuaucaugccuaagucuucauaaucaccauuuagcaacuauuaguguaaugaaaucaaaacuccuuucagaaacuagcaaaaccaaagcauggcagaugggccagguuguuuugguuugcauguuuaaaguucccacagugaagaaccucugggugguugugcugugauuauaaucaagaguggacuggaaaaagccagugucagagucagcuaccccuucuucuucaacaagaggauggauagauagcuuugcugcccagacuggggucagucacugaaguguaagguuuuaauuccuaacugcaugaaaagugaaaagcacccuccugcacuccuggcucaugcaaauuuaugugacaauuuacacaagugacauguucuggggaaaucacuaacacuaucaaggaaggguuacaauucaaagcaugauucuaccaauaacaaacaucaaaugacagacauggcugcaacacacgacagccuagugagcuagcuacaaugcuaccaccuuucacaccuauuuuucuuuaaaaacaaaaguucauggaacauuuggcugagcauacuuucaaagaauuuuaccaaaaacaaauaacgggaaggccaggcaugaggacacuugcuccuauaauggauuuauacagguguuccacaaugcaaaucuggagugaugguacagacagaauuagauccucagcaagaguacauagugugcaacuacacaacuaaacaacucuaguuaguccaccaccagcaccguuccguucccuccacccuccucagcacugucuucccuccuucaaaagcuguccuuuaauucuacaucugaauauguauauuauuauuauucucauauauaaauaaugucuuagaacaguguugguccuggguagugaaggaggaaaaauguuuuuaaaacaugcaguauuaucugauagauacuuucaguuugggugcuuaaaaaucauauacauuaaaaaaauggaaccaacugaauacuaaguuucacagcuauuccucacuguccucauugggccuuaguguccgaaaagaccugaccugagccugagaagaggcagggcugacucaccuugugcagugugucaucucuuccaggccacugagagcugccagagcaaggugaaucaauaucgccuuaagucacaccaagagggucuaggucagaaguucccaaauuagggcauuccaacaccucccuuuaagccaucagaaaagucuuccauguaaacucucaaguuaggaaaauaacuaacacaaggacacacacgaagcacaacuacagcaacugcaucuugcacccuuggagcaggaaacuuuaagucuccuuuccugcccucuccugguauuucauuuuaugggguaucucuguuuaaggcccuaggugcugauuuuggcuuggucacuuuguacuacuccaacuacaaccauucuccuauguuuuaaaagcaauauccacagguaaaguauuugugaaaucuuacagguuguuuaaaguuuauaucugauguuguaucaugacaaugcuuuucacuaaaggaaaacacaaagcugcgggucuccacguacgguuccaugcacuagggguagcuuaggcagcauucauuuggcacuagaggaaauuacaggaacuaguuucacuuucauucucaucccuagcaucagcagacacuguuguuccuucaacuugaauuucugugaugcuuaagagaaaaaaaaaaaaaucacagaauacucuuaagaguugaaauguugcuugauuuaaaaaaaaaaaagcaaaaaacccaaagaccucaguaccacauucugugguagaaaagucuacagcucugagauacaccuuucauguggcacugagaaucauuuuccucaucaaauacuucauuuccuauaccuuacuccugguuuuccuacaucuuacaauggacuaaguaaaaacaucacauauguguccucauuccuuuucaucuuacaccuaauuagggagacaccaaugcccuauggaaaggcaguuuccaauuuuuaaagauacaacacacaaggacagggcuagaaaaggacgaaguacaaugucuagcuauacugugacaauguuucauaauacagugugcuccuuacguaggucugugagccaaauccaaugcauaaaugcaauuuagauucaucauuacaucagagaccagaagaauucaagccuaaggguggaaucuagcaagguccgcaagguugggcuaagaucaccaguuagaagacacuaacagaacacaaugauuuucaggaauucaacuuuccaacaauaacugcacauaauuuucagauuauuaaucaguagcuaaguguuucaaguccuccugauguaaaaugugcuguaucacugcacacacacagugaagugagaaccauccaugcagggcuugagcaucucccagugcucccaguguuccuuuuuaguucauuuucuucaugaaauccucaaaacugcugcacagaugacaugcugacaucagcuuaacagaaauacuuuuguaggcagcuguuuaaaacaucaccaauuuuaaaucacaaaugccccuauuacacaaaaggcuuacauucauucuuuuaaaaaaagaaaaagaaaaggaaacaaacaaauguccauacaccuuccaguuacaccugaacagcgcugcucuguuuagugugcugagcucaauaccacgugagaaaagaggcacacggaaccaaggacgauggcugaaaggauaguggaaagaaaaggagaauuuacaaacacagaauucuauugucugugauuaaaguccuuuacuuuuuagcaccacauuaaacgauuuuacacauccagucacuuaaugaaauccaacaaacucuucaagaguccgggggaucuggucuugguaguuaaugucauuagcccgaacugcucgggcagccaggcacuugaggcucaucuucaucugaguuuuaaguaguauuucagacaccccaguuguacuuuugucuagcggaguuuuauucugcuuguuugucaugucggugugagcuccagccuccacaaggcugaugaugauggagugcaaggucagaaaaucacugaugggccuguuguacuggacgauaauguggagggcacuguuccccucauuguccacugcauuuaccucagcgccacaguccagcaggagcuuugugaccagagcguugggaaagcugcagacaucguuaguauggaaaucaucaacugguguguucgaguugacagccagguguagcaaggaaaaaccuucccguguucugggguccaggugaaucagguuguagaucugcuuguuaauucugcacugaucuucuucgcuacacugugucuugguggagaugcacacgagguacagaaagguauagagguuacacucauaguuauccauggcacuguggacgucggcaucggagauauuuuuaacucuguucaugcucugcucuauuuccaagacacugcaucucaaaacgcacucuaugucuggggccuucacagcuucauugagguguaucaucugagagaagacuugagcaaaccgaagcagaucuuuguggguauuccuguuaccuuucugccucagguguagugcguggagccacaauuugaugcacugcucgaacuccauguuaucagcauagacagccccucuguaaaugauggggugggaaacaucaauguugucagcaccuaaaauccguucccgaacuauaaggcccuccaugugaagagcaucucugucuugccgaauagccuccaauuccuguggguuccuacacucaguucuguucccauaagcauggaugggugggagaaccucuuuuucaagaauguugucaccauccugaaaucucuccaacauagcuaaauauaaauagugguaugucuucaugaugucauaguucucacgaucauuugcaaaggaggcacccaagagcuccaaggcuucaauccgacuucugcggucacaaucagcaugagagagcaacaguucaacgacaucagcuuuacagcuuucagcggccaccuucaauggugucaucccauggccauucaccacuauugcagcucuccauuuuaucaguucuuucacaaugucaaugugaccagcuucggcugcaaagugcaaagcuguggcuccacagugugcuuuagcauugggaucagcacguuguucuaagagguaucugaccacaucagugugcccuuuauaugcugcgaucauuaggcagguguugucauacuuguuggcaaugcugauauuggcauuauuuucaaccaaauauuucacaauguccagucugccaucaaagcaugcugcccgcaauggaguugaguuagugacuguggugugguucacguuggcuccauggcugacuagaaguuuaacaacuucaaaauguccggcucccgcagcacaccaaagagcaguggcaccgucaaugacauaccuacacacagaaaguacagucagucagugggcuaacaggcccugacaugcauucacaggcaccaaccaaaacuccacuuucccaaacauuacuaaaguaucaguuagaguagaaaaaaaacaaguaauuucagcagagcacuuuacuagugugggaucaauaaaauuauuguuacuguuuuuucuaaagucauuuuuuuuuuaaccugaagaauacucucuacuagcaacaauacauuucagaaaacacagaagaaaggcugagaagauuggcucaguggggaaaguacuugcuaugcaagcaugagggucugaguucaaaucuccagaacacacuuagugacaagaguggcaagugucuauuuuuucagugucacuacuguaggaugggagacuacuacugugggguggaaacaggagaaucccugaagcuaauggggcagugggucagaugugcucagcaucuaaaaacaaagcagucugucucaaggaggaaggugaggaccaauaccagguacacacaguuuuaaaaccagaaaaagcaaaacaagcaaaaaugcagaggcaauguuuggaggucuauauggucuuuuuaccaaagguaugaaaggucugcugacucuucagaggacaucaugaccugccucucuguagaccaaggagcccuccagaguucaguuuucccauuuagagaaagagcuccaguucauacauuguuaagaugcugcuuuagggagaaaaaaacgaaaagcaugugacagcagcccuaagguggcaguucucaaccuguaggucacaacccuuuuuggcaaccccuucuuuaaaaacuauuuacuuuacaauucggaacagcagcaaaauuacaguuaugaaguagcgauuaaaguaauuuuaugguuggagaucagcacgacaugaagaacugaauuaaagaguugcagcauuaggaagguugaggaucauugcuuuaaaacuacagcaacaagaaugaacaaucacuggucauacaguguuauuaccggcuuuuuaggaaguguguuaaaguuuucucuuacccagcuagcucuaaauuaacugagacuggacuauuauauuuguuuaagaugcuuuaaagacacaacaacugagcaguguuacucuauuuuaauccucucaacuaaucugccuaccucccagccaaaauccccagauauucgcauuuaagggcuuucuucuguucagagcuguuuucucauggugucuccaggacucuccccauggguagguaauccacuuccucucucuccuguacccauuauccccuggcugggagaaguccugcccuauucucugcccuguucaaucauuggcugaucagcuuuuuaaucaacaaaucagagaauaaauguggaguaaugcuuauacaacauugaggcaggaaacacuuagaauaagaauuacaaccagagcccggcaugguggcaugcaccuuuaaucccagcacuugugaggcauaggcagguggauuugaguucgaggccagccuggucuauagagugaguuccaggacagccagggcuacacagagaaacagagaaacccugucucgaaaaaccaaaaaaaaaaaaaaaaaaaaaaaaaaaaagaauuacaaccagauauaggggagacagaaucaguauuuaaaucuuuacacaguauacaacauugugucuacacaauauagacagcugcauacugcuuccuuuugggaaauguacuggauggcaggaugccauauggagacuuaccaagcaaauaugcucaccauguaaauauaaaugcuauauagaaauguguuuuggggcuggagagauggcuuagugguuaagagcacuggcuguacuuccaaagguccugaguucaauucccagcaaccacaugauggcucacaacaucuguaaugagcauccagggcccucuucuggugugucugaagacagcgacaguguacaguauacaugaaauaaauaauucuuuaaaauaaagaaaagaaauguguuuuagcuaggcagugaaaggcacaccuuucaucccagcucuucggaggcagaagcagguggauuucugaguucgaggccagccuggucuacagagugaguuccaggacagccagagcuacacagagaaacccugucucgaaaaaacaaaaaacaaacaaaauguguuuuagcaugcuguaucccaagugauguuuguauacugugugacgggauauauuccugaagcaagucauuacacugcaugaacagcaggaaacaacuagcauuugagaaacuacccaagcaacucccuggcuggacacuguggacacugaggcuacaguuaccagccacucacugagccacuguuacaggcaggguuugcaaccucuacaaaacuaggcuccucugacaaguccauccuuucccacuuuuccucuagucgccuuuuccuaauuuuaauucuacugauaaugguuucauggaacccccccaaaaaagaagacuuuuugcuaaagauauuuagaauuacuaugcuagaaccaguaaguacaccugacaaauauuaggacagacugaugaccaaauaacuauuuacuaggacaauuaaacacaccgaaauccuauuaaugagcuucuacuacacaaccuuauuugugacacagaucaaauuacaguccccacaaagugagaguauaacucccauaaugccucuccaaaagucagguguuagcacugcagauaggguaccucccugacucuuugaaauuacagcucuuaugaaagaggcucagcucuugacaguggcaggcugaccugcucuucugccuucuaccaugcggaaggacagcauucuucacuacagaaugcagcccuugucagacaaccaaacuucccuucaccuugaaugucccagccuacaugauaugggaaauaaauuuccacucuaagaaucagucuuauuuuguuacagcaguacaaaaugaacuaagacuuuagaaaagcauaaauuaaucccaauuaacaucacaaaaaaauacccucuaucccuuuuuuguugaaaaaaaaauauuagucagaaguaauguugcacaccuuugucccggggggggggggggggggggggaaggagagggagaaauauaggggcacaucuggaagugagagaacaagcugagggaguugguucucuacuugaccauauggucccaggaugaucaggucuggccauagugaucuuuaccaacugagccauuccacuggaccuguauuuguuuucaacacaauguguuaauuccagucuggaaaagugcuuuguuuucuuuucuuuuuugguuuuuuucaagacaggguuucucuguguagcccuggcugucccggaacucacucuguagaccaggcuggccucgaacucagaaauccgccugccucugccucccaagugcugggauuaccaccaugcccaguggaaaaguguuucugaaauugaaacaaauauugauguacuguuuccuugcaggugauacuuuuacuuuuuaugauauugcacuggcuaguuuugugucaacuugacacagcuggaguuaucacagagaaaggagccucccuugaggaaaugccuccaugagauccagcuguaaagcauuuucucaauuagugaucaagggugggagagcccauuguggguggugccaucccugggcugacaguauuggauucuauaagagagcaggcugagcaagccaggggaaagcaagccaguaaggaacaucccuccauggccucugcaucagcuccugcuuccugaccugcuugaguuccaguccugacuuccuuugaugaugagcagcaauguggaaguguaaacugaauaaacccuuuccuccccaacuugcuucuuggucaugauguuuuguacaggaauagaaacccugacuaagacagauauugaaagaucuuaugguguguuuggugcuacguaauucuauuaguuacauaucugcaugaaagacaugguuacaguuauuuaucuaccacauagggcuaguggcagguuauugugaagauugaguuauacugcacuugaaguaguuaauacaggaggcagaggcaggcggauuucugaguucgaggccagccuggucuacaaagugaguuccaggacagccagggcuauacagagaaacccugucucgaaaaaaaccaaaaaaaaaaaaaaaaaaaaaaaaaaaaaaaaaaaaguaguaguaguuaauacaauacuagagacauugaaauauuuuguaugaacaaguugauacacgagauauuuuuccuuaaagucagcuguaccucuuuaagucuauagcuuaguuggaauuacaaaccuaguaaaaugcacaaaucuuuuuaauuuuaaauuuguauuuauuguauuaccuuaauuuuuuuuuuuaaagauuuauuuauuuauuauauguaaguacacuguagcuaucuucagacacuccagaagaaagggucagaucuuguuacagaugguugugagccaccaugugguugcugggauuugaacuccagaccuucggaagagcagucgggugcucuuacccacugagccaucucaccagcccguauuaccuuaauuuauguacauguacuauauagcaugcagguagaagucagagggcaauugugggagucaauucucucuccuacuaugugaguucugcaaauugaacuuggcagcagaugccuuuaucuacugagccaucucaucaccuaugaaucuugagaauacaucuauggacuccuuuucuaauccagguauaaaacauuuugaucauccuaaauguucuccuugauccucuuccuagucaguucccccuuagaucauuugccuguaauguaaauuuccuaauauuggaacccuacagcauacuacuucauauuugacuuuugacacuaacugugaaauucuuccauguagcuggguauaucagcaguuucuuuuugaaugcuauguaguauuauguuguauggguauucuacaguuuacuuauccacuguccucuuaaugaacauuuggguuguuuccagggauuggcuuuuaugaauaaagguauucuaaauagucuuuuuuuguuugaguugagacagagucucaguauggaguccuuucuagccccuaaucaccuggguccucuggaugaguaguaaauacucuuaacuacugagcccucauaguuuaaguuuccaggcccuaauaguuugaaauguugugcaucagcugggcgugguggcgcacgccuuuaaucucagcacuugggaggcagaggcaggcgaauuucugaguuugaggccagccuggucuacagagugaguuccaggacagccaggacuacauagagaaacccugucucgaaaaaaaaaauaaauaaaauguugugcaucauaugagguaagaauagaggcugggguggagagaaggcucggugguuaccuacuguucuuccagagguccugaguucaauucccagcaaccacauggugguucacaaccaucuguaaugggaucugaugcccucuucuggugugucugaagagagcaaugguguacucauauacauaaaauaaauaaucuuuaaaaaaaaaaaaagaauacacacugauuaucucccauaccgguuauuugcuccagcacuauuuauuuaaauagugugccuccuaccugaauuuccauggaauuuuucuuuccugccauggugcuggggacuugaacucaaggugucaugcucccuaggcaggcauucuaucacugaacuacauccccagucccacuggagccuaucucauuagccagaagcuccagcagugaguuuauuucuggaauguucucuugauacauuauuucauccuugcaccaaugucacauuuaauuaugguaguuucuuauuuucucuucaaaauuaccuuaguuauauuccuacauacuuuuagaguuggccugcaguuuucacauaugugcacaugccugcuaggagugugauuuggauaacaucaauguacagagaucccuuuguuuguaauauucacacugaggcuauuuuuuuuauuuuauguauaugaguacacuguugcuguacagaugguuaugagucuuaaugugguuguugggaauugaacuuuuaggaccucugcucacucagucccugcucgcuccagcccaaagauuuacuuauuauuauaauuaagugcacuguagcugucuucagacacccagaagagggcgucagaucucauuacaaaugguugugagccaccaugugguugcugggauuugaacuccggaccuuuggaagagcaaucagcgugcuuaaccgcugagccaucuugccagccccccaaacugaggcuauugagaugucuaaaccauaaacuugaagucuuucucuguuuaguuccuuauguucuguuuaucuaaaagacacuuuguaauuuucagugcagaaguccuauacauuauaccuuugguuuacuacuagagccuaauuauuuuauaauaguagugcaaaugguauauugugacaaggaaaaaacuuuuucauugaacucugcauaugaagugaaauuuucaauguacugguuugaacuagaaugaauuuuggucagacaguugggaagaggcacaguuagcaaucacaaagcuacugcuuagcuagcauuccauugaccccuccacucuuuuuuucuuuuggugggugauuuuucuacaacaggcuagcauagaaaucuuauaguucaggcuggccuuaaauuggcaauccuccugccucacccucucaaguacugggacuacaagcguguacuaucaugccugguccugaguaauuccuuaguuuacaaacaaacaaaugaaaccaagagugauauuuuaagggcuggagagauagcucagugguuaagagcacugacugaguucaaaucccagcaaccacaugguggcucacaaccaucuguaaugggauuugauacccucuucuggggugucugaaaacagcuacaguguauuuacauauauauauauauauauauauauauauauauauauauauauauaaucuuuuuuuuaagugauauuuuaaacuggguaugguagcacgugccuaaugggaaucugagacgggaaaauccuaaaguugaggccagccuuuacucuauaguaagccaguaguauuaaccuucuucccaauaaauaaauaaauaaauaaacaaauaaauaaauaaauaaauaaaugaaaauaauuaguuuguuuuauuucauuuugagacagguucucacuaaguagcugcucucuagccuggaacauacugagaaaagguaguauuuuaauugcuaguguaaaauuaauguauguaaaggacauauuuuaauauaacacuucuugauguuuaaauagcuuauauuuguauuccuagcauauggcaauuucauacuuuuaaaaccaauucauaaggccaaaucaguuauggaguguuuguagaauauaugcaagacccucuaguuaucucuagugccaacaccuucucauuccucauacacacacacauacacacacacacacacacacacacacacacacacacacacacacaaaagcaacuguucccaagccagcucaaggacacauuguaacuaagcauguugauaccaacaucuuuuuuuuuuuaagguuuauuuauuuauuauauguaaauacacuguaacugucuucagacacccagaagagggcaucaggucucauuacagguuguugugagccaccaugugguuacuggggauuugaacucaggaccuucagaagggcagucagugcucuuagccgcugagccaucucaggagcccccaauaccaacaucucuuaacuauguauuuguuuuuuauuacauuguauuuacuuguaaguggggaaggcauggggcuguagggguguguuuccuguauucaaguacuguacuaguacagguauccauagaaggccagaagaggaugucugaucccuuggagcugaguuacaaguggaugggcuuguaacucacuucauagagauucugggacccaaccuagguucuguagaacaguauaagcucuucacagcugagcuauuucucuccagccccaucuuuuaagcaugaggugagaaaaugaaacaaaaaagcaauuagaguaucuuucugaccucaaauuuccuacaaucuauguugaaaagguaaaaauuaaauuuuagguacacauucacuucauaugauuuuuguauauauuaguaagauagugaugcauaucuuuaaucccagcucuugggagacauaagcaagaggauccuguaaguucaaaaccagcauggucaacagagcaaauuccaagggcaacacagagaaaccgucuugaaaaaaacaauaauaguaauaauaucuagcugggugugguggcaagcgccuuuaaucccagcacuugggaggcagaggcagguggauuucugaguuugaggccagccuggucuacagagugaguucaaggacagccagggcuacacagagaaacccugucuugaaaacaaaacaaaacuaaacgaaaaucuuuuguuuuacuuugugagggucucacuaaguagcucugguguccuagaacucaucauguacaccagacuggccucaaacucagagauguuccugccucuaucuccagagugcucagguugaaggcguggaccagcaugggcagcauuauuauuaaauuguaauuauuuaguauauauaugcacacccacacgucaugauaugacugugaaucagaagacagcuugcaguugguucucacuuuccaccuugugcuuuccaaggauuaaacucaaguccucaggccuggugguaagcaccuuccccacuaauccaucuagcuagcccuucauuuuuuacaauguaaaguacuuguucacuuucccaagguagucugguauuuuucauuucuccuuuauucauacagaaauguaauaggaacuauagaacaguuccaauuaccuacuuuuuuauuuguuguuuuguauguacauguguguaugguauguauauauauguucuuacaaaggcaacuaaaacucagauauuuucucacaaaaguguguguaaauauggggaaguaggugcacacacaagcauguaugcacauguguguauaaucuacauagcuuuaaaacaaaaauaccaauuuuggggggauugguuggguugguuuuguuuuuuucuguuugauauuuuugguuuugggggguuuuuucaagauagaguuucucuguauagcccuggcuauccaggcuggccuugaauucagagaucuggcugccucugucucccaagugcugagauuaaacuacuguaccaccacugcccagcaauuccaauuuuuaaaaacagaauauaaagcuguaauaaaauuaaugcaccauuuacuaagcucucaugagagaagcacuguagaacaaugaucucagagcuggucagaaggcucagccaguaaaaacauuugauaauccucucgauugaguucaagaccaggaacccacauuuuaaaauaacuuuaguuauuaaauaauuaacaauuaaaaaagcaaaacucaguggcucacauguguaaucccagcccuagaacugcuacagcaaaaaugggaggugggaauaggcgccugcacauacagcaacaacagaaaggagacccacacaagaacaagacgaauagaacguaaaguaaauaaaccuguuggauuuugggggcuggagagauggcucaagugguuaagagcacugacugcucuuccagagguccugaguucaaauuccagcaaccacaugguggcucacaaccauacauaaugggaucugaagcccucuucuggugugucugaagacagcuacaguguacucacagaaaacaaauaaauaaauccaucuuuuaaaaacugaucuuucuagccuuaauccaaaauugcaaugcaaauucuguaauauauauguaaacaauaaucugaucaaucucuucaagaacaaaagcauccaugagguaagaaguuuuugcaguugaaggguuucuagcuuucauuuccugguucugcuugaaauagaaauaccuaguucaagcacugggaaugaaaaugaaaacccauuagaugugcacgaucagugccuuagcuaaaguccuggacauuguucucaagaccaacagagcuccuugacacacuuccaauguuugucuacgcaaagauggaggauguaguccuccugccucuccucucacgggacauucauuaagugcucauccuaacacuggcuuugaaaaucagagugcucauggccgagcgugguggugcacgccuuuagucccagcacuugggagggagaggcaggcggauuucugaguucaaggccagccugaucuacaaagugaguuccaggacagccagaaacccucucucgggaaaaaaaaaaaaaaaaaaaaaagaaaaucagagugcccaacaaaaaacuucaguauuuucccaccaaacucuccucacccaugucucagcaaaccugcucaacaagugguucccaaacuagcacaaagcagucaggccuaaguucccaggucagcaccauuaucccacagcugcaggguggcuucccuugguucugcucccuuucugcaguaucuuugguagcuucccauccaucacuagcucaaaguucuuuuuucaucucacggagaucuucucuacuuaccugucaacucugcuguucacaugcugagccauaagcaaaauaaucucaauuauuccaaaaacagugaacaaggacucaaaugauugacaaggcucguucuaggugguggucuccuugcucuagagcaguaguccucagccuuucugauguugcaacccuuuauuuagucccacauauuuaguuccuccuguugugcugacccccaaccauaaaauuauuuuuguugcuacuuccuagcuguaauuuugcuguuaugaaucauaacaggauaccuaguaugggacuccuguaaaaggggucacaaaccacaaguugagaaccaaucuacuugguuuccuaagagguuauaaaagcuuuuagguagaauacagugugaugguuuaucaacuacauggauccagcucaaauacuaccuccucugucaagccuugauucucuaccaccacaaagcugaaggcuuccucuuccucuguucucucagcagccucaaggacucuuauuagccuaaauggcagauuaucugugauuacuaauguuugauucuccccucccuucucagcaaacugucagccucuacaauggaagucucauuugucucugaauacagaccccuaccaaaagcuuagcacacaguggaugucugacaacugucugucugcuuuagaauuucuuaaucucacuaguuugugcagaauggugaacaagauauucagguacacaggcucaaaacugcauuuccaaucacgucaggaaucaggcggagggguacuuguuuguucugauacagggucuaugcagcacuagcuggccuggaaccuuuauauaccaagcugaccucaaauuuacauacguuuccuacuucccaauguugggauuacaggccugcaucaccacaccuggcaucagguucuuuucauugucaccucaaaacagcuuucucguccaugaucuaagacagcaauggccagagccuuucuaaauuugugagaaaacuaauuucuuccugacagguucucuuaucaacccagaucucaacaagcuccauagcaacagcugcuacuacagggacucauuccuaacuuaauagauaugaauguuuacauaguggggccauccugcuucaggcauagguaaaguugugagaugcuggagaucucuaggacacaaagccaaagaauaggcaugaaucagguugccaucuuugcucaucuuccuacuaucuacacuagaaccaaauauaagcuaugacccaggggcuggcauuucauuagaauacaacaguccaaaucauuucccucucauuuaaaacugacucaaaagcuuuuaugguuuaaggaggaaaaaaaaaaaaaaaaaaaacaaacaaaauuuaacauucaucuuuaaaaaaaaaaaaaaaaaaaaaagaugcuuuaaagcccacaccuauaauggaagcuaaagcaagagguugggggauuccaggucagccugggcuaugcagcaagaccugguuuuggagaccagaaguagcaaagaagaagggagggagggagggagggagggaggggcuagagaauauaagaaugcuuccaaacaggcuuuuuuggucaggcaguuuuuacuaaccaaaacuaaauugcauuucuauacguagauuccaccuacugcaaaagaaaaugcuaaacuaguaauagcuuauucauuuacaggucaacaaaaaccaauguaaacaaagcaaacugaauacagcuauauuaugccaaucauuccgcaaucguucagcacaggaaaaaaaaaaaagguaucaaacgugacgacucuguuaucuuccuccgccccccaaaaauauguacaauuaaccucaaaugaaaaaaaauauuagaauaauaguaaauaguaaauuuuugaacaauguuaaguguuugugaaaccuucccacuguaucacccuauacauguaauuuagcaauggcguaacuucuacgccaggcccagagccaccuguacagccaaaaauauuggccagcauugugggagagucagaaccgugccuagagaugcccagcugcaugacaagauucuaggggcuuauuuuaacagauagucccacgaccugcuugaggcucgauccgaccacgggagggggggagcgggaggagaagggauauggagagguuaaaugaagcaucaaaagguccucaauuuuaauuguugaucucguuaauuuccgaucuagguuacuacgccagugcugauauaaagauacaaaaaccuagaugggcagccaccacuccgacagugcguguucgcugacuaaugaagacuauagaucucaagacccaggguguggcuaccaccuacagggggaaaaggguaggagucgauaagaaaaggcagcaaagcauagcucugggagacgaggugggcaucaaugggggugaagggauaugaaaaagaacugaguccacacaugaaaacaggguuaaugaaggaugagaggauccagggcuugggaggcccgcgcgcgucggagggaggauggaguugggauguaccuacccgucgaagcggacggugccggucugcugggucugcacacgguaguguucuaacagcaagcgcaccaccuuggcgugcccauugcgggcugcgaugaugagggguguggagcgcuguccucccugcugacugacauagcccagcagguagcggauaucgcucucugaccgguuaaggagcaaggcagccagagugagcaccuugcccucgcuggccgccuuguacacauagccagccaggcccuccauggccgccgccaacuccaacacccguuuggucgccaccgcugcugcugccuugcgcccccggaggccgcguccaccagcacuucagacccgggcccucacagcccauucaacagggcgccgccgccguguccaggcagcagcgcgacccagggagggcggagacgcagagguggccgagcaccgccggaggcacaagugggacccggcccgggcggggagaaggacggucagggccgcccccgaggccccaggcaccggcccugggccgaggggaucuccauggcggccgccgccccgggucucaggccgccuccuuccugcgggcugcgacaggcgcgcgcccgagcuacgggucgccgcuggggucucgagaggcccgcgcacgcccuggauagcgagcgaugugcacgccugcccgcgccgggccggagggucuggaacggccuccacuuagcuccucgccgcaggaaaaccgcgggcacucgcccaccggcgaucgaaaggguccgcuggcgagcggggcucccgugagccgcgcguggguguucgcggaccgcgccggcagcaccagcaccggaacuuagggcgggaggaaagcagccgccgcagacggagccgaagggagggagg

SEQ ID NO: 5159 - RNA, 13224 nt, Mus musculus
ucucucccgcccagccuuccccgcguugggcgccgaggcuccgcgcggcccgcgcagccgucucuccucccggaaggcgaggccgagcguggcggccauggaggcggcgacgcggaggcggcagcuccucggagcggcgggcggccccggugucgcguucgugcaggccaggugcgcgcggagcggggacagggaggccgcgaggggccccagaguuugagagaccucgccaggguuaaggaaaccgcagggauaggcuacucgggggccaccccggccagccuggcugagucccugugccacuuccaaguuuuuaggaaccuccugcucugggcaagacugugacucugcucugaauccgguggcucagggcccagggaaagugggccguuaaccggggacagcgugacucucccauccugaaugagagaccccuucccucagaggggagauguuugggguuuaucuggcucgacagggcagagccagaggcgcaaaacccgcccuuucaucuuuuccuccagucugccuccauccgcuccacugaccaaagcauucccgccugucacauguauugauuaaacaccugucaugugccuagcguugugccagauggcaaacaggaaagucugagccaaagcaggugacagcuaauucuggagggcuuucuggaguugaacaguacaagacucugcagaggacagacacuuacugccgggcaugguggcaaugcuuuuaaccccaucacucaggaggcagaggcagguuucuagggggauguaauccaguugguagugacugcauagcaugcaggaagucgugguucuucccaggccacagaaacuggacaugguagacaguggaaggaugugaggaaacacaaggacuauacauacuaguguuggacaugucacacguguaagagaaaaucaacgacaggggcuggaccaacuuuaaagugcccugaaugucccagaguuggccgagaaggcccuagagucugaaguuggaggaggcaccuacucuggguggggaggcuguucacuuugagcaggaaagaccccuuaccuuccucaccugagugaccugguaaaaauguauauuccauaugccacagguaccaaagagccguggagagauuugagcacucaugugcaccaggugaauuuuaggaagucccuggcacuguuuggaauggugggggaaguucugggagacuggguugagggcagccuuuucauaguuccgacuggggagcaauucucugagcaugugcugugcugccucugguaacauuucuaccugguggucauccuaugagcucuccguggcguagucacaggguagccaucuuaguuuguauauacacgucaucagggcagauuugcccuuaggcacauuauugagcagcuucuugucacuugagggucccuauacucuaaguauuaggucaucaucucugacugauaaggaagugguccagugugcaguaaggaggugccugaccagacugaggcucaggcuguaaaacgcccaaaaaccuucuacaaguucagcagacauuccacaagcugcccccggcacuaaggggaucaaaaccaucuuccauauuuguggcugucacgguuguucuaccuguuaucuguccaucgacgcuacaguguuuacauuauuuaagcugucuuugcuuuuuguguuuagacagggacucuauuacauaguccuggcuguccuggaacuccaucuguagaaccaggcuggccucaaacuuggagauccaccugccucugccuccugagugcuauaaggugagugccaccacagccgucucugggaccuuuucuuuuuuuccucauuguuugucugcacgucuucauuuuuguugaaauguccggagcccuucucucuacuccccguacacaacucucuagacaagcccuuugccuuucugccccccaggcuugcagaugcugcugccugguccuggcuucccagcugucgaggugucagugccccccgccccgugguagacuugggaagcugaggaggggagcaggagcaaaggcugggcuugccucagguuaccuggacuggcauuggcuuucgccaagccgauauccuccuccauucagucugucgcuccugaugggggccuagaaccaacguggccuggggggagggggcucagccugggaaguuuggagucagaacuugggacaagcuugagguuccucaucuugcgguguugaggggagguaccuuuccccugugugaucugccaucacugucaaagccccgcagaaggaaacgguugguucagaaguuugccugucuuuugucuguguauugcugguaaaggaaagcuuucauuaggcugaggaaaagccagcacgagagagaaagcccugcagugcagagcaggauucugagcauccacgugugugagucuggagucccgagcucggcucuuccccucauccuguugcuaccucuuuccccuaccugccccccuaagcuaggccgcacuaaugucagggguucucauuuacugaagugcuuccugggauagagggagaaauuguuaaggagccucuagugugagccagugcaccaaguggccucauuucccccacuuccccaugugugugcuuucaaaaccccuuuauucuuucucuuuucuaauuuuuuuuuagcagacuuaauucuuuuauuuuucuuguacaaaauccuuauguaguagccacagcuggagccuggguccucugaacagagacucuggugugaucagugaauuccugauaaggagacuuggugaagacagucucuuuccagaggugggggucagguagcuguaagucuuggagauggcaucaaagguggccuuagcaaaguugcccaggguggcagugcagccucuggcugaaguguagcagucaucuauaccggccaucaucaggagcuucuuaggcacaggagcagagacagugccagugccucugggggcagggaugagacgcaccagcacagagccacagcggccuaucaccuugcauggaacaguguggggcuugucaaucuuguuccccaaguagccucuccgcacagggacgauggaaagcuuggccaagaugauggccccucggauggcaguggcaaccuccuuggagcucuuaacgugaccacuguaguccccaguagcgacaaaagccuugaaccugguccgcuggccagcccgaaucugcuucugcacuggcaugauuuucagacccucauccuuuagggacgcacccaggaagaagucaaugaucucagacuccuuaaugggcagggagaacagguagaucuccuccaagggcuugaucuucauguccuuaaccaggcggcccagcuuggugacggggauccacucuugucuucagcuuuaccuccacgagccccgcggccucggccacgaccguggccccuaagaccacugcugaauccuccgaggaagccaucgcggccuccuaauccugggcccccggguccucccggcccucccgaugcaccggcgucauccgccauuugguguuuuccugaagaagaagaagaagcuuuuuuuuuuuuuuuuuuucgaggcaggguuucuuuguguggcccuggcuguccuggaacucccucuguagaccaggcuggccucaaacucagaaauucgccugccucugccucccaagugcugggauuaaaggcgugcgccaccacugcccggcucucucuuuucuuuucuuuucuuuuuuucugagacagaguuucucuguguaguccaggcuguccuagaacucaaucuauaaaccaggcuugcuaggaacucagagaccccaccccugccucugccucccgagugcagggauuagggguacacaacaccuccuggccccuuuaauucuuuauaccaaacaccucagcucagucugagcugagggcuucagaaugaaacacaggacaccccuuccccgcaacucuuuaccacucagcuuguuugaggccuguucugaaagucauaaagaggaaaggacaaacagggacucucuuggggcgccgucaccgcacucugagcagucugcaucuagauaccugaauaucuagcccugucuuaggccuggccagcuuuaccgcuuagucucugauaggccugggauuucugcaugccuucucccccaggcauuuuucugcagcucacaugcagcucuucuucugguuaaaagugccagucuuuccuuuuuguagguucugcauauuguuccuggcuacccugauccuuuuccagauugaacucaaaugccagccgguuuaugauagugacugcaauaguaagcuguuaagagcacagagacccaggcuugaguucugugcuaucuagaacuccugcauuuccauggcaguuagugugaccucagcaccgcccaccccaccccacaacccccagcaaaaggugccagcauauaugcccugaggcagccugccaugugacacucgcacacgcgugugcacacacacacacacucuuucuuugaggccacuucacuuucucuuggcugucuuuggaggguggaccuucacggcaggccaccuuggggcuugcauucuagagagccagcaccagaaggugcuuuuuccccaauucaccaagcccuccccguggcuaacauuaccucuugggaaagaagcaagaguugggaaagagauaauaaaagcagucauagcagcuccuuacagcacaagcaggcgacaguggcuggacucugaccucagccucagcaucuuugucuaaaaguagucauagcagcuccuuauaacacaggcaggugcaauggcugaacucugacuucagucucagcaucuucauuuaaaagcaguaaggaacagcccugccucugaugccacugccugggguuagcugagaugccaccgguaaaagucauagcaucuuguacaguuggugaucaguuuguggugcgggacacuaagucaggggacacgaggcuaugcugauugcggaaagcuuacucuaccugcuuugccuuguacaggaccacagguucgccagaggccugccucccuucuucuggguggcuugguccaccuauuuaucuuugggauuagggggagcuaauuagcugaguucagcaaacauaggacagucacaacaacaccuacaaaggaccacgugcccauaggggagggauacggaacuggugacagugaugguuuuaagucagcccaagccaggaacagagcugaugucuggaggucagggaucugcgucacgcaugccuguucuggcuguacacacaggauaguaagacugucccuaucuuaggagcuacugguguuuugucucuggauaguaagcuugcuguaagagagacagaugggggagguuggagaguugggggaaccaccaucucauugcuaggaauugaacuuaggaccucugaaagagcagucagugcucuuaaccgcugagccaucucucuagaccacccuauucgucuuccacaucuugcuuugcuccugccaucauucuauaauggaggcuugacagugacuucccccuggaucagcuucuuccugaaccacaggggauuuggggcaacugaaacccacggucuucuugacuacauccaguuucccaucuagaaagcauguauguucugucuucaagugccuagaccucugucuuucccuugggcugauggcaaagcaggaggagagagggcugacccuggucucuuguucuucaccaggcauggcucugugaaggccgaggacaaagaccgcacagcccccuuccaucuugaccucugguucuacuucacacugcagaacuggguucuggacuuuggccgccccauugccauggugaguguguggcugggucccguugaguggccucauggacuucacuucuuguagggaagccagcggcuuuuauauucuguagcugugugacuguccagccaugccagugagagggucuggguggggcccaguugucauccuguguucccuguagcccaccuugaaguagucagaccaaguuuaaccaaaucacugagccagacagaagguuugggaaagggaacagagaguaucuguccucccucauuguccucuggaggggaagcccguuagcugguuuuugcauauuauaacuggccaaauuuguaauaauuaaaauaaagucacuuccaaguagugagaguagaagucucaaaauaaggaagcguuagaccuuccuggucugaucccugucccgccuccaaggggcugggccauacccuuccauuccuuucucugguuauguaaacauauauagaaauuucuuuuuuuuccuaaccaaaggaaacuuuguuuuauaccccauauucugcaccuugauuauucuacauuaggauauaucucuauacaauauaugcaaauugcuguuucuguuaaugaagcuuaaccuuccacacuaaacauguacuuugauggccugucugguacauggucuucagagagacccugucuuaagacaaaacaaaccuagcugcuaggcacuuccagcaaaggggcagguuacaaaauuaacauacccaaaucaguaaccuucuucuauaccaggcagguacagucccauucacaguagccuggaaaacaaaacaaaaaaaaugccuugaaauaaaccuaagcaaggagugaaagagccacacggaccugcacagcggaagguucagcaggcauucgacgcuccgggcaaccagugaaauaaaacagaugugacuaugauaguguaguuuggguuuaaaaaaaggccaaaggaaaaaagaaagguuuucaaauuaugaaggauuuuagauuguaaauguguuuuguccuuagauggaagauuaaauaaaacauaaaacuuuaaaaaauaaaaauuggggggaaaagugcuaucauguagaggggccuggauaucuguguaucguuuaugacugggacaguccacuuauugacugggggacucaguuucucucugggaguccauuaggucugggacugcuaaagggguuccaagagaacacaggaagcgaagcgcucagugucugaggggcuggugucaguggccugcaggccucccugugagugaugcucucuccccagcugguauucccgauccagugguuuccucucaacaagccaagugucggggacuacuuucacaugaccuacaacaucaucacgcccuuccugcugcuaaagguacagacuggccugucucccucccauccucuccgccucccccuccccuucccucucccucucucucucacgcaugcaugcgcgcacacccgugucauaagcuguaagcugguucagugggucgggggcugccaagccugauggccugacuuuccuccccacaugacagaaaagagaaacaaugcccacagauugcccuuugaccuuuacauguguacccauauacauacgcacaagaaaucgguaaauguuucuuuaaaaaugagggcuggaaagauggcucgucuguuaagagugcugacugcucuuccagagauccugaguucaauucccagcaaccacaugguggcucauaaccaucuguaaugggaucugaugcccucuucuagugugucugaagacagcuaugguguacucauauacauaaaauaaguaaauuuuuacaaaaaauuuaaaaugaaagacauuucaaaucucuaacaguaggagauuacaguggccucaagauucaguuucugugguuuuuagaacuuccacgcucauuucauacacccugacauuuucuguuugcuagggccugccacucaaaacucagaucugugcaucaugcuagcccaccuaaggcacacauaggacacacugagguaguggaagggccaggccuggucaggacgccuaccuugaagcucugaucccgccucuaacucuuccaccucauguuccuggagaggaagugugaguucgucagacccugcuggguuuacacuccaccaugaucaguagcuaggcugcccugcuaaggaacucacaacuuccagagggacuuucuaucccguuuuuuuuucugagggaaggguuaucacacaucguaauugaggcaggggcaugccauggcccucauucuucaccucagcuuauugagcgguccccccgaacgcugccgcggucuauagucuaugucagcaucaucacuuucaucaugggagccagcauccaccuggugggagacucagucaaccaucgccugcucuucaguggguaccagcaccaccuguccgucagagagaaccccauuaucaagaaccucaagccggagacucuggugaggcugccuccccugccaguccucaugacuccuguagcccaggcugaccauagauuguauaagucggcaagggugaccuugaacuccugauucuccugucuaccuccaaauuacaagcaugcaccuaagugagggaaggcacuguugucuacugucacccaaacuaguaugcuccuaauugcaaagggacacggugucugacuggcuguggggugcacgucuauaaccccagcacucaggagacuaaggggauugcuacaaguucaagaccggccugguuuauauagcaagacccagugacuggcuccucauggcccaucugguacccuagggagggaaugagaaugguguguguggguggaggguagagaggggggcaggggugggucccagccccccucacucugccaccccugugccuucucagaucgacuccuuugagcuguuguacuacuaugacgaguaccugggccacugcauguggugagugaccggcugacugcucuagguuccauccaggguccaggcaccaagagauacuggacaaggcucccuggaucccaggucuccagcuauugaguggaacaucugggaugguauucucugcucagugaagguuuuaugagugggaccccuggucagcaugcuaggaagacccagcuacuuuccuuuggccuuaagggggccuccuagagccuccuuccuacaugaaguucccacagcggccacuagagggcagcaagcagaugcucguccucaugagccugggguuggggaggguggagccuaguccugauaaacaaacacacagagaguugugggucuggugcaggagacaguugugggcguagaaagcugagaagauccagcagggccaggucugggugccacagauuguauuccccaucuuagaacauucucccaggggaaucucucuaccaucgccacuacugcugcucucaggaaaaucucaggcaugagaggucagagucagagacacagggcucaaguaaaggguuuccucuuccuucauccuacacaagaugaacuaaagccagaggaaagaggugagagcaguuguuagcuaggaggugaugggcuagcacugcgaggcgcuucccuccacacaugcccagcacuggugucucugggucugucugagguuauaggucuucauccucuugguucagaaaggccucucuugccagcucuuccugaccuugacagauagaugacuccucccuuuggaaguagggagaggaggaacaagcugagaacucaggagagguuggggggguggacuggggauugagggucggggugucacuggacagaaaacgguugcaugugagcaggagugaugagcaagugugccugugugugccugugugcuugcgcacguguguguguguguguguguguguguguguguguuggaauagaaagggagcccuccguguggagggggagaagccauacucucggaugggauagagacugugggcugagggugagugagggccuucacagcucuccuuggcucccccagcacuguguucucucagaccucagcccugcuggguagcccaguagccaggcuaguguggcacuggacuugcugguauuugagggacauggaugggacagagccucucauccccucaucuccauguggaaugaaggacagggcgggcaccaagcccagagagggaaggcaggcaggaggugguuaccauggcgcccacuccuuccccucaguuuuaacacaggagccuuugcaugagaguuaccuuuuaguuucuguuccucccaccuugacucuuagggcagaaaaggcuggaaguagagcagugugcaugacaugccaacacggugacacacuaggaccagugggaaggugguggggacagccccuggccaggcgugugaagcuguugccucucugucacagguacauccccuucuuccucauccucuucauguacuucaguggcuguuucaccaccugcaaggcugagagccacaugccaggaccugcccugcuccugguggugcccaguggucuguacuacuggugaguggacauuggcacaugggguggacaaagggcacaagcacuaacugagccaccacaguaaaagcccacacauagaagccgggcgugguggcgcacuccuuucaucccagcacucggcaggcggauuucugaguucaaggccagcuuggucuacagaguuccaggacagccagggcuacacagagaaacccugucucgaaaaagaccagagaaagagagagagagagagcuguugcuagacaccuugagagguggggauguuuauguuguuacccucaaaagggagaaaacagccuugaaguugucauucaaaguuguugcaugauguccccaaggucccagaccuugguuguaaagcuggagucccuuaagugaacaggucggcauuagggugcccuagaggcagacagguaaccuuguagaagcuaccaagugccucugaguguucuauacgcgggguugcaacaacucuagaugucagugguccagccuucaaggggacaguaaugacaauagucuccaugucuugggauggaauccccaaacucaauugucuccagaaaccaagcuggcaagagaugaggccccagggaguaugcgaacugagaccauguguugcacgguguucucugcaaagagugcauucucuugcuccuccagagccaguuuuuaucacguggaaguguucuaaugcgguaagaaaagccagagagauggcucagcaguuaagagcagauugcucuuccagagguccugagcucaagucccagcaaccacaugguggcucacagccaucuguaaugggaucugaugccuuguucuggugugucugaagacagugacaguguauucacauauauaaaauaaauaaaucuuuaaaaaaauaaagaaaagaaaaagaaaaagagaagccagaaaccaaaguccagauauccugugauucucaguacauagccuuggaacuugcuguguagcagcagccagagaccuaccugucugccucugccuccuggacacagugcaaacccaugagccaccaugcccagcugaguauuauuauuaucuuuauuguuguuaugaaacauguuugcagcucuguauauaggucugacuauucuggaacucacucuauagaucaggcuguccucgaaguccccauguugggauuaaagucaugcacccccucaucuagcuaaccagcagaguaugauuaaaccacucaaagucagagcaguaugacgccucugggcacacucgguccacucacuaggugagauguuccgauugacugggagggcagccuaggacuugguccaggaggaugccagagaugguguugccauggcacccacuucaccuccaccccuguucucuuucuccagguaccuggucaccgagggccagaucuucauccucuucaucuucaccuucuucgccaugcuggcucucgucuugcaccagaagcgcaggcgccucuuccuggacagcaacggccucuuccucuuguauuccuucgcgcucacccucucacugguggcucuguggguggcuuggcuguggaaugacccuguacucagaaagaaguacccuggugucaucuauguuccugagcccugggccuucuacacacuccacguuagcagucaacagugaggcuuacugggggcaccaggccaugguguuuguacaugugugcauacaugcaccgugguaaugugaacuaugcacugguggcagggauggacagagugugcuguugagagacucaacuguucuggucagguucugaguuuguuuuuuucuuuucuuuuuuuccccccuuuggacuuaagauggaauuuaguuuggggaaguauaugaaggccaagaucccggccccugcccuccccuguauuucauuacuauuagaggugccugaauaacaccccuaucucucaggacugggcuggccuuauggagauaucuucuggugacaagcgggugagggcugcucagggcagaagcaggagacucugcuaccugucccugggcccuagguuucugggucacaacuucuuuugugcuuuaaacagagcaguuccaucucugggcuucuuuugcuguggugggcuccauaguuuauguggcucuggggacuggugguugcugauucccuuagggagcggcagcacggaagagugguucuuuuacugugcccccgcccccacccucagccuagggguauguuucucccagccucuuguccaacuucacaccccauuuauaugcuguugagaacccagucuccagggagccagaggcccccacucccagucucucucagcuaagcucucuaagcuggccuggguucugagcuacauggaaggcagaguucucaagcccuuguuuuauaguuucccccgaaaccccuuguaagggucugagacaauacaagucagacucuugagacagcacaucucagccugaaucucucaccaccugccuggugccuuuguucccagcaugguggcuccuccccagcccacuuccucccaggccucagauauaggucuccuuggcacaaggcgccaccaccucauuuggcagccagcacugacugaccugugcugugagucuuggagacacuccaugcauggcccugccucuuuucugcuguucucagggacuuugccucaguuuccccuugugaucuuucuguggguuagcccaugcugggguagggguggugacaggggugagaggcuuaaauaaaggcuguuuugaagcccagcau

SEQ ID NO: 5160 - RNA, 10800 nt, Mus musculus
cgcgccgucacccggagagcccggcggauccccgacucccgcccgccgcuccgcccgccgcgcaccuccgcucgccgcuugcccggcuccagccgcccgcacggugaguaccugcgaucgcgagcccacagcccccgcgccggccgccgcagcgcuucuuucguugacuucuccuuuagacucuguggcgguuguuuccuauccuaacaaacgacuccacagccucgcugccaccgcugcccaccucccgccugcuuaaccucgcuaggcucgccccucgagccacaggagcgggccaggggguccccaugccgcccugagcacugcuccuugucccugagugcggcccuucguuggugcuuucuucuuuggcccucgaaaugcuguuuccuuccuagggucccucacuucuccgggcuccaaggccaaaagcccuuugggaaaaccccuuggggacucaggagccccagcuucagguggacgcuccaggcucaggguguccucuucacucuaugcgggcccgguacauuugcccagaaaucccagaagccaucgucauuucccacagcugcgggcccccuuagccaccuccucagccugugugagagccgucccugggacaccuagcucgccuuguugaccccucagccagggaguuagcacaguaguuugcuugccuccuaaaauguuacuggggauuucagugacaagggaggaucaacuugccucaguuugacuggaagagaugaaacagauaauaaauagguugauacuugaacaagauacaagauagaugggagaaagagcggugagcuggcagcgacagacagcucagggacagauaagaucgacaaauaaguaucuaagcaaacagagggagggaaagauaccugcagaccaaagaugccagguucuuagcuuuggaauucggaucccuguuagagugaagcuaccccucugaaauggauuugcuuuuccagccaaguucggaggagggaguccuagggacuagauuggcggcaagagcgccugccgcccagcauuggguccauggagcccugagugucugaagacacgugaggugacugggcgaccuagaaggcccuaaacaucaauuccuggguccuccaccaggcuagacuguggauacagcuuccucucugccuucuccagagaucaaagcgagggaccagcagcaacuuuuuagugcuuggaguuuuacaguggcuuccaagaguggccaagauuccuucuagcccaucugagcugaugucggggcaugaaggauacucaaagaggagucacccccacaaaaggagcagcccagagccuggggagccuguguugggucugaguaagaaaagcuguguggaagaggacagaaagcucaggggcauguuuccaaagcuaaaaagugacuccagagaaacgccugugagaaccucucugucccaagcgcugacaagaggggagccggcuuuagucuggaaugcagcuaaaaaaugcagaaaaugugguuagagacugcgugaucccggccuaacugauggcuggcaagaaagcguuuuguaaacccagcuggacucuuucugcucaaggaacaccgggcucaaggagucagaagagaaguacagguuugugcaaaccgguacuguugucccuggaagccggucaccacgaagauaggugcauugggggccacccgaggucguggugcacgcgacaagcuuuggaaaggguaggguucagcaccgcgaacagcaguggccuccuccucuuccuucuauccuccuccuucaaccuccaucccucccccuucucccugcccccaccccuacauccugcaguuugugaugggcagugagugccccuccuucgccuccccaccucucccuucacugcccccgcccgcacgcgugcaugcgcgacugagcagaggggccgcuggucccugaaguccgggcuucaggacccuggcgggcagggcgagcugugagguagcugaaggcacgcaaaccugagugccggcuggaaagccuggauuuggcuauggcauugcuguguggccuugggcaagucacucuccgucucugggucccacuuccuuuccaaucugaaaacaggauugguuuccuggcagccggggcuuuccugagguuucgauuuucccuuuuccucccuuagccccccgggugcuuuuguuucagcucagaagcuggucugaauaacaaaaggggccaguccgugggacgaaugagcuugagcuccccacugccaaguaacccccucgcaccccacacguugcgccccgcugggcgggccugaaccuagguagcggcgcuaaaaaaauggcucaucugcucucugcucucucuguuucgcaggagcggcggcauggaggcucucaccacucagcuggggccgggacgcgagggcagcuccucucccaacuccaagcaagagcugcagcccuacucgggauccagcgcccuuaaacccaaccaggugggcgagacgucgcuguacgggguacccaucgugucgcuggucauugaugggcaggagcgccugugccuagcccagaucuccaacacccugcucaaaaacuacagcuacaaugagauccacaaccgccgcguggcccugggcaucacaugcgugcaaugcacgccggugcagcuggagauacugcgucgggccggggccaugcccaucuccucucgccgcugugguaugaucacaaaacgagaggccgaacgccugugcaagucguuccugggcgagcacaagccccccaaacugccugagaacuucgccuuugacguggugcacgagugcgcauggggcucucggggcagcuucaucccugcccguuacaacagcucucgugcuaagugcaucaagugcggcuacugcaguauguauuucucucccaacaaguucaucuuccauucgcaccgcacacccgacgccaaguacacucagcccgacgccgccaacuuuaacucguggcgucggcaccucaaacucagugacaagucggccaccgacgaacugagccacgcuugggaggacgucaaggcuauguuuaauggcgguacgcgcaagcggaccuucucccugcaagggggcggcggaggcggcgcuaauagcgggucugguggugcagggaagggcggcgcugguggcgguggcgguccagggugcggcucagagauggccccaggcccaccgccccacaaaagucugcgcugcggugaagacgaggcggcugggccucccgggccaccuccaccgcauccgcagcgcgcacuuggccuggcggcggcagcuaguggcccugcaggaccuggaggaccugggggcagcgcagggguucgcagcuacccggugauuccagugcccagcaaagguuuuggccucuugcaaaagcugcccccgccucuuuucccgcauccuuacgguuuccccacagcauucggccuaugucccaaaaaggacgacccaguguuggucgccggagaacccaagggaggcccuggcaccgggagcagugggggcgcuggcaccgccgcgggugcggguggcccgggagcuggccacuugcccccaggagcagggcccggcccugguggcggcacaauguucuggggacaucaaccuuccggcgcagccaaggacgcagcggcgguagcugccgcagcugccgccgccacuguauacccgacguuucccauguucuggccagcagccgggagccucccggugccuccuuacccggccgcucagagccaagcuaaggccguagcggccgcgguggcugcggcugcugcugcagcggcggcggcggcuggcgggggcgguccugagucuuuggacggugccgagccagcuaaagagggcagccucgguacggaggagcgcugcccgagcgcucuaucccgcgggccccuggacgaggacggugcggacgaggcgcugccaccgucucuggguccccugcccccuccgccaccgccaccugcucgcaaaagcuccuacgugucagccuuccgacccguaguuaaggaugcagagagcaucgcuaagcucuacggcagcgcgcgcgaggccuauggcuccggaccugcucgcgggccagugcccggcaccgggaccggagggggcuacgugagcccggacuuucugagcgagggcagcuccagcuaucauucugccucgcccgacguggacaccgcggacgaaccggagguggacguagaguccaaccgcuuccccgacgaggagggagcccaggacgacaccgagcccagggcacccagcacgggagguggcccagacggcgaccagccugcugggcccccaucuguuacauccucaggcgccgacggccccacagacucugcggauggcgauaguccucgcccucgccgccgccuugggccaccgcccgcuaucagauccgcauucggggaccugguggccgaugauguggugcggagaacugagcggaguccaccaagcggcggcuaugagcugcgagagccuugcgggccccugggaggccccggggcggccaaggugagccuggugcaccucgccgguggcgccuccucccuuacgccauucugcccucguacacagccgcugcgggccaggugugggaacugggauucuguucuguuguggcggacgagcagcaggucccagcugcucuucgcagccccagccgggggcgcgcuguggcauugggcucgcugggagggacgcagggcugagggauucggaaaauccgggggacuggccugagaaacagcgagugcgauuuuggauuuguugaugcgggaggugaggagaguugcagagacaguuaggcacccagaaagagagacaaagggucuggaggaagaaagagguagaaagaaagggccugaggaccagagaaagaagcccuggaggccaggcccaacgugugugccugcacgcguaaggaugacacccgaggaacaccauaguagcgagagaagagggcagccucuugccaagaagaaucucuagauguacuaacuagcaguuuucugagucuuuuccaacucuggccuaagaaacuacacagcucugggcuggaaaaccuaagcuugcgggcucuuugguugucagggacgcggcaggagggcaagucguguguggccagagcgaaggauuggcuguuuugaaaguagaugcgcauacuuguccauuuacgcuggguuuauuaaagcagaaaccauugcccgcgcgagaaagccauccuuuaggcuggcaacgacacagagaggaaagguagcucucaggaagugagcauagaacguggggguggcuuuggacagccgcuggcuugaaagcggcuuuguguuuuaaguaauuuguuccggaguaccaaagauuaucccaaauccacuacgguacgucaucacugcguucaggucuccagggcccaccaaccucugccacacucucguccuuccuguuggcccgcugggcaagggugucccgccuaaucgccugucauuuucggccgucgcagguguaugcgccugaaagggacgaacacgugaagaguacggcgguggcggcggcgcuggggcccgcggccucuuaccucugcaccccagagacccacgguaaugccuccugaggucucuggcccuuuuaaugcaggaaguacagagagaacccagagccaaggcaggccuuucaaggaagggaggggcggaaagagacggagagaaaaggggugauagagaaaggggaagaaaaacaauagaagaaaaagaaaacuaaguguaaacuccaaaucucaggguuuggcuacuuaaaaauaaucccaacccauccccuuucacucacacacgcacaaucuccaguacaccucaucggagauuuaaaccuuuccaaaaaccuacgccugccugacaucucuuuuacaccauuucauuuauccagaaacgugcuuagccuuaggcugguggccuuaaggggguggccgggccugauccgggcacagggugagggcuaguggcugcgcucuaggguaucccaaaaggcugcggccccaaucaagaaucaccccugcauuugcauuugggauccuguuguuagcugggaaagagcggaggugaggggugggcaacagaaaucuaagccggccugugcagccgggugcgggacaguguccuacaacaccaaugcccggaagguugucacuuggguuacgaucucugcuggaguggcgcggacaaacccggcggccacgcgcucucccggugccccaguaucugcgcacgcaauguaggucgcuugucccuggugggcucagcugcuugucuugaucuuuuccugggggccaggggcuggggcggggacguguagcccggaacggagcagaccuugugcaggggaggggguacccggcccaaagccucagggcgcgcgccugggcgcacagccgggaaccagaggcggccacgacguuuuuaauuagggcuugggcgccccaaccgaggccgcucugcaguauccgggucacgguuucuuugccucuccuugaaacucggucugccuuuuagagccggauaaggaagacaaucacucgacgacagccgacgacuuggaaaccagaaaauccuuuucagaccaaaggagugucucccagccaagcccugcaaauacagaucgaggugagccccggcaguccuggcucucaccgguagccuugagcugaggauccagcgcauccgggucaccacaggcuuggaggaagguuuuaaucacgaacaaacgaugccacugagcagauaguuaacguugugggggaggggcaggccggguuuccggacuuguuuccucucuguuggcauugagggucuucugaguacaggagguggguacuaaaaggaaaggggagaaccaccucauucaccuagaauagaucgaagggcgccuccugccaggguucagccuccugaacucacuugccuucucccaaaauuacugucuuggaagguggggaggugggaaagccacgcgucuggcguaaguccuuccuuuggcgggauucccaggagcuccccucccccuccccucugaaggcuuucccgaggacagaaucccccucuuaccugcccuugugucguaggugaggaugggcucacuuuggaugucacaggaacucaacugguggagaaagauaucgagaaccuggccagaggugagguuaaaugcgagaaauggagccaugagguacuugagauagagggacucuuaagaggagaggggcuguagucucuagugacucacuucacccagaggggguaaaaaucacccuuuggacaccuggcacaggggugcaggugagagcacccaguaaguuuauuggaaguuuggguucccaagaccugagucugucuugaaggacccggugagaaagaauuggucuugauucugggacuuguaaccagugggcaaugugggucucucaaaacccagggaaaauggagcuuuuccugaagaacaagauggcagacaggcacuuauugcagaaugcaugaaaggcuaccuuucucucugggacugaacuguucacauaauaauguaguaagguuggagcucacuugcagacuaggacacccucuccuguugcugcuuagucuuugggagauugaggggggguagcuuaaggggacagggguuuugaaccccucucuggcucagcaucuuacauuccuguguugccaaggagccuuuucauggaaggaccuagauacuacugagcuccugcuggggcagcuuguccuugcacuccccccagaacagguuucuggcggcauugaacugagcccccaccccccacccccgcaccaggguggcaaggggggggguaggagcagugaucuuccacucuuccuagccucagauugaugucacaacuucaagaccauugugcuugagagccucaguacuucuugaaauuguagacaaacuuucugugugugucucuuuacuuccuuccuuccuuccucccucccucccucccucuuucuuucuuucuuucuuucuuucuuucuuucuuucuuucuuucuuuuuuuucuggcaaggcuguucaugguuuuaucagauucucccugaauugccuuuagagcagagauuagaagucucccuugaaauagggaauggugguuguggggccauccucuaagguugagcaguuacuagaaacuuaaaaacaaauguuggggccccaguuauucccgggagccagggguucagacauguaaaauaguuugcaccuucuugaaugugaacacccuggcaccucucccaagcccccaucguccauccaaagcuuggagcucaaaugagaaagaaaagccagagcuugggacgccucgacucaggugucaggacuguuggccaggacagacccuuggccccaguggguacccuggauugcaucagucucauacuuuaccucucucccaacccuucacagaagaauugcagaaauugcuucuggagcaaauggagcuucggaagaagcuggagcgggaauuccagagucucaaagguacuuccuuccccgccccucaacagcuucccaaaccugccccaggaacugggugcgggcagcagccaccgcuugccccaggggagagaagaacuccagggcccagcguuuccagcuaggugaaggacuggaugggggugggagcaggggugaggaugggagggagcgggaaguggagccgggagaggaggcugugcuuaacagcucucacuuaaucaauuugcacagauaauuuucaggaucaaaugaagagggaauuggcuuaucgggaagaaauggugcaacagcugcaaauugucagagguaagacgcgagucaggugagcgcgcgcacggccguaacugccucugucuggcaggagccgcaauguuggcucagucauuuggauuuaaauugaagguaauuuaacaauuauuuuuuuuauuuaauauccuuuguauagucugauuagccucagaauggcaagcgagcccagcaaacggcuugcaggcaucauuacguggagugauugaacuucuuagcgcugcaauuuccacgguuucuaaauuaaaaaucgaggcguaaaauuaccugggaaguaaugccuaaguuugcuuuaauuuugguuagauccgucugccuuuaagcgccaucccaggccauuuccucccccagcuucccagccugcaguuugaaguguagguguccccuccuuaguuucuggggugguuucuguaggggagagguugugcccaggcugugaccucagccaucugccuagaggguggucucacagaacuuccaugucuuccagauaccuuguguaacgaacuggaccaggagaggaaggcccgcuaugccauccagcagaaauuaaaaggugugaacccagaaacaaagauaagagacagacagacagacagacagacagacagacugagagagagucaaggcugguuguacuauugggugggugggugaauggauggugaaugguggguggguguguagguggguguaguuauggagauguuugaaagaaaggcggccuggguccacguggaucagaagggaacuggggugaaauuuuauaacuuugauguaggacgaaaaagcccauugagcucugagcauccgaaaauuugcuuucuggccuaacccuagacugggacaauuagaccucuuugugccucgguuuccccgucuguaaaauggggcuaauggaccuaagaaauaguucugacuggccagagccucacucuugccccucuaccucccuucugcuccauugagaauuccugugcccaagggcuggauggguccagcgagggggaggggagacugguggagcuggguggggggcagggaggcaggcgaggcggccaacgagguuggugugacucucucuccagaagcucacgacgcccugcaccacuucuccugcaagaugcugacaccccggcacugcaccggcaacugcuccuucaagccuccgcugcugcccuagcgccggcuuggccgcgcccacgcgcccucaagccaugcugcuccuuucuguaaauacccgcugcaguggcggcccagagcgaggaacaagccauuaggaccugaccguuguaaauacagccgcccgcccgccgguccccagccgggcuccguuggguuucccauuguaaauacugccucgccccuccuuugaacuccagggcaucagaccucaagggguaaacuggacccaccggggaaagaaagggaagaggggagaccucuucuacgaccccucccacucgggcccgaguagggccugggaccccgaaugugaauauaacguagcaucuucgcuggcuauggccgugcacuccccguccuguccacuucugaaacucuuguuccuaacgacaacguggcuaugugcaauggagacaaacuggacugugagucucuugguucaguauuagguucacuuuauuuauacuguaaguuauuuuacuuccccugggacccuuuccaguccucguuuuacauucauuccucuuuggauuugcuuugugauuuuguuguuguugauguuguuguuguuguguaauguaacagcacuuuaaaagggcgacaacugacucacgagauggcgaccaucuugagccuauuuggggagaccuguauccgugacuuuuguuuuuaauaaaaagaaaaaaaaaucuguuacuccuugggg

SEQ ID NO: 5161 - RNA, 1791 nt, Mus musculus
uccauuuacgcuggguuuauuaaagcagaaaccauugcccgcgcgagaaagccauccuuuaggcuggcaacgacacagagaggaaagguagcucucaggaagugagcauagaacguggggguggcuuuggacagccgcuggcuugaaagcggcuuuguguuuuaaguaauuuguuccggaguaccaaagauuaucccaaauccacuacgguacgucaucacugcguucaggucuccagggcccaccaaccucugccacacucucguccuuccuguuggcccgcugggcaagggugucccgccuaaucgccugucauuuucggccgucgcagguguaugcgccugaaagggacgaacacgugaagaguacggcgguggcggcggcgcuggggcccgcggccucuuaccucugcaccccagagacccacgguaaugccuccugaggucucuggcccuuuuaaugcaggaaguacagagagaacccagagccaaggcaggccuuucaaggaagggaggggcggaaagagacggagagaaaaggggugauagagaaaggggaagaaaaacaauagaagaaaaagaaaacuaaguguaaacuccaaaucucaggguuuggcuacuuaaaaauaaucccaacccauccccuuucacucacacacgcacaaucuccaguacaccucaucggagauuuaaaccuuuccaaaaaccuacgccugccugacaucucuuuuacaccauuucauuuauccagaaacgugcuuagccuuaggcugguggccuuaaggggguggccgggccugauccgggcacagggugagggcuaguggcugcgcucuaggguaucccaaaaggcugcggccccaaucaagaaucaccccugcauuugcauuugggauccuguuguuagcugggaaagagcggaggugaggggugggcaacagaaaucuaagccggccugugcagccgggugcgggacaguguccuacaacaccaaugcccggaagguugucacuuggguuacgaucucugcuggaguggcgcggacaaacccggcggccacgcgcucucccggugccccaguaucugcgcacgcaauguaggucgcuugucccuggugggcucagcugcuugucuugaucuuuuccugggggccaggggcuggggcggggacguguagcccggaacggagcagaccuugugcaggggaggggguacccggcccaaagccucagggcgcgcgccugggcgcacagccgggaaccagaggcggccacgacguuuuuaauuagggcuugggcgccccaaccgaggccgcucugcaguauccgggucacgguuucuuugccucuccuugaaacucggucugccuuuuagagccggauaaggaagacaaucacucgacgacagccgacgacuuggaaaccagaaaauccuuuucagaccaaaggagugucucccagccaagcccugcaaauacagaucgaggugagccccggcaguccuggcucucaccgguagccuugagcugaggauccagcgcauccgggucaccacaggcuuggaggaagguuuuaaucacgaacaaacgaugccacugagcagauaguuaacguugugggggaggggcaggccggguuuccggacuuguuuccucucuguuggcauugagggucuucugaguacaggagguggguacuaaaaggaaaggggagaaccaccucauucaccuagaauagaucgaagggcgccuccugccaggguucagccuccugaacucacuugccuucuccca

SEQ ID NO: 5162 - RNA, 39621 nt, Mus musculus
ugguacggcccaaggcggaagcagcgccggcgcggaacccgcucugccgcagcgauggcugccgguguacccugcgcgcugguuaccagcugcuccgccaccuucaccggggaccggcuggugcaacgugaguaacccgacgucugagccgggcugcaaggcccaguucagagccaugggcgcagggccggcgaccucucccgggcucugcccgagcugggcccuaggcuccggcuccuccgcaggucucggcgccaggcgcuuaaccuucugccuguguaaagugaggccgguuucugaccucccgccucaggggugguggcaagcacccccuaagaugauauucaagaccccggaaauugugcucuuagacgaauguaaggcgcuggaguugcgguguuguguuuggggguuaugccccugcugcugggguagugguuccucuugugaacugaagugcucagcaaaaaaacaaaaaaacaaacaaacaaaaaaugcacgcgcguuaguguucugccaggaugauggacugaccagaacuccugugauuguggagagcuggaauuuuaauaacuguagccagauucucguggacugucucuagucuccuucuuagccauuuguugcccacuucugugucugaccuaauauccucugacuaucagguaaaguccuuuugggaauaagcaaacagacccccuagcuuccaucaacccaaaggcuaagaauuuuaucaguuggugucugaggccuacagcaagggcuuccacgaugugcuguaauccaccaaccuguuguuccccucaauguauuuuuagaacauccugauauguagcuuuguuguuccuauaagaacaccauggaauuguuauugccacguuggaacauuugacuugaggcaccccugauuccuguucccuuuucaugaucccucauauuuggcuccagaauaaacgcuuacucccuuagagaugagagcugugggcguucuugauucccuccccuugauuguguguguguguguaauguacauacaugcauacuuguguguacaugauauuuguugggugcccccucacuugcaguuacauuucuugaguucuuucugaggugaaaguuccccggaaaaaaaugaguuugagguguuacugcacccagugcuuuugcuucuggacccuaagggcuauaaaauucaggguuuuguuuuuguuuuuguuuuguuuuuuuugccuuuguugugcauacgcgaauauacguguguguguguguguguguguguguguguguguguguuuucugcuuuuuagucccacugcucugugcauacugagcguggcacucuaccucagagauaaaccccagccccaccccaaaaugagcucugaaauguaggucagagagacuagugagcuagagcugaggaggcagcucacuggccaggucuauggcucugacugugggcaagucacugaaccucugcccuucaucuuccuaucugugggcugaggauuauguuuggccacaggccagcacguggcaagcauuggauaagugguuggccuuauuauaaaagcguaucaccuguuuaacucaggcuuugcugagccuuaaagggggcacaugaagagguguccugggagaccgugggugcuggcuugcaaaugcggccgagccuguaaagcaucgugcaguuuguaauuauuuucuacaccuguugacagaauuaggcaugcugucguuccugcacggguauucuauaacuugcuuauucugaacacuuagacaguuccuugcuagggcagaagcuuaguuacaacauucauaaaugagaaccaaacucuuugccauucucuuacuuccccuaagcagugcuccccuucccccaucccccaccagggagugcuccccuucccccaccccccaccagggagugcuccccuucccccaucccccaccagggagugcucccccuucccucccaccaggucucccaucuuugccccuucuacuucauguugaauuuaguaaaauuuagcauauggagaaaaaaauguuagcugacauuuuggugguguuuuuuuugccaucuccccggggccccugcauauuuucuguauuuuauaauuauuguaauuauauaauucuacuucauauguaguuuuuagccuggugugugugugugugugugugugguguugaugauggauuccagugccuugcacguguuaagcaagugcacuacuacugagucacacccuaauccccauccugauauuuuuuuaacacuaagucaaaaaguacuuucuauuguacauccaugcagugaauauaccagaccuuucugaaggcguuuaugggucuguauuuaucugacuuucaauaaaauguauaugcauuuagaguccuauuagugauaggugaaugaucuuucaaaggcaggcucaggaauauuauauauucugauagcuauggugcucugucucccuuucauccuccaaaaaggucuugugugucuccuaggccagcucugaacuuguccaaguguugagcccgccgugccuggcccgguccuguuucucaaagaucagaacuggcaaucguggucaguuccuugaaagagcugaucgaccaccaguagccagcaaaugguggcauucuuccuuuguucuuuaauagagacuuugaacauuauuggugugugugugugugugugugugugugugugugugaaguucuacgaaacagcccauuuuguuucuguaugcagagugacuuaggaaacucuaauucuuguuaaaauuaggugccacucaucagugcuccacacgucagcaggggaagugcagaaaagccagcagaugguuuaaauaaguaaagcaggaaagagggcuggccaguucuuacaaggucauggggacggaggccucagauggcguuaaagacggacggacggaguuacacuauucagggaauggauuuaauuuggggauggaagacagagaccaccacgaugaguggcuguagucuagguaggacccggguuucugauugacugggaugugccuugaucuggaagaggaauccuguuucugucaucacucucucuguaucugaucugcuuuacugcucuugaccaacaguggaaauaucuuguaaucaaauaucaaguucuuuagaaauccacuuuaaaaaaaaaaucaguaggccuugacucuugacuguggauaaagaacccgcauggacuuugucaaaaacuucuugucacuguaagacuuacuugcaguacuccaguuagauacauacauagcuaaggggaggccuucuuggcauauauauauauauauauauauauauauauauauauauauauauauauauaaaauauauauguguguguguuuaugcauguauaugaauauauguguauauauauacaauuuuuuuuaguaaguuuuuguuuauuuguuugugagggucagaggacaccuugucggaguuagcucucucaucccaccacaugcauuccugaggcugagcuuagguuaucuggccugucugcacugucgccuucugagcucucucaccugucccacaguguaggccauuagaagcucagcaugcuggaggagcuugugcaggggacugcgugaugcgugagagugacugcgcuucaucagaguucuuucugccuggaguguguuuguggacaucauauuuucauucuagaaauguguguuaugauaaaugauuauuaaacauggagcuagugucuguucuagcuacugcuacaaaaauuaugucuuaagguacuggucccacccucaagaggaguguaguaaaaaugugugcucuaccugugagaauuagaaaauguuaagagcucacaucucauuccucugagaggaacuuagaagaacuccuagagagugguguaguugaugccaagccagcaacuguggauuagcagccuuguuucuacaucuggacaagcuuccagaacaucuguagcaaaauucuuucaauuaguaacauucagaaacuuagagauauuaugauaguaguaaaugugcacguagaacucuucccaagaguguuuuuaauagaugugugucugugugugcaugugagugcaauaccaggaaagccagaagagggcguuggauguuggaucccucagagcuagaguuacaaguaguugagagcuaccauguagguccuaagaauugaauucagaucuccuggaagaucagauagcucucuuaacuucuaauccaucuuuccaggcacccucaacuguguuuuuuaaaaauaaaauuuacuucaguucuacucacaguaggcuagggcauuuccaucuuauggugaagaaacugguuuggaaauacgagguuuaauuuacccagagugcucaggcaguaacugcugcuguguguguucauggucaagucuuagcccagagaaagguagagcugagacguuuuguuacucuacuccauaguaagcagaaaggcugcuuaagguggcugcuuugggggaugaagugguaggaagaaugaauacuuacaaaauaguuuuaaauaugcuucauuacugucugggaugguugaagauuuauugaugaauggaaaggggggaaucugccuagaaaauguauauuacauuaaaauagagcguuauuuaacaugggaaguauguguaaugcauuaaauauacauuaaaagaucauuugugcuuuaagucuaacaauuucuggguuuuucuuuuucucaguuaauuaaauuuaaggcagagacauugugugucaguucacuguauaggauuaaugugaguaggccacauaucuguucauauuaauaugacaucccguuggguugaggauucuguguaucaguaauucuuccuucuguguuugguaguguagcgcuuacugacucugaauuuccuuuuuugaacaaggucucacuguagcccuggcuggccuggaacucacugucuagacaagcuggucucaaacucgcagaguuccacccaccucuaccuccugaggcugucauuaaaggcauaugccaccaugcccagcaauuuuggcauucuuaaccuagauuauuuuauuuuuauuuuauuuuuuaauaauuaagccuaauuuugagaucucaacagacauccuacauguugacucaaacauuuguguguccuguugucuguccauccuugccacacucccaccccaccuccaggguucaggaaauugaaccaaaggccuguggaucuuacggaagccauccccugaugagcuacaagcccagggacaauuuagcuuuguguguucagaaucuagaagccuuuguucccuggucgucagguuucuaaacagugggaacaagaaagcccaauuuuuugauggacagacuuggccauggagagucucucagcaaguguuuauagcguuacuucuuggcaaaacaagaacucucgcucggcaggaucgggaguguuucuccauccacagacuccaggcuuagaagaggcuccugagucacugagaggaggcuccugauccagggcugggaugcaacugagucacaaccugugguuuuccuacagcuuccagagaggaccugaguggagccuuuggucugcucuggagccggguuucauucagcacuguuuccaggucuuuauuuucuucagcagaugaagagaugagggcagcaagaucugccacaaguccucagagcugucaccacaggcacuaagaacgguggugucccauggaauuuaggggcagaaacugguuuguuuuucaucaagauacuucuuaauacauuuaauuuuuccagcuaacauuaggacuugagauuuuuuacauuucuuacaagagagaugccauucgcuuaaggagugaaacucagggauuaaacccauuauccucagaccugaggggccucacaggcaagaacacacuguguaccagcguguaauuaaagcacagugaggcugagcuucuucaaagccacuuaccuauaaaaguuggggaccugagauuuaauccaucuuucuguuuuugcaaauuuggcaaccagaacugcacauugucaaaauggagacaggagaaauggauauuaacuuuggcaguucuuagaauacguuuauacuccugcugcaggaacuuugggaccucagugggaaauguauugagucaggcaaaugguaaaugaaaaggucucuguagguacuugcugcugcuugcuuccuuuccuguagagcagagcaucugaccuacugugagcagcuugucacacacucacguguucuauuuguugaugggggacuaaccacaaggauugccuuucuaguuaguggggaggaggugccgaguaggauuuugucagccguguugugcaggaccguuuguaacacagcacaugguguuguguccuagaagguuggagccugucuagacugagacuuugauuucugcugugucuguguaacuggauggcuuuugugcggcaugcgauggucaugugauauucacuacucuaugccuuucacccuguauagucccuucagcaauagcaacauuuagugaauaaucaaaucugauauaaaaucauuuuauaaggcuaagucugaaaguuguuggaaacuuuucuggcaagaaugacaguuuggacauggcauugugcuucaaauagaucucugcagcuuacccgagaagcaaggcugacgaagguggaggcagcccagggcagcugugaaaagcucagaaacuaccaaccagcuuuggguguaguguuccgcaaagcccugacugcuggcucugacccgccagcugaggcuucccucagcgucagccuguccaggggaggaaagcaugagccauugggucggcagcagcauagaggggcuaccagagcagggucagcucucugucugagcucuccgggaguguucauaggggaauccgcccacugaugguagccucuuuuuaguugucugacuuuaaguaaguuaacuuuacuccagaaauauuuucugauuauauuuacaugggccauccaucauaaauaccucgagcauugccccagucaccuacauuguuagcagaaugagagcauuauuucauggaauagguuuuagucagucuucucacuaaaaauacucaaggauucuuuucaggcaucuagaauuaauugucaaguguuuuuuuuuuuuuuuuuuuuuuuauggcuaguauucaaagaagcaugcaacagagugagcagacauaacaagggaagaccuuuguaccuggagugagggguucugcaagaaagaacaccggcucagucuuggaggauuuuuauucuguucaugaguagagcuggaucccucuuucagggcuccuguccucuaggccagggguucucagcauccacccuguugccauacugggcgaggccacucugucuuuuugggcugugcuguugggcaagcauucuuggccucugugcacuagaugccagugccauuuccugacuugugacaaccaacacagaaagucuccagguguccacaccagucagugguacaggaucauguccccguggagagucacugcugugguuguaauuagagcuaauuuugaauguauaaagagugacgagaagcuagaaaagggauucgccucuaaaagcacgggcugccuugcugaggaccuaggcuugguucccagcccuggccaucaggcaggucauaagcauuucacaacugccuguaacuccaguuucaggggaucuaacgccaccuucuggccuccaagggcacagcacacauauggugcacaaagaggugagcaggcacauguauauacccaugaauaaaaauaaagguguuuuaagaggaugggauucagagauguuuccuuuuucuguaaaaucuggguaggggcugucugugaaucgucuaauagucuuuguacauugcaugcaaauuuuaaggcugauggauccugcuucauucucauaaaacguauugccauauuaucuccacuuccugucagcuucuuuauauuuuuucauguuugugccauugcauugugaggucuuuuaaaggcaaacagagaccacaugugcacauaugcccaagcauuaacacacacacacacacacacacauacaauuauuuuaagaugaggccauggugaccaauuccagaugacuacugggagaaaguaaacuggaagaaaagggggaggguugaguuggauuuccucugcuucaaguuuuaaaacuuuccgcugugauauaaaaagccuacgagcaugugaaaacauggguuucuaguggccagcagagaacaggggcggccaggaggcaggaagccuuagaagggaagcggggucucugcugcuguucagcaguggccugcagcugugccacccugcugugcucgaaguccaggccucccucagcggcuccacacugcccccaaaacaaaggcgacccgugccugugugggaggcugcaugauggcuacucagggaacuccagaugggaauuugcugacauuuauuugucagaguggcgucacugcccuggcauucugguuucagcagcucggguccuuggcacacagcacugagaucuuguggugugugugugguuuucuuucucgguugaagcgucugacagcaugcaacccccagaagacauucucccucgcagaguuuuggcccagugguugugccaguugcaacaacagaggcacggugagguuucugaggccauuuuaccugcuggcuaauggacaccccgggucucacgcuuuucccaaccacaucucccuggguucuccucuuucauauggcuaucuuccccuucggcugacaucagacuccccugccuccuguaauuuuccuaauugcuuucucuucugccuccacaauggaaaagaaagcuuuugagacgucauauuuuacaagguggucaggcuagaugagaagccgucccugcgcagccugacggagacuuuccucauaagagcugcguguggcuccaaccgcaaagucaggaggagcacagagaaagcugaguugggacuuggggaauggacauuuguuaaaaauuaaauuuuauuuuuauguguaugguguucuacaucuaugcaccacauuugugccuggugccuauggagaccaaaagagagcaucagaccucauggaacugacguuacacguaauugugagccaucgugugaguguuaggaauuguccuuucgaacaauuaacagguuaucuuaaccacuaagccaucacucuacgccaugggaaugaacauccaucucgagccuccccuguguuccaucccugcaccuucuuacacauuucagucuugaagccacaacaggaguuuugucucuauuugaggugcacucuggccagccucuggauagcccucacgugcagggcuguaguggcucauuuccaguggucuccucugcuugcuuggugcuggcugcacaaagggaaggaagaggcaccuuggggucagcuggaaagaggaacccgugaccaacuguuguagccugagugggagacacugaugccugccgggaaggcaguuucaguuuguaggauaaaaacugaguuaaggauguggcucaguugguaaaguccuucucuagcuugacuaggcccuggguuccaccccuagcaccucacaacgcugauguaugccacauccuguaaucccagcaccuaggagguggaggcaggaggaucagacacucaggaaacuacauucucagaacagugcuggucucuggaaggauuguccugauuugccuuggcaagugucaccucucuaaagccauggaaaguacgaucuggccaugaaaucuguugguguuaaguaagugcucuuaccacuaccacuacagacacauggguaaugccagguacagcagcacucuguuaccauuggaacgcugcugcugcuacuguuguuuugggcugaaaugucuaaguaaaaggaggucagguguuuucguguacgugaguguguguguguguaaacgguuugugugguguuuagagaaugcuuccuaaugagugccaagaggcucacucaccucucacugauucugaagugcaccuugcuaccuccucuuuccucugauggcuugccagauuggccugcuguccuaggugagggcacaaagcccaugcagaagauagaugacaaauguugggucacuccacugacugucgugcgugcaaccucugucacauagcuuuaaucuuucuuuuaaacaccaguggggcuguaggggaaauaagcucucaaagugagaaaauaagugggggugagggguagcuggagacucccuggcugcagaagaaccgguucucaaguagggacugcuguuuguacuuacgcuucuaacugggugggggugagggugggagguggauuugcugcgggaccuagagugacauguuaacuuuuuacacuacaaugaacuauuuuaaggugugaauccaaguguguaauaacagaccuaguaaucaaucaccuacuguuugucucuuaaaaaguuagguauuacagcuccaccaggcggcugccagcagaguggauaagagcuggagggcuggaaggcagagcugcucugggaauuucuuuguacacagaagagcugagggcguccacauucaggauaaugacaggcaaagaagggggaguguuucgggccgugcaagcauaagcaggcucucauaccacagcacuccucaaaugccgugagcaauuugugaaugguuucacuguccugcugguucaagggguggcggugguccccucguucugcuguuccuguucaguccuggggagacaguggcucuuuaaguccaagggugugcuuuggcuugugguuauaccccaggguggugagacugagcccaggucacagugccagcaucucagggaagcaggaaaagaugcacuaagcuggcuuuagcuggcuuuagcuuuaggcucugcuccacacguggucucccuucucuacacuguauugacaguaggaacuggaauaaggcagucuucauccuucuccuacuucuuacuuggcacagauaugauagcaaaguucauacccagccucacugagcaaucuuauuagauaacacaugccaagccagaaaugugcugcugaguagacugggcucugcaguuguuugaggaaguucaaagaguaaaacaaaacagaacccaggcagcuacuaaaucaccagaaacuaaaauucaguuugguuuuugguucuauucccaucugaguguaacacaaaaagaaauaaauaugccaccccaucucccguuuguuuuuguuuauuuacuuaucuuaaaaagcuuuauuaacauacaaucugugcagcauacaguuugcccaacuaaaguguaccauccggugcuucuuagugugugcaaccccuuagcagauccagauguucacgguugcaguuagcauguacuugcaauuuaauugauuguauuuugucauugaagacaccgauuuggaaaaaccauaaccccaaauugauuccagcuuuuaaguacaggacucaggaaauagcagcaagccauggggcuuaguccauuugguuucuucuucgccucuuaaaaauacugcuguuaguuuuccuuccucuuuaaaaaacagccaguucguuauuuuaaauuagccaagaaugagggcucauuucauguuggcuccuccuacccuucccaagcccgucuguguuuugugaccucaccuggcuugggcugccuuccucccagugcuacggacaagauggggucugugcuggcugggugauucaaggcuacuguuagcuuggagcauuaguucagacugugagguggacuuuggucuaggaauugguuuuauuguuugcuuauuuucucugugagaaauugaugugaagacaaagccuuagauuuuaauagcuccucuguccugcugcgcgcccaccugggcugucauggugugaggaacauuguauguagcuggcugcuauggaguuagcacuaaauaaagcguuguaacugaaaguggaagugaggcaggauugccaauuuguuaaagaggucaaaggucaguuucagacaugggcacagaucuguuccuuuaagagaaaugacugacgcuugggcaaaaauguaaggcagggguuggagagauggcucaguauguaaaguucuugcuggacauacaaggauuucaaagaccagcacccacugcuggguguggccacacaagagggaggcauggcuuuaggcaugguugcaggugcacucauaaccucaggagagucacaggggccuccuggacaccagcauagccagcugaagguuugaugagagacgcugucucaagggaauaagguggagagcgguagguguccucuccagccucuguguguauauacagugugcaagcugcacacccuagugcacauagaacacacucauucuucaccucugaauaaggugaaggugguggggauggugugggguaggggagcuuggcugggaaccuuuucagucaccucucccgguuguaaauguguggugcagggaccagcguguuccuacggcucugugaccauaguucuguguguucugugaccauaguucuguguguuguaaauguguggugcagggaccagcauguuccuacggcucuguggccauaguucuguguguucugugaccauaguucuguguguuguaaaugugugguacagggaccagcauguuccuacggcucuguggccauaguucuguguguucugugaccauaguucuguguguuguaaauguguggugcagggaccagcguguuccuacggcucuguggccauaguucuguguguucugugaccauaguucuguguguuguaaauguguggugcagggaccagcauguuccuauggcucugugaccauaguucuguguguucugugaccauaguucuguguguuguaaauguguggugcagggaccagcauguuccuauggcucuguggccauaguucuguguguucuguggccauaguucuguguguuguaaauguguggugcagggaccagcauguuccuaugucucuguggccauaguucuguguguucugugaccauaguucuguguguuguaaauguguggugcagggaccagcguguuccuacggcucugugaccacaguucuguguguucgcccaucagugauucauguucugcagugaaauuuuccuaccugcacagcacauaaauuuuugaaagauuuaguuauaauggaaaacauuuaauuugcuuugauacguuuuuaaauuugccaguggugucucugucaaauaaggauuugggugguuuucaaagaccgaacaagaauggauauaaauagaauuggggccauuuaucaguaucuauuauuuuguuucauuaacugaauuaaugucuaagcauuuagcccaaggaauauaugcagcucuauuuuauuaaugacuuagccuuaauccgcucauccucuuagcgugcaguaagugcaaagugguuaggaauuucugcagucaucuacuucccauggaggacuuacauaauaaaauuaauauacccucauucuuucuuuucucuuugcucuuuccuggguauuuaucaagguagcuuccacuccccucccacccccacuacugucuaaucuagagcuaaugaauuuuguguagcccaguguuaacagcacuugacaaguacuggaagggccugcagaauugcaaaacagaaaaaagaaggaaagccagugauuuaaauaaggucaccauugccuuuguaauaaucauuagagaagaaacucucccaguaauuguggggcucuuuagauccauuguagacggggaagcagccgaggcccugggucaucuggcccugggucgucucauuaaauaaacuggccaguguaucggguucugugccuuccauggagucacuguguugucuauuuagauauccuugggacagaagaugcuguuguggaagcaacuuccagcgaugcugugagguuuuaccccuggaccaucgauaacaaguacuauuccgcagagaucaaccugugcguggugccaagcaaguuccuggucacugcugagauugccgagucaguccaggcguuuguaguuuacuuugacagcacacagguaagcucugugaugccuucagucagacauugucauagcuuucugcuucuccucuguguucucugaguuccucagugugucucuuuauuuuuguucauuuccaccccauagaaaucaggucuugacagcgucuccucguggcucccucuggcagaagcauggcuagcugaggugaugauccuggucugugauagagugugugacgauggugagaccuuccugcagaucuguuuuaagguuuauuuacuuuguguguaugcggacaccguugcugucuucaggacacaccagaagagggccucggaucccauuacagaugguugugagccaccauguggucgcugggaauugaacucaggaccucuggaagaacagucucucuggcccaaucuuccugcagauuuaccuuuccaugaagauggguccauccaugugcucugcucaccguuacucucugauacucccacaguggccacguuaguuguuuucagcauacuuugaggcugcggucauuuucguucuguagcuuuauuuuagaugccuuuacaaugccauugacauucgggggaaacguugaggucugaguguguugaaggucaguuacuuaacauucuuuuguguguuguuuuaggaauaaaccgacaacaggcucaagaguggugcaucaaacauggcuuugaguugguggaacucaacccagaggagcugcccgaggaggacggugaguguacugucuggagagagcagaacauuggcuugacgucuaagauuguggucuaaccuagggugaucacagcaagagccuacaaauacuaauuuucuccggcaguuugaaaagcuuugagcaggacccauugcuaugcugugacccucccagcucugccauagguuuuuuguuuguuuguuuguuuguuuguuuguuuugcuuugguuuuuuuuuuuguuuuguuuuuuguuuuuuuuuucgagacaggguuucucuguauagcccuggcuguccuggaacuguaggcuaggcuggccucgaacucagaaaucugccugucucugccucccgagugcugggauuaaaggcgugcaccaccacugccuggcagcucugccauaguuuguucgauggauuccauggcccauuuuagaacuuuugaaaaugcaggugugugcuuaaauaaaugaaaguaagaggucacugcugaaaaccauugucaccucccuguuuucucuacugccagccaaggaugaugaggccuguguguguguguggaguuuauguuccucuuuuuaaauucauagcgagcuaaggcugaauuucuagaaaucucugggagcaugccagaccuuuugacacccaagccaaaaauaaacccagagccucccacaccccucccccagggccucccacaccccucccccagggccucccacaccccucccccagggccucccacaccccucccccaggacagguguguguugccugucuucuguuccacagcuaucuggaccuugcguuucuuuccuuucuugguaagauguauuuuuuauuuuguguguuugaauguuaggcuguauguaugugcaugugccugugccuaaggaggcuggaaaagggagucagacccccuagaacugggucacagaugguugugagcuaccauguugauaauggaaaucauacuccaguccuuugaaggagccaucuuuccagcccaucuugucuuuggggggagggucuauuaaaaaaaaagcguuauuuuaaaaauucuauguauauguauguauauguauaugaaugcauauacuuaucuguagguaccuccaaggccagaagagggcauccauccucuugaacugcagugaaccaccuaacauagguuugggaauuaaaccucugcgaaagcagcaagcccucuuaaccacugagccaucucuccagccccaagauuaguggguuuugugcuauccugugguuguuuaauaagaacuugcauuuucuggagauuaugaguagauuccaugggcaaagugauggagauagcuugaucacacuacucccuucuguccugacuguuuuuaaucgggaucucugagcccuguguuugcuuuuuuccuuuauugcuauacauaguacaugaugaagcgacagcuaaacaaacaagauaauuaaaccaaguuacuugaaaguguaguuucagguacaaauagacauauauaugaauguguagguauaucuaggugcguauauagaucuauguguuucuuuucccacagaugacuucccugaaucuacagguguaaagcggauuguacaagcauugaaugccaaugucugguccaaugucgugaugaagaguggugaguaacgagacaauguuaccuuuuuuuuuuuaagauuuauuuauuuauuauauguaaguacacuguagcugucuucagaugcaccagaagagggcaucagaucucauuacagaugguugugagccaucaugugguugcuggaauuugaacucaugaccuucggaagagcagucagugcucuuaaccacugagccaucucuccagcccuuacuauuauuauuauuauuauauguuuuaaguacacuguagcugucuucagacacuccggaagaggguguccgaucuccuuauggaugguugugagccaccaugugguugcugggauuugaacucaggaccuuuggaagaguaguuagugcucuuaacugcugaaccaucucuccagcccgacagcguuaccuuuacccugugacauguuuuaaauuaucuggauauauguggagccauuaguagacuauggaauuuuuguuccaacucucaaaucuucaguugaaggaagagccagauguugggauguuuaguguguauugaguagguaauucagcgaauaugugaauuuuacaguaggccucacauugucuuuggcuuuaagaggaccuaaaauuuuuuuaaagaauuuuugcauauucaauuggguccuuucuuuaagauuuauuuauuuuuuuauuuauuggaguacacuaccgcuaucuucagauacacacuagaagagugcaucagaucccauuacacaugguugugagcuaccauaugugaacucaaccucuggcagagcagucagugcucuuaaccacugagccaucucuccagccccagaauuuuaagauaugagcuuuauaauuaaagggcuugcuauucuagcugugggauucuuuguagcacucucugucuuugcccuuucugggcucuuuaugugagugggguuuguguguacuuugagaugccagcaaggugguguaaugaacacggucacauaugcagcuguugcauuaguccugauguagagagagcuuccaagagaguauggguucuuguaccauucauucuucaugggauggucagcauugaaaagggagaaugcguagcuggaggaggcauggcuccaagagcaagggauuuauguuacacagccccuaggcgagucucccauagcccgggagcucccauagguuucagaacaccaggcaggagaugugggcucucugauguagcaaacaagugaugagacccuggaggugggaucuccaccaguuggcauuaggguggagugugggaggcagagguggagccccaggucagagagaccugagcugcugcagcagccugagggggacuguugggccuugcuggaugugauugcggugacugagguggaaggcuaggucugacauguagacuguaguuggcugacacuggcucuuggaaccugcauuagcuugcucaguguucgggaauaagcugaugguuuagaacuguggggauuuaugaccucacuguuuuagaaaaaggucagaguccuacccuuggggugccagggucaccucccuccagagaugcuagagaaggauugcccagccuugguucugacaucugcaguuccuugacugagacacuguuacuucuagucuuuccauuguuucucccuguacacaugucuuuguucauaucuccuguccuauaaggccaggacauuaaaguaacauuaaauuagggcccauccuauggccacaugacccguauucauuucccuguuuccagauaaugguacauuucacuguauuagagguuaggacuuagcuucaaggucuggggacugcacuucagucaagagugucgugccugagcaagugugcugugguaggugaagcacugcagaagggaauaaaggaagccuguguuuuacagucggccuagccugucuucccugagggaaagggaagucguggguggccagcuugggaggugcugagggcuucaucccagguguugcuaggaugcuugguacccugaccgcucaucuaacccuugugcuuggcaaagccccuuuuuguacaagaaggaaguuuccccuccuuccuuccccuuucuccuucgucuuccccacguucaugucagggagagucugcucaucugauggauccuuuccauucauccacgcucauccauuccuucaucacuucuccguugagcauuugucagacuguguacaauguaaaacuaaguuuaagauaugguccauaaacucgaucuauuuagaauaaaguucuguucaguacugccuguuauacauuucuugaaauagcuagaaauucagugaagcuuuuuuggcuuuaaucuuuuuuuuuuuuuuuaaaacucugacccccauuucauauguuaaagaaacgauggcuuauaauucacauuuauagcugugcagccucccagugaaguuacggucucccguguccuugaguuaacaaaacggcacauuggaaaugguuagaaggaauguguccaucugaauguauguguauucagugcacacacacacauaccauauacucuuuuucuugucacuguucccuaaaccacuguaagagggaccccuuagcaguuucacuguguuagcuguugcauguaauguaaagaggauaaggucuccgggaggggugccuagcuuaugacaauuauguaacaaagcagggacugguuggguaguugggagguccugggcgugugugaauuuacagacugagcauacuuugcuucugcacagguugguuuucugucaacucuaagcuaaaagaaaccuuuuccucuccagaguugacuuaguccugacguuugucacagcaaugcagagcaaacuaggacuacaucuucaugcagacguauuucugcauccuguguguucagucaguggagcgguguucuuuacgugugaggcagaggcacaugcagauuuguguggcucuuuaccaucgucucguuuucucugcaguccugggacacugcugugcuuccagcuaaaacccaagauuucggcauuaguuuacuuucguguuaagaggaccgaggucuguguugcaaacaaaauaaccaccuccuccuaggagaagcaagcgauauagccagggaugugcaggucuuaagaaguaggacaucuugcagaguuucaagucugucccuacagagacagagcucugugugacugugugcugggccaucagguccuuccagggcagccugcuuccucugcgcccugagaaccugcagcuucucugcugugcacgccagcaagcuacaucuuccucagcagcugccgccuccucccuuccucuucuguuuuauuucuauuguguguaugugcagguguguagaugcguauauggaggugggauauagauauaugaagaggucaagggucgaccuuggcuguuguuccucagagccaucaccuuguaucuugagacaguuucucacuggaccccgaggccuugcugauuaggcucugcugacaagcacaugccuucacaccugccuuuuuacuugggugugaggagacacucggggccuucuauuugcacugcagccacucaaauggcuaagcugucuacccagucacacaguaggcuuucugaaagccuaaaauuaggcauaagagaaggguccauccaugguccauuaugggugggagaggcguucaugaagccucaccuaccuuaggagcuauuggcaguuaaugguugcugggaagcgggagucauuuucuucugugauauaacugcuauuaaaguugcccaguaaguaaccuuccacccaugcuuaugcaugcagcccuaauuaaacucugugagucagaaaagaagccacagaauaacaacaaaaccccaaaucagccaugaaaaugggauagagacugucuggaagaagguuggcucagugagagugggaagggcugagaaaggguaauggggagggggaugagagugaccgaauugcaugacaaauacauuacaugcacauaggaacucauccgaaagcaacagcagugaacaaguuauguuuaaagcuaccaugcacucagguucuugcacugcuagguguguucagucaaaaaagcauguccgugcauggcauccuuauaaaugcucaagcaguguugugcacgauagcccauggaugagagcaacuccagaaccagugggcaucucauucagcagacugggugacucugcucuaaacaaguaugugcaagcucugccagggcgaacccaccaugccaccgcuuugcccagagcuuuugugucauugugcuuuguggagauaucuagaacaauucaauccauagcggcagaguauggauuagugguccccggggcugauggagagguugcuaaggagauggaauuuccucaucagaacaugaaaagcguguuuuugacuuagugcugaucauugcagaguuuugugacuauacuaaaagcacugaauucuauacguaaaagggguggcuuugauaugugacuggcauuucucauauccuugaguuagauuauguucguuauccgauuuaauuucacagcauccaauaaguguuaggugcagagguuaaaugacuuugccugaggcacagaggucaagaagugucacacucauuaccaggcuggcgacaugcaauccccagggaacuuaguaaguaguagugcucuggucauccgcccccagacauucugacugguuuguggugacgcucagcuucccagaacccuguaugcuuugaacucggugcauucaacucguuauguuuauaaauuacuaaaccguguacgugggaugggguacaugugugugcagugccuguggaguccugaagagggcguuggaugcccuggaauuuggaguuaugggcaguugugaguugccugacccggguucugggaaccaaacuccucagggcccucugaaagagaagcgcacgcuuuuaaacaccacacugucucucuagccuugggcuauauuuuugaccuguaugaugaaguuggucuucaucagccacuuccaguccuggcugcacauugggaacuuuugaaaccggugcugucugggccaaucuacuaguggguggcagcugcaguguuaggagcugcagggacucgcuuguaggcauggugagacgugcuggcacaaaguagucaucuaguuuugacuugugccagugugcuugaucggggagagugaauugagcauuuugaaagcugcauuggccuccgauucuauagucaccaagagccuguauuuucucauuccugaauccugacuuccaaaagccacaggaagaaagacaagacaggaccaguauuaguucaccuuaggagaggugaaggcagggugugugccccuucuuccuccuccauaccugugacuuguguuauuagcacaacacaaaggucaccugugcuccuuggcaucugccaucauauaagaguguugucagacccugugcacuuggccauuuggaggccacugcuggccuccagucucuccuugguguagacuuuagguucuagucugaaguucauucaggcacuaauugcugagcacacacuguguucgggggcccgugcuugguuuacacuguugaauagucagugucugcacuuacgggcucccugugggaacaauauucacuaggcaacaggacaccagugaguuauguagagugcuacaaggugagggguggugggaaaguaaaccggagagggcacuguggcuugggguagauugcaguauaaauaggguagucagcuuagaucccuuggcagguagagauuuagaccugggagaagagcaucuugacagggcaugcaguaaggugagagcacccuggcauuugaaggauagcuaggugcucccuaugacuacagaggagaagagaugggcgaaagauagaacacuuggauauuuagggcucugcaagacaucuugauagcuuuggcauccacucagguaaaacuaagcacuuugccaaggcuuugaauagaagagauggcaugauauaacugagagaggacugacugcugugugauggagaagaacaggagaagaaaccaaucuuccaggugagagaaaggcgacuguaggcguaccucaacugagugauucuuaguggaggcccaggagggccagaagaaucuguaucaggcacuacacucaccucuggggggaugcugagugggucggggaugccucucucaacugcccugggcaggaaacucugaagagcuucuggacuugccuguuaaauagugcaggaauagcaccauggcaucugugccagauggucacccacccuuucugacugagugcuuuuaaguaacagcucagagcugugugcaauuaaucgcauaaagaaaucaaaggccucggcagauagagcuggucuucugggcaaagcuguuucuuuuacuuugugcuauaauucugaaaacagugcuaagacauuuuucucuguccgugaugugcgcucccacgugucuacuccaguaccagcuuuccuaguguaccugugaggugaagaaaagucucguggaaguugugugcugggugugguggcccaugccuguaagcacaacacuugagacugaagcaggaagucccugaauuugagaucaaccugacuguauaaugagauccugccucagagaacuggacaaaauuugguucaggguaacugaaugaucagugaaaugggaagaaugguggcugucuagcguaaagagaggagauugcauuggcuacacauacauguaugcaugugcacauguguguguaaacauguaguuuguuaaaaacucauauagaguuaagcacaagguuaagagaaagaugcuuaggaagaaagcaagaugcacccaagagcaugguguguggguuuguuaaagaaaaauuauaaugaccuuguaggguuacuguugggcucuuuugcugcauaugaauauguagucacaguugcaggaagggagggggcuuauguacuuguguguguuuguagagguccaggguugacaucagucacucuccacuuaguauuuugaggcaagguaucucacugaacauuuuggcugcuuuggguagccagcucucucagggcaucccugucucugccucccacaugcugagcuuacagaugggucaccauaccuaccuagcauugaacuccucugguccuugcacuuuuguggcaagaacuuuacccugcugagccaucuccucaguuccuguccuuguguuuuauaggauguaagggacauugcuuucuuugacacaauuguguguauguauuagccugagcaaaacauuaguaucuccauguaugcauuugcuacggcuucuuucuuuuacaggaaaaggagggauuggggaggugacuuguccauacacaaagcaaguuagcuaaggggguacaggaccacaggucuccugagcaggaguguugcuuccauuguacugcggaugcuuagcgcaguaguuaugagugcaugagagagcugaccacacagagagggaguggcccugucugcaggcauccacuggugucucaaccuaggugcucuguugugagcaagacuugaaugaaacugacuggagguaaugauuauagcugagguuugagguuucucuugcuuauuguuuuuaaauccuuuuauauuaucugaauagcaugaaguuaguucuaacgcauugucccugaacuuaauccaaagaagguccagcuaagcuuccugcuagcuaaugcaacaaacagugaugaguuacuugugggugggagcaguguguuuucuuuauucuacuugaagucaggguggauuagcauucucuucaguuugaauuaugacuggcuauacaccguagguacucauaccaguuuuaaaagcaaacauuaauuuauauaguuguagacaaaucauuguuuugucccucuuugcuuauuaggggaauauguccugagaaagaaaucaucagaugaagcuaucauuguaugaacauugugagaugugcucauacagacccagaggguauaggucagucaccugaugcagccuuccuguguagucacagaacacaggaggcaggaguaggaggcugcugugaguaguucuggaauauauuuucucuuguaaguagagauaacuauaaaaaccacaguauaaguguguaaaccagcaucauuuauuaucauuuucaaguagugugugcagugcacacuuguggguggucccgugaugggugugcagugggccuguuuaugcugggggucaccauggcuuugcuguagcacauuaaggcaguagcaggcagcaggcuucuucagcccugucuuaggcacugcucuguugcugugacgugaugccaugacccagcaacucuuauaaaacaaagcauuuaacuggggcuggcuuacagucucagagguuugguccauuacgaucauggcaggaaacauggcggcaugcaggccaacgcugagcaguagcugagaacuacacuguagacagagagaaagacacugggccugucugggcuuuucaagccucaaagcccauucccaguggcacacuucauccaaauccuuuucgucuuuucagauagugucacucacuggugccuaagcagucaaacgugagcccaugggagccauuccuguuaaaaccaccacgagcuucuuagguuuuuuagaccacugaugcguacuguguugcaagcuaugguuggcccaaauguuaugcaguauaugaccaugcuagaaggauaugcagaucuuccugacaaagacuugugugcugacuuacaauggaguuucugcuguuggcacugucagugucguguuucauccgaugaaacauucucagugaauguugaugcuugggagacaaacgaauuucuacuuuucuauguuuaaggcccagcuccacacagcaccugaccaggggcagcauuaucuguggcguugaacugcaccugggagaaaacagugccuaaaauaucccuggugcccagagcuaccagggaaauggcugaaagucccagacaccauuguguggggaaggucagacuuuccgggacccauaguuuccauucugcauuaaagaucucaccacaaauggucuaggaaaugaggugggugggacccauacucacauuggggcaccuuuggggcugucuagccucuucaguuugcuuacccuuccuuugcuguuaugccuuaacuuugcucagucugagcucaggcugcaacucaaggaaaguauguaaauggcaucucagccccuugcucuguuccccaagcucccaccagagucuggucuguggcuugaaaaccaaccaauagggucugauauuuauaguuugguaauaucccuuacuuaucacugccaugaaaguagauaugugacauguuuuaaguucccauccccuccccuuugagguucccaauagugucucucauuugguccaucagaaugccauauuguaaaguacuuggcuugaggcagggccuugaacuuggguaguaccuuuaagagcuggguagagucuggagcacuguguuuuaguucaaccuuuuugagaccuaugcaucauggaagaagguaguauacacaacaccuuugcuaggugucgauuuuauguuacauaguguuccugucccugguuucauaaacuggacacuagcaaguucuguggaggguuuuuucugcacugguggcuucuggguauuacaucagauagcacugugguaaaugaagagggagggguaaccagggaaggggcugguagacucacaaaugcuaaaggguugcuacuccaccccgagugagcagagcuuccauaguggguagaagcaacucuuccacacagcagucuuccauuuucccauuacaaacgagaugaauugagaaucugugaagcaucaccuaaaugaucaucuauugccccugcauguccugaguaaaugauugcaugguggaaguuccagaucccagaucaagcuggccuuuguaauugauggaaagaacagaaaaaagaaaugagugcccacuuacaaggucuguuuucauggcugccugagauguucaccugagaaaguagauaucuuaugccuuucacuuuuaaaacguuauaucagcaucagcaucaucaccgccaccaccaucaccaccaccaccaccauccuugucaucaucuacuuagcucaagcuggcugugaacuugaugcucuugccucaguaacccaagcgcuaggauuucaggccugugucaccacauccagcucuguauacacuuuuaagaagugaaaaaugauuaaauaaaaauuugaaccuaaugucacagaaaaauaaagcaucaaauuagugagaggacgacuggucagugaagaggguucuagacagccugccuauaccugugugacuuugggagcucggcuuuaugucucuggaccccagugucuaguuucaggggcagcauccacuguaaugaauggcauuuaaucccauaaagcugugcuggaguccaacuuuuaaacuuuacauucaggaaccccaaggcaugaccugagcacucagacuguccccucccuaugauggcauugacuacuccaugugaauuaaggcuuaaugagugaaaggaguguuagcagagaggauuguaggaaauuaguuaggguaggaagaaaugaugugccuuucagguacggccuccaggagugucacacacaaagcacugguagguguucucuuucagguacccugguggccauguugcugaccacccugcucucccaccaucaucguuuccaaaguugguuacauacugcgucaggaaccaccuccuuggagucuucacuaccgcugucccccacaguggggucucaguggcuggucuugguggccagcacccuuugaagguuuuucuggcacugcacuccagguugaggaggugggacccacacacaguagggccuuccuugcggcuugugcagagcucuucccuuaugauggugcucauucccaaguuuaguugagucuucaggcuguguuugugcaaaaggagaagggugcucacccagcucccacucacuagugcccuugccgcuguccuuuccucaugcuucauucucugcagcgaacguagagaguggggaaagugaggccuuacuccuuucucaggaauggcucuugacuuagaacagcuccccuguguccuggcagccagagagcagagguacagguccagacucuaccacaagccaaaccacugaagggcuaugugcaagcgagcccuaaguaagcguugcuuuaaugauguacucaaaauuucagcaguuguucagagagagaauaaauaggguuuuaugauuuuaugguuuguuugguuuggguuuuuguuuuuuuuuaacaugcaggguuguuucgcuuacguguaugccugcaucauguggguccagugcucacagaggcuagaagacagcaucagauccccugggacaggacuuuaaaaugguugcgagcugccacugggugcugggaauugaacccugguucucuagaagaacagccagugcucuaacugaaccaucucucuagucuccugugguguugggguguuuguuuguuuguuuguuuuuaguuguuuuuuuuuuucuaaacucaccaggaggaaauagaauaugcuauaaaaacauagacucuuuuucucgguccuggugucagcauuugugaccuuucuuaaagguuguauaacccagaugguauggcauggccuaagaauaucacuaaacagugggugugaugucuccaugagcuucggagugcuuggcugugguuagaaugaguggcccugguuaucacagcauguaaauggagaagacuagcuucccugaaaggaaggcuucauacagaguggggaaggacauaagaacaccgugacgggcuggagagauggcucagcgguuaagagcgccgacugcucuucugaaggucgugaguucaaaucccagcaaccacaugauggcucacagccauccguaaugagaucugaugcccucuucuggggugucugaggacagcuacaguguacuuacauauaauaaauaaauaaaucuuaaaaaaaaagaacacugugacguacagagcgugcuugagcuuauuccggugaggccucguaguugcugcuuuucagaaguaaaacugaaaagugaacgcaacguguuuagcaggccacauagguuccggccuguggccaaggacauucuuaacauuugacaaaucugugcaaauaacaaacacugcuggguugggguuuuuuuauuuuuauuuuuugauuuuugguuuuuuuguuuuuauggcaucauugucucccaucuguaauucacuggaccacuggaauggagccggauguuuuggggacaaauuuaauacagagugguuccucuuuaucuguggugugguuaccugcagucaacaaacuaccgcacaaguuuuagaaauaaauaacucccguuuucaacuugagugcuuuucuuagugacaagguaguguaguguaccauuccugccugagcagguggguugaccucgugaguagcccaccccacacguugccaccugcccagaaggcaaccaguggccaucuugacugucauuugacugcugagauaguucagugccuguguucacaugaucccuacuuugauaauaauggcuucagagacagugcuaaugaugcugguugucuaggcaacugggaugaacugaaaagaagccauccaaaacuuacuagguuaucuccucccacggccacgugaggaguaaguucgguacauggacaugucugcagagaggucagcugucccacagagcucuguuuagagguggguuuaauuuuucuuucuuccuuaauuuuuucuguguauacuugguccuuaguguguguguggcacugugggccugcagugcccacagcagccagaagagguuaccagauucccugaagcuggaguuauagaagguuguaagccaccaugcaauugcuggaaaccaaccguauggacagccaguacucucaacugcugagccaucucuccagucacuagaaaacuucuauuacuguauucugcuuuaaauacuuguuuuauugugguuauugucuuaacugugucuaacuuaaaaauuaaaccucaucauaaacauguaauaugggcugaaagcccuugacccaaaugcuuaggacuaaguuucucagguuuuuagacuuucugcauuuuggaauacuuacacacauguaugcaggacauacguccugcuuguuugagucuucugugcacucaugcaugcagccuggagguaauuuggaacagugccuuuguuuugguggcauagacguucccacucaggcaucaugguggugccagaaaguugaggguuuuggagcauuuuggguucugaguuaggucuguuuaacuuguuuagggaaaaacaguaagagggugguuuggguauaaccacaguagugcgggcccgggugugccgggccuucacugggagcagugacugcucuucuuaugcuuccugacuaauuucuuugucaugaugacuuggccccuccugcaucuccgaaguuguagaagaguucgcugcugcguaagagccuggguuuguuccuuccuagucuaguguaugguuucaaaggaccgucucaguaggaguagcguccccaugccagagccugggaggcugggggcugagggcgagagagauuuacauaauucuuuuccaggauaguggcgugcaguuggugcccgugggcagagcugugaagaacacugaaccagaagacccaguguauaaaauaccagccaagccuuuugagcaacacuccgugcaggccgucugcuuugaauaaacaaaaguggauucuuuucucaauuguauaaauguaugcgccucugacuuccuuaaaacauaagcagaggaacauaaugaacccucugaugagcggacugaauccgcccaccauuguuccucagaaagcacugagcacagcgcccuccagcuuauucuaaacucguggcucaucgugaacuuuuuaggguuuuaaaauuuaaggauuuuauauauauauauauaagaaaaaagugcucgaacacagcaaauuccaagaugcgugaggagaggaggcugagagucucuucucagccauggcuucugggucagagaucucgugcucaguggccauuggugcacagagcagcagacugagcucagcccugcgagguugguuugucugaggucaugcagguggguggggccgugagagaaaacuaggguuggucccaagcugucucuuccugcuacucuuuuucuaacaauuuuaccuauuagcauuagagcauuaaucauuauucugcugauguuaauauuguggcuaaauguacauagcauaaaauaauaauuuuuuaaaauggauggucauagaaaaaauaaaggugccuaaggguuuauaguguguuguaggguugcaugccucucugccuggcucugugaucacugaggucauaugcccuaccagccugccaaguucagggaaugcuaaccuauagaacugggauuugcaguacuuaugaauuaguugaaaugacccagacuccaaguuguuuccaguaauagaagggaggcacuuguguugacugugcagucugccuuucauuccagucaaccacucauguacucucaugacaggugaagucccugaguccuggacauacacagcucaaagagcgagagcuaccugccgcuggggugaaccuguccucaggcucugacacccuuagaggugggugcccugcuccagggcugcaggcugccuuaggccccgucugaucucaaugccagcugacugaaacacuugcuggaaacugagaugagugagccucugccuagcuuggugacagugagccuuacaguccuugaggcuugggcucuccuuuaguccauguucuuggugauucuuuaauugguuucagacacucugcccuacagcaugggaacccugagugaggguggcuccucgguagcaaaaugacagcuguauucuaaagugucacacuuuugucuauacaguaguaauacuuucaagcugauauauagaauguucuggacuuguaaucagcaucagcuauuaaaacacugaugucauaacuugcaaaugaagccauggaacggcauccguguguaauagccugcuaguuuuucaccuugaccaauauucugucauuuagauuauucagaauugagcgacuaugcauaugucaacuuuguaucacuguuacaaaauggagaugaucagccuaccggacucaguucacuuuggcucaggguuacagucugucguugauuagccuugugacuuuggacacaguguaucauggagugugugucugauggagaugacuguucaucacauaguggccaggaagcaaaacagagagaagaggcccacaccacuucaagggccugcgcccaaugaaugaccuuccuuccucuauguuguaucaccucccaguagcaccuugaacacacaagcccuugggacauuucaaauuuaaacucuuuauuauuguuguuguuguuguuguuuuauauauaugaguaugcugucuucagaagagaacaucagauuccauuacagaugguugugagccaccauguccuugcugggaauugaacucaggaucucuggaagagcagccacuaagcucucucaccagccucagaucuaaacuuuuuuuuuuuucaagacaggguuucucuguauagcccugguucuccuggaacucacuuuguagaccaggcuggccucgaacucagaaauccgccugccucugccucccgagugcugggauaaaaggcgugugccaccacgcccggccagaucuaaacucuugcaagcauggguagagguggaguugaggacagagccuuuguuuccauuguagcuguaucaacagcauucaugaugcuuucucuucagacaggagccagggcuucagccuucucaacucacuggcuggggcaaaccgcagaguugcaucagcagagagcugucacucugagguaaagaauuuucacaucuuuucuacuccuugacuuuaauacccuuguuacagaucuuuacacauucgucauuucucucauuuccauuuaagaggcagcagagaucucagcacugaagggagagucugaagugccccauugugccuaaccccugcugagggaaugcuagcccauucccuuggcagguuugcacucagggauauccugcagggcuuuuuuguuuuguuuuguuuuguuuugcuggaacacuuuuuaaauaucuuacauagaaaauaaaaaugauucuuuuucaauacuguuuaucaaggucgucccaaguuggcucugagugagccgacagucugucuucaccccccuguccucagcagcuccauucugaggucacuuggugagccugccagacccaggugccauggugccccgccaccaucauccucccagacacugaacuguuuguguuauaucaauguuaguugucugggcauauguucaugcuugcuuguguauaugcagguguguauggaagccacaggacaccagcagggucauccuaaggaucaccaaccauuuuccuuugagacaggaauucuuacuaagcccagagcucaccaauuaggccagucagcccuauggaaccuccugucuccgccuccccguugguuacauuagccuuuguauguggguccugggaacccaguuccaaucugcaggacaaguccuuuccugacugacuggcuccccagugaugcaaacaaaacgugugcuagcacucuguagcaaaaucuaacauucauaguuucuccuugaaaagagugcagcuggggcaguggcuuugcagcuguuugugucugaaugugaucuuguuccuguuugucuccuccugcagggucugucagugcuucuccacagcgagcugggggugggaagagaaaacccuuuugggauucucacugaaauagcuuccugcuaaguuguugcuucccuguauuuccccagcagcaggagccgucgccaacagcugagaggacagagucccucccuggccaucacaguggugcguguggcucagcaggcgcacagguugacagcauugucgguaagguccuccaugagcucccagagauagcagcagaauucagaacacgggaagagaagggacgugcagucuucucuccuuaccuugucccugcagucggggucagcggucacugacccauucccauccgugcgcuuccauagcucauccagcuugugucccauucugacauucaaauggcugucugugagggccaccugcgaccucugugccacuaacucuaguauuucccauccucauccugacugagcggccuucaggacuguggacagugcuucacugaaacgcugucuucucuucacuuagcagcacagcaucuccuggucucccuucugcaugcuuuugcaaggcugcucuccuccuuuucccaagauuuaaacacugcugucuucagugcuccaucuaaacucguuuaaaaaaaacuuguuauugauucuuugugauuuucacaucaugcacccaaucccauucaucuugccaucccuccauaucugcccuccaccuugcaaccuccccugcccaacaaaaacagucucucugugaaacugaugugucaugggaugggguguccuacaugacaacacaauauaccuuuuugcccaaacaacuuuucuuguaaaccgggacucgucucggacugugguguugcccuguguccuggagauccugcagcuuuggacccagaggaccggccccuuuacacacuccagcauuucaugguuggcauugauguugggguggaacaacucaaagcccuggaucugggucugguugguagcugaguuggucagccugacagcucuccgacuuucacaccaucagagcuaacucuccaugacugcccaggcaagcucucccaaucucacacccuuaggaccagcucaacugcaacccacaucaaccagggccugcucuacuguacugcucaggcgaggugcaggacccauacugccaaguacugcagccacaaggaguggggccagcgcucuugcucucaggcccucugggcagcccucccaggaugcucggcaagggguagagcgagcucuccuuaagcucuuccuuuuaacauauuuuuaaaacacaaagugacccugucuuuauuucuagcuugguuaccaucucucugcucagguaaaucagaaauaugaccuuacgccuauacaucaauagccuaccugaugugcacugaacuaagacacauuuaugaacccaagugcacuuaaacaaauuguauagcagugugguaaaugaaagguauugaaaaucgcuguccuugucuuucuagaacguuuaauagucaaggcuguaggcauuagaaugccauggaauuggguuaaagugaagacuguaccucagguagugauagagccgugagugcaugauucccagggucuuuugagcaggaguaagcaaccugcccucccagggcuguagaaaagcagaaguauauucggguaaguuaaaguaucccauggugaugaagguauggcucaguagugcaacucauucacagaacgccuccuccuaagcgugugcaaggcucugggcuugaccccuggugcuccugaaauggggcugggagucaaaggaagaagaauggauggacagagcaaugcauggaagggaagggagagggauggacagauggauagauggaagggagagggaaugacagagccauuggacagauguauaaagugagcuccucucaguacucuguguucacuacagugguggcagagaauguuagaaaaccaaggagccuacacaaaugcagacacagcucuaucaacggugggaaggaucugaggagcccuggauccuggguggucagggaagcuccugucacuguggaagaaggaauauggcagggcuggagagaugauugagcguuaggcgagugcagugcccuauagaagacccaggcuugauuuccagcacccugccuccagcuugagggagauccaaagcccucuucuggucucugcugacauauauccacucacagaaacacacgaauaugcacauaacuagaguaaaucuuauuauuuuuaaguaauguacugaggcagaaauggugaaggauccauauuaagaguguauuaagcaaacgugguuuaaaacagccccgccucuggauaguucgcuggcauuuaggugaguucaguuuuaaacauagguuacucuguuuuucuauguuugaguuguagacagugauaacuguccuaauaggcuuagacauauguguggccaucauaauauggcaggguuguucccugucccugcugaguguguaguaaagggagagcaucuuucagagcauucuccuguugcugggacaagucgcagcucuacagggaacaguguccucuaccuuaucagcgcuguaaggaugaagcugugcccuguagggaggcuccagcagccccacagggcacagccaucaagcuggccugugucagcacucagcuguugcccaugugugcacaguagaacuagcacugccuguauguagcacauguagaagcagucugugaccaacucugauuucagaccccauguuagaccuggauauucaagaacuagccagucuuaccacuggaggaggugaucuggagaacuucgagagacucuuuucaaaguuaaaagaaaugaaagguaauuaucccagcaugucucacagccucgcaugucgaagcuuuucuaguuuaugucguaggaucucacuuugugguggcuagauuggauucugagcucugggcuugggaaauucagcugcuuaggagauuggaccauuuuguugguaaaaauucccuggggaaaacauccugucucuguccucuucuccucacucacucucgaguuuucugaagugugucucuuccuuucagugagucucauuaacacagcaucugucacaucuuuacaacucacucacaucccaucuggaaaauuugggagagagagcuuccuaauagcguaaugacugcgccaugagcguaugucuuagaaacccaucuaccaccuccgaguguuagcacacccaggagcuccagauucuccugugcuguuagacaaauuucuuaagauauauuuuuccccuuagacaaggcugcgacgcuuccucaugagcaaagaaaguugcaugcagaaaaggugagacgacccgcagguauuuaucgucuguaagaggcucugaugugcgcugugcccuggguauuacagccagcuggauggcuauuugugcaacaguaacacgggugcugcugucugugcauguuacgugacaugggaccuucacagaggcaucaugcuugccuuccuguuaagccagggagcucuucgcuguuuuaucuauucauuuccagagcaauacauguucucgucaggaaauggacaugcucggugacaucuccuuauauaaacugugucaucaccgaucucuccaucuccuuuccggacacuaaggccagcagcgcacuggugguuuugguucugucaggaaugaagccaaacauaucccuacccuucacacgcauguacggcccugaucgcauccagaagucugggucaaaggcugcucggggguuuaaugugugugguuggaggggaaaaguguagaaguguagaccuuagucaguuuggauguggcauaugaagugagcugaagguuagcuguuaccaacuaaccugaccuuugucacaugcuucccuccacagguggccaaagccuucuggauggcaauaggaggggaccgagaugagaucgagggccuuucuucugaugacgagcacuaagcucuuccugcuagguuugacugacuccagugccagcaccgugcuccccaagugcuucccuucucaacgggguucucuucugccaagauugccacuagcacgcuggccaccugacugguuuuuggggucccuuaccugagcuuuuagaaaggcguuagggagaaaucuuuguuccugccgcauaagugacugaggagugaaaugacaguguggaaacccuucagaucuacagucuucguuuuaagaaccuggguaaaaugaggcucggaaauguguaauacaggagaaccaagugucagagagcacacugugaccucagcacugagggucugaggccagccugggcuccauggggaguucugcugcugugcucgauugccccguucauucugucugcagguccggagcuugugcuaucggcuguguacugucacugguccccgccaagagcacagcucugaccuaaggugaaugcuggugacaagaaaggcagcuguagauguaggaugugccuaggggauagggaacagguggcucauggguuugucucuuaguaaguccuuaguaaguucagugucugaguuccugccacaaagcagcaaaagccaggugugucucuauaagaaacagaggugaaaguuuccuccucuggggaauguaaacuccccucuccccacugcugggcaagggcccugagugcccuccugaggacccagggagcagcaguguugguucugagcacacugcugacacuggcagcugugcucuucgaccacugaguguucucccuggcaaugugagguuucagagcaggucuccccuucuuucugcuuggaagccagagguugcugucaaggcaccaguuccaagcaguggggggauaggugagccucccgacagccagguccugagccaccaucaugguucacuuccagggcuauuggcuucuccauacuccagggcccagccccaggggagcacagagcaaaguucuaaaggaaaagaggggaaaaggucuaaaagugcguagucugucaucacagacacuucugugaggcaggcuugaguccccugcauugucaugggucucuaaggauaugcagccauguacaugguacucaucgugggcugagagcuggccugacuuagugucaaccaugacuuaggucaugaccagaaacaagacgcgccugcuuggguaccacuuacaggaccugaaacaugcuuagccaggccagaaccaacccagggaggaggcaugauccuggugauggugguauucuagaaacagugggugcugcuuugcuccggguuccuggguucccacuccccacauucugaucuuguaagcuuugagcuuggguuuaccaccagccuuucagggggacuaauacuuuaaugugagugcauucgcuacugguuaagaagggaaauuagggaagucggcuguggguugccagaaagguagaacuuguuuuucuuaaaauauggaagauuuuagaaaauauauuaggucacaugauuagggaaaaaauagacuagaaaaggcuguggacuugauuuugcugacuaaacaaacccaaguaauuaaaagaugacuuauuuauaaagucugcuaauguguuuuguucuguuugggaagaggugugaguugguggaagccuggugucuuuuguaguagacauacaguccgaagaguuuguugccuguaauguuucagaaucuacuuugccuauauauuccugagcuggugcuguggugauagguguugucuaacuuaugugcacauaaguuagaguuccggggggacugaagguaagaaacugguuuucugccuuaaauacuucuuguuucuguaacaaagugcuuggcacauaguagguccacaauuuuuguugacaaguacaaucugcuugguggaaaugaucacagagucugaagauccaugaguucuagaaaugagagagagagagagagaaua

SEQ ID NO: 5163 - RNA, 35963 nt, Mus musculus
auuaucaaauaauuuaacauuuuagugaauuuuuguguuuacaaagaaauaaguauuagaauuaccauuagaaauuguaauauaugaggauauaaguauauugagaauaacaaacugaaaaagcugaaaauguuucccagggauucuuuuugucuuuccuuuugagacaggguuucucuguguagcugugguuuuucuggaacuugcucuguagaccaggccgccucugccuccucagugcugggauuaaagguguguacugccaugcccaguuaaaaauauuuggacuaaagccgagagaauccauggaauauaggugcuaaucuuuugagauuaaugcaacgccagcauaaauauuaaccauacucaagcuuaauaaaauaccagggaaauaaccaaagucaggcauccccagauuuucuguuacauuuccagcacugauguaaguuuugugugaugguaaggauucccaaaagcugugugcauaccaagugaacaugaugccuuugucccauggcuccaaaacuccauuucaaaauaauguuugauuuacugguucacuuuuacaacaaauaagaaaaauuagaaacgcaguggcccaucuccuuuagcuuuuguuucaaaacacagcucacuucugguggauguaucugucccuuucagagcccuugcuuaggcacaugcacguggcuucagagauugugguccccacagucugcgcccucuccauccucacugcugcccugaugcugacacuucuccucaggagacguggcugagacgggaucuccucuccaccuucaucugucaaagcaucucuucaggaucacucuucuuuucugcugcagaaguucacgugaugucuauuuuucaggcucugaaaauuaacucacucuuuucccccuuuuuguuuugugcugugauuuaagaaaauaaaaauaagcauaaauaaaaugaaagaaaccuguagucucaacucuccugaagucagaguuaauauuugcuaccuaucauucacacaccucauuuuucaaaauuaggaacauguguauagauuuauaacuugaugauuuuucauuuucuggaaaaauuacuuuaauguacaaaugacugucacugagcacugccauaucuuauggacacuaucagucuaaaccccuuucaggcuucagacuauuagcuaagcaggugagcagcaagugggcaggacaugugccuccugagggagacuaugagugacagguacugcauuguggcuagcaaagggacucugcaauaccacgcuaugguggcaaaccaaacaaaguuuuuuuuuuuccuuuuaaauuuuaacuaaagccaggugugguagcgcaugcuuuugauaccagcacucaggaggcagaggcagagaggcagaucucuaugaguucaugguuagcuugaucuacauagugagcuccaggacuacauagauccugucaaaacaaaaaaccggaaacauuaaauuuuauuuuauuuuguuuuguuuuguuuuucgagacaggguuucucuguauagcccuggcuguccuggaacucacuuuguggaccaggcuggccuugaacucagaaauccaccugccucugcuucccaagugcugggauuaaaggcgugagccaccacgcccagcuucauuuuauuuuuaaaauucugauaaaauuaaucuccauuuacuaaagggcaaaugaggcuuaagggggaaugguaagaucaggcauuuuacucauuauuuaauucuauuuauuuuuaugaaacaaacaaacgaacaaacaaaaaggccagauaggguuacacagugagauuuuuguuucagaaacaaaacaaaacccaaaaguaagaggauuuuccaucaauccuuuuagcuaauauaaacucaaagaaagauguaaagggcugcaauauaugugccgccacuagauggugcuaaaccucuuugugcgcagcugcgagagcacagccagccaaagucaccagucuccggggcuuuugcccaaccccugggggcuuuaaccuauccccagggugcaugaggaucauggguguuacuaccaguccuaguuuagacacgucaccaaaaguauuuaagccacacacuuucugagccuucuuugucuaccucacuaugauauagaaguaaaaguuaaccguggaagaaucugguguguccuguguucauuucccgcgggacggggauaagcucgggauagaaagaugauuuuauuuuuuagguuuauagaaacaggauuucucuguguaguucuggccguccuagaacucccucuuuagaucaggccgguccaaaacucagauccgucugucucuguguccugaguguugagacuaaaggugugcacagccacugcucaggggugcuuugauuuugauuuuaaaaaucaaguauuuuuuaaaaagguguuuacauuuagggcucaaugaaauuuggcugaggaaaacugcuuauuaacaaaacuuuguuuuucaugucaaguugagggucuguuuacaauuuucucuuuuaucaaugauuuugaaaucacacuacagaugaaaacuuucuuugauucuagaguuaaguagaccuaguaaguggccaagcaaagguacaaagaaagccaaguaagaaccugguggccguucaguggccuggggagcgguuagucacgacgaguggaugugguaccgacaauggagaacuagcuaagacacggggacucaucacaacauaccggagagaagacccuuugcaagggcccgcagugcgcauuacuugaagugcaccuggcugcagguaagcauguuaacgaaggcuguccuuucuuccagacuaccauucagugucagcucaggaaacucugcaagcagaaagacaacgagccagucagagcucucaccugacuuuaccacaacacggcaguugcguaagaaguguggauggcacccgacuuccacuugaaaagacucuguuuggccaaacccugcuggggcagagucuauacgggguauauuuauuuauacagcauacccuccugauguuuugauuaaacaacauucaaaguagaguaaaaaacaaaaacaaacaagaacuaccuucccucaggaaacaacuacauuaauuuuugugccaccacuuaaggaucaacaagugucuuuucugaaucauucuguaacauaauuuuagagaagaaauucuuagcauuuacagccuccccaaccccuuuaugguuuuuuaagacaggguuucucuguguagccuugauuguccugaaacuugcuauauagaccagguuggacucaaacucacagagauccaccugcuucugccucccaaguacuggaaucaaaagugugugccaccauccccaggcagaauuuacagccuuacagcuaaauguacacucauuucucuacccucuaaaagaaugacucgggcuggugagauggcucaguggguuagagcacccgacugcucuuccgaagguccagaguucaaaucccagcaaccacaugguggcucacaaccauccguaaugagaucuggcgcccucuucuggagugucugaagacagcuacaguguacuuacauauaauaaauaaguaaaucuuaaaaaaaaaaaaaagaaugacuccugugcuucaaggaaacagccaguuagcauuuggagggauuguguccacuuccuuugugauucccauguuuuuaucauuacuacuguuauuugcuaagcacccacugguggaccacugucuaguggacacuugauuuuucuaccccauuacuuccaaauauuauucucuauuccauggcagcugaaagaaagugugcucguucccuaagucugucucccuguucuuuuuuuuaaaaaaagauuuauuuauuauuauacacuguagcugucuucagacacaccagaagagggcaucagauccuacaggugguugcugagauuugaacucaggaccuuuggaagaacagucagugcucucauccaccuaaccaucucaccggcccugucucccuguucuuaaagacaacuguuuuacuuaggagcaaaauaccauuacauaucuugaaagguaggucugacuuaaaaacaucuaaucuccuaaauguuuaccuuuuguugguuucuuucauuaauuuuggugaggaugagacugucccauguaagccaggcuggccuuaauuuaaacuauguagccaaggaugaccugaacuucugagguccuacaucugcuucuaaaguucugggacuacaaguaugcacuacuauauccagcuauaacuguaguuuaaaaagaacaaauaaauaaauaaagcaaguaaauaaucucauucuguaguuuaggcuagccuagaguuuugaaacuaacuauauaauccaggcuugcacaccuggcugacuuuguuguuacuacuccuguauuucuguccccaacucccaucucagugcuggcaauagacaucaaggugcauguaggcaagugcuucaucacugagcuaauuaauuuccuagcuucaguuuuccuuuuugagcgaguuuucaggcuacaggaggcuaagcuccugcuccuucugcucccaccucccaugugcuugggauugcaagcaugguccaacacacuagcuccuugcacuuuuuacuuuuuauuuauuuuuuuuuaaaguuuaaaaaaaggucuuuucuuucuuccuuuucucucucucucucucuuucuuucauguauguauguauguauguauguauguauguaugugaguacacuucagacacaucagaagacagaugguugugagccacaauguggugguugggauuugaacucaguaucucuggaagaauagucagugcucuuuaaccacugagccaucucuccagcccugcacuuuuuacuuuugagaugaccucugaauuuccuuuuggguaaacuguucaugccuucccacugaguuuuuuaagugcauguguacacaugcauguaugcauguuuugguuuuuaagacagggucucuauguguagaucuggcuguccuggaacauguuuuguagucaaggcuggccuuaaacauagagauccauuugccucagccucaaguacuugcaaagauuuuuuuguaguauacuaggacauguuccucuucugaacacaugccauaaaugugcuuuucuaguuuacuaugucuguugcuuggccuaaauauauauauauuagauaaauauguauauaauuuuuucucuuuuuuauauaccuggaauuuaaaaaaggauuauauuuaaaauuguaugugcauugaaggugcccacaaaaaccagaagagggcauugaaucuuuugcaaccggaguuaaaaguagcuuugaauugccugauguggaugcuaggaacugaacccaaguacucugcaaggucaccucugaaccaucucuccaacauccacagcugauuuuaacccccuuuagauuuuaaguuuuauaucauacuuaaaacacauggcaugggggcuggagagauggcucagccguuaaaagcacuggcugcuuuuccagagguccugaguucauuucccagcaaccacaugguggcugacaaccaucuguaaugggaucugaugcucucugguuauaucugaagcaauaguguacuuauauacauaaaauaaaucugagggggcuggugcgauggcucagugguuaagagcgccgacugcucuuccgaaggucccgaguucaaaucccagcaaccacaugguggcucauaaccauccguaacgaaaucugaugcccucuucuggaguuucugaggacagcuacaauguacuuacauauaauaaauaaauaaaucuuaaaaaaaaaaaaaaaaaaagaaaagaaaucugaaaaaaaauaaaccaaacaaacaaacaaaaaaccacaugcuaugauuuuaacugauggcucccaggaaaaauuuuuuuaguuuaaugauuucugcauguuuaucuaucuaugagagacagaauccccugggaaauaggagugggcauguuguggggucuugucuuaauuguguuaacugaagugugaagacuugcucaguauagacagaccaucaucccugggccggccacucuggacagcuuuaaaguggggaaaguaagcggacacgagcacacaggcacugccuucuucugcugacuaagggaucucuagcaacagcuacucaagcuccuucugcuuugacuuccuuaccauggugaguggagaucugugagaggaaauaaaaccauucacccuucacggcuucugucagagaauuuuaucauaguaacaggaaaagaaacuaagacauaaaucaguaccaaaaguaggguggaaauuauauggugacagggaccaaguggugguagagaugucuugguugguauugauuucagaucguuagacuagugaaucauuugggagaugggcaucugagcaugucugugagagauguucuuauguuaagugacgugggccgacccaccguauuggauggugugaguggaggaagggaacucagcaacccaugcacucugcuuccugacugugagcaaguacaauuggcugcuuguuuuaagcuccugaugccuugaagacagaaucagaucccauuacagaugguugugagccaccaugugguugcugggaauugaacucaggaccucuggaaaagcagucagugcucuuaaccacugagccagccccagcaaagguucuuuuuauccaggauaauaagaaaaagcacucacaagugauuauuauacuuugaauuuuucuaaaacucacaauggcacaaaagucagauuuucuuuuaaagucuguuuuauaccuacaguucagggaaagaccugcaacaaugauuccucccauaaagauuuaaugacuacauagcaucuuuaccaggccuguggaaacuggaauggucuacaggggagcugucacucaguugccacacuguuuucacccucuucugacuauugcugagcuccacucuccauuucugcggcuucucacugaagaaaaaaauaccaaaagaaaauuaaaaugaauaaguaaacuacuaauaaccaaacaguagcucuuccuuccuuccuuccuuccuuccuuccuuccuuccuuccuuccuuccuuccuuccuuccuuccuuccuuccugucauccagugaaauccacgugugacaagcacugaguacggauauaaauaggccacaaucccugagcuggagaaguacagucaagaaagggggagagaaaaacauacacacaugucaaagaaaaacaauuuuuuuuaaaagcaguaauagucuagggcuggagagauggcucaggaguuaagaauacuggaugcucuuuccagaagagaaggguuuaauucccagcacccacauucagcucacauaucucuaauccaauuccagggcuuuugacacccucacacagccauacaugcaggcaaaacacuaaugaacauaaacgaaaaauaaaucauauauauaaauaagcaguaauagagaaacacugugcaaaccaaguguggugguacucaguaauucuagcacacgagaaggcugaggcaggagaaucacuaucaguucaagaccagcauuagcuacauagagaguucuagacaagcuuaaacagugagacuguuucuauuuuuccucaaagaaagaaagaaagaacaguguagggguugggggaaggcacaaagugucaagauuaguaauuauuuaaaagauauagaaaggaacaagagugagguuuggggauuuuacgauuauggucauuugaaagauaaaacagaagaagaaaaaccagcauuauaaaagaguaacauuuaaaauuuuuauuuaauuauuuaguuuaaaaagaucauuacggcaggagggaugguucagccugauaacuugaguuccaugauagaaagggagaacugacuccccgugaauuguccucugaccuccacaugugugucacagcuuacaagcacccaacuucacacacgaauaaauaaauaaauguaguaaaaauuaguauucauuuugggccaucaagauggcucaauggauaaaagugcuugugacagacauggaaggcugauaaucugagucugauccccagaauacacaagauggaaggagaacagacuauaaaauuguccucugaccuccacacacaugccacagcauguacuugccuacagauagcauacauauacauacauauuaauacuaaauauguuuuuuugacuuuuaaagauuuacuuaagugugaguauagacaggcacgucucacagccugucaggggacaacuuuuagggucaguuuucugcuucugccuugcuuuuuuuugaggacagacugucacuauuaugugaguccugaagaucaaagaacuugggucaucaagagcugugcagugagugaucuucuuagcagcugagccaucuucuaaccccacacuuuucuacacauccacccacccacccaacuaccuuuuuguuuauuuaguguacaggugagaauguccaugugcaggguguguguaugcuauaguagucuugccaggguguacaugugaggucaaaggacaaccauggaagucagccagcucuccuuuaaccauauaaguaagcuccaggaguugaacucaggucauauggcuuuuuuuuuuuuuuuuuuuaaccaaguaacuagguugcccacccuuguuuugauuuuuuuucuccuuuuuugagacagugucucaauuaguacuucuguuuggucuagaacuuuacuauguggaccagucugguccugaaacucacgagagguacccaccugaguccuagauuauaggcaugugcuaccacacacaggcaaaaacaauuuaucuauaacauguuuauuuaaauuggcaaauaaaaaggccauuaguaguggucucagcggugcacuuacuuuggaaguggaaauaggacaacaaaauuuaaagcuagucuaggugauauaauaagaccccaucucaaaaaucaacugaucacugauaguacaaacuuuugguaugacagaagcuuuaagaaacagacaagaggaaagaaacguuagggagaacaacacuggcaugucagagugcaugacuacaaugauucugucauacucacagccacacccuugguccugcugugccugucuagccucaucacugucucucaucucauggucaucauucucugucauuucuuccuauuauuucuccugugauuuacuuuauuuuauuuuuuuaaagauuuauuuauuauuauauaugaguacacuguagcugucuucagacacaccagaagagggagucagaucucauuacagacaguugugagccaccaugugggugcugggauuugaacucaggacauccgaaagaaaaaucaguggucuuaaucgcugagccaucucucuagccccucuuccaugauuuugugacagaacaaagacuaagaggcucaaaagucuuaagugaaaaaaauucugggagaagaaauagaaaaggcugugagucagagagugggaaaaggacuaccagccuaagccauacugggucaugaaauccuaugguaacugggccaaacuggucuuaagguacaauguaauuauuaaguugcuuaccuuugauacaaauucuugacagcagcuggucugacuggcaacugaaaaauguguugcucaucaagaggauuuuguuuauaauauuuuaugcaggaucuaaaaaguuaaaacaaucuuuuuugggaaugagagaugucagaaaugauaaaggcuuucuagucuagagaaagauuuuaccacaaaccaggcuaugacagaaggaaugaauucagagucacaauaguaacaaacaccagccccccacccuaccuucccucugcugaaaacaaaacuuaaagacaauguuucuagccaaggaaaucucacucacuucaaaaaaauuauguagacugauuucuuauauaaaaccauauugagcugagaauguagcuaagugguggcucacaccaguaagccugggcuacaaaugagacaaugccucaaaacaaaaagcaaaaauccuuacuguguuaaagagaagagaagcucaugcugagguuuaaugaaaagcaugcagaugacuaagauuucaagaauaugauggaguuucugaacacggcaaaccuguuccugugucgauacugagggagaaaugaaguauuccuggaagacagaaauauaaagagaggaaggaagcaacgacuaagcagagccccuggaaagaaguugccauucccucuacaucuacaccuggaugccugauaauggggaaagggaggcaaugacugcacagaacucccuaccuuucaccaucagccuuaaaccaaguucuuugcuaagaacgcuggacacaaaugacagucuccuauaaaagcugaucccagacagcuucaguaacaaggacaaguggguagccaacacuacuuacuacuaaggauggcagggcuacucugcaagaccacccuacaucucuccuuaccuggugaaccgaagucugagaaacuaaccaagugccugacacuccccccuugaacguauuacuggaauauuggcacagauuuuggagaagacauuuggcaagcuaagccaguaucauaaaguguugaacuuuccaguuuuauuucugagauccaaacuaauaauccagugggaaugauaagcagauuuugauaacagccaagauucuagccuccuggaguguacacuuuguauaauucuuuccccuugagugagccuagaacuuacaaacaugaugugguuuuauugccauagcuaggccacuaauagacuaugcauuaaucaauaauagauaaucuuaauacauaauaaacauaauauauuguguuacauguauuauaguauauuuugauguuuuuauagcuaacauacaaaauauauuauauauuagcauauauacuaauagacuauauacuguuuaauaugcaaaauauauaauguacauuauacuauauuaaugcuauauagcauauguuauauacugauauauauauauauauauauauauauauauauauaauacucuuuauaucauacuuacuauugauuaaugcauagucuguuaccuacuuaaggcaauacaaccacaucauauuugcaaguuuuaggcucauauacaaucuauauaauagguaguuaucacuugguccuuauaaaacccugcccaguaucggguguaguggugaugcuuuagucaccagcaugugggagacagaggcaggggaaucucugaguuugagacaagcuuuaucuacaaagugaacuaauuucagcacagccagggcuacauagugagacccugccuuaaaaaacaaaccaacaaugccagccagugauggcccacgccuuuaaucccagcacucgggaggcagaggcaggcggauuucugaguuccaggucagcucgauccacagagugaguuccaggacaggcagggcuacacagagaaacccugucucgaaaaacaaaaaaaaacaaaagaacaaaaacccuuccaggccuucucuaagaagaccaagaaggaaaggagaugcucuucacugucacucugaaauaaacugucaugcuguggggaggguccaugauaaaugcugagagcauccaauagaagaaacugguugguccugagccaauacauuaaagaaugcuguaacuucuuuagcaaauaaucauucaaaggagucaagauauaaaauaaauacgcccuuagccgggcgugguggcacacgccuuuaaucccgguacuugggaggcagaggcaggcggauuucugaguuugaggccagccuggucuacagagugaguuccaggacagccagggcuacacagagaaacccugucucaaaaaaagaaaacaaacaaacaaacaaacaaacaaaaaaccccccaaaaccaaaccaaacaaacaaacaaaaaaaccacccuuauagauuccuugacaacuagguaagaguuucacaucaguugcauagaugcaaagagaagggaaaggcuggaacaagcaccugucagcugacguugaggaacagcaguaacuggcaucaguuggcucacugugcuuccuaggacagaggcuggcacauuacagacacuuagcaacuguguguuguuaugacuacauaagagaaagaaacucaccaaaugauucaaagaugcaaguuccugaccuaucaagaaaaacauauguaaauaagcuuuaggaaauucccaguaaaaauuuaaaaauaaaaagaaucuaagaaaaauguuuguaguucauauauuaaauaggugauuaaguuaaauaguucaucaauuacauuauaaauucauacuaauacuuauucuaaaacugaucauagcuugccccuaauaaacaaaguaucaaguguuaaguauugaaaaaagcugggcagugguggcgcacaccuuuaaucccagcacuugggaggcagaggcaggcagauuucugaguuugaggccagccuggucuacaaagugaguuccaggacagccagggcuacacagagaaacccugccucgaaaacagagaaacaaacaaacaugauuuaaaaacaucuuuuaacuagcgacagcagguugguucagaaaguaaaggcgccugccagcaaaccugacagcccaagcuggagccugggacccacacaguagaagugacuccagaaaggugcucuccacauccacacggauucacgggugccccaccacagcacauuuuaaaacaaacaacaaacgaaacucauaccuaaaagccaaaaaaccaaaacacuacagcucuauuuaaccuauuguauuucucaagugggaaauuggcucagaaaaggaaaaugcuuguaucauaggcaaucagagguaaagccagauagacaaggacuaggaagguaaaagaacucacugacaaaaaagcugauauaaucuuucuucaguuuguccaaaccaauuuccaaaagcaucugcagugggguaguuccagagagagggacacuguccauagcuccaugguaagacugaugaaugaguuuacuuaguaaacuguuacuuccacugugcaacuagaaauagaaaaaaguuuauaaguucuuaaauuuaaguauaaauaaacauaauaggcaaaauaagacuaugaguucaaauuuagaauuauacauuuucaguuuccugacauuuuaaauucuuucaauaaaagcucccaaguuaacccgaguucuuaagaugccacuccuggcuagaaauguggcuuugccuaacuugcccaaagcucuggguccauccccaguucuggacgagcagggaguuguguguagucucagcauucaggaggcagaggcagguguuucagaaguuuaaagucaguuacccucagcuaucuagucaacuggauacccuauuaaaaaaaaaaaaaaaaaaaaagaaagaaagaaagaagggcuggagcaauggcucagugguuaagagcacugacugcucuuacaaagguccugaguucaguucucagcaaccacaugguggcucacaaccauugauccugcccucuucuggagugucugaagacagcuacaauguacucacauauaauaaauaaauaaauaauaauaauaaaaaaaagaagaacaagaaaagcuauuccuauuccacuuguguuuugaaaaucuaaagcagucaaggcaggccuaaagugguaagcuugacuuucccagagagcaucagagcugguccugccaggccuuacaacuaagccuucuccugggugacugcagcaccacugagcaucuuuaguaaacuucugucuucacucacauugaagcagacugaaggaacauaaacuccucuccucagggucuauguauaugacaaaguuacuuuucagcugugacaucuaaccuaacuuagauuauuuauaaauuacaaagggcuaucaacucacacguaacuuuggcaccaauuaggaugauuuuaaaaucuguaaaauggcaccuugcugcuacuuucuucauagucuucagcuuuccuuagucuucugcauuugcucuuuuuuuaaaaugagauucucaugguuuacacucacuguacacagcagguucgugcucaucaauaccccacaaacaaagaaucccauuucaauagcuaagcugcaaacacucacaauugccacugucugcauagugagcguuuucuuguguuuguucuauaucuucuucacaacacuaauuauuguucuuggugcugggaucaaacucagggccucacauaacuacaaaaauucuaacuuuuaucaugaauugguggcuaaguuauuuuaaaugguugcuaauaagcucuuucuaaacuuuuauuuugcuuuuuuguucaauguaaaaguaaaauaaccgcacuuuggaaaauucauacagugacggaaaugucaucgaucgcaaagagcacaguuauuuguaaggcuucucucaguggucaucaugaagaguuuaacagauggucccaaaugguuuguuuucaaaauuuacauuuuauaaaguuacauguauucuacauccuuugucaacacuguuuuagcagcuauuguacacaaugcuauguggcuacauuauaguuacuuagucaucucauaacaaggaaaauauacaucaauuacuauuucuggcuccuaugaggaaaauuacugggcuggagagguggcucagugguuacaagcacagacugaucuugcagaggaucugaguuaaauucuagcacccacauggcagcucauuacugucuguaacucuaagaucugacacccucacacagagauaaugcaggccaaacaucaaugcauauaaaauaaaaauaaauguuauuaaaaaauaguaaaacccaaaguauuguaauggacaaaacucuauguuuugggguuuuuuguuuuguuuuuucgagacaggguuucucugcauagccuuggcuguccuggaacucacuuuguagaccaggcuagccucgaacucagaaauccgccugccucugccucccaagugcugggauuaaaggcaugcaccauacccggcuuguuuguuuuugaggcacaaucucacgacaaagcccagguuaaccuccaacuugugaucauucagcuucuuaccaaaugguaggauuacaggcaugucuuaccaugccuggucuugauauaugcuuuugugcaugagugcuggggagauccuagcacaaguauuauugguuuagaagucauauuacauuuucagaaacucaagccaucaucaaaacugcuuuguaaaagaccauccuaguuuugaagucuuagcaguggcuuaugaaaacauucauuuccagaauagcuaacaguaucaacagcuuauauauaucaagacagacacuagguccuguguaugcauuagauacauaacauaacauuagauuccuaaauaacacuaugacucaggaagaguccaguccucauacuguugaugaggguagugagguacagagaaguaaagggccccaaguucacacagcuacuggaggucaacacagacuguuugauccaggguuuuaucaaacgcucucuuucugcuuguaugguuugguuucuguaugucauugagaaaaacauucuacuuacacccuucaaccuacccauggcuguauaucaccacgcugaagacucugcaggaugagugugaaacacuucaccaagucuugauaggaaaccacaccuuaaaaaccaagucacacagaaaucauuuccacaucucuacugauucaagugucaauuuuaaugacacaagaaacaaaaaacgccccccucccccgcccuccgaacuuuagcggugagaggggggauuuaaaaugggaggggaaaaaagacagaaagauauagcucagauugccaaauaacauuugguugguagaucaauccaucuaucuaucuaucuaccuaucuaaaauuguuauaugaguuaucuauuacuauuagguauguuuugacuccuguaaauauaguuauaucucaugcaaacagccaaauuuuauauuuuaaaaggcaugaaagggggcuggaaauaugaguuaagagcacuggcgacucuuccagaggaccaaggucaaucccugguacccacguguugcuuccaaccaucuaguuucauaggaucuaaacugccuucuggucuauguaagugggcugacuucaugugguguacagacauacaaacaugcaaaguacagaugcacauaaaguugaaacaaacaaaaaccuuaaauacacaaaaagagcccacuguguuuaugauggauacgcacugcugcucauucuacaccaaagcuguucagcaaaaucgagauccccccgcacggugagaagcauggaccugacaacugcagcugcgucaugguucacugccugaaaaagaagcaaacuuuacagaacacuccauuuauuuacuuuuauuuguuuguuuggagauaggguuucucuguguagcccuggcuguccuggaacucacucuguagaccaggcuggccuugaacucagaaauucgccugccucugccucccgagugcugggauuaaaggcuuuuuuugguuuuuuuugagacaggguuuuucucuauagcccuggcuguccuggaacucacucuguagaccagguuggccuugaacucagaaaucuaccugccucugccucccaagugcugggauuaaaggcaugaaggcaugcuccaccacgcccggcucauuuauuuacuuuuaaagugaaguaguuuaaacuuuaaacacuauucugagcacuauaaggacaugaacauauacaaagaauuauagaaauguuauuuucuucagaauuucauuuacuaguaaggagaaauacuugaauagaguaaaaaacuauagucuuuuuuuuuuuuuuuuugguuuuucaagacagaguuucucuguguaguccugguuguccuggaacucacucuguagaccagacuggccuugaacucagaaaacucugccuccaaaaugcugggauuaaaagugcaccaacacugacuagcuaaaaaaacuagagucuugaaguuguuuuaaaucuguaaugacuaucccgacaagguggcaguuacauacucauaaaacccugcacucaggaggcugagguaggaguagauugcauuugaagcuagccugagcacgacccugucucaaaacaaaaccaaaccccaaacaauaacagcaaaaccauaccacuuaaaaguaagcucucagccaggcgugguggcgcacaccuuuaaucccagcacucgggaggcagaggcaggcggauuucugaguuugaggccagccuggucuacagagugaguuccaggacagccugggcuacacagugaaacccuguggugaaaaaacaaaacaaaacaacaacaacaaaaacaccucaaaaacaaaagagaaaaaagcucucaauuuucuucuugagaauauuuauuaaguggccuuugacccaauuuccucaucauuagguggaaaucgucaauuucgaaguggcacacuauggcuugguagcagcauuucaugcuguuuuuguauacuaugguaguacuuucuacagcguauuauuaacauaacuuaucuacgcucugcagcugaacaacaaagacaaacaggauggaaggagaccugagaggcuccacaggaaagggaguucaaaagcagggaaagauucuaacugagaguaacugcuuaucccucccucccucucuccccuuuccuuccuuugcuuuuacgagacaggguuucuuuguguagcuuuggcugucccaaaacuaacucuguagaucuagcuggcugugagcucacagagauccaccugccucugccucccaagugcugggauuaaaagcauucucuaccaugccuggcuugcuuaccucuuuuuguuuaucuuuuuuuguagaaucaucaaauucauccaguuuauuuaagucuaaaaagcagaaaagguuuauugaguuuaauuuucugcuuacuguauuauuuccauccuaaucuuguugucagcuagcaaauggggacaggaggaauauacugggacuuuagcaaacuaccaguaugucagccauccuucaugcaggagcuggaaacaaagagaggcaugugcacaaugcucagauaccaucucaucacucuucuacaaucucaaacacacuuaguuaucugugcuacauaaacuuccacgucaacauucucuucuuuacaguccugaagccugaucaaaccuagggauuuaaauaagguuggcaaauccuuggcuggccuggccuagcuuuguagaccaggcuggccucaaacucagauccaccugccucugcuaccccaagugcuggaauuaaaaguguacaccaccacacccagcacucauguauuuuuuuacuuugugauaagguuucucuaaauugaguagcuugacugacacugaaaucacucuacagcucaagcuaacaguucuucugccuuggccucucaaauaguuuuacaaauagauuauaggucugugcuuccaggcuuagcucaaacuuaaucuuacaauuuuuacaauauaacaucuaucuuugacauuuuagaaccaaaguucucuccaaccauauuagaucacagcuuuaauguauucuaacucaaagcuauauaaaaccaagagacaacugauauuuaaauauagcaagcauaugcacucaauuaaaaacaagcaacagacaagaaugaauuaugaaaacaaacaccauucagaaauuccugaacaaauucaagagcagauuuuguuuccagaggcucaagccauucaguuacaccaguccugaugccaucagcuaaaaccuguaaaacagucagaaaacauguuagcugaaaucauagucuaauuaauagggauauauuuaauaguaucaaguaagguagcaguucuuuagaacaauuuucuuugugacuuauuuauuucauauauugaguguuuugugcaccacauauaguaccuagugcuuucagaacucaaaagagguuacuggaucuccuggcaauggagcuacagaugguuaugagguaccaugaggguacuaggaaucaaacccagguccccuggaagagcaacaagugcucuuaaccacugagcucucuuuccagcccucugguaagaguucuugaauguugacuacucacuagacauugucauaggauuuuguauguaguauguuuuuuaaucccaacaaaacucucugagacagauacuacuauugucuucauuuuauuaaggcuaagaaagcuucaguaacuagcugaaguuacuaacaaacaguagcaggauauauauccaccagucuggcucuaugaaugguauucucaacuauaaugcuaugcacacaggaacuacaugugauccuggaaggauacaauacaacugaggcaacaaugaaaccacaaaugugaaacugaaagcaagauuauccaaacacaauauaauuacacacauaggcacacacaaaaaauguaagcacagugaaggaaaggcagucaagacaggcuacacuagcuacaggacugauaacgggaggauucugucugcugcaacagagggggaggaucaugaggaaugacuccacccagagugaacaaacagcagagaucagaaggaacagagcaaaagacugagaaacuucacaaguuuuuuuugcuucacaugagaaaugauauccacuauugccauuguaauaaaaugacaggaucaaguaauuagcacuaccuuuauuuccagggaaaggaaaaaauguuucucaacagaaaagagaucacuucauacuuacagaggggucuaugcaaaaugugaagauaaucuguauguaucagaaugacugagauauuuaacuugguggaggucagagaugguaaacauauugcuauguguaggaugguucaaaucacaaggaauggggcagugugaaaugccuagugucucuauugaaaaacaaugcauguucuugacagugugucaaacaaaggugaaaggguuguaaguguacaguaagggccagugaaacggcccagaggguaaaugugcuuauugccaagccugauaacccaaguucuaucuccacgauccacaucuaggagagaacugacugucacaagcuggcuucugacuuucugcacaaauacaugcuacauauaaauaaacauaauuaaaaauaaauacacaaaauaaguaaaauauaauuuaaaaaggcauaaagggggcagacaaaaggacaaaaagaagaguagaagagaaagauagcaacaaguauguguaagaaaauugcaugcauuuauaaaauacaacgcuggaauuuguaugugaugugauagaaucacagggcccgucucaacagcacacuaggccaaggaagugccguguagaagagguuuuacugggagagugagagagacaagguagcagcagaaaaggaagaggaggggagagagugugagagggguguucuccuuauuuauauggaaaaugauacaacacagguaaaggugggagguaagucaaguggaugcugggaauauggugucugcugccuuggcaaccagucugcaggucgaagguccuguuguuaucuauguugugucauagguuugccaacaguguguguguaggagagaguaugguuuaaauacuguugccauaugaccuaauaauuucaccagagaugcagaaaacauagggucacauaaaaauuugcaucaauguucacagcaaugucauuucuaauagccaaaaaguacaaaaaaaaaaaaaaaaaaaaaaaaaagagggcuggagagauggcucagugguuaggagcauuaacuguucuuccagagauccugaguucaauucccagcaaccacauggugguggcugacaaccaucuguaaugggaucugaugcccucuucuggugugcugaagacagcuacacuguacucauauacauaaaauaaauaaaucauuaaaaaaaaaaaagaagaagaagaaacauucaucagcugaugaaaagaacaacaaaaugcaguauauccauaaauuagaugcuacuuagcaaucagaagcugugaaacacuguaagcacauuagcgugugucagagacuggcaagguugugaagugcgugcuaaacaguccuauggacagaaggcugagguuaggaguaaugaaacuauuguaacacuaaucguggugaugcuauguacaauucagccaguaaaguagaaaggcagaguguagcuauuaucauuuugaagacagcugccauauaaauaccugugcaaauugucaagacuauagugagauguaacauuuuuuacaaaauuuuaaagaaaaaguuauguugugaaacaauuuucaugacaauauguaauucaaugaaagaaauuccagaaggauacucacaaggagaaauuucaguucucugugaagaugacucagacaaccucuggacucuccugauuguacucugauauucuaaaaaguaucaaagaucauuaguuuucauuggcaaccaaugugcucugcccaagagucacuugccugucuucuaaagcagcaguaaauuaagcccacaccacaaucagggccaucucaucccaaggucuuacagaucuggcucuccugacacacaaucucaaucaggucacugcccuuuaucguaucacaaagacagaacagaacaacugucucccucacauggucuccugccuuuccucagagaauuuccaagaggacagguggaaaaaauuuaaauaaauagcucaaaacucagugacagucaguauuaugacacacagaaaaccaagucccaauaaaucaguguguuagccuacuaacuaaaccaacacacaaaaguagucuacccagaagcuauagcuuuacaaccuuaaguccuuaaaagcaaggaagcaaauuccuacuacaggagaagaaaaccaaaaaauauaaauacccauaauccuacccuauaggagaaccgcuguuaacaugaugaaggcuucuguguauacacgucuuuuuuuuuucuuucgguuuuucaagacaggguuucucuguauagcccuggcuguccuggaacucacuuuguagaccaggcuggccucgaaaggcgugugcuaccaccacccggcucuuuuuaacuuuugcuuaaaaaguuucccugcuuuuuuuucuguucuccuagagguucugcguucaauucccagcaacuacaugguggcucacaaccaucucuaauggaaucggaugcuccugguguaucugaagacagcuaaaauguagucauauaaaaccaaaugcccccccccccccccccccccccgcacacgccuuuaaucccagcacuugggaggcagaggcaggcggauuucugaguucgaggccagccuggucuaagagugaguuccaggacagccagggcuacacagagaaacccugucucgaaaaaccaaaccaaacaaaucuuaaaaaaaaaaaaaucacugaaauaaaucuuacaaagagcguuaucugagaacauaggucagagggagaagacuugccuauuaugcuagacauaaucuccaauaccaaaaauaaucuuuucuuuaaauuuuuauuuauuuauuuuuuuaauguguaucaguuuucccugcauguauuugugugagugugccagauguccuugaacuugaguuacagacagucaugaacugucaugugggagcuggaaacugaacccaggaucucugaaagaacagccaguacugagccaccucuccagccccaccuggauuauuaauauaaucuuaauuuuaaaguaucuuaucaugauacaccuuacuacuuuaaccauuucuuauuuuuugacugaauguucaacagguucuauucuuaauauuuugagaacuuaagcuuuuuguuagcaauuuaaauuucuuuuuuuccuuuuuuuuuuuuuuaaaugauuuuagagcuuuauuguagaaaggcaggggaaaagagagaaaguagaaggagagagagagagagaguggccauggccacguggagagagggggaaggaaaagagagaaggcgggcuagagaguaagaaaggaaagagcuuaaagagguuuuuguuuguuuguuuuguuuuaagacagggucucgggauguagcucuggcugucuuggaacuauguagacuaggcuggccucaaauucucaagagauccucuuggcucugccuccugaguaaugggauuaaaggcgugugccaccacgccuggcuugacuucucuuaagucaccaggaaaagagacugcaaucaucucuuaaaaguaaagcuccauaguaacaggacuguaagcgacugacagcucagcuuacuuggcaaucuccauuaguugucuggugagaccucggaagucagccaagauuuucugugugguacagccuaacacccagugaaugucaaggcugaaaguguacauacagcacuagcaagaaacacguaaugugccacucaggagccugagcaaccuaagagaagacaggguccauuccuaccagagcugcaguugaagacaggggagggguuuggagcaucucauccacagggcuccaggaaagguccagcgugacuguaguuugugauggggcaacagugucauccaagucgucagacuuaaagagcucauacugggcaaagccucuggcugucaccugaagacagggcacaggagagcacagcaucagcuucaaaccaaaccauuaucaaaaucaccuugacuucuguccccaaaggggaaaaaaaaacccuaucaucaaaaugagaaaaaaaaaaaaaaaagacaauucuuuuaagccacaaacauuagccaaaagagggagcacauauaaagcaugugagucccauaucugaggacugagcaugguccuacaaccaaccccccagagagcaggggauaacucugcccuggcugauauaagaauaaagacaaauacucugacacgacagagaaacaucuagucauagugagagaaagaagagagcuguuaagcguggacuucagaucaacuaaacaccguguaaguagcuaguaagacaaauacucacagcagacacgugaugucuuuucuugugugaaguuuuuaaauuuuccagaucuucagaguaauuuuuaucagcuacaggacaugagauaacaaagaaaggaaggaaggaagaaagaaagaaagguugauuuaaugccaaauuauacugcuaaaacuagaaaguuauguuaggugguggcggcacaugccuuuaaucccagcacuuggaaagcagaggccgggagaucucugugaguucaagccuagccuauagagugaguuccaagacagcuugagcugcagagugagaucuugccucaaaaccacaaaaaaccuaaacaaacaaacaacaacaaaagguguuaaagagagaaagaaaaagugggguucagugguuagggaaaggggagagaucugaaaguuggggaagaggaaacuguggucagaauauacuguaugaaagaaauuuauuuuuaauuaaaacaaaacaaaagaaugcaauagcuuggcaugauaacacaugcugucuuuaaauccuagcacucaagaucucuuuaaguuccaaaccacucuggucuauguacugaauucagggcuaccugggcuacuuauagugagaccuuguuuuaaaaagaauauaacuaaagccaagcauggaaacucauaucuaaaauccgagcuacucugcagacugagacagaaggacauugaguuugagacaagacugggcuauaaugacacuccacaauaaaugaacaaaacaaauguacacaucaagaaauauuuaugaaaaauuaaauagcuaggcauacugguauggacuuguaguccuaacugcuugagcccacguauuuaagucaagccugagucauaaagaacuaauguuuaaaaaagaaaaagucuguguggugguauucauguauaaucaugaauaacugagcuuuauacuauggcugaaacagagaauaaguucaaggacaacuuugccucaacccacuccauccaaaaagguaauuuuuaaauuaaaaaguacaaauuaaauuaaaucccaacaaagcagacauaaaacauuugugaguuucuacaauacccccucccugcuguugagcacaaacuuaagguucaauguuccauguuucacucccguccuauauggaagcccagaaaucccacuaaacagcuaggcaaauaaacauacggagacugagcacugaccuuuacaagugagcacauacaggauaacgccugcaaugaugucauuuguugugauaagcucagcuccuagccaacagguaccuucaggaucugaaccgucacaucucacccaaagaggaggaagggcugucacuggcugcuuaaucuucagaugagucauauuaggauugugagccaugguauagagcccaauuaacugccuugaaaacaaggaauaggaaaacaaauuuuaaaauggcaacacauauuaucuuugaagcugaaggugcggcucagugacagaacacacgcuuggcgcguggggaacacugagcucaagccccagcaacacccacccucacacaaacaacaaucuggaaaugaagaaaaaaaugcauaaauacauguauguuuauauauuucagcaagaggauaauaagguaaaauauauacucuaauagcuacaagucuagagagauguuuuagcaguaaagaacaugcauuacucuugcagaagaccagaguucaguuuccagugcccacacuggguagcuuagaauggccuguaacgccagcacuagaaauauccaauacuucuggcauucauagaagccuuacaugcacauaccaugccuagccccuccuuccucccucucucacacacauauacacacaucugcauaaauuaaacauuuaagguuauguauauuggguauaaaaauguaucauauauaauuaugacaauuuaacauacauauguaccauauacugcuuuggauauauaaaucuauaauuguugaaagagaaaaugaaugacaacguagacauaucaaaauaacuguuuuugguuuuuuuuuuuuuuugguuuuucgagacaggguuucucuguauagucuuggcuguccuggaacucacuuuguagaccaggcuggccucgaacucagaaauccgcuuguuucugccucccaagugcugggauuaaaggcgugugccaccacugcccggcuguaacugguuuuuaagguauauagaaguuaccauucaaaauacauaaauauauauauauaucaaaauuaaagaucaacuaaaacaaugcagccuaaauuucuuuuuuucaagagauagaaagaauuuacuaucagauauuaagaaaggaaguucuaaggcauucaacuucaaaaaguaaauacaaaaaucuuaaaaucuuagggugauaugaaaggcaugaagaaaaaaaaaaaaacaagaaaugcuaggggcuagggagacagcucaguugauagugucugccuugcaagcuuaagaaccugaguuccaucuccagaacucaugugagacaagcaugcuggggaaaguuggccuacaccuugaucccagcacucaggaagcagacagguggaucucugugaguuugaggccagcauuaucuacaaagugagaucuaggagagccaggguuacacagagaaaucuuguuuaaacacacacacacacacacacacacacacacacacacacacacacacacacacacaacuuacauccucagccccaacaauguuuccaacucaaauccuaucaaaucccauucucuaucccuaacucuacacuuacaaaaacaaaacaaacaaaaaaccaacuuaacuaccgagaagugguggcacacaccuuuaauuccagcacuugggaggcagagguaggccagccuggucuacagagugaguuccaggacagccaugguuacauagagaaacucucucgaaaaaacaaaaaacaaaacaaacaaaaaaaccaacuuaacuuaccuugcucucccaacagguaaggccaguggccuaauauuuucaccagcagagagaucagaaauagcaguuucuucagacugcaguucuucaacuugacuuguuucuuccuucuccaaaaccuuuaaaaaauguuuuagauuacuuaauaagauguaagagucaauuaucuuuuguguuagaaaauaacuacacagaagguuggagagauggcucagcaguuacgaucacuggcacuagaguuacaggcaauagugagcugcuauguggaugcugcaaaccaaaccgaguccuuugcaagagaagcaggugcucuucaccaccgaaccaccgagccaucuuucagcccucaaagacuguaguugcuuccuguaaagggagaaucugaugauggaagaaaagugcuguaacaagcucaguauugaugagcuaaagguaaacaucacaggagacccuugggagaugcccagauauguaaguaucuuucauuucccaaauggaacaaccuguuucugugauaugagcgucgaguacucaguccucaauuuuaccuuguuuauucaggaacaagguccuuaugcugggaucacagguaugccguaccacacucagucauaguggcccucuacucccaucuguucguuuguucauuuauuuauucaauucaauucauucauucauucauucauucauucauucgucaagacaggguuucucuguguagcccugguuguccuggaacucacuuuguagauccaucuaccucugccuccuaagugcugggauugaaggcauaccuagcuuuguuuuuuguuuuuuguuuuucuuaauggaucuauuaugaaaguuuguauuauguacauaucuaugguuggcauuauauuucaguagaaagcacugugcuuacuccuaaaagaauguguacacuuucauuaacaggaaaacaguagcacgaaauuauucaaaaaaaaaagggcaaauguggcuacuaagaauuagcgacaacgcccaauacuuaccacuuuuuccacgagaaacacugagucauuuucauuuagaauaguuuucagaagacuugguuggccuuugcugaucaacugcacuuguacaucagccugcaaaaaacagauugcaguguuucuauauuuaacuacuacagaccaguuacgugcaaauuucuaaaaaggaacugugcaaaauauuuuaaaaggguucacuuauuuggccaugccauuucucauguuuagaaaaccugacuaaagguuugcuggugagauagcucagcgguuaagagcacugacuguucuucugaagguccugaguucaaaucccagcaaccacaugguggcuuacaaccaucuguaaugagaucugacacccucuucuggugugucugaagacagcuacaguguacucauauacauaaauaauaaaaagaaaaccugacugcaaaaugagcuggagaaaugguucagcugguagaguuuguugcuuacacacacccagguaaagcugugcacagggcauggaucuguagccccaguccuggggaggcagaaacuagauacuucuggggcucgcuggccagucaguacagccaaguagggaguauuaaguaggagacccugucacaaccaagguggauagcaauucaguuucugaccucuggccuccacauguacccauaggcacauguacaugcacauacacagaaaauguagcuuauuaucugcccucuauccaaacaugaacaucuaccugaaaauggcugccuuguaaagucccguuugcuuauaccuucacugacaucuuccuuuaaucacaguauaauguagaaagacuauuauccuuucuucuucuggacuauaaaacuguacaaauuuaguucacaagaaguaucuucuuguuuccaauguacuauacauacauuguacaaaaacauaaaagcagccuuuuacuuuucuucuucuaaaaacauguacuacauaugcacauaugacuguguguguuccugggcgcacauguggggguccaggacauucugcaggagcuauucuccccuuccaccuccauguggguucuggggagucaguuauuguacucaucuaauagauaagccaguaugacucacauauaaagaugacauguucuaaugguuucacaucaugaacuuuuuucccuguuauuaaggaucuguggauaacuaagaccacagcugguauauagcaauucuguaaauguuauuuuuugguaguuuccaguuaaguguuguaauaaaacaauagacaacaaacauccaugaauuacuuucuuagaauaaaaaccuaaaaucauauugguacaaucaaauugcccuucaaauaugucagaaaacccagucaacacaaugaauauuuuuauaucaguacaggaagaagaaauuagauauccugaugaugaguaucaaacuuaccccaaggaacucaauguccguaaucaucagaacgcaguccaauaauaguguugccccccuuccucucuauccuuuuuuucucucuuaucuggaauuagggauuugaaaggguggaagaaacaacccacaaaguagccaaagacuacuuucagagaaccaaggaugcugcuaaucuagccuuuaaguuucaguuauucuaggccgcacugcguucuuuaaggauacccggaagcacuaaccucaauccuugugaaccugaccuuauaugcaaaugcaaucaucaagcagaaauuaacugaguuagggaguagggucuagacucaaugacugcuauucuuacagaagagauucagagauaacagacacaagggagaaaaaaaaaaaaaaaaccuaugcgccuagggaggcagguguuggggcaacaccaugacuucuagaaaccacaagucaggcagaauccaggaaggguuguuaccugaagccuucagcaggaguauacccugccuauaccaucauuucacaccucuaguccucaaaacugagagaaucaacuucaaucugaggcugcccaacuguacuccugucuacugcagcugugggagaagaacguggaccuuggucaggaaggacucagagggggcacacuugguggggcugugcguguugaguuugcuuagugggaacucugacagugaaagagaacugcacuugugcuuuucagucauguccuuugucuuuucuaucacaguuuuugcccuuccuggugauuuuugauuuuuuauaaauauuuuacccaugcaucuauauaaauguagauauggacauauguauuaaucuuuacuaauaauuaguucccccucuuugguuguuuuaauuugagauaauuuauuuuuauuuuacauguauuuugccugcauguaugucugcaacaugugugugcccagugcucucagaagucauagagggcaucagauucccugggauugggaauaagagacaguugugagcuacagugugggugcugggacugagcaacaacaagugcuuuuaacuacugagcuaucucuccagcccuuagacuggcuuuuaauaauuuauugguucuauguaucccagauacagguuuuauauucccuccugugaggaauuuaacuauggaacaucuaauacauagcagacuuuuuuuucccaagacagaguuuccugguguagcccuggcuguccuaaaacuaguucggaagaugcugaccucgaacucaagaaucugccugcuucugcuucugaauuuugggguuaaagcuggaugacaccacacccagccaagauucuuaauaaaucuauaagcaaccguauucauauuuguaaaaucuggaaaccaccuaagugucuuuacugaaacauagcaacaggaugaaucucaaaugcauauauucauuuaaaaagcuaacgcugcagggcagugguggugcacaccuuuaauccuagcagaagaaagaaaaagaaaaccaaagucaagaaaccauauauuuuauuuacugacauugggaaaaugggaaacuauggagagagaaacaacugagcaguuguagguauagagacauaugaaaaugcuuagauagggacaugggcacacuuuuggacagguaauacucuacacuuugauaacagacauggcugcacuccugaagguauuucugaaaauucauagaaccaucuccuaaaagggucaaauucauccuauguaguuucaaaaaccugauuuaaaaacacuaugauuuuagggucauuguguuuaaacccaaauaaauugcucauaccucauagaugaaugggucuuuagaggcuccuuucuucucuucauuaaauucccugaaaugcaaaaccacaugugaaaaacagcugcaggaucuccauuauuaaacucagagaucagccaguacuuuuauuuacacauugguggagaaagcuuacaacagugcuaaggauagcugcagaaaggaaacaauucgguuaaggagagauaaaggaggguggcauggggagugggggugaggcaugcugcaaucccagcaaaagcaggcagaucugaguuccaggccagucagggauacauagugacacuuuuccucagaauaauucugggaaggggggggggggaggggagggaagugguaucuagagacauggcucaggauuaaagcacuguugcuccugcagaggaccuggguucagaucccagcacccacaugauggcuuauaaccuuaccucuaacuccagguuccauuguaugacacccuuuucucugcaggcaccaggcaugaaccagcccacaugcacacacauaggcaaaacauacauacaaaacaaacaaacaaacauaaacaaaugcuuuugauuauguguauauauguaaggagaguggguaaugaaugugcaauuacccaagagggcacugcucuagagcugaagugacagaugacugugacaccugcugugggcucuggcaaccaaacucugguccucuggaagaguaguaagugcucuuagcaccugggccaucccuucagauucauuaauuuaaaaacaaacaagcaaaccuaaaaauguaacugcuggagauggaauacaccuguauuccaacauuugcaaggcugaaguaggaaucugacaaguuccagggcaacucaggcugcacaauugggagccaguuuaaaaaacaaaacaagccgggcaugguggcgcacgccuuuaaucccagcacucgggaggcagaggcaggcagauuucugaguucgaggccagccuggucuagaaagugaguuccaugauggccagggcuauacagagaaacccugucucgaaaaaccaaaacaaacaaacaaacaaaaaaaacccaaacaaaauuaaacuaaaaagauaaaagccucuaauauaaauuuaaguaucguuuaagaaaguuuuuaugggcuggagagauggcuuagugguuaagggcacagaaugcucuuccaaagguccugaguucaauucccggcaaccacauggugacucacaaccaucugauggucucuucuggugucucugaaggcagcaacaguguacucacacauauaaaacaaauaaaucuuuaaaaaaaaaaguuuuggggcuggugagauggcucaguggguaagagcacccgacugcucuucugaagguccgaaguucaaaucccagcaaccacaugguggcucacaaccaucuguaacaagaucugacucccucuucuggaaugucugaagacagcuacaguguacuuacauauaauaaauaaaaaaaaaaaaaaaaaaaaaaguuucuagccaggucguggcccagauagugaggucuaaaaaggaaaacccugccuugaagaaaaaagucugggacuuauuaaaaaaagagagagagagagagauuugcccuuuuaauuagggauuuggggugagcauguaacuuuagaggccagaauaggacacugcacccucucaccacagcuggaguuguggagagcuguggaucaccagaagucaccacagcuggaguuguguggagagcuguggaucacuagaagugcugcucuucacugcucagcugcuucauaaggcauuuaguagugaucucaaaguacacaaauuauaaaacacuggccgacucaaauaaauuaccaaaauguauugccagccugagcuauagggaaaguagcucuaguuacugaaagagcccaacaguuauaucagaauaguucgcaucuuuugaucugauacuugaccuaauugaucuagaaacaaaaaacaagccugauaggucaacuuuuguuauauugcacaagacucuuuacuauauuuauuuaagcauguauguaugugugguauguguguauuugucaaggucagagaacaauaugugagauauuuucucuuuccacuaugugggccccaugccauguuugguggcuacugaaccaucucucuggcccaagauauugcuugguuauucagcaauuguuuaucaaacacucuagcuaguuccuggggauagcaaacaaaacuagucuugaaugaauguagaguaaacuaccaguuauaggguacugagaacucugagaggacaggaacugugaaucacuuguaacauuucagagacaugauuauggcccaaaacagaacacuggagaugggcaagaacgagacuugucuagcaugcacaagacccccaccucugauccucagcgaagaauuaaaacaacagaaguggcugggagucugggaaagaugaaaagaaagaagcuggcuggucuuuuaaguuuaggacucuuaacuugaagaauucuggaguuaaaugccacaucggcaagaaugguaauuucuuccuagguuuguggugaagcccuggagaucaccaagaaacuucaguaggcacggagagggauacaguaagugaaaacuucuagaguuuaugcauggaaagaugaaaacauccaggaaagaauuaguaagcauaaaggaucuaaauaaauuuguaucaauggaggugauaaaacagacauaaaacaaccauagaagcugagaacauaacucgggaauaacagugcuugccuaaaaugugugaagccauuuccagaaccucaaaagcugggcauaaugguacaugccuguaaggacagcacauuggacaccgggccacgauguuuacaaguccaaacucagagaucuuggguuuaaaacaauaaaguacuuaacaccauggcaaaauaccacaacaguuaaaaacaacucaaguuccugagcucaaagacauuagcuucuuuaaaaacaucaguuuuguugggcgugguggcucaugcuuuuauucguagcacuagggaggcagaggcaggugaauuucugaguucaaggccagccuggucuacagagugaguuccaggacaaccagugcuacacagagaaacccugucucaaaaaaaaaaaaaacaaaaaaaaacaaacacaacacaacaacaaaaacccaaccacuaaaacccacuaguuuuagcugggcagugguggcucccgccuuugacccccagcacucugagggcugaggcggccggaucucugaguuccaggccagccuacucuacagauugaguuccaagacagacaggguuacacagagacacuauuuuuuuuuuuuuuuuuuuuuuuuuugauuuuucgagacaggguuucucuguauagcucuggcuguccuggaacucacucucuagaccaggcuggccucgaacuucgccugccucugccucccgagugcugggauuaaaggcgugcgccaccacgccgggcucugaaacuaucuuaaaaaacaaaagcacauuaguucuuuuccuguaguagugaaaaauuauuacugcuuuuguaaacaggaggggcaauaauggcaguuaaaaaugauagcauuuagagacuaaugggcuauacccaacuagcaacaccuugcaccuagaauuaaaguuuuuugucuucacaucaggccuacgaaaucaaaaaucucagaggcugagccagucaauguauauuuuggcaacccugugggugauucugaugugagucgcugacuuagauuuucacacaggauguagaaguugacagaauuucacugagggaacacagugaauuuguggcacggcucacgccucucaucucggcaucaggaggcugccgaggagggucgaugcggauucuguccguuucugagcuugaggcccgaugacaucuagcucucugugucccaggagccucuacuuagaagcguguacaucaguccaauccguacacugcuuugccaucuugccucccuuggguaagcucggguguuuucuccggaggccggcaguagccuaggccuccgcagagcccuggcugccucucacaucccagguccaggaaagccggcagccagcuguggcaaacaccaccggcaggggagggacaaguaccaucccauuccccaaccacaacucacugccggagacgagcauaaaacuccuccgccgcgcgguucauucgcgaccacauaccgccguggccuccguccauugcuaagaaguuaaacugaacugcgcgcccagacaaugacgucagaggccaugaccccgccccgccggaacuacuucacgcuuuaaguucgguuuguacucaacgcuaacacauugcuuuaauuuaguagagcauccccucaauuuacuauuccaaaagucucccauuucuguuaggggggaaaaaauggacuaaaagagauguuaugaugagg

SEQ ID NO: 5164 - RNA, 3825 nt, Mus musculus
cggugacgucaucaccgcgcgccuaguagaaggcagcgcccuaaggaaguggaaggggauguugagucgacugcaggagcuccgcaaggaggaggaaacccugcugcgucuaaaggcggcucuacacgaccaacugaaccgccucaaggugagcguacagcuuuccagcucuagccccucgggacgucgacggagcgcggcgguacagcuccaggccgcuagguguugagcagguuuagcuccugagcccgcaucuaccccgacccagcacgccggcucacggguuacugcuguuuauaugcacuagagggggcuuuaguguugucaugcuaguacugaaucucagacccgcuugaggcgcgaaugaagucugggaaagaaacuuguccgcuugaguucccaguaacucuucugggaacagagaaugacucggaugcagauuuaggugcgcuuugaucacguccuagacauagggguaauuuggucccugugaaaugaucaugguaaucccuggucagcacucaugggcaagaucuuuaaauguaagugacaugaggauuagaggagcccuuuauaaacugaacuuguauacuugugguaaaaaaacgauaugcaguuuuucucagggcauuuauaaacugcccacccuuauugcaacagaaccucuuacaaguacaugaucguguguugaagaugaccucccaaacgcaguuacccuggugcaccaggaaacacgugcauuuuuuaacauucugccuuuacuuucucauuaaugaguagacaagcucaaucauaggacauccaucugugucuguggaaccagcugucuccuggggugagggaggggagaaguggucucgccuguguaacccaagcaugcuuugaaccuaguguguagcucagguuaguuuuaaacuuaugauccccuugccucccacauuucuaaccuuaguguaguggcacuugccuuuaaucccagcacuuuggaggcagaagcaaguagauaucuguaaauucaaggccagcuuggucuacugaguuguaggacugccaguguuacaaagaaccucuucauagggaaagaaaggggugaggagguaaagcugcccuccccuucuagagcaguucagggaugccaaccuauauggcaucuaguggaauucacucacuauaguaacccagcagaauacucagugaaauaaauaucuuugacuuuucuuuccuagguugaagaauuagcccuucaauccaugauaaauucucgaggaaggaccgagacacugucuucucagccugcaccugaacaguuaugugauguaaguuuagucaaguacagacuuccagagagaguguagagucccauugugcccgagcucuuugggcaggcaaaugcuguauggcacauuauuaccaaguccaaaggacucugggaaguaccauucaaauauuugggggccugggcgaauuuauuguacacugaaccuaggacuucauacaagguaagcaaguacgcuaccagugagcugcaucuccagccccucauaauuuguaguucaguaauuagcuaaucuauauuaaucauccagacaauagcaaguacgcuaccagugagcugcaucuccagccccucauaauuuguaguucaguaauuagcuaaucuauauuaaucauccagacaauagcuuaucuuuuauacuuugucaaguuuaggcagccucuacucuucuaguguacaccaauaugccucgccuacccaggucucagauuacuccauccuuuccagcuacucaaaggaaccccaacaagcuagcagugguuguuguguguuugugguggggcuucuguugaagcagugucuuuuguacccaggcuagccaccguauguucuucucuccuccugggauuacaggcaugugcacucguauccuguuuagaaacucugcucucuuuaggacuaugucauggucgcugcucuguuaaguguggcuucaaguacaaagcuaaggaugaggugcagguauuacccuacucacgcuuaccaacugccuucaacagagccaauacaguguuccugaauauaccgugcuuugagaauucuuuauaagcuauguagccuacacaguuacuuuacugaugauuucuaaaagagcaugguagguaaguuaagaucauaguaaacaugaaggacuuauucucaccgcuuuccaggaaugggagaaacgagaaagaggaaagucauaaaaagaugaaccuaaaauugaacuuuaaagauauuuuuauaggugugugugaaugcaaguucgucuccauugaacaucagacacccuagaguuggggcuuguagcuauccagcauggguauuaguacucaaacuuggaucuuuuuggaaaagaaacaaguacucuuuuguuuguuuuguuuuuucuagacaggguuucucuguauagcccuggcuauccuaaaacucacuuuguaggccaagcuggccucugucuccugagugcugggauuagacgugugcaccaccaucaccuugcaggcaacaaguacuuuaacugcuaaucauuucuccaacucaugaugagauuugauuuuaaaaagaauuugcugggcuggcgagauggcucugugguuaagagugccgacugcucuuccgaaggucccgaguucaaaucccagcaaccacaugguggcucacaaccaucccuaaugaaaucugaugcccucuucuggagugucugaagacagcuacaguguacuaacauauaauaaauaaauaaauauuuaaaaaaaaaaagaauuugcuguuuugaggcuuaauucuaaugcuguuauucuacaguaauucuaaugcuguuauuuugcacagaugucccuacauguagacaacgaagugacaauaaaucagacuacacugaagcugagcacaaggagcccuauggaagaagaggaggaggaagaggaggaggaagaggaggaggaagaaucugauucguaaagggggaucaagggcaggguaguuauacaaacuaagucuugggugcuucaucucuucaaagucaucuugcagggccuaugugaaagauaaacuuaugaauggaagaggcucagcccauaaaguaucuauauucaaauaugaagagcugaguuuggagccccagaaucuguguaaaaacauagagugucacaugccuguaaccccagcacuggggauaggaagaacaacagaucccagaagcacacuggccagccugucuagccaaaccagugaguucugauucacucagagaccugucugaagagaacaguuauaauggcauagaggcccagcacaucucaaucccagcacacaagaaaagggauuaaauagcaagcugcaaaaauaaaaauuuuguuuugauuuuuuucugcuacaauauauaaaucaguucaauuuuacuaccagaggaauggggaaaaguagauaacaucugaucauuauguaaaagaucauacagaguuuuagccaacuuuggcauuuacauaccugcauucccaagcuuugggaugcucuagcaagagagauugacaucugcugugaagccagccuggaggagaaugaaaacaaagcacaaugaaaggucuuaccaugguguaaccacuagaguauuaggcuaagugagaucaauuaguaacucuauuccaucucucuucugaaaaagacaaacacuauacaaauugaccuaauuucagucauuaccaggggcagucacaugggaugugaugagaggcagaaugucaggugugacgguccacacagcaaguuccaggacagccaggacuacu

SEQ ID NO: 5165 - RNA, 26152 nt, Mus musculus
cuauucgcugccuccggguucccuuaugucgcacggcccuuaaguuccggcuauggcgcgcggacggaagguuuaagcggacggacagaggcuggagaugggcuccggguaagucagggaaugugccuguugagggcuguguuucgauggcgguugggguuacaggggaaggaguggaaggaacaacacagggcgggcggcggaccuucucugaggcccgcguaggguggcggucucaggggcgcuggcuccagggccugcgacaggccugcccucuguguggcccgggucuuguaagcagcaggauuccgcgcuuggggccguguuucuuccuccccugagagucuuccgucccuggacccugagacuuccguccccucuuuccccgagaguuccauacaacaaauguuuugggcucguuuuaaagguaaaggucuauucuucaguugcagucuuaagugaacucugcugcacuucaggcuacccauucagauauuaaucaucugagaauuuagaggaauucguagggcaagccagagcgacagaaaagccgacguguaugcacuuagaaacugaaguggagcuuugagagauuccugagcgucaaauugcuaugaaugggcuaaugauccccuucagaguagaacuauaaauguaauugauggcuuuuagagcagucauguggcgaggauguaucaucaggaguagacuguccaggagaaagaaaacccuugguuaucugaaacauuguaaaaugguaccaauuggaaaggcugagggcgguguggggaaauuugaucagagucagcccaagugagaaauacaucguguuaucuacuaaugagagaucuuuuauuuuucaguuuuguggcuaagcccagacugcuugagugaaacagccuucagggacguuccauucuuucguuuaucccagugcuuacaacccaaaaacaaaauuggauugccacaagucggccacggcugaggaagugcacucgggcccugacacaaaugcaucagucaggagaaagagccagcuucucaggugucuucagagaaggccagacugacagcugcggucacccauugcagugcuagcagcaauuucauggacuggaagugcuuguugguacuugauccagaaaacuguuucucaaucucuuaagaggugagggcgugaucaucagcuuuaaaaaccauaaaggcuuccgugcauaaaugugacccacaagagcuggauaaacugcaccugagcagaagugcaggacucccugguggcucugcuuaaauaagaaaguguauuuuuguguacagaguuaaaauuuacaauguauuuuccuaaugaauuaauguauguuguauuagggguaguucauugguuauguugagauuuugaugagcaccugcugugugccagauguaaaccugaguagacauuaggaagcaaagucuuuuuaaaauuuuauuauuuuuuuauuuuuuuuuugguuuuucgggacaggguuucucuguguagcccugacuguccuggaacucacccuguagaccaggcuggccucgaucucagaaauccgccugccucugccucccgagugcugggauuaaaagugugcgccaccacugcccaauaugaagcaaacucuuauugugauccuugcccuuagugaccucauuuaauacaguucugaacucacuuuuccuaggcagcauggaccuaggaaaaugcuaguauguagcaaaacagggcaguaaugcuuggggguggggggugucggggguggugaggucaugucaucucccagaagagugaauauguuuaacacauuguuuaaugagacagagagagggauacauauuuaauuuuuccuuaggggcuggagugguuccgugguuaagagcacuucuggagacccugaguugaguucccagcacccacauuaggcagcucacaaccaccuguccaacucuagggacucuaacacccucuucuggccucugagggcaccugcucauguauggcaggcgcucacacagauacauacacugaauaaaaaaugaaauuuucuuuuaauuuucuuuccuacugucuaacauuuuggacugguaaagagagucugaaaaguaaaacuuuuuucucuggguuaacuucauugguauuugauacaugagcuguuacaauaugugagauguaucuauggccaauaugugguuaaaaaaaaggcuuuuccuguuugaucugcucuuacauauaacauuguugccaugaacuaguaugugcugaguucccaacaaccuacuuacaaaggaauugcagacugucacacaguuacaguuggacauguacugaagggcagugccuguuguuaaauuagagaacacuacauuuugaaucuguugcaucuacccuaauucuagaugauguaugcaaugugauuuuuuuuuuccuauuuugguccuuugagacaggguuucauauagcucagacuggccucaaacaccuuacauagcuaggaaugaccuugggcugacucuccaccuugcuagggcagagauuauaggcaugcaccucuguuuuuugagacagagucuuacuauauagccuuggcuaucuuagcgcucacuaugaaauccaaacuggccuugaauucacaaaucugugucuuggguacuuggauuaaaggcauaugcuaccuugccuggccuacaaugugauuuauaugaauucgcaugcagccuguacacacauacacauacgcauauugugaagugcuuuuuuuuuuuuuuacucauucuuuauauauaaucuguguccuuuauuuauagcucuauaaaauguuauugacucugcagaugaauagaggaccaacagucucaacccacaugagcagaucugaguaucugggaacuuuauucuugagaaaagaagauauguuuucuccauacugaaucuuauuucauuuuaaauaugaaacaauauucaucaagacacuggcaaaaaaguuagcaguugucagguaguacauaccauauacuggcuagguuguucuucaguaaauuguuaaggaguugaaguaggaguuguguaaaguggaagcuccauagucaaagaauuuaaugaauugaauguaauguucuugguuuaugcugguuagugggugugucuaggagaggcccucauggucaacuaggcuuuguguuuuccuucuccuguaauucuguggugcucaccaccacauaguucugggaaagugguuuaaacugugguugagaaaaaagaaauuggggcuggagagauggcucagugguuaagagcacugacugcucuuccagagguccugaguucaaaucccagcaaccacaugguggcucacaacaucuguaaugggaucugaugcccucuucuggugugucugaagacagcuacaguguacucuuauacauaaggaaaaaacccuuccuucccaggauauguaaacucuuauuucucuuccacagcauuucucugguuguagcuggcugugugcugagagggagugcuagaauuguccaucaugcccacuguggugguaauggaugugucccuguccaugacccgaccugugucugucgagggcucugaggaauaccagcggaagcaccuggcugcccauggccugacgaugcuauuugaacacauggccacaaauuacaagcuugaauucacagcgcuggugguguuuucgucacugugggagcugaugguccccuuuacgagagacuacaacacccugcagguacgcauaggaauaagcuauuguggauauugaaggagcucaaauggacugggagaaaaacaguguuaugauugcuaaaaucaguacaauuuuagaacuuggaauuguuucaaagagcguagguauacaaucuauaacaaaacaagauucacaaggucuuggcuuucuucuggcagagccaugagauaaggauguugcuguauuuuccucucuuggucuucugcaaucugaaugcuaaaauccagcaucuuuauguuuaaacuccacuccuuucugguuuuuucaggacagggucucucuguguaguccuggcuguccuggaacucacucuguagaccaggcuggccucgaucucagaaaucugccugccucugccuccccagugcugggauuaaaggcguguguaaccacugcccggcaggaagcaaaguuucccacacaacuuaggaaacuggaaaauaacccguccuuuuuuuuuuuaaaucaaucauuguuguaaacauuuuaaauuauguuuauccugacaaauaacugauuugcagauaccaagauacacuuuaaaaccuugaccaguggguauugucuuccgggcuuuucuguggugugcuaaacaguuuacucucugacaucuuuaaaugaucaauguuuccagagugcguagcaugguaccaugcccccagugauuagucaguauuuguggaauuaaacugagcaguuuaaaugaagguuaggcaaguuaggaaacaaggaucaguuuagcuuaaacuuaaaaacuauguaugggaaagggcuagagaaaugacucagcagcuacgaguacuuaacacugcucuugcagaggcacaggguucaguucccagcacccacauaguaacuauaaguguuuguaacccaguuucaggacaucgaaaccucuccugaucucugagggcucauacaugcacacacgcacacauuugcacauacaggcacacuaaguacuuuagaaauauauggaaaacauuuguguuaaggcauuucuuacuuuagucccccacccccacccccuuuuuuuucuaaauguauuggaucacuuuagggggauuugggacaggaucuuugcuguggaacccgggcaaaccuucaauucucagucuuccucagccucuugagcacuggcauuagaggcaccagcaugcuugggucuuacgaacuuucuuauaagugauuaagcuuaaggguucugauguucuggagucuguauggacuugcuguaugcaacugggcaaucacaguuaagaucuggagcucuggcaucaggcugccuggcuucugacggcaggcucugccuucucucaccagaaaguuacucgguuguucugcaccuugguuucauuguuuaaaaggaguggaaugacggucagacacacaugcuggaaauggcguguaaaaugugguuaacguuugauacgguugucauuuuugugauguguuuucauuuuugaauuuaguauuuuccuucaagcccacuuagacacaggcuugggacuaauuuagggggcuggagagauggcucagcaguuaagagcacugacugcucuuccaaaggucuugaauucaauucugagcaaucacaugguagcucacaaccaucuguaacaggaucugauaccuccucugcugugacugaagacagugauaguguacucacauacauaauaaauaaauaagucuuuaaaaaaaaaagaaagaaagaaagcuaauuuaauuguuccuuauacugagaaaaaucucuuacuguuuuuguuuaaaaaaucugcuuuggggcucccagaggcacuguauccccuuuguagcauauguacuuugaaaaucuuguguuuucuaauaacgaagagaacgguaaacacuuguaauuuuuaaauuuuuauuuauuuauuuauuuauagacaggguuucucuguguagcccuggcuauccuugaacucacuuuauagaccaggcuggccucaaacucagaaauccuccugccucugccucccaaaugcugggauuaaaggcgugcgccaccaccgccuggcaucacuuguauuuuuuuauucaacaggaagcacugaguaacauggaugauuaugacaaaaccugcuuggagucugcauuagucggcguuugcaauauuguccagcaagaaugggguggagcgauuccuugccagguaaugguagauucuuucuccucgcccugaguaaaaugcaacugcugaggcuucagcauuccacaaaccauauuuuauacuguucaugucuuuugaaaacggcacuaaaugcuggggcuguaauacaguggcaggacaccugccuaacaggcacaaaggccccagguucaagccccaguauuggaaaagagaaaagagagagaaagaaaagaguauaugaaaaaggcaccaagucacucuaacucaucauacuaauuuaauccacuuugugcuaauaugcacaugagccagcaaaauuaugccucaaggcaaacaucuuccuaguaaacugacuacaauguaguaccaguguagaggagacaagggcucacaguggaguuuaagaacugcacucccuagaaaggugguaguuuugaguuauagaauuguaaacaucaauacaaucuggucuuucuccaucacuucaguguagaguuuauucagcaaacuugcgucucgggucuagauuguguggaauuggagagagaaguaccaucaacuuaccugcuccuuauguggggucugcaguggcuccauguuagcaucaagucaaagucgacagcaacagaaaagggagucagacguguauaaacagaugugcccagaagaagggcaaacacggccagcaggaaaacauagcagcccgcaguuucccuguguggaggcuuugcaggguuccacaccacucacucacugcaguuguaguaugauagccgccaccgcauaguaaaggagcgagcaugacuguugcuugauuuaccaaccuaggcaaugguuaggguacggccuuugggucagauugcccccauuugugauauaugacuuuauauuagaaagucaagucagaauuuaguaucaauagcaucauugguauuuuaauuuuuaauucacaguaaaauugugaagccagguauguaguacacuccauaguauacaugccaauaacuccagugcucaggaggcuaaggcuagaggauugccaauuugagacuagccuguacuaccaagugagacccugucuuacaaaaacaaaacaagggcaauagaagagauggcucagugguuaagagcaauucccagcacccacauggcugcucgcaacugucuguaaccccagacucagagcauccaaaggcaugagguauccauaugauacauagacauacaaaacacuuuauacacagaaaaugaacaaauacaauuuaagcaagggaggcagugugugugacucagguauuaagaauacuggcugcucuaacagagaacccagauuugauuuucagcaccaacaugguaacaccucaccucuguaacuccagucucaggaucugauccccucuucuggcuuccuuggaaaccauguacacacaugauacacauaccuauguacguacauauauacacacauacggaaacauacauacagguauguauacauacaggcaaaauaugaaaaauauuuuuuaaaaggaacaauaguuacaagauugccguuaccuggcagugagggaaggcuugagcugguugaaagacaugaaaggauauaggaagugugggcugccuguucuauagaggaugaaaggauauaggagguagugggcugccuguuuuguaggggggggaggaugcuuauguaaucaaauacagugucagaauuuauacuaaaaaugcucaguuuugcugcaugaaaauuacaucucaagucaaacugggggagaaaagaaaaccuauuuuauuacugugaaaaccauacuauuugaacucuugggcucaaaaggaaccuguaucacuuuacaguuaagucacauuaguaaacacuuguuaaaagaagacaacaaaugggacuggagcgauggcaaaguuaagaacacuugcuguuugugcaggagacuggguuuggcacccacagugggacucaccuguuuguaacuguagcuccaggagaaggcuccaaaagaugccuucuuuugucuucucaggucuuaguuagcuaggguuuuaaugcugagaagagauaccaugaccaagccaacucuuauaaggacaacauuuaguugagagcuggcuuacagguucugagguucaguccauuaucaucuuggugggaagcauggcaguauccaggcaggcauggugcuggaggagcugaaaguucuauaucuuguucugaagaugaacagaaaaacaaaacccaccccccacagugacacacuuccuccaacaaggccauaccuccaaauagugccgcucccugagccaagcauaucacacccugccaugcaggcacucggacauacacaaagaaaauaaacauaagucuuuaagaagacagaaaauacuuuuugguucauucuuuucaggaaaacaguauuuaugucugugcacuaugugcauaccuggaauauucaaaugaauaucagauuuucuaauaguaaacuaaauagacaguuuugucagcgucuucugaaguggcagucagcagguagcagguaguucauugguucuuccauggccauggcuaagaacugguguucuuggguuuuggauuuuguuuaauuuuuuuuucuugaagauuuauuuauuuuauguauaugaguacacuguagcuauacagauuguugugagccuucauauggcuguugggaauugaauuuuuaggaccucugcucgcuccagucaacccagcucacucagucccuacuugcucuggcccaaagauuuauuuauaaguaguauaagaaguaaaccacuagccaggcgugguagcgcacgccuuuaaucccagcacuugggaggcagaggcaggcggauuucugaguucgaggccagccuggucuacaaagugaguuccaagacagccagggcuauacagagaaacccugucucgaaaaaacaaaaaaacaaaaaacaaaaaagaaguaaaccacuauuuagaaauuguugguuccuaguaaaagaaauccccuauuuucaauugaaagucuucccaaaggcccaggccuucugagggaucuccauucagcauuugagacuguagacaucagugcugguguugguaucccacacgcugcagccauuuacgaggcugaagagaaccaauaaucuuccuuugggaucuuaggacauccacccagggcuucacuaucaccuuaaagcaguggggauagagaaaauggcuuuucagauaccuuucaaauuguaaguuaaacaugcauuuuuuaaagguuuuguucgcugcuaccaaaauggccuuacaagauguuuuuacacuuuaaaagucagaaggacaaguaacagaccagaugcacuuuuuuaaaaaagauuuauuuauuuauuauauguaaguacacugucuucagacacaccagaagagggugucagaucuuguuacagaugauugugagccaccaugugguugcugggauuugaacuccagaccuucggaaagcagucaggugcucuuacccacugagccauuucaccagccccagaugcacuuuuaaagcaguaucuuuuugguugacgaagaauaggauuugucaucuuuaaaaauaaagcagcaaaaaauaaaauaaaauugcaaggggcuggagagauaacuuagugguuaagagcacugacugcuccuccagaguuccugaguucaguucccagcaaccacaugguggccacaaccaucuguaaugagaucugaugcccucuucuggaugacagcuacagcguacucacauacauaaacuaaauaaauaaaucuuuacaaauaaauaaauaaaguagcaaaauucggauguuugagcuggaucuucuaaguacacauacaaaugaaucuuacuauuucuuaugccagugccuucaguauuaaacuuaucuaacaauuggguucgaggccagccuggucuagaaagugaguucuaggacagccagggcuacacagagaaacccugucucaaaaaaaaaaaaaacaaaaacaaaaaaaaacaaacaaaaaugcagcuaaaugaaaauugucugugauugcuuuuuuuccuuuaaauguuugaaaguagaccuuugaaacacaauuagagcugaguguaguagugcauaccucuauucccagcacacaagaggcagaggcaggcaggucuuuuuuaagcuagagaccagccuggucuacagagugaguuccaagccagccagagccuaaaagugagacacugucuuuaaaaaaacaaaacuuauuguuguuguuguuguuauuauuauuauaacaauaauaacauagaugaaaauguguauauuuuagauacagaguucauugacuucacagugcauaaauguauauaagcaccaguucaauuaagcuauauuuccaacauaccucccauccaagguucaggaaaccuugagaaagaggcugaagaacgaauguaagagcuggaggauguggggggaguucugugaaauacuguguuccauacaugacacgccaucccacucaugaauucacaguccuuguagucccugcauaagaucaagccguagauuuccaguggaucaaggaggggccugagggccugaggagagagacuggcaauugaugacuucugaaggaaggaaagucauuuuuuccuugaaaguguagcccuugggagguugcuaggcuccaggggugacuccacacucaugugaauaaaggcaccauuaauuguacucaccguuaaaauacagagaggaggaggaggaaauaaaguggguagccuggggagaaauggaggaggagauagggagaguggacaugaucaaaaacauuuauauagcugaacuugucaaagaauaaaagaugcucuagccgggcauugguggcguaugccuuuaaucccagcacucgggaggcagaggcagguggauuucugaguucaaggccagcuuggucuacagagugaguuccaggacagccagggcuacacagagaaacucugucuugaaaaccuaaaaaaaaaaaaaaaaagauguucuacguguauaaaacaucaaaugugucuaucaccccacagaaccaccccacauguauauauguauauauguguguguaugcauauauauguguguguguauauauaauuuaauguacaaucuucuuguuuuuacauacagguuguucuggugacugauggcugucuugguauuggcagggggucacugcgacacucccuagcuacucagaaucaaagaagugagagcaacagguuuccacuccccuucccuuucccaucuaaguuauaugucaugugcauggcgaacuuggaggagguaauacuuuuuacucaacucuuuuuaguuugauuaacuaaauuuuagggcuuaguaucuuuguugauacauuuguuaaugcuuucuuauguaugccauagcauugucuccacugauuucaacugaggcugguuacaguuuuaaagacugcaucucaaaugcucacugacauucagauguucccaacuuaggaacauagcugggguugucuuucuuucugcugguggguugugggggauccagguguucuucuggguguuaugucccuuauuuggaaguucuuauguccauugcagcauaaauguugaaagaguauguguuuuaauuuuuugguaaaauaauauuacuguuagcaugcuuuacuaaaugcuagacugcuuaguuuuuccacuugagaaaauuauuugacuuuucucuacuccaauuuucuuucaaauuguaguucuuucucugucauuuccuguuaagaaaaccaucccaguuguuuccugcugcuguuacgcuagucuuggugugcuuagagugauugaugauuugugcccuccucccuucucucucugcagcuucagagcaccgauuccuuggaaugccuugaacgacucauagacuuaaauaauggugaagggcaaauuuuuacuauugauggcccccuguguuugaaaaaugugcaaucuauguuugggugaguauauguguaaagccuuccaucuuaauauuuaauucagaguauaguuugacagcuaggaagaauaucuguuuuauuauugcugauugugugacucaguucuccccaggagcccagcucucagauaaaaugagcagaagcaguagguuuaaaaguucucucguuuucugauuaaguauaacugagucuauauauuagccugcaaaacugacuuccuuauaaugcucagcaguuucuaacguuaaauuguuugggccuucucugaauugaaaucuuaucacaaaugucagcuuguauucugugucccaaaugcuaagguuagaaucaaugggaaacaauaacaaaguuugcaucuuuaaagauuucuuguauaugugucauaucugcucuguaaugucuucuagaaagcugauagaucuggcguacacaccuuuccaugcuguucucaaguguggccaccuaacggcugauguacaagucuuccccaggccagagcccuuuguuauagaugaagaaauugaccccaucccuaaagucauuaacacagguaacuguuugaaacuuccuucuuaauuuuucuguuaucuuuaacuuaccuaagagaugacagguuauuguuuuuggguaagagcuuaaguuaaucuccaauccuuggucacuauaacuacauguuacuagaguuuaaaaaaaagaaaaacagacagauugacuuaaaaugauaauaaggucuucggucuaguguucuuccagcugagcuaucugagccaccugaggugauucuugguaaagcuucugagauucauuagcaucauaccuaagguauaugaagagcugucuucuagcucuggcgcugugacuuguacacugugacccuggaaguuaguugcuucuuucaguccuaaugaguagguguggggaaugaaccagucauuugcuaagcucuuaguucugguagacgaaaccauucuagcccugcuucuuguauuaagcccaaaacaaaaugcuuucugcauccuacugcuucgaucuagugcauguuuguugaugccauacuuagcugaauuugaaaacuuugaauuguggagaguugcaggagagaacugucuuccauuggcuggaagacuccugaguggugagugcaugucagagcucucagggacagacaucaucgcucuaagaguugcugaugccuggccuaauauagucugacaguuacuagaugcucaacagguaauugcccacucaauaaaugauuagaaauaagugugacuuauuucuaauaaaguguaauuaaaguaaauaaguguugaugguuugggguguagaaauuuuagaaugaaagccugugagcaggcuuucugcuuuugugccuuuagcuuuuggcuguccagaaguaggacccagguucauugucacagaauauaguaaacuguaccuaggguuuagugccuucaaaccaaauucuacuucccuccugcccuuuaucuaaauauuucuuuucuuuccaauauaaacuuuuagucuuauacuuuguaacuuguaccuaagucacccaaguguuugucgcaagcccuucucuacucagcucagagccauuaaaugcucagcuagggaggcgcugacagccggccugcagggaggacacacccugcuguaccacagaaguagucacuugggauacacagcacgauccugggauccugaaacuguucggcuaauguggcuaaugugugcuucuggauauacuuaggagaaaaacugaaauagugaaugagucuauuuucuuuacaguuuuuauauuuucaaaguuuuguguuaauuacuuacauaaucuaauauuuuauuaaaaauucaguuuaacuuuaguguuuuauuuuauuuuugagacaaggugucacuagaaggcucuggcuggccuggaauccugccaguuuugcuucccagguccuagaauuaaaggcguuugcaccacacccacccaggaacuuuuauuuuagguuuguuuuuaggaaauacuuuugggucauagcauggcugcuguaaaggaaagaaaucauuauuguguuauucuguauagaauuuuuuuucucaaguaaagcuucuuuuuuaguauggaugugguauauacacaagagugugcagguguaugcagaggccaaaggaagacauugugggucuuccucuauuauuuaugccuuauugccuuaagacaggcucucacuaaaauagaagcucccauuucauuggcuuugaugguuaaccugcagucucccaggaccuaugucaauauccccugagccuggaguuauaacucauauggagguacgaguuacacucugguuucugugaaauguuggggauucuaacugcaguccucauguucaagcauucuuagccacuaugccaucuucacaucccaaaggaauguucuuaaaaugguggcucuaccuuccaaaggcugaaugagguuguuguacuuacuuuaacacucuccauaugugaccuuacugcccuugauuauacaggagaauucgaccuuuaagcuuuugccuugacuaaguuccuagccucauaaaaauaaaauuuaccuugucuuguuauaaaacuugaauucauuaaguaaaagucauuacaguuuaagguacuuaaaaugaaaauuaucuaugaccuuaaaaaaguuuaacaauuuuccuaguuaucauauuugaaauuuuugccuugaaauauuuuuuuagaaucuaacacauauaaauaaugcauuuucccuauugugaauacuucuguguugauuucucgcuuacagacuuggaaauagugggcuuuauugacauagcugauauuuccagccccccaguuuuguccaggcauuuggucuugcccauagcacuuaacaaaggugaguucucuucuucucccuuugguuuacauggggcauugugcuuucugaagucauuccucagugccggaugguaagcuggcccgcugggcagacuugaauggaaaagcacuaucacugaacuggauuucagaaagcuaacguugccucagaucccagaauagguaaggugaugccuuucacuguggaagcuuuugacacguuacauugugcacugguuuggggacugaugguggaagaccucuucagaggugguagcucuaggaucucuacucagggcuuuccuaagaggaacacacugagagaaaaaggggaaaggacacagcuuuguucugccaguuccaaccaugcauacagagcaugacugcaugcaucaugacuccugcuugggaggcuucacugcagacuguacauugcugcauuaggagcugugaagucauauccccaaaucucagcaucucugaaguaugccaaccccuagcuguuugaaauguucguugcuguguucuaaguugaccaucuaccuuauauuuagcaguucucuucaggaaauauguguuucaggucacaccucccuucuuguguccucugugucugugaaugcuuuacuaugagagcuggcguauagaucaucccaugagccuuagucacucauucacagcaaggagcauuguaaugcucuuuuauuuucuauguguuuugagacaaggucucaacucuguacuguaggcuagcuucacacucagccuccuaaguacugggauuacaagcaugagccaccgugccuaguucacaagcaaaaucuugauauucauguacagcagcuuauuaggaucauuguguuuauaaaccuauguuuucggagaacagccagauuguccuaacugucacauccuaggaguauucuguaugccuauauaguugcuaagcagaaaguaagcaacauauugggggcagggaacaguauaggggcaauaagaaagcagaacagggcaggauuguaaugugcauugaauaccaagcuaucaugaagaucccuccuguugaaauaaagagucucugaguaagcgaucagacagauguuuuuagaggaaaguuaacuguaagaagauucaccuacagcaguguaugggagacccuagaguugagaccuuuagccaagaaguucauaccauuauguacuuugaacuuguuucuccagugugagggcugucagcuugggccacacuugauacuucuaugucugauucucuuuagauuggugccucgagucuccaauggcaucucaaugaauuuucuauaggaaugcuaugcaauuguuuuuauauacaacuccccugggcuauauaauucauaagccauagacuucuauuuaaagaggauaauuagaguuaaaugagcucaguaguaaagcauaauauaucuaucaagucuaaagacuuaaguuugauacccaguacacccccuccgaaaaaaaguuuguuugucuguuuguuuuuaaacagguaggaaaaugauguaguuaguaaaguaauaaaguucuugucuugagagcaugaagaccugagucgagucaccagcacuuauguaaaagagcugaguggguacacacucguaggccagguacccugggguagauaggucucaugaaugaaugaaugaaugagugagugaauguuuuaaagaaaaaaauccagauggaguaauaaaagcuuauaaucccaggcuaaggaggcagagacaggaggagcucugaggcucacuggucagccuuccuagccugguugguaggcuccaagccaauucgaagccugcucagagugggugcauuucuaaagcuaacacuugagauugucuucuggccuccacacaucugcauaugcaucuguacgcaugcuuuuuuuaaaaagugaaaaaugauaauuucucucaugguaaauaaaugguaucuuuuuuggugggagggggcaggguuucuuuucucugugaaucaacccuggauguccuagaacucacuuuguagaccaaauuggcuucaaaacuuucagagaacugccuaccucugccucccuagugcuaguauuaaaggcauguaccaccaugccaaggccaagugguggcucuuuaaaguauguuuacagagucuguauugccaccaucaccauccauuucagaccuucccaucauccaccaacaggaacccuauaaccauggaucccaagaccccuucucucugugggcugccucugcuagcuguuucauauacguagauuaauguauuugaaguuuuuauauggacauuuuguggaaaacugugauuuuguaacuuguuauaauguuccuuuacaguuccauguaguucccuucaaagcaugagauaguuaagaguugagaauuuuguagcuaauaugcuaaccuguuuuacagaaggugacgaggugggugcuggcaucacugaugacaaugaagaugagaauucagccaaucagauugcuggcaaaauacccaacuucuguguccugcuccacggcagccugaagguggaaggaaugguggcacuuguccaacuaggguaggaaggguucauuuguauugcugacccagagagagcuacacaguggagcguuucacagaccuaaggaaagacauggaaagauccuggucacucuucccuuuccugccauacccuucccaccuccauuaccuuccaguccuuaguuaucccacaaaguuagugggaggugaccuuuuuaacugcaucgauuuaauguuauauaucuucucuuuuaaguuguuagucacauguuuacuuuagagagagaauuuuguugugacccaaacuguucacacauacaugauccacaugccucaggcucuaaagugcugggauuacugcuauaccaaaagguuuuccuuuuuaaaucuugcaugggugcugagaagcaaaccuugguucucugcaagauggauagugccucucauagugaccucuguuucugggaacccacacuaccuacugcugcuuguuagcucaugccaccccaacacugcacagaugaggagacugaagcuuugagagacaggaaauggcccaagaucacaaagauagcaaacccagagccagaguucuuaaccugcaugcuuaguccagaacgcaugcggcugcucugaguuccuucccuguguggaaagaaccagcuuucauauugucuguagucgugaagccugcaaagcugucugcuucucuuccuguaacaccugguacuggaaaagaggagggggccuucuggccaugacccgguuuugucggauauaaaagaucaaggaguuaagauuaaucauaggaggcauaucuccauuucugcuugaaugaaaauucccaaaagaauacaguagguuuuuuauuuauuuuauuuuuguguguauacaccuguguguguguucaggugagagcaggguguccauggagaccaagggcuggaacuggaugacaggcgauaugaccuucugguccucugcaagauggacaggugccuuugagagaggccugcucugguuccuggcacccacgcucccgcugccucugccuguggggcucucccagggcccuuucagaagcuugggcagaauucccucacugcugcagaccuugccucugguguugcugcugucacuccaggaggcaaccggagggacccaagggcugcggcauguguugcucugcgcccaggcucagaccugcuguacuuucacagcucuguucucucuuaaaccgcuuucagugcacacagagcuacacacacucacacacacucacacauaugcucagucuuacacuccucacacacacacacacacacacacacacacacaguuuugucugacuaauauguaucucagagaguuggaaauauuaaguucauuuucaaguuuaagauuuggcuuuggugaaguacuacaccugaccaaaaacuuaagacuguuuucagaaaggcagaaccuagacuucuauaaccugacgguccuaggcuugacguucugaucacccaucuucucuucaucuaggccugaauggcauggaaugcucuacucccaagcagacagcaagaagaaaucaaaccucaugaugucucucuucgagccuggcccagaaccucucccguggcuugggaaaauggcccaguuggggcccaucucagguauaaugcagacagaucuuacuuacuugacauuguugucucucugcugcuaugaaugucugaguguuguuggagcacucccgagcucucugaugugggugcauacacggaggaccucagaguguuuaaggcuugaacucagcugucucggcucagggagugaagcagguauagugucauucugcgcucugaacggaaaaccccgcguguucccacugugcagucaggguucucagaccacacagccaucuuccuuuuggagacgcuuuucccucacuucacuggcauuguugcuguuucuagucugucuuuucuaccucuugucaccauugugaucaguggggcagcuggaggucauccaccuguggcauugggaacuuaaggcauagcuugucccaucuccaugaaucaggaaguagaguugagcugguggaaauuggcuuguaacccucaacucccacgcccauagagcccauuucuggguauuugcccuguccgaaagguucuccaggggacauuucccauucaaaucucaacaggaaguguauguaaagugcaugguacaauguagguauagaauuacagaugucuuuucucuucuugccuccguuuccaaaauguccuuugguuucuccuguuguugugcucuuuuuguuccuucagguauaguggguucagacucccagaucuggaccuugagucucaccuggugucccuccauauuugcauguugcauuuccaggucucggcuggacugcacugcccccacucucacugcugauacugcucugcucacuccacccuuccuuugguuuggaacaggccuccagcucuguucucaccauuacccuuaacccaguuggcuccauuuccauuuuagagcugucugcuaucuagucugugcccugugaauaaaagagcugaaguuuucaaagucugauggggaguagacccaacagugcgugaggucaggucacagccaggagcacagcugaucugacagcugccugggacuuaggaaggagaucuucccgggcagaggcacgccagcugaguuugcuaagcugauggaggaagaaagggccggggaagcaaacagacaccugugggaagggaagaagaagcuggagugcuggaggggcagagaguagguuagagacuggcugagagcagaaaagaccugcucccaagugacugugugcagguacugggaaagcacagcugaggcggaaugaugauagcuccuucugcugugaugccagcacucagggcaacaguuaggagacugugugcugguggcccuaauccagguaggagauaaaaagacaaucugcauuccagugcuagugauggaguucaguugguagggucuggcaaugcaugaagcccuugguucaguccucagcaccucauauguccggugugguggugcgcaccuguaauuccaggggucugcauauuacagacugcaguggcuuuaauuaaagaauuuggcuauauaaaguaauugagugugugugucucuguguguaugugugucugugucuuugcaugcaugucugugugcaugcauguccaugugugugcccgugugugaguauugaaacaaggucuugcacuguaacucaggcuuuuuuuccugccaugugugacuccguaguuaacuagucacaugagauuauuuaaauuuauuuaaaauuuaagaacauaaaauugaguucaaguguagauguuucuuguauccuacaaaguuugggugaagagaucugggcuaaaauauagagcuguggguaugcuguagcuauaaagugaguuuucccaguguguguguuugguuugcugcccuuggccuuugugugaagcucaugugaagcugguuccuuuaggacauuacacuaggucccugcagacugucuaaucuccuacuucagugacucagcuauugagaacagguucuccagcaugacugaaguuaauguaauuuucuguuaaugauagagcaauucaaaagcuagucaccuaacuggaaauguaauuguguuugcuagguguugucuucaaaauugucuuuuucuuuaagaugcuaaagaaaauccuuauggggaggaugacaacaagagcccauucccccugcagcccaaaaacaaacgaaguuaugcccagaaugugacugucuggaucaaaccaaguggccugcagguacacagugcuuccagagggcuggcagggggcuggguuugauugcucucuccuuugcuacuguguaauucauuuacuucuaaugucugcccuuguuuuccaaaaggacaugagauggccuacagugagacacauacacaacacaaccauuuuuuacaaaauuuagagcaauaacaaaaccagagggaaaauggaaacaauugugccugcaaccagaggcaaaauggcacuuguguuugaggacuuugguucugggcuuccugcuaccaaggucaaaaaagaagcaaaugccuguauaguuuuucuugucuaauaacaauaagcauggcaacauuucuggacagaaggauuuguucagcauuggaucuuauuuuuuauucuuuauauuuuuaaaacagauucauguaguccaggcuagacccaaauucacuguauagguugggcugguuuugaaccccuaauccucuuguaucuaccugccaagugcugagacugcagacaugaaccaucacaccuaguguaucagcacuggauccccaacccccaacauaccacacacacacacacacacacacacacacacacacuguuucacuguguagcccugguuguccuggaacucuguagaccaggguggccucaaacucagagaaauccaucugccucugccucccaagugcugggauugaaggugaguaucaccaauacucagccagagcugaaauuuuuaaaauauuuuuugagaauuuuguauaucagcauaauguauuugaucacaucuacauccccccucccaaguacucccaggcccuccccaacacaucaccuccccaaauucauaagcuaccaugcaccaggggcaagucccuuaagagaacaaagggagcccucaccaaagggucaucaacugauaauagaccuucagugaggguggggccucaggagccagcacugccuuuuaguuuaaaagucugcaugcuccaggcaguggggcacaccuguaauuccagcacuugggaggcagaggcaggcggaugucugagauugaggccagccuggucuacaaagugaguuccaggacaaccagggcuacacagagaaacccugucuugaaaacaagucuucaagugcuaagguuguggauuuuuggcagggaggggacgggggauggggguuguucgggguaagacaggguuucacucuacuguagccuuagcagcucuagaacuggcucuaaaccagacugggguuuaacucacaaacagcccucauccucugccuccugagugcugcugggguuaaaggccucacuaaaguaacagucaccaaaccuggcuguuacuguuuuaauuguuuugggguuuggggggggggggaggagauagaaagguaaguauuaaauuuaccauugcagccauuaaaaaauguauggguuaaacacuguuuauguuauuggaugaccauuggcauuaucuaguuccagacaagaaacccuuguaugcuuaaccacugaaccaucucuccagcccuauuuuaaguugaauuuuuaaaaaaaaauguccugugagcuaaggguccaacuucauuuuucuguauucauucaguuucccuuuucccauugauggucuagccauagauauguggguauccugggucuauuuugaugagacaauuauuaguuuaauaccaugaagcucucuaagagggcagugcuguagccauuguugagaaaagcacugaaagcgucucaggagucuccaugcugacacgaaguuuguccuuauuuccaugucuuuaaacgcuuaaaacuacucauuuuucuccccaaagccacagaauucuaauguugaacuguuuuuaugcuucauagacagauguacagaagaucuuaagaaaugcaaggaagcucccugaaaaaacacagacauucuauaaggugagacauaggaaaagguggaccuaguggguagaaguaugaauguguagagcgauuacauuggggugcgcguguaucaguuuucuuaacagugcaaucagggguggcuggcuaggcucuuccucucucccaauccaguugaauccagccuaaaugacacaguccugugcagaagguugcugugaggggcucagcaagcagcucaaagggaccaugaaucccagcacaaccucaccacucuugcguggguauuagggcuaaccccagcaaacacugcacaugaucccuagggaaugucccagaacacaacagaagcugccucaaggaaugacuagccaacaguuaguguaagggaauggaugugcucugcaaucaugccuagcuagucuagaaucacacugguucuucagggaccaaagugacaagggaugaaguggaguggggacauuugggcucaccuuaagagagaaggaaaggaaaaggaaaaggaaaaagaaaaggaaaaaaagggaaaggaaaagggaaaggaaaggaaaggaaaggaaaggaaaggaaaggaaaggaaaggaaaggaaaggaaaggaaaggaaaggaaaggaaggcaggcucuuacuggcuuagcuuauagcuugcuauggagaucaggcuggccuagaacuuggagaucuggcuagacucacuguuuuacccccuuggaguuuggcugaauuagauuaagugcaguuugaggugggccuuagccuguuaauuuuaaaguacaauaauauguaggggcuagagagauggcucagaaguuaaagagcacuuucuacuuuagaggacuuucaacucccaguggcucacaaccaucuaaaugguuccagaggaucugacccucugagggcaccaaguaugcacaugguguguguguguguguguauucaaaacaccaauauacauaaaaaugaaaauaaaaauaaaauuuacccuugggugaguauaucuuccggagagcacaccuaccuugucugaguaacaucuuacuaccuuuaucacuguugucuuucaaucuaguuacuagcaaucugggaaaauuggacaaaauauaguuuuaaucagaguuuggucagaaagccucucagccagccauaccuccaaacucugugauccacauaagcccuggaccugggcucagcugcagccuaucucugcaguuuguacauguuugcuaguguucuuucuguucaagcaagcaugcuuguacaguccugagguggucuuuuauuuuuccugauacauuauaacuagcuucacgucugagaacuagaaaaggccugacaccuggcugcuucaguuccucaagugcacgaggaaggagccuccucccuguguaaacagggcauuugagagcacagcagccacccagcuuggccacaacauguucgagcgaguggugggugcuuccucugcugucuccuccaaauguguucagucacucacuccauaucuaaucagagaggcaccaggcugaggccgacaucuggagccagccuuucccaugccugauuaggagagggaaaccaguccccagagucagcacgaauccuguaugcaaggugcuugcuuuguuuggcauaacugcauuaacugugaucagcuugcugacgauucuagcugcugagcugagcaugcagcagacaucacuggccaguuaugcaucacgcugcugucccugguccuuguguaaaacacugcuuccuaagugagggucaaagagaacuaagucuaagcagagugcuuggagauugugugaagagaacuauccauguguuucaggagcugaacagguuacgaaaagcugccuuagccuuugguuuccuggaccugcuuaaagggguggccgacaugcuggagagggaguguacccugcugccggacacagcccacccagacgccgcauuccagcucacccacgcugcccagcagcucaagcuggccagcacugaguaugccauauaugaccacaacaucacaccccugcacacagacuucucagggagcagcacugaaagaaugugaugcugagcucuggagcguuccuucacguucacuuugucugaaggcaauuuagaguuaaaaccuucuccagcucuaucagaaacagcauuugcccgucugaauguuucuacugcagucugagaaaggucugaaggcugguugucuggggcucagucucuagguccagaaacagccuuuguuccaugauaggcacagcuccugagaagcuuggacagaugaggagcgagcgcaggaagaagccuaggcagccagggccgucuagcauccagaaagcgacucuucaugucucaauuacaaggacauucuuaaacuucugugcuuggaagaagcaauccagaugucuagaacuugccuaaguacaaacccgaugccauugaguuucaauuuuuuucuuagaacuuguuaaaauacaaguggcaaugcucaggugcuucugguguaucccaagguacacauuuuuagacuguaaccacaauauguguaaaaucacuccuguucauguuuuuaaaugaaaauuaaauauuugauuuucuauagugauugcacuuagaaacaaaugguguuuugaucuaucuuaucccuugaauauaauacagcuuccaaaaugucagacuccuaagaagcaaugucucucggguccuguguaacuuccuaguuucugacagugaucaagcuuuguaccucagcaagguucuggccagugguucugagagcacugaugggagagucaggccucccaggcugugccugcacagugcucacccagugcuucgugacugccuucaguacucccuuaggcuccugccagagucacugugccugaacaaagcacuuuacccauuuaaaacucaugagauuaaaugauguuuaagcacaaguua

SEQ ID NO: 5166 - RNA, 34742 nt, Mus musculus
cgccccgguccucacugcgcaagcgcgagccgcgagcguggguuaucucgagacagccgggcugcgggcugcggagcgugcgggucugaggccugcguucugcuagcuccagcggcucacaggccgagguaacgaggcgcagcaagccgagccuccccgcucccccggacagcgugggccauggagacucaagugcugacgccgcaugucuacugggcucagcgacaccgcgagcuguaucugcgcguggagcugagugacgugcagguaaaggccgggcugcgggcugcgcgcaggaucgggggccccccgguccccgucggccgcccugugcguuugcgcuccugcagugcgccagcaggaaccgcgaguggagcgccccggucucccuuaggggcugcaggugccguccggcguucugcgcuuggccccgguauccccuuuguuccugguaggcgcccuggggagccucagcagaguccuggaagccggcggcuggccuucggguugccuaaggcccucugaauugugggaugagcuccgugggucuaaagugcggcuugacaguggccuguugugcgguagcaggacgucagcgcuggccucugagguuuaguccgggcggcccauugaccuucucaaggcccgucgcugggcugggcggggggcaaccccccaaccguucagugauagaaaucuacaccacaccuccgcucaccaaggaaaugauuuccauccucucuuuaaggcugcgagcucagccuuagcaaguugcguaaagaaauuaucgugugacauuaaguauucauuucaccacguuuaccuauuaaugugagcaaaucaaaucccugggaacuucccaugucucuaaccagaccauccaguauucugugugaagcgagugguuuuggucuggaauguucuuucccuagucuccuugacauccaugguauuguaaucuucauuccucugaacuguuucuugcucgcaguuagauaccugucugaauucaucaauucaucuggucuauuuucuugcagggucuaggugcccauguccacuugagucuaaucuuugcuucuggaauguaaauaauuuccccuugugaacgaugaagcuaauacuggccagaaugucuuugaguaagcaguaaauuucauuuaagguguaagcaaacccgaauaaaugcuacucuagaauaggaugaauaauucucugugcuauuguucucuacucugcuacaagauucuuugcuaaaauagaaaaaaaaguuuuuguuuuuaauuuuuauuuuuguauuuuggagacagucaugcuauauaguuauggcuggccuggaacuuacuauguagaccaaggcuggccuggaacucacagagaucugccagccucugccuccugagugcugggauuccaagugugcaccaccaugcccagagauucgaguuugaaacacguuaacagugaacacugugaagguggagaagaaaggagaacauuucuuuuggagagaaaaguccuuuuuaagaaauuuugggaagaacgagucccucaccccuauggaggcuuuaucuuucuggggcuucacgucugcuagucugaggcguuaguuuuaaaagaacaugucaacaccauguauaccacaccacagauuuacagagaugagucagacgagcuccacuuucccaggcccaggcaccuuuuccagggcauucuguccaaaaggaagcauaucacauacaaacaaaaaagguuguucaugaacaugucuguugguaaagcugggguuugguguauucuuugccucucuuuuguugaguuggaaaugacuuccagagaugagaaggcuucuugucugccuuuuacugggagaacuuaccagagagcccaccuguagcuaaaacgaagcuuacuguaacuacucuuugccgugugugucagugucuguuaagaguguguuaaaacugauuauaggauuugagcauugguguuugugagagaccaaauggaggagggggcucacugcuguugauaaaacuguucugaaaaacuguaaggagagagacacaagauuaaacuguuuuggagaaauaguguuuacuuuggucaagggagagagggugucugguauaucuuugguggcaguaugacuagguguuuguuuuuauacacacuugugcauuaggcuuggccucauucuguuuucagaauaaucuuuucugagcuguuguucuaugagauaguaauggccaauaagagaauggucaauaaacuguuccagcugugcuuuuagugaauacacgagcugccucucuuugcuuucuugauuaaucuacuaggguucuguugaaaccacuuguagcucagggucggcucaagaugaagcaauccauuugcuuaguacaaaccacuuaaggaguacucacucucguuggucccuaagguagguucugggcucuugggcagcuuuccaauacucuuuuguaucuuccaguguauccuacagcugcuauaugaauuucaaaggguugaaaacuccauagcauuguggggggugaucaauucugccuccuuccaggacaagaugcacaauccaguugucacaucagucuuuggaguuguagaguuagcacugaugggaaaccaccgcuguuguguacaggguuguaaacagcuucacccgugacuuuaugcuugaggugagcaguggcacaggcagcagggaguuuggaauagcaccucuggugaagggcagcaucaguacacaggucuggcucagccuccauggugguuaaagcaaguguucauuuagcaagguuucugcuguauucagacagaguacacaguuaguuugaaagauacuguuuuucagugucugauagaaagagaagucacccaaggggugagauugggccuuuuuucuucuauuuauuagcuggugaccacagauaagaugagccucauccuccuaauuugcauaaauaugaguaauaaugucugagucaugggaaggguucuuuugauguuugaacuggguuuagaggggauuuuuuaauucucgugugccauccaagcaugugggguuuuauaugacugugauguuaaaucuuagaugagagauagauacacagagcacugaagcugagcaccaucuguuagcagacccgucuacauacgaaaccuuaucacauggccaagauggcuuuacacaguaauugagaaaggacgaaucauucagaagauaggauuaagagaacuaucaauccaaguggcaaaaagauaagauuacugccucuaggacauuggcagaaauccuuuuuaccuggguuaaugaaaaaacugacuguguaaagugaagcugcuaaggaaaauggaggagaagaacaccuuaagaaacaaaguguaaauccuaaaggagaagcuugaugaggaaggcaagcuugaaggcuauacuugccccaaauacgcugcagacgacuagcaucuuuccuaaagaacagaguaagaaaacaugugucuucuagcagaaaaaaagaacagauaauaaugaauguccaagaugcugaaacacugccugccuagcuucagggauaagcagggcguaugagcacaugcuauucuuuccacacagagguuggcaaguacagagagugucugacaucaguugaugcuguguauguuuggaagagagacaguaaacauuucuguggggaggggauggcugugguggucauaccuuuaauccagaauuugggaggcagaggcagguauaugugaguuugagguuagccuggucgaccuggcaaguuccagguuagccagggcuacccugucucaaauuaagggaaaaauuaaauucacugugugugugugugugugugugcgugcgugugugugugugcgcgcacacccauguguguuuguucaagauugagacacagugcauuuguggaggucagaggacagcuuucagagucagcgcucuccuaucauucggguccgagaacagaccauggucaagcuuggguagaagcguuuuuugcuuaccgagcuaucauucuggcccaacgugagguauuuuuuuguuguucugcuggcccucagugagucaucuuuaauacaguuagugagaguauuaauuggcauuuuuuuucccagaauaguuuggcaaugucugauugaauugaagauguguuuuaaguaauugcaacuguaccagugucuguuuuauuuccuuuuaagccacagacaaauagagcauacugucaaugcauauuaguuauggauggcaguguuuguuacaguuuccaguguuuggccaauugcuugaaacauuucacaauauaauucagaaacucuaaacuguucauaaccacaaaacaaaacuacucauaaagcaguaaacgagcuuggucauucgauuugauuuagauccaaggccauggacuagaugcuggucacaguauguaauauaaagguagugccuuccaguugagggguuagacaggagguacugcaucaaacaggccucuagaugagcguaaauaaaggagaccugagauggcagaggcaggcuuaacugaguggucagaggaggccgaguggaggaaaugaggaggucugagccacgaggauagaaugaguuaugcaggaggcacggaggagcgcugggcuugcagcucaguggaagaauggucuucgaaugcuagacaggcugugggauagacccccuucauuacacacacaaagugggaaaaaggaacagacagagagagagagacagagacagagagagacagacagagacagagagagagaaagagaacauuuugacaagugcacagacuuaaagacaggccugggccuuggaggguuccuggggaacagaaaggacauuaguaugugugggguguuguaaggaaaagcgggagaggagguuggaggguuuaaagauguaggucauguagagccuuguugccaugguaagggaggagcuuggauuucaugguagagcagugagaacuauugaagaguuuugagcagaagguugaguccuuagaaucuguauuuuaaaaauuacucaggggcuugcugagagcucacacacacacaaugucugagagaaccuggaggccacgucugcuuugauauguaaaauaugcaccucaguccuuacacacacacacacacacacacacacaccccacacacccugagacaggguuucucuguguaacagagccuuggcucuccugaacuugcuuuagaggccaggcuggccuugaacucagagcucugccagccucugccucccaagugcuggauuaaaggcgugccuugucagugcucuggguuaugugggacuauugaucgaagagggacaagacaggaugaucuuaggcuucucaggcagcaaggggaugagccucucaaggacugaacccaaacccuuuuccauauaagaaaacuuaucuguucuuggggguguauugaaagagcuaucaccuuaagcgauuuuuagccauacagacacuuccugguuugcuaggcaagccuggagacuaagcuaugcgaaggcucugagaauccuucaaaagaauaacuucauaaaaucucagacaacaaucacuggcaaaaggcuacuucagaauuuaggugccaacauuccagauucaugccagauaccgugguucugcuucaggcguuccaccaccacuaagccggggacauacuuucuugcacacuggaguguuuguuuauuuuuagcuaaaguggugaggcuuaucgcuguucagugaacaucuuugugggaaaacaugguguuucaguaaguugguuuuuguuuuguuuuguuuuugaaacaggguuucucucuguagcucugcaaguccuggaacucuugucuguagagcaggcugguucagauccaacugccucuuuuugugcugggauuaaaggccaccacacccagcucaguaagagggucuuaggacuaacugguggugggauaugaguuuccacuugagugauuggugggaagaggcugaaguuuguaauucacaaggacaucugcagcuucacuauucugggaacaucuccaaggagauaacaucugagcagaacccugcauguuaauaagcaauacgagggggcuggaggcucagugguaagagcacuggcugcuucugcagaggacccagguuaaaaucccagcacugacaugcaaagugucccagucaggguuacuguugcugugaugaaccaccuugaccaaaagcaagucgaggaggaaagguuuauuuggcuuacacuuccacacuguaguccaucagugagggaagucagaucagacacugaagcagggcaggaaccuggaggcaggagcugaugcagagguuauggaggggugcuguauacuggauugcucaucuuggcucacucagcuugcuuuauucuagaacccaggaccaccagcccagggauaucaccacccauaaugaguugggcccucucucaccaaucaccaauuaagaaaauacucucugcuaggcaguggugaugcaugccuuuaaucccagcacuugggaggcaggggcaugcggauuucugaguucgaggccagccuggucuacagagugaguuccaggacagccagagcuauacagagaaacccugucuuaaaaaaucaaaaaccagagagagacagagagagagagagagagagagagaaagaaagaaaaaaagaaaauacucuccaacuauauuuuuuucuuucuuuaugauaaaccauauggcaggcacagguuagggaagccagguagguuuccuggugucagccagaggcucaucuuggaagcagggccucucacagguugcgguucagcccugcuguauuagugcuuauacacagguucucaucacacaaucacacacaggcagagcaugugaacgagaaggaagcccucuguguaaaggccugcuagguagaaaguucacaaacugcgcuuaugucagaggcuaugaaaaugggaugaguuucuuuaauuucacucccuugaauaauuacugaggcauugggaacauagagccaaacauaacugcucccugcuaucaagcaacaaaaguccagaggaucagagaagcuaacaaacaaucauuacagcacacuguugagagcacuggacaaagaugggugcagggagaagcuauugauuaagcuauuggaaguaagggggaagaagagcauuaaugucggcucugauuuugaauaugaaguaaaagcugcuguccugcagacacagacacuuagauguggaagaggaggaagagagcaaugagguugacuaaugucaacauccuguauguucuuccaacuuaaugcucagaauaguucugaaauuugguuuuguuuguuuaacuuuuccucccacauuauuuaguguguguguuugugcauguguguauuguguauguguauguccagggcacauguuuagaggucaggagacaacccaaggaguugguucuuuccuucuaccauguggguccugaggauuaaacucauuucuuuacuguauguacuauacagagccauggguagucucgcuauuuuaaaaauuacagugauugaaggguuguggauuugaaggugaaagagaagcaaauaaagaugaucagauaggagucuaggucuagcugacuucaagaccaucuuuugcuucuuuuucuagccauguacuuuucguaagcaaagguuuauuccuuuuuuaguaaaaaggcuggcuuguguuaaucagccuuucuguuaaaaacaaaagcauuaaauaaaaauaccagaaacuccucaggguuagccuggucuacacagugaguucuaggucacccuagaacagggucucacacacaugggagauagagggauagggagagggagagagggacagagggagauggagggagauggagggagaggaagguugggaagucagaaaaggcuuuugcccugagaauguucauucagcuaagugagcguggauuucagugcuggaagcccagcaggguguaggguguuagaaauuaagaucagaguucaaaaucucccagaggcaugucauauaauuucuuccuuauaaucuguccuuuagaucaaaacucaagaucuaucaaagguaugacaugucccugguaaucuuucccugcacguaggucaagguaacuagaugcaaacucaccuuucucccuaaccguugcuuuacagugagggcaucagacaagccuuaggccaugacuucauguccaaguagccacagcuugugggauccuucgguccuugguaggagugagcauaguggugcaugucugaccacagcacuugggagucacaggaagguagaucucugaguuugagccuaaccuggucuuccuggucagccagggcuacauggacaaaccgugugucaauaaacagacaaacaaauaaaaucugcuccagcucuuaauguagcuccauaguguagcuauguugguaucauuuaaaagccuuuaggcaaauguaucagcucacuuugauacaggugucaggguccuaggaacaauauuaaagucacaugcaucuaguaacacagccuguccuguauguaaguuacaugcucuaaaauuauuaccaccacagggguuccuuuuuuuuucuuuuaauuuugaauuuguuuggcauaagccuuuauuauuguuguugauucugguuuuuuuuugagacaagauuucucugugugauagccuuggcugucuugaaacuagcucuauagaucaggcuggccucaaacucacagagaucugccugcuucugccuccugagugcugggauuaaaggcguguaccaucaugccuagcuauuuuaauuguuuuauauauauaugguuuauggucuguguacuacaugcaugccuggcucuugaggaggccagaaaagggcaucaucagaucccuuggaaccagaguuauagugagucaccacgugggugcugggauugaaccaggguccuuuggaagagcaguuagcacuuuuaaccagugggccauuuuuuccgcucugcauaagccuuuuuuuaaaacugaaagaucuccuuccgugaccaccaccuuuggggaggcuaaaccuaacacgcacaguguucagcagggcaggaucugcccucuuauggcugaguuaggacuugaaaucuguggcucacaaacauguuuagccaacuacuuagcuuguaguaugaccagguaugucagccuuguuuggacauaccugucugaggagagaaaaaucaggccacccaagccucuuuugauuucccaugaaaaggaaauaggauauguggaauacaaggaaagaccuaaguugaaaauuuagcucuaaggcaucccagaucuguauagcuuccuaugauaugcaucacauucacauagaaaccuguuucuugggcuggggaauauagcucaguaguagagagcacucuccuagcaugcacauggcucuaaguuugguuucuaauauggugaaaaaccaaauaaaacaacaacaacaaaaaaaugucuuucucuugcugagaaccccucacaccccagaaauguggcucucugccuauucaguggucaacaggagaacagucauccuugccauauuuuauggaggaagauuuccuucugggguaaaucuuuucuuuuucucuuuaucuguuuuugaaaauauaguaacagaagaggagggccuaguucccagcacagcuccuacaagugaguucuugagagugggucugaaguuaggguagauaucgcugcucuugcaggaauccagugagccaaggcacggcucucuauguguucucagcauuggggucuaugugcuugagcagauacugugguuuaagcuucgaucuuacuuuccaccacugggucugcaccuucuaauuuuuggaguucuugaguacuguguacuaggguguuugggagaguggcuggggcauaggaauauacuuggaaagcuguaucuuggugcccuggugaauaacuucuguagucguccuguuuuggaugagguuuuaguucugucuguccuccugucuuagagacuauuccgagucugaauccucuaugugaagccuuuacuuccacucaggagacugcccauggaagcuugacauucuccaagcuuucagccgcccccuucuggcugcccuuggcugugcauagagcaugugggugcccacggaccuaguacaccacucuccaggcuucucucugccuugguggugguuuccuuuggugaguagagcugagagucaagcagaaaaagagaugacacagggaccggaccaccucuugcagagacaccuugaauuaucgguaggaggugggcuuuuuuuggggggaggguguucgagacaggguuucucuguauagcccuggcugucuuggaacucacuuuauagaccaggcuggccucgaacucagaaauccaccugccucugccucccgaguacugggauuaaaggcgugcacuaccaugcccggcuaaggaggugggcuuuuuuuuuaauccagugaaaaaaauguuuaguuuuacuuuaggcugccaaagugugcauuaaagcccuuucuggggauaaaugagaaauuugaguggugggaaucuggagcuggagcuacuagaacacaaagugacuugcugacuguugugagcccagcccugcuguaaggcuugguaugaggcucuccccuuggugcucucaaccacugguucccaugaugcucguucucuucucaacuugaauaacccuugacgccagucugugcucucugucugcguccuugcuaccuucucacaggaagugagucaucuguuccgcugggugcacagggaugcagccuucgagaucugucuguucccucauucaccucauauagcuccuugccugccuagccaucaucguaauggaccgauucauagccucaucguucuguagaguuggagucuuuggaggaggcagcagucagggaggcaccauagacacagaagccugcagggaugugaacagaccccucacucuuagcggggaggcacagggucugucagucucuaggaggaggaggggaagaaauucugcuuuacuauaauuucucauauugaaaugucuuuugugucccuggucucuucacagaacccugcuaucagcaucacagacaaugugcugcauuucaaagguuaguaucugggccgaugcucgaagaccucugcauagaucagaaggcagauggcaggguuuuugggaagauuuauuuauuuaugcuugugaguacacuguagcuguacugauuguugcgagccuucaugugguuguugggaauugaauuuuuaggaccucugcucgcuccagucagccucacucacuccggucaacuccgcucgcucugcccugcucgcuccagcccuaaaguuuauuuauuauuauacauaaguacacuguagcugauugggacacaucagaagagggcgucagaucuuauuacaggugguugugagccacuaugcuguugcugagauuugaacucaggacuuucagaagagcaaucagugcucuacccgcugagccaucucuccagcccccacgauggcaguuugucuuuaaaaaaaaaauuaaaaauaauuuuucugucugucugucugucugucuaccuaccuaccucucuucucuauuuaguuuguuuucgaaacaggcucucaguauauaccuuggauggccagaacacccuauguaggccaggauagcuuuaaacgcauagagaucuucccugccucugccuccugaguacugagaauaagggcaugugccaccauacuuuacaaacauguguguguguacauacauacauauacauacacacacauauauauuuaaaacuauauauauauacauauguauguguauauguaugguauguaugaauguguauguaugacaacaaaggucagacaaauguuucauauuuucuggaacuggaguuacauacagauaugaacagacaugugggugcuaggaacuguacucuggcccuauguaagagaagcaagagcuauuuauaacugcugagcuguuucuccaucugcaauaguuuuguuuuguuuuuaaaucagagcauuuggagcauguagaugacuuuuuuuuuuuaaagauuuauuuauuaucucuaaguacacuguagcugucuucaaacgcaccagaagagggcgucagaucucauuacuguugguugugagccaccaugugguugcugggauuugaacucaggaccuucggaagagcaguuggugcucuuacccacugagccaucucucuagccuguagaugacucuuauaaucaaauauuuccacauaucaguggcuguuugcaucucuguuugaagcugaaauagaaccacuggcacaauacacagauacacaugcaggcagacacacacacacacacacacacacacacacacacacacacaagaagcauuuaaaucuuccauuucuuaaaagacaaacaaaccaacaacuauaauggaggcagagauggacaacuuauuacacgugugcugaggaagguggugggggugggugguaucacccccagggccucccaaacgcugaauacgagccccaccacugagcuggauccucaacccaguggaacugucuuuccuuuuuucaaaggauuuuugagacauggucuuacgaugugguucgggauagccuugagcucugcauccugucccagccuuuuaagggcuggauuauaggccugcauccaccauucccagaugaaaaguuuuugagacuuugcuagucugauggucucugauuccaagagucuggcccauguuuucucuguagcuccucaguaggcuuccuguugugcucagggcccugggucuguguucacaggcagccagugccugggucuccuuacuuccuugccauucugauuuucuagaguuauugucuuuuuuuuucuuuucuuuucuuuuuuuuuuuuuuuuuuuuuuuuuuuuugguuuuucgagacaggguuucucuguauagcucuggcuguccuggaacucacuuuguagaccaggcuggccuugaacucagaaauccaccugccucugccuccugagugcuggaauuaaaggcaugugccaccacgcccagcuuuuuuuuuuuuuuuuuuuuucuuuuuacuugcaccucaaguaguccagacuggcuucaaacuugccauguagcugaggauggucuucaacaucugacccuacuguuacuucuuacucgaugggauuguguaugugagccaacccuaacuuccuggguuauuggaaaguggaauucuguuucaccuacagcuccauccacccugcuuuacuuccaugaagucacagucuggcuuugauguguuuuucaagauagaguuguggugguaguaucauaggcuuaagaauuuagccugugagcuguucuacuuuaaggaauguaugaucuuagcaaauauuuggcagguuguacuaaaguggcccgaggagggaggggagacccagaaggaaccaagaggaagacaguggagaggagagggagaagugaccugugguaguuucugggucuaguggucauuggugcuuggaccaagagacugcuugauuugggaaaagagccauguccuggcucagggauggaguggcuaccucagggauuguuccuuagcucagcccaucuucugcccuguugcauuuggaacugcuaaaggacagguuggcuucuaccuucauucugucccugacuagaaggcuuuagauuagagccaucuuugaguuaguuggugucuuacucaggguuucuauuccugccaaaacaucaugaccaagaagcaaguuggggaggaaaggguuuauucagcuuacacuuccacauugcugaucaucacuaaaggaagucaggacuggaacucaagcaggucaggaagcaggaguugaugcagaggccauggagggauguuccuuacuggcuugcuuccccuggcuugcucagcuugcucagcuugcuuucuuauagaacccaagacuacccagcccagggauggcaccacccacaaggggcccucuccccuugaucacuaauugagaaaaugccuuacagcuggaucucaugaaggcauuuccucaagggaggcuccuuucucugugauaacuccagcuugugucaaguugacacaaaaccagccaguacaguuuguacaugcucuugugcucucgugcacguucucucucucccccucccucccucccucccucccucccucccucccucccucccucccucccucccuuccucccucccucccucccucccucuccccuucccucccucccucccucccucuccccuucccucccucccucccucccuccucuuucucuuccucuuucucucccucucucucucccccucucucccucccuuccucccuucuccucccuucccccucucugucuuugucuugggauuugaacccagggccuggugccugcuggcagauaaggacugcugaaccacaucccaguccugcagccugucuuagcccagucaggaacaucugauuuuuuuucugcucagaauuuagaaucaaaguaaaugagaaaguuaaacuuuacauaugugccuccccuuugggccuuucuccucuuucucuucuuccuuuucucuuccuucuuccuuucucuucuuccuuuucuuccuucuccuccucuuccuucaccuucuuuuuacugauauaguacugaguauuaugcaggcuguuaucguaaauaguccaaaacaaaccaucaguaaucauauggaguucaaguuugcccauaguugggcuuauccagcuguugaguagcuccgcccucacguucccaugcucccacacuuuugaugggaacuguuagcuuuugccuuccuuuucaaagcacuguagcaggguggauuugggguggccuugcugugcuuaaauucacaaaauugacauucuuuuguuugcagcucagggacacggugccaaaggagacaaugucuaugaauuucaccuggaguucuuagaccuugugaagccagagguauguucucugcuuucuuguaaccuuuccacguuaagaaguguguccuaauaguuaggugacauaaggacagacucugaagaugagcaaaggggagugagacugcugcauuuggaacagaugcugcuguguguggcugccaaggaguggacauacuggagagccagagcaccagagcugcaucugggcuuggccauuaauugauaugaacuucauuuuuuccccuuacguguuagauaagggcucagaugaaaccucuagcucucuuccaguucugguauucuccuauuuuagugaugacagaggagagucaggcgauagcugcugaagcccucacuguaagguuuucaugagacucagucacugugccaauaaggaucauaggaugcagaaaggaugaagggugaaaaggauuuuuaaaaaaugcugggaguauaggagcaguuuccuucuuuuagccucaggaagcugaagguuugguucauacuucuggccuggugucgagagucuaugaauuuuccugugccagagcucauuuugugguggcucaaauagcccugucgugggugcugagaacauggcaugcccauggaggcugacugagaagccagaaaaagaaacugcugcucuuuccaguagcccucgguggacagugcucuccacuuaucauggcuuguagaagcagggauggaagaggaggcaacacccaugcagcugcucugugaagucaccgcagcauagugcagccagugcaggaaaggaguucuaacgcucgcuuuuucucccagccggcguacaggcugacccagaggcaggugaacaucacaguccagaagaaggggagucauuggugggaaagacucaccaagcaagagaagcgcccauuguuuuuggccccugacuuugaucgcuggcuggaugaaucugaugcggaaauggagcugagagccaaggugagcgaggcuaagcucucauuucugaagaugaacucaugaggguuugauagagugggacacguuacacaggaacucggaggcuugggacgugauugugaagugcucaucauguaagacugguaggcuaccucagggccaggccaaggugacggggucucaggaggugacggggucucggggaagguaaaguacccucuuaucacacgcccgagacacagaggcaaagccacagcacuguugacccaagcuuggcccgcuggccaggacagcguuuaugggccucuccccaucccacugugcucucuggaaggaagucugcccggccacucuuucagagcagggaguuuuguuuccauaucauuuguuuggaaauuuucuacaugagaaguucaccuguucucucccauuuccuuauucagucauuuccauaaauuuauguguaggauuauacucuaacacuguucuuguggcucacaucaucccauuggaggcucuuccacuuggccuagugcaucuuucaaaggccuucaccauugcaggauuuuuuuuucuuuucucuucucccuuucuuacuuucaggcacucuauaaucagguguagcuugcauacacuucgcuucaguucuagauaaccauuucuuuaaggaguuaucuuuuaaaaaaaaaacaaaaacuuguauguguauugguauuuugucugcauguaggucugugcccacagaggccagaagagagcaucaacagaugugggugcuaagaaucaagccuagccauugcucuuaaccacugagccaucucuccagcccaagcugucuuuauuuuuggagagugauauuagcacccagaucagcugacagugaggaaauacaggugugcauacucagauacugagaaauauaccuuuaugugucugucuguauauuaagcuaaccacaaguuuacacugacauuaguuaugauuuuagcaucugaaaaaaaaaacaaaaacaaaaacaaaaccccagagcuuauacuaggaauguaguuucuggaauguaccgucugaaauggcacuucuuacccuagccuaccacuguguuuggugcuauagcaagcuguaagaguacaagacugcccagcuagcugauucgccauuggaugggguacuagacucagugcucaggcggugaucugcaacagucucuccguagagcgcugaugaacauggugggaaggggcagccugaggggucaggucaugcucccagcaccugggaauucuaacuuguauucuugaaaauuuucugucuaaauucuaggaggaagaacgccuaaauaaacucagacuagaaagggaaggcuccccugaaaguaaguggcuaaggugguuaugagucaacuggugaugggcuggguagaugcgguguugggggagaguggggacuuucacccugaugcaagcuugggugaguuuauguuuaguuugaagcuaugaacaccacucuaaagccuugccuuuucuuucuauuugggacuagccuugucugaguaaaccagggcuaaugcagcagaagagaaccuugucuuaugcacagacuaagggcagacagcacucaccuuguguaggcaguggaaaugggcguggacuaaggccacaccccuuuagccuggcaucuucucucacuugaugucugaagggccguggcaaggaugccuuugguuaucaguucuuaagguggaaagugucuccauguaugucuguaccgugugccuguggaguccaggagaccagaagacaguguuguaguuccugaaacaaguuacuaccaguugcuaucugccaugcgggugcugggaaccaaaccaagggccucuacaagaguaucaaguggucuuggccacugagcuggcucuuuaaccccauucagaguuuucauuuuauuuuauuuuauuuuauuuuauuuuauuuuauuuuauuuuauuuuauuuuauuuuauuuugagauaagguuucuuggcuggccuggaauucaauaugucuaccaggcuggcuuagaacaugcagaaauuggccugccucugccuccugcgugcugggauuaaaggugugugccaccccacccagaucucagaauuuuagaaaaaaaaaaucauuuuaucuaaccaaauguuuauuagaaagaaggucuguaagugacuauauaacguucguggugauggugccuaaguccagcagcugccuguuacacacacggccugggaagcacuagaguaacucuagguguggagccggaugaguuaagugugggcaccugaaaaacugacgcuccagcggcaggcucgugcaggucucaggagauucacguguggacugcagaaggacgagugaggugugugcugaaucaaagcuuugcagggcagcauugacaugccugaaggaaggauggagguagcuuuagagaagugguuuccaaaucguguucucugguaccucaagaguucccagaaauucuuuggagggguagaucuccacuuuaauugacauagaucuuguguuuuacacauuuaagauucugaguguguguguguguguguuguguuuuaagugaguuuaaaaaaagcuugagugcgggcgugguggcacacgccuuugaucccagcacucgggagacagaggcaggcggauuucugaguucgaggccagccuggucuacaaagugaguuccaggacagccagggcuacacagagaaacccugucucgaaaaaaacaaaaacaaaaaaagcuugagugaugacagauuuaaaaaaaucaucuuaaaagauaaaaacuuagucucuaaagaggacuaguggaggcaaagaccaacgcagggagccaccucaaugaagacaguugccugcacaaacuuuaugugagucuguagaagccacacaaaagugaaaggagagcacggacaucacaggacugaugucacagacaugugaccuccacacugagccacagcacaugagccugcccccucacaacaacaauagugaugaugaugaugauggugaugguggggagggauggugauggugguggugaggggggauggugaugaugaugauggugagggggguggugaugaugauggggguggugaugaugaugcuggugaggggggaugguggugaugaugaugaugagggggguggugaugaugaugguggugaggggggaugguggugaugaugauggugaggggagaugugaugaugaugguggugaggggggaugguggugaugaugauggugaggggggauggugaugaugaugguggugaggggggauguggugaugaugauggugggagugaugaugguggugaggggggauggugaugaugaugauggugauuagcguuugcuguguuuuaaacuuuugcgacaaggucuggcuggccuggaacuuacuacauagaccaggcuggcuucagacucacagauaucccccugccucugccuccagagugcugggcaccaacaugacuggcccaguaauaaaguuguguuuuuaaaggcuaccuuugauauuuacauuaacuuuuuaguguuuuaaacuugauaaauuaaaaaaaaaacaaccaaaaacuuaaaacauggauuuuuuuuuaaauaaauucaugguuuccugaugcuaggguucuucaugauggggaaggaaguguacauuuugcauuaugaagaaguuugacuaaguguguuacauguggugucuuuuggcccuaugagaugggcugguuuuauuuugaccauacuguuguggucugggcaucaguaaaguguugaugagaguauuggugacacaguuggccuggagucucugccagagacuguccuuuuuguccuuucuuuuccccugucuugugagggaggggccuguaaggccaagcucguucuguggacagagugcuuguucccucuucugccucuggcuguguccucauccugcccaugucuagaggcgcagcucagauccuggcuuagccacauagacugccuguuucccaggcuaaugucuuuuuuucagaggacauucucugucuccuucuggcuugugcuguggcuuuccagcccgucaucagcuccuuggaggcggugcugugcucucacugccuuuguguucccauuuugcccuucgcagacaggacugccuaugugucuauacgaccacauguuagaauugcuuuuguuuuuuucauuuauucuuccuauuaugugagcuaguuugaccugcaugaucuuaaagaaacaaaacaaaaccaaaaauaauccccucaaugcuccaaaccccagaggagaggaauuauguuaacuaggacaaaagcugaagggagacauaguucccucuaucuguuucgagggguggaguuuuucuccugagcuaggcagggcuaugaaaggaagcuggugaguacacgacacggggcaccagggcuucccuccggaguuguguucaggagcucacggcccggcucugcuuugcuuugcagcucuuacaaacuugaagaaaggguaccuguucauguacaaccuugugcagcuccugggguucuccuggaucuuugucaaccucacagugcgguucuuuauuuuaggaaaagguaaguaugacauuucaucuaccucagcugagguggcucucucugccuuggacgugaauaggcaccugcccuuccugcccuuccugcccuuccugcccuuccugcccuuccugccuuuccugccuuaccugccuuucccuaugucaguuccuggaggaacaugcugaccggagcaggccuagagguuucacuucugcggauguguuuuaaggaaacaagaacuauaggugaaguuucugcagaugugacauguggcauuaaguuacaaacuucucaugugucuucaucaguaagaaauuucuguggaauauucacuaguguaguguuguggagcauagagaaagagucaacaguagcauaaacaacgcuuaugaggcuauaauuaaugucuaacuugcuuuucuuuguuugaucauagcaguuugcaaaugagcacucucaaaaagauuagagagaauacaguuuuccaguggucugaauguaggucaauuaacaguaccguuucuuuugcaaaauagguauggagaaaauaagauuauaauagaaaauguaaacuguuugaaaagagacaugaacucuuguagaguauccuacugucugacucugcauuuuccaccugcaguuuucggcuguggagccgguuagcuggggguguguguguguguggggggucuguugaaaggggaggaacugugacuuguuuauaccccugacauuggacuuuggguagcacaguggcagcuaggaccacaugccuagggcuuauagucaaccugugaccagcagccuccaugugaccacaggagagaauggagaagucucaggugcagcuacucucggauuacuauggcauucucauccuggaaggaaaacagggaccuucagauaaguaaaugcucaccuuguucaaccuaagaugguagguggaugcugaguguuuuuucauaagacugcuggcuguagggauggcaagauggcucagaagguaagggugcuugcugccaagccccaaaacuagcuccaccacccacaugguuguaggagagaaacaaugccccaaauuguccauuaacaaccacaugcauaccauggugugugugcagccacacacacacauacacacacacacagacagacaugcuaaaugcauuaagcaguuuaagacauuaaggcuauaaagugaucuaguccaaaagcuaucaagugaaacaggccuguuggcuaauuggugaucaauuuucaacuguaauuuauuuuuucuauggacccuguuaaacugaggauuuagauuacaaauacauggauaaugauuguagcugccaguggcuuucuuuuuucuuuguuuucuuuuuuuuaaagguuuauuuuauuucauguaugugaguauaucauugcugucuucagacacagcagaagagggcauuggaucccauuacagaugguugugagccaccaugugguugcugggaauuaaacuuaggaccucuggaagagcaguuagugcucuuaaccgcugagccaucucuccagccccuuuguuuucuuuuuuguuguugggggggcagaggcaggcggauuucugaguuugaggccagccugaucuacacagagugaguuccaggacagccagggcuacacagagaaacccugucucauaaaaccaaaaaaaaaaaagagaaauauuucagaggacaaccuuguauuauuaauaaggccuugaaaaauuguuaucucuuuuuaguuaggauagcuucucagaauucuaagaauuauuagugcugaagguaugaacacuguuaaggauuuugaaaucuaauuuuaaggauuuuauuauuaggggcuggagaaaugacucagugguaagaacacuuacugauugcuccucagaggacuuggguuugauucccagcagccacaugguacaaaugucuguaaguccagguguccacuccauggcagcaagcauacaaguggugcauagacauacaugcaggcuaaaccaccagacacaguaaaaaauaguaguaguagcaguaguaaugaugaacuuuuaaaaagauuuaaguuuuaaaagugugugugcauuuauuuguaugugcaaaugaaugcuaggugcccuuggaggccagagagggagcugggucugcggaaguuggaguuauagguguuugugagcugccugauacauacgggugcugggcaccaaacucagguucucuuucagagaaaugugugcaucucacugcugagccauuucuacagccuuccugcaaucucauuuuauugaauacuuuuaucucuauguaauugaauuuuugauugcucacaugauagauuuagcuuuaacuucgaagagguaauugaucugaaaagaguuaccguuuugucuuguacacagauuguucuuuucaacagauaguaacaaugaaagcuggggguggcuuuuuuaauuuuuuaaccaggagaaagggacagaggguuuuugucuggacauaagggaguucauccugggaguucugaagccuguccuggccuaggguaggaaugugaaccugacuccgugucuauuuucuuccucaaguucuuuuccuguaagguguggagaagcugccccugcuagaucauguggccugaccauccuguaugcuugugcccuagaguccuucuaugacacguuccacaauguggcugacaugauguauuucugccagaugcuggcacuaguggaaacccucaaugcugcgauuggggucacaaguaccccggugcuaccugcucucauccagguauggaagaguuaugugugggaacaaggaaugaaagauuucagcauggugaauaggucaucugguggauggucauaaugugccauguuccaguuauuaaacauacuuauuugcauaggcuaacacuauuucauuucagcauguagggagguuuuucuuuuuuucuuuuuuuaaugaguuagggucucucuaguccuggaugucguaaaauuugcucuguagaucagucuauccucaaacagagguccuccuuccucacaagugcugggacuaaagccgugcaccaccgugccuggccuugaaggaaacauuuuaaagcacugcuauuucccaaagcauauuuucacauugcuggccuguuuuguuguuuaugacauuuucgugaaaugauaaaauuauaaagagcuucuuauguagggaauuuugauuuucagguaaaagcagagaagccugucucuugguuugauuagguggcuuuagcugcuaaaguuuagcaacuagaaaugguuuuuguucccuccaauaccucuaugcuaccucagucaguuauuguccuuggccugcuucuuagcagaucacauagugugaagagcacacugcccauccgcagaggcaggcaggcaggcaggcaagugagugcuggucacaucucaguacugauuuuaugugcaccaugcuuguccacucucagcgugcauucucacagugucagcuguaugguaagagguauuaguuaaugcaacagacuuuauuauuuauggguuuuucuuccuuuaggaagaggcuguccauuuaaauguaacagggguaguguaugauacaguaaauauccuguaugugaagaaccaugauaaguaaggauucaggguuagccgggcaugguggcgcacaccuuuaaucccagcacucgggaggcagaggcaggcggaucucugaguucgaggccagccuggucuacagagugaguuccaggacagccagggcuacacagagaaucccugucuugaaaaaaaccaaaaaaaaaaaaaaaaaaaaaaaaaaaagaaagaaagaaaaagaagaaaagaaaaaaaaugaauucaggguuuguuuguuuguuuguuuguuuuuuugucuaaguguaagggacaggcucagaaucaccaucuauccagggaauaccuuuuguguaggacaugguggacaggcucagaaucccugucugucuaggaguaccuuuuguguaggacauggcggguaugaagcuucagggcuggccaagguuauaagaccuggacagggcuuauuuugacuugaaagugagggcuaaauuugccucagguuaacugaaguacuuauauauugaggggcuacuaagcagccugaggccaggagcaacucaagugacaguuccuggguucugugcagaaacagugagaaagcaauagagacgaagccuagggagaaggaggaguuaccuuuguugcucuuugaggaaauauuaaagagucuggccugauauuuauaacucaagcagucugguggagaacauuuucuguauaaaauaauaauggaucacuagucuaaaauguguuuacuugguuuugcacaaacacuguagagauuuuuauuuugaggaaauguggcagguuagguggcuggauaaauaugcaugcugccaauauagauucaggaaggaaaaaccaguuuagugaugagcaggccaaaaaacgaagugacuuugggcaugcagagcuuagcuaaacacccaucugcagaacuacaagcucaguuguaggcugucacaagguagaagugggagccuucccucguagagcagggacuccagagagcugcuguggcugugacaucacacuugugcccccgcccccaguuuugucagaaagaaccugucuuaagaggaaggagauagacugugaccugggagguuaagaugagaaggucuuaaguguaaagccagcauaaaguagcuggugagaucugucucaacaaaacaaagcaguagacucugagaccgccagaaggcucugugauagaacuccugucuccucgcuguuggcacaaucuugacgccacagaccuuaaagagauccuccaguaccaacaaaucucuucugugaaaauuaccuuugggggccggaaagauggcucgguguuuaagagcaccagcugcuccuguuggagaccugaguugcucacuucuaacugccucugauuccguuuuaggagaccugugccucuggccuccaaaagcaccuauguuuacauacacauuauuaaaaauaaaaugaaauggguuggagagauggcucagagguuaaaagcacuuccagagguaauucccagcaaccauauaguagcucauaaccaucuauauaaugacaucucuucugguaugcaggcauacauguagacagaacuguguauacguagaacauaaaucaaucuuuaaagugggguuaagugcuggagagaggauucagcaguugugagcacugacugcucuuccagagguccugaguucaauucccaguaacaaccacaugguggcucacaaccaccuguaaugggaucugauguccucuucuggugugucugaagacagcuacaguguacucauauacagaaaauaaacaaauauuuuuuaaaaauaucauggagagucuaaaguggguuuaacaaauacaauuauucuaaaaaaaaaaaaaaaaaaccaaacaacuuugucucaaagaauuuacagauugguuuccaaagaaaaugggagacuuccaaucaaagaucauaaaaccaaagaaacaagacauuugugcaagaaauagcagaagcagcagacuguaggaugagccaugggcauuguagcugugagagugccugcagaauagaacacagucaugcggagguuggacuauggaggcagguggaucucugugaguuugaggucagcacggacuacaaacagugaguucuaggacagccagagcuacagagaaacccugccucggggcaaaaaggaaaacauuucaucaguugugagccugcaugacuuaccaugcuuuucuuuucugugagguggcuugcauuuauucuuacuguaaauagggcuaagguuguuuuaaaaacagagcuuuaaaaucuuagcacauuccaaaaccacuuugauuggaacugaauuuaucaguaaauaugaggauguccuuauaacauugaguuuuacaauugaagaaagcuaggucuuuuuuauuuauuuauucauuuauuauauguaaguacauuguagcugucuucagacacuccagaagagggagucagaucucuuuacggaugguugugagccaccaugugguugcugggauuugaacucuggaccuucggaagagcagucgggugcucuaacccacugagccaucucaccagcccgaaagcuaggucuuaugcuuucuguucuuccugucccuuccuguacuguaaaugcccgcagauuuucucuucagcugugucuaacuuacuuuuacagugauuaagcguuaaugucugaucacuauauuuucauuaauagaauuccugcuucccuccuuucuggaucugcuucuacuuuucuacuuucuuacuuccugcccagguagucgagcucucuguaagcaugaguguguuggggguuuuguuuuguuuugagacaggguuucucuguguagcccuggcuauccuggaacucacucuguagaccaggcuggucuugaaaucagagauccacuugucucugccucccaagugcugggacuaaaguugugcgccaccaccaccaggcauaguaagggaaauuuugauacaugcuacaacagggguggauccugaguacauugugcuaacugaaaugaaucagccccugaaagacaaaugcugcgucaucuccuuacaugaugcauucagaauagucagaaacaagagacagaauguggaguggugguugucaaaggauggagauuggaggcucccuuuuggugagucacggugucaguucuacaagauaagaaguuaugaagcuuugcugugcuggugguuguacaacauuacacauguaccuaauacaaccacaguguaugugauuacuguaaggccagguguaguggcacauaacuuuaguuccagcacucaggagucagagacagguagaucucugugaguuccaggccggccagaacuacauagcauaaccuugucucaaggaaaggagaaaaaaaaaaaagaagguuaugucuauguuacaauguaaagaaagagcuggcuggcaagguggugcacucugguacugcagcugcucugguguggagcauggguuaguuuaauaaguacagaagcaaguuacagaguaauccauauggcaugagcucuaaacggcuaaaugauaggcacaggagugcuggagagguggcuuaggagucaagagugcuugaugcucccucagaggacuugaguuugguuuccaauccccaugucggguggaucucaaccaccagcaacuccagcucuagaguauugaaugcugcccucuggucgccacaaccauccacacacaaguggcacauauacauauaaguaaaaauaaauaaauuccaugaaauagcaugucauacaggucccauguaccagcacuaggcuguguagacacacacuggaaugaugagcacaggacaauauuacauaccauacagcaaucacugugucuguaaugcucuguuccuuacugugggcuaugaaggcgccaaugcucauuggcaguauccuauauauuauguuuguauauguaugugugcuuuugauaucguagaaacagaagauaauagcucaguguuauaaaggaucaacuaaauuugcuuaggauaugcuaagcuacucaagaguagaauuuaccuaaaggaauguuccugguucucuuaccaggaagagcaugaaucugccaggcaggaugacacuggguaauagcugucugguaaaguagcccuugucuguuuggagacaacuaugauaguauuuuuacaucagaaaucucuccauuuguccaaacaaccaauccuugggauuucugucucggugaaacauguuuauaugcucaaaguguaacuugggucccuaaagcuauauaagcugauaggguuucuuauucaggcugguccccuuugugcauuagccagaaccaguuuuaugcuagcauuaaagggauuuuccuucauuaaacucuaagugguggagugauuucucacugggaaggcauauucuguaucacuuuaauguacauguuauguagguauauacacagaaaaguacccauuuaucuagagagacggguuuguaacaagggaccaugaaauggcucaauggguaaaagcucuaagccugacaaccuuaguucaauuccugcaacucaagaggaggagagaacuaaguccugcacguuugucaugguauacgcccuuccauccacccccacacaaaacaaaccaguuuuaaaagacuuuaaaaaagggaccaucuuaacugaguuguuacaaagaaaguaagacuguuucucucaacggaugugauuuucuuaaugcgucaagaaagaucuuauucgaauauuauuuccuuuagugggcuacacuguaugucauuacuuuuagguauuuucauaugcacauuuuaaauaaaacuguacagugcauuaagaaaagggagcauuuguaagugcaugcaugugcugugggaaugcagacagauauauagguaugugcacacagauacguacaauguuuaaauucucucucucuuuuggaucuuuuuaauaguuucuuggaagaaauuuuauucuguuucuuguuuucggcaccauggaagaaaugcaaaacaaagcugugguuuucuuuguguuuuauuccuggagcgcaauugaaaucuucagguggguggguacaaaugcugcccggcucuggaguguguguugcugcuuuggcuggaaguuucauuaggauuacacaugugaggagucuagcuacaucagggugcuuggcaguccuaaaacaggccguuuuaaagcacugcuuagagccgagacuauagggaccaaagggaaccaaagaaugaaagauccaucuauaaacucaagguuucacuguuguguuguaaagaagacccaaggcccauccauccagagggaaggaaauacuugaagagucaggaggaagacgaagguugaagcagcaauccaggcuggguggguuaguuaagagagcguuccugaggguucuuacuaaagagcacucucaucuuaugguaguuuguuuauauuuuucccucuaaagggcuaaggcaggaggauugccaugaauuugaggucagccugaccuacacacugagacucugagaaacaaaauuaaaaucuauccaaugaagcaauguuccuuuuuaaaccccucacccauaccgucugcuuuuucccagugugucauacgcaguggggcuuccucagcucugguguguguagugacaguuugacaggguuccuggcacagugggaagaggcaguggugccugcaccaugucuuauugugccuggaucugaacccccuggcaccauggauacaaagauuugaaacagauucaaggucuuugaugauaacauuuugggaagaaauuaauuucuugugauuuuuaaaaaauuuucuuuuucacuuuugaagaaaggucucacuauguagccuuggcugcccuugaacucucagagaucuuacugucucuucuucugcgaugagacuuaaagacaugcacuaccaugcccagugugaugucucuuuaagccugagcauuucugauucgagauuagaggcuuuuuguauaauuuuauagaauuacucauuuauccagaggcagcuaggcaucucucccuacuaggaacauagaugagagcuaggaauaaagcuauguucuaagcauccagcacggagcugaacaaagaggguuccuugaagaauacacugagccugcccauagacuucacagccuggugugugagaaugcccaucuaggguggaauucagagccugcaguggcuguugucuuugauuucuguuuuccauagguaucccuucuacaugcucuccugcauugacauggacuggaaggugcucacguggcuccguuacacuauguggauuccguuauauccccugggauguuugucagaagguauuuuuaaaaacuuuagguucauaguauagcucucaggggugcccaugugguaagaggcugguuuccucucugccagccguaaucuaaucaaugugguauuaagaccucaggccuuucuuccugauggccuuuuuccauacucuuugucugacuguuccagagacaugggucucauugcguaagguuuggaagcugggugcuccugugcugcaugcuuuuuauuuacaagcuauucuuaauauuccaaagagagaucuuauuaguaauuucauuuuauuaugacagccccuagugaauagaucagacacaaaauuuccucccauuuuauagaugaggaaacagaagcccagugcugggcuguucucaucagucuccuggaagcuuagaggcaaugugagaacccgggagcuuucuguacaggcggguaggagacaucuccugcagccucaggcuggagcugugagcccgaggugcuggaagcucauguguuccauuugcuucucacugcuugcuugcuuucagcuguggcagugauccaguccauuccaguauucaacgagucgggaagguucaguuuuacuuugccauauccagugaagaugaaagucagauuuuccuucuuccuucaaguuuaucucguaauguuauuuuuagguaaguacgucucuugucauauuuuagacaggagagcuaagugguucaguuuuagcaucccuuaauauaauucuacuucugaaagaguggccagggaaaggcuuuauuugugcaaacagacccaguaggagaguuugcugcauguggaaaucuuucucucaggucugcaguagcugaauugugagugcucugucagugcgagucugucauauauguggauauugaggcauaccauacaguaucucccgaugacccacuaagagcucuucuaacaagagcaggagaugagaacccugcugccugcauucuaaccuacuuggggcugaggaggagguagaggcguggcaaaugaggggggagggagguggcgauggucucuguugggaagcgccccgcugauuauggccgccuuaguagguuuguauccaacaugaauucuagauuaacucagaaaagcucagaacuaaccggaacaagagauaaacuuaaaauuacucgaaagccaccguaacucaaggauuuccuguaagcaucgguguuuagguuauguauuugacuugguagauuuaaauaaacauagcugcguuguaggcaacaguggguucagccacugccagugugcuagcucucuugguguguacuguauucaucaagacguagccacugauagauaacaagaguugucuucagacuggcaaggcucagugcaagagaagggagggaaggaaucaguagugagcaucuaagagguugccacccugaacagaagaugaacaguacaaauggccugagagguuaaaaagccgaguggucuccaugauuuagugugggagguuauacuacuuaggaggcccuaugaaaaaaaguuagaauucugugugguggcucacauuuguaaucacagcagcagggagacugaagcaggaggacugccuuaaguucaaggcuagcccaggcaauagaguaagguccuguacccaguaaagaguggaaauauuuuaauaugcagugacccuaugaccuaucuuuuuuuuaguguugcuuaauagaaagauauguacauguuauuauucaaaauuaaaccaauccaaaauuguaaauuuugggucuuaaccagguaguauauguucauaggucaaggaauuuuuuuaugcacauucuuucauaguaaguaugugauguguuuuuaucccuguuguacaacugaaggaacugaggugaggcuaagcuacagaacuuucugguuaaguagaauugaaacuggcaucugaaauccuguuuccucacauacugcuuuguacuuucagacuguagcuuacuuuuaaaaaaguaaguucuuuaaaaaaaaaaagucaguucuugaauagcccuucagcucugauuuagccacucauuacauauguauggggggaaaacaggcaaaaaccaucguuaacuuaaucaucuauguagggugaacuguauugaugacuauauuaauauugaaaugugucaaaacaugagagucagaugaacagaucauaggcaugagauacacacagucugauggaaaguuggauccagaagcuguucaguagacaagguuuaucucugucuaacccugcacaagaggccaugagcagugaggccacaagccccugcagggcuggacaccucucgcagcacugcuguggguuccgcuguaucugagcaauagauuuagugccgugaggccugggcacaaacagcagauaacucacuucccugucacaaggacauuucuaaucaguugguuuuuuuuccccuaggguuauauauuaauuuucgucaccuuuauaaacagcgcaggaggcgguauggacaaaagaagaaaaagcuccacuaaagaugaauuugguagcuucauuugagcagagucuaugauuccuacucuucuacuucuuguacugauauaaggguuuguuuuguuuuguuuuuuaaaguaaggcugucucucuuucccaguaacauuccugagucuacuguccuuaucuuaguguuguacuugcaugacauggauaucugguaucugaggacaaguucauucuuguguauuuaauaacaaagguggcccucuucaugucugcuccucccuacaggcacugucugucuucacagggcuuggucuuucugcugccacuugugaaaaccgaaaaaaaacaagacuacauagcaccgacuuuuugaaaaucagauaaacaugguuauugacauuuuuugagucagaguagggcuggagaacacuucauauuugaugccuuuuagcuaaagacauucauuacuauagcacuucccaggcauugaagaggcagagugauuuagagaacgaaaucagaaccugggaacaccaugacuacuucauuucuagcuaaaucagaacugccuucaacacuggagaaagggagaaguacugcgcaacagagauuagaaguccaaaugugaauggcugcaggggucagaagggaacagagaugcaggagacaggcaggaucaguugugguaaugaugccuguggcaaacacaaacaccuacuugggcugcacacagucacacaaucaaucuauaauucuugggguuagcucaguccauuuacuuguguauuucugagugguuggugagauuacuuuauugaacuguuuuuuuccuuguuagauuuuuuuuucucuuuuuuuguuuuuuaagauaggguuguucuguguagcuuuggcucuccuagaacuugcucuguagaccaggcuggccuugaacacagaaagagauucaucugccucugccuccugagugcugggauuaaaggcaaaagccaccacagccuguuuuguuuuguuuucgguuuaaaaacaacaacaaacugugugcaugcagaauacagaccuugagguuggcuacuguucaagacagcuucagucucucuaccacauuccauguaaaccuauggugaaguaacaccagaaaaaagagccugagaguggucgcuuccaucuuccacuccccuuguucuuggggggaaaggaaggagacuucugcuguugcagugagcccagaguggauuggcauuaaacuggcugcuuugacacaccucaucucacccaagaguauuucccaagucugcagcuuccgucagcgauuguuguguuaccuucugguguucccucacugauuguggacaaaccuggcaguugagcuuugcagucaauuaugccguaucccugugcaaacucccauguucuaguugcuguuagcauccccuuuguugcugucugagaaagugaaagauuguguauuucuauuaaaacauuuacagucaaaauccuaau

SEQ ID NO: 5167 - RNA, 2971 nt, Mus musculus
caugcccccaggccccgaggucccagugcagguguggguggacggucaacucuuccaggcggagcagucgcugcugguggagcacugcggcuucuuccgcgggcuuuuccgcucuggcaugcgggaggcgcgcgccgcggaggugcgccugggcgcgcugagcgccuccggcuuccgcacggcgcugcgggugcugcgcggagagcggccggcgcuggcggccgaggacgaguugcugcaggcgguggagugcgccgcguuccugcaggcgcccgcgcucgcgcgcuuccuggagcacagcgucacgucggacaacugcucgcuuuugugcgacgcggccgccgccuucggccugcgcgacgugcuccacagcgcugcgcucuucauccgcgacgggucgcacgagcugguggcacaacuggagcugcccgaggcccgagccuacguggcggcgcugcgacccagcaccuacguggcggugagcacgcacacgcccacaccgggcuuccuagaggaugcgucgcgcaccaugugcuuccuggacgaggaagaggacgcauggcgcacgcuggccgcgcugccccuggaggccagcacacugcuggcggguguggccacccugggcaacaagcucuacaucguggguggcguguguggugccagcaaggaaguaguggagcuaggcuucuguuacgacccagaggguggcaccuggugcgaauuccccagcccucaccaaccgcgcuaugauauggcgcuggcuggcuucgaaggccgccucuaugccauugguggcgaauuccagaggacacccaugagcuccguggagugcuaugaucccgccacagguugcuggagcuucguggcggacuugccacagccggcuacagggguucccugugcccaggcacguggccgccucuucgugugccuguggaggccggcagacaucacugccguugucgaguauguggugcaaauggacaaguggcugccaguggcugaacugugucguucacagagcuacggucacuuuaugguggcccaucgcgauagucucuauguaguacgaaauggaccuuccgaugauuuccugcacugugccaucgauugccucaaccuggucacaggccaguggacaucgcuaccuggccaauuugucaacagcaagggagcacucuucacgucuguagugcguggggacaccguuuauacugucaaccguguauccacguuggucuaugccauugaagauggcaccuggcggcugcucagggaaaaggcuggcuuuccucggccuggcucuuuacagaccuuucuucugcggcugccuccuggcacuacuggaccuguggccaccgcacugccagaguugugagcuuggaaugacuucagaagauaacacaagucuccaugaaccuuggcgguguccucaugagccuugacugugugauuggggagcucuugggaacuccuuuuucccuauuaagacacucagguuugcuuucugguggugcggguguccacgaagcccugagcaacacaggugcuuggguccuuaaaucucuugggcucuguugggagcuggugggucacaaucucagggaaaagggugggguuacaauuugagcaauccggacuuguaggcgaauacaagucuagcuauagcuacuauagcuagaaguggguuaagugauguuaaaccaaucugcuaauuagcaggcacaaaaugucaauacaacauuggccuguaguugucagcuguggcacagagaagcuugaagacaauaccagcuuucuuaacacaaaggucaggaugagaaaacaggucuacacauaauuugccuccacccacaagcugacagcaccaugcugauuuuaaaaagcaaacaacgcaccgugcaguaagaagaauacugaagcagucagccuggaagaacagcuucggaucacagagucugaguguuucaggagcagagagggggaagacuggacaagacaggaucuugguaagcuccagccuuuuuaagcugaacagcggaagauggaggcauuucgccagugaggcuggacuaaauuauagcaaaagaaacucagcugagccugaagcaagaaggugggagggagcaaggguucccuacaguagcuuuaaggacuggaauggaaagggaguacccggguguaaauccuugaccuaucuuuuuuguaaucacuguaacuguagacuguuaaucuccugacuucagguuacuuaagguggauggagccuagcccugcugaccucucagggcauuucuucauagauaugccacaggcuccaccucucuuguaaucucugcuguggccauucccugagccuacagugcuaucccucuuccucucugucaguuccauacccaccuccucucugcaggcuugccugagccagcuccuguuuuccugacuuggcugccagcauugcucauugaucucuguguuggauaugcagccauaccuguuugcagauagaaggcguagggguccaauacuuuuaacugagccaggcacccccuugccugcggaaugaaaugaagucuuacaagaaccacuaguuaggggucugcuacugacugacaggugcuguuaaacagcucucaucuuaaaagcaauacccagacccagcuucuguuacagaugccugcuucagcccuacagccuggccauaucccagguaaaugucucucaaugguccgguauagucucuauccuccaggacucaaggcucauagaaaacccuggcuucagaagucgagaauacagccuuggcaugguacucccugagcauggagccuuguguugggccgucgauugcuaccucuucccugauguguaucccaaacuugaaauaaguugccuuugggaguguggaauugucuagccuuuuagucuagucugaugaaucacaacaauaaacucugacauuuguauccua

SEQ ID NO: 5168 - RNA, 2229 nt, Mus musculus
ugcaacgcaauagcagcaauggaccagcccuucuuuggguuuugaugucccugucuauaaauaccaaugggcagauaaaugcaaauuuuggggugugauuuuggcaggccugaguaaauucuagaacccugaaggccuguauucuggaaaacacugaugcuggagagggaagggcauacuagcuccaucccauuccuggcccauaauggugagcugucacccauucacccacugugaggggaauccaccugcuuccauagcuguuaagcuaauagaaagucuuuguuaguuaggcagcaauuacacuggguguuugggaucccaguguagccuugggccuuucucagggugagcuuuucagcacagaacuauuucccagguugacacauaucaguuagcaagaacaguuagccagaaucagaauuacagaagccagaaaagcaguuagagacuuucccagaacuaugggcuuuaaugaaucaggucuuuguucuuguuugggcagguggugcuguauaugagccacauuuuguggccugaaugguacuuccaucauggagucgguucuguuaaggucugggccugacuaaguucugggggguccuguuauaccagucagaaaacaaaagacaaaaaacauggaaaccuggccagcaggcagaggguccaggguauaaacaggauggcagugucccuccuaagcaagaaaaaaacaaaacaaaacaaaaaacauuuuucuggccaggaugugaauucugacuuggucuagcuguugagggauucacaguaaaccagcuguuauaacgcuugugagguaccagagggauuuguuuacauuauaccucagacuagacuugcuugagcagcugaugcauaagggguuuccucugaguuggaaaaguaggagccgcauuguagccacaucccccggcuggcuaaaguccugugcagacuuuccagauggggcccaugaggagaaaacuugucucauugcaggagcgcugcaaaggucaagggggagccagcacagguccagcagaugagagguuuuaccacuucugaguuugugugacguaggagaguugcuuagagucugucuugggcuggggcucaguucacucgaagcccuggaaucaguccccacccagcaccaaguaaacccuagugccugaugguacaggucucuaaguccagcuggugugaguuggaggcaggaggaucagaaguuuaaguucauucucucuuacgagaucaggagaacgggaggagccuacacuaugucagagccugucucaaaacgaaaagguucgcucaagagagguuauucuguucgggcaaguagcucaacucuucuugucuagcccccucaaucaaagcucuuauagaggacuucagacacucaaaacguggagguugcguuguugggcccagcaaugggcaugcggccaguguucaguagaugugcaaaguagguaagggaugaacaggugaggaguguaggacuuguaagucuuuccuggugccaagauacccacaagcaauugcacauaaagcuaagcuguugggaacucuguggcaucuucuccugggucacagcacaacaugccuucuauuguugcucuguggugcuucacaauaucaaaaccuaguagaaccuuagaagucauuggcaaaucccacuccacaguaguggaacugaggacuggagaggcuguguagcuuuggcaaauugguggccacagagcauugaaggcccagguaagcauccuuuucccaacuccaggagcugcaagguacucccugccccguguacugucuucacuacagcuggaaagaggcuccaccaucagaccauaggguguuuucucccaagacaagaguuaugucugucuccucccaucaggcagugcucuucugggacagaaucuggauuucccguggcucacuagggauuccaauagguugggguucaggauuccacugaacagacccugcuagagaggugacugagcaguuacguauuguucuuuuaaaagaagauucaguuuugguucccaucacccaccuaguggcucacaaccaucuguaacaccagucccagggaauuugacaccuggccucugcaggcaccaggcauucauaugguacacauacauacauucaggcaaaauauucauacacauaaaaauuaaauaaauagggcuagagagauggcucagugguuaagag

SEQ ID NO: 5169 - RNA, 4586 nt, Mus musculus
ucaugggcaucuuuuauuuuauguuccuugguaaaaacaaauaggaguucuaacuccccccuccccccgaagcugcaccuguuuuguaacccugggaagguuacagcagcccuuuucugaaggauucuacacccacgcccccagccuggccucacacccuagguggucuugguccugacagcuuggguagaagacagaagacaucuguccuuguuugccaccaaagccuagccuaacaaggacagauccucgcccaggcaccugcuguuuggggucagcccccccucccugaccugcucugccucuuccuaggaaagagcaucuauggugagcgcuucccagaugagaacuucaagcugaagcacuacgggccuggcugggugagcauggccaaugcaggcaaagacaccaauggcucacaguucuucauaaccacagucaagaccuccuggcuggauggcaagcaugugguuuucggcaaaguucuagagggcaugguaaguuaaaauguggagguuaaaccucgguaguccucaccaaggauccagcuggaacgggcaagggcuucaaguaggaaaucuuuuccccaaaggcgccuaagccacagauacagacaggucaggggcacugguucuuccuaaccuggcauggagguggggagugucaagaauaaacagccuggccaggugccucgcacaugccuaugguccuagcuuucaggaggcugaggcuaggggaucacuugaacucgggagucagagucuaggcuggacaaccugggaccacguuugagagugcccgugugguuggcucugugagaggcuuaaccuggaaugcuugcggcccugaguuaauccccagcaccacaaucggagcuccgugcccccaaggcucuaaguccuaggccccagacaacccauccagaagaccuggcugaguuuguccggcugcgggguccuguuuggucacucauggagucagggguguucggaaucacgucugagcagcguuggaucagcuguccagcaucguguucuguguucaccuauguggggcucucucccaggagugugccucuugacccccgcucaaccucuccucuccugccuuuccugucuaggaugugguacggaagguggagagcaccaagacagacagccgggacaagccacugaaggaugucaucauugucgacuccggcaagaucgaaguggagaaacccuucgccauugccaaggaguagagagccugggggaccucaucccucuaagcagcugucuguguggguccugucaauccccacacagacgaagguagccagucacaagguucugugccacccuggcccuagugcuuccaucugauggggugaccacaccccucacauuccacaggccugauuuuuauaaaaaacuaccaaugcugaucaauaaaguggguuuuuuuuauagcuugggugugggcuguguuuggggguguauauaacaccuguccugagugugugucccugugugggacucuucugugcugauggacgcaugcuccucccccggguuccugccuuagccuguacuagugcaacccacccacucaccaggcagagacuuucuagcuagcuccugugccucaucuuaagcuuacaccugucaggcugggcuagaaaauacaccugacucuucucagccuaccucugaaauuaccucacaccuuucucuuuaucuugacuucgccacgaccccugggcuuuuaagagucuugaguucuaccagcuacagcugucagugcaaaccaggcucagagcuuugaguggggaugggcacaucugagccucagccaguuacaccugagucuaguccaagggaagacccauuuuccugagacugaggcacauagcuguccugaaagguggcccaaugccugggcuagucagggcacuagugauggagcaggaugacaguuagccucuggcugggcugguaccgggcuggugcugaagccauaaagacccuggagcacgccguccaccaccacuucugggagagguucugugggggagacagugaaggagaaggagcuagcaggugauacgcuuggccuugagcuugcagcacucugagcugcccacaggcucagccgucuacccagaaugaggcgccaguggcuuucucucuuccacaucuauucauacuagcuuuggaagacaggccccaggggaacagagaccuggugagccaacuguauuacacuagcuucuacuagucacaaagcaagcugccaguuacaggagcagcaggugguaaccccagaggacaggagggaggugcugaugggaacucaccuggggaaggggugcaaacguagggauccauacagaagccaaugaccggccgguggugcagcugggagcugugugagagaggaguugugaacagugagaguggagagguggcgacgcaaaggcucaugggauggucacugaggaccaaaauccauccccagggacccacagaggaaaaggaagagacuggcuaacaggcugcuggccugccuccuagcacacaaccaccaggggucagcaggccuuuagggcaggacuuugacuugccuggugucacuaggcaggaauucccccagggugcugaaaagaagagaaacacuaaguugcuugaggauacccagggggauggugaggaggggguggagacacuauagcccaggagacucuugcuucuauuuuguaacaagcccaguuccggagguggaggcaaggcaguuagaguaaccaaagcuguccaccaaaaagcagccccuguuccaagucaggaaaggugaugagggaagcgguguaucagaaccaggccagggcccaguccguucaaaaaggaaaaaagcuuauccuaaagguucccuuugcggccgagggccuugccacgugagcaggguuauccuuaccuccagcugcuggucuuggagucuguagggaaaugucuaagucucaagaauuccaguaacuccuugggcacauccugauucagguacaggaugcccuagagaagaaggcagagaaagucugcaaucagauaagauccagcuacuaauugcacaacccauuacaacaauuuugaggacauuuguuccaaaauaaugaagacuuucaaggcaguagaaauaaguauuagcccaaacucagggucauccuaaggaaugaaccgcaaagacuagcaccacaaagugggcaggcuagucaaauaacuaucacuguuagaggaaggaguccacacacaccucaugaagaaaauacaggaaaacacccuaagggugaagaaucuacucauuggauuauucaaaacuuucaauaacccagauagaaaaguucguacucauuuggauaaagagccugagauacugaauaacaaccccaaguugugggacccaacacacucccacaucucuaacugggucuccccuggucccucagacuuaggggcaaccaaguguaccccgugcacaccuggauguaggucucuaaucccugccggcgcuguuccaguccucugguccuccaguugggcaggcguuuugagggaaagucaggcacuuuguaccguuucuugaucuguacaucaguuacagaggugaguucccagcaaagcacucaagcccacugcaucuagcugaggacuuucuccaguccucucuauaugucugucuuuaagcuucaaccugggacagcuggcaagaggugguugggacagaagugacaagccagagaguggaaaggacgcacacggacaaggucagucugagcugagcucuagccauugcguccuccccgcgaggggcccugcagcccagggggagucgccuaugaucugcacccuccugggggcugggacaguaaugggggugaccaaccagaagcugggaucagagcucuuucucaugccaccgagggaccuggccuggagccaaaucgguggguaguccgcgacaucucacccgcuuguguagagcguggaacucgcuguagcgccgcggcacggugugucugcguccgcuguacagcaccuccacuuggaacaccuggcgggcggaggagugcagacggcggguccaaaggaugcaguaggacccgcgccgcgagacgcgcccaauuucugguguuagaaaggcacaaagccgacuuggcgugccaccaucagggaaaccccuuccgaaccccagacacaccugaaagaaaaggguaaccggcccuccccucugcuccaagcgaccccucaagagcccaaaccauuguccaaggggcuggcaaagccaaguaaccccgaaccuuugcgacgaauguccuagcccugaauucugggucccuuuugcgcugaucgcgaagauaaucgguagauccccgcacacacucuucguccauuugcucaccauguggccuuucucuggacucugccugggcccuucggccucgggccccaccgagggaaugugaacuuccagcauccgcgccccgacccggcugcagccucucccggaucgagcgcuugggcacccgaacucccuggagcagccaagcagcccua

SEQ ID NO: 5170 - RNA, 2128 nt, Mus musculus
aaagacacucuuauuuucugagauaaagaugaaaugaggccggcaugguggcgcaugccuuuaaucccagcacucgggaggcagaggcagguggauuucugaguucaaggccagccuggucuacaaagugaguuccaggacagccagggcuauacagagaaacccugucucaaaaaaccaaaguaauaacaauaauaauaauaaaagaaagaugaaaugaggguuuggggaagcuccacgaaggcuaaagagagccucuuaguauggagaucugcucugugucugccaugugcuacuucccggggcugaaaugccucuucuuuguuuugugucuucuaagggggugggaaauuaugaaugacccccaggacucacacacagcaaacaaauacugcuacugaaucacauccccagaccuacugaguuauuuugagagagguccuugcuaaggugcccaggcuguccuugaauucaguguaacccaggcaggcuuugaacuugcaguccuuccugagugcuggaaauaccggcagaggccaccagacacagcugacuuuuaacuuucuguaugcaucagcccugacaggaacuguugggacccugcaagccucaagaggggcaggggaaagauccaugcaagaaaaagacugaaacuugagucagcaccaccuuugaaaguggaagaguuugaccccaggguugauuuuuaucuuacguuuuaaauacaguaaaauguuggagaaagguuuccgggugacauuuagaacaaagcuuuaggcauagugacauaggaacucccuagcaaaguaggaaagcgccugugaccuuuacgauaggaauggguucuguugacugcugaccagugcuccuggcuaggggcuaaggaguaaggauguauacucggcuuaaggauggaaucuauugguagaugaugcaaaguacaugggaccuccuucaggaggaaggguucuauuugcugagacaaagcucgggacuaaggggaaucagaaaagcuggcucccuagaauaguaaaaaaaaaaaaaaaaaaaaaaaaaaaaaucaccagguugucagccaccauccacuccccccuucugggugaccaggcaucaguaaucauccuuuggagucugguuuuuccagugguuucuuuaagcuuuccaugaccuaauucccugucugcaguucgucucccucccgccaagcagucuauagaccgcuguuauauuucucaugauacuuuggaaauuuugauuggcagcuuuuucuugccuaauagaguuuccuaguacauaagucacagaguuccuugagacaccauuaugugucaugaguuuuagaaacauaaaugaauaguaaaagucuggaugggaggaggaaaugagaagaacaaaggcaccgcuaugaguguauuuaugauccaauaaaaucccugugguagagccccaaauugccuucauuccaguuaccuugucuaggucauuaaccuaccaucuuacucagucccccccacccuucaauuccagcaccagggauacaaucuucggcaaauacuaaggucucagucaauauuugaugaguuauauuguguuacauugauaguaaucuaccauccaguucuuaugacugucaggugcuuccaaccaccuaucucacuagccagcuacauuauuugauuucucauaauaaaccagugaggcagaugucucuguuugccugaugggaaacugaggugcacacaagagaccuuucguagggucauucagacugaacuaggccacagcugcugagucuuuucuugcuaauuucugaucauuuccuuccuaacuaagguauugugugugacuuaucugaaacccagaauuucauuuguuugcuugcuugcuuuugagacaggcccaggcuggccuuggguuugugugauccuccugccucagcuagcugccugaaugcuggaauuauagacugugccaccacgcuuuggaacaauguuuguucuuaaaacaccugggucuacuuuuguguauuuucuacuauccuuauguuggaaauaacccauugugucaagauccuuaaauaugaggaaaagugaaauuucugucuguauaaauaacauucuuaaucaca

SEQ ID NO: 5171 - RNA, 3202 nt, Mus musculus
ugugaguuguggaucuucuuuaaccaaaaggauccuucuagaacucuuggauguccaagguuucccucuuauauccuugagaggguugcugcuuucauagguacagccgugggagguagaauggaaaggugacauccuggaacacacgagggaggcauucuggaauagacgacaaggaagagaagcaauggucccacggguuaugugcugacucugucauugcugugcuuagguagcaacucacuuccucucauggcuucucuggcuucuucgucagauguugugaauguaauuucagaaugguuuccuccacugggcgugaguccuaacgugugcuucucauuuacacugaggggcuggggagacagcucuguugguaaagugcuugucacacaagcaugaguaucugaguucaaucuucagcauccacguuaaaagagcuaaauaccccagugcuagggacgcuagauaggauuccuggggcuccccagacagucaauuuagcugauucagagagcucuaaaucucacacacacacacacacacacacacacacacacacacacacagcuucuuuaucagauucaucguggcugaagugcugugguccagccugcuaucuucaauaggcuucgcuccuaguguuuauggaguuuucuguguguguuuucccuuugcucguccacucguggcuaaagcaggccccgucuuguccaccuuaguuucccacagcacuaggacauuuuaccuuuaaggauaugcuacuuaaucucuaacgcuuugcuauuaaaagcuuuugacuuauauucggacagugccaucagggugaccucaugcggcucccgccugacuugaggcuuucacuccccgcuacaguagcauugaccugaaagaaugccaggagaaacugugugucccuggaguuggcgugaccaccagguccugggaguuccaggucaagccuggcugaagcucuguccuccgugcuccaaagcaguugggaaaggacguaaaugggaaagcagcuagcucccuucaucccacaugcauuacaauucuccuuucacgggaugacguguguuaaucuucugcagugaggcucagaagggaguguuuuaugucucuggcugucccaaaggaucugagagcugcaagagccaaguucccguuggaacaggagauccacuauucuggacugaaggaaauaacugcucauucaguguggccuuggaacugugugugcacacugagcuuggcuucauguuagguagcuggagaacgcagauccugcagagccuguuggaguaaacacauuauuagaaucaugagaagggucagcaaacacacaggcauuagcgcgugcuaaggacagcccacugcccugaugauacuuaaugguccagggugauuaucugucacaggaagaugccgcaacugccugagguaauuuucuaaaaggacguccuaguauuguuuuaggugcacuguuugucaagacuggucugcagcagugguucacagucugugggucaugaucucuuucagggguugagcaacccuuucacaggacucgccuaagaccaccggaaaacagauguuuaccugaugacucagaguagcagcaaacacacaguuaugaaguagcaacaaaaauacuuuuguggcugggaucaccguggccuuucugaccaggacaaagaacccuauuaaaggguugcagcacuaggaagguugcgaaccacuggucuagagggacagagggacccugcccagguggugagcugcugcagauacugucacagcuaguaaaagagggacacagggaggaaguuugcauuuuaugcuuugucccuucaaacuagugcuagacacaagguuucucuaugcagagaacaguuguuguucuauugaucccuucugggauuuuuauuugugcugaguccuauacugggcauucugagcaauucaagucaaaguggaaaaauccaguaggugccccagauguccccugaggugagagcagagaugggggugggggcgggagggggagugucaaggacagaccaaguugggagucacuuaaccucaggguuccaauuuggaaagcugguguuauaauugguauguguuguuuuagaaagaccuuccuaccucccaugcaugguuagggcaucagcagccagaaggaggaggugaaugggcugggccuaaugcuuguucgcauccaugccaggucugacuuucuugacacuugcuguauguuaccuuuagaggcuuguggagccucagaaauuguuggccagccagccuacagggccaaguuccaggccaacaagagaccuuaucucaaucagaaaguggagggcaccugaggaaugacaacuaagcuuguucugugaccuuaacccgcauaugcuccuacacacacacacacacacacacacaugcaacacgcacaccccacauaaaaauaaaugcaguucaguucagugcagcuguggccuaguccauucccauggcuggugaguauccagucgccgaggaaauaucuuuaagagccacccugaauuaaggauaucugucuacauaucugagugcugccucagaccuccgacuuuauuaaaauuguguguucaugaugauaguggcgugaugaugacacuguccaacaggaaguugaaagggacucugaggggcuggaguucacaucauauucaucaccgccccaaccuggaggagaugggagauggcucagggcgaggugcgguguuuuacauagggaaagcucagcacccucccccccacccccggccucgcuagcacagcuagcuccaggcuacaaggucccacccuagagcagcaucacaaacgccuucccugggaccucuauagaccugcaggacuccacuggucuuucuaccucacuucuuuucagcuugacuuggaaaucucccugagacuccacucuuagcucuccucucaggagcuaucagcuacagcuaccuagugaucagccuggguguuaguggauucccuuaccaugugguuucugcccuccuggucugauguaggggacgaggaaguucuccccaaacggcagaguggucaaagacucacacacagccugcuuuucagagagagccaucuuauuucugucucgcugguuccagaguggacguugguuccaagcagcucugagaca

SEQ ID NO: 5172 - RNA, 3233 nt, Mus musculus
auucgaauuuacauauuuuaaugagaaaauauuauuuagacuaggucauaauuuaauguagacaccuuuuaaaacucugucuuaaaaugggcaugcugagaacaaggacaucaauauuuaaaaugccaugcgaauucugugcagagaggaagaaaaauaaaagggauuuuuuuuucacagcuugaacaacacuacaauuucuuuuuuaaauuaagcaggucacaauggaacaacuauuggguuguucuuuguuuguuuguuuguuuguuuguuuucugucaauuaccuagaaugcuaaaaggaacauaccaaaccaaagugcauuuuacacaguguaaaucauuccuauuuacaacucuuugcagcccuuuagcuucacggaaaaguucuuuuaacagaaagaucuguccagaggacaucucugcugacacccccuuccccuucccagucggcucaucuacacacuuccccacucgcccuaggauuucucccucgggcuuaguuuacguuccuuucuuucuuuuuucuuuucuuuuuccuuuuccuuucuuuucucuuucaucaaaauaaauagcuaaaaaggucucuaaauaguaagaaaguuaacaucccaauuaacuucccccauucucccccuaccuccuucccacccccaaagcuggccagaagagcaaacauucacaugacaacagguaauuguaaagaggacucuacccccucgccccuagccuggcagauuuucaaguucacuguuuacauuuuuuuuuaaaccgcgcgcuuuguaaacaauaacggugacuuuuagcuguguuuugcuuguguguaggacaagcauccuccggaguuuuagcagccucccuccucacucccagcuaagggagcuucuggccggaaacaaaacccagaaggggaaaaaaaucuuuagaagcccgggaggcagagccgcagccggggaaaguagcgguccgcccaucccggccugaugggcggaggcgaucccuuuggaggaucagugaguuggucuuguggccacagauuuucaggaccuaagaagauccggcccucuuagugcggcugcagccucggcgggcuucugcucccgggcagugucucuggucuugaaauugcgcagaguccagagcuaugccucuccaagcucagaagacgaguaguuuuguuguuuuguuuuguuuuguuuuguuuuguuuuguuuuguuuuguuuuguuuuguuucuguuuucuccgagcaggagggagucaggguguucugccuguuggaugggagugcauuucagggucccaggagggaccgcuuggcuuggauuagccccuguuuucucuggugcccuagagggaccgaagacaacuuucacacgccuuccggcaaguuugugguuugucuucugguuccaaaaccaaaaguucuucuaagagcgaggacugaagaagguagaaugggcaagucgggguggcgguuuuaggucgcggagggcuggacccggagcagggaaguguugagaggggugguguggaccaagacggagccccagcuuccuugggucagugcacggccaccgagugcaaggcggaggccgggcuggugagugucucgcuagggguggcggggcugcuuuggcugguggcugucugcgaggagguggggcugagcgaaggcggcgaguucgagagcaggguggggaugggugcgggcagagcuggcagcgcgggcacugcggccggcgugggcuugaugggcacugggauggcgggcaacgucuggcccgcggcguggcacagcggcuucagcggcacuccauaggcgcuguagucgccacuagucauggagauggggguggcugagucgaucauacccgcggaaccguacacauguggccauccagugcccagagagcugcccaugguaguuaacugguuagggagaggauaggcagccggaaccggcugcauggcagagaaggccagccccccaggcaucuuguacucccuagcgaugauguucucgauagcaaagggaugcuugaagccggaaggcugcgccacaccgcccagguuguacgcagcggccggcaucugcggcagaugcgugcccgaggcggccagcgcgcugagccgcagcuuagccugcugcuggagguacugcgcggcguccgccggcuugcugggcgccagguggucugacuugagcaccuugaagcgcuugcgacgccgcaggaagcucccguucucgaacauguccccgcagcugggaugcagcgcccagaagcugcccuugcccggcuggucuggccgccucgggaucuugaugaagcaaucguugaaggagagauuguggcgcaggcuguucugccagcgcugcguguucucccgguaguaggggaagcgguccaugaugaacuuguagaucucgcugagcggcagcaucuucuccggagagcucuggauggccauggcggucagcgagauguaugaguagggcggcuucuggucgcuguacguguugcggcccggccgaggcaucuucuugcuuggccacuugcucaggguccgcgcggcccggaggacuggucgaaucugagaaggggggaggugauggagaagggcagcauaggugcagagacacuggcgaggucacucaggccgagucacagauauaggggguggggaagaggggauucgggugccagcaacuuugcgcaccaaacuggguaagacucagcuaggggaaguggagaggggaagaccgagagcagcagagagguuugcaggaaaguagguaggaccuggauucaggggaggggacagagagauagaugcucaccuuaaaguuguuccaaguugccgguccgcauccgggauggcguggcugguggccgagucccucccugcgcgcgaccggagcgcagcgucggggagcagugagacucgcugccagcuaggcuuggacucagcccgguagagcuccucuccgcgggcugcgcagcgcgcucgugggucgugcgcccugcugggagaccgaacucggcugcggagugcccgugaggacaguggcagacgccgccucagggauccagaggacgcugcugugguguucgugguuccgcugagcuagguggcugccuccauguccacccucgaaccaucugauaguuuuaagcggugacaggagcagaaaagaccccuguagcggcgcuucauuaaugugccacuucuua

SEQ ID NO: 5173 - RNA, 54052 nt, Mus musculus
cuccauuucaccuuagcagucucucucucucuuucucucucucucucucucucucucucucucucucucucucucucucuguguguguguguguguguguguguguguguguguguguguguguguguguguuuuggggaguuauuacuuuacaggcgaguuaauuacagaacacccaagacgacacauaaauaacuacaggaucgagaauuccaagaccagagcuuucccaaguggcugcacagccugcguucuuccuagcuuccuuugaauugggggcagaggagagccgccagacaggagcaccuacacuggguaagcccaugccucuacguaagagcuaugaaccagacgcagugaggugagcaaaggugggauccuccacucuucuuaaaccccaccuuacggagaggaagcaaaauugugagugauuccugcugaggauccagcacugaugggaaggagagcaaagcuggaacucccugggagcgaggcagaagguaggaagagggcugggaggagaaacgggcauuuucccagggguccugucucuugugcgcgaggcuuggugauucccucauacacacuugucgccuggaggguuccaucaccugugcagguguggcgcuggaaggagcuguuuccuggacuguggucucaccccuaacuucuccccaguuugaggugggaaaagcaguuaacuauuuuugugggaaccaggcuugguacauaagggaugcuaggauucccgggaaaaugauugaugacauagagaccuggaaggcugggcucucauugaagcauccuucccuacaccuaccucugccuccaagucgacgcgcccuacgacgggacugagguucuuguaagcaaguccccgcccgcugacucccugcagcgaacuggguggggacccgcggcgccgcggaaaggcuauuuugagugugggaacgcggugggaggaggggcgccggcgggcugggcgcgggcgcgcggggaaagccuccagcucgggcugccacggcaaccgcguccaggcaacgcgcccggaagaggcucugggaggcgcgcggcggcucgcgcccuuccagggugggggagccgcgaaccccgggccgggccgcgcgcgcgcugauuggagcgcgggcccgcagccggguucgccccgcaaagccccgcgcucgcggccaccgcacccagagcgccggcgacgacaugggcagccucggcgcgccagauccgcgcgcgggugagucuucagaggugucuccccuccccacauguccgggcauccucuagacucaagcggcgggugcuuccgcagggaccgucgaugugaccuuggagcaaccacuccauggauaggcaugggauagugcuggggagagggggugagggaugaagccucgugugccccgcgugacacucuggacgcgagaggguuaacugaaugcugacgcgcagggcugaaguuaggcgcagagcgcaaguggcauugcaucuucgcgggggcugcaagcuagcagacagaagaggcccccgagggacuguuugaggagagccaagggugugcagaguuugccaggacuaggggcaagucuaucauucacaguuggagcugagugaccuuggguggguuagccacauugcucccgcggauucucugguuuucauccuuugaaaggaagggcucugguucuuuccaguugcagcacaaggcuguuuugcugguacugugagcugaggaagggacccucuggggaugcaagacuuaaccauauuuauuccgcaagggguuuccaaugagcuggcucccaaaguagcaagaaauguuaccauuuuauggagggaacagucugggguccggaaaggcuccuuaaaaugcauagauuaaaaucccuucggugcacuuaaguccugaacccaaucaggguccaagcugccaaauacuucuuuccuguaguugaucugauaggaaacuuugugucugaacagguaaaaucaaaacccaguaguggcaggcaguggcaaauuaagugagucauuucuucaaugugcagaagcugugugugugugugugugugugugugugugugugugugugugugugugacaugcgcaugcgugcacucagcuuaaagucuguguaugcuguuaagagguuauuucacagaaauaauguugaacugguuuggaucuacagagggaaucacuuagaacuagggccagacauuugcauuguucuuuggagauuugggguuagggggcuagcaagauggcucgguggggggugggggugggguaaaggucuuugccauuaaacuugaggaccuggguuugaucucuggaacccacauugugaaaggagagaaucauccaacccccacaacuuguucucugaccuccacacccacacaaggcacaggagcuaaacgaauaaauguaauuaaaaaauuaacgaauuagcuuucugagaguaaauacguucuuuauuaagaaaugcacauuguaucuaccuuggcuuguguguguguguguguguguguguguguguguguguguagaggugacuuacaggcugugguauuuuuucuaauuuuagcacuggcuggaacuaaaaaugacacagaggccauuuuucauccauaaacuucccuuuccuccaaggggccacaacagguccccaugacucccaucacuggacuguugagaugccucugacguuguguuccaaggacacucuugauauccauggaaaucugacucucucuguaaaacugugagcugggaagccaaguuuccaguuaguaagcuuuugccagcucagcuaccugagggcuuagaaaucuuuaaugguuuacauauuagaaaucgcauuagcauacagauacaaaaguccucauugcucaagaauucugccugugagccuacaaccccuuuaaagacccacaaguccuggaccuuagauccuucguuggcaaaggacucauucuccuacccgugcuggcugcuaacccaccgugucuccucucauguauccugcagcccacuccuguauuuucauuuccugucuccgagccugucucuccccaccccccuucuccccucugccagggugugagcacagccuccuucacaacaccucuucugagaaccaggaugaccuugcccauauucuuuagugccaccuccaacguauuaacucuuagaaugugauacugucuucucaagacccucauuccuguguuccugguuugguacuugccagaccugguggcccuucagaauugcucugcacauuuugaaaaagacaggguuuauuuagucucucaaauaucaagauggaaucauuaggguguuguaggaccuuaaaaauccaaaaacaagcaaacaaacaaaacccuuucuauaaaacaagcaaacaaacaaacaaaaaaacaaggcuuagguuagcaaaauggcucagcagagaaaggcaccugucaccaagauggacaacccaagccagagguucagaaucugagcacaguauaagaacagaaugacucuucuaaguggcagugugugcugggacacacacacaacuuuuuuuuuuuaauuucuuuuuuguuuauuuguuuguuugucuagaaaaaaaacagaggagggaggagggggagaaaauagccugucuggugacuguugcucacucaggcagggaaacuacuucacuugaggcucagaaaaagucauaaacaacgaacucaggagcagcuggcuucauucucugcucugccagcuuugcuagggauuuuggguuuaggcugccgcucucccacucaauggacuggcagugccuccgcuuugaccucuguggcuccgccuuugaccccuccccauggcucugccuugacccuuauggcucugccugcauuuucuuucaaccucuaaaauugaccuuuaagaaccuucccacaucacugaaucuuuccaccuacugugccuggcuuuaaccaucacggaagacuccagcucuuucacccgcgucauuguaaugccucagcccaucuucagggcucuacaucuccacaucucccaucagcacaugugaccucugaaaaacacaauguuuugucuugacagguuuugacauguugauuuucggggggugggugugggggacggggagguggggagucagagccuuacuauguagaccaggguauccucauauccagagaucugauggcuucugccucuagaaugcuuagcucaaaggugugagccacugugugcagacuuggacuucuuauauuccaggcucuagucucaaaaucacucucaucguguuuucuucuccucgccugccaaguuauccaggagaaagucacaaagaccuuuggacugguuuuguucuaaauugaugcuggcucuaauuucaugaaggcuggcuuucauguagaagaauuguacucgucacuaacucgcauccacuuugcucugugccauggcuuucuaucccuuaaacgccagguucccuuuuagaaaauggccuuugauggauaagaugcugggccuccaccucuguaaauccagcugugcccuccugcgagucuccaaguauuccuucucuaucucuccaugaccuuauuguguuggucuggaauucggggaugucucugugucuguccuaagucuagucuaaacccauucuacagucuccuucccuuacucuaguccugcgugccccggauugggaacacauucauuugucaguuugucauuguccuuuugacuuucuuugcugccucuuuccucugccccacccucauucugccauacagucaagucaucuuuucuguaagaaauggugcuagaguuuccauucugcucacuagaaccuucucuagugaagggagucaugguacuugcuacugugugguuacggagcucacggacugggacuaaugugaccaaggaccugaaguuuuauuuuuauuuucuuauuguugagcugugcuugaacucauaauccuccugccucagcuucuuaaaggcuugagauuauaggcaugugcuaccacaccuggcuugaacugaguuuccaauuuauguggauuuuaaaugaacuuaaacucaauugaaauagccacagggagccauugacuauuucguggggagggcagagccggcagcguuaaagugggaucagcuguucuguugagcucaguaaguuuucuccuuugacugaacgcuuccuuuaucucucuguggaaccugcuuccucacaguuccccuggaggggucuuggcugcagaacugagccuucccugugcccuucuccuugaucaaugcccugcugcccuucugugccucugucugucugucaucaugcccagcuuggugccuuucuugcuggccccuagcugugaggguucugaaguuguuauuuuucccccugucuucucccccccccccccggccuucucuuuuuuuccauccaagcuucgggguaaaguaagagccuaccuuccugugccccaguggagcccauguucucuccaucucugugaggccaauacuucuuguucuugcuuuguggauggagagguugauguagagggaacgcaggauaacucaaggcaaagcugagacaggagcucuggcuggcagggugcucuuccaccucugccuggccugcaagcccagugugugcucucaccucugccuggccugcaggcccagugugugcucccacuucugccuggcucaggacccugacaugguuguuuuaucacucugcuuuucuaacaaucuccuuccccuuuuaauuuuuuuuaaaucuuaaacugauucaaauauacggaaaugcuucaacaauaagcugaaaaguucugaucucucuuucagccgcauucuauaaauauuaacuuucauccacacuuguuuuaucuuucuggcacuuucucccacucucucuuugcaucuauuuguggauauguguguauagacacacgcuccuguaccaugucagagcaacagggaggcaguguaccuguacuguccccaauacuuaagcauauauuuccuucuuuuaaagggacuuaaaaaaauacugcaguugucaaaauuaggaaauuaaguuugaaucagugguguacucuacucuacagauuuagucagguguccuaauagaacuuuauacagaagaagaggaagcuguuuuuauuuuuuuauuuuuuuucgagucccgguuucucuguguagcccuggcuguccuggaacucacuuuguagaccagacuggccuugaacucagaaauuugucugccucugcuucccaagugcugggauuaaaggcaugugccaccacugccuggcuaggaaacuguuuuuaaaagggucugauuuagggggucaggauucaaucuaguguuuaaaaaaaauuuguuuaguaguguguguguguguguguguguguacaugcacauguacauguguauacacauucauauuccugaauacacccccuucugucuauauaguguuacuuguagguaugugucuuuucagagccgacccuugguaucggacagccagcugacgugcuucuccugaggaaagcagucucucccgcucucagugcuccuuagucaccugccguucuuucuguagacuugagaccucguggguuucccacccacuuugacaugucuguuacugcccuuccuuguucagcucaugcaugugcagucagugagguguucugggugcagcuucugacauuccuaggagacaccaccaucucauggcaaauucugucuuuucuaaucuuccugaccccucuuccaccguguuccccgagcuuagguuguagauguguccguugggacugggcugcacaaggcugcuucuugaucgcuugugguuuuuuuguaauggucuucaucuguuccaaagagaaguuuccuugaugagggguggggaaccacauguaucuggggauauaaggagacauauuuagaaugaaguuaggaguugugcugguuuaguaaaguggaaguuguagguuguccucuaagauccgugccaucacuagcccuggagagugagcuggguuccuguaccaggcacagguucccucuuguugauugcaggucaccuguguccaccaugcaggguccaaggaucaaacuggagccaucaggcuuggcagcaacugccuuuaccugccccucccccuuuuggauaaggucucaucccaggcugcuuucaaaacccagagcagucuuccugaccuagccucuuacauccuggggucaccagaaugagcuaccaugccaggcuccucuguuuaggacugauggcuuuagcuacccccugcccaucccccauuccucccucccuuccucugacaguguccacugugaagccaaguuugaaacagaacuuuugauucuccuaccucucaggcucagcgacaugucucuuuuggcuucuuuaaucuggaccaguuccccaguuguuuugucuuuuaugaccuugacacuuaagaaggguccagucuggaugugcugcaggcugaccuuugauugggcuuguugucacgcugaguggggacacugucuccugcccccacgugcauccaagggauuuccugcucucauucuccucuggagucagcuugaaugccaaggucgugcugacucugcuccuugucagagcuuacugacugacuggucuagcaaaugagcuugcccuguggaucuccagucucccucuuguagcccaggcuggcaucagauucauaugcagcuaaagaggcccuucacuuuucuauccuccaucccccaccacccacgugcuagucacaguuguguaucagcacaccugcuuuucugugauucagggaauggaguccagagcuuuguucuuggaggcaaggccucuaccaacugagcaccuuccucagaccuuggcaaggugucuccaugcuguuggugaaauagaugguuucccuggaggacaaugagugcguauggcuggggaagaaaugaguggagaaaccuaacagcauauuaaaaauggcccgugugguucuucacaccccaagugagcagcugaaugcgagagaaggaauucuucccccguuuccuccacggaguccgagacaccuguuucuucauugccugcuccucccacgcccucucgguucuuugucucccaccaccuuccucucagucaucauccaucuccucuccuuccuucccucccucugacugcuagcugguuccuucugcgaguaacauggacuucuuccuuucucuacauggaugguuuuagcuuuugacuucuuggguggaguuucccuuuucuuuaguuggaaaucagcgaaguuuaaggaaauguucagacucacuggccuggcugguguagaaaagcggggaagucuuguguucagacaacacuggaggugauccagucacugagagaauucugccacaggccugucuucucagugagaauuagagcucugagcagccagagcaaauccuccacgcugaccaagaagggaacugaugcccagagccaucacaugcucauggcgucucugccagaucccagauuuagacucuagccagguccaggaccacgaggcuugggaccaccaagccuccaucggggcuuccugaggcucaggagacaccuugaggucucuauccaucaaggcagagugagccauaccaugguggucaggaggcagagaaguggggccccuuuuucaugacuuucuguuuaaauguuuugauagcguauaauaauuauacacuagggcuggagagaugccucagcucucccagagguccugaguucaaucccacauggugcucacaaccaucugugaugggauccgaugcccucuucuggugugucugaagacagcuacagugugcucauacaaaacaaacaaauaaaucauguacacaauauauuucaaucauauuccccucccccaucaugcuaucuacuucccuucccccuacugauuucccccucuuucuagugagacccacuucugcuuucaugacccucgcucuugaguguguguguguguguguguguguguaugugcauguguuuguacacgugugcaugugcauguauguaugcccacauaggcauguacauguguggcauagguaccuuaccaggaaacuucuuccccuagcaaggauccucucugaggaucagggccucccaaacacauccccucgagaagaggauauuaaagguucugcuguggaugcaauggaccggucacaccagaagugggcacuccacaccccuguccacuuuauccagagugugcucucaccacuucugagugauggcagcugggucuggggguggggggaaugguaccaagaugucccuuuugugaccguguauuuggcagucauuuauucucagcgcuuugaccaguuaggagugucuguguucaccacugaccacugcagaaggaagcuccucugaccgaagaugacuuggcuuugucuaagcucucucccaccuccuuuccuccaggcuccucaugacucucuaauagaaccccagacgaguuuuggagaaaggggagacuuguuuguuuuuuacuauugggcaauuuuuuguuguuucuuuucuauagcucagcaguuaacugauagaccuuaucuuuauuuugugguccugaaguuugaacccaaagccucaagccuacuaaggaagcagucuaccgcugagcuacugguccccuccucucaaccccuuugaccuguuagaaaugugguuacuggugauuaaagaaaaauaaucuagcaagauauaguuaccucuuccuguuacggcaggaaagugauugagaaugcauagcaugagaagcaucagaucucuugaaugaaagcaugugugucuccugaagcaacaggacuuagcuucuaggguggugggcauggaggugacugggucccacgggaucuucccucugggugcagggaggucuucccugcuaaguggcagccagcucccagcuccugauggcuuguggugaugacacccuuuguggaugaagcugcucuaggagggccgggaaagcagagauccugcgacuugaauguggcuuaauaaagagaguguuugugugggagagaaugugugggggugcguuucgaauuauggaauucuuaaaauuguuuaaccgggaagauguuuuucagaaaccccuggugccuugagcuuguuuuucuguuuauuucauauuguuuuucucccuguuuuuuuuuuuuuuuuaauuagcccuggaagggcucaagaguccucccuugcacucuaaauaguuaagaguauuaguguguugugcuguggucacuucagcuagggggaaucucugggaaggagguucccaggaccggcagagaagggcaguuguguccccugagugcccagacaagggcaugaggcuggagguagggguuucuuucaaguccauacccuuagcuuuucaguuagaacaucaggcaggguagaagcccaaaugcacacccagccuucagccugcacgagagccagaagucgugccuucccugcuugugggugaacccuguugcagagaggguguagguagagaguuuauacccaauuuuaauaauauuuuuucugcucuugcuguugcacuuggcagacucccuuuuuaacauuugguaaugugucuucgcuaaugcuagaaagaaaagucaccaaauauagcuguugggaaaaguaauauuaagacauuucuuuggguguggcugcacacuugcaagagugcauggauucccugcaaggugaccugaaggcugcugccacacucaagcuggaggggcaucuugagucagccacugauaugccacuuggguagaguacugucuuagucaccaugaccaagacaacucuuauaaaggauaacauuuaguugagggcuuguuuacaguuucagggccuuaguccaauaucauagaggcaggaagcauggugugguacuggagaagcagcuaagagcuacauucugcucuguagccagagagagagagagagagagagagagagagagagagagagacagagagagacagagagagagagacagagagagagacagagagacagagagagacagagucagagagaccaagagagauauagagacacagagagagacagagagggaaagagagacagaaagagauagagauagagaaggagagauuggauuuggcuuggcuuuuuaaaaccuuaaaggcuauucuuccagagcacucggguucaauucccaacacccauaugacagcucacuccugucuguagcuccaguuccaggggaucugacacucucauacagacauccucccaggcaaaccaucaaugcacauaagauaaaaagaaauaaaucauaaaaauaaauaaauagacaaaaccucaaagcccaaccccggugaaauacauccuccaacaaggccacaccuccuaauccuucucaaauagggccacucucugaugacuaagcauucaaacaugugaucggauggggacauucuuauuuaaaucaccacaaacaccucagugauuaaaaagacuggccucuccccauuagagaaauaaaacagcagaugagccuguauuugugagcaucugcgaggagacaugauacccggccuccugagagcuacagauuccuauaggaugcaguuccugcugcccuacagccccucaaucgggaagacaccauccacaaauaguucuaauaaacaauagagacacaaauagcauuucaaaauagcuguuauuaauagaugagaacaaagcugaucuuuuuuuuuuuuugcagggauucuccucaaaacacugguaucacucugagccuuggugagugggcuaacgcagcaaccaccaaguguuucuugcacucuggaguggggggguuguuugugaauccaccagaccugacagaggccacucacuguugcuugcaaggccaggaaauauuuuaaacauucuaaaccuccuuaaaaauguauuuauuuuagauuuuaaaauuucaugcuauguaucugacguucgaccugaauguguguaugugugcacaccacauucaugaccugguuauucaaaagggguuggauucucaggaacuggaguuauggaugguuuugaguuccuauguagaugcugggaacugaaaccaggccuuccacaagaacaacaaaugcuuuucacugcugagccuucucuccagccccugccccuuuauucgagauugggucuuguguaccugagguuggcuuugaacucagugaguaguccaggaugaccuagaacuccugguucccuuccuuccaccucggcgcuaggcuaguaggugcauccuaccacacuggguuuugcuguacuaggggugggauccagagcuucugcaugcuuggcagacauucuaccaacugaacuauauccccagcucucugacccucaguuuugugaaucaaacagagauccucucucaccugucuagcccaauggcguucccguugugaguggaauagaauggaguuaaagaagacaaaucuugcccaguggauucaaugccauuugauggggggcgggggcacuggaaaugccugccugggaccuuauaagcucaacauccucaguggggugggggggcuuuaaaaugccuuggguggcaccucagagcugcuaugucugugccauaugcccaaguccccaugggcagguaauccaggccacagccacagcugugacuguaauugcagcaccaggcccaggucucguaaugugcccacaagagagugagaagguaacaccgacagcauguuguucuaauugagucauauugucuucuaaacccagaaugaggcuugcuucuccauucuuaacagccuaaggugagcaguuucuacacucgcuacugcugguggguucauuguuugauucgagaagugcuuguucgaauuuuuguaauugugacgauaacaugcuuauuaaaguauuuugaaaaugagaacagaauaaaaaugugcuuaaugcuauugguuacauuuugacagcuaucccucuacuguuuuaaaaauguacuguaaaacagggcacgggggugggguggggguggggugcacaccugucauuccagcacucagucaaacagggagauugagaguucgaggccacccuggucuccguagcaaauuguuugccaccuuggucuaaauugagagaucucaugucaaacaaggaagccaacaaaacuacugucacaacaagccuuuguccugcucuuuccagggugguggagggggcuuucugaguuucuggggggugauguaggaucuaggcaaggugugauuaaugaaugcaaggcaccugccauggcccagguauagguaaagcugugugucuuggaugugaggacauguaagucucacaggccauauauggguccaccucccagccuuaaugccuccuccauucuugaauauguuggaccaggauuuuuuuuucucuucaggaaugccucaccugguuuccaaacuucugaucuugggauggggcagauaagcugacuacaaagaaggagccaggccugacuucuuguucuagucuguugucugaggaucuuugggaacauggacaacuaugguuguuuauaguggucuuuccuuggucuggucaagcuggauuggcuuuggcaauuaggcaccuuggcuugaguuacacaggccuucccucauuaaaagugguaauagccagauacugaucauucacaucacagaggcacaggggaagcagaguggggugugagagaaagaaaagacagcauuuaaaaguagucacaaacugggaccagggguguagcucaguuggcagaaugauugucuggaauaacaaaacccuaaguuggauucccaugcucuguguaaaccaggcaugguagugaauaucccuaaugucagcacccagaagcaaagggaaucacaaguucaaggucaugcguggcuacauagugaagucaaggcuaguuugggcuacaugaagcugucuuuuaaaaaaaaggcaauaaacaaaacccaaaguagccucaagucuguucaagucgguauggagaagaguaccuuuggggucaaauaggaaaggggaacaggaaauuguugaccugugcccuuggcaggaugggggcuaguuuucucuugggucuccuguccuagguauuugugcuaggccagguugggauggcuuuucaccauagugagcuggaggacaagcaggcauagcacuggggcaaugguagaaagaauggaaauguuucaggauccuuaacacuacgaaguuaagaggguuggcuggguaucccaguggcuaaggcuauuugcuuccaagacugguaaaacugcaacucaacaaacaaacaaacaaacaaacaaaacuucuccccaaauaaaggcuaaccucagggaguuauggcacagucagaguagcagaugaccuugaccuauccgaugacgauguagagccacugugucagagaucugaccaguuaaugagugggagaugcccgaggcagggagguucccuggaacugaccacggggagaucuggggcuaccaccugggaagggacuuuaucuagugauuugucaucagccucuuacuuagcuacaguagagacaccuuucacuauugucacaaagagugcuggugcaaaccaaccaggugacuagacagaugagcagauucuugaagcauucauggaaggucaccggccucaagcauauguugauguguguuaugaacucaugccauagggaaucuuauaucguagggucaguggcagauaaugggaagaguugaggcugucucacagucaggaguguccucucuuccuucccaaaguccaucugguugagauuucugcagcucaggcauguggguggugucggcuguggaggggauggugaaugucuacauuuggucauagguuuguacugcuaaucucuucacugcccgccguucugauggggaugcaggacauaugugaugucuccuaauaagugccaaaugaguuuuaaguugggcuauuucauuaaugaaaaucucauagaagugucacauaaccuuaaaaguguaaguguucugugguuccaaucuuccacgggcgcuuacuucuauuuuauccgaaugguagaaguucuuaacguugacaccuaaguacugguuggacaucauagcuuguuugacaugaauuacuguuuuuuuuuuucauaaauguaauuuguuuaaauuuuaaaguucuuugucugggaaagugaaauguucacaguuugaaagucuaaaaauaaaacaccggagaauugaugccaagacaauggugucaaucagaaauccuuucucgauccaguguuggagugggacuaauuacagaaucagcucauggguaccaggcacucauuguuuuaagccaauuaaccacaggcuugagagacauaaguucaaaaaucuuuuuaaaacuucaguuuucugaugaguugugacagccaaauauugugccuauguaggauuugguaugaauggauauguuuuauaauaaaguuuuuaaaaucaagcacauucaugccauuuucuugguggguagaaaucagcuucccauuaagcauacaguauuuuuauuuucgaucuauuuagaagcacaugauaauugcucacccagaugagauugacuaagguggcuggcuuauugaaaaagucuacagagaaguacaagauugaaaucuauuaaggagauugcuuugggaacugggggugucacugggugggggcagagcaugugggaaaagcugggugcuagccaccggauuucaggagacgugaggcaagggucuugccuauggaaaaguaguuuucaagcucaagaugcaaauggaaaaagaggaaacuccugaaaccuccauuugguggucgucguugcucugucugguaaggauuggcaguguucauuucagaagcauuuagguuuuccaggcucuuuccuccuucgugggaagcaguugcuguuuauuucacauguaaaaucaaaagcaaucacaguuacagcugaucaguguuuccacacaacaugugagccuccugguagcuuaaauaagcagaguuugaggugcuuucaaguucuaaguauaaacuguccaguaauuuagcacuuauuguguuuuuuccaacagaugugaauuauuaagaagaaaauggcccaacaggacaccguacuuccuucucuugucaaccaggaaggguauacuaucuggaaaauaugcaucuaagguauaauuuuucuuuccaccaaucccacgaggguuucuagagggugugaagaucaugaaagaugaugccuuguggacauuacauuguaaagggucuuuauuuuuuuaagggcaagaagagcauucuugugucccucucauggcuccuguagaccaccacuucaugacccaaaagggagagauuucacgguggcccugcaauagacuugaacuuccugccaacagugaaaucacuguggagcuugagaugaguguucccauuagcucuuugaauucagaaguugcauauuggaugccuauggggaaauaccgcucacagaaauacaucacacaaccugcauaucacagguucuuuccaaaggagccaucauuuaaagagugaggugaccucacagccacaucugauuuuccuggcucauuuugaaguaucaguuuuugauagcaaacaacaaaaaacucaagaaacaccaaaaccagaccucauuuccagauggucuuuuuauguguaguacaaaaucaugguaucccaggcaggggacauauuagcuccccagagugccuagcccuccugauuauauccuguguggugcuuggccaucguuucugauacugcauggccccuguaggccuuggggcucauaaucagcgcuuuaggagaagggagaaggaagcaguaggccucugggaucagcuugaucuggcuaucaaucacaguuaauaugggggagccauaguauguccauucugccagccuccugcuucuuggagaucacagagccuuccagcagcccacuuaacuccaugggcagaaucaccuuaaaauccugucuagcucucaaaguaaacucuuuuggguagaaacuuuuccucaaauccuguuuaguuugugccgacagacauuuuguacuucuuucuuuggcgagucuuaaaucuggcuuggaagauuaucuuuuccccagcaucuuccaaccaugugacucccuucugcaggcgagugaagaccaugccccgacacagccagucccugaccauggcgccguacucuucugugagucugguggagcagcuggaagacaggauccucugucaugagaaaaccacagcagcacugguggagcaugccuuccgcaucaaagaugacaucgucagcaguuugcagaagaugcagaauaaagggggaggugaccgcuuagccaggcuguucuuggaagagcauaucagaaacauaaccgccauugugaagcaacugaaucgggauauugagguaaggggugugcaagccaguggaucaugccaugcucaucucccaagaccugguccauguaaggcugccaagucugagucccagcugucacacaguccuguaugcaugcuuuugggugugcaugcucauauauguaugcguguguguguacucaccaacucaugcaugaagaguugaccuuggguuucuuccccugucacucuauaccuguccuaacuucauuucuaaugaugugauaaaauaccccaacagaaaauaucuuagggaacaaagaguuuauuuuagcuuacaaguucaggucacugcccaucauuguggggaaguuaaggcgggagcuucaagcagcccaucacaucacauccacagacaaaagcaaagagaaauaaauucauguaugcugaucugcuugccagucagccugauuucuccauuauuccacaaccacccauggcagauuggcuuuucccacaucaauuaacuuaaaacaccaccucuacacacacacacacagacaugcccacaggccaacccaauguagacaaucccucacugagaaucuucucuugugauucuagguugugccaaguagacaauuaaacuaucuaucacaacacuauaggcuuagauuuuuuucaaaaccuacuuuaauaaggguucuuaaaggcuucaaccucccuucuagcccaucacccagguaggagaaaagaaagguuaauaagaaguggggguuguggaccuguuuagaaauaguucuuugagggcaauuccaaucuucagugucagcaaucuaguccacuagcaaacacuccuuuagcaacagcucgguccagaagaaaccaagaggcagaagcagcaagaagcagccagaacaccacuggaaguucuucagugcuuuucucuccaugaagucauggcaagcuaagaucagugaagaaaguaagucaaaccaaugccagagagucgucagcaaagaccagcguucgcaaaguccagugaagaucagaaagaguugcaaagugaaccaaugcaagagcaucauccguugucuguugguuaugcuuauauucuuuccaaauaucauguguccucucagguauccacucgagccaaacaucacacacucauucaccagacagguuccagaaaaacgccacauaucuguucuuagcaaaacauccucucacaugucugccucagcagagcauccucuuguaagacaguuuccagaaaaaaaaaaucauaugacacuagcgagucuuuagcaaaaccagaauuucccacuucacaccgcccuauuuuuugagacagggucucuuacugacucugaaacugaccuuuuuuugcuuagauugacucuggucagcaagccucggaaaucugccugucucucucucccagcuuugggauuacagguacaucccaacauacuuggcucuuacguggaagcgggggacccaagcucagcucagcagucugcacagcugucacuuagccaacugaauaucucuccagcccuuccucccuuuugugauguaagcacacgguguagcauaggcuggcuuugaauuugcaacuugugucgguccuccugccucugucucagaaacgcuggaacuucaggccuuuggcaguagaucggagcugucuaucuugucuauuauuacuagguauuuucaguaauggagcccaggcuggccuugaccucucuguaaccaaggauuaccuuacccuccuuauacuucucuuucucucucucaagugcuggauuauacucugcacgguuucgugggguucagagaacccaaacuaggcuuggugcaugcugggaaagcacuccaucaguugagauacacccuccuccccagauuuacuuuaggacagcgucuaauguguccuaggcuggccucaaacucacuauguagcuaaggcuguccuugaacuccuggucucccugcuuccaaguucugggauuaagacugugcaucacagggcuggcaagauggcucagcaguuaaaagcacuugcugcucuugcagaagaccuggguuuggcucccagcacccacauggcagcucacaaccucuaguaccuccaguuucagggggucaggugcccucuucugaucuccucagacaucagacaugcaagugcacauucaggcaaaauacuucuacacaugagcuaaaaauaaacacaucuuuaaacaaaaaggaugcuuugccuugucucuuauuucuacuuuuuuuugaguuacaguuuuucuuuguguguguauauguguguucacauguaugaaugcauguacccgugguguauguauaguggucagagagcacuugcaggagucaguuuugcuccuccaccaugugagaccuggggcuugaacucaagucaucaaccuuaguggcaagcaccuuuaccugcugagccauccugccagcccugccucaucuauucuuaaugaucaccaaggaaacugcuugcaggaauagcagaguuauauuaaacuuacugcaguauuugauggcaguuacugucaguacuguuuguguuuguucuaaauuuaccuggcugauuauuaaaucacuuuguuuuguuugacucucaguggaaaacuagacaaaaaguuuuccuguaaacucuuucccgucucugaagacaguuaguaccugugugaccagaucagcccuggcuacuccagagaaaacguuucuaggccgaagugacuauacaucucauguuguaguauucaggcggcuuaggaguuugaauggcuuucacacuccuuuauuugcucugacauggaauucagaugaggccaagauggucuagccuuagaauuugcacauuuauuucuaauuuugaauuaacugcagggcccacguaauuuaguucagaaagcuuaagugugacacauuaggcacagccugggcuuccaucuccacacaaggucagugucuuucacaugcagcuuucagcaaugugaauaaaagguagauggacagacugggaacccuuuguuuccucuuggggguuguguuuaaucaugcuccucuagucagauuuauauuugugcuuauuuguuuggaggcaagcucucguggggccuacgcuggcccugaaguucuuggagccuaggauugaucuuucugccucuaucuucugcauacugagacugcagguguguaccaccacaaccuguuuauguagcaccaaaugagccuggggcuuugugcaugcuaggucagcacgagcuaauugaauuacaucucccagacucuggauuuguaguuuuuuuuuuuaauagcuuuauugaaguauaauuuauuuaccacaaaauccaccuaccaguauacaaauuaaaugaguuuuaguaaauguauaagauugcacaaccauuaacacuaucuaauuuuagaacacugccauuaucccuucuccaaauucaugggaaccuguagccugcucccagccucaagcagucuuucauguaugcacuuccucccucccucgcucccucccuuccucucucucucucucucucucucucucuuuuuugagacaacauccugugugucccaggcuggccccacacucacuauguaguggagagaucacauacagcguugcauaugccaggcaaugcccucucccauugugcuuccucuccagccugcguguuaauguuagugaaguccaccucaccuuuucuuucucuucuaugguuuaugcuuucaguggggugaccuaaaacccgucugauuacuaacuaacccaagguuugcagaggcucucugcucugcuuucugccaaacgcuuagauuuucgaguugguaaauggggcgaagugagguaaggcauuuucuaaauagaacagacugugagcuucucagguaaaagcuuguucgauucaucuucccauuguugaagccguguugggaggcaguugggaaggcugucugaguccauuugugcugcuguaguaaaguacuggggagcgguugacuuacaaagacuaggacuuuauuuaaugugugugugcacuugugguaaugcauuuguguguaggugggcaugagaguauggggccaaaagacaccucggguggucauucuugucaucccucaagcucuauaccucuuugauuuuuuuucugagggucucuugcugaccuagcgcuccccaagcaggguagauuggauggccaaugagcccaaggauuccuuuugccccugucuccccaguguugggaugacaacuacucaacugccaugcccagauuuuuguuuuguaagggauucuggggaccaauuuuuaaguccuuacauuucaaacaaauacuucagugacugagcugucccucaguuuccagguuccauucuugaaaguucuguccuugaaacugagucugcuucccauggccaggauguggacugagcuucaacacggauuugggaggggacacccuuaucuaacccagagcaaggcauaugcaaugaacagaugcucaguguggagggaaggcaggugucuggcugcugcagaugcagucaaugguccucccuuucaggcgagccauuaaagugacccgagacugaaaccauccccacuccccaguguguuccucucccuucuccauuuugccccuuugaagcucaucuugaacccugaacuuuuacuucuuugucuguuuguacugaagacaccaucucguauaacccggguuggccuugaaguagcuagauagcagagaaugaccuuggacuugugguccuccagucuccgucucccaaguacugccugcacaauccacaggguaacacaucaaacuuaguuuuguaaauucagaguucuaagggcuggggauguagcucaguggauagagagccagccuaguauguaggaagcucagaguuggaucucagauacaacagaaacugggugugcuaguacacaccuauaaucccagcaccugagagggagagacaggacaaaccaggaguucacggucauccuugacuauauagcaaauuuaaagcaggcuuugguuacaugagacccuaucucaagaacaaaaacaaacaacgcccccccccccaaaacacaaaaaacaaaaccaaaggcucaguucaacaguguagugaauuugaaaucacaguuuguuuucuauaacaucugaaauacauuuuauaaaaugauguuucuggcuucaaccagacagcacucuucuuuuccauucccaugcauuuuuagaguauacaaauuuugcaaaugaaaagaugauuucuguuguagaggugggaaacugaauaaaaucuaauuugggcagaaaauuuacuuuggguaucugaauguuuacucucuugucacugggaauaauucauguagaaggaacagcaaggaaauuuagaaaccuaagauuccacugugcaaugccaguuauauggauuuggauauauuuuaaacuugagcacgucugcccaaacacauccaaaaugaagaagcuugaugagacauucaaaaugcugcaguauagccaaacuuccucaaaagaacaaacaaaacagaaaacacggcuguauuagucaguuugagcugcuaugacaaauuuccacaggcucaaauagcagagauuuauuaccggcuauacuagagaguaggcgguucaaacuccugggcaccuuccuguaccugcgccugcaccugcacaugcaugugcacaccugcacacacacacacacacacacacacacacacacacacacacacacacacacaacaccugcacacacaccccuauacauucacuggcccugcuuccugccaucaugggagauagcagaagcaagcucuuuucuuuuuauuauuuacuauuauuuauuuuuggucaugcaaucauguaauccaugcugguaucaaacuugaucuauagcccaugacaacuugagcuccugauccuucugcugucuccccccugagcugcugguguaaccggugugcaccaccaugucaggugugugcagugugagggaacacacucaugucugauaaggucggcauauuugugccaggccgcuacauccccagccaccuguuguuauauuaauacacugcuacauauggaacccaggccuuucuaggaguccucugcauuaggauucuuaucccuauagccuaauuauauucaaaagaccuccuccuaacguuggagguuagaauuucagccuaggaaguauaggaggauacaaugauggaacucuuuguucaucagcaauauaaaaccggguugguaggguggcuggaaagauggcucaauacuuaagagcacuugcugcucgaucaugaggcucagaccucagaucccagcauccacaugagguggcuuacaacugccuguaauuccagcuccugggcacaugcauguacccacacacaugcauacaccugcacacacacacacacacaccugcacacacacaccugcacacacacaccugcacacacaaacaccuacaagcaccugcacacacacaccugcacccccacacacauaauaaaaaauuuaaaaaucuuuuugaaagagucaaguuauuguuacacaagauaauaguaguaagaaaagaugauaguugcauauuuaagaugaagagacauugauguauucagguuguaugcaaagaugugguaggcguauuugugccagagagcuagauucuuacaguuucuucuguaaauugcuuggcucuuuucuuuuuucaaauuauuauuacuaauguuuuauacuugguucucaguucacucuaaaguuuuacuggguauuguucugauaggaaucaugacuguagguaauuuuuuaauguuauaaaacugaagguaaggcuggugucgauaucugaacugcacucugguggggugagagcuugcgcuccuaggcuucaugucuuuaucugacaagggaacuccagccugcugcucagagggcuggcuccagucuaaucccuguuagggagauuuggggguuuauuaccacauccccacaaaaaccaucagagguggaggauccugaggagugaaccucggaccuugcacaugcuaggcaagugcucugccccugagcuuugcccucaguccuccaagugugagcuauugcuacggguuuccuuuauguauauagguguuuugcuugcgugucugucugugcaucacgugccugguggccacagagagggcaucagaccccaguaacugguguuacaggugguugugagcuccuauguggguucuggaggagcagccagugcucuaagccauuuccccaaauucauaguuuuuacucuacucucuaggcuuggcuuacuaagaggaaauagaaucaagugcucauuggccauucauccuguugacauagcauuuugagugcaaauuauuauuuuuuaacauuuuauacuuuuuuugagaauuuuagacaugaguccuguauuuaucauuuccaucccaccuuguccccucuccaacuccuccgaugucacaucccaccuccucucaacuucaugacuauauuauuauuguuacauauauacauacgugugugugcgugcagacaugcacaaaacugacugaguccauugaguauugcacaaauuaauuuuuaaauaguauauggugucuacuuugucauauuuuuaaauuuuuuauuauguuuauuuuguuuaucuuuaugugcgugugcacaguuuggaggucagaggacaacuuucaggaguguguucuuucuaccauguggauuuugggaauugaauguaggucaucagguuugguggcaagagcuuuuacucaccaaacuguuucccuucccccacuauguguguguguguguguguguguguguguguguguguguguguguguguguguauauauauauauauauauagagagagagagagagagagagagaaucuuauauaucccaggcuagucucuaaacuccucuacaaccaaugauaaccuugaacuuuuagucuuccuguuggcaucuucagguuacggguacuacaaguacgaguccccagcuuuuguuucuauuaugguugagauugaacccaggacuuuuugcugcaccagggaagcacucuaccaacuaagucccaucccaaccccugccuccuauucauuuuaucuugucugguucaccuuugagguccugaucacuaaugggauuaugaucaucugugaacuuucuccuggaagaccaggccugaaccauagagcuaggagccacauuaacugacaauacauuuagggugaagcaggaacugucugagugacaggagcuaacauguuuccccagggauucaaguuucagcccucagccccacaccacacuccaauggacauguggguggugaaggcuaaguaaccauagcaacacuaguuuauaucagugaaauaagacaaugggauggagauuaacuauaggucuguuuagaaaggaugguuacaugugaagggcuacugaagacagcaggggacagccaagcuaaggugaaggggguucccagggagccugugccacccagggagccugugccacccagggagccugugccacccagggagccugugccagaggcagagggagcagacugaggaccagcaagcagccugcagggccaugagcugaaggaagggaucacucagaagcacugaagaccaggauaugagguucggaguuugcuuguugaagccaguaccuagggcggaugagaggguaagccaauauauauauauaugauauuuuaaagccaucauguagauuuuuuuuugagacaggguuucucuauguagcccuggcuguccuggagcucacucaguagaccaggcuggccucaaacucacagagauuugcccuccuuugcuaucugagugcugagauuaaagauaugagccacugcugcccugcagguuauuuuuguuuuguuuguuuguuuuauuuuugaguuguuuuguuuuuuugaguugaguaucuuguuauguaguccaggcugguuuugaacuuguaauucuaccccaacuccugaguagcuaggaugauagcuaugcaccaccacacaugucuucauuacuugauuuuuaagguaaaauaauucauucauacuuguggugcugaaaaugcauggguggauacuaaaaccuauagaaaccuuuccaugguggggcuuacagacggacagacuuuggcuccugugaagagguuauucaggaccaagaguagaggcaaaggcccugaggauguagcucggagguagaguucuugcccuguuugcccgaaucuuagguuugacauucccgaccugcauaaacaaacaagaauggaagcagagagacaggcuggcagcccccacagacauggagagcuauaacagcaguucuuuugggagcugcugcagacaaggggauaaguggguagauuuggaguucuuuugaagguagggaugacagaaccuucugcaugguggauggagagacuucuguuugggccuuggcagguuugaggggcccaugacaaaacuaaauaccagguggaacuaaauaccagaaaaucaaucccacacaugaaggagaaccuggaaagcuuuaagccucagcuuggauguagaggggccucccuccauugcguguuccuuugugaaucucuuuccaucuaagaagagguagagaaggaucucucucucucucucucucucucucucucucucugucugucucugucugucucucucucucucuuccucccucccucucucccucccucccucccuucccuggcaguuccuaggagccucugagggccuggauggucaccucacaugcauaaauaccauuacaggauggccuuguggguggguggguggguggguggggcuucuucaauaauaaaccaugacuggagaugacuggcuucuucucucuuggagaggaagacauuuuuaaccaaaagacuuggccauauacuugagcagccuguagucuuuccugcuauaacccugucucugaagggcaugccugguacucugugcuuacuggcuaacuaaaagacaguuucucagacugacaaauaagaacuugccuugccaaaggccagccccauucuaaaugaaagcuccaacauggcagaccaggacacacuucugauguuacuggguuucuguaguuucgcucuugaauuuccuuaaacaauaagccuucuaaugaucucugucucuucacguaacuuuuuaguaaugugaauaccauguuaagcucagaucucuuucuuuucuauauucuucaaagcauugcuaaugcaauacuugucugcauaagaacccuacaaguuaaaugugcuuauuucuaagcuguaaaggaaaaagccacauuuuuuuuucugauuauaaauguaaugugagaaauccaagaaagaggaauucacucuccucucaaaccagaucuaauagggaagaugguaagguucccuuauuuuacaagcuucuuggcacacagcaggaaccaaccugugugucuauuuuauauucuuucuucuugcucaguauugaacucuacacaguuugccuuguuuuuaaaguccucugugacagccaggcacagugcugcaaaccuuaaaucccagcacugggggggguggggggguggggguggggguggcaaaggcagauguacugaugugaauugaagccaaucugggauacauagcaaguucuaggcuagccagggcuacagacugagagcugccucuaaauaaacagacaaacaguuaaauggucaccucucgcaaaccucucagguuugcauagagaugugagaguugugaaaacugaaacaguugcucuggggaaucaccuaugaaaacauuuuuaugcugacacuuacuguuuuucuuugaagauuaauucuaagacguagaauuacuugaucaaaaaucugaacaacauggauaaauuuuggcuaccuuaucaacugugcuucuuggauuuuguuguuguagugcuuuggggauuacaauucaaauacuguauuucaauuuauuuuuuaaguguauguauguauguacguauguauguauguauguauauguucaugcauguguauguagugugucuguagaggucagagguugaugugcagugucuuccugaacccaucccuaucauaguuuggacacagggucagauccuccugucucugccuuuccaguguuggaaucacagcuugugugggcaggccuggcuuuuacguggguacuggggaucaagcuugagauauuuuccuugcaugggaagcacugaccaacugagccauaauaaauaaauucaaaaaaauuuuaguagaccuugggcuggauguauauauaaguacuauacauaaggcucuguguucagucucuaguauagcaaagcaaacaauaaaacagauauuuuauuuauuuauuuagcuauguuagacccacagcagaacagaacagaaagccuucauucugccugagccuucauauauauauaucaccccugucccacacccugucagccacauccccuauuggaguucuaccucagaaugguucuggaccuuaccaaguaugauagccagaucuuuugaucuuccuuccuccacugccagauguugggauuacagaugugucugccaugugaggcuuacucugcucggauagaacacaaggcuaugcagugcuccgcacacacgcuagcagcuggacuacauccucagcccccaguguaugguuucugugucucuggcuacuagaaagguugacugcguuaauuauuuuaagccccuuguuugcgaauuccuuuccauuuucuuuacucagggcuggaaaaccgaagcaaagccuggcaucuaaugcacuggugcccuaggagagcgccugcuucuuuugcaucuaucuucaggcccacucccuagcuuugacuuucuggggacaggaccugggacucuucauauaaaacaggucuucuggaugucauguguguuucccaaaggcauuugagcaccauggccuugugucuuauuauuaucaacaaaaucugaagaaacccaaacagaaagcaugaguguuucuuccuauuuguuguuguuguugcuucuauuagggguagcuucccauugugcuuauugaggagagagggagagagagagagagagagagagagagagagagagagagagagagagacagagagagacagagagagagagagagagagcgcuccgccagugccuuucaccagugggagagagccagagauggauuagucaggcuugaggucuccuugcaggaaugugcucagaugaguaacguuuugccauucauaggugauuguagcuagugugcgcauucuucagagagcagguucauucauucaaaaauugggagccauaggaaauaauaggucuggcaauugcaaauuccauuuucaguggcaauaaaaugugucaccaagcugaacaaaauagggaaacaguucccuguaugggugcuggcgguaagggacacuggccacuugcugccugcccccucacuagucccuccccccguccuugcccccccccccuucuugugcaccuggacugcacagacaagagggucuggcagugccagcugcagccgggaaaggcagagugaggccuuagcaaucugaggaggaggagccgggcacauugccucccucuacagaaggaggcaaggagacauuguggagguagcuguggaggcccacucucccacucuuccucuuagucuuuggcuacgacuggcacaacucccucacuggcuguaccuccagccuacugacgcuuccacuccugucagaaacacccacugagcacgccagugagccgacaaaggaaagcucuaucccauccgaggacccagcagccauaggaggaggaaaagccacgccccccagcagagggaaccagcggcccggaauaaaagagcaguuuacauacuuaggaccccugagcacaguguaaaacugcugccuugaauuuagaguuuucugggucccaggaaagaguggaagaaaucccggagagaugagcaucaaaaucagaauggagcugucaggaagggcaagcuagacuggcgcaggaauggcaggcgcuccagcgggagggggcagaaggagagaggcaauucuaguuacacacgggaguuacucauggguugaagaguuugaaaaguucaccaagcuccagguuaaagcuucgguuuuaaaagcagaguugggucgucgauucugguaagauggaucggugguccaguuugauuugguuacuagcacccaccuuagucccaauuacccccaacuccaguugcagagcgucagacacccucuucuggaguucauggucacccacacaccgggcauaggcucucacacacaugcacuuaagugaaaauucgaaaacucggucaugugccaugaagcaaaacuuagcauguuaaaaacaugaaaugucuuaccgacuuuuuuaauaagccaguauagugaggauuaauuaacaaagacagagccagugagguggaacagcaggaaaaggcauuugcugccacuccuaaaaacuucaauccgaucccuaggagccugggaucgagagaauccacucccgaaaauuguucucuugaaaccuacuccuaacuaaauaaaauguuauuuaaaaaauaaaaaaauaaaaaaaacagcuugaaauaaagaaacacauuuuaaauucuguuuugacuuuuugcgacgucuugugauguaaccuuggcuagccuccaauucaaaacccuccugaguguugggauuacauacuugugccacugugugggccaacucuaauuaauucugacauccuuagauagucagacauccuuaaaucaaagagaaauucaauccaaaauuaaaaccauguaaaauaaaauaacaggagcagggcacgguggcuuaucucugagcuccucggugcuugggguggcccaggcaggaggaggggaaauuagaggccagcuuugauuacaccaugagcuacugucucaaaagacaaauaaacaaauaagucuacacgcagcuuaaggcauagcagauaaauaaaaucacucccauacgaaggaaagauaauaaaaaaauaaaagaacacaguuuuauugguggauuagggaacucucaguggagaguuauaccucuuucugggcuuacugguucucugcuucuggguucaucaguucacugauaaaaagagcuccuuaggcaggcagauguucaugaguguaaggccagccugaucuacacaucaaguucaggaccagccaggguuaacaguaagaccuuuaguuuuaaacaaacaaacaaacuaacuaacuaacaaacaaacaaaaucuucuuuugggaaaaaaaugagucgagcacucauauacuuuccugaauuaugaaauggacacgugugaauuugccacugacccuaaguguccuuuuuguugcccagguucuccaggagcagauccgugccagggacaacaucagcuauggaacuaauucugccuuaaagacgcuggagaugcgccagcucucuggcuugggagaucuccgaggaagaguugcaagguaggugcccucaaaacaucccacggaagugucuuggggaaggaaggguuauuuuggcucacagcuggaaguuacaguccaucagguggggaagaugugucaucaggagugugaggugacuauucucaugggguucaaggucaaggagcagagggagauggguuauaacuaagauugauuucuucuuuuuauucagucugggacgagagccccugaggcggcucuggccacacucaggguagguuuuucccucuucaguuucgccucucuaguaacgcccucacagcuaagcccagaggucuucugggugauucugaauucagucaagcuggccaggaagaugaccaguacagcagguauucaaauguuggagacuuuacuccuugagagcaauuucguuugacguugagaugcucagggaguaaagugcucacuguuggaaguuugcugaacugagguggaaggagggcacuaacuccacgagguuguucuuuucucucagaucucucucucucucucucucucucucucucucucucucucucucucucucacacacacacacacacacacacacacacagagcacugcccucaucaccaccaucaucauaaauacccauacuuuuuaugaacuccaauuuagugaagaaguccaguaauuucuuuuacuacccccuuucuagcuuugaccacagaagcuacuggcagacuucaacccugggugucagccugccaugauuucuuucagugccaaaacuggcugggucaucaugggaggaaaugaucagagagcgcccucugcugguggaaguuauuuggucacguaauaguauggucagugaaucacguaacucacagcuuacuguuugaaugccuuuucaaauguucaucuuuguuauaauuaacuuuuuuuuuauuuccugaaauuauugauuucccauaggcuggaaauuuuaauauguguuuuccuauaaguguggaaagugauuuucucuuuacuuggguauuuuccaugaacccagagccucaggauuaccugggauauuucuucaaauguauuuuguuuacaguuacauuuaugcgcuuaugcgcacagguguguauacacacguguguguacugugucaccuguguggauaucagaggauaaaugcagaaaucaauacucuccuucuaccccaccugucucgggaaacucaaguuaucgggucuagcuagugcuuuuacggguugugccuucuuccuggcucuuaccugggaccuugugagcaauguccacugcucccacgucccacagcuacugaauuagaaucuguuucuaaagagauaccuggguucuaggcgcacuauauuugagaguuguugcaagaggccuucccuuccggauuacuuuuagcuggcugggaugaaguuguccugacuacaguugggccucuuuuacccucugcugcuaucaagcgcucaguacaacuuuacagcuaauaauggggauuuggagcaaagacgcacuuucagccaguuugggguagcagugagcucaggugagcaugggaugaaauuaggaacgagaccaacagagaccaggcacuguuaaggccgcagagagagccacggucugguguauuugugacgaaaccuaguuauugauugauguccauaggugcuacaguagagaaagaaccucaccaagaugcuaagucuccauuuucugaagaagcagagggguucagccuucuuggaaaaggcugacccccgccuagcucacugcaguuacuuuauucaaacaucauacaagguuaauuggggcugggaaagguuccagcuaccaaaguuaucuugcccuugcugccccugagagcagacaauucccacagaucucggucccuuuugaccauggcuagccauaaccaaaagaaagaauuccugguuugucgggagcaccuugggaccaaggucggggcagcugcaggcucucacguagcaccaagugcagauccucuaaacaaauaacaucucuucaagguucaaacagccacagaacaauuucucagcuucuauugauugacccaaacacagcaaaggcuuugcugagacacugcacucaaagccagacacagcggcuuacuauacauuucccuuaaagccagacauagcggcuuuacuaugcauaucacaacaucuagugucuuguauuccgggcaugcgucuuggcagacugaaggguaaagaacuguguucagcuggaggaggcucuaagggcugaaugaaggguggagucuccacuccucucugguucuugcugguguguuguucuguucuguuuuguucuguucuguuuuguuuuguuuuguuuuuauuuacuuaaugugcaggcgugugccagacuguguauaugcaccguauguaugcaggagucuauggacgagaggagaagacaucagauucccuggaacugcaguucuaggcguuuggaagcuacccugaauucuggggacugaacccagcucucugcaagagcagugagcacucuuaaccucugggucaccucuccagcuccuccuccuccuccuccuccuccuccuucuuuauuuggaauggaaauggagucuccauaacucuagcaggcccugcuccaucucguccugucucagucuccugagugcugggacuggaggugugcuccaccaugucuggccugugucauuugccaggaugaaccccuccagucuccauagucugaucuccucaccccucccuacuguugucuugccccuucagucauaugccaacccuuguuaaucuucccagaaaagucauucuucuaccauagggccuuggcacgugcuggucucccacugaggaccuuuccacuuccucuucuuacuccuuguccaccuuuaaaggguagcacagauguccucugcuccgggaguacucccugacacccugccugcagagugcccucucccccaacgacguaagccccacccagucacuccgcugucuucugaguugucuuagaguggggcucuguaucauuuacuucuguagucaagucccuggagcccguugagaacaggagauacucaacuaaugcuugcuuggauggaugcccgagcuagaaaagucacuggggcaggacugagaacucuugaguccuuguuuggcuuuuaaaagaccccgaagcucagagaacagcgggaacuuggaaggacuugagaccacaagguggagcagggacuugagacggcugaggaguuucauggccacuguguuuguuaguggucuuucuuuacagcagugguucucacccuuccuagcacugcagccuuuuaacucaguuucucaugcuguacugacccccagccauaaaaguauuuucauugccacuucauaacuguagcuuugcuacugauaugaaucuuaauguaaauagcuguguuuucugauccucuuagaugaccccuauaaaggagucauuugaccccaaagggguccccacucacaggcugagaaucacuguucuaaagcgacagaaccaacaguggugugugugugugugugugugugugugugugucuauguguguaaugauuauauuggucuauguagcacagucuggcagucagauguugauuaucuccaugcuggagaggcugaggacccaggagcugcuuagccagacaccucagcagcccaacccuggugcugagggccugggggauucccagagagcgagaggucuuuaguccacguuggaagccugaagaaagucugauaucagugggggaggguagcaguaucagcaagaggguagaugaccuuguuaguaaggcucaaaggcaaggaggcacacagcacagguuccucucagacccccucuuaucugggcugccacaggaaggugcugccuauguuuagugugggucuucucacuucugguugccugaugagaaaaaucccucacagaugugcccacuagcuggauccagucaagaugauaacccaaauuaacugucacgcugcugugggugcggguggagauuuaaggugcaugugugccacaggcagggaaagagugggccacaaauggcugcuaucagcaccuccgcuggacagugcacacuggugucaucuuuaugacguuguaucuagaccaagaagaauucucuugaaaugccuucugcaaucuuccauucugcuucagcgugauccaugagcuucuccacccaacuugucccccaacacuccccucccacacuccccccucccccaaacuccccccagcuacccccccccccccccguuaacaaacaccuggauucugaaaccaccuugaguguuuguuuuaagcacuggauauuucggguuuguuuuguggcuauaucugucuuccucuuggaaagcugaugagacuuuguugaaaugaauccgcaugagauaaaaugcucuuuggcaagaguugcacguucgugcauugauugcauaauuguguugaagaaguauagcuuuuaaagugcuauuacuaaauuucuaggcugacauaugacuucccauuuggauguguaguuuugauggaucuauugguaauauaguuauaguuagcagcaagcaggcccuugcuucuugucuguagaaucuaggucaggcaggaucuccaugggggggacuuucuucccacucagcacagugcaccucacauaggaccuggcucucucucucucucucucucucucucucucucucucucucuccauauauauauaucuuccagaaacaaagcucacauuagcuucccaguuccuacuggaacggaaugcuugcuccuguguuuggcaccuggucugcauuuucccaagacucagugccuacuuccucuuuuuuuucuccgagaggcuguaggugugccugguggcagaggguuagaggaaaaauacccauaugccugggaguugguaauuagagaguaauauuggagccuucccaaagggcgccgcagaccucuccacaucccucccucucucccacuaucuuucuucuguucgcuaugaagaagaguuugugauauguaagucacauauaagcaaacaauggaggaggggccugaggagauagcuuagcacuucagaguguuugcugcucuuccgaaggauccguuugcuucccaggauccgcgucaacucacauggcucacaagugccagcuccaggggaccugauggccucuucugaauucugcagcaggcauugcacacacacacacacacacacacacacacagagagagagagagagagagagagagagagagagagagagagagagaaggagggauauuuaaaauagaacuuugaugcauacaauuccguggguuuuaguauauuuacugugcacaguuaaucacaggacauuugaacaguucagaaagaaaccccauggcauuugcugucuccccccaucuucccucacucccugucuacggcaaccacaacaacucuuucucucucuauggcuuggccucucuggguguguccuguaaauggguucaucccaggcaggcuuuaagagaagcuucgugcacucacucagcaucgggguuugaggguucaucugcguguggccugacagcacaucaucuuuucuuuugcuuucuguggcuaagagacaccacauugugagcagauaugcucuuucuacuuuuaucuauuauaaauuauaauaauuauaaguaauauauaaaauauaaugauaaacuguaaauacagcuaaggauauucguuuaugaggucuuguguguuuacauuuuuaaaagcuuuauuuauuuuuauuguccauguaugaguguuuuccuuguauguauguauguguacugugugugugugugugcaugugugcacacacauguguguguaaugaccauggagaccagaaaagggcaucggcccccuggaguugguguuucagggaguugugcacagcccuuugugagugcucugaauaaacuccgucucucuacaaguguucuucgccacugauuuaucuccagccuggaagcagcuuuuuauacauggugugaaguaggguucugaguuguucauucuuuugcaugcuuaguucuuuucaacaucauuagucaaaagucuaguccaccccucacuggauugccuuggcaccauacugaaaaacauuuggggguagggaccccuaaguuccuuucuucucccuuucuuucccccauccuccacccucuccucuuccucagccuacuucccuccccaaccccacccacuccccuucccuuucugucccuugcucucuuccauugugugugcaccagagguuaaucucagguguuacucucuggagccauccacuuuaaaaaaaaaaaaaaagauuauuuauuuauuuauuuauuuauuuauuuauuuauuuuauguauaugaguacacugucacagacacaccagaauagggcgucagaucccauuacggaugguugugagccaccaugugguugcugggaauugaacucaggaccucugggagagcagccagcgcucuuaacugcugagacauccagcccacccacuuuuauuuuuaaacucugugugugugugugugcgugugcguguguguguguguguguguguguguguguacacaacaguguggagucaguucucucuuccucuauguggguucugaagacugaacuuaaauccucagacuugcacagcaccuacuuuacccaccaaaccauccugcugguccaaaacuuguguguguguguguguguguguguguguguguguguguguguguaaagcgugcauuuuucaggugcacaagcauguaugugccauagugccagcguggaagucagcaguuauagaggguuggaucucuccugccaccuugugggauccggggauugacgucggguugcugggccuggaugcguguaccucucuccucugagccaucuuaccagccauugaaaaacaagcaggcucgcuugcuggccuugagcuuaacaaggccaggcugaauucuggagccugaacuccagucaaggacaguaagugcuccugacuacagagccuccccgccagccccacaccuggcuuuuucacaugcauucugugcaucagacacaguuccacacacuuuacugucugagcccacuccgcagcccaagagugcaguuucugaggagcccuugcauuuccaguugcauuuuaucguaugcaaggcagcucuuucgcaugcuuuuaaacuuuaauggguguguguccuuugccuggauaggugcgacgccagcauagccaggcucucugccgagcauaagucgaccuacgagggacuccagcacuugaacaaggaacagcaagcagccaagcuuauccuggaaacaaaaaucaaagacgcagaaggacagguacgaccgggucaggcgccucucagaaggaaguuggaguuuauucucagcucagaauugcacaguguagcuugguuuuuacagcagugaccagcguggguccccgguauggguuuaugcagauccucaguucuuucugucuuccuucccucggucucacuggagcggcccuucacgaaucuggaagccagaccacagagaguuguugguacacugccaauugaaaagauccuuuccccucauucauaaaacaauuccuauuccccagaacuucuacguuacuccucccaaacuaccucuugcacaggcgaguggcccauugucacuuugcaugcugcuuaucccagugucugauucagaaaauauguccuguacugacuggagucguugcacguacugcuucaucgaguggucuguaugugggacccaauuaggccaaagcuagagaguccaccugcaaaggaaaccucugaguauuuuaucuugaaacucauaguucacaaagggaaacucaguauuucacgaguuuggaacaguuucuuuuaaggucuuuacuaccuuuacgugugugugugugugugugugugugugugugugugugugugugugugucuguauaugugugugucugugugugugugugugacugugugugugugugucuguguguguguguguaugugugugugugugucugugugugugugugugucuguguguguguguguaugugugugugucugugugugugucugugugucuguguguguguguguguguguguguagguguguguguguagguguuccuagaggcuagaagacccuggagcugaauuguaaggguuguaagccaccugacacgugaguggggagcaggggggcuaaagagugaguuaggccaaccugaucaauuuacacgucucaaaauaaaaagcaaagacaggcggcuccacuggguagagguacucgccaagccuaaagaccugagcucagucucuggaacccacacaauggaaggagagaacugacucccacaagugguccucugaucgccacacaugagcugacauguacacaucugcacgcaugcacacaaaggaaguaaauaaauguuaaagaaaaaugauaggcaaggcuaagggcguagcuuugcacuggagugcuugcucgguguuaacuaagcccaagguuccguccuuugucuuuugcuggguucuucucuaccccuucuuccauccuuucaacccccuaacauaugauaugagagaaaaauggauagaggggaaaggaaagagaccccagaggaaagucagguggcauuauuauuagacugcuuccugcugauuagaggcguggcguuccuuggggcaaguuugaucucacugucaggacaucucauuucuucuuuuacuuauuucuucuuuguuuaugaccacuuaauaaaucauaacaaacaaacaacaacccagcccaccuuucagggcccuaacuuuuauauaccuuuugaaauguccccagaauuccaaugucacacaaucacagaaacuaucugcugcuagcaaaaucaugcuccugcuagagcauggggcaaaucauagucaguugcuguggacaaucugaaacagcucuaucccacaccugggguuaaaacauaaaacauguaauguuacuguguuuuucaaagaaaccaaaacucuaaaaauaucacuacaguuccuaguaauggagcagggucugugagaauaaaauuauuacaaaaggaaaaaaaaugauuuccugguaguuaaggugaguacaauacagaaaucuaccaaaagagacaugauagcgaugguggugaugauggugauggugguggugaugauggugauaauggugaugaugaugaugguggugguggugaugauggugauggugguggugaugauggugaugauggugguggugaugaugaugaugauccacaucuuacaaauaugaaucuuaaguaaggaauuuugagcaacacuuagcuuuucagaaaaugugaucauuuuauacaggacuaguuuaacauugagcuuuagugaaaacaaaucccaaauaagaacaaaggccagaaguagggaaccagagggauguagcccacagagggucuucuguggggcuucacuugaugagggaguacaucuggaaccuugauuuguuuguaagccauagaaaugcugcccuccaggacuggcagccauggugcugguggaaguccaagguaauaauggcugcauaccgcgacagcugguagagauaccaggccugggcaggggcugggauugcucauuagagagcucugaaguuuaaauucacuuccugaugaauauuuuggcagugccccuugucuugauuuuugcugggugugcaagaaaaaaaaaaaggcagaggcugcauagauggugugagaaugaagacgcccuucauagaugggagaugauguaaggguuaaagcgcccuagggagaugauguaaggguuaaagcgcccacuggcaccagcagaagggccugaguuuggaucugcggcacccaaugaaaagcuagacacugugggggcuggagagauggcucagcaguuaagagcacuuguuuuuccagaggcccugaguuugguuuccaggacucauacgguaacucacaaccauaacuaccguccucaggaaucugaugcccucuucugaccucugcaggcacaagaaacacacauggugcacauacauucaggcaaauacucaugcacauaaaauaaaaucaucuaaaaauaaaaaagccaggcauugugauccacccugcacuggguggaggagaggagaggcgauccuuagaucuauuagccagcucuucuagccaauagugagcuccguguucaauaagggacccugucucaaaacauagaguggagaguaacugaggaggucagcuccuguuaaccccuggccuucauauggaccuaugugcacauguaccugcguacacacacauacacaacagacacacacacagacacacagagagacacacacacacagaaaaacauacagacaaacacacagacacacagacacacacacacaaagacacauacacagacacacucacauacagagagacacagacucacacacagaggcacagauauucauacacagagacacauacacagacacacucucacacagacacacacacagacacacucacacagacacacuuacacacagacucacugacauacacacagaaauacacacagauauucacauaaagagacacacacagauacacaugcaagcacacagauacacacacucacacauagauacacauacucacacauagaggcacauacacaaacauaagcacagacacacacucacacacagagacacauacacagacacacacacacucacacacaguaauacacacacacacacacacacacacacacacacacggaaagaggaagggaacccccauauggacuuaguaaagugacucaaugcuacugaccggcauugagcguaugaaaaguuuucugagauggcccaugaagacagauaugagcgccuucuaacucaaucuucuuuuccagauuucucagcuuuugagcagaguggacuuguccaucucagagcagagcaccaaacugaagaugucccacagggacagcaaccaccagcuccagcuccuggacacuaaguaagccacccguuuguaaaggcuuuugucacauucuuccugagaccaugaaauucacauuuucucccucuugcuuuuauuuaaaaauauaaugucuaaauguugucugucuuaaauauuuauuuuuauuuaugucugugugaauaugugcacaugagugcagugucuacagaggccagaagagggcguuggauccccuggagcuggcgugaacagccagauaugggugcugggaacuuaacacauguccucuggaagagcagcaacugucccuaacugcugagcccucuccccugcccaccucuccguuuuuauuuaccacacagagugaaaauaauaacaaaaacuaaaggaaacaguuuccauguggcaacagucaccuuuucuucauaaugauugcuucuaggggcugggugaugguccauugcuucauucaaugugucuuugguucauuuguuuuauuuugguguguauaugcauaugugcauguguguaaaugcgcagggguagguucaaugugcccaugcgggcauggguguguggaggugaccaucaacauugggaggcuuccucuaccucuccucaccuuauuuauuuuauuuuacuuugaggcagagucucucacugauucuguuagauuaccuggccaauaaauccaucuuuccaucucuccagugcuuggauuauagaugcaagccaucuugccuagauuuuacacggauuccgggcauccaaacucagguccuguugucugggcagcaagcacuuuacccacuaaaucaccuuccugacugcucguauauauuuguggaguacuuacucugguucuaguaaugaaggaaaaacaaaacaaaacagaccuuguucuucaaccugaagaguguacaguuuagggagcugauggccagguguuagauaagggcuuaggcagaguguuauuuauuauuaauagugcuucaagggauauaccuauaucccuugugguuauguuagguuaaauaaugguucccccaaauccuccauaugaauacauuuauuaacuuuuggggauaaaaggaacuugguggguguguuucagugucuucaacugggaauauaguccaggagucaagugcuugacuagcaagaccgaggucauagguucaaucucaguauaagaaaauuaaagccuuuuaaaagaucucuauauguacacaaugguagacauguuaaggucagacuaugcuguguggucagugauccaggacagacagggcagcucugacaacccaguguggagccucuacaguucuaguccugcuuuucccagcugcuacagagggaaaacccagggcaacagcugugucuugggggauguaaucagagccauguauguacuucauguacugccaaucaucugagucauuggugcgcugcacuguaacuauuacguuucucauugcugggaccugacaaaggcagcucaaguaaugaagauggccauuuggcucacaguuugagggaauaccauccaccauggugaugaacaugugguagcuggagcacaggagagcuagucacauugcaucuauagucagggguugaaaagaugagugccggggcuggagugauggcuuaauaguuaagagccauccaaagguccugcucuuccaaagguccugaguucaauauccagcaaccacaugguggcucacaaccaucugugaagggaucugaugcccucuucuggugugucuggaaauagcuacaguguacucauauaaauaaaauaaucuuuaaaaaaaaaaggaaaagaaaaaaagaggaaagaugagugcuugguauccugucuccuuccuuccuuccuuccuuuuuuuuuuuuuuaauucaugggacuccaguccaugagaugguauuuuauacauuuagagugugccuccccucuucauucaauuccucuggaaacacccucacuuaaugcuucaaggugugucucccagaugauuccaaaucaagucaagaugacccaggagauuagccaucauauccaucuagcugcaagggaggcuagaaaauguggucucuagcuaggcagccauguacuccagugacaugugacacuauauaaaaccaaaaauagacauuucagugacucuaauggauuuuuuuauuauuuaaauuguacuucuauguuuauuacaccucuauacauaacuauauauauucuauaguuucauuacaugcuaauucaaauaagaagaaggugauuaaggggaacauacauugauaguuauuuuaagggcucuggagggaaaggggacuagaggaauggauuauuguaagggugcuuucuuuugagacaaagcaucaaguagauuaagcuacuaugaauucacucugaccuuuaacuucgacuucuccuggcuuugccuuccaaguucugggauugcaggucuguuccauuaugccugguuuauuuccuacugguuuagauuaggcuaugcucauauggagaaagaacaauaaaagucaagagaaagaaagaaauccagccucuaguccuggaggauacaagaggcaaggaagaguauaugaaaggagaggauguugaaaggggauagaugaaggauaauauguccucugagcaaggaguaccacggacccuuagaacugcaaagaugauccccuggcauguacugugccaccuaaguaccugcauugccaguuccuauggguaggagcaucauuaggugucuuucuguugcuugcuuccauccugcaccaacuucauguugaacaugguccuaagagaaggaaaguaugccauucccauugaauugauguuaugugauguuacguaaaacuguuuuacguucagcuuguucgcacaccucuccuuuucuuucuuuucuaaugguuuagauuuaaaggcaccguugaagagcucagcaaccagauuuugucugcacggaguuggcugcaacaagaacaggagcggauagagaaagaacuucugcagaaaauagaccaucucuccuugauuguuaaggaaaacaguguaaguguugaugcuuuucaauaauagguauucaguugaucaaugucugaucaacaccuagggacuuagcauacauuuauuuggugccucccaaagcugcuuggguauuccccauguuccuucucuuuucccuucccuccuuuccuucuuccucucccgugucccccuuuucucucuuucucgucuuuccuuuguucugagcaucaaacccagguucucauaccuguuaucucaguuucuuuuccuguugcuaugggaaaauacacucacaaaagcaacuuaaggggcuggagagauggcucagcaguuaagagcacugauugcucuuccagagguccugaguucaauccccagcaaccacgagguggcucacauccaucuauaauggaaucuuaugugucugaagauagcuacaguguacucauauacauaagauaaauaaauaaaucuuuuuuaaaaaagcaacuugaggaagaaaaggcugauuguggcgcacauccucucaguggggaguuaaggcagccggaacauagcacagcuggucgugcuguauccaugagagcggugaauacaggccucagugcucaguucucuuccccauucacacaguucaggauccccaccagggaauggugccacccacaauggcugggucuguccaccucaagcaaauaaaaauaacuccccacagucguguccaggggcuuggcucccaguugauucuaaauucuguuacaauuaacacuaaccgucguaucuguuaauuuugaacuuugccacccagccaugccccccauuuccuguucuucauauuauucauaaagacaggaaaugcuuuguuuuuauauugguuaacaaaagacaaaguaaaauuuucagcuaccgcuuuuaagucacaaccuugacuuaaaugaucccgauugucuaucacacauuucuaaguaaagcuacaauuacuuacuugaucuguuuuucuguuuuauuaaugauuuauuuauuuuuauuucguaugcauugcuguuuugucugcauguaugucuccugggugaggguguugggugugguguucuuuggaccuggaguugcagacaguugugggcugccauguggguguugggaaaugaaucccggucugguggaagagcaaccagugcacuuaaccacuaagccgucugaucuccuuucucuuuguuuuuaauguugugacuuaguuuuuguuuucaccaaugucgaguggcucucugucccuccgggccccuuccaaugcacuguaacuagagugugcuuggacgucagaccagaacacacuauuuccuuuucugucuacuucugcuuccacuggcucucucaaagaacuaauuuuugcagagcuaccaaaaaauaacuucaaagagcuuugcauuuaucacacuucaagccaguaggcuuagaagccagugcuaggaaggcaaauuguguuggguucucuuuccuuguccggcuucggcuuccucccguggggcuugggcugagcagaaguggccagugugguuugccugucugacugcucgguccugaugcugagccauuuguugaguggcaggcucugcaucagugccaucacaggauugcugucacgcugcaaaaucacaccugaugaaaggcuucaugcucgucguuugaccacuagaaccuguggaugcaguuucacaaagcguaggccuaguggaccguacuacuuugaaucccuccccccaguugucuccuuugcugugccuugacucacccugacauguuugugaaguucugagccugugacugaccauuuggguuuuuuuuuuuuugaccauuugguggcucuucuaagauggaagcuuccuucucucucacggaaacacauccaaguuugcauucuccgggaccccaaaugacuuaaaaacuugucagucuucaauaacucagaauccuuuuagguuagauuucugccauccucaagaguagcacuugucgccacgauucaggaugguugauagaacuccagcauugacugaacagccauugacagaagggaaggggaaagaauuaaggauauauagcaaguguccuuuaacuuuuucugaaagcagcuacauacacuuguucuuacacuucauugguuagauuacauggccacaccaaacucaggagacagaauaaaauguaguuuuuuuguuuuuguuuuuguuuuuguuuuuuuacucugggugaccuuugagaauggauacgggauggauaaccagccacugugauucuggugccugcagaugguugaguccucuggcugaugugagacaaggugaccacucuucuuuugcaauaaccaagugcaauucuuaucuuggaccucagggagccaaugaaagagacguagagaagaaacucagccagaugucggccaggcuugacaaaaucgaagagagucagaagaggaaugcugaaggacagagaaagccggacgaggagaaggugcacgggcggaucagcaagcuggagcuacagaugacggaggacaugaaggagaugaaagcggagguuaaugccgguaggccagaccccacgcagcucauguggcuugucugucuaaaaagcuauucacugaaaucucugaaacagagacugagcuggcuuaaaaaaaaaaaucagcaaaauguuccuaguugcuauucuaaguagcugugcagaauuuaacaaauucauucauuuauuuacuuauuauagcggugggaauugaacucaggaccucacaguugcuagacaagcacgugcuaccagggaacuauacucccagcccuaaaguacuaguucaauugcaagucuaugaagagccuccaugacacacagcaaacaaaaaaugguuaacccgcacaugacugacauuuucuuauuuucgucagcgcuagcuaccugcugauuccucucuguucguguacaugugaggcacgucugagagcuucuucagcaucgcuggcuguaugcacacggcacaugcguguggaguuaguucuguggggcccagcaacgggacuuaagcccucaggcuuggcagcaagcgccuuuacucagugagccaucucaucagccccaaucaaaacuuuuuuuaaugaauaauuuuuauacuuuuucauaaauugucagauaaaacuuucuaaggaaaaaaauaacauuauaaaaccccuuaauuuuaaaaaucaguaaaaaaacagaauaauuugaaauucuucuuugguggagauggcuucuuuuuuuaaaaaaaaaacaaaaccuuuuucauaaucaaaauuuuauuuguaagauuuguucccaccccuuucuacauaugacaugugugaguguguguguguguguguguguguguguguguguguguguguguguguguuugcgugcgugcgugugcgcauuugugagccaccugauguggggcucugaacugcaguccucugaccgggcaguaaagugucuuagccacuguccuaguuaggauugccacugcugcaauggagcaccaugauccaaaacagcguggggagggaaggguuuauuuggcuuauauuuccacaucacuguuuauuacagaaggaagucaggacaggaacucaagcaaagagggaaccuggaggcaggagcugaugcagaggccauggggugcugcugcuuaguagcuugcucuccauggcuugcuuggccugcuuucuuauagaacccaggaccaccagccuagggagagaaccacccagaaugggcugggcccucuccaucaaucacuaauuaagaaaacaccuauaggcuugccuacagcccgcuuuuauacgggcauuuucucagcugaggcucccucuucucugcugacucaagcuuacgucaaguugacacaaaauuaaccagcucagccaccaacacaucucuccaguccucaauuaauuuuuaaauuaaaaaugauuuguagccgggcgugguggugcacgccuuuaaucccagcacucgggaggcagaggcagacggauuucugaguucgaggccagccuggucuacaaagugaguuccaggacagccagggcuauacagagaaaccuugucucaaaaaaccaaaaaaaaaaaaaauaauuauuuguauauuuaagguucauaacacaaaaugguugcuauguucaugcaaauuaaccuacccaucaucucacaugggaggugcauguauguuuguguauguugugugcauuauaucuauaucuauaugcauagauauagauauguuuuuauaugugugccuauguacguguguaugguuuaugaguguucauguguaucuugagucaacucuuucaucaaagacccaaagacaauauauuagaauuucccuuaccacauaaauuagaucucauuuuaugaauuuugcucuuuuguuuuguuuugguuuuuucccagcucucuccgggcaggguuuggguguggagagcugugggacagccuuagcucggggcgcagauaaaaacuggccuuuugggggggggggggucaagacaagguuucucugugaaacagcccuggcuguccuggaacucacucuguagacauuacauuucaauucauagcaauagaaaaauuacaguuaugaauuagcaacaaaauaauuuuaugguugggcucaccaaucacaacaggaggaacuguauuaaagggucccagcacuaggaagguugagagccauggccauaggaacuggaggccuaaggccuggugcucucuugacucacagaagccccugaaccugguauuuuuagacuacagggcaguguuuuacagaaaguuccccaggugcaguuugauuacuuucuuaugauauaaccuggaacggcgggauggacagacgcccugcuccggccaucugaucagcagauacaugcugugauuucuccuggugauaguggugugagcuuuggucacuugguuaaaucugcaucuacugucuuucuugacugcaguagagcccuuugcgucuaaaacacaauuuucauggagguucccaugcagcacugacccaagggcucaguaucggucagaaccaaucggcacuauugcuguagaagguggucagacacugcuucuuagcuguuaacuccugugaccuuugccucuuccucaaggguucucagccaucuaugagagcauagggucccucagacaagugcuggaggccaagaugaagcuggacagggaccaacuucagaagcagauccagcagaugcagaagccagagaccgccaugugaagacggcugggacaaggaccugacaggagacugcacguggggcuaagagccagauggcucugcagccacaucguggcuauguuccggaucccauccagggugugcaugugccaagaaaugcgcucucaugggucuaagcguuuaccuucagucuugaaaacacccuuuacuuaaaaucguaaauacaauuuuuacaacguuauuucccuaagugcaguugagcccgauucccucagauuuugaaaggcuuuuaugaaugaaaagaauuuauuuucaaugcuugaugcucuagccaagacuacuauuuuggaaaaaaaaaaaaaacccaccauggugauuuuucuuuugauuaaaaagugaaugaguugcuacagguauguauugccccucacccuacauuaagagaaguccugguagaguucagcuuuaaguccacaucuggauuguauuuuuguugucuauaugguuuuuuuuuuuuaaauguuggguuuuuuuuuuuuuuuuuuuuuuguaaaucaccugucuuuuguagagaagaaguuuaacacugggagagaaaaaaaaaagcccugcaauuuauauaaugaaaauaguuuuuuaaaauugauaauugccauacagauuauaaauuaaguagaaacuuacaacguuuaucuagaucccacaaggcacgauauuuauauccaccuagggguaccggcuuuuacuauuuaaagcuauuuuugaaaccacucacaaccuguguagugauagccauauauuuaauaaugggaugguggcuaagcaaccuguuuaucgaacagcuaauuguucaucaguuguaaugaauguuagaauuuuucagacuuuacgauuuaccuaaauguucccuaaacaggcacuacgugcuaggguuuauagacauuuguuguaacugucuaucuugugccuugguuuuuuuucuuacgucgcuguacuguccucuguaaaaaaaaaaaagaaauuacccacaaaauagacagugugguaaacacaucaggguugugguguaagacugagauccuauguaauuuuaagcauccuaaugauuucaucgcugucauggugggccgcacucagcauccuucauggaauagcugcacacaccuuuguauggacagagaggcaaagcgagacuacauuuguaauacugcgaggagacgggugucccggcaccuuugcaggcguuuuauuuucaguugccauguuugagucauugaagacuugagccugugccauuugcacuucuguguuaaagugagggcacagagagagagagggagagagagagagagagagagagagagagagagagagagaacaggagcauuuaaaaguuccaagaacaacaccccauccuuuccuuuccucucucaugugcaaggacucaggaaaaucaaaagcauuuucuauuucuagaauaaaccacacugagauucuaccuggcucuuacuguugacccauguaagauaugcugcuaaaguaccuaauauucuacucuugggaccuugaaaacuuugauuugaguuuggaugcaugagagguuaugugaggaacauguacccauccugcauuucuucaucuccccacacaucguuucgucuccaugcaggaggaucugcccaccuaggagaagucagcgaugcuucgugaccagacagugugguuucuucuuucccugugugcucggcuagccauguuuuaucgagugauuaagcacaaaucucacucaggacagggccacaccuccucagugucucucuccccuggggacucuaagggggaagggugagcacacaggacacuugggaggaggagacaggggacaccugcugacccuggccuagcaggugauguaagcaggugacacagcugcuggugauaccgccagguauucgagacguugccgaccaugugacaagacacuguggcagggacccuccacccuggcugcuuggggucacuuggggaguuuaaagagcaacugacaccaaacaaccuccugacccauuaagucagagcaucugggaggcagucaccagcaccaaccaguaugugucacagcccuaucccgaaucccccccacccccccacccccagcgauucugugugcuauggggaggccagccauccugcgaagacaauggaguacucuucucgccaaaguuuaaaggagaaucagcugcccugucuuuuccuuuaccagagauuugcaauaaagagaauaaaauuuccaaau

SEQ ID NO: 5174 - RNA, 1773 nt, Mus musculus
uggacgaggguagccugagaacaggauguagcuacgggucucccaguuucaauggcggauccuuuaggguucgccaucagaggauuuagauuuaacaaggcuuacaagauugagauuuuaguugcugugcccagugauugaguuaccuucauuucugagcuaaguuuguguuguguuuuccuucacgcagcggcucgucuggauucaagaaagaaagguaugguggcaaagcguggguuugccugaggugcaccacaaaggccgugggggaauuugaagcaugugguuggcgugguaacaacuugacaaugggaaccuagcaaguuggguggagagauuguggaguucugagucagagucuccacaagauaaaaggaggucagccauuccccgccagugcaugaccggccaggccaccgucagggcagagaguaggcagcacaagcgcagggacauacagacuuguuuuguaauauuccccgcaacaacccaugagacaucucccagacugggauucauuuugauuagaacauuucuuauugcuggugcucagcauguugauaauauggcuuccagaccaucacuuucccuuuggacuguuuuguuuuugcuuuuguucugucuuguuuuguuuuguggugcugggcauugaacccagggcuccaugcuuaagauguguaucccagugcccaaaccauuauugguccaccuacccacugcaagcagccgucacugaguccugguacaggcccuggagaagaaucagacaagugccugcccugaugggacuaaaaucuuucugucauauaaagaacaucugcaucaacagaggagcucacugcucuuauauguguuccuaaaaacacaaccaaaucagauugugaaaucuaaaggcaucccaaaccuagaauaauucccagcagugcuuugucuugugcacacacaguuaagcuauuauucuggagucuggcagaugauuuucaaacaucucaguuggucaaugcuuacuuagcauauaugaagcuccaacaucaauucccggcauuguauaaacaaggcauggugccacaugccuggaaaaucaacacucggaagguagagccaggaggagcagaaguucaaggucauccuuggcuacacagugaguugcagaccugucugaaaauaaaauaaaauaaaauaaaauaaaauaaaauaaaauaaaaugcaugaaguaaaaaaaaauguauaaaauaaaauaucuggacuucuccuucccagcagaauaguguauagcuuuaagauguggguucagcugggcaugguggcacacacauuuagucccaggacuugagaggcagaggcacauggauuucugugagugugagaccagccuggucuacauagugaguuucaggauagccaagucuauguagaaagacccugucucaaaaaccaagccaaaccaaaaaagauguaaguuaaugaauuuacguaccuauaagucaaacacaggugugcauacguguguacacacacauacacacacacacacacaaauauauauauacaggguuucucuguguagcccugucuguccuggaauuugcuuuguaggccaggcucaucuugaacucagagaucugccugucucugcuucccaaguacugggauuaaaggcauugcagcaccaccucuggcaugcuuuucuuaucuguaaaacagaagauuuuuuuuucuuuuuuuuuauuacguauuuucuucaauuacauuuccaaugcuaucccaaaagcc

SEQ ID NO: 5175 - RNA, 2492 nt, Mus musculus
ucuggagagcacauaccacaucucccauguaagagcugugagggagcugggcuggugcaggccuacaucccagcgacugacuggucaaggccaaacagggcaucuuagagaaauccuggaucaaaguaauaacugacagcuggagaugcagcugugacagcgcacaagcccagcaugugugagagccugaggucaaccuccaauacacucaaauacauuuuuuuuaaagccaugguaaaauuuuuaccuuguaaaaucccaguccuuccuaaccaccuccccagcacauacagcauggcucugucccgagacaggccuagcgcagggugggaagaggcucucagcucuagcagaccaagugcucaugcacauuugaaagcugugugcacggguccagaggguaagccaagcaacaagcauacucccaccccuugcuggaaaaugagucaguguggaaacacacacgcacgcaugcaugcucgcucucgaguaccaacccucuucucagaguggaaccugccucacagacagauggguccagccauacacaaggaaaaauucagaguagagaaguagcugugugggcugaggggacagcucaguaaaguacgagccuugcaagcagaggaaccugaguucauaucacaagggcucccagugcagccuucuucuccuacucacccauuuuccuuggcccagcaccuucugagacaggcaagaggcagcggcugccaccugagaaggaugguagugcaccaugucauagucgacgagcgucagcuccaucagguacuuggcuaaagugugcuguucaacauccaccuaggagaaugcagcacacugugaggguugugaacuugacccacuuaacucccaccucucucaagaacccagugaauuaaguaucaaagcucucuaaagaagcuuucucuuagagcagcgggucucaaccuucuuaauacugugacacuucacuacagcuccucauggugcgcugacccccaacgagaacaguauuuuuuuacuacuucauaacuguaauuucacuacuauuaugaauuguaaauaucugauaugcaggauaucuaaugcaauaucuauaugcaacacuuguuugacucccaaagggcuugcaacccacagguugcaaaccacuggcuucuaguuugggcuaagacugagcacagucaacuucccagagauggugggacucaccucuccggcuuuugaggcucgccuuaagaagugaaguggcaaaggucggcccaacucaaauuucaacucuuucaaaaucagagucuccauuucucggauuugggaacugguguaagcauuaucugugauauaaacaaagucuucgauauuuggagaaaacaucuccucauauuuggaagccaggagcagagcugugaucccgaccagcugcaguuucuuccggcagaccagcugagccuaacgagaaacaaacacauccagucaccacugacucggauuccacugaggcccaggggggacggcgugaagaggccaggcccuugcaggacacaggagaccugaauguggcuguaagagccaucacagagcacgccacugucauucaguaaccaugcugggcacagugaugagauuccaacacuaugucauuggguccucccccaaauccugaaaaggucauuuauacaacagaugaccugacccuagagcuuuaaguaauggucccaaguguccacaguggucuugcccuguccucagugugguauacacuguauacagaucacugcaaaagugcaaacuaaagagcagcucguccgucaccuaccuugaagacccuccucagguagagaagacacgcaucagugcuccagaguuggggugcacuacagcguuuaaguaugugcuguaaacuuccuagcccagggcuggugagacagcucagcagcacgggcuuggcccugagcucaagcucugagucucacggugggaagagggaaccaacucucaaaagcuggccucuugccucccuccagugcugcacacgcaccaagugaaugacauuucuuccaacgaggugaggagcagagagcagcucaguggcuaaugcugcuaagccugaagacccgaggcuagucccugaaacgcacacggcagaagucgucuuaccucugccugugugcuaugguacgccugugcuccaaacauacaaaaagaaagcacggguuauuucaaguucucuuuaacugggacuuugcucuucuugcuucuuuuuucauuacuggaaaucuacacaaaauauuacucaguuuccuucccaguguguguacugagaaccauacaaucuauugguuaaguaucuggaaguaccucacagccauuaauauacgugauaacugucaccauaucguacuugaccuaacccuauuucauugacuuuuacaucaguccagucugcaagggggcugacgcagaugacacccugacuguuugcugcggca

SEQ ID NO: 5176 - RNA, 2492 nt, Mus musculus
ugccgcagcaaacagucagggugucaucugcgucagcccccuugcagacuggacugauguaaaagucaaugaaauaggguuaggucaaguacgauauggugacaguuaucacguauauuaauggcugugagguacuuccagauacuuaaccaauagauuguaugguucucaguacacacacugggaaggaaacugaguaauauuuuguguagauuuccaguaaugaaaaaagaagcaagaagagcaaagucccaguuaaagagaacuugaaauaacccgugcuuucuuuuuguauguuuggagcacaggcguaccauagcacacaggcagagguaagacgacuucugccgugugcguuucagggacuagccucgggucuucaggcuuagcagcauuagccacugagcugcucucugcuccucaccucguuggaagaaaugucauucacuuggugcgugugcagcacuggagggaggcaagaggccagcuuuugagaguugguucccucuucccaccgugagacucagagcuugagcucagggccaagcccgugcugcugagcugucucaccagcccugggcuaggaaguuuacagcacauacuuaaacgcuguagugcaccccaacucuggagcacugaugcgugucuucucuaccugaggagggucuucaagguaggugacggacgagcugcucuuuaguuugcacuuuugcagugaucuguauacaguguauaccacacugaggacagggcaagaccacuguggacacuugggaccauuacuuaaagcucuagggucaggucaucuguuguauaaaugaccuuuucaggauuugggggaggacccaaugacauaguguuggaaucucaucacugugcccagcaugguuacugaaugacaguggcgugcucugugauggcucuuacagccacauucaggucuccuguguccugcaagggccuggccucuucacgccguccccccugggccucaguggaauccgagucaguggugacuggauguguuuguuucucguuaggcucagcuggucugccggaagaaacugcagcuggucgggaucacagcucugcuccuggcuuccaaauaugaggagauguuuucuccaaauaucgaagacuuuguuuauaucacagauaaugcuuacaccaguucccaaauccgagaaauggagacucugauuuugaaagaguugaaauuugaguugggccgaccuuugccacuucacuucuuaaggcgagccucaaaagccggagaggugagucccaccaucucugggaaguugacugugcucagucuuagcccaaacuagaagccagugguuugcaaccuguggguugcaagcccuuugggagucaaacaaguguugcauauagauauugcauuagauauccugcauaucagauauuuacaauucauaauaguagugaaauuacaguuaugaaguaguaaaaaaauacuguucucguugggggucagcgcaccaugaggagcuguagugaagugucacaguauuaagaagguugagacccgcugcucuaagagaaagcuucuuuagagagcuuugauacuuaauucacuggguucuugagagaggugggaguuaagugggucaaguucacaacccucacagugugcugcauucuccuagguggauguugaacagcacacuuuagccaaguaccugauggagcugacgcucgucgacuaugacauggugcacuaccauccuucucagguggcagccgcugccucuugccugucucagaaggugcugggccaaggaaaaugggugaguaggagaagaaggcugcacugggagcccuugugauaugaacucagguuccucugcuugcaaggcucguacuuuacugagcuguccccucagcccacacagcuacuucucuacucugaauuuuuccuuguguauggcuggacccaucugucugugaggcagguuccacucugagaagaggguugguacucgagagcgagcaugcaugcgugcguguguguuuccacacugacucauuuuccagcaaggggugggaguaugcuuguugcuuggcuuacccucuggacccgugcacacagcuuucaaaugugcaugagcacuuggucugcuagagcugagagccucuucccacccugcgcuaggccugucucgggacagagccaugcuguaugugcuggggaggugguuaggaaggacugggauuuuacaagguaaaaauuuuaccauggcuuuaaaaaaaauguauuugaguguauuggagguugaccucaggcucucacacaugcugggcuugugcgcugucacagcugcaucuccagcugucaguuauuacuuugauccaggauuucucuaagaugcccuguuuggccuugaccagucagucgcugggauguaggccugcaccagcccagcucccucacagcucuuacaugggagaugugguaugugcucuccaga

SEQ ID NO: 5177 - RNA, 78354 nt, Mus musculus
cggugucgcgcucgcgcagucggggagggccggcccaggcugcggcggcggcgacggcgaugguggcggggcgcuggugcugcgcggcguaaggcacgccggccguucagggucgcgagcgcgcgugggccgcgaucgggugcucggagccggguccagccgagccaggcucagccucacgcuccgcggcggcgguguugacagacgcccuccugaggagagccgcccggcccgccucagccucacccggccgagcgcuguuccccagccccgcgccagcgaguccgggaccuggccgcacggggccugcggacucgggugagggcgccggcggaaggggggggggugcgggggaggggagcggcgcgguggcgcuugcgcgcggcgggggaggggccgagcaggagggagaaagaggaagggccgcggcggccggcccgggucggcgacaggggaaugaccgcgggucccggacggcgcggaguggcucauuguguccgggcaagaguccgcccgcggacacacccacggccucuugggagggggugggugaggggauugcgccccggggccgccgcucgccagcgggacuggggcucagggccgaggagugggggugacaauggagugaggaagguaaccccggcuggagccgggagccgcccggugcgggcgggcacgcgcaguccgcggagcagaagacaggcgcgucugauauuguguggaguuggcugguuagucauuaaaaaaagauguuuucuuuauccugccuagauaauugaucggagucagcaguggugcgguggaaauaucgguuuuuguucuggagaaauagagguuugucaccacacuucuuagauuauagagcuuuauagauaauuuuaaaaaaaaagugugacuuuuuagcguccaaaaaaaacaacaaccaaaaaccaaaaaaccaggaaguuguagcuagcgccuucacuuaauuugcucaugucuggggugacuccauuguauuguugagagcuuuccuguuccuugauuuauguacagaaugaguuuagaacuccugaguagcagugagugagccagcugacagagaccucauugucagaguucugacagcucuugaaccugacuugauccaaacuuaguuccauuuggcacuuuuaucuuuaauuuucuuguuuuggggaccucuuuaaccaaagagagcaaaaucaaaaaaaagaugaacagagguuccucauaucuuuaccauuugucuuugcaauagcucucacgugacuuaauacagauguccuuucaagaauucugauuuuacuuagcuuuugagucuacguuaaagaacccaaacaaaccccaaaaccuucaugugcguauauaccaguguguggggucuguacaugugagugcaggugccucugaggccggaagaggaccuaguacucuggagugguaguuaaaggagguuuugcacugcccuguauaggugcugagucccgauuggguccucagccagcauaguaagcacucuugacaacaaaccauuuuuccaggucuggauuuauauuuugauaguuuguaacuaagugauuuuuuguuuuguuuuuauuuuaguaaaaagguuuaguagaaacuggucauuguaauauuguguuacauugugacauagguuuuaaggaagcucuucuauuuugaagagaaacaauuuagcuuuaaauuacuuuuguagcaggagugcugagugugugauggcucgaguugccuuuaauccuaacauuugggaggcagagccuagcuugguguauauagugaguucuacaacagcccauacuauguagagagauccuauuuuaaauacccacccccaaaauauauauuacuuuugcuacuuucuuaggguguaaccauggacaaauuauuucauuguauccugcuugcuuguuaccucagagucucaguaguaucugaaaaaauuacugagggcauuugugaguugggugaaugauaguggggaaaauuagcaagaauaauuuuuguuuguuuguuuguuuguuuucgagacaggguuucucuguauagcccugguuguccuagaacucacucuguagaccaggcuggccucgaacucagaaauucgccugucucuaguaguuuuuuucuuaauaaucaggguugggugucauguauguguguuuucuuuugucaucuuuccccuuuguucucuguauauuggucacuuguaucccagaugguucacuagaaauagucagucuuuagcuccuauacucagaaaucuuucugccucagccuccaaaggagcugggacugcagguuucugucauuguacuugggucucgaguuuauaguugaaaaaagcuauaauaaaaauaauuaggcuuaaugaagaaugugugcuagcugggguuauauucagcaaguuuuguuuugguguuucauauuuguaagaaauugagacauguuucuacugauauucuaagagaacagcaguuuauuugcauaaagcuaaagagcaguaaguuuuugagcaggugcaucugaguacaguuuuuuuuuuuaaguugaaaauaugaaauagaaaauucauuguaucaaaacauucauagcuuaaaagucuuaaagaugucaugauuagccgggcagugguggcacacgccuuuaaucccagcacucgggaggcagaggcaggcggauuucugaguucgaggccagccuggucuacagagugaguuccaggacagccagggcuacacagagaaacccugucucgaaaaacaaaaaaaacaaaacaaaacaaaaaaguuaugguaauaaagggcuuugguaucaugcauuaguuacaacuuaguuauaugugucccugcuuuuaccccaacuccauggacuugggucuuuaauagagggaaauagacugacagaacaacaacaacaaaauaauaguaauuaagauuuguuacauuuguuuagguguaguaugguuguuguacauuggaucugaauuuauuguuaacuuuucuugaaguuauagccuucucaauuaguaaaaugaguauaaaauucauaaauguucauuucuagccucugguuuugggugugugugugccacauuuaauagcuucuauuuuuaguucuuucaauauucacuguuagauuuaucaggacagcucucuagaaagaaaugcucuauggagaguauaaauugaugcguguaugcaaauaaagcacauacauaugcauuaaccuucaaugaagccauauuuguucaugguaguggauaauucuguccauuggagaaguuacucagaguguuuuguuuguuuuguguuuuccgaagaugggaguguacuauaaccugguucucauugaauaucucaggcuggccacucaggucaccaaagugcuggugauuacaagugugagcuuguguccaguuuuaccaaccuuuuacaccuuucagaaaauucuaaauaugaauacaccccccaaaccccaaccccugauuuugagaccaggcucucaggcaucucagguuaaauucacuguaaagccagaaaguuccuugaauuucucccccuccccuccccucccuucccccccccccuucuuucuuucuuucccugagacuagguuucucuguguagcccuagaauucacuuuguagcuuaggcucaaacucagaucugccugccugugcaucucaagugcuggcaucaaaggugugugucaauuuaaguauauugaauuucuaauccucuucuagaugugggauaguaugggcuacagcauuguuuauaaaaaugauacuuugguuuugguuuuucgagacaggguuucucuuuauagcccuggcuguccuggaacucacuuuguagaccaggcuggccucgaacucagaaauucuccugccucugccuccggagugcugggauuagaaauccaccugccucugucucccaagugcugggauuaaagucgugugucaccacugcccggcauauugaccaucuuauacucuauucucucuuguaucucucagguugcugccuggguuucuguagguagucagaaauugacaauagaugaaaagaaaguuacaaaugauagaaacacagagcagagcugauauguuacauggagguuuuacauuaugauauacuuuaaguauguguugauugccucauguuguaggcagauacugauuggucugcagggaucaagauguugccuucauagaguagacagucuguugaguuacaaccucauaaauaggauaaauaguggugagugccuugaggaaaauaagaucauguuguagagaagaauggaaauaggcuucuuauguagguagaaagguggcacagccguguuuuagaguuacucucagaugagauaaagaugauaauaauauguuuacuuacguaggaacaugucuagauuuuagagcuagagacugaagaaugagaaaagaggcuguaggggcuggagggauggcuuagcaguuaagagcacugacuuuucuucugaagguccugaguucaaaucccagcaaccacaugguggcucacaaccaucuguaaugacaucugacgccucuacuggugugucugaagacagcuacaguguacuuacauauaauaauaaauaaaucuuuuuaaaaaaaaaaagagagaaaaggggaugagaauuuagcucugggggagaguguuuaccucaaaauuucaagggccugaguucagucuccagcacugaaaaggggggauugcaugguagcucauaguagaguucuuaugugucugcauguucauguguaugauguggaggccagagcauacccuugaguguugguccuccaaugcuguauuuguuaggguucucaagaggagcagaacuuagagaaugaaccuauuuauauauagaaaagagauuagagugacuuacaggcuguggcccagguauuccaacacuggcugucuaccaauggaaaguuuaagaaucuaguaguuguaguuguucaauccaugagcuuggcuauuucagcacauacugauguaugaagacugaacacuuggauaucuucaguauacacuggaauccagaaguaggcucuacugccagugaaggaaugaacuugccaacaagaauggggacaaacaggcaaagaacaaaagcuuucuuuucuaugaccuuuauauaggcuucuaccagaaggugugccccagauuaaaagaucuuccuaccucaaaagaucuguauuaaaggucggucuuuccacuucaaaugauuuaauuaagaaaaaucucucacaaacguacucagccacuuggguuuuacuuaauuccagauguggacaaguugacaaccaagaauagccauuacauauugggucuccuuuguuuuuucuggagucgggcuggaggugugauugauuauauugaaaaguuugacuauuacagcuucagauuccacacagcaguuguccucuguuaaacuacccuuaucacuacccuuacuugugaaaggaauuacaagcacuacucccuuuuuauagcaaauaauuacauguacuggauuuucuuauaauuuaaccaauacaaccaaccuaucauagguucaaaacuaaggcagauauagaagcuggcuuucugcugugaagccagaagcuaagagauucaugaaaauguauagcauuucuuucacaauauuuggaaacauuuauaaauguuaacuuuuuagugugugauacuauuacugcucuuacaaauauucuuuggauauuucuaguuuuacuuuugaacgugucacuaguagauaaaagcuauacauuaaaauugggauccucagggugugaagagcuuaaaaagucaaaaaacuugagaacugcugcaccagaguauuaaccaguuguaagcauuaucuuuacauuuuuugguuacauuuauuuugugugugugugugcguguguguguguguguguguguguguaugugagugugcguguguauguauauacauguaugccagugcaugaacaugcaacauggcacagguguagaggacaaaaacaacaguaucaguucuucucccguauagguccugaggauugaacuuaggucaucagaguggauagagagcaccuuugccugcugaaccauccugugggcucuauccuuugguuucuuaugguaaaugagucuaucuuuuuuuuuuuuuuuuuuccuccuugguauaguuaguguguaggugugugggggaagggccuggaaccuggggucucuuuccaacaugcuaggcaagugucacacugcuugccuaccccauucucauggcaauucuucuguuucuuuaaauagaacucagcaaaaacugauugaaugccaacuccauguucugccuaagcuuuagggugaaaaaugaguaacuuuuguaguuaauggaaaugggcuagagagagaaaauagugggugaaguuuacuuuguguuugcuuuuucagaagcagguuaaaauugugauaauuuuuuagaauuugaaguggauggugcaggucuguugauaaggaagcagcugagaagacagaggaagugagggagucagaguuccuggagaggaggagccagggugugguugaauaggcauagaggaaagugggagucuugggacugagguagcaagagccuuugauuucuuagucauauugucucucuucauuuugagaguuucuaucaguuggaugauagaauuuuuguugccauuuuucuuuuuguugugaaauuuuaaaaauuugucaauguauuaaguacugaagaauauuuaaaaugaagauauguguaucauucaccuuguuuaaacaaaaugaacguuggauaagagauuaauuuacauuacugacaugauuauuggcuuugcaaauuuuagugguaaaauaauguuuauauauguaaacaaauacccuauuuacauauuuaaagaguggauugauuuuuaugaaaccuaagcuaaauucucuuuuuuguuuguuuguuuguuuuucaagacaggguuuuucuguguaguccuggcuguccuggaacucuguagaucagggcggcuuagaacucagaaguucaccugccucugccucccgagugcugggauuaaaggugugcaccaccacugcccggcacuaaauucuugaaugcagaauaauuuuuguuuaauaaauauuuauuuauagaauaugaaacauggcuuauuuucauguauuugacauuuucuacgaaguuguauuuccuuuuaaguuguauuucuuagcagggcggugguggcgcacgccuuuaaucccagaauuugggaggcagaggcaggcggauuucugaguuugaggccagccuggucuacagagugaguuccaggauagccagggcuacauagagaaacccugucucgaaaaacaaccaaacaggggcuggugagaccgcucagcgguuaagagcacugacugcucuuuugaagguccugaguucaaaucccagcaaccacaugguggcucacaaccauccauaaugagaucugaagcugccuucuggagugucuaaagacagcuacaguguacuuacauauaauaaacaaacaaacaaacaaaucuuuaaaaaaagaaaaacaaacaagauuucuuauuuauuauuauauguguguauguaacucaugugaguguggauaugagcauaucacuguacagauguagagggaaggaggauaacuuugaggaguugagucuuccagcaugcaaucaagggcuagaacucagguuuuaccuuucagucaacacuuacccugagcugucccaccagacccagcgcaccacuucucaaagccaccagcucagcuuuuccuucaguauuggaacaaacugcauuuuuauuauaaaacaucaggugaaauaugaucccugauguaggaagagaaauggcuugaaacuuuaggcucugacagaaagaugcuuaucuccucagagacacaugagaaagaccagcuauacagcacaacugucauucuagacugagcagaauugcaaguauaaucuauguaguuaaauuacuguuuuauucagauaguuaccuuuuuccuuugugugugucugauaucgguccaguaguauccccuggagcguaaggagcaguuuuucuuccuaaauuagauacuacguucauuggggggacuggggagugguaugucuuuuaagacagggucuuacuauauagcucuagcuccccuggaacuagauagaccagacuauccuugaacugagaucuugaucuggcugccuuugucuuccaaguccugggcuuuaaggaagugcaucaccauucccugaguggauuuuacauuuuuaagaucgucaaaagugccuuguaauuaguuuucuggcuuuaauuuuuuuuuuuuuuuuccaagacaggguuucucuguauagcccuggcuguccuggagcucacuuuguagaccaggcuggccuugaacucagaaauccgccugccucugccucccgagugcugggauuaaaggcgugcaccaccacgcccggccucuggcuuuauauuuauuuauuccaauuuuguugagggagggugaguagguuaacugcucaaaguuuagggcuuuuuguuuguuuguuuguguuuuugagcaaguuucuggcuguccuucaacuugcucuguagaccaggcugcccuagaacucagagauccaccugccucuuuaccuccugagugcuaggacuaaaggcaugugaguuuuggccuuuuuuucuuuaggaaagauuugaaauuuaccacuugagugagguagacuagcuugagguaggcauaccuagagaauggaacuccugugucuucucuuaccccuuaaaaaggauaagaaaaacuggaggaaaaaagcuugcugacuuuuugcuuagaugauuucuaaaucaauuuggauuuuaacuuuaaaaauaacagcauuucaacuuucauguacauacaguauuuuaguauuuacagcagacuuuugagguaaauauuuuuguuuucauguuucauuuaaaggugcccgaagaacuuuagauagcaggugauuuagaacuugcuaagaugugccauaguggugggauugcagggcuuaagucaccaagucagaaacucacuuggagaauucauuguuuuuauauugcuuuccaaggaaucaaggcuuguuuuguauuucucuuggacaugcccuuucuccagcaagagagguggguugguggcaccuugaguaauaacugggaggagcuuacuuuuguguacuucucugagugugcuagcuuuuuuuacagugaacuuuaaaaaucagccaaacugcuacacuugaguuguuuuuuguuuggaaguucauguggugcucugucugauguucguucaucacauauuuuccuucugauauuuuauuaacaauuguaaaugcuauagaaaaugaguggguuguguagugaacacccauagucugucauuuauuuggugcuuuuuucuucagauuucuagucaucuauuuuagguguucucuaaccaacagucacgccaauaacuuuuuuuuuaaauuagauuuauucauuuuauguguucucucucucuguaugauguauguaugcauguauguauguauguauguauguauagaacuggaauaguuaggagcagccagugugggugcugggaguugagcccagauccugugcaaaagcaacaaaugcucauagccucugagccagcucuccagccccuuuuguaacuucuuguuuauuuguguagggacaugaucuuucuguguaguccuugaagcuuggaauccuucuucuuccaccucuuuugaguauugggaauuacaggcauguaucaucauguccugcuaacauuuauuuuaaguuggcagaguuugggcuuuagcucaauuuagaacucaaauguaccagaccuugaguuuaauccccagcacuacagugaacagaauggaaacaaauugcagguacacauuuuuagccuccauucuauaguuucuagcugggggugguaugcaugccuguaauaccagcacuggaaaacaagccugagaagugcaaguuuguggcuagccuggacugcagagcagaacuuuggaaaaaacaacaacaacaacaaaaacaacccuccaaacaaaaagaacgcaagucauuuuauaaccacaguuguauauuuauuuacauuuacuugucucuaaauuuuacuuggagugaaaugaaucuuuuuuuaaagguuugucucuuuuacuucacuacacugagcaguaagugauagaagaucagagugccuguuaugccaaaaaaggaaacaaaggaguguuucuuugaaaaucuugguauuuagcucagucugccuggaauaugcaguuugaauaaaggagaaauaucacaggagauuugcccuaaguaaggccccaaccacaaguggccagaacugccauuucaagugcuuaucuauuccagaggcuccuuuacuuuggauccaguaauacagauacugugugucuucuuugcuccccucaguggagguccugagguucuccuguguugccguugauuggcauccccuuauaucuaugcucugucuaaaauuaaccaucaauaaagcugugagcaucuauauacaaaccuguuuguacguguuuucagagcuuaguguagaguuaguggaugguagguuagaugucuauauaacugucaggagcgucaguguguagcauuugguuaugacgcuuccugggacguggcucuuuuuacuucuuagccuuuuuuuuuuuuuuuuuuugguuuuuagagacaggguuucucuguauagcccuggcuguccuagagcucacucuguagaccaggcuggccucgaacucagaaaaccgccugccucugccucccgagugcugggauuaaaggcgugcgccaccaugcccggcaucuuagccuuuuuuugaguguguaaugggaacuuacuguaguuuuaauuuauguuuuucugaugauuuuugagauagcauuuuuuagguauuuacuggcuauuuguguuuguuugauuguuuguaguuuuagacacaucucuucaaugacuuuugcucguuucauagaaagcaugaguguuuaucaugaguuuauccaugcauucucugugugugugugugugugugcagauuaaaauugcauauacauuuuuaaugcucucuauucuuucucaguuuuccacugguaucucugaagagaaaaagguuuugauuuuaguaaugucuaguccaucaguucaaaaagaaaccaugccauuuuuacccuuucuugucugccuguuuucuuucagaaauuuuaugaugcagcucuuagguuuaauuuuguauuuggugggaugcagauacugaggcucauuuuuucuucuagugcucuuugguugacuacuguuguuggaaagauuaucuugucacucuuguugggaaucauaugaugguauuuauaaguauuucuggguucucugcuguuucuuuuuguugguagugcuggggguggaaccagggcuuuggacaugcuaggcaaccacugaaccacagaacaaguuauccauccuagugucucugucagcugcuugcuuucuuuguuuccauuguuugaaacaaaccugcauuauuuuuaguuuuuauuuuauuuucuacugacccugucuggucucauagaagauaacugugugcuccaacuuccuuuaauuugugauccugcugccuuuggaaagugaugaaggugaaggcugggagcuuagugcugacaucagaaaugacaggagaacagagcuucccgaaauacccucuccagcuaagcugcugugaagucuuaggucuuguagauucuggaagccuuuaucuagucuuucagauguugaaaagcaccuaugagucuagagagaugacucaagcuggucuucuagaggcuuggguucaguucccacauaugagcucucaacuguaacuccaguuccagggggaucugacacuuuuacacagacauuucauacaggcaaaacaccagugacaugaaauaaguuaccuuauaaauaaguauaccuuauaaauaaguaccuuauaaagucaucucaauuuuccuuucuuaaaaguaauuauuguagauaauuagcugcuugaaguugaauuauaccuuugaagaauauaaauuguuuauuaaguaauguuuccuuuuucauuuuuuucagguaacuucuuccugguacacuucccuuacucuuucuuuucuuuucuugucaugccccacccccaccccaaggucaggcauuuuagaaaaaggugguguccucuuugacaauaguuacuacuuguuaaaaggaaccauccccuuuuccucuguucaaagaaacuuguggcuccccguuaacauauaacuguggugccuauuaucuagucucuaaacuuccucagucccugcucacaaacccugguccuagcuccuaagaucccuuccuccagggugccuuggcaguuugggauaaacuuuccucccuuuuacccagaguggcuauuuuugguuucucuacuguacccauuuuauucauuuuagagacauuaucuugcuaccucaagguagccugggcugaccuugaauugugccuguagccucucaguugcugggauuacaagcaugugccaccauaacugacuuucuuuuucuucauggaaaguuuuuccugguauuguuccucuuaaggauuagaccagauucuggggcuguuuguuucaaagugugugucugacaaaguaccuucauauggcauuugaauuacagugacacaccuaucugacaggcuagaacauaguaaggucgauucugucuuguuuuuguauuuauuuauuuuuuauuuucguuuuuaaaaagauuuauuuauuauauguauuuauuuauuauauguauaguugucuucagacaccuuagaagaggacaucagauccuauuacagaugguugugagccaccaugugguugcugggauuugaacacaggaccuccagaagaguacucagugcucuuaaccacugagccaucucuccugcucaucuuuguauuuauaauaaauacauagagcauugaagcacauuuuagguauauuuagacaguguuuuauuacaguaaccuaaacaacaaaacuguaugucuucgaguucuagaguucaagaucaagcaguuggccauuucuacugagauuucccuuuggcuuccaauuagccaccuugcuguaucuuuuuuuuuuuuuuuuuuuaaauuagguauuuucuucauuuacauuucuuuuuacauuuacauuucaaaugcuauccugaaaguccccuauacccccugcccacuguaucuuuauaucgucuuuuauuuguguauuuguagccaucccccauuuuucugaauuuauuuauuuauuauauguagguacacuguagcuguuuucagacacaccagaagagggcaucagaucucauuacagaugguugugagccaccaugugguugcugggauuugaacucagaaccuucagaagaacagucagugcuccuaacugcugagccaucucuccagcccccauuuacauuucaaaugcuauccugaaaguccccuauacccucccccugcccacuguaucuuuauauagucuuguguauuuguagccaucccccauuuuucugaauuuccucuuaaaaggacauuaguuagauuauacuaggagccauccauaugaugcugaaauuuuuuaugacugugagucaggugaaauggcccaagccuaugauccaaaaugaggaugcugaggcagaggcaggaggauugcaaggucaaggcuggccugggcuacauaguuccagaccaucuuuuuuuuguuuuguuuuguuuuguuuuuguuguuuuguuuuuuugagacaggguuucucuguauagcccuggcuguccuggaacucacuuuguagaccaggcuggccucaaauucagaaauccgccugccucugccucccaagugcugggauuaaaggcaugcgccaccaccgcccggcaguuccagaccaucuuuaccuacgaaagauguuucaaaauuucaaaaacaacaaucaauuucuuucucucucucucucucucucucucucucucucucucucucucuccacacacacauaagaaccagugacuuaauuuucauauuuuacccucuuggugacuuaccuagguuaacuacugucuuacaaauaauguuuauaucuucauaucacaaaaacuagauagaacauacauaaacacacuuaagcaugugugugucccugcauaguacauuuuuaauguauuauugcaaauuguuagcaagaaggugugcuuauuugcaaauuuuccaguaguaguaauauaaggugacauaggacauuuuccuacacuguauucaguggauuuugcagaauuugucaguggaaucccaauggaaugagaagcuauuggcaagaggaucucugucucuaaauuaucuccuaccuuuucuacagccuagggaagcuuuguaaacaauaccucuaugcaugcaugcaugcuugcuugcuuucuuucuuucuuucuuucuuucuuucuuucuuucuuucuuucuuucuuuuuuucuaaacuauuuucauacuuaaaaggcaaagacaguaaguauaguguucccuuauaucccucacccaguuccaauuccuuguuauccuuccaccgacugcaugucuguaucuacaaagagaugacauugaugcaucucuauuagcuacaguccagguaucuaaaugcagucucugguuucacaguuucucuagguauuuucuugcagauuauggcaauauuacacaccugucauguguuuguuuugugggauauuuuuauuaugauuauggguuagggggaagaaugccucagcugugaaguucccuuaucacuuaauuaccaguguuccauaguagccucaggaccauuagugauguuggcugugaacagagcuagcauuugccuaguuuuuccucacaguuucccucuuguccacuugaggguagugguuuuggggcuguugucuaacuucugugagagguuagaaaaguugacuuucuucuggaaggaagguuuugcuuauaucaauauggacucgugaaugucuguuuuuuuuuuuuuugguuuuugguuuuucgagacaggguuucucuguguagcccuggcuguccuagaacucacucuguagaccaggcuggccucgaacucagaaaucugccugccucuaccucccgagugcugggauuaaaggcguucgccaccacgcccggcugaaugucuguucuuaauggaaguuagaaacuaacuuacuuaauugcuaaauuguuucagcauuguccuggagaauucuuuuacauggguuaaaaauauuauuauucuuuaagguagagucucauguaucucaugcuagcuuugaacuuaguaguuaggcaaagaugacuuugaacuuuugauccuccuaccucccccaagaacaagaacuaaaggauucugucaccaugcccaguuuauguaaaacugaauaaugagccuggggcuucaugcauuuuagguaagcaugcuacaacuaauuagauccuagccacaaggauuaguccuuuuguuuuuguuuguuuauuuuuuuuguuuuuuguuuuguuuuuuuuuuugguuuucuuuugagacaggguuucucuguauagugcuggcuguccuggaacucacucuguagaccaggcuguccucgaacuuagaaaucugccugccucugccuccccacugcccggccuuuucuuauuuuauuuaaauguacacacacacacacacacacacacacacacacacauauucgugcaaugccaauugugugcauguauaccugaagaggccagaagaggguauccaauucucugguugugagcuaucuaacauaggugcuaggaaccaaacuugaguccucuagaagcucuagaagagcaucaaguauucuuuguuugguuuugguugaggaacuaaggugcauauucuacauaucaaagaaaauuugaccuucugguucuuccaguauuccucucuaaccuggcauacccuacccuuaguccugaacauuccaguuuagggguugggcuugccccccccccccuuuccccauaaugacuuugccucuguccuuggagccuccgaacgugcccaggaacagcuucccauaaaauuuacauuuaaucuaaucuaaucugguuugaauuggcucuuuucacugguagagaaguaauuuaucacuccuaaccuccgagcaucgcucuagccccuacucagucauguccuaaggcaucuuugcccauuuuauuggaucuacaaaugaguguguauauuggguucugcagcuagcucuuuuuacuugacuucucaguucugagucuaggaaauuugaaucuggauauuuguaugagcaguggagggauuaguguuauuucacuauaaaugauguuagugcaggcuuuauucaacuucauuuuucuuuuuaaauaauggaagcucccccuguucuuccucucuuguccucucuucaccucucagguucuagaaagccuuuuuguuccuuuuaauuauaacgagaaugaugaugaugauguguguguucaugugugcuuguguaugauuugcauguguaggguauaugcaccauggucuauauguaaaggugagagggcaucuuuggagucaaguuucugagcaucaagcaugaagccagaguugaagcaagugcccuuacaucugaaucaucuuaccaccccuuuccuuuuuaucauggaaguucuuuagacgugacuuagggcuuagggcaggugaagagucauggagccucuuucauugcucuaguucaauuaauaggaaucagaacauuugccugcuuccucuuagacacucagaaauccagaaaguccauggacugguuuuagaagagcucaugguugcuuuugcucacuuuuucauguguguauaaccugaugugaaauagcagcugcaguuuuaagaaagguuuuggucagagcaacaguuuuuucuuauaacaguuuaaggaagagucagugaauuuuagaaaagauuuagcuuuuuauuuuuuaaaguuuucuuauuucuugccauuuuaauugguaguuuaccuuagauuguaggauuuguacccacuuagggaccaaacaggaaaccuuuuaauuugcuaauuaagauuuucucaaaauaagagguaaagacuaaaaaugaacaaucuguuaugacaguauagaagccaccauuuucuuuauugcucuggcaccaggaaguggguggaaagauuauuagucacuugugcuaacccagugaaauggcuaaaacuguucuuugucuguucauggagaacuuccuugggugucuugacucuuucuagcuuaguccuuuuauucccuaguuuuugcauuucccuaaaugaugcuaggcagugugaucccucauucuuugauaauuugaccccaguugguuucucccuacugaagacauaaaaccagaaaagcugcuaagcaguugagaguucuacaucuuaggacacaauucaguuguuagacacaucugcucuuucacccuuccuucacugugucacguggguaucuuaucugcaugaagcugguaccagaauuccuauuugcuguauccucuguguucccccauaguguguugugcauuuugacucauuaaagucuguaaauauaauuggccugcauuaauaauuguccuccuaggcuugcugccucagucuguuaaccuaggccuaauccuggaagcuucuagucucugugcaaucuaauguaggccuagaacgucagccucugagacuuacugcugaucacccuuccuaguucuucccgaguucugcuuggcugguucagcuuagguguucuggcucaucauauucuucuucaggcugacugaaucugacuucucucucagcuucuucugaaucacucugcuuugcuugaaacuaacucuagcaaucuguucuaaucuccucauuuucuggcucauucugucuuuaccugugucuagcuuguucucucucuucaaccugucucuguaaaacacuacugguaaaacuaccccccaccccuguucucuuaaguaucuucccuuuccuccucucucuucugauaguugggcauauccuauucugucaaaucuuugucugccacuuaaacacaacgucaacuucuaacuaggugcuuucuucuacaaacuaacuuuaucuucuuaguuugggauuaaaaggaguguucuaagggugugucuguaguccagccagaaggauuuaaggugugugcuagggaggcugagccacaacacagcuagaaacaaguuuuucaguaaaugacacaaucauaguguggucaaauguccugccacaaaagucagauucuguuugauaguaaauugugagcuucuuagaguacaggaucuugauuuuuuuuuuuaaagaguauuuucuuuuuuguauuacccacuguuauccacaggucuagcacaugacugcuuuauaauuaucugaauaacugagcacagaaacauuuucauuuuuacuguggcuuucuuuaauuuugcuucacacugccuauuucaaacaguaguuuucauuucucacagagauacucacugcuucagugggcguguucucuuugaagaguucugaguaagcagaucagguggcacauaccugucaucugagguaggauuggaaguuuaagcuacauacuaagacccugucuaaagcaaaggacuguguguguaaaccacaguaaacguagugcuucuauuuaaaauagagcacccucagcuugcugccucccagucaccaaagaaaccaggaggcagcuugaacuucaguuuuaggagcugaaagguaaaauaagaaaucucugguuuguaaguuuaaagcuuugaccauuagcagauaguuacuuggggaguauggagacuguuuucuuuacauguuguuuucuuucccugacucaguguuacugaagccaggguuuugagcuggguaagcucucaaacacugagcuaaaucccuuaauuuucaauuuuuuuuuuuuguuuauuuggguuuuuuguuguuguuugauuuguuuuuauuauugauuucuugagacaauguagaccuaacuguccugaaauuaauucuguaaaucaggcuggccuugaguucagagauccugucucugccuccugagugcuaggauuaaaaguguaaaauaucacccugacuuauuuuucaauuuuuuuuauugauccuuuuccccccccagcuaacacagagauaauuauuguacuuuuaauaccaguuuuuuaaaaaaagauuuauuuauuuauuuauuuuauauaucugaguacaccauuguucccuucagacacucuagaagaggacaucagaucccuuuauagauggaugugagccaccauguaggugcugggaauugaacucaggaccucuggaagagcagucggugcucuuaacagcugagucaucucuucagcccaauaccagguuuugugaaauggauuuuaaugauuguucucuaauaguuaacaugucuauaaacuuagacacuggacuaguguuaauaaugagauuacagcauauguguuguacagcaauuuccucuaggauuaaaacauucucucuugcagggaagcuccuuaugcaggaaaguaaacaacucaauauauauucagguagucccugaaucuguccagauugacuaggccccucccugucagcugaguaacaaagaaaacuuucaaaggagaaaagcuucaaagaagacucugagaucagaccaggugccugcaagagguuuagacuagaguccaacuuggaaaggacacucagccuguugagcuguaugcagguugugccaugugcucuggguuuccgagcuuuggugagcugucagucaugcugggugggucugggccaugcagcugucuuugagucauucugcuccuguaagcaaccucucucauauuccuuuaagaaacgccaauaacauucguggguucaccaaguuggacuuuggugguauccaaacuuuggucuuuugugggaucccuaucuagcgugaguagauauccguguugucucuccagaacaaauuuugucacacaacaguuguguacucugguaucacauugaauuucccuuuagguauaauuacaugguuugcauaguugacauagaucguauaggcucugugucucuuauuaauuuugauacuuugguaguagguauuuuacuugugaguaguuuguuauuauguauuuucugacuaagcuguuuguauaaaggacagucagugguuggguuuuacacacaaaggccuaccuuguuuccaugugguuuuaucugucaguuuccugaaaauaaaagaaaguuacgugaguuuucauuuucucuuccuucucaauugaaggaugucuuaggguuuuacugcugugaacagaaacuaugaccaaggcaacucuuaugagaaugacauuugauuggugcuggcuuacaguccauuuucaucaaggcaggagcauggcagcguccaagcagacguggggcuggagaagcugauaguuccucccgccucuuguucugaaggcaguuagcagaagacuggcuuccugguagcuaggacaggggucuuaaagccuaugcccacagugacacaccuacucuaacaaggcuauaccuccuaaauagugccacucccugggccaagcuuauacaauccaucacaaaggauaugacugauauuuccagaacaguguuguauaucaguaagaagucuuucuuuuccugguuagguauuucaccauuaaccauguucccaccuucauuccuuccaucaguuuguuucucccccacccccugccaccccccuuccccccagucucucugucucugucucuuauuacaaaggacauacagaauggaauugugagcaggaucuagccaauccucucagauccucagcuguagaagcuugagauuuuuacagauuacauuuguuuuuugacaauuucaugcaggaauuauaaugcauuuugaucacucugacuuuccacccuuucuuaccuuguucucacccuaucaaccucuucucccuggcccuuuuccagauucauguuuuguuuccuuguuuugugacccauugaauuuaacuagggccaucuguagauuuggagcuauccauuggagcugggugggcucaucauuggacacacagauaaagacaaugccugcccuuuccccagaauucaucaguagauaguauuuagcagggagagaguaucaugagcccuucuuuaaucuuauuaucuauugagagguccagucuuaugccuggcucuaugcaagccaguaguaguuguaagaugaauaguacaguguuuguggcuugcccugcagauacuaucucauagcucuucuucauguuuucuggcucuuacauuuuuuuuucucuccccuuuuuacaauguucucuaaacuuuagagggggugguacauauuugggacuugaacacacaugcaacuaacugucacuuaaacuggauaccuugaaaagccaugauucuaugcauucucuuuuguuuacugcaaagagaagcuucugugauuaagacugaaaguagcauucaucugugguauagacauaaguauuuagaaggaaguaugguaucaugucaguuuagcuaaacuauuuuuuaaauuauuuuauauaugagugaguacaguguagcuguccucagacacaccagaagagggcaucggaucccauugcagaugguugugagccaccauguaguagcugggacuugaacucaggaccucuggaagagcagucaaugcucuuaaccacugagucaucucuccagcccccuaacuauuaauuaguuuaauuccugauuagggccuaggacuuccucagagccauggguuucugacuggguuuguagugucaggccugugggauugcccucacauacaucauugagugguugauuauccccguaagaguacaccgccaugcuacuccuacagcagucaacacauuuuggcuggcagguugggcguauaguuuguaggguucacagcuggguagacagugaugccuuuucucucuccacaauguacauugcaccuucugauaccauuaaagcaagugagcagggaggaaacuuagagcucaguuccagcuugauuguuuguuuugcagcaaagauaugugguguuuucagcaguaaaucuuaaauacacauauaucauguuguauuggugggcaguuggaaacuugaaaucuuaaagaaaauaaaaauggucuuuuugcagacuuucuaaagauauggcuauuuuucuuacaauauuugcuuuuaauuacaaaguagcauauggcugagugugguggcauauacuguuuaauucgagggcucaggaggcaaaggcaagcugaucucaaggccagacuagucuauauagaaagucccaggagagccagggcuauauagaaacaccgugucucaagaaacagcaguguguggauuggcuuaauacuuccagagagggcaauguuacugucaguuuuuuuguuuguguguuuuuuuuuuuaaaugcucaccuuuucuguuuugugguaucauagacaccgacaauaagauaaauaucuuccauagaucugagucccaagacugaauauggcacagugguaaauauagugguaagaagucaugggcaguguugccuaauuuuguuaauaaggcuauugucucauccuggccacacugcugcugccuuugcaguuugcaucaccauguuauuaguuacucagaucagaaacucaauuauuacuuuuauuccauugcuuuucucauuaauguaaaaagucaucgagaguaccuacuauguguaaucaacuuuuucucuuuuaauuuuuuuuucuuuuuaaauuauuuauuuuauguauaugagaacacguuacuaucugcagacauaccagaagaggacauugaaucccauuacagaugguuuugagcuaccaugugguuacugggacuugaacucaggaccucaggaagagcaaucagcgcucuuaacugcugagccauuuuuccagcccucuuuuaauuuuucugucuuugcuucuuuccaaguaaguuuauugaguauauugcaagaggcugcuagcugugcgguagcaaaaguauugccuacaauuaaauuuuuuuaaccuuuuauuuuucuuuauauauaugaguauuuuccugguaugcauaucugugcaccagaugugugcagugccuucagaggccagaagaggauuuucagcuguccugagacuggaccuagaguuuauagcugccauguaaauacuaggaauuguacuagaaccucugcaagagcagccaguagcugagcgggagcaucuaucuguuuuguuuuguuuuguuuuugagacaaaguaucaccuuguagcccagucuagucuaaauuuguaaucucccugucugcuuccugagugcuagaauuaaguuugugccaccaaguuugugccaccauaccuaguuuagcuuguuuuguuugcccuauguuuccuucaaaaucuuaucugacaaaaacugauaucaggacgcaaaagaacuagaaaacagcaaaaugugcuuauaaaauggacaauggacuugacaucucuuugaagacauacaacagccaguaaguaaaggaggguaugcucaauggcguugcacagggaaggccuuuaggauagcaauucccaaaauccagaguaacaaaugcuggcaagaauguggagaaaauagaacauuuguucucugcagguuagauuauaaaauggcagcuguggaaaauguaugguguuuccucaaguaucaacaaucuagcaauuuuaauucugguagaaauagccggagugucuaccagaugaccagauauauaacaugucacacacaauggaagagcagugagccucaauagggaaaucaugauauaugcuacaauauggaugaacuguaaagacccagugcuagguuaaaugagcacaacacacaaggauaaacaagugcuuccauuuacaggaaggacucugaccaguuaaauucacacagagaaaggagaaugauagugugacaggaagggaagaauugaguuucagaugaaaaagaugaaaaauuuccugagagagaaaauggcuguacaaccaugcagauguauuuauuuauuuaaauuuauuuauuuauuguauguaaguacauuguagcagucuucagacaucccagaagaggauaucagaucucauuacaaaugguuguuagccaccaugugguugcugggauuugaacucaugacuuuuggaagagcagucuguguucuuaaccacugagcaaucucuccagccccucagauguuuauugcccaauuuuauacuagggugguuaagacgaaccacuuaaacuggugagguugaggcaggaggacugauucagggguagccugggcagcauaguuagacauccaucuuuuuuguagccuuggcugucuuggaacucuaucugcagaccaggcuagccuugaaaucagagaccugccuccuucugccuccugagugcugggauuaaagaugugcaccaucacugucugucuagaauuacagcugauuuccuugguugggagcauauacuucuugcugccauagaacacucagaaaaaaaucuccaaagauagaaaagucuuuggggaaagcauuguaggcauagagagccaaauagcaaauucaagaaagaaagaaggacaguuugguugagauggugacugagaggggaacuaguaggagcuggggauggaauaugaguucacaaagggucagaagagucgcuuaagaguuuagauuuuauuuuggaacauuuagaaacaacugaaagguuuccagugagagaaugaaaugugaucugauuuguauucuuuuaagaaugaaaugagaagaguucauucaaguguauagaaagggacuguuagaaacagaaaauaggccucuguggcaggacuccucagcuaggaugacagaaggcgcuacaugucuaaagcucagcagaacuguggugauucuggauuugguuuuugguucauuucuuuuucauauuuugguuuuucgagaugauugcauucuggcuguucuggaacucacguuguagacuaagcuggcuuugaauuuacagauccaccugccucugcuucaaguucugggauuauaggcguaugccacccagauugggccuggcuuuucugauuauucuauuucagugucuagugccucuuuguuguagaaguaguuauuauucugucgcuaguuugggcucuuuuuaaaaaagauuuauuuauuauuuauuuuauauguaaguacucuguagcugucuucagacacaccaggagacggugucagaugucauuaaggaugguuguaagccaccaugugguugcugggauuugaacucaggaccuucggaagagcagucagugcucuuaaccacugaaccaucucuccagccccuaguuuggguucuuuugaucccuuuuucauauauagugcuacuauagccauugaaaauguaacuguaaauugcagaucuuaaagaggugggcauuggugguauaccccuucaaucccaggacucgggaggcagaacaggcagauauguuugaguuugaggacagccuggucuacagaacaagcacuaggacacucagggucacacagagagacccagacuugaaaaggcaaaagaaagguagaaaggaaaaguaaaaagauuuucuccugucaccuaucuccauuuacccucuuacucaucauuaaagugauagacucuuucuguaagccuuaccauuucccaucucugcucuggauuacauucuuuuaauucuuuuuuuucucucuuuuuuaaggauuuauuuuauguauaugaguacacuguagcugucuuuagcgacaccagaagagggcauccgaucccauuacagauaguugucagccaccaugugguuucugggaacucaggaccccuggaagaacagucagugcucuuaaccacugagcuaucucuucagcccaugguuuacauucuuugaauaucaucuccuuugucuucugaccugccuuugucucuacuccauuuguuaauuccuugucauuauuguguaccuuuguggauuuuggcucuuggaaugugggcaugcuaauuauugugccuuccgaccuucaaccccaccuccuucaccagacuacuauuuucuagaauucuuuucuagaauuguugauuucaacaagugcaguguuuguguuauaaaauuuuaucaggguuuuguuuuguuuuuaugcuucucuauuugauucuguacuaugaaaacaacaaucuagugccuagagagauggcuuagugguaaagaguacuuguugcucuugcaaaggacaaagguucaguucccagcacccauaugguggcucacaaucaucugguaugacuucaguagucugguuuccuuugacuguauguacccagaggugggacugguggggcagauggcagucuugagaucuaauucucuucucuaguuuaaugaaggaagcuuuaaaggaaguguuugauuuugaccaaauaugcuauauugugaaaguuagcaggaauacugcaaggcucauuugguuauuagaaguugucaagacuuguguacuaguuagcugugucugugagaguggauagaagcagagauacuagaagaguugugagacagucaaguggcuaacucugcuuagucacacuauguccucgaguggaagaauggaugcuuuauggaugcuacagacucuagauggcugugcagcacagauguaccuaguucuuuaaaugccugccuuguuucuccuaggccuucccugaaguuucccaugucucaauggacuccugaauuuaacgagcucuacacccuaaaaguggcuaugaagagugggacuccugaugcgcccacuacacaggagagucugaaggcgguccuucugcacccacagccccuaggggccaccaagagcuucccugcagaaguggagaugauuaauagcaaaguggggaaugaauucucucaucugugugaugauucucaaaaacaagagaaggacaugacuggcaaccagcaagaacaagaaaaaagugguguugugagaaaaaagcgcaaaagccagcaggcuggccccucauaugugcagaacugugucaaagaaaaucaggaaauccuagggcgcagacaacagcuagagacaccgagugaugaggauaaugacucuuccuuaagugagugucugucuucucccucaucuagucuccauuuugggggcucugauacagugacuucagaugaggauaaagaagucucggugagacauacccagccuguucugagugcuaaaaguagaagucacagugcaaggucucacaaguggccucgaacugaggcagauccugugccaaguuuguuaaugaaaagaccuuguuuucauggcagugcacuaaggagagucacaugcagaaagaggcuggugaagagcagcuccucgcagaggacacagaagcagaaggagaggaugcuagugcagaggaagaagcgggaggcgcuagcucagaggaaguaugcucuucucuccagcuccaguagcuccagugagaaugaccucagcagcgauuccucguccagcuccuccaccgauggagaagaggaccugugugcaucugccagugagaaccccagcaaccccgcugcucccucaggugagaaggcuggagugcagucgcacagugaaacugugcucacacccaguucucaagccaaguucucuuagcuuuuauucuuuuugugaagcucuuagcauuuuuaauuagugaaaacauuaacugcaaaccuugauuaaauccaacucauaagacauuuagacauaaggcaccaagaacaaugucuggaccaugcaggagggacaaaacacacuucucuauguacaauggcccaauauuaucccauguguauaacugcuaugacagacuagaacagcaaauuaaugggaaacucuuagcuuuuauucuuaaaaguauaaucagcugugucaaacugacucugccuccagauacugaaagaauuucuagugauaaaaauuaagucagaauugauuuuuguauguguguguaaauuggucuuguaaguaacuguuauaacuaaauuacaauaaugaacaauaaugauggugacaauuacgaaaaugaugauugaugaugaugauuaugagauaaaaucucacuaugcagcccuggcuguccuggaccuuacuauguagaccaggcuggccuugaacuaagagagccauuugcuucuaccuccagaguaugccacagugucugggacauaacuagauuaacuuuuuuuuuuuugguuuuucgagacaggguuucucuguguagcccuggcugaccuggagcucacucuguagaccaggcuggccucgaacucagaaaucccccugccucugccucccgagugcugggauuaaaggcguccgccaccacacccagcuuagauuaacuuuuuuuuuuuuuagauuuauuuauugauuauauguaaguacacuguagcugucuucagacacuccagaagagggcgucagaucuuguuacagaugguugagaugguugugagccaccauguggaugcugggauuugaacuccggaccuuuggaagaacaaucgggugcucuuacccacugagccaucucaccaucccuuagauuaacuuuuaaaugacuuuuggccaauuuuuuucguuuaguacucuuuuacuuuagugguuauuuuuacagauaacucuauaauuuuccccauguuuaauccuauuaagaacauuuauaaucuuaguaaagucuccuuaaucuuuucuuuuacuguugucuuguucacuuuuuuuuuuccuuguuguggcugcccuugaauucuugaucuuuauguuuagcuucuuagugcugggauuacaaucguguaaugugucaccacaauauauuuaucauccuuuuuauugcuaaaaaauuuaguucaagucaauaaaugagugugucuuuggaaugcacaccuguaaucccagugcuugggaggcugagguagugagagggcucacuuaaaucccagugcauggucauuucucccuguguugcggguuuucuuacacagcuuuaccuccuuucaaagaaacacaaauagaaaacguacauuaaguagauaauuuauguacauaccacccuggaguauaagccugugcgugugguauauguucaugugucugucuccugucacugggauuuauuuauuuauuuuaaauauuuauuuauguguaugagcacacuguagcugucuucagacaccccagaagagggcauuggaucccauuacagaugguugugagccaccaugugguugcuaggaauugaacucaggaccuuuggaagagcagacagugcucuugcugagccaucucuccagccccaggauuuauuuuuugaagacuguuucucuuuccuguucuccuucaacucauggccucuucuuuuuuuuuuuuuuuuuuuaauaauuguuaucacauaccuauauguauauacauagauauuccuaaauauagccuauuuagucuguauaauauguuacuuguauguauauuuucagggcuggccauuuggcacuugacaaccaauugguaugcucuuccccuuuccuucucccagcuuuguucaguugccuguaggcaguucaguucuuuguguaugguuggcacccuauaggcuauuccccuuccaguuuuacagggugugugggcucuagcuugcuucugcuuauauagcacuuuagucccugagcugugucuccuagcccuaggagagcuuugcagaggucuagggagggguuucaagugcuguaacaggacuuugccuuaccuuugugucugauaccagccuaccaagguucaagcuucuaguccacuguugagaccugcugucuccucucugucuucucccuucuuccuguuacucuuuucucagcaacuucuuacucagucagguuucauuuuuucagucuucuugaauguuguuuugagaagcgugcacugagcucauauaguacuggagaguuuaauggugguucuuccuucaugucucagaaaagagggaggcacucaggguuguuuuauguaauuguuuacauuuuccucaaaugguccaaauauaaagacugauguugggagaaggaguagcagagccuaaugucuguuuaaaaucucgaggugguauuuuggugugacauuuggcugaggagcuuguuuuagggaaugaaggugagugcuacuguaucucugaggaggauguaagugagcuuaccuguucauucuaguuaauaauacuugcagcgaguaacauugcacuuauuuauguacugucugucuuggcaggguuaaguuaccucaacuacauuacuuuuagaaauuaacaucagggcugaaagauagggcucaaugguuaagagcacuagcugcccuuuugaggaccugguuucaauucccagcacccacauagaggcucacaaccauaugugauucuaguuccacaggcccuuuuccuuaugcauuagucacauccuuauauacauuauauacaugcaaaagagcacuugcacacauaaaaaaagaaaggcaagaaagcaagcauacagagcagcaaacauuuaucuggggaagcauacaucaaaaugaaccuaacauauaacagucuaauguccacaugauacagaauaauaaaagcucuacaaaagcauaaauaaauuucuucuucagagagucuuuuuuuuguugucguugaaacaagguuuuucucuggguagcccuggcuguccugaaacucacucuguagaucaggcuggccucaaccuccaaccucagagauccaccugccucccgagagcugggauuaaagguguauaccaucacugccuggccagaguuuccauucuuauugcccagaaacaauaaucauuaauuauuacuuguuaguuguuaggaaacccuccaacagaaaauaugaaagcauaugcagagguaaauaauacaggucuuuauaucagcaugcacagucaugcaggucuguguuugagcguucccuauuuguucagcuagcucuuucugaauuuuucuguacagacuuguacaccuauguaagcauaucugaaagugucguagcguauagacaguaaaauguuaacaacugcugugccagaauacccaaggaguugccagauccucugcuuucaagaggggauggugcugugaaggugccucagugcaguucugagaguuugguguuucucauuuaauccucuccauguuuuucuaauuauagaauuuaaagaaucauuuuaaaauaacuuauaauuuauaagaacugaaagauugguggggauuaguuuuuuguuuuuguuuuuguuuuuuuuaaucucaacucuuucaaagaauuuuguccuugcauucuuuggaaguaguuuuauuucucccuagaccuauaugaacacugacauuaaaagcaucauaugcccagugacugacaaaaaccucauugguaaaaaccugacuuugagucuaggucugaugacuaagucaaacaugcuuuagucugaauagcauuggggucagcuaaacuaccaguuuuauuccuggguauaacaguguguguuagcauuguaggcuagugacugauagaaaucugagccuuuuuaaugcuuuuaagugcuacaauacagcaauuuuacuuuaucuacuguuuuugccaauacaccuaaaauaaacuuaguauuggauauugcuuuacaagcauugguucauguaucaggcucaccagaauucugagaaauaguucucuccuaaugcgucuuuauuauuuggcuucuaaauuauuaggaauuucuguucauaaauagaaaaaaaauuaaguuucaguuggauuaguagcacucuuguuggacauuguguuacccuaacuuuaaaaaaacaaauacaacauacacaugcauacauauauauauauauauauauauauguauauguguauauauauauguguguguguguguguguguauauauauauauauauauauauauauauauauauauauuauauauauaauuuuauuuuuguuuauuuuuugagacagaaucuuuuuguguaucccugguuguuaugaaacucacuauguagaccaagcuuuucucaaacucacagagauccuccugaaugcuggaauuaaaggcagguaccaccauguccaacagaauucaauuauuuuaagauaaucuaauaaauuuagguucaagaguagaugcuuauuuuaguguuugauuucugugauuguucagugaccccuacuugacccacccacugauuuacuuauuuuuguucauuuuaauuuuuuuugguaauuauuccacuucauuuauuuuauuauuuuauuguauauuuugcuuagauacauguugugcacuguguauauguagugucaccagagaaggggauuagauuucccuagaacuagaguuacagauuugugagccaucauguguguccugaaauuuaauuugaauacagguucucuuuccuuuuuuuuuuuuuuuuuuaaagaauaaaaauuuggggguuaccauuuauuuguaugauuuuuaccugcauguauguaugcauguauaucauguaugugcugugccauuggaggucagaagaggucaucagguccccuggaaccaggguuagagagagauuccaugugcgugcuaggaugacacagauccucuguaagagcagucagucuuaacuguugacccaucucucuaaccccucauuaauuuaguuuuuaaacuuccuguuuuauaccacuaaaaccuuggaguuuucaguuagacaugcauauaagacuuccccacccucccucccucccucccucccucccucccucccucccuccuucccucccucccuucuucuucuucuuccucuuccuccuccuccuuccccccuucucucucucucuguuagaucuacuugguauggugcacauuugugugcaggugugcaugcaguugggugucccauuauauuuuuaaccuguuuauuuuauuugaaaagaguuggucucuuacugacccuucagcucauuauuuggcuaggcaggcuggccauugagcaccaaguaucuaccuguuuccacauuuuacagguucaggggaucugaauucauguaacuaucuggcuauucucaaauuaaccauuaacauuuucccccuauggguuugagaugacaucuuguuauauguugaauuuuguuuuuguuuggauuuacuauuggaauuuuuuuuaauuuauaaauuuauuuacuauuuguaggugggugguugggugugcgugugaaggucaaaggauaauuucugggaguuggcucucuccuuccacuguucagcucccagggguagaacucagaacaguacucuugguaacagagugcuuuuaccugaugagccaucucuccaacuucucugaagggaguuuuagugucuuguguacagaagaacacacguugauuauagaaucuuuaucauuuucuuaauauuuuugcuuauacuuucaaauaugcuuuauucucaauuugcuuaucuauagaagauccagugaaaguuguugggaugugguuccaguuccaaagcuuaugccuuuuguacccacucaccacuuggucauuccugcccagaguuccaccuccuccagcugcuuuuauccccuugcucugcccccuacuuaacauuucugaaguuggauugguuuugacuauuuaggcucauuuguuggcucuucaacaacaaagaugcuguauaacuucucauuauuuucauauuaauuuaagauaaaauuaguuuaauacucuucaagguaagauuuuuuugccuagugauuagcauacacaugccuuuuaaauagguuugccuuuuauuuccaggaaguauugaugaagauguuguggugauagaagccuccuucacuccccaggucacugccaaugaagaaauuaauguuaccucaacugacagugaaguggagauuguuacaguuggagaaagcuaucggugagacuuuaguucuuaguuguauacuugcacuuuuauuuuuuuauuuauuuuuuauuuauaaauucuguauuuauuuauuuuguucguuugauaauuuguagcacauguaaauauccauaugcguuuuuuuuuuuauuacguauuuuccucaauuacauuuccaaugcuaucccaaaagucccccacacccuccccccucacuccccuacccacccauucccauuuuuuggcccuggcguuccccuguacuggggcauauaaaguuugccugaccaaugggccucucuuuccagugauggccgacuaggccaucuuuugauacauaugcagcuugagucaagagcucugggguacugguuaguucauaauguuguuccaccgauaggguugcagaucucuuuagcuccuugaauacuuucucuagcuccuccauugggggcccugugauccauccaauagcugacugugagcauccacuucuguguuugcuaggccccggccuagucucacaagggacagcuauaucacgguccuugcaacaaaggcuugcuaguguaugcaauggugucaucguuuggaggcuaauuaugggauggaucccuggauauggcagucucuaggugguccauccuuuugucucagcuccaaacuuugucucuguaacuccuuccaugggugauuguuuccaauucuaagaaggagcaaaguguccacacuuuggucuuuguucuucuucaguuucauguguuuugcaucuuguaccuuauaucucgcuauacuaaguuucugggcuaauauccacuuaucagugaguacauuucauuugaguucuuuugugauuggguuaccucacucaggaugaugcccuccagguccaaccauuugccuaggaauuucauaaauucauucuuuuuaauagcugaguaguacuccauuauguaaauguaccacaguuuuuguauccauuccucugcugaggggcaucuggguucuuuccagcuucuggcuauuaaaaauaaggcugcuaugaacauaguggagcauguguccuucuuaccgguugagacaucuucuggauauaugcccaggagagguauugugggauccuccaguaguacuauguccaauuuucugaggaaccaccagacugauuuccagagugguuguacaagcuuguaaucccaccagcaauggaggaauguuccucuuucuccacauccucgccagcaucugcugucaccugaauuuuugaucuuagccauucugacuggugugagauaaaaucucaggguuguuuugauuugcauuucucugaugauuaaggauguugaacauuuuuucagguguuucucagccuuucgguauuccucaggugagaauucuuuguucagcucugagccccaucuuuuaaggggguuauuugauuuucuggaguccacccucuugaguucuuuauauauauuggauauuaguccccuaucugauuuaagauagguaaagauccuuucccagucuguugguggucuuuuugucuuauugacggugucuuuugccuugcagaagcuuugcaguuucaugaggucccauuugucaauccucgaucuuacagcacaagccauugcuguucuauucaggaauuuuuucccugugcccauaucuucgagacuuuuccccacuuucucuuuagaggaaugggucgauucgcauucuucuacaugauaacaaccaguugugccagcaccauuuguugaaaaugcugucuuucuuccacuggaugguuuuagcucccuugucgaagaucaagugaccauagguguguggguucauuucugggucuuccauucuauuccauuggucuacuugucugucacuauaccaguaccaugcaguuuuuaucacaauugcucuguaguacagcuuuaggucaggcauggugauuccaccagagguucuuuuauccuugagaagaguuuuugcuacccuagguuuuuuguuauuccagaugaauuugcagauugcucuuucuaauucguugaagaauugaguuggaauuuugauggggauugcauugaaucuguagauugcuuuuggcaagauagccauuuuuacaauguugauccugccaauccaugagcaugggagaucuuuccaucuucugagaucuucuuuaauuucuuucuucagggacuugaaguuuuuaucauacagaucuuucacuuccuuaguuagagucacgccaagauauuuuauauuauuugugacuauugagaaggguguuguuucccuaauuucuuucucagccuguuuauucuuuguguagagaaaggccauugacuuguuugaguuaauuuuauauccagcuacuucaccgaagcuguuuaucagguuuaggaguucuaugguagaauuuuuagggucacuuauauauacuaucauaucaucugcaaaaagugauauuuugacuucaucuuucccaauuuguauccccuugaucuccuuuuguuguugaauugcucuggcuaggacuucaaguacuauguugaagagguagggagaaagugggcagccuugucuagucccugauuuuauuggaauugcuucaagcuucucaccauuuacuuugauguuggcuacugguuugcuguaaauugcuuuuaucauguuuagguaugggccuugaauuccugaucuuuccaagacuuuuaucaugaauggguguuagaucuugucgaaugcuuuuucugcaucuaacgagaugaucaugugguuuuugucuuugaguuuguuuauauaauggauuacauugauggauuuucauauauuaaaccaucccugcaucccuggaauaaaaccuacuuggucaggauggaugauugcuuuaauguguucuuggauucgguucgcgagaauuuuauugaggauuuuugcgucgauauucaugagggaaauuggucugaaguucucuaucuuuguuggaucuuucugugguuuagguaucagaguaauuguggcuucauagaaugaguuggguagaguucccucuacuucuauuuuguggaaugguuugugcagaacugggauuagaucuucuuugaaggucugguagaacucugcacuaaacucaucuuuuccugggcuuuuuuuggcugggagacuauuaaugacugcuucuauuucuuuaggggauaugggacuguuuagaucuuuaacuugauccugauuuaacuuugauaccugguaucugucuagaaauuuguccauuucguccagguuuuccaguuuuguugaauauagccuuuuguagaaggaucugaugguguuuuggauuucuucaggaucuguuguuaugucucccuuuucauuucugauuuuguuaauuaugauuuugucccugugcccuuuagugagucuagcuaaggguuuaucuaucuuguugauuuucucaaagaaccaacuccucguuugguuaauucuuugaauaguucuucuuguuuccacuugguugauuucaccccugaguuugauuauuuccugccgucuacuccucuugggugaauucgcuuccuuuuuuucuagagcuuuuagauguguugucaagcugcuaguaugugcucucucccguuucuucuuggaggcacucagugcuauuaguuucccucuuagaaaugcuuucauugugucccauaguuuuggguacguuguggcuucauuuucauuaaacucuaaaaagucuuuaauuucuuucuuuauuccuuccuugaccaagguaucauuaagaagaguguuguucaguuuccacgugaauguuggcuuuccauuauuuauguuguuauugaagaucagucuuaggccaugguggucugacaggauacaugggacaauuucaauauuuuuguaucuguugaggccuguuuugugaccaauuauauggucaauuuuggagaaggucccgugaggugcugagaagaagguauauccuuuuguuuuaggauaaaauguucuguagauaucugucagauccauuuguuucauaacuucuguuaguuuuacugugucccuguuuaguuucuguuuccacgaucuguccauugaugaaagugguguguugaagucucccacuauuauugugugaggugcaaugugugcuuugagcuuuacuaaagugucuuuaaugaauguggcugcccuugcauuuggagcguagauauucagaauugagaguuccucuuggaggauuuuaccuuugaugaguaugaagugucccuccuugucuuuuuugauaacuuuggguuggaagucgauuuuauccgauauuagaauggcuacuccagcuuguuucuucagaccauuugcuuggaaaauuguuuuccagccuuucacucugagguagugucugucuuuuucccugagauugguuuccuguaagcagcagaauguuggguccuguuuguguagccagucuguuagucuaugucuuuuuauuggggaauugaguccauugauauuaagagauauuaaggaaaaguaauuguugcuuccuuuuauuuuuguuguuacaguuggcauucuguucuuguggcugucuucauuuugguuuguugagggauuacguuuuugcuuguucuagggcguuauuuccauccuuguauugcuucuuuucuguuauuauccuuugaagggcuggauucguggaaagauaaugugugaauuugguuuuguuguggaauacuuugguuucuccaucuaugguaauugagaguuuggccggguauaguagccugggcuggcauuuguguucucuuagugucuguauaacaucuguccaggcucuucuggcuuucauagucucuggugaaaagucugguguaauucugauaggucugccuuuauauguuacuugaccuuucucccuuacugcuuuuaauauucucucuuuauuuagugcauuuguuguucugauuauuaugugucuggaggaauuucuuuucugguccagucuauuuggaguucuguaggcuucuuguucauaggcaugucauucuuuagguuugggaaguuuucuucuauaauuuuguugaagacauuugcccgcccuuuaaguugaaaaucuucauucucaucaacuccuauuauccguagguuuggucuucucauugugcccuggauuuccugguuguuuuuaguuaggaucuuuuugcguuuuguauuaucuuugauuguugugccgauguucucuauggaaucuucugcaccugagauucucucuaacaucucuuguauucuguugcugaugcucaaaucuaugguuccagauuucuuuccuaggguuucuaucuccagcguugccucacuuuggguuuucuuuauugugucuacuucccuuuuuaggucuaguaugguuuuguucauuuccaucaccuguuuggauguguuuuccuguuuuucuauaaggacuucuaccuguuugguuguguuuuccuguuuuucuuuaaggacuuguaacucuuuagcaguguucuccuguauuucuuuaagugaguuauuaaaguccuucuugauguccucuaccaucaucaugagauaugcuuuuaaauccgggucuagcuuuucgguuguguuggggugcccaggacuagguggcgugggagugcugcguucugaugauggugaguggucuugauuucuguuaguaggauucuuacguuugccuuucgccaucuuguauucucuggagcuaguuguuauaguugucucugguuagagcuuguuccucaggugauuauguuagccucuaucagccgaccugggagacuagcucuauccuuaguuucaguggucagaguacucucugcaugcaagcucuccucuugcagguaucgugcccagauaucugguguuugaaccugccuccuggcagaaguuguguuccacucaccagaggacuuaggaucccguggcagauccuguguggguccuuguggguguccguagacuccccugggccagggaccacaagggacuugagcccuguaucaggccggguuaccugcuuccuuaauuaaugcagucucagguccugcgcgauuggauuggagcaggugcuguguuccacucaccagaggucuuaggaucccguggcggauccuguguggguccuugcggguguucgcagacucccccgggccagggaccacggugcugcagugggcuggccggaagggacuucauacuugcacuuuuaaauguagauacuuuaccauguuuaugguacggauucccuccagauccucaacuugauacaaagcaagguuagauucccuucagggagacaguaaaacucacuauugcaaaauucccucccagaccaguggagcuagaaucuuaggggaucucauauuuuuauccuugccucauuugcucuaaguaagcaacaguuuuacuuaauauuuuuuuaacaugggcuuuuuaauuucuagcauguagauuccauaaacugugaaguuuguuugugaguaaaauauagauauuggguauaauucugaauuuacaagugaagaaaauuuacugccauaaaaacagcacuuguuauuuguguacaucaagauuguccucguuacaugugaaauugugcuuuuauguuauagcagccaaguuuaaggcccuuuaugguacuauuuuucauuuaaucaugcuaauuaaguucugaacuaauaagugaguagaaagaucucauuuguuuagauagauaucugaacauacguugacucuuguagaauuacuuuugacaccauggccccuuguuugaaaugaaaaaguuaauauuuuauuuacuccaugcuuaacuugauaauaaauauugauauuagugguaaaauguugcuuauuugauauaccagacuagucugaggauaaauauuaauuuucauguuggaaugaauuuagaaguacauuugaggauuuuguaugcuuuucuuuugauacuuuuuuguuggaguguggguucuaaugauaggagaguuuucucuuuccuuuuuuuuuuuuuuuaaagaauaaaaauuuaggggguuaucauuuauuuguaugauuuuaccugcauguauguauguauguauaucauguaugugcugugccauuggaggucagaagaggucaucggguccccuggaaccaggguuagagagagauuccaugugggugcuaggauaacacauccucuguaagagcagucagucuuaacuguugacccaucucuccaaccccucuccucaauuguuuuugguuuuaagugauuuccuggaauaggaaauuggcacucuauagugugugccauaggcugucacaguuagcuugccacugcuuauaaggcacagcaccaguugaguuuuuauauguuagcucucagcuguuagaaaguaagaucuguuuuccuuguggaaauggagaugcuuuuaucaaacagaaacauuucuccaucuaagagugaaccuagucucaugaucccuagguaguuuccuguuaguaccugaaaugcaccuuuguuaugguugaaaugguuuucugcccuucagauguaagagaauauuuuugucugucugucguguuaggauuugacaguugccauugucauaguggccuugaagaccucugugacacuguugccuuauguuuguacuagagcucuauccaguagucugucuggaggaagaacaaccugcaaagccaaaagagccauaaaguagaccuggagcugccugcuguugauggcugacagacagacagacagaccccacacucaucguaggcgcugggcuucucaggaaaaucuuuuuuuuuaauuuagacccuccaaccuccggcacccuugcccaucugacccaagacaugauucucccuggcucuccuaaaacucgcucugucgaccaggcugugcucaaacucaaagagcuccaucugccuaucucugccucugccuaccaaaugcugggauuaaaggcauguaucaccaccacucagccuaauuuagguuauuuuuacuuuuagauuuauuuuauguguguauuuuguccguauuucugugcauuacaugugcuccuaguguccauacaagucaagagaguauguuaaaucuucuagaacuggaguucugauggcugugagccaccauguauaugccaggaauggaaucaggguccucuacaagaacaaggaaugcuauuaacuucugaacuaucacucuccccccaauauggggugugugugugugugugugcugccugccagccuggucuguguuguauuucuuggucuuucugucugucuguucaugaguaugugcacuugagugcagguguucacagaggccagaagaggauguaauuccuuugagaauagaguuaaagauaguugugggucaccugauguggacgcuugucaccuaggauccuuuucaagaucagcaaguauucuuaaccaaugagucauuucucuaguagccuuuucucagaaguuuuuaauaaggauauuuauccuuauaagaaaugauuuuuaggggcuuggugagauggcucaggaaguagagcacugacugcucuuucuaagguccugaguucaaaucccagcaaucauaugguagcucacaaccacccguaaugagaucugacgccaucuucuggugcaucuaaagacagguacaguguauuuauuuauaauaauaaauaaaucuuuaaaagaaaugauuuuuaucuuagguguauuuauaauggcucaugauauccagugcuuucucauauaugcauugucuuaaaauuaccucuuauacucuuuucagaauuuuagguuuugaauuccuuuuuaaacucuuggacuuuaguguuguuaaagacuguucaucccacuuugaauuuuuguauauuuuucuuaaugguggcaccuuucuaacuuugcauuuaggaacacagugucuaguggaucugacucacauuugucacacgugcugaugacaaacuucacaguuuuaugcuuagucugagcauacugaagacacaaacuguguaacaacuugugacuuauuugccuaauuuuucaaaagcagauuuagcucuucucuugaagccuugaguagguuaagaauauuagugaacuaucaguaaauacucugucaucaugauuaugaauccuuacgaaacgucuaaaugccuaugagugauuggaaagagugcagugccauucacuuaugguauuugaaguugugauuugaugcuuagaguaguucaagcaagugaugcucacaaauucaucaacaagccagugcuuucauuuugucaacuccagggacuucucugcuguauuuauacagugucuguguauuaccuuaggagaggaccagaagcuuuuccugguauaucauuucuaaaguuaaauucugcaaaccuagguugggacauuauugcacagauaugacugugugucuuacuugggauuucuguguguuucuucaucauagugaauaacuugggaugcuggagugugugccuuaguuagggcuuuacuuuugugaacagacacuaugaccaaaguaacucuuauaagaacaacauuuaauugagacuggcuuacagauucagagguucaguauauuaucaucaaggcggcacccaggcaggcauggugcauguugagcugagaguucuacgucuucaucugaaggcugcuaguggaagacuggcuuccaggcagcuaggaugagggucuuaaagcccacuuccacagugacacacccaccccaaaaggccacauuuacugcaacagggccacaccuucuaauagugccacuuucugggcuaagcauauauaagccaucacacaguguauucacuuauaauccaagugaauaucuaaaacagugucuacuaaguggcuauuaagugguucuugucuuuuugucuuuuugaaugguugaucugacaucaucuauuuucugcuuugguucucugauuggugguaccuucauuuagcagcuuauucagugccugacauugcauuggucauuguuuuuaauccaguaaccauuauuucuugggaaaggucuugcaugaagaauuuaaguguuuuauaagauaagcuuguggaauuuuagagugacugaaaaaggauccacccuucauuuauguuuacuaacuugaugcugacuucauuuaaggucucguucaacccuuggacacuccagaucucauuggagccaagguucaaguucgcauacaggacggccacaggagucucgaaaccgcaguaggaucucuacuguuauacagccccugaggcagaaugcagcagaaguuguggaccuuacuguugaugaagaugguaaguuggaauaguagcuguuggguuaugaagaaaauuugacaaaauaucuuaagugaccauuuugugauccaguguuugauaaguguuauuauucuuaaaaucuuuauauuuguuuauuuacauuuauaaaauuuuaaaaacaaagcauggaaaaugagauuaacaugaauacuaaaauucauagcuaauguugugaagugguugcuuuauguaaagggugaaaauaagugcguuaugaauaauccucugagacacaccuuugccuuauuaguuuuccuggaaaggacauggagagagguuaguaauuuagcuuugucauacugugguaaaauuauaagcaucagcugggcagccugacuugaaauuaugcugugccagaggguacaguuuguugcuugaauaugugacugugguccaggggcagaacuugaacuuuguucuaacuuuuuuuucuuuguggugaauagaccagaaaauuuagcagguacugaaaacuuuuuucucuugguacugggaaucaaacccagggugucagacauacuagguaagcacucuaccagugauguacagcacuaguccuacuagagagcuaaacaucuguuuaacuagguuaaacaugcguguugggguuuuuaaaugcaguucuuaucucucaguggcauuuugguuugauguugcagugaaauuucaugagagcuuuauuguguguuguacuuauuuguucuuaaugcuugauucuuuaaaaaauguuagucauuaucguaguaaaauuaacuucuccaaguaugggcauguaccuauaagcaacacuugguaggccauaauaggggaauucugagcccaaccuaucuauauauauaguaauaaacuguuucaaaggaaaaaaaaaugaguugcuaacucaaauuaaaauacaaccauucuuuaaucuucugugaaaugcuaaauugauguuuuauguuuuauagaaccuacuauaguaccaaccacuucugcuagaauggacucacaaacuacuagugcuuccauuaacaauucaaauccaucuaccucugagcaagccucugauacuacuucaacuguggccaguagccagccuuccacagugucagagacugaagcuacucuuacaagcaauagugcaacugguucuucugugggcgguacguaagacuguuuucacaguguuggcaagaguguauucuuacauggugagguacuucauguuagcaaagcaguaucaagaaaguaagaaacgguccauagaauguuagaaaauacauuuguaagucaugucugaugaggguucuaauaacagaaugcauauagcucucugaaauaauaaaaacacagcagccuaauuuaaaaauggacaaaguauuugaccagacacuuucaaaggccaaugaaccccaugcgagauagaugcuaagcaucacuacugauuuaugaaacgugauugaaaccguauugaaguacauaguucacacuuacacagccguccaugauuuaaaaacaacagagucaccagaacuggucauagaugagaaauuggaacucuagugacauacgguagaaugcagacggcauagcugcugagugaaacacuggguccuccucauaaacuuaaacagaguuuccucauggcccuggcauauucugaaaucagguaagaugggaauaggaguuuuaaagguuucaaugaugucauuuucucuuauuuuaucauugcuccuuguucugccggcauuauauuauacauaagaaguguugccuaacccaaggccagaaagaacuucauuuuguuuguuugguugguuuugagcugaagaccucauauguguugaguguauuuugcuuuguuuuauuuuuaaagauuucuuucuuuauuauauguauaugugucgcuucagacacaccagaaaagggcaguagaucccauugcagaugguugugagccacuaaguaguugcugggaauugaacuugaccucuggaagagcagucagugcucuuaaccucugagccaucucuacagcccuugaguguguuuuuuaucacugagcuauauaaccauccuaaagaauuuuguauuuucagugcugaucacauuuuuuuuuuuaacuaggcaguuauauuucugguucucucucaauugcuuaaggcagcuugauuucugauggacagugguucagacaggaacuuaauaacaaggacacacgauagauacuguagcucauaaauugacuauauugcuauuuuuaaugagagcacuuuuguuguguaauacaguuugcucuuaauucugauaacaucuuugugacuuucauuaagcuggaaaauggcuggauucaaaagacuuuucuggaagaaaacuaaagacaauugagaacuguucauggaaggauuuuucauggaugucuuucucugaaaagaaauguagucagagucaaauuuauuuuuuuauuaauuuauuaagugcauauucuuucuugguacuuuacuuggauauuuuauaugacuuuuaaaacaaaaacaaacaaacaaaaaacuugguaccaguggaagccagaggaggacauuagauuccccuggaacuggaguuauagacgguugugagucaacaugugguugcugggaacugaaccuuugacugagcuauaacucuagccccuuuuaugugauuuacuguuaucauuuaauacuuaaagugccuugguauuggcauuauaauucccauuuuauauaagaagaaauuucaaaaguuaaauauuuugauuggggcucauagcaucuuugugguaaggauuucaauucuucauucacuucucuccugauagccuuaauacucauauuccugccuacauuucauaaucaccuuacagcuuucauuuauauauuauguauaucuacuuauuuuuaguaccuucuguuucuuaguuguucuguuucauuagucacuguaguuccugacaguucauucuuaauauuacacuauaccaucuuugagacagauguuugucccaggucaaauuguacagaaacuuaauaaaaguggcauauguaguuguacgaauuaaagcaguuaauuguauuucuuuuucccguacaacaccauauggaaugucgguucaacuuucuaccuaucagguguucccugcuucauacagguuuucuacuuugaaucauuuaagcgagcuagcuacacucaucucuaaauaacuaaauggugcaguuaaugaccaggugcugugcagcugcugccuccauaaaugcugaauaucucauuaguaggcuuuuuuuuuuuuuuuuuuuaaauuacuaggcuuuugggagugauuuacccuccauaucuuguuaguucuuccccucucccuccaugauuuucuaaaacucuguccuuuuccucaaggcuuucaucuuucaugggacgaaaguuaaagaauaaauucucaggcauguguuccuauauaaccugaagauauuagcguuguaaaagcuuuuguguguuuaugcuuggaauuuuuuuuuaaaugccugauccauuacuaacugacuaucuaucccagugucuuuguucaaucuccagccuuaaccuugugcucucuucgucuuuguugucuucaccaguuccauuuccuaguauagguacagguacuccugccgucucuguguguacauguuacguguuuccauucuacauucuuuauuauuagaguuauuuaucuuuuuuaaugugugugcaugcguguguguaugccuaugcauauucacaccaaggugacugugggaguuacagggcagcuuggagaagucaguucuuuuuacaauauggugucuagggauuaaacucaggucuuaaagacucaauggugccuggcggugguggcgcaugccuuugaucccagcacuugggaggcagaggcaggcggauuucugaguucaaggccagccuggucuacaaagugaguuccaggacagccagggcuauauagagaaacacuguuuugaaaaacaaccaaaaaaaaaaaagacucaguggcaagugcuuucaaccauugucuggccccuguuuuuuaauuuucuucugacuucuuucagagugaugagagaugcgcuauaugcuugguaacaaucuucuuaugccugucuucuucccagccuucuguuucauaauugcaguauucaccugccaccaggaagcugaugauucucauucugugauuuuacacccuuguccuuguuuuaaaguuuauauucaaccauccuuggacaucuuccuuggaccauucuggagucacaccuuuaaauucauacucaaaacagcucacuuuuguagccugugcauauacuugaauuaugcuucccaucugcaguauuugcauguucaacaaauagucacugaguugauaaugugcuaccagguguuuuucucccagugugauuagauaucaaucuucauuugaacagauuaacagauuacauauggcaugugcguccccuccacaaauuaguuuuaucugaguuuggacagaagagaaaaugaaaggauugguagauagugguccagccagauacucauugagguggaugcugugacuucuaguugaauauacccauaagacuucaguauuggaaaguauuacugguuuaagggauuuagaagauuuuuuuuuuuuuuuuuguagcauagaguggaagaauucauaugguauuuuugaaacuuuauugcuaagaaauauuaagaaaagauaaucucuugucaguccaugauacauaugaacucccugcagaauuuauauucucagaaaaaacauucugagacacugcacaacauuccauacuguguguuaagcacauggcaccauuauauucuuuuuuauuuuaaaaguuacaccauugaugugugugugugugugugugugugugugugcacacauaugcacacacaugugcaguucauaagacaacaugaggcagucauuucucuccuaucauguaggucccaggaaucuaacuuagguguucugacucaguagugauccccuuacuaugcugauuagucucacuagcccaguaucacauuaaauucuuauuuccagauugauacacaguacuuauuuuuaugcagugguauuugaucauucuuugcauuuguuucuguuucaagaugacgugaggagaacugcaucuagugcugucccagaaagugguccuccugcaaugccaaggcuaccuucuugcugcccccagcacucaccauguggagggacaucacagagccaucaugcauuagcacacccacacucaaguuguuuucagcagcauggccaccauuuucagcaucaccaccaucaccaccauacuccccacccagcugucccaguuucuccuuccuucagugacccugcuugcccaguggaaagaccucaaguacaggcgccuuguggagcaaauagcagcucugguuccagcuaccaugaccaggugugugggauuuacaagucacuuccucccuccucccuuuccccuuucccuuccuguuuuaaacuuguguuguggucauaaagaaaucgaaaaccccagugauauauuuaguguauguguugccaaaauaaguuugucuauaaacuaagccauauucuugaaugcaaaaaugaccuaauuuagugagcugugaauuuuuaaauugagucuugguauacagaaaguuuaaauuauugcagacaguuaugggggaaaguagacaugauauuuauuguaaaauuuacuuauugggccauguagauggcauggugaguaaaggcacuugcugucaggccugaccugaguucagucucaggaacccacauaaguuagaagagagagccaauuccuacaaauuguucuuugacuuacuuaugcaugaaugagcacccccccauacacaaaaugcaauuagaaacauaaacaaacccaaaagauguauuuuagggaacucaauguaacuuugacuugucauguggcugaacaaagccaggauagagcugagaaaggcuguccugcugugccuccugaccuuccugaagcaccagguuuugccuuuuaaauuuuucuggcugucucuuuggggaucuaacuucuuaacaguaaugaagaggucuucucugguggggauuugaagaguuuaauaaugaccaagauuuaagauguuuugcuucuuuucuguuaacaguucaggguauuaauagguugucugaagccauugugcuucugaggaaggaggugugugaaaggcccugcuaugaaggaaagcuuccuuuuacuagcaauggguguugaaagaagaguagauuuaacuagaguugucggcaguggugagguagccccccagcuuccccauucaugggagagcugccaauaagugaguuuaucauauacuacucuuguuguaguugauaaagaauacagcuggcuaagagauaacuuuaguacucaagacacagcaggcagaucucuaaguuacaagacagcaagggcuauacagaaaaauccuaccuugaaaaaggagggcgguggggacagagucagacagagagagauugcuaaccccaguacuuagaggcagaagcagguggaucucugaguuuuaggcaagccuagucuacauagcaaguuccaaaauagcuaggaauauguagugagacauugacucaaaaaauaaaagauaaagguauaggaaagauugaauuauauaaacaaugcuuccuuuuggcuggagucaguaggugccuaucuuuaccaguuccagucacauuaaaacagugguucucaaccugugugucauaacucuuauuggggauucgacaacccuuuuuuacaggggucaccuuagaccaguggagaaaacaggcauuuacauuacacuucuuaacagcuacuccuuaagaaguagcaaugaaaauagauuuaugauugagugucaccacaacaugugggacuguauuaaaguguugcagcauuagaaagguugagaagcacuguuuuaaagguuggcuuaucucaaagcugucucauggacaacgggcugguguugguagagaugaaccccuggaauugcccucucugucuccucauugcugagauuauaggugugcacuuagcuuuuccucuugguucuggaggaaucaaacucauauccucaugcagagccaucuuucuauccauguuugacacuguucagggauaagaucuuuacuauaggcuaggcuggccuugcuucucuuaccugagggcuagagugacagguguauuaaccacacuuggucaaauccauuuugaaaacuacagcuguacugaaucuaacucguagacauuguuuuaaaauacugaaaaauaccaacaacaaaaauaaaaacccaauaauucuuacuuuauaaucuacuguagaguaagaugaaaguauuuacuuaggguuuuacauaacuaacacauaguuauauauauuucucuauaugauauuuugauacauguauagccuucauguccaucacaaaagucaucauuuccauguagggaacaugaagacucuuauaguuauucugagauacucacuguuguuggcuauaguuacccuacuguguaccuugaacuuugcaaaccacaugcuuuaauaggagaaaauguuaauucuuucuaacucacucuguauauauaucaggcuggccucuaacucauagagauccuccuaccacugccucauaaguguggaacuugaagcugugagccaccaugcccuccuugguuuuguuuuguuuuuucacuguuagaguuuuagucuguuauaaaacaauguagaaaauuuugacagauuguuaguugaauucuaauacuuucagugcugugauagcauacuaucucugguuagaacuucagaguaaagcaguugugcuuucaaaccuucuguucuuaguuguacauaauguaagagaaaucaaucuucaaauuguuuucagauuaguguguguguguguguguauguguauguauucuugcuugucuuuauauaccucauuaaugcauuaauguccagggaggucagaaaagggcaucagauucucagauccccuggaacuggaguuuuaagcaguugugagcuaccuauuuugggugcuagaaccuaggucuucugcaaaagcaucaaguuucuuagaccagucagcugucucucuaacccuaagaaauaaaucuuacaguaacauuaguuaaaugcuuaucuuguauuuuauacucaagccuuauacaguauuuucuuuguguuugguuuuugucauagaaagauuuguguucccaaauuuauugaagacuuuguuuuccuagagagagcucuagcaauguuugucgugugauaagaaaugauguuuucaugaaacuuuagaaagguaaacucuaauuguucuuuacccagcaggcauugccagucgaucugagcaacagugcucucaggacucauggaaguggggguuuccauggugcaucugcuuuugaccccugcugcccugucacaucuucccgggcugcagucuuuggccaucaggcugcugcugccccgacucagccauuaucaauagauggcuauggcuccagcaugguugcccagccccagccccagcccccuccacagccuucucuuucgucaugucggcacuacaugccaccuccguguaaguaugaaucuagggggcaaagaacuggaauauggaaaugggccauuguaauucccccauggaauuacauugauucuaguuuaugaauuuuaguaagcuuauaaaugaacuuacuuauuuuucccauacaacuaucuaugaaaucaagauguauugagugguacuuuauauucuuuguuuguuuguguuuuuuugagauaggguuucucuguguagcccuggcugucuuggaacucacuuuguagaccaggcuggccuugaacucagaaaucugccugccucugccucccgagugcugggauuaaaggcgugcaccaccaugcccagcugguacuuuauauucuuaagcaagacaauuuuaaggaauuuggcuuuaauuuuuaagaguaugaagaaaucugaaaguuuuguagcauuucuaaucacaguaaaggaaauuuguucaagaacuuucaaauuuuauucaaagaauucugagucagcuaagacaugggggggggggugugcuguaacgaaaugucuugccuuuuggaaaaagaguuguauaacucauuugaaauggacaacuacaacagaaucaggcauggcagcuauaaggaaacuggaaucuacuagauagguuaaaacugguuauguuccauaguacuuuguuugaaucuuagcucauuauaaaacagaagcuuaacaaauacugugauaauaucuuaugcugagaguaaaccagcaaguuaguaaggaagcugucuuuuauagugguucugugcauuucaguuauuuaucuugaguuucuucuacuucaguaguaaaaucucauccuuguagacacagcugguggaaucaggccaaacuuugaauaauaaaacuaaugacauauuguuugagucucacuauuacaacguaaaauacaaaguuugaguuagaaauguuuagagacagacuuuguuuuucagagauuugaugaguuaaugugcgcugcucuguuacacugcugcucguccucagucugcccuuccuagucagaccuacugugugcuucccauccuucccuuuuaucuaauaggccgacgauguaaucugaccaauaaagauugauguuuuugacuuaaaguucuuuuaucuuuaucauaaaagugugucauguaaauucuacaguguuuaaaccagaauauuguaaaaugaaaaacuaaaagcucuuuuuccugucucauuaaucuuaguugcucagagguagcaacucuuuuuuuuuuuuuuuuuuuaaauucuuuuuuuuuaauauauuuuuuuaaagauuuauuuauuuuuauuguauauaagcacacugagcugucuucagacacuccagaagagggagucagaucucauuacgggugguugugagccaccaugugguugcugggauuugaacuucggaccuucggaagagcagucaggugcucuuacccacugagccaucucaccagcccccgcaacucuuuauagaguuuaauauaaaaacuccuagaaguuuucuuuauaguuauacaguauaucugcccuuuaaaagaacaugagccuuuucauuauauagcauucugugcuuuucuuugauuuaacaauacauuguuauuuucucaccauacuaacucauaaaacucaguaguguuuaugguuuuucacuccuuuacuuuuuuuuuuuuaaauuggaacauccuauuauauuaaaucuauucucucuugaugaauauuuaaguuguuugcauugcaguuacucuaguuuuucuauagccaaacaaauacacugucaguacuguuaaauuucccuccauggaaucauccaguuuauauuuguuauugggagcucugugagcgaagguaggauuugauuuuucccaugugagagacgucuugacugauggcccuguugcuuuuccucauuguaguguauuugucaucuguguagguucccugccuccccauuucccuuuaaaaacauucguagcaucauuuauguauaauacauguuguucuaauauccccuuuucauugaaaaguggauagaaaaagcacuagaaaaagugguugaaggaaaacaauuggguuuuacaugaaaugauggucugaguggauuucccagaucugaugaguuagcuuagugacuuugggagaguuauuuaacacuuuuauuuucaguuucuucacauuagcaaaaugggaauaauucugauuggcuauaacuuacaaaauuuugauccaaaugacuuaaguuguaccccacaaauacuguuauguuaggaaaaaguuucuuugcuuuugaaaguucauggucuuacguaagcaaugaaacuacuguguuuggaaaaccaucuuugaaauguuuugugaucuauaaagccgugcaauuaaauguuagaaauaaagcuaucugcuauuauguaggaaggaauuugagucagagucuuaauuaugugcccugguacucaugagcuacuuucugccagucuuguaaguucucaaauacagguauguagugccacaugaaaagaggcuccuuuuuagucauugagccauggugcacacugugugacuguucaauguaggaaguauggaguuaugcaaucuugauauuauaagugacaaguggagcuuuuggucuuuuuuuguuuuuugcuugguuuugaagacaggguuucucuguguagccauggcuguccuggaacuaauucuguagaccaggcuggccucgaacucagaaauccgccugucucugccucccaagugcugggauuaaaggcgugcaccaccacugcccggcgcuuuuguuuuuuguuuuuuuuuuuaaccaaaacuucuuuauauaaauuauuaaaauacagucacuucuaaaaugaaaucauagguauacaauuguauuuauuagugagcuaagccaaaagcuguauaauaauaaagagaaacaacaguggagcaaaugcuugaaugaagacacuccugaacuccuccauuucaucaagcaucauaaaccaccaauuuuagacugucucuuguacauuagucuauauucacauuccucgcaucugacuugauuucugcauuuuauuucauuuucagucucucucucucucucucucucucuaauauauauauauauaaaaauguuuucagugugacuguguggugugugugugugugugugucgucagcugcugcuuugcggguugaaugucuuucugggugucaauugcuauugccucugacgcucaaagaagcuuccauucucuaugacaaguggagcuuuuaggaagaacuuucaagaagaauuuauuuuaaguuuuauuuuaugcauaguugaugcacauacuuaaacagauuuuucugacuugguaagagcaccuauaaacuuccaaaggaagauggauuuaauggcacuuaucuguaauuguagcacuuaagagguugagacagaagaaucuuaaauuugaagccaaucugggcuaucuaguuagacccuugaugagaaaccaaaccaaaacauaauaaaaguaaugggaaaggauugggacugaagagcagguggcauguacaggcagcaggcuaucucuuagaauguuugccuaagaguuuuaaaacuuucaaaacagaacuuugaccuguaagucaugaacacaguguugaaaagguucuggaagcugcuggacauuuggugugaauuggagaggugaucagcaauaaccugcuuuaucaccugacuucuggggaugugugccuuuuugaaaaguaaauuuaguaaaaagucuuugagaaaauugggggggaaaagugguuuugggcaagaaaaauaguuuuaaaaguuauaaaccaugccaagaauacagccauauaguucucuucccuccauauauaugcuguuauauugugcccacugauacacagauaaguaaauguaguuuugcaaauuaagaaaaauauuaacuuaaaagacaguuguuuguuagugaacuagaaaauaacuguaguucagacuagcuacuuagaauauaccccagaugauggucugggacgugcugucaguaaaguguaugaugugcagcuugaggaccugagguccaucuucagaaccuauggggaaaggcuuaguauggugguguguacuuguaauacacgugcuagaaaaccaaggcuggaagaucccuaagguuauuggccagcagauuaaccucauugaaucauugagcccaaguucccaaugagaaaaccucuaaaacaauaaaguggagaguuguccuaauuaggguuuuuuucuguugcuguuaugaaacaugauggcuaaaagcaacucgaagaggaaagggauuauuuauuuggcuuacacuuccacauuguccuucauuauugaaggaauucaggacaggaacuuaagcagggcaggaaccuggaggcaguagcugaugcagaagcaauggagggguacugccuacuggcuuccuccccuuggcuugcucagccugcuuucuuauaaaccugugacuaccaguccagggauagcaucacccacaauggccugggcacuccuccaucagucacuaauuuaaaaaaugccuuauagcugaaucucuuagaggcauuuucucaauugaaauuucuuccuuuuugauaauccuagcuugcaucaaguugacauaaaacuggcgagcacaagaguuaauaauaacuacauuuuaugucuaacucuggcuuauacacacacacacacacacacacacacacacacacacacuuacauacauguacugcaagagcaugacaaaugugcagacagaugcacuaaagaauauuguccuacuaggcauggugguauacccuuuaaucccagcacucaguugguugaggcaaguagaucucuugaguuccaggccagccugguuuacagagcgaguuccaggacagccaggguuacagaaagaaaccuugucuuggaaaaaaaaacaaaaaaacaaaaaccaacaaaaauaauugcuuaaugaaaugaaguuuggacuaaaauccaagguuuuuuuuaaaaauuuuuucuuauuuuugguuuguuuuacuuuucauuguguugcucagcuugcuuugacuuuuuuuaccuauuucuaguaacugagauuagagauggcauauuaugccaaaugacuuuuuuaaauaucaaauaaauucagguuucucacuaagagagaugaguauuucaacagugacuuugaaacauaaagauuuucauugaggacauaaaagaaaguaucuuguuaagggcuuacuucaugcauuuucucggcaaacaggccuucucaucugucuguagcacaagaugugaccuaagguguggaaaggcaaggacagcaauagaaguguuucacaguuguauugauggccuggggugugggacuuaaaaagauucccuuuucucuguacugcucuccgucaacaguaaaucauuaaggaaagugagacauauuuagaaagugguuaacuguuuguaauuccagcacacaggaggcugaggugggaaaguuauaaauuugaaguccguuuugauuauuuaacaagguacuaucucaaauaacaaacaauuguauacuugugggauuuaguuuuguccuggcuugaacccaggacauaccucugaaauaaucuuccagaggauccagguuuaauucccgucauccacauguuaagcucacagcugucuguaacuccaagauaugauaccccaacacagacauacauguguucaaaauaccgaugcucauacaauaaagauaaauaauuaaagaaauaacuaaagaaaagaaaagcaaugauacuuuuuuucuagagcauuugaguuugguuggcagagccuauaagucccucuucagaccuccaagggcacuuauacauguuauaaaaauaaacacacacacacauuggagagauggcuuuccauccaggcacuggcugcuuuuuccaaggaccuguguucaauucccagcaccuacauaguggcucacugccaucuguaguaggaucugauuuccucuucugucaugcaggcauauaugcacuuauauaagagcacuuauauacauaaaauacauauauaaauaaauccuuaaagauacauauuaacacauuaguaaagaugaugacaaccaaaucaaaacauugcugacugugaugguaagaauguauaccaaucucuuuuaggugaguauauuaauuaugguaacccuuaggaaacauguuugucaauggcuguccguaaguguuucugacucauaccuccuacaaauuuuacuguagaaacagucugagcucaucgugugugugugugugugugugugugugugugugugugugugugugagagagagagagagagagagagagagagagaagaaagggaucucggcauuuaccaguucuuauuggggacuuuuccagaaauuuugguccagucccuaauaggauguaguaaauucuaaugcugugaaugaaguagaucuguaaguauugacaggaaacacuuuucuugcagaugcuuccuugacaagaccacugcaccaucaagccucagcuugccaucacucucauggaaaugccccuccccagacucagccucccccucaaguggauuacgugauuccgcauccuguccaugcuuuccauucucagauaucuucucaugcagcaucucacccuguggcaccaccgccgccaacacauuuaggcaguacagcggcacccaucccucagcaucuuccuccugcucaccagccaauuucacaccauauuccagccccagcaccuucagcccagagacugcacccucaugaagugaugcagaggauggaaguucagaggaggaggaugaugcagcauccaacguaggucucgugcuuuuaaggaaauugugcuugcuuuucuucauguucuguugcucucucaagcaugaaauguuuggaaacuagguuucacuguauaugccagucuggcauugaauuuuuaaaccuccugccuuagucacauguugcuaagauauguaucaucacaccuaguugggggaaacaaaaugaaacaguuaaauaaagcagugugacuguaguaaaucuucagcuugggaaaaaccucaugcuggguauugaaucuauggccuugcaccuaauggacaaggauuuaucacuagagccucugauguuggggguggaggugccacaggguaagaugcuggccaggauacacuggaaauccugucucaaaaagccccccacccccccccccacacacacacacaaaaggucuuuuauaaaugacuggagcaaaauacaguuuucuaucuguuuuauauguuuauaagauauauuuaacugguuugugcauaugauaugacauuuguuuuuaguuguaugacauuuuaaaguuguauuuccauucugcuguucuccuaauuaaaauauauauuggagaaguuucaagagaauaugaaaccuuucucgugcaauuauuauuauuuuuguuuguuguguuuugguuuugagacagggucucauuauguagacuugaacuuauuagagacccagcugcuucugcuucugacuccuaagugcugugaugaaagguuugcaccacuaucccugguuucugggaggauauuuaaauuagagauguuagaguaaaugugcaguaaguuuuuauagagaguaucaaguaaguuuuuauagagaguaucauggacauuuuuuucauuuaauaguuuuuuaauacauguuucuuaguguaaauuaauuucaugauuauagauuuucauaauauaauaggauuuuuuccuacauuaagaaauaaccaauuauucaauuauuuccaguggucuuuuuguguucuguguuuccaggcgggcacaugaacggcccccgccccauccacauaggaugcacccaaacuauggccaugggcaucauauucaugugccucaaaccaugucuucacauccucgccaggcuccagagagaacugccuggucaguaccuucuuuacuucaaacugugcuaagcagugucugguaaaacugggggaagcaaugcuuugcaguggagugcaugucacagugaacagcuguguggaagacauuucugcugggaguaguuaucucugggugauaagacccagaaagaaagcaaaguuuugaguucuggaacagaugucacuugaaucagggaaagauuuguugguuuuguuugguuuuaugucaaauaauauugugugacuggguucauuguaaaaggaucaacucagguuaaguagucuuuccauaccuuaguauuuaucauuucucugaugacuuuuuuuuuuaagauuuauuuauuuuauuuauaugaguacacuauaucugucuucagacauaccagaagagggcaucggaucgaucccauuacagaugguugugagucaccaugugguugcugggaauugaacucaggaccucuggaagagcagucagugcucuuaacugcugagccaucucuccagcacuuuauaaucaguuuugaguaucucagggcacacuguaggaacccagaacuuaguccuguugaacugaauguuugucuucauguucuucuguguuuccuucuauccacacucugcucucuacagccaaaugggacuuugacagauucuguagaugagaggcuagagcuuuuccuguuuucaugagugccucucucagaggucauacucacaaccuugcuuuagccaccucccuggucaugcuuguguuugccccaccugcaaugucuaccauugaaaggagaaaucuaguuuguguucugaagaaauaaaauugguuugcuuaaagcuuucuuuuuaaucggcuugcugcaguuacuguagcagaauacagagugggaguaagggaguggaccuuuagcauaagccauuccugcucuugcagggucaccacucuggguuuuagcacugaagaauuuuuagauguagaagcucuucuaauugucacugacaccaagaacccagcaaacacaguccugggggagcauggucacauucagaugaaccaaccgagucagcucugucuggugugguccuugaggagagccaggucccuggucagaaaagauccuaggagccacucauuaucucucuuauuuuugugacuaaagaaaacugaguugaaaugcucuccugcuuaugcucacaagcuauuugaacauuuauuucugaaauguacuuaaaauuauuaguacaaccagaggugggaggggggcuaaguucuauuugcuuuagauuuauaaguuaagaaccuuuagaggauuguaaaaauaugucuauguuuccauuucuguuggcacuguaaggaagaacaaaguuaaacugcucucccucuuucucagggaacuggggauugaagcuggaguaacugcagcuaccuacacaccuggugcucugcacccucaccuggcccauuaccacgccccgccucgacuucaucaccuccaguuaggagcacuuccuuuaaugguaaaaugggaauuuuuaauauuaugaaacauuugccuuaaaaguuacaucccuuuccuaauuaaguauuacauuaaaauauuaggugcaggagauguuuugcuagauuuuaggaauaauucuccuaauuaggcagcuguuguauaaaaauagauauauugaaaucugaguuuguaauuugaauuauaaaauauacucuugauauacaaaaugccaagaaguaggcuuuucugcacaccgagaugaccaugaccugcuaucauggacaugcauuggugcauuggugaauuugccaucaauggauuggaucuguuuugaugccaccuuaguguagcugcuucugauugacagaugaagauuuuguuguuacaauguuaaaaaacuauuuguaauacuaauuauagacaugagcagaaaaggaaguacucuuuguuguaggaagcggcacugcagagaggcuucuugucccuuguucuaggcagcguugggcuugggugcugcuuuugcaaaagauaaggcugaugaggagcugucacacaagaacaagcacuauggguccauguaagcuaguguuuccagauacacagcuggggcagcucagccagaacauuuuuggcccagcacucaugaacuuauaagccugaguucagcaccacugagggggugggguggggguggggaccagagacagagacacagaaagaauaugauuaugaaacugcuccgacaagaaacggggacucagcagccacagaggguauuuuguuguugcuguuguuuugagacagaguguugcuguuauuuugucuugugacagagucuuucuauguagcccuggcugucugcgaacuuaauauauagaucacaguggccuggaacacagagauaugccugccucugccucccagcugauguguucugauuguauuuaugcuuuuugugugacuuaaucugauuauccuugaaagggucuuaccuccucaauuaugggaaaaguagauuuagagguggaagaaggaaacaccuuuaaguguugcaguagaugacauaauguaauaaguaccugaaaaaaaaaaaaaaaaaaacacugacggaugguggcaggaaaagcuccaggacacaaugaguaguacuuaggcugucaccagguuucccuguguuagagaauauuagauggcuugagaaagaguuaggugggagauuuuggaccuacuaaaucugagauagcugugucaguaaaaaaaauuuuucugugggcuaaagauauguuuuugaucuggcaagauaccaugcagugcuaaggaauccaaggaggaggaguagauuuucaaagagaaguagaaguugaaagaagguaaguagacaguacaaauagagcagucagaugacugugugccucagccaaugacaagaacugccucccaagcugagaaacaaagcaggaguauacaauuuuauaaauuuuuauaaauuuauauggucaguagugucugaucagacaaaagaauaaaguuuggaaaguguugauguuagaauggauuuugucagugguauaacuaacuggcaagaagggagauggugccgggcgugguggcacaugccuuuaaucccagcacuugggaggcagaggcaggcaaauuucugaguucgaggccagccaggucuacagagugaguuccagaacagccaggacuauacagagaagccuugucucgaaaaaacaaaauaaccaaaaaaugaagggagaugguuacauuuccuuuccuucccucugacuccuuccaguauccuuccuuuuuugaggaaguagaauugacucauggucugugcuuucuagguaagcacucuaccaccaagacacacugcuguucuugggguacuuuguaagaaagaugagaacuugcagacagugaauacacacuacuuguaacuuggcuaggacaggcagcauugcuagaaauuccaguauuaaggaacauugagguuuggaggaacggaaauguucugacuugacagaaagccaguagaaagaauuacuuguucagagagagaaauaaggaguauuuaauuaaguaaggacuagguaagggaaacaagaagacaaauuugaauaggaggagaagaauccacaaaagguagaggaaaggguuucagaagaaagauucacauauggaggcagaauugcuuuuuauguugcuuggaggaaguuguuacuugccuggugugaucuuaguuauaaguaaagcugcagauaauguaauauaacauugaagguuaagagcuacugcuuuuaaauuguguguuuauuuugaauuauuuuucacgugugaguugucaguauauuauagucuacuagaaguguguuuugauucagcacaggcugauuaaaaguccagcacaggcuggagagggcuggagagauggcucuaugguuaagagcacuaucuguucuuccagaggucccagguucaauucccagcacccacauggcagcuuacaucugucuauaauucuuguuccaggauaucugacuccuucacacguguaggcaaaacauacauaaaaauaaauguacauaugauguacauaaaaauaaauaaucaauuaaaaaucauacuggagaaaaauaagaaaaacaauuaaaaaucauguuggagauuuauuuauaaauugauaauuacuuauacagacagaauagugcucuguguccuccuucauacauucacuugacuuuuggugucugcuacaacaaugcuugcacagagcuguaagcuccuugucaugaucuugcuuuuguuuaaucacugacuuaauguauauugauuuguucaaugagaacaugcagcaguaguacuacaguguguaccugagcaaaacuuagcugacauaugcuugcuccccaggcaaaacccagccugucuuaguuaggguuuuacugcugugaacagacacuguaaccaaggcaagucuuauaaagaacaacauuuaauuggggcuggcuuacagguucagagguucaguacauuaucaucaagguaggagcauggcaauauccaggcaggcaaggcacgguuagagcugagaguucuacaucuucauccaaaggcugcuaguggaagacugacuuccaggcaacuaggaugaggaucuuaugcccacacccacagugacacacccauuccaaccaggucacaccuauucuaacaaggccacaccuccagauggcgccacucccugguccaaggauauacaaaccaucacauuccacucccugguccccauagacuuguucaaaaacaugagucuaugggggccauacuuaaacauagcauaaugcaaaaugcauuuaguccaacuuucaaaguccucauagucuauaggagucucaacaauguuaaaaguccaaaguucaaggucucuucugagauugauccaacuaauuaacugcaauccccaaagcaaggcaggaaaccagcugggcaaacuccaaacucugcaucucgauggcugaugucaaaguggucuucagaucuucccuccuuuuucaucuuuguugacugcaacaaacugcuuucuccugggcugauuccauucccuguuagcagcuuuccucagcauguaucccauggcucuaacauuaacaucuuugagucuccaaggcaauuucaauguuacagcuucuuguuucagugucugagauuccacuugaucuuuuggacuccuccuaagggcuggcaucacuucuccagcucugcccucuguagcacucuaagcucagguugauccacuccacugcuguucuuggugaucauuccaugguacugacagcuccaauacacuaggguuuuccucuccaacuaggcuucaccaauagccucucauaggcucucuucauggugccaaggcucaaauccuuugcaugaccccuucaguccugggccaucaacuacagcugaggcuauaccuucuccaguggccuucccuggccucucacagugccaauacucagcuguuuuucaugaccccuucuugccuucaaacccaguaccaccugggugacucuuacacauuaccaaguccagaaaacacuucccagaagauuucaccucagugaugcuggucuccucauaauuacauaaucacuaauuucuuagcuccagcuaaccagcaucaauugucccaguaguucuuuccauucuuaacucuagagccagagccacauggcugaagcugccgaguucugcugcuugcaggaauuagaacaugaccugcuuguacuauuauauugucgcuggcuuucuguuuuccagauccuucacugccuaagcuuggcuauccugguucuugcucuguagauugaccuugaaugcagagaucagcagagauccugggauuaaagguguauaccaccaugccuggaucuaaauuuagcuggguaggaucuugccccaaggccccucucccuuaaucuguuauauccuagaacacaggauuuugcuccauuucacuuccugguacuccuuuaauacucgaaccauauauuuuauauuuuuccuuucuaagcuugcuaugcuuguucaaacuucucuucauaagacuuaacccgagccgagcgguggugguggugcacgccuuuaaucuuagcacuuaggaggcagaggcaggccgauuucugaguucgaggccagccuggucuacaaagugaguuccaggacagccagggcuauacagagaaacccugucuaguaaaacaaaacaaaaaagacuuaaccagagaauaaagucuuugcugagcuuuuuugaaacuuccuuugucagugcaauuaaucugagucucuucaccuuagccucagacagacuuuucaggcaaggacaaaaaguagccacauuuuucaacaaaauaccacaaaaccagucuuuaugccacauucugaaauucuucuccuuugaaaucucuugggcuaggucaacacaguucaaauuacuucuagcaacaaagucuuccauauuccuaccaggaugacccaguaagccccauuuaaagcauuccacugcuuuccaaauccaaagucccaaaauccacauucuuucaaauaaaagcauggucaggcauaucacugcaauaccucaucaucgcugggagcaucaaguuagccaguaccaauuucucaacacacuggauggccauaaauggccauaaagaacaaaugucccaggccaggcaguggugguggacgccuuuaaucccagcucuugggaggcagaggcaggcggauuucugaguuugaggauagccuggucuacaaagugaguuccaggacagccagggcuacacagagaaaaaaaaaaaaagcuggaguuaucacagagaaaggagcuucaguugaggaaaugccucccaugagauccaacuguaaggcauuuucucaauuagugaucaagggggaaaggccccuugugugugggaccaucucugggcugguagucuuggguucuauaagagagcaggcugagcaagccaguaaggaacaucucuccauggccucugcaucagcuccugcuuccugaccugcuugaguuccaguccugacuuccuuuggugaugaacagcaguauggaaguguaagccgaauaaacccuuccuccccaacuugcuucuuggucaugauugugcaggaauagaaaaccugacuaagacaccaguguaacaaauaaauuuaaccuguggccagcucacagaaaauggaauuugaaauauucaggauuuacuauacugagcagaauaaguuuugugugugugugguuuuuuuuaaaaguauauuuacuuauuuuauguauaugaauacagugguaagcugucuucagauauaccagaagagggcaucagaucuuauuauggaugguugugagccaccgugcgguugcugagaauugaacucaggaccucagagcagucagugcucuuaacagcugagccaucucuccagcccugguuuuuguuuuguuuuguuuuguuuuguuuuguuuuuuguuuuugacagaaucaagauggguagucaagaacauuccaugcuuuuuacuacuuagagauugauaagaucuuuuuuuuuuuuuaaagauuuauuuuauuuauuuauuauuauauguaaguacauuguagcugucuucagacacaccagaagagggagucagaucuuguuucggaugguugugagccaccaugugguugcugggauuugaacucuggaccuucggaagagcagucgggugcucuuacccacugagccaucucaccagcccgagauugauaagaucuuauaaaaaucuuuaauuucuuucacguuccucugcuacuaccaagagaccaucagcuuaguaaacuugaguauacacagauguaauuaguuaauuaauuaauuuacuuauuuauuuauuuucugagacaggguuucucuggguaguccuggcuguucuggaacuuacuguguagaccaaauuauucuuaaacuuggagauccacuugcgucugccuucucaauucugggaauccaaugugugaacuacuaugccuggcuuuuuuuucuuuuuuuuuuuuuuuuuaaaaaaaaagagggacuguauuuugcuagguugcccagacugaccuugaaacuagagcuagcuucaaaccaccucagucugccuuaccuaggccuucuuaguaaccauggcugaguaugucucccaacauccaucuauaugcagaguucuuuuuuuuuuucaaagauuuauuuauuauuauaucuaaguacacuguagcugucuucagaugcaccagaagagggcgucagaucucauuauggaugguugugagccaccauaugguugcugggauuugaacucaggaccuucagaagaccagucggugcucuuaaccacugagccaucucuccagcccccauaugcagaguucuuuguguaagguuguauuuuaaagggagccugucucucuuaauagaauguacaguuggaguuauggcuugucuuuuaagcugaguguauuaauugaauggagguugaugugauaguuuguauaugcuuggccggguuagugucccuguugggagguguggccuuguuggaguaggugugucccugugggcauggcuuuaaggccuggaagucagucuucuaccagcagccuucagauggauauagaacucucagccccuguaccauuucugucaggaugcuuccauguuccugucuugaggauacuggacuggaucucugaaucuguaagccagccccaauugaauauugucuuuuauaagacuugccguggucauguuguguguucacaguaguaaaacccuaagacagaaguugguaccagggacuaggguauugcugugauggaccugaccaugcguuuguuuggaagaauguggauuuugggacuuuggauuuagaaagcaguggaaugcuuuuaagugggguuuaaugggcuauuguaguaggaauauggaaggcuuuguugcugcgugucauuugaacugugcagaucuggcccaagagguuucaguggagaaaaacauaaguacaugaccuagagacuguuuuugugguauuuuggugaagaauguggcugcccuuuacccuuguuugaagagucuaccugaagcuaauguaaagagacucagauuaauugcauugacgaaggaagucucagaaacgcccaucaaagacuuuguucucuaguuaagucucaugaagagcauuuuaaacaagcauagcaagcuuagaaaggaaaaauauaaaauauaugguuugaauauuaaagggguaccaggcagggaaguggugcugaauccugugcucaaggauauuaaauugaauggaggaauuaaugaccuuguggucagauuaagagaguaaugacuuugugauaagauucuaccccuaaauuuagaucuagguguggugguacauaccuuuauuccuaggagauaaagacaagcagguuucugaguucaaggccagucugaguuagagcaaauucuaggugaagaaaagcuuaaauccaggcauuguggugcagaacuguagcuucagccauguggcucuggcuuuauagucaagaggagaaggagacuaugggacaauugaugcuggucaacuggagcuaagaaauuaguggugagaaagaagaaaccagcacugggcguuagugguguacaccuuuuaucccagcacucaggaggcagaggcagacagauuucugaguuugaggccagccuggucuacagagugaguuccaggacagccagggcuacacagagaaacccugucccucugccucccacaaaaaaaaauaaauaaauaaaaagaagaagaagaaaucagcaucacugaggugaaaucuucugggaaguguuuucugagggcacaaagaagcuguguuccagagauagccaagagguaccuccuacagcagcuggacuuggucauguuguacaagucauccaagugguuuugaagacauggagggaaggguguagggaaaaggagcugaggcuggccauguucuugccuuaaugauacugacuggaccucugaaucaaauauugucuuuuauaagacuugucuguucacagcaguaaaacccuaacuaagacaguugaauaucuucaaagauaacaaaaaucacaaaucuuaauugacuucauccaucucuuauaaacagguuccugacauggcaggcuauccucacauccguuauauuucuucaggauuggauggagcaucauucagagguccuuuuaggggcaauuuugagguaugaaauaaaauaagugaagauacuuguuaugguguuuuuagugcaggcugaauuuauuguguuuucaugaauaaguaauauggcuacuguggcugggaaccagaaagcagcaaaaugucugguuuucucauguuuccgggacuuaacacaaauuaugaacaauaucuuaaggucagaaguaacuauauaaaauagaaugaaugcagccuggcaguggugcaaaacuugaaucccaacaguugagagacaaacaggcuagucuaccuaaugaguagcacugcauaauuagacccagucuuaacacaaaaaaggggauggcaacauagcucagugauuaaaaucacugacugcucuucuaaaggucuuuguacccacaugguggccuagaacugucugugacucuaauucuaggggauucaguguugccuucuggccuccucagauaccaggcauccaugugguacauacacaacuauauuacagggaaaacacccauccacuuaaaauuaaaacaaaagcaaaagcaaaaccuacuaaaucaguauaaacauccaauaaagaaccaucuuaaugugucaggaaaccauaauuguuuucaccaagcuauauugguagagaaacaguuuggagaacggaaagccaagugauccauguguugcuuuggaugucauuuaugguugguauucagaacagcuuguuuccuugauguaauggacagaauugagcuucugccuccaugugcacgucaggcuugccuagugccacguggucacgcccuuauuaacaaccacuuaugguauuuguauuauaggguuauaaaauuuacauuuguugcauuuguaucauugacaguacucucaaaggaauauucauugugguuuuaauaguaguuauucauuacucucaggaauugauucaucuggaagaaagauuaggaaaugucaaucguggagccucccagggaacaauugaaagaugcacauauccacauaaauauaaaaaggugaggauuuaguccacaaaacuccuaguuuggcaugcaaaugcacgaaauggcauguuauauacuuuugaauccaggauugcauggugaaaaauuagcugaaacauacucugaaacugaaaucucuucacauaaucccugguuuucagauuuagacagggagucauagauuauguucuccaagauacuuuuguguauuuuauaaugcgcuuacaauauuuauauguauauauuguuucuucuacuuaaaaaagaaaccuacaaggggacaucuagaaaguuuguucaacaccuuuuauuuguuuacaagcucucagcucuuucucugguucaggugauaagguauugcuauguagcccaggcuagccuuucauuugaguuucucccucagccuccagagcuggcauuacagguguugcugccaugcugggcuuccaucuucucuuuaggauguugugcaaaauuccaccauagaguaauacuacaaguuuuuaaacuauccuuuuaugugugaugugguggccacaccuguaauuccagcacgagagcgccuaaacgaagaaauugcauggguuugaugccagcuuggguuuauaaaauaaaacaagcaacaacaauaaaaacagugaugggggucgggguggaggguuggggagaaacacagguaaaacauauagccaggccucuucaccaauguuuagauacuauuucucauaacuuuauccuucacucuguguaguguuauguggaaauuccaaauuagacauguuaaauuagcuguuuacagugaacagauaaugcuuaguguuguacgagaacagugacuauggaaguuacuauugguaguuuucauguuuucuaagagugucaaucaggcauuaccacuacauccugucuaaacuaacuauuguuauuggaauuaauuuauaaagauguuugaaauagucauuauaagaauaauuuacuuaacuauguugaaauaguaauuauacagaguaucaacaucaugaauuaacaguaauaggauuuaaccuagagaauuuguuacaguaugacugugaauauagaaguuacuguugacuuccaggagucaguaauuaauugguagucacuucauucaucuguuaauucaugacaguguuguguaggaauuaaguugcauaugaauauguggucuuguuuuauucuuguuuguuuuaaauaaacacagacuuuacucaguuguucaauaaugucaucucugcuaauaagguaacaacugauugguucucacagaggaaacugcacugcaaacaagauggggaagaagggacugaggaagacacagaggaaaaauguacuaucuguuugucuauuuuagaggaaggugaagaugugagguaacuagagauuucugacuuaaaguucacucucuuaaacagaaaggacuagauuauggcucaguggcaaagugcuugccugguugcacagcccuggcaacuuugugccucagcaccacagauaggugauugauucacaaauggaucaacuggucacgagggcauguauuuaaaauuaacuggaaacuaaagacuguugcugauguaccuaccauugccagcucucuaagcaaaagaauaagcagaucagagucuccuuguagaugacagaaacauggaggagagagugcaccuccuuucuggacugcagcagagucugugugcggcacuucuguagugaacagcgucuucuguaaaucgugcaggaguaacaguuugaaaggauuuugauaccuggauuauaagggcucgagaucauugcuauguaucuauugacagcacuuuuuuuuccucucaguuuucugagacacagggucucacuauauagcccugaccggccucaggcucucuaagugcugggauuacaggcaugggacucuauguccagcauaacuauacacuuuugugauuuaucaguguucucgucuuaacuuaguguuauuauuugaaaguauuuucuuuguauaauuaccaagaugauuauuuuguuaccaucuugacuuuuaaaauaucauaucaaauauaacagagcuguggguaguaauuuuguuucugggagaauauuuuuauuauaaccucuucaacuaguaguugagagaagaaaaaugacaaauuauuguucacugcauuaugugguaagggucuuuuuuauguuuuuuaaaauguguuauuagccgggcaguggcagcauacgccuuuaaucccaguacuugggaggcagaggcagacggauuucugaguucgaggccagccuggucuacagaguuccaggauagccagggcuacacagagaaacccugucuugaaaaacaaaaaaucaaaacaacaaaaaaaguguuacuaucuuucauauauauauauauauauauauauauauaugcauauauauauauguauauauauauguguguguguguaugaaaaaaauuauauaguuuugugugcauauacauuuguguaucauguaugugcagguguccaagggagccagaagagagcauuggauccccaaaacugggugcugggaaucuaauugugccccucuggaagagcugcugacauucucuuaauuguugaaccaucucugcagccucuguguguguguguguguguguguguguguguguguguguguguguuuuaaacacagucuuucuggugaaggcauguaguuguuaagucagucucuuugugguguuacugggaguguccaagaaggaagagagcaguugaaguuauuauuugugacacauguuaggcuauuaggauaugaauagcaacucuuaauaguaaguagaaaguuucauucuacuuuuaaguuuagauuuaguguuacuuggucaugucugucagcuuauuuuucaguuucuaauggcaguuuggcaugauauucugaagugaacaucuccuguuagcccaccuuauaaaguaguagcauuuugcuaaguggguauuccaauugcccuaugaaaacacuauuccuuaccuugggaaugcuguuccgccuaaugucuaaagaguuugaggauugauuaauggugcagugaccuuuaauuccuacagcaaaggcaaguaaaugacuauguauuucaaagaaucuucacaagcaucauaaugauuugauagcuaaaaguguuugcagcaucauacaacagggaguuuucaucuccaggacauuggccacucaacuacaagacaaaacuagagugagauugccaaugcugcuugaccugacacuuuucaggaguuuuauauuguuugcuuucauagacaugccaguuauuuaucuugguaacucauacauuauauuguccaaaaugccaguuuuauaaugaguaauucuuagagaaggugugugcaugcauauaagcaccacaguacacauguugaggucagaggacaaccuugguuccuaccuucugccuccuuugaaagaggaucucuguuuuuguucauuauuguaugcaucaggcuagcuagcuacccagcuucuggggaacuugucuccauuccuuauccuuauagggggcauccuggacugcaggugugccgagccauugcaugcuguuuuucauguggguucugaggaucugaggucagguugucaggcuuguccagcaauuacuuugcgcacugagccauccugccaguccuagucuuucuaacagaaagaugcuuaguaacuucguaacacuauuaaauuacuggguguaacauguauuugcaaauuaguaccccauagaauuaugaaauuaauuuuugcuuuuuguuuucuucaacaauaggcgccuuccauguaugcaccuuuuccaccaaguguguguugaucaguggcugaucaccaauaagaagugccccauaugcagaguggacaucgaggcccagcugccaagugaaaguugacauuguguuucagaacucuuggugucccucucauuccuauccuuccugguacugcagucaaccaaagauggcaugacuuaccugcgcagaucuggaagccuugaacucggagugcugacucugcuacaugguacagcuaccgcuagaccuacaacuuauguacacaguugauuuugauguauuuauaaaagcuuuuuuuuucccuagauuugacauuacuuccuguaucauuuuacuguauuuuugcaugauuccuuguauugcauuucuuugcacauauuaugggcuugugacccuaaacuugcaggcaagauuagcugcuuuaguaaguaguauuuuguggucuuuuuuuuguuuuuuggguuuuuuuguuuuuguuuuuguuuuguuuuuguuuuuuguuuuuuacauaguaccuugaaaauuaugaauuuuuuauccauuacuaaccuuuaauuuaaucaaucauguacuuuaguuuaauguauaaagauuuucuaggaaaugauauuguguauuaagacauuccuuaauuaaauuaggacaaaauggcugcuguauauuuacaauauggaauucugaguuaaguaccgcccuucauacugggaacagaauguauguaacccaugucaaucagaugcaggugguacccacacgaccagagugaucaauaggaauuuucuugguguuccuuucuuccagcacagugcaagauagaguugcuguugaugccauauguuuagacugcuguucugacccuauuuaucuuucucucugccauuuggaacuuuauucccuaacccagguuuugcugcugugaaacagcguugaugaacacuaaauauuaaucugagauagcuggauuguauauacuugcagauuuaaaaauauagggaaauugaaaaagacauguagaauuuuguuaggucuucugcuaagcacgaauaagauaucugcuuacauuaauuuuuauaaagucauucagucagaauuuaggauucagucauuggcagguaucuaugcauucguagaacuucuaagggucccaggaucacuuuuaagggauuuuuuuuuuauaguuuaaauaaagucagcugaaucuacaugucucuuguuuuauuucucucuaaacuugaaaacaguaaaucugcagauacugugaggcacagauuauauugucaagcuacuguugcuaugguuauagacacccacuucagacauuaccaagagucgaucacugacuuaaaaauuuuaauuucuauaguuaagauuuacaacauaauauagagugaaaguuaacauacuaacauuucuccuuuggaggaaguuuuaauccacuucaggaugcauauuagcaagauacuuucauauacaggauagccuaauuuuauuuguuuaaauaugcuuaauaugcccaagauugcaaaugcauccagucaguaauaccacugucuguauguggaagacauguucccauggaucauaugugaagaugucaauaagcuugcauuaagccaccugcuuuguaaguggauugauuaauaaauaacuuauauuucuauugucu

SEQ ID NO: 5178 - RNA, 2112 nt, Mus musculus
uaaccaucgccucggagcccgagagaugcacgcgcugcgcaccgcccguaggccgggguacccagcgccgcccagggucugcagcuccacccuccgcaggccgcagagccgauggagagggcgucccaggggaggcagggggcgcgaccggcggcggcucgcgaggccgcuggaaggccaggcuccucgcggaggcgcgggccccgcgcgccgggcacgcacaggcaccacccgguccgccccgaccgcggaagcguagcaccuaaacggcgcggccuacgcugcccugcgcgcagcguccgggccucaccugcuucagccgggagaccaguaccgucuugaccccguugauguccaaguugcggcgcuucagcucggaccugaggucgauaacccgcagcuccgugaucuucuucccuuccgccggcccagaggcggccgaggcuaccacggccccggcagcggcagccauuuugggaaagcaacgcgcugccgaggcagcuagugggcugcagggcggcggcggcggcggaggaggaggcagcggcgguggaggcgguggccgcggcagcaccaacuuccaacccgggccccgggcggccagcggcgccgcgcuacgcugcgcacaaugagccacugaccacgcccccccacggggaccacgcccccgacucugcuccagcgcaaccugcagcggcacccggaugacgggugcgcgugcgcacugagcaggcauggagggggcggagcucgcagcggaccgguggcucggccucuggcguggucccgggaaagucuccgcguguccaaccgcucagcuguccucgguaccacgguucccgccucuccauuagccuccuucuccucucaucucuuaccuagagccaucgccacuugagaggcaccccauaguagggagaguaggugcgucucuucaccgaaaugagggggcgugugcgccagccuucccggaagaaguacggaaucaucguggaaagguggucgggguauacuagugaacuuaggucggcggguuccgccccggaacgcccagcgaaaccugaggccgagagcccaggggacagugucacgcugugacccccugaagcuuagccccucuuugccugaaaacuaccaggcaaacguccucuccucguuugccucagcuugcccauccccuccgacgggccugauggcucaaugaaauuguucacaaaaggagaauaacuuaaaaguauauguugcccugauccuauacaguauccucugcccugcgccgccagcauuugguaugucaaggacaggggccacuuuauggagaaauagcccgcauaguaucucuuaguaauuuuaauauuauuaaucaucacagcguaaauaucuauagaauuaacacaaaguuggacaaaguuaggaaacacagggaacugaauuaacauuuacuggugggugauguuuuguaaaggcaaggguauguuuuguagagcgagguauagagcggugggagggacugccucauccggcugaugcugaggcauccccaccccagguaccauccauaagacuggucuaguauagaauagaguuuauuuggggguauggcaaggggagcugagaagggaguagaggcagagaaagggagaagacagaagagaagagcccggccaagaacacguggaggggggaggggagaggaagaaaggagucaaaggggggggggggacauucccauccaggccuaccuggcuguugcuagguaaguguugggcggagccuagaaggaaugcuaaggugcuaacaaaggugggguugagguuguuuuguuuuacaucuuucuccaguuuccugguuauaaaacuuaaauuggacugggcaguggugggacaugccuaucagcacuaaggggagagaggcuuguggaucucugagauacacuacacuccagccugguaucugcagagugacccaggacagccagggcuacacagagaaauccuaccuuuauaaauaaauaaauaaauaaauaaauaaaugugaggugugccuuacuuuggguugcuacacacagaggaauccuaccuuuauaaauaaauaaauaaauaaauaaauaaa

SEQ ID NO: 5179 - RNA, 101735 nt, Mus musculus
cgagggcagggaagcggggaagggaggaaggaagaggccgagggggagggagggcccuguuuuggcggagcagggcgcgcggcugggccccugaaguggagcgagagggaggcgcuucgccgggugccacugccggggaggcucgucgggacccagcgccggucgcggcucccucaggaucgaugcaccgcgguuaacccgugaggaggcggcggccggggaagaugguguugccgacaguguuaauucugcuccucuccugggcggcggggcugggaggugagacacgaccccgggcggcgacggagcggcggucggucgggccgagcgcagcgucgcggagccgggccgcgcgugucaggucuccucggcuucugucagcucucucagcucgccucagccgaccccgagcgacgcuccccgcgcgcuauugucccucgcgcgccccgaccgcgcucccgccggcggcggcccgagcaggcugcggagccccgggccaggccuuccccgcccccacggcccggcggcccugccugcccggcuucucgcgccgcuuuccccgggagcggcggagcccaggccagccgcccucgcgcacuccgcagccaccucagcccugccgggguccgagccccgggaccgcgcagacucgcagcaacuugcgagguuggcagcgcggcgggagcauuguucugcaagcgagcgagcggacccgggccgggugucggacgccggugugcgugucccacccgagugccuucccuccgccucgugcucuuuucggaguguuuguagccagcgcgccggagguugugugugugugugugucugucguucugucugucugucuucugucuccccggggcaagacuuuaguugacugaggagaagggcaagccguuuuaggaugcucuucgauccaucugucuuuuugaguugaguccacagagaagcaagaccgacccuuccugggcgaaccaacuugcagaguuuucuuaaacucucagguggagcagacguacugcuuagucagaggauugucagggcugugcucccucccccugcaaauuggaguucacuguugcuucaaguuuccugaugcuucggguuugagacagcgguauuucauucccaggcuuuccuaggacagguugcaugauuauuuuguuccuaugagaaagugcuuuaccauagguaagcuaauuugccgcccaagugucuggagagagguuagcuuaaaagcauugaauuggaaacaacccccagaacuuccaggggugcuucggaugguugucagcagccuaauuugauacuuuagaaaauauccuaguguuuucuguaguguauugucuguguucaucccuuugucucauugacuuaaacugcaggacccagccuauuuuugucuggcauucugcuuacucugaaguugguuuuguguacucaguuucuguuguuguguguacuauucauuuauuaaguacacauuuuagaugacagccacuaauagaugcuuauuuuuguuuuguuuuuguuuuuuguuuuuuuuaagaaccagauugcagaccguuuguaaagagccucuuuauuuaacauuuguauuucuguaacacggcuuauaguccuggcuggcuguuuucacuuuuugugauuauggucaggaauuagacacuguucucuaugagguaauaaaaucuaaguuaaaugugauacacuuugauaaguagugauacaaaaugccuuuuauuaaggaaaacuaaaaccaauguggccuguuguuuggggaaaaaaguaaauuaacagcauaagcauugugggugaagaguuuuauucagaucuuuggaguuucuuucugcacuaaguaaugauucaaaggccagguuuuguugugcuucugcuaaaaacuuaaaaaaaaaauaaaaguuuucacuuaaguauuaugucaaauuuguaauacuugaguauguagguauauuuauaauuuggggcuguggaauguagcccaguggcaauugccuagcaaggccaugcaaggcuuuggauucaacaucucuguuuaaggcccaaaacuccuccuauguuuauuuguaacucauuauacuauaugcuggguuuuuuuuuuuuaucugaacugaaucgcauauagcuaaguuuauauauuuuugugauguuuuguaggcuagugugcauucaaacuuaguagauauuggcuguagugcauuggaaaguugaauguuuguaagguuaggguaguuguagaaauacagaacuuuaagguauaagccauguucaggugaaacuaaacucuguugguugcuuucaucuugccuguuuguguuaaucacuguugugugugaauguuuuucuuacugcacauaaugugaggggugggaagcuggaaggaggcaauaaagugcuuaaauacuaaaacaacuuuucuaguuuucccuucuauguugguggauguccugcccaguguuguauuuguagaaagauaccaugauaguuuuugaguuuaugaagugucuguauggaaguauucauauaucuguacaaaaugcuucuaaaaaguuauuuguugccuagcaaaauggcucaguaggugggagcacuugcuuugaaagccugacuaucugauuucuaguccccaucccuuaguugaaggagagaaccaacuccugaaaauuaucuuuugaccuucacaugcacaccaugguuccucgugcccuuacucacacauguacacuacacacaauuauaagauaauaaaguuauuuggagacguguuaggaacuuauuggcacuauccugauuagccaacaauuuuuguguuuuguuguuguuguuguuguuguuuguuuuugagaugcagacggauuauguuucuagcucuaacuccugccuuccuaguagcugguacugugggugaagaccuugauguagggcugaugguuacuuuugagcauagaaaaugugaaaauuaaggucuuucugagcaguggggaagcacaccuuugaucacagcacuugggaggcagaggcagacagaucacugaguucaaggccagcuugggcuacagagugaguuccaggaacuaugucuugaacacgucccccccaccccacccccccaaaaaaaaggaaaagaaaaauuauuuuguguacuuaagaacucagaagauauuaguuauagcaacaaaguaauccuguaauguuuggcuuaaagaaguuauccauguaaugagccaugcuugguaugugguguguguguguguuuuaauuuaaaacucuggcuuuguaugauacacauucuacagaaacaaacuuggauauuuagcccaaggaauuuaaaauauuaaggcuuaagcuuuaacuguucauuuuuuuuuuuuuuccaaacuucugccagcaaguaggaguauaggaagauaaggucuuuuugucuucggcucaaaggaacuuugaauuuuuaucuuuucagcuagaguuugagauuccaguacacucugucaccuaauaaggccaauuucaagucauccccaacauuagcaguggcucugugucagugugcaggaccucuguuggcagaguugaggggacugggcauggcaggcacuccuuuguuccagaccuucgcauaguguauauuauugggucucuuuuuccuaaggacuuuaaccuaaaggguuggauagaggagugcaaaggacuuuucucugaugcucaucauugaucuaauaguguuuaggaguuucuccuuuaaacauguauaaaaauuaaauguaaguuuaaagggauaauuuuucuaauaucugcuaaguggugaaauauccaaacauaaggcaguguuuuuuuuuuguuuuuuuuuuuuuuaauuuuaggugguggggauuagaucugaggucucccaaauucugggcaaguacucuauuacugaacuacauucuagucuccccuguccccaaacaguuuuguuuuagacagggacuccucacuaaauacuaggcuggccaggagcuugguauccuucugaguagcugggauuacaggucuguaccaauaggccugacuuauuucaaacaagagaaaucucaaagguuaacauuuuuaacccucuuuucuccauauaccuccauaccuguuuuuaaguuuuguuuuucuuuucuucuuucuuucuggaaacagggucucaguguauggcccacacuuacguuuauagucuucugccucaguuuaccuaguguugguauuacaggugaacucuaccaugucagauuauauaaaaacuuucuuucuucuggaugguggcuuaugucuuuaaucccagaacucaggaggcagacuuuaaucccagaacucaggaggcagagacagguagaucuuugagucugaggccagccuggucuacauaaugaguuccaggacagccagagcuacauaauaaggccuugucucaaagaauacaaacaaacaacucagcaacuuucugcuuuuuuuuuuuuaauugaaagaaucuuucucuuucucucuuuaaaaaaaaaaagauuuauguguauggguguuugcuugcauguaugucuauguaccacaugugugcuugguagauuccuuuagaacugggauuauagacaguugugaauuaucauauugaugcugggaaucaaaccugaauucucuggaagagcagccagugcucugaaucacuaggccaucucuucagccccuagauacuagcuuucuauuuagauagauaaugcacuuagguuuucugguuuucuugugaaauuugaggauguuauuuuuaggagguggggagugggagucaggcaugauccuaccaugaagcccaugcuggccuugaaucaccacauaguuuguguuggccuggaguucuugcugcuccugccucugccucuggaguauugguauuacaguugugugccaucauaacuagccagguugucaacuuaaacuaguuucuaacuucucccugugagaaaacuaaauaaauauacuuaacacuugaccuguaaaguggaaguucugauuuuccugugugauaaaguaaacguccuuuggaaguuuuaucuuuuuaaauauauguuuggcuuuguagaguuuacugcugagaucacuuuguuaguuucugaacuauugagagaugguacugauguguuaguuaaagugaggaggguagaacggaaagaaaacccaugaauaaccuggaaggcuuagcagugucuaugcucauuuauuuaguuauagauauaucauguccugagucugaauggugaauacuguagcuuuaaacuaauuuaccagauuauugauaggaaacacauacuuuuuuuuuaaauucuuuuuuuucaagguuuauuuauuuauuuuauauaugugaguccacuguagcugucuucagacauaccagaagagggcaucagaucccauuacagauaguugugagccaccaugugguugcugggaauugaacucaggaccucuggaagaacagucagugcucuuaaccccugagccaccucuccagccugaaacacauacuuuuaaauguauauuguaguaauguuuauuguaauauucccuguaguaauauaaacugaauugagaaaaugcauuuucucuacuuaaaggaaacucuguaaaagcuagaagcucccauauuuguuuuauuuauuuacuguaagagcugugcuauaguaacauuguuuguuauucuagguuugauuuuuuuguuuguauuaaaguugcaauucuacuuucccauuuuaccuuuuuuuuuuuuuucucagcauagagaauugaacaccuugccccugcuuggaaagcauucuaauaaugagacauaugucccaaccccuuuuuaauauuugaacuuuaaaaauuauuuauuuacuuuguguguacaugugcacauacuuguuugcaugcacaugccauagcaugcuuaugcagguuagggaaccguuuggaaguucuacuuuguggguucugggaacugaacucagauugcuagguuuucacuggcccuucuuuaugauuaauuuugagacaaggucucacuaaguugaccaauguggccuugaacucuguuuguagaccagagaagccuuaaacuugcaaucuuucucuuucaguaguuugaguaacuaggauuauaguaggcucagguaaaguuaacuccccacccccacucuuucucucucuuugguguuggagacuaaaccuaggccauuauuaauguucuaccacugagaugcauccacagcucuguguuuuaauuauaauguuugcugaugucgguagggguuugguuuuuucuuuuuguuaaugcaguuagggcuuaaucacugaguugcccaaguuggcuuaaaaacuucuagacucaaguaagcucuguagcagugggauuuauagguauaugccaucauggggucauguaguuuugcaauggucuagcuuaaaauaaauccgugugaauccuaaugguguaguuugcaugaauggagacugcuggagagcaggacacagguacuuauugguuaucucaaccggugccuuucagugauaggccauguuccuaucuauuaauuguaaaguaggagagucuguagauagagaaguauaugguguuuucagguuggagccccaagcucagaaucacggaggcagacuuuagauagcaggaaaugauuuguauuuugucuguuuuucacauaggcaacuccaugugacaagguuggguagagccuuaagguuguuuaaaauuuuguuguuguuuaaaaagaguuaauuuauuuaauacuugcuaauaauucucccaugaaauucuaaaaacuuggcuuggggccagaaagauggaagugccugucaucggguccgagaacuuaaaucggauccccagaaugcacacaguggaaggaaagaucugacuccuguaaguuguacucagaccauacauguacagaguuggcuuguucuguaaaauaaccuagcagugguaauucuaacuaacccagauuucaguguuuuuaaaagguuauuuauuuauuuaauauaugugauguaauuauauuuguguaagcacuuugaaaaggccagagaaugaucuuggugccuuccuguaucauguuccaccuuauucuuuagaaguggggucucucacugaagcagaaguuugcuuuuuuagcuaagcuggcuggccagagagcucuuggauuuguagcagaagccugucuguacccacuaauagaggaauuauagguaugaacaucaguccucagauuuguuucugucugcugggcauuuaaguucaggucccaguguuuggacuagcauucuaccucacagagacauuuccccauccucuguccccauccaccgauugccaauuuuuauauuagggacaaugaaguaaugucagugagaguggaaaagcugcaauaauuucuaccaguuggaucucuaguuauucuccaacagcgagacugccuugaguuaguacuugugggcauagcucugaucuagguagauagcagaaacgcauaugagaacaguuccagauaaugugcucucccuuugcuucagaaagacuucauccugaaccuacuacaguucuagcuaaauagguguucagugagaaccagggauuguugggcaucuuuaauugguuggaguuuugaugccacaguuugaaugagaagaaaaguaaaaaauacuaaauuuaucagaguggaggaaaugccaggauguaagcauacaguuccaauuauauauuguaguuauauuguagugagguaaaauuuggugaaaaugucaccuggcuaacuggcaguuugugagguaaagaguggugaugcauguagcuugagaaacuagguuugaggagacacaguuguuuuugauuuuguuaauuuaacauguugggauuaauuucuuuggugcuagauugcaugguacaucugguuauaugaaaauugugaauuuaccauuucaaacacuaguuggggaaaagaaucugaucuuugaguuuuaaauggcaguaaagagagaugcuaacugggcuguaagaaccuggacuugcauuauucguauucugggccauaacuaggagguggaauauuauggaaugcaguuggucuccauauugaauggcugggguaauacaauaaggaauaaguuagcugcuuggugaacugugugguuuagucucagguuagaguaguuauuguagaaaaaaagauuuuaaaaguagugagggcugucaagcuggcucagcagguaaaggcacugccacuaaaccugacaaccugaguuuuaucccugggacuuacaugguagaggagugaaccaauuccauaaguuguccucugacagucacauauauugcccccccaacccccaccccauauguacacacacacacauaacacaugaaaaagcacuaguaaaacuuggcaaauguuuaauguuaggcuaacaaaauguacugaggguuuacuguugaaaugggaucuuaggagcuuuuacaauggaaaguggcucuguaaugaggaucuaaguuguugaaguugaaauugucuugagauuuugauucuagcuagaagguggggguggguaucacagucugggacuuaauacugucauccuucuuccuggggacugcguaagaguuugcauugcucuucaguucucugugucuagugauuuggaaaguaucauucuagagaguuagaugauaguagucuauaaauuuggaacagaggggagcgauuaguuugaagauacacgaauacauuuuuacaaagugauuuuauuuuauauguaugaguguuuugccuacauguauauauaugcaccguguguauaucuggugccugugaaggccaaaagagguuaucagaucucuugggacuggaguuauagaugguugugaccaccugguagguacuaggaacuaacccaaguccucuguaagagcagcuuguacuuuaaacugcuaauccauaucugaacuaucucuuuagccuccauuuuucuacugauuuaucuuguuggaauuagccuuuaggauuuuagacuaugguacucuaacaauaguuccacaaauaucuuuccaugucuuugcuuacauuaaugaugauuagagacacauagucacacaaauacuugaacuuuugacugaguuuuggaauaauagcauauaucaaccuagaagaccauuaacagaugaauggauaaaggaaugcauuauuuauacacaguacaguuuaauucagcuuuaaagacugaccaaauuuguaggaaaauggauagaacuggagguugucauguuaagcaaauaagccacacugagauaacuauugaguguuuucugucauauguaaaaucuagguuuggagugugcaugaaugagucagucuaucugucugucugucaucugucuaaaaccucacuggggcuugggguuuacugagcgggcuaggcuggcuguccagcuagugagucacagggauuugcuuaucucugccucuucagcacuaagcuuacaagcuuuuuacaagugcucugggguucucauguuaaugugguggacacuuuuaucaacuaggcuaucuacucaucccugacuuuauuuuuaguuuauauguuuuaggaccuagcacaaagccuagcucacaucaagauuuauaauaaguguuuuauuaaaauugcagaauuagugcuggugaaauggcucagcaggguuuuuuaaaaaaaaaaaaaaaaaaaaaaaaaaaaaagccugauaagcuguccuguauccacaguaaaaggagguaaccaacucccaaaaguuguccucucauaucugccauggcacauuaaugugugccugcauucccacacucucucuauauauacauguacacaucauacgcacaauaucaaaugaaguuaaaaaacccacagaacaacauugcuggugaguggaguggauuugugaguucauguuacauagacauuuucauuaagcaagguuguagucuagugaagcagccuuugaauugcugucugucuacaguguuaugggaauagcuccauuauauaaagcuaaaugucaugaugauuuuuguuaaaguagaguauucuugcaguacauuagagaguauaccuuccaauuaauacaguauauuaucagaauuccaaguggacaauaauaaggauuaaguacuuuaauccagaaccauuugcuagucugggagauagguagucauuuguacuuacagacuaguuagggaauuaaucauuuguacuuauaaauucuaacuuuauuuuggucaggauguuuaauuuuccuggugacauauaaaaucugauuuuuuccaauguaguacaaaucucuuaguaauccaagaguuuuuuuuuuuuuuccuucauguguagaguaagcuacagaauagugauugccagacaagugugacauagguggaaagcgaggucauggaaauggguuuagggugaaauguaagaucucuauacagcagcaguggaaaugguggcuggaguuucuugcaucugugugggagaauaauguagguagguuggaagcuuccgucuuuaaugaagauuaucaucuguacuggugguauuuauuugaaagaauaugaaacaucucaguuauauauaucuucauccauccauucuggaauuuugaaauuucauuucuuaagugaaagguagaaauagaauagucaguggauuuuagucacucauauuuugugcccugugugauugauuuaguuuguauuugugagaggguuucuuagcuucucuucagauccaacugucuuuauuauuuuguuuauaagagucuagauuauuuuuugaaaauggauguguugaaauaugcuuuuuggggucaucuacuggggcaugagcagacuaugggcacaccagcuccaccccuucauuaacaaaaguaaguccuuucuuuuucuagacuccacccuuucuucuuucugucucuuuuuucaguacuuagggucaaccugagggucuuacacaugcuuguuaaguauucuaacccucagauacauaucaaggucauuucuaaagaugugcgacaaaagaggaaagaaauaccuugaaugcggggcauaguaccuaaugaauagaaaaaggaggaaaugaaaaagccaacgugcuacaggcauuuguaaaccuauuagccaucaauaugaaggaagcuguuuugcuuggccaugcuuacuccacaguaggagacucaaaccucugaagccaugagccaaaggaguagcagaaagccucacugcuuuauuuuucaaauauccuccugggaauccuuaugaauuuuaaaaauaacacaaauggcauuccuauaagucacauuugaccaaaguauuuuaaaggcugcauuuuguuuuguaauuaaaaauuuaaauuguauuuauucauuauauguagcucugaguugcauagggacacuuucauguaacuauguauaauauauugagcauauuuccccacuacuuuaucuucccauuaaugucuuugcuauccuagauaguuucacuucuauauuuauggcauauauaaauauaugauuuuauguaucauucucacaaauguaagaaguuauauguuaucaaccauucugugauugggguauauguauuuucucuaaaugauauaauuuuauucuuaaaaaaaagaaauaugcuuuuaauuauagauauacccuguuaucuugaaguuucacuuguaacugugagauguagauaguugauucuagaugauuugacugguuucuagugaagaaauagauacugguuucaguuugaaguuauauaguagaaauggugugucuaagugcauuaaaauacucugcaauauugcugaaauauaggacauaguucuuagaaggcuauuuuuguuauaugagagagcacuuuuauaagugcuguguaauauuucaagaucagagugaauauauagcagcauaaagaacauuggucauggauauuucuugaggcaaagauaaugauuuugaaauuacauuguugaacuuaauugucaacuugacugaauuuggaauuacuuaggagauacaacucuggggaugucuguaggguguuuccagagagguuuagcugaggaaggaagaccugaaugugggugcugccauucuauggauugggguccuggacugauugaaaagggggaaaaaaccccagaaaggauacugaccaucaggaccccaucucugcuugcagacuauggaugaauugugacuaguugccugaccuuccugcacacaucuuccugucagugguggacuacacugccaggccacagcagugaaaguauuagaaauaucuugauugcagcuaauuuucuugaggcauuagaaauguaccagcuuuaguuuguccuuuaucuacccuuucauauguuguaauugaguuuucuauaacuaggaagauuuauuauguuaauauuuuuguuaauuuuuuucccauucuuaagauuguguuaucaacuuuuuuguuuggauauagauagagaaaaaaauuuguuaauauaaagugauacuauuaaccuaccaucuguaggcugaguagcuaggauuucaggugugcacaaucaugcauaguuuauuuaguuacuuauuuucaugauguuuugcaguacuuugauugaaccuaagccuucucacacaugcuaggaaaguacucuguccugugggguuaagugguugaacucaguuuucaggcuuggugggaagugccaucuuaccaucccuauuguguguguguguguauauguuaacuguguguguuaaauuguguucacaauuuccucuggaccuuuaaaguguuagguacugagugcauuuacuguguacuuuauagaaauucagauuucugaaaucuguaacagggcaaggaagcaaacugcuguugauaggcuuuucuguguaaaugaaauaaaauagcagaagagaaagauaacuuacuugauaaagugcagaguggagugauuuaauauaguuacaaugcugcaguaaaauagccuuaggauuauugcaucauuguagccuccccuaaucaagaugcgaggcuagggagagaaauuauaauaguucaaguggaaagauauaugacacauggaaaaacuugggcgaucuagaaacuuuccuucaccagaaguugucauuuuccacugaccucagauaaggaaguuucacucugcacuccagguuaaauguguuucuuuugcuauuauuaggaaacauuucuacaugggaacaccuuuaauaguauugucuauguuuggagauaaaaggaguuuggguuggcaaaguuuuucuuuuuaucucuuuuucaguauuggguaucaaacuccagucacuguggauauuaggcaaguuuucugccauugagcuauauauauuccuggccucugguugucaucuucugagcccuuccuguuaacuucccugcuguuuguugggccuugcaugguaaugcauaaguagugaaagggaugcucuagcucugugcuguuuugguuuugguuuugguuucuuagucauuagaagauugaucaguagcuauuuauuguaacuuuuuaauauuuguauucucagaacuuaaaguaaagauuagcauauacacuauuaagugugcucaaauuucugagagagugugugugaggagaagcucugaagauuuauguuguuguuauuuuuuuuuuuuuaauugacccccuuaccauuuugagugguacucaggaucaaaccuaagaauucaggaugcuagcuaagcacuuuaccacagaggugugccucagccguacuguaaucaacuuuaaaauagagcagauuaccguucuugcuaguguauuuauuuugcucauuaaguacuuuuacauggucuuuuaauuaaagagguagaguaaguuagacuuuuuuuuuccuauaagaacuaaguugcuuuuuaaaaacaacugugucuuuuuaucugaaaguacauuuuauuuugugcauauggguguuuuuacuggaaaguauguuugugcacuugcaugucugaugcucauagaggccagaaagugucagaauacucagaacugguguuuacagacacuuauuagcugcagugcaggugcuuggaaccuaacuuguauccucugaaagagcaggaggugcucuuaacugcugagccaagucuaaucccugaaagcauuuggaagcauguauuuguucauugaaaaaaguagccuaaauggauaaauauguuguuguuuugagacaacuauaaccagauuguuucaaccucaucuuccucccucagcuuucuuuaugcugguuuauagauaucucucacaauguuuagcaguuauuuuuuaaacaauaacuuacuauauucuuagguagugcaugcuguauaccauucucaacacucaacacacauacauuuaguccaaacaaugucacuuuuagguauaaguacugguaaaucuauuuuuuuuucaaaugggaaaacuaaggcauaaugaaguagguaguucagacaguugugaaugcugcaugauuauuuugcaugaaaauuuccugaaaugcauucaugauagcaguaagauaaucccuccuuuaucuugaaaguagguauagagguuuauaaaagaguaaauuuuaugccaaugccaggauuuuugaaauucuguucacugaaauguguuccauaggaccacauguuuuucagugauuggauuauggcucuuaaucucuaaaauguaguuucccuuugcauggaacauuuggauagguucauucauuaauuauuuauauugguguuuaucgaucaauuuuucuuuuuuggagauagggucuccuuauauaucccuggcugguuagcacuugcuguauaaaccaaagugacuucaaacucagagguccuccugugucagccucucaagugcugagauuaaagguguauaccaacaugcuguaccugacuguugucuaggugcugaggauacauagugaacagagugcuuauuuaacuugugacuguauucuaauaguggugauggguaguauauguuaguuagaacucauaaagaauaccagaguagcacauuagagagugagugaugggaaugugcacuagauuggguguucagagaacucaggaugacaaaaaaggugacagauagagauacugcacauagaaggagaaguggaggaggaugagaacggacaggaguuggguguaggggaugcaaucuccuacaaggaucaugcucagcuuuauaaacuauaguuuagacuuugagucuggaaggcuaacauacuuguacuuuucuugaauagaguuacccuguuguguaaaggauagaugguagaaggguaggaauaguaccauaaagguuaguuguuugucaugguuuugacugucaagauacuuuuuguuuuuguuuguuguuuguuuuugaggcaggguuuuucuguguagcucuggcuguccuggaaccagcucuguagaucacacuggccucaaacuuguagaguucuaccugcuucugccugccacucaacugacuguugagauacuuuugaaccuugcuguguuugguacauuuucagcuuuuggaguuucgaauuucuuugcagcacauuucuuuccuucuaggcauguaaagaaagcuacuguuaugguaguuacaggcaccuguaauuagaacugucccuggagacuuagguucugaacugagcagacaugcguucuugaugaaauuuaggcauuagugugcaucuuuugguacuuuugggaaguuuuuuccccaauugcuuuuagauugaguuucuggcaccaggaaggcuggggcucagcucagugguaaugugcuugucucagcacccaugagcuccccguguuaaguccccagcaccacaaagaugacauuagaaagguagcacuuuuaauauuuugauggucauuauggugccucugcuugcuucuaggaguuacuuguguauuuuugaggaugaugguggagagguuugauacuguuuuaaaauguggaauuuuauucuuaaauagacuguauuguaugagaagaguagagauugaagaaaaucauauugagaaauacuuaaguauuuauggggacaguuuucaugaggaggauacaagaugauuuguaagaaacagaaccuuugauuucuguuugagugugauauugcuuugccugagucaugauuucucuugguuagauugauauuauaggaaggauaauauuuucaguucaaaggcaucuauagauuaauagaaccuguuggcaaggauuaguacuggaauagaugguaaggaauuggaguagagcguuggcacauuggcacuggggaaaccaagagaacuuugccuaggaggacuggaugcaaaagugagguguguagaggccgugcuuuguuuagguagagaugugagaguguuuaacaugugccugugagaccugauggcagucuguguucuggcuuuaccuuuugaguuccugaccaguuguuaaaguauaagaacaaaauucaguugagucaguucagagucugaacugcauguagaacucuacauguagaaacaggcaguucuguggugucugacugaguaaguggugcaagggcuggagauuggcuuguauugcuguggagucaaccaugccagucucaauuaccagcuguggaaaucaagggucuacacauauauuuuugaucuauaaaaaguacguuucauuccucuuuaguauuucauuuuauguagcuuuaaaaaguauaucuuaaaggugaaugcuaggcuugaaggccaugugcugccaccugaugguuuuccuuucagcucuuuguagucacaucagagucaugcaugaggccgacuuuaugaacauaguagagcuguuaucauggccucauugauacaucacuugccuccuucauauugcuucugauuuguccaugcccuuggacuuauuacauaucucuuaaaccaccaguuucuucuacauugcuugauaauuuuuuuuaauuaauagaccuguuugguggaucagauagaaaaguacagagcaguacauagccugguaaauagcaagugcuuaacaaauuuuaauuauaauuacauucaguuuauaaguacuauuauuguggugguugaccuugguuaucuugaggcugagauuaguagucuagagaggauuaacuggguguaagggcgugauaauuccugaauguaggggguaccuaccauccaauauguugaggccuggguagaaaaaaagagaaauaaaaaagaaguguuuuuucugcucccuggccacugaugcgagucacuuugcucugucacacucucugccauggcagaauaaaaucucuugagugugugagucaaaauaaguauuucuuccuuuacgauguugucuucaaguuuuuuuuuuuguaaccauuauguaaaguuaacaagcuugcacaagcauuuauuuuacuuaaccuauuuuuaaaucaggugcuaauuuauaaaauuauuuaaaaauugcauuuauuuuuuuuuuugguggggguggggugggagcagaagccugcuguggugugcuuggaggucagaggccaacauuugagaauugguucuuuuuuucuaccucauggguucuagggauugaacuaaagucaccaggcuugguaguaggcagcuuuauauacuaagacaucuuuccugucacaaguaaguauuuaauuaaauaaaaacuuugccuaaucaggauaguccuuuuccuucuuuauacauaguaaacugucaguguccauuaaaaacaaacaacaaagccaaaaaacaaaauaaaacccuacaacuaaaguacuuaaaaaauaaaauagcucuugguaguuuugggauuuaaauuuuccuucuuaagauguaaaauguucacauuuguacauguaaaauguacaguuuuuuuguuucuuuuagccagauuuucaugugaauuuuaaaauacuagauuucuaaaauagaucuggaaggaaagaauuagcaugauuuuaugaauaugugaugaacugaaagguauucuuacuaaaguugagggaaaaguaaaaaugcucucauuucucaugguuugugguaauccugguuaguauaguaaguuaaacagauaaggcuauaaguagaugagaaagagauuuaaauaggagaaacagaaacagugccagggaagaaaauaaaaaaaauauuuucacaaguuuuuaugcauaaucacagacuuuacagguucucaccagagaaauaaaaccaauaagaaacagauaaauggagcuggaugaucuagguaugugaggggguuuaucagaggaauugacuuguuauugacuacgagaagucucaugggaggccaucaaagagagagaaagggagaaaaaugcaugcaggauggugagcuggugauguucuccuguguuugucuuccccacucacauccauaacucacauggcagucucauagaaacacccagaaauagcacuuugacugcucuucacguuauuuuguuuguuugucuguuuguuuagagauagauguauuuauuuauuuauuuauuuauuuauuuauuuaauguguuugaguacacuguagcugucuccagacacaguagaagagggcaucagaucccauuauagaugauugugagccacugugugguugcugggaauugaacucaagaucucuggaagagcagucagugcucuuaaccucugagccaucucuccagcccuagguuauuauuuuuuuuaaauuaaauuaaaaaacagaaacaaaaucaaguuuaucuuacauguaugaguauuugccugccuguaugucuguguauuacaugggugccugguauacucuggaacucagaagaagggguuggauucccuggaacuagaguuacaaacuguugugagcugcccuuuggguacugggagucaaaccuuaguccucuggaagaacaacagcuagugcuuccaagagcagagcugucuuucuugcccuaucucuagauauuuguuaaucuauucaggggggcacuauuacagaggucuuuugaucucauguugguguucuuauugcagcagaaaaaaaggaugcauuguuguuaaaucaacacuaaagaaacuuaaugucuuuagugacuucuguaacauucugcaaugcuccaaccugccucagccuccugagugcuaggauuacaaguuuacucagcucuguugcacaaaagccacgaugaaaaccaacacagagcuuaucuguguuaaacacagguaccauuugaaaacuggcuuuuggauuauagguuguggacucuuguaaaauuuucuuagcaguucuuuuaccuagaagcauaggugguccuuagcccuguuaauacucuauugaugcuuaaagcaauucuguaggggguugggggaaagggaaauagcugcugauugaaguuuggaauuucuucaugaagaaaaauugcaaugcuuccugagcuugaauguacauauggaugacuuuggaaaucuggucuggacuuagauugugugccuuucuguuacugugacagaugccugagacagucagcuuaaggaaagaguaguuucuuuuggcucaugguuucagagguuccagcccaugggcugauacagucauuguuuuugggccuauagagcggcggacagagcguucugauggaacagagugcucacgucauaguggccaggaaagaggaggagucacaggagguuuggggucaagguaaauaugcuuauuaaaggcaugcauacucccaaugacuaacuucuuuaaaauagggcccaucuuccauagcuccauccaguagucuccucaacauuguaaaucugucuguggcugagagcauugguuaggucagaguccugaugaucuaccaguaucuggaaauuuccacagacacuguacaggaucuguccuaaccgucuggaugucucucaauccaguccaggcaacauucaaaguuacuuaccacacugaguuauuugggagugccaguagaugcuguggagugcuccagaaucuacccuguuaacauuuucccaguguguaccuauccucuugcccuugaaacaacuuagacagugagguuucuugugauaggaaaaaucugugcauggaaaaguauuuguguaggauuaaaacaucuacagaauuguauuucuagguucuacaaauguucucucauacuggaauugauugguacuugaucuuuuauuuuugccuacuucuugcuuugucuuguucaaaauggagguauuuaggaacaacagauuauugaaagaugggcuaauaguuuauuagaagugauuagaaugcugauaauuaaauuuugagagaacaaaugggaacuuuuguuuuuugaauugucugauuuuuguuuuuuauccuguacuuuaacaaguaugaauaauuaaaagcaaauuuauauuuuguuuauuuuuaugugcaugggauuuuuuucugcuugaaugucucuguaucaugugcacaucugguguccuuaaaggccagaagaguguauaggauucccuggaguaccugccaugugggugcugagaacucaaguccucugcaagagcaguaauucuuaauggcugagccaucucuccaguccccuguuacuauuuuuucuaucugaaaauuuucuuuuaauauuucuaguuguauaggucuguuauuaauaauuuagaaguuuugauaucuaaacaagucuuaguuuugaccucuaagacccuuuauuuaacugcuuaaaggaucuugggcuaaaaguuucaacuuuaaacauaagugccuaccuugugauuuauacagaguugugucuucauucuucccuguguaucucuuuguggcuuuuguuguuguucccugucccaguuuauuuuaauauuuugaccucuaguuuucacccauuagucuaugauuugacuuuaucugguuucuuuuacauguauucuuuuuggcuuacuguugacuuagauuuuuacaugcacacgcgcgcacacacacacaugcauauauauacauauauguaaacauauguauuauguguauguacacacacauacacacuucuuuguuuuugguuuuaugagacagaguuucucagaauagccuuggcuacccuggaauucauucuguagaccaggcugaccuggaaacugccucugccucucaagugcugggguuauagguaucccaccaaugggcuuaaguguggcuuaauuuuaauaucugcuuuuacaaccucaucugcaaauuucaucaucucuaacauucuauuacuaaggacuaauuuuuguuuuaguuaugggagaauauguauacacacauauauauguaucguaauuguuggauaaagaaauuccuauuuuuauauuuggagguguuucauuauaucuuuaaacauauucagacuuuucuggcaguuaagcuacuuggaaucaguugaaucuaauuuguuauuuaaauuuggaagaaaauguuuauuuaagcuuuguuaauauagaucuagaacagcuguuugacuauggcuacuuguaccccguuacuaaggaguuacuucucugaggguuauacccagugcuuuauacacuuuuaggacuuucuuucuuggugauaugacuaugaauacucaccaguccuguguuagauguguuauggcugggcuuaguaguacauacauaccuuuaagcccaguacucaggaggcagauacagguagaucucugugaguucaggguuaacccagccugcauagugaauuguagggcagccaaggccacauggaaagacccugucucaaaacaaaaaugaaaaaaaauccaagaagaauuauucucuucuucucuggugguucuuauuuuuuugugguggaauaauuuauucuuuuacauucagauuauuacucaucaaacaauccagguauuacaacucuuuuuuucuuggcaacucugucccacagaucuuaaauguuuggccucacugaacucagcuguuuagguugcuucuuggaagcugugggcauuuggaaaagagcucaccucauuuguggcuuugucaggcuucucauuguuagggugguuggauaaauucuguuugucuuuauuucauccuaacgagaacuggauauugacuuaacaauuugcaucuuuuuucuugaaucacuucaguguaaguuauggauaucauuccaauuaacucauaaaauacuucaaaaaagugucuuugaaaauucaagaccuucuguuauguaaccaugguacuguacuaaagaaaaguagcaagaauuccuuaauguccucaaagacugauucugguuuguugcaaauuauuuucauauguuuguuuucauccuggguugauuuuuuucccccccuuuuauuuuguuucuuuuguggguuugcucuaaugugauuaugcaggguuauauuuaagugcacauguaacaguucucaggagagauuuucauucuggguuaugaaaggaauuuaaguguauuuaaaaggacauucuuuggcuauuuaagaauuaaguuaggccgggcagugguggcgcacgccuuuaucccagcacuugggaggcagaggcagguuauuacugagaagaauuauucuccucuucucuggugguucuuauuuuuuguggugggauaauuuauucuuuuaaaguuucugaguucguggccagccuggucuacagagugaguuccaggacacaggacagccagggcuacacagagaaacccugucuugaaaaaaaaaaaaaaaaaagaaagaaagaaagaaaagaaguuagaaggcaauaacaggaacagguucugggauauacucagugguagagugauugcugguguguaugaggcucugggcugguccccagaaccauaaacauauuuagaguuuagaacuaaauaucauuaguauuuaaaauggcauauggaucaaagaauaaguuaggaauaaugagagauaaaaauagaaaugaaauguaacagaauaugugaguuaccucugaggcaguacugagggaacauuuauaauacuuaauacccauaaaguucacccaggacugacugccugccugccugccugccugccugccugccugccugccugccucccucccucccucccucccucccucccucccucccucuuucucucuuucucucuuucucucuuucucucuuucucucuuucucucuuucucucuuucucucuuucucucuuucucucuuucucucuuucucucuuucucuuuuucucucuuucucucuuuucaaaucuaucuguuguuugaggcaggaucucacugugcagcuccgggugugcuggugcuuguuuuguuuuguagaccagguuggcuucugacuuguagagauccgccagucucuuccuccugaaugcugggauuaaagguguguacaaccaugcccagcuuuuuaguuuauuuauaaaaugaaauuguaguuaauauguuucuacaaaacaguaagauuauuucauugauuaauuuugaccagacuugaagggggaaaugauaacuuauuuucuuuuaauuuaucuagaaaauugaagacacaccauuauuucacuuaucuuuuacucagauaauaucaauaguuacugaguggaccaggugacaaaauuggcuucaauggugauaauuucuaucagcaaaaugugauuaaugugaauuugugaaaccugauaaagcauauaagacaagccuacagcagaugcaaaagcuuuugugugugguuaaugucacccuuauguuaaguucuuguuuguuuauuuauuugucuggcuuuguuuuuguuuuuguuuuuuguuuguuuuugagacaggauuuaucuucauagccuuuucuguccuagaacucacuauguagaccagguugacucagagauccucuugccuuugcuccccaaguacugggauuaaaggcaugcaucgccauauccagccaaugucacucuuauaacaauaaguuuaaaagugugcaaaaauuauuuuugugggagauuuaucauaguagucaggauuaauaagacaguugguauauacuuauucauagauauuugaaaauaauggauaaguuaggacuaauaaguuagaacuagaaagagccuucaaguugguauuaauucagacuguuaccugugugcuuguuuuuauaggucaguauggaaauccuuuaaauaaauauauuagacauuaugaaggauuaucuuacaauguggauucauuacaccaaaaacaccagcgugccaaacgagcagucucacaugaggaccaguuuuuacuucuagauuuccaugcucauggaaggugaguaaauucauugcucucaguaucugaagucuuuugaaauagucugcuaauggaagaaacuuuuuauccugauguaaagcuuccuguuugaauauucauccucaaugaauauaccacauuuuuuauacuggaauuugguauauacauuaaaaaaugccaucauuaaaaauggauugcccuuuuauguauuuaagucacuuguaaauguuuuugaauugugacugugaggucuaagcauggauauuuuuaaaggguggucacaggaggauaagagguuguagaaaaugugaggagccauagacagauaagacauacuuuauuuaaucaguaacauacagguggcuaugaagagagaugcugaacugaggcacaaauugcacacagggggacacaugcaugcaugcaugcacacacucaucuggcacaucggccauacagagguggggcaguggcagacacacauaggcauucaccuuugaucuuaaggccauauaucacacaaaauggcacucugcuaggaauaguuauauaacagaugacaucacauuuuuuuuuaaucugguguuagccaugggugucagcuauguuucagcuaacucauaccagauagccauauuagcaacguguuuucuaaguauuagcuagcccuuacggcuggcgaggauguggagaaaggggaacacuccuccauuguuggugggauugcaagcuuguacaaccacucuugaauucagucuggcgguuccucagaaaauuggacauaguacuacuggaggaucccgcaauaccucuccugggcauauauccagaagaugucccaaccgguaagaaggacacauccuccacuauguucauagcagccuuauuuaugauagccagaagcuggaaagaacccagaugccccucaacagaggaauggauacagaaaaugugguacauuuacacaauggaauacuacucagcuauuaaaaaaaugaauuuaugaaauuccuaggcaaauggauggaccuggagggcaucauccugagugagguaacccaaucacaaaggaacucgcacaauauguacucacugauaaguggauauuagcccagaaacuuaggauacccaagauauaagauacaacuugccaaacgcaugaaauucaagaagaacgaagaccaaaguguggacacuuuacccuuucuuagaaaugggaacaaaacacccauggaaggaguuacagagacaaaauuuggagcugugacgaaaggauggacauucugaucuuuuaauguacaauucagcuucugccucuuccauguucuuuugaacuuuuaaauuccucacuguuucauugacauuugauuugugcucuccuuccuuucauguauuucuugcuuauuuuucuuuuuuuuaaaaaaauuauuuuauguauuuggauauuuggccugccuuguauguugugcaucauauaugugucuguuacccauggaggccagaacuagguaucaaauucccuggaacuggaguuacagguguuuguguacugcugugugggugcugggaauugacuucgguucucuucagagcagccauugcccuuaagcacuuagcugucucuuuagcccugcuuguuuucuguauuguguuguuuucuucuucacaggcaagcacuuugcuauuuaguauugcucaguauauuucauaucugaucuagguguuuuuggaaaaauguuaauggauuaaucaaaagauuaauuugaagauguuucuuuauacuaaaaagauuagggcuagcaguuuacaacacuaaauaaaauuuuaugacucuuaguuuuagguauuauuaaaaaucauccauucuuuauuaguaccauaaaauaauaauaucauuagcuuuucuaacuuuaguaaccucucaaaauaaacuuacuacugugucuccaaauauauguacuauugucuuccucacuaaacagaggaggagauuucaguagcugccuuuguuuuggaugccacauuguuguauagguagauuuuuauuagguaaguuacauauuuuauauuugacaaaccaaaucucuaguucuuuuaugugucugugagugagaaugaguaaccaugcaaguaugcagucaucuacaaaauaauuugauuguuggcuaaaagugaucucuaugauuuaagccuuggcugauaggaccauaaacauauagcuaauaggaauaguaaguaaggugugcagaagucacuucacagaagggaaacuugcugugguguuuuggagaugaaauacugugggaacuuacaggaggagcacaucuuauugaggugaugguuugaugguguagcgucuccuuuucuuugaaauagaaaguacaaagugaugaagcuauguaagaaauuauagauuucuuacuagaucuauuauuuccucugacuuauaagaaaugcuaaaaccaggugugaugcuacaugacuguaaucuagucccuguacucaagagacccaggaaggaggagcucauguucuagaacaauguauucuacagaacaagauccugucucaaaaaacaaauugaaauacuaguuaggcacaucauaacaucucuaauaggauaugcaucuguguaaagaguaacuugcauuuuacuuuucuaaaugauccuguguguuucuauuggauaaugaguacacuauaaggaagacuuuggcuuacccuuaacuguagccacaucuauaaacauugacugucauaugcauuguggcuagaguacuuaccugcuuuuucagccuuuaaaagauaucaauaaguuuauuuaucuuaauugcaaaccagggcccagucucucagaaccaggcaaauuaaucaauuauggaacauguugaauacagaacaguuagcucacauacauaacgauuuugcuugcacugugucuuaggguuuucauugcuguaaagacauaccaugaccaaggcaacuuucauaaagaaaacaauuaauuggagcuggcuuacaguuucagagguucaguccauuaucaucaugaugggaagcauggcaguauccaggcagacaugguacuggaagaggagacuucuacaucuugauccuacagccaggaggagacugucuucugcaggcagcaaggaggaggcucuuggcagagcuugagcauuauauaugaaaccucaaaguucugccuccagagugacacacuuccucuaacaaggccaugccgccuccaaugaggccauaccuuguaguagugccacuuccccuggcccaagcauauucaagaguuuauugaucuuauuugaaaaccugcauuaugauuagacaaauauugcauuguauuauugcauuaugauuagacaauuaugauuugaauauuuuagaaguauuccagccccuguguguucaaauauuaaaguccuuuuuuauaaauaagcauaugaacaaacuuucaacuuugcuuaauauuaagggcuuuuuuuuuuccaggccaggaauagguaggcgguguacuccuuuaauaccagugcucaggaggcagagguagguaggucucugaguuugaggccagccuggucuauguagugaguuacaggauaaccagggcuguguagagaguuccuguucccaaaaaccagaccaaaauaaaauacuguaugugugugaguguguaugcaugcagccuuuuuucaagucuaagauuuuuuuccuuucucccuugaggcagggacucauauauguuagucuggucuuggcugaacuugcuacauagccaaagaugaccaucaacuucugaucuuccugccuccauauccccacuguugaaauuauaggcauauaaccauaccuggcuuacgcaguguuggggcuugaauugaggucuuuguucaugcuaggcaagcacucuacuaacugagguauauaaccagcccaugucuuugugguuuuuugagacagggucucacucugcaucucaggauagccuagaacugaagauauagauaaugcuggccuugaauuuguggcaauucuagcuuccuuagccuucagagugcaagaauuacaggcaugagcuacccugccuggcuucuaagcccaaaauuaagaauucuacgaaaaggcauugguuuugaaagaguugaaaguuugugaaaagugcgacuugagccaguacuacaguuguugaagaagguauuuuaaaagaauuuaccaauuagguacuaagguaaaauacaucaaagauaauuugcuuagaauaauaaauuuucuggauuucugaaaugauuucauuuggauaaaugggauuguuuaguuagugcuauauuuacaucaauuaugacuuuuuccuuuuuugauuauuuuguuuuacuguguccaaaugugcauaucuucccuuaagaacuugagguacagagccugagucuuacuuagguuuuuacauaugguuguaaugaggggaaggaggggaggagaaggaaggaaugaauaugaaaauauccagaauaugcagaaauggcaggucuaucauauucuaagacagaauuuuucuaauaauuuuggauaauuugugcuucucaauccuugucuucauguaauaguguauaauguaccagaaacuuguuuuucuauauuccuuuuaaauacuagcuggagacauguugcaucuugcuauaacuaucauagaguccuaccuuaacuaucauguuccgugguuugacuaccaugcauuuuaggcuucuauaaugccaauggacuauaaucuccugaggaauuuaauugaugugguuuguaaaaugugguuugugugcuaccuuaaaucucauuuaagucuugguuuugcaguucugcauuuugugauguaauaacuccauagauuaguuggauaugucuugggcuuuguuucugccauaucaugaguuggguagcagaaaaacccaucccuucaaaagcauuuauuuauguaguguguguguguguuuuguguguguguuucugcacaugcauaugaagguaggagaacaauucuuaaggaguucuuuccuuucaccuuuacauggguuuuaaagaucaaacucagguuuuaguaagauuuguguuuuaugagcccuuagcuguugaaucaucucagcaacuuuuuguuuugugugugugugugugugugugugugugugugugugugucuuuguaagagacaaggucuggccuugcacuaacagcaguccuccugccucugcuccuaagagcuguuuuauuuacguuuuacuauguaacucagacuagccuggaucucacuauguagcauaagcuggucugguacuuaccuuguaguucagguugcccuugaacaaguguaaucuucuuaucucacuuuuauaagggcuauacuucuuuuguguuuguguguaaguguacacauuuguacauccauguuugugaacaugaauauggaagugagaagacaaccuuggauguuguuccucagguguauccuaucucuuuuuuugaggcauguuauucacuggucuacaacuugucaaauaggcuaagcuuguugaccaaggagccuaagggauucauucuccugucucuguuucccauugcugggcccagccuuuucuucuaaaauggauucuggggaucaaacucaacagauugugcaugccuaauggaccagucagucuaggaggaacgaucucuguuaauucuguggugauaacagggagccagugacuuuugauuuggauaauuucuuccuuauggaaugaaguaaaaacauauuuugcuugacccugguaaagacguucuaucuauguauuugacucccagcuguuuuuuguuuguuucuuccaauuucacaaagagcuuacucucacuagucaguaacucuuugauuuuaucuugaaggccuuuauuguugauagaauaaauauggugaaagugggguaccuuuggcagguggugccauugugugcuacuaagaaauuaugccaagcaacagauuuaauguuggggaggagggagagugaaaggcuguuuaggaguggggacaugagagagaaacagagagauagggacagagagaacgaacaagacacagaaugagagagauagaauaaaggagauagaggcaaagagggaaugggagagagagauguggggugccugggaccuuuuuuuguacugcacauguugcauggguggaaaugccuaauugcuaacacuggucauuuugcccagacugauauuggaugacauccugagacagaguauucagccuguuuuacuucuuugaucugcuucuuuuaggcuccccuuauuuacacauuuucaaauuucccacuauugguuauacuuuuucauucaguccuuugauuuuugauuuuugcuagaaggccugcauuuugccaauugugauuccuuguacauccuaagcaggcgaucuauaacuugguauggugagaaggccguuggcuggcuaaauacagaugacuggucagacucagacucugguuuuacuugugcuauauucauguuacugugcucugacuugugaaauuauuaaguguauguuuuucugcuuaauuuguguuuuuuuuuuuuugccuuuguuuacagucuguagagccuuagaacucuugugaaugauacccaaggugcacagagugauucuaucuuguacuucuacaaaacuguucugcuuauucuuuauauaugugacugugaugcauaguaagcuuauaaaaggagauuugaaaaaaaaaaccuuuucuuuuuuuuuaauuuauucuuuaaaguccagacuuuaucccccuccugauacacccuccaacuguuccauaucccauaccucccccuugcuccugucuccaagaagauguuccccacccccguuccaccagacccccccacucccugggaccaacuuuucuauuuaaaaaaaaaauguuacugcacuagugaauggcucaguaaagacacuugcugacaagccugauagccugaguucaaucucugggacccacgugguucaaggagagaacagaaucucagugucuuccaaccucuacauguguguacucacacacacacacacacacacacacacacacacacacacacacaaguaaaugauaugaaauguaauaaaaaguauacuagugaaagcaaacucauaauauuugaugcuuauauuggcaacuuaccuuuuuauucuuuuaaaauuaguauguaagaauauuuuuguuaaaaccuuuacccgugagcaucauguguauugcucauauucacuccuacaauagaaauggaaagaaaauauagauagagugacuaucucaggcaucuuuauaagaagacagagaaaaugaacgucuggaaauggcagacaugucucuugaaugccuugugguuuaaaugagaaauaucuuccauagguuuauguaucugaauacuugguuccagcuggugguucuuuuuggggagguuauggccaucuguuuucuuuucagaguugcuuuacuggucuagguccuuugcauguccaucguguuagagcugacuugucagcauuuacagcaaaacuugcuauuuugauggagacugguauaucuuuagauaacucggaaaguugauagcuuuuuggaaggcgugcuaagucuugauacucaggaccucauguccuaagcccacugugugcuaagcacacauucuaccgcacuguacacccagcccaacaacacuacagugucuucauauccugaaucugauaccucuauuuauuuaagucuuauuuaauuucuuugaaauuuuuuucuaaagagauuucaguguagagacaugauacaucuuuuguugaacuuauuccuaaccacuuuaaaaaugcuauuguacagagagcaaauugucugucuuagaguuguaccauuuaugguguugaccugggagugaauuaaaaaugggugauguugagaaaggcaagaagauuuuaguuuagaagugugccacaaugugaaacgggaggcaagcauaagacuggaccaaaucuccauggucuguucgggcagaagacaggucaggcuacuggauucuuuuauacagaugccagcaagaacaaaguuaccaccuggaaagaggauauccugagggaguauuuggaggaucucaaaaaguacaucccuggaacaaaaauuaucuucaccgggagugagaagggagaaaggcuagaccuaauagcuuaucuuaaaaaggcuacuaacaaguaauucuauugccuuauuuauuacaaaacaaaugucucuuggguuuuaaauuauacuauaauuuaaugcauauaccaaaauucagaucaugaauggcuaaguguuuuucuuauacaguccuaauuuaaguaaaacuggauuguaguaaagucgauauuaucuuuuuaaaaauaacaaucucagcugcauacuugguauguacugcucauccuuucucaagauaagagugaacuuaauuaguaauguucuacuuuccagaaagauggggguguuaccucaaaccauuaaauaguuuuauaauuagauuuauaaaacugggcauaugaauauguuuaaacacugggaaaguucuaucacuaucucagaaacaagaagacuuacuuguguuucaguuuguguucacuggcuuguuacaggcaaugguuaaauaucaggagggcaacuaucuauucuggacaaugcugauuuaauuauaauucccuaugucaaguaugcucuuuuaccacugagagguacuuucugugguuuuuguauaauaucaaauaaagaguauauaauauuaaaaaaauacuauuguagcugagaauggugacauacaucuugaauuuccuaguacuugggaggcagcugcagguggaucucuugauuucaaggcuagccaggguuauauagugagacccugucuaauaaaacaaaacaaaacccccauuagaaaaacucagacacacacacacacacacacacacacacacacacacacacacacuaauugcaauuguuucuuaaauuuccucuuucauguguuugcuucuagauauaaaaacgugcugguggguuuuguuuuggucuugguauauuagcccuguguuuugugacuuuauuaguguccaguaguugauuuuauuucaucuacaaauaaagguauauuuauuuguuuguuuauauauugaguuauugugcuaucugguaccuucauuuaguguuggaaagaauuggcaagugcaaaugccuuuuuauuucuaccuuaggggaagaaugauugucuuuaauauuaaaacauauuagcaauauuuugauagguuaaggaagcucugacucuuguuuucuaucaguuuuuaucuugagugagugcugaaaauuucaguugcuuuuucuacaacuaauguuaugacuguguggguuuucuccccuuugaauacagucaguuacauugaugguuuuuuuuuacacauuuuuaaaaagauuuauguauuuacuuuauguaugaguauacugccacugucuucagacacaccagaagagggcaucagauuccauuacagaugguugugagccaccauaugguugcugggaauugaacucaggaccucuggaagagcagccagugcucuuacccacugcgccaucucuccagcucuacauugauuuuuaaauguaaaccuaccugacuccugaauaagcuaaguugaccaugaaauauuauuuuuauuaaggcacuuuucugguuucucugacuaaaugccugguaagagacaguuuaaggaaggaaggauuucuccaggcucauggcuugagggcacaucaugacaucaugacacagaagacacaacagcaggaguagcucaggacaagugauggcaggagcaccaggcugcuugcuuacacuuguacagaucaggaagcagagagguagccagaaccaggccugccucucagagaggcaccauaacuaaaagauucuuuacucaguucucguucagaccacaugaucauuuuuuauauugccauuuccuucuuguccuuuuccucguaguuuguuuucuccuaauaaugcuaauaugcucccccuaauucagugguucucaaccuguggguugggaccccuuggggacacauaucagauauccuacaugucagauauuuacauuaugauucauaacagcaaaauuacaguugugauguagcaaaaaaaauacuuuaugguugggggucauuguguuguaucuuaagguugucuuuguuuuguuuuguaccuuuuuguggcacugggcuaaaauagagggccuuggcguauauacuagguagugcuuuaucacugaacuauacuccuagaaauuaagauguuaauuuacauuuuguuuuuuaaguaaagaauaaguucauauauuucaagucuagauggugcagaagaguaaaagggacaauuuccuuucauuuccuguccccagccacucauuuuccauuccagguugacccuugcuuuuaauuuccuuuuuauuuuuaaagucauuuggcauacacuuggacacuaugucuuucacacaaaaauguucuuugcagaaauauguguguguauauguauauguuuauucauaaucuuuacuauuuaaaaaauaugauauggacuggaaaguuggcacagaggguaagagcacuuuucucuuucaaaggacccauguuugagucccagcaccaaugugguagcuuacaaacaucuguaauuucaauucuagaggaucuagugcccucuuuggacuucuacaggugucaggcacacacaugguacacagguauaccugcaggcuaauauccacucauuuacauaaaauaauaaaauaaaaauagaaaaauauuuaacuguacuuauuaugcuauuuacuuuuauauuggaggaauaggggccuucuaugggagacuuagacagcgaggcucuguaacuaaggcuuccuccaugcucccuacagccguucuugaugagagagacaguucaagcuuauccauacuguuuauugacuguucaucauggaaaauggguuguauacuacuuccucaggguggacuagagauuaaauaccuuuuguagaaaggaauguucugguagggaagcuuauuggcuaaacccugagggcccaucuaaauacauuauuagcaugaagaacuaggaguguggucauguguuucaggccaggaaucugguagggagcagggaaacuccuuacaaaugagugcuuauaauuucuucuaaaguuauaaguucaagaauggguuacagaagucaggaaaaucauuuccuuauacuuuuuauugaaaaaauuuuauauaauauauucugaucuuuuuacucuucacugaguucuuuccagaucuuccccauaucucuacacauccaacuucacuuuuccccuuucuuucaaaaaacaaaacaagacaaaaaagcaagaagaaacaagaaacauaaaccuuucagaaaccacaggacaaaaucuaaacaaguaaaagucuaauaagacaaaaaaaaauggaguaaauaaugcaaaauaaaacagaaguugacaaaaauaccauugaguucuguguuaacuaacuacuccuggguuuguggcuugcucagaagugugguuaauauacacaaagagacuucauuggaggagacagauuuucccuuuguccauggguaucaguugcagauaguuucuuggucagggguaagacauugugucuaccucucccucucaguacugggcucuuaucuggcuugaacuuguacagguuuugugcaugcuacuacaguuacugugaauucauuaugugcaucagucuuguuguggcuggaagacaugauuucuuuggauucuuccaucacuucuggcucuuagaaucuuuuugcuucuuauucugcauauaucucugagccuuaaggggauggacuugaugaaaacauccuauuuaggacugagugcuccagaguuucucugcacauuguccacuugccggucucuguuaaauuccaucuacugcaagaagaugucucucugaugaaggcucugaucuauggguauagcaguaugucauuaagaguuguuccaaaacacaagaaaaucaagaaggaagaccaacguguggauacuucauuccucccuagaauacggaauaaaauauccgcagaaggaguugcagagacaaaguuuggagcuaagaugaaaggauggaccagccagagacugccccaccuggggguccaucccauaaucagccaccaaauguagacacuagugcauacgccagcaagauuuugcugaagggacccugauauagccuccugugaggcuuugccagugccuggcaaauauagaaguggaugcucacagucaucuauaggauggaacaaagggcccccaauauaggagcuagagaaaguacccaagagcugaaggggucugcaacccuauagguggaacaacaauaugaacuaaucaguacccccggagcucaugucucuagcugcauauguagcagaagauggccuagucagccaucauugggaagagaggccccuuggucuagcaaacuuuauaugccccaguacaggggaacgccagggccaagaaguaggagugaguggguaggggagcagggcaggggaggguauaggggacuuuugggauagcauuugaauguaaauguaaaugaaaaaaauaucuaauaaaaaaagugggaaaaaacaaaacaaaacaaaaaaaaaagaguuguuuuacugccauguuccuuuaguaaaauaauaguauguaguuuuuauuauuuauucuccuguaccugugaccuaucuagucucaggcucuugaccaaguuagcagugccagguauggguuauaucucauugaaugggcuuuaaauccaaucagaaagugauugguuacugcaauaauauaugugccaguauuguaccacuuuaucuuguggguaggucaccauuguagaucacaggguuuguaacugggugauacugaugauugcuuuucucuguguauagccagcagaguacauuccaguaccgugaaugcuagucauuggaguucucauaguuuaacaguaaguguugucuuuagcaauaaggccuuucuaucaaauugugaagaguagccuuggcaauagccuaugauguuuggagguuucuguaagggcccuuuggccaaugaaucaacaagaugcaaccuauuucuagccuuggagguuuuauugguagcauaagauggucuaguuggggcauuguaucuuauuauuuagugacucuuauuuguaucuauuuuagaaagcuuuuauaguaguaggauuccauaugguuuuucagugguuuaguguuaguuguacuucaccguauuccuuucuuuaccuuucucucccaucuccuucccuauuuaaucgucauauucuacuuaagccuuuugucucuuuuauaacacaaaaagcuauuucuucuuuauugagaucuucucucuucauuagucccuuacuggaaucuuguguucaaauuguagcacauauauugagagcuuaaaaccuaacauggucauguaagagaaaauauacauuuguauuuuggggucuggauuaccucacucaggaugauuguuuuuuacccacagauuucacaauuaaaauuuucuuaaugacagaauauuucauuauguaauguacuacauuuucauuauuuauuuaucaguugauggauaucuggacuacugcuuucuggcuauuauggacagagcagcaaugaacauggauaagcaauuaucucuguagugggauauagaguccuuugaguauaugcucaagagugauauagcuggauuuugagguagauugacucccagcuucccgaggaaccaccaaacugauauacauagugucuauacugguuuguguuugcaccagcaguugaauaaguguuucuuuucccucacauccauauaaagucuuuauuuucauugaugcagguaauaaauucauaccucuuaagcauaguaaucaaguacuuuaccucuuagcgauaccacaagcccuacaguuuacuuaacuaauauuaguuuguuguaaaggacgggacuuaggaacagcaaaaugaaagugacacaaaggacagauaggaguacagaacuuccaugcccuuucuugauguaucaccuuugcaguacuuccauguguuaaccacugguggacacucaccaauuucacugacugugauaaugaagugacugaacaugggcugacccucagacagccucagguugggcugaucaucagauaugcccaagugacugagggcuggaauuuuagccccagagaucuauaaacauguuacacagccccugaugaaccugaggauaugugggggccccauguucagacaccucuuuauagauuugggugugauuagaaauggacacuugaauagggaugaggacacuccuaucauccagaagaucccagaguuuuaaggaauuugucauaggaaauggggacagaggccguuuauugaagucuguuguacuggaggucauuucauuauauggaagcaugccuaagaauucuagaagaauuccuguacuagaagccacugccacugauucuuuugaucaguuuuccuaagcagauguuguacagacuuauuuaugucacaaaugaguauagugacuggugcaaauuuguaauguguuuuaaacaagguuucuuccuccuguucuacuauucaaaacaugcuugagaagauaaacuauuacaacacaucuuuguuauauuugucauaaagaucauggaguagaaauuguauugugugcagacuucuguaacaauuauggaacuaugauauacuuuuaagaguuuagugaugacacuuaaguuguugccauuuauccacauuuccugcaggcuaaguauuguacugacuuuauguuaugaucuaauccuuaaaacaauuccacaagaugggcagaauuauaauuuacuucaguuucgcuuugagacaugguuucauuuuauaguuccaccuggccuggaacucacuauauuucccaaauagaugaauuguguuacacagcccuugucuuguguacuuuuuuuuuuuaauaguaaaagaaaucauuuaggauuuggauccuuuaaauuucuuuucucauccuauuuugcagacaguucaaccuacgaaugaagagggacacuucccuuuuuagugaugaauuuaaaguagaaacaucaaauaaaguacuugauuaugauaccucucauauuuacacuggacauauuuaugguaaguuggacuuuuaucugacauauuauuugauuuuuuuuuuuuugguuuuucaagacuuuuuuuucuacacacaggaguauaaugauaaauauaggcagauagcucagaaaagguuuuguaaauacugaggagaggaaagaaaguggcagaggaagaauuucuugucauuugaugguucagagugucaagaauucuagaagauucuaagauccuuuuuuuuucuuuuuuucuuuauuagauauuuucuguauuuacauuucaaauguuauccccuuuccucauuugcccucccaaaacccccuaucacauacccccuuucccugcucauuaacccacccacuccggcuucccugucuuggcauuccccuacacgugggcaucgaguccucacaggaccaagggccuccccucucauugauuaaaaaucaagcuuaccauuuuguuggccagggaccuuuccccuagagauccauaaaggauggagaaaguguuccccugacucuguggucccugauucaacuuugauuuguaccucagugugcaaucugaacaggagucauauaucuaugagauaggggagaagagauugcaucugaucccagguggcugucuuaucucuuuagaagcccauaucuguacuuugguuuauacuguccuuucccuaaauacuucuguccccaaaauuaguugcucaaaaaccaaaacaacaacaacaaaacccaaaacaaacaaaaacccaaccuugucaaugaauuuccaacuuuguuaaaacaaaagcaaaaacaaaaaaacaaaacaaaaccaagaugguaguggcuguugguauacauucuuucugcccagccuuuccuagacuggaccaccgugugcagcagaggcacagagccuggaagagaugaaaggucuacuuagagucacuugucuugccuggcuuugagccugguauucccaugcucaaggcauguagggaauuuuguggaguuuuaaaauuuuaacuaauuaauuaacuuaauccaauuaauuuuuuucuguuuuaaaacaaaaccugaggcgguagaucaggucaucuuaggcaauggucuuugaaaaugaagucaucuguggagccacuuuacaugauguuuaauaguguaccacaacaaaaaucuguaacgcuuugacgcuuggugcuuucaaguuuaagaguuacuguuguuuuagccucuuguuuguuuguuuguuuuugagauuaucuuauuauguagucuacacuggccuagaacuagcaaaccucauaccugucucauacuuguaguugauaagacuacaggcauguaccaccacauucaaucagaguuuucaaaaaaacuuucaaugauuuuuauaauuucugauuuuccaaggaagaaauaagugggaauuucugaguuauauaaauagaaaaaguuaaaaggaaacugacaguagagaucaucuuaguucaaaacaauauaacaaagucaccuaagaaaauuuucccagguucuuucucccuaaaauccaugugguuuguuguuguuguuugguuauuuuacacuuguaacaaauaucucuuaagaguuuaaaaugugcugggaggcacagacacauacuuaaucuaacaggaaggucaccagacagcaaagugggacagacagggaagucauaaagaaacuaacauaauucagacaauccucaacuauuaacucaacaguggucaacaauuuccuucuguaaaugagauuuuuuuuuugcuugaagucauaacauuuugaaaaauuaaaugcuuaaagagaaacuuuuaauuuuuuauuauacuagauaaaugauacaugguuuuacuuaccuguacacuaauguuacuaaauuuuagugguucuuugcagucuucuaauuguaaccaaggaaaguauuuuuggcaguuucuaguacucucuuacauucuucaucacaugucuuacugggcaaacugugcugauuuuguaggugauggucauaaaaaauaaaaguauaaaugagcuuguaaagaaaggugaugccauuuaaaauaucucagggaugagauuugauggcacacaccugcaauucugauaaucuggaggcauaggcaggaggagcaugaguucaaggccagcuaagucuacacaacaaggcgguuucaagaaaaguacagauuuuauuuucagcucgugauuuauuaaaaaucaaccaguguuaauguguaacuuagaaaucuugagaggucgggucguguuauuucacgugggugguguaugugcucagcauguaucaggaccagacaauuuggccccuuccuucuccccaaauuacagaaaauccuaugaggugauuucagccuugucuuccucuuuccuccucuuccuccccuuuucuucuugucauuucucucucuauuuuccacugcccucuuccuucucuucuuuccuuccauucuuucccuacccugccuuuccacuuuucuccucuccuuuuuuuucuucccuucccccuucucuacuuuacccucccucucuuuccuuucauauggucucuucucuccucucccucccuuuucucucuucuccucucuuuguaauguuugggauugagaccaugaaaauuuguuuuuagugagagauguuuguuguugaagaaaaagucuuguuaauaguguccaggcugauuucaagcacucccaucccagucucaugccaccuuuguuaauuuaacuuuugaguccugccccuuuuaaaggcaugugcauauaguuuuggcugcuuggaagguugagguagggggaguuugaggccaauuugagcaauauagccaagaugcucucuuuaaacaaaaccaaaugacugguggugcuguaacauggcucagagguagaauucuugugcagcacucgagaaaccauggguucagaacuaucagagcaacugaaaugaagcaaggugaagcuacgugccuccaugucacuuaauucugugccuccaugucacuuaauucuguugacuuagguuuaugacuguauugaaauagaacuaaaagcacucauuuuuugauguuacuucucuuaguagagaauaguacgguaguauuacaaaucuguccaguacuuuuuucaaagacucauuuuuuaaaaagguuuaaaaaucuuaccucccaggcuggcuuaguucucagugugcaguucauucucacuuugaaauugcagguuccuaaacucugguauuaaaagcuugagacacuacaucuagcuucuuuguccaacaucucaaacuagauuauaggaaugaguuuuuuuaaaaauuacuucugaacuacuuggccauuucauguauuuauaaaauuuauagguggcaagaaggccaaaaaauguacaaugucaaguuagaaagaagguuuucacuugugguaaauuaggaaaaguuuuccaggguacuuuaaguuucuuuauucuggaaauaccuaguuuauuagaggaucucuuugcuuuuuaaaaaauuuaaguuaaugugaugauuauugaaugacugcuauguguaugucagucauugugcuagguaguaggcauaugauugucaguaugacagauguuccacuuuuauugcuguauaaguaauuguauaucuguuuuaacuaaauacugguugcuauucauaucucaacuugauguauuuuacgugaaaauuaauuucccagcacauuuauacuuaggauaguuguauauaugugaauaugugugugugugcgcauucauauaugaauggcuuuuuuuuaaauaggagaaugugcaaauuaaaauuucaagaauuuguugcuuucaucaauaggugaagaaggaagcuuuagucaugggucugucauugauggaagauuugaagguuucaucaagacucgugguggcacguuuuacauugagccagcagagagauacauuaaagaucgaauccugccauuucacucugucauuuaucaugaagaugauauuaguaaguauucaugcuuuauauuagguagucuuugcaaaggcauaggaauccucauaacuguguggagacaaauguagccugggcuguuucuuuccuaagcuuauucagguuaaacaaccagaguguaauaagcaaagucuccauuuaguaaauaaugggucucugugguauagcaguugucaacacaggccagucauacucuguugauauaaaacaaccaauucuguuugaacugugaguuagccaaaccgacuugaacugucauucuaaauucugguaucagccagucugcuugguuacaacaucugaugucuguggcuucaacagacauugugcugaagguacaacaaugucuuaucuucaaauauccauuucuauaugaauauuuauguaauauaggauuuuucuaauuucuaaauccacugagugcuucucuuuagaaucuugaaauaaugaugugaccacagccugguguaugauuccaggcuuuccauggauuuguuggguaauucuuuuucuauguuuaaggauagaaaauucauuuaaccuuuacauuuuaauucugucaguuuguguuuccgugguuauucaauugugagacuguaccauuaaaauaacacaaacacauuccuguaauuucuaugcaccuugaauacuuuccuuccuuuuuaacguaagcaggcuaguuucucuaguuuugccuguuuuccugacuuggcagcuuccuuuugcuuucauuuuuuuucuacagauagggauuuauuauccauauuucauuccugugcuucguaauauacuggcaaaugugaauuauuuugcuuuuuugcuccauugucucugacuguuucuguguuuccaucugcccaacugcuuguugcuucugauggugagcugcuaugggagaauagccaacuuuacuuaaggaugugauuaugacuguuguuguuugcagccucguggauuuauuaaugcugccucgcuugcauuuucagucauccuuauuugauaccuuucccacucuaccuggaauuucuuuuggccucuuaagccuuauaguccuccucccauaaauaggaauauggauucuuugcuuuucuuucuacugacagaacuuuucuucauugggcuuguguuuuuccuugaaauuuucuuauaaauuaagucuuuuuugcaguuuuaucuccacuauuacaaugugcuuuucuacaaauacagguucuguggguuuugcccauuuaauauucaaguaacaguaucugugaaguagaucuugaugaauuucuaauaaaauguugaaauaugcucccuaucgagugucuucaaacuuggaccaggucuuucuggacaagaaaguugagaagugugaccgcucaggcugguuuuccuccuucggcacugugacugcugcuacgucuggccaucagcuccccugugguuugugcugcuugugaccugagaugcuucuuucuccuguguucuuucuucugcuuaucccuguuuugguuuuuuguuuuguuuugcuuuuuacauuuacacuucccccuuguuacagcucauaacuuccaaauaucuuacgucaauauuuuuuauuagguaccaguaguaguauuaaaacuuaaagauaguuauguuuagaugauuuugcuuauaacuucucuguuaaguggaaaugcaguggugucaagaugggcauaugggaagcaacaguuuauaaaaauguuuaucaccuuuuguuagugucaaaugaauagguuuguuacauuuucauucaguguauuuuaaacuuuauucauacaaaaagcugaguuguuagggcaggagagaugguucaguggauaaaagugugcagcauaagugugaaggcuauccuauuaucccauaaaagccugagagguguaacagcagcauuugggaggcagagcuagcuagacuauccagaacugauggccccagguucaccaagagacuuugagcauaaauaaaauggagaguaaucaguaagacacccaauauccaguuuuggcuuugacuugcaccugugcccauguacccuucccccacauauguaccccacacaguuaguauaaaaaccaauuuuagcaaguaugcuaaucaaaaacagggaguuagacuuacuugucuggcaaacuguaguuuaccuacuccaauuauaggggauugacaaguaaauuuacuuuuaauugaccauuuaaacucuggauguuggugauccuaaaagaagcagcauuaauuagaaggauaguuguaauuuaauguugcuuggcacuagauaaaauucuuuauguauguuaacuauuuuacccucagaggcucugugagguauaggaaaacauuauuccuguuuuauaggugaggaaaggaagacuuagaaucuaaugugacuuguggauauugucuucugugccauguacccauggggaaaaacaguauaauccucauuacccuuuacuacuaggauuacuggggcuuuucugaaaucugcacgccuucccaaaauuauacaauuacaucuauugcuguguuagaccaaaaucuauucuuggguuucuuuuuucuuucccucagcuagugaaaagaaagggucugcuccuaaaugcauguuauuauuuuuacauaacuagcuuagugucaauaauuuauuuucuuuuuuuuuuaugguuguagaagaguaggaaguucuuuuuuauuuuuuauuuuuuuuaauaauuuauuuucacaacugaaguacuacuugauuauguauauacuguagguauguauaagugaacuuacauaaagauucugauaauuuagcuaugcuuucugaauauucauuuuguaccuauuggcauaaguguauacauccauguggaaaaugaugcuuuuguucuggagaacauuaggugauguguuuuaggcagaaauacugagcagccucuccaggugcuuuugauacacaccuggaugugaugcugcucacugcauacaguuaucagcuuagaaaucacguaugcucaguucuccauugcagcaguaaaaaacacucucauaguauuacacgaugacaaagcaaaaaugccacuuaguucucuacuugcuagcauaguuuauuuugaagaaauagaaaaaccacugucugguaaacuaguauuuuuuuuuaaagaauuguuuauuuuguguauaugaguacacuguagcuguuuuagauacaucagaagagggcaucagaucccauuacagaugguugugagcuaccaugugguugccaggaauugaacucaguaccucuggaaaagcagucagugcucuuaacugcugagccaucucuucagcccucuaauaguaauuuuaaaauguguagauuuuaggaaugccugacuauuuucuccuuggaaccuucuguauacucugaggcagaaguuuaagucauuuuuuuccuguuauauuuucauaaaaauccuuaaacucugaauuuaaaaaccuuuuaauuguauaaagcuauauagaauauuugguuuauucuuuuagaguuauuguuuuuauuuauuuuccuauguguagacauuugccugucucuucuaggaauguaggugcucagguucuuagcauguguuaguuauagcuguauguaucucuucuuuuguguguguguacuucagugagaaagcacauaaucuuaugaacuuaaaaaugaagguauuuaaaacuuuguuuuaccaucucaagauggagauuccauugguguagaaauguuauuuauggaggcgugaguauauuacuuuuaauaucuuuaaaauaucaguuagagaguugcuuuucguuguggguucucuucuccucuaaucaccucgaggaaauauaaauuucuccauccauuuuacaggugaaaaaauugagaaagccauaagaaauggcaguuauuuuuaaaaugauaguuaaguagaaauguaauaugcuuaaaaauuaaauaugaagacaccagguaaaugaggaacaucugcaauacagcauauagguuauuugaguaauaaagauuccaagauaaaauccagcuuguguuucauagggaguucugaccauccuagacaacagaaccaagccaugucucaaaaaacaaaacaauaaguacaacaaacaaacuacaaugcacaagcaaaaauuagguuaaaaaaaaaacgacuuauuuagucagaaauuauacaaguaggacuuguugagaaaauuuuagaucaagaccuuuucuaauuuguuaccauauguaucuguauauauauuuaucuuuauaaaguaaaauauagcuacaauaaaauacaauguuucagaagcacaaacaucaaagaucuguuauaaagcaacucuaagaaguaacauugauguuuuuugcucuucugagaacugcucaugauucuguuuuacagaauuuuacaaaaagauuagauuagcaggacauuguggcucauguguguaguuuagcacucaggagccuaaggcaggaggauugugaacuugaggccauacuggacuacauaaugaguuccaagacagccugggcuauauuaugagacuuugucuuaaauaagcaacaucaaccaaaagcagagauuaauuuaucauacaaucuagauguuauaguugaguauuuucaaauguacaauguggugaaauguuugggaauauucagucuguuacuaagaagacugaauuuuuaaaaaaaucuuaaaauuuuacaucuguguucauuuuaaaaaucauuauaauagaguauuggcacauaaguuaauacaacucaggauaauauuaacacauauuagucaaagcaucuggccacuuuuuaaauuuuuuucuuuucaacuuuuaaagagcaaguauuguauauguucuggacaaguucuacagaaccauauuuccaacucagcccuuaauuuucaauuugucuuuuguaguaaucuguaaaaacagagauuuaaaacauauuuuuuggagaagcaguuuagaaauguuagauaauuccuaguuguugauggaaugaaagccaguaggaggcuauugaaacuauguuuuuguuauuguuuuuaaauauuugucuuugcaugauagaugccuuugagaaagagccauagaaaacagcugcugguuggaaauuaaauucaauuauauugguuuauaaauguacaggaaagauuaaguuaaaaaaaaugcaccgugauagcaaauucugacuugguacaagaaugugcuaaauaaaagcuguaacuaaaacaaagaggguggaacaaucucauaaaucauaaaucucauaaauaaguuggauauagaaaggcuuccuggggauugugacauuggauuugaaccuuaagacaaaaggucuuugcugaaaagaaucugugauuacagaagcuguuaccugguugugaccccgucugucugucugucugucugucugucugucugugucugucugucuaacuaaaauuugccugucauacagcuuaagaaauuugagaaaagaaaauuuagaaacaaaaacaaaaaguccaagaacuaacauuggcuuugucuuggaggcacuguggacagauguaccaucccaagauggacuuauaaaucaauguguuaaaaguauucuuauguauuucaguucuaagcuuuucaguucacaaguguguuaguuuuguacuucaacuugugauuuuuuuuccuuaaaaagcuuuuagagaaaggauuuaguuucuuauguucugggguuuuagucaaugguuuguuugcccuauugcuuugugccucugggggcaacaguguauauaucauggugggggagccugguaaauauuguucacuuuauguccucugggaauucagagaaagugacaggacagggccuggguccaguuaucuucuucacugguuguuucuagugaccuaauuccugcuagguuuauuccacugcuuuugagcacaauagguggccaggccuucagcaaauacuccauuaacagguuuguaugauuacuuuauuucuuaacugacauuugaauggcugauccucucuuuagguccugguauacgguggugaauacugcaaaaguucauccauuggacuucaaagucuagugauucuguuuauaauugaucauaauacagcaaauuuuccuguugcucugacucccaugaucuccuuccugccagcacuaauccuuuguuccuaaaggccagggugaggguagacuugcuugagucagcucucccaccuguuuccuggaagaugaaugcugugugucugcugcucuuuccauccuucccaaccuuacaaagcuggggcuggggcuggggcuagaucagaggggauagggcucucacaccggaauugcagagaagcauuuggaguccuucucuaccucuacauucuuuguucuuucuccucuugguuauuguuauuugggcaacuuuggaauaaauagaaauuuucuuaguuaaggaacaaguuggugguaugacaacaguuuucauauauuaucugcuuguggagguguucuauuuaaauuucugcucagauuaaggauugaaauauuuaauugaauuuguguuaaauagcacauuacuagauuuuagaacuucuuuugucuaagagagcccuggugaagaaccuagaucuuaacugcacagaggugcuguccucacgguagugaagcuguuggaaguggguguuuugugacuguuggugcugggcagauaauucaaagaauaaauauccugcuuuaguagaguggauaauugagagucaacuacuuacuuccugugugaggugguaccauaauguauguguuauugauauuuguguuuccuacagaaaacaaaagcaagagguuugcaugcacaggaacuggaggaaaggcaggagcucugagcggaucuuuguuugaaacugccuaauguucuccacucacugcucauucuuuugaaagaaucucuguuuggccuuuucagggaaccgcagugcauccuaugauuuugcaucucaaugagggcuuauucauuaguugaacaaaggcuuuuucuagaaauggggauuauauugucaguaauuuuacagagaaaaugucauuguucuuuuuuuuuuuuuuuuuuuuuuuuuuuuuuuuccuugugguuaaugugguggccagggaaaauagucucuuagaaauuuuggaaguauacagacaaaauuauauacuuggccucuguccuuuuucugucaugagaauuuugugcugacagaauuugaaacauauaauaguguuuuguugccuuggaauuuuuuucuuacccuaacaaguuuucaaaauaauuuauguuuuuaacuuauauaaaauauaauuuacaaagagaaaaacacuacuuguuuaaacacuaauuuuaguuuuuucaauuacagcauauuaaguaaauaaaugauacuuuuauuguucuacauucccauaugcauugauaacauuagaaaguuuuagucuuuugacaaaaguauuuaaacauuauagugguuauaguuuuuucauuguuuauuaaggucacuuuguggaguuugauaaguuuguaggauuaguuuuauggccuaugcuacugugcaugaggucuccuugguguagcuuugugugagagaaacugcaaauguacuuugggguagaauggagguuucuaggcuguguugggaacuuaaggcuacaggucaugacuuugaacugagaaaguccugcuuaucagagguguggauaaagaguuguauuuaaaggggauuuggcugggagucaagggaguaggauaggggacaaaggaaguaaaggugaaugcaguaaguaauuaugacccuagauguuauauaaacugaauaagcagaaggaaacugcccuaugguagugcacaggaugagaggcauuggugaauugaaagauuuauuguguuugaauggguugggucuaucuagagguauuguguagaugguggacagaacauaggaugcugaaaguugacguuguggaggagcuagagaaaguacucaaggagcuaaagggaucugcagcccuauagguggaacaacaauaugaacuaaccaguacccccagagcucgugucucuagcugcauauguaucagaagaugaccuagucggccaucaguggaaagagaggcccauuggacuugcaaacuuuuaucugccucaguauaggggaacaccagggccaagaagugggaggaggaggggaguguaggggguagaauauggggggcuuuugggauagcacuggaaauguaaaugaagaaaauaccuaauuuaaaaaaaaagaauagaaggauaauaaacagcauauccaucucugaaaaaaaaaaaggaaaaaaggaaugagaaguucaaaaguagaguuguagacuagaguaaagaucuaagaauacuagagggaucaucugcaugaauguuguaguuucaaagaauuaugaugguugaugugagagugagucaagaucuaaaaauaaauaaugggaagugacuuugaauuccugugguacaugggauagucacugguauaaucuaguggcuauuuuaauaauccaaggcagaaaguaguagauagcccugaguacuuauuaaaaugagagggggggagauaauuaucuuuccaacaauagguugcccuugacuucaugaugaaaguaaagaugcucuuggccuuugccagaugauggauuuuagaggaacugauuuuauuaaaaacauucuuuuuuuccccauuaaucaauuuauucacuuuauaucccaucuccuccuagucccgcccucacaggcccuuccccugucccuccaucccucucugagaaaggaaggggaaguccucccuguuaccaaccuacccuggcaccucaagucacugcaggacuaagcacauccucucccacuaaggccagggaggacaggccagagaggggaacaggauccauagacaggcagcagagucaggguaagcccccaccuccuguuguuaaacauguacucuugguuauagagagcuguaaucuuuucucagugaaguaggggcauagcaguuuuauuauuaauucuaggcucccuuucaacucggaggagugacaaccuauuagauauugguucugauauguuucuacugacuuucucucaauuccugcugcugauagcucauauaggcaauaugauauacucugaacacugacacauacuugacuauuauaugaagacuagaaaucuacucuaauaucaaguauauguaauugcacuguguuacagauagauguguuuauguguauaaauguauuaacucaaaucuuuuaucaguaaaggaggaaguaaaauacccaggagauauuauuuguuagauuauuuuagaauuaauaaugaaauaacuagccugcauccauaacaauguauuggugaaaaccagugcugaucuuaaucucagaugacacaguaccaaacgcugaaauaucccuaaagaucaaaauccuuaaagucuaaaauagcagaaauuuuaaaugaugcauaguaauguauaguggguaguuguaauugcuuuaggaggcugagauaugggaguccaguucaagaguuugaggcuagcaugugcaauauggcgaggcccugccacuccucucuaaaacaucaccacucuaaaagacuaaagucccaaauguuggugucccaaaagaugaaaucuccaaaacaaaaauucucguguguguguguguguguguguguguguguguguguguauaaagugagcuaugugugaggaacagaaaggcagauucuagguaagggauuagucuugccauauggcagcccaaagguuucauuuuaaaacuguucucagguguaauggcucaugcuuguaauccuagaacuggacaggcugaggugagggggaaucaugaguuugaggccagccuggauuacauaguaaguuuuaaaucagccuuaacuacauagggagacccugcuuaaaacaacaaaacaaaacaaggcuguuuuuugucuucauuugcuuuuguuuuagcuggugaaauuugaaaauaauuauuugcagaguaggauaagaagacuuuuguucuacaguguugcauuuugaauauuacauguuauauauaauaguauauuauauuauaugcaguauauuaugugccaguuuugugauuuguaugaguguguuucaaauggauuucccaguaccaaaaaaagaguguguggagaugauucagucgucuugcaggcaugaugaucucugagugcauaaccagcgugcauguaauaaacuagaacagacaacuuaugcaggcuccuugccagcagguccaggcaagaggagagagguccuggucuuacuggggucucucuggggcugagcuagauggcgagugucgauggcccaaaagaaaacauacagagccaggaguccuguagaagcaggaacucaacuuuauggcacuggccucucgcuuauauaaguucagaacauagggaggggagucuugguggguaagaugauauaggaggcagagaagugugacagaggauauggagugauggacagggccaguggcagagcucuacaacagcaagggcggggcagaggcagggccaaacaggucuugcugagucaccccaauaaguggggagugacugagacaggucucaaaauucaagccagucucagguuuguccucaaggcccaaaccagagccuaaauggggcccaacaaacuuacaccugcauuaccagcauuggagaggugagacaggaggaucucuggaguuugcuagauagguaggcuaacugaaucagugaauuccagguuuagcaggagacccugucucuaaaauaaaacaaacaaacauggugguguggugaugguggugguagugguagugucaucgucuagagagauggcuuagugguuaagaacacuggcugcuuuuccagaggacuuaggcucuauuccaguaccuacacaguagcucacaacugccuauaacuucaguuccaggagagucaguacuuuuuucuggccucaacaggcaccaggcaugcaaguggcucacagacaaaaauauucagacaaaaugcccacauacauuuaaacagaaagaaagaaagaaagaaagaaagaaagaaagaaagaaagaaagaaagaaaggaaggaaggaaggaaggaaggaaggaaggaaaaaagaaagaaaggaaaaaagaaaagaaaagaaaaaagaaagggcaggcagggaaggaaggcaaggaaggaacagaaagaggaagggagggagggagggagggagggagggagggagagagagagagagagagagagagagagagagagagagagagagagaggagcagguggauugaaaagacccccaauguugaacucguguggacaugcaagcacauauacauacaccacauauauauauguaccauugcuguuaccauggaacaacacagaaucauggcaugacaguaggugcagaaaucuaguagugaaugcucaugucuacauauauagacuacauagggauuucaaaaggagcagcaccacaugaccuaaaagacaagcaaacagcuguucauuccuauacaguacuucaacauaaagcugaugcuguaaaagucagccagcucucauaugcuucuucuguacaguugcuagucuuucucuguaguguacuuuuucauaugcggaacuuugaguauuuuucauuuucguuuuuucacuguuuaaaauuuaacauuauuuucuguaauuugcuaugcuauuuauuuuaucccuuauuauuuauaauacugaaaguaaauaguaguuuggacuagguucaguuuuauuuuauggaguuuuguguguuugacuccaugaaaauacauuauaagcugggcauaguggugucuuuauuccuagcacuugggaggcagaaacaggcagaucugagaguucuaggccaaccucuauauuggaaguucucgagcaaccagagcuacauguuaagaucuuauaucaaagcuaacaaaaccuguagcauuaccuuagguguaaauuguauguguguguguguguguguguguguguguguguguguguguguguguguauguguguauguguguauguguguacacaucauugaacuauccuuauuuagucaagaauuuuugcauuuuugaaugauaagcuucuuuugagaacuuggcuauugaaguaacugcauacauaauguuguucuugugugguuuuuaauugaucuaaucaaaagauucaguuugucacuguguauugaaugcuuuacauauaguuuauguauaguugcuuuacauauagaaugcucuguccauauucacccgccuaccucuuggaccugauggcugccauuaguaagccaguugugcugaggcagugcuuaguacuuacagacgugugcuuuauugcuuuaaagaaauuuuuuuuucaaaaauuugugcaaaguggccuuuaaaaaacuuuuucgugccggguggugguggcacacaccuuuaaucccagcacuugggaggcagaggcaggcagauuucugaguucgaggccagccuggucuacaaagugaguuccaggacagccagggcuacacagagaaauccugucucgaacucccccuccccaaaaaaacucuguuucguguuuuuuauguuucuuaaacaaguucucuuuuaaaaguguaaguaaaugaccaaaggaguuuuaaaagguuuuuagugguguaugugcacaccaauguacgugugugugcacacagacaggcuugaggagcagcuccagcucuguccagcagucacucacuuagucuuuccuuccuaccuaccucccuucucucuccuuccuuccuuccuuccuuccuuccuuccuuccuuccuuccuuccuuccuuccuuccuuccuuuuugagcaagaguacagagucucuuagaauuuacauucuuuuuugaaaauacauaagauauuuauuucuauauauuguuacacuuggcagugaaaucaauggcuguugacaaagguacaaaucuuaccaauagaugcacagaaacagccagaacguuuuccauuucaaagucauuaggccauuacaggauucauagcuagagaacauuuuauuauuauuauucaaaucauaguaucauucugcuauugccagauuggagucuauuagccauucaggacaaaagaucagggaggaucauauuguggcuaauuacuugagcuagaacuuguuugucugugauaccuuacuugaagcuaugaaguucguucuacagacauaugccuaggauaaugagaaguaguuuggucaaugacuuuuaaauugcuuuuuuucaaaaaauaaaauuugaaaguuuaauaauguuuuuaaaggucugaauacaugguaugcuaauauaaaaggguauguauuauguugaacagaucauuccuacccaacucuagcacacacuuuuuuuuuuagugguaggugguauugagguguaaagagaggaggaggaggaggaggcauuuggguaauguuauugugaaacuugcugcaagugguucgaucacagagguugucuuuugaaacucuuaguuucaguagucauuuauuugggaguaauaucuaugaggucuugugucuguucucucauuugaguguaagauggaguuugaauguggcugggggugggggcugggagguuaggauguaacagcuuuagaaacuucauaauaaauuaaaacuguaagcauaguucuuugcaggagagugcccaauucaguucaguaaaaauuguaucaaauauugaauaauuuuuccuauuaaacuuagauuagccuaagguaaauguuaagaugggaucuuauuauuaaaugaaguauuggcaccauucuuagaaauuuauauagaggcaucauguacuuacucacaaaggaaaaccaagaacauggcauacuaauugaauaguaauuuauuugcuccucauauugaaacaagaauuuaaaaauuuaaauaucacaguuuauauaguaaaccauuuaguaugucaguacuccuagaacuuuuguuuuucauuugcuucuguagucaccgcugucauaguuacuuuucuguugcugugaagacaccaugaucaaggcaacuuacagaagaaagagauuauugggggcuuacaguuugagggugagucuaugaucaugauggcagggagcauggcagcagacaggcaggcaugucuugagcaguaauugagugcuuacauguugagacaacaaccacaaggcagaaagaguuaacuggguaugauacaggcuuuugaaaccuuaaagcccauccccaagugacacaccuccaauaaggccauaucuccuaauccuuucuaaauaguucuaccgacuguuagauaaccaauuaauccugggggaaaacuauuucucccacucucagcauuccuuaguugccuguaguucuuugacuaggguuggggacuuguaggcuuuuuccuaucuacuuuagcaugcccauuggugucauccauguucagcucauguuugggcaaaguggccuuuaaaaaacuuuuucgugccggguuucguguuggugagacuuuauggauguggcuucugacauuucuaggagacaaauucccagaucuucuuacucuuacagucuuucugccuucucuuuuacgguguucccugugggaguguuuuguagauauauucauugggacuggguuucaacucuguauuuugauugguugugguuuucuguaauggucucuguugcaaaaaagagauuuucuugauguggggugaagacuauacuuccagguugaaggacaaauguuuagauuuuuguuagaaauuaugcugguuuauuuaguaaagugauaguuguagaguuuccucuaauauccaugaguucacuagcacugagugguuagcuagguuuccaguacuugaaaugguuuuuaauuaauuaauuaauuaauuuuuuuauacuccauauuuuauuccccaccuuaguaauagugucagaccuuaggaccuugagcuggaucccacuuugggccugucacuggaccuucuuuuccucaggcuccucuccauuuccaucccuguaauucuuucagacaggaacaauuaugggucagaguugugacugugggauggcucccccucucccucauuugaugccuugucuuccugcuggaggugggcucuauaaguucccucucucuauuguggagcauuucaucuaaggucccucccuuugaguccugagagucucucaccucccaggucucuagugcauucuagagggucccccaaaccuaucuccugagguugccuguuuccauucuuucugcuggcccucagagcuucaguccuuuucucucacccaauuagcagaucagguuccccucucacccccacucccccgccccauccacuuuuccucccaggucccuucccuuccuccccacuugugauugcagucacaagugguuuucuucuucuuaagcaagucuuaaacccaauuagagcuguuggaugccuccaagguaugugugauccuacuacacuauuagcuccuugccuuccucuuuuggaagcugcauggugccuucugguaccaugaaagcuaguccucgagggagaggcauucaagucaguuucaguuaagggcaucagaacuuuguuuucaccucagggagcaaccaagggcagcagcaauaggcuguauguucugagaaucuucuggacaacccugaccaagaguucaaacagccuucucaugucugguuuuggugguuuuuuuuuaggugguccuugacuguugaugggagcauugccaucucagaugagaaauucacuaaaacuauuuaaauacauuuaugucagaacuuuauguauuauaagguuuuuguuaagguugauaauuaauaguaugguuccucaucacacuaucaucuuguuaucauaccauguccuuuucagacauccuuacuguuaauuuuccuuccuuccuuccuuccuuccuuccuuccuuccuaagagcccauuuuuuccuaucuuccucucagauccuuccccuuuauacucuucccacuuucuucuauuuuuauccuccacucccuccuaaggagccccccacuuugggaaaagugaucccuguucagaucacuguacccucuacucugccucuauuguuccccaacccccauccuggcaauggucccauuuuaccugguuucuacaguugcugcucaagcacuuuacagugcacacuguccuacuuacaucuugguguuugauuuuguacguucucuuaauugugcuuauuggauuggauuguaaacuauacuuaugaacuugguaagaaguuuuuagaauguugagagaauagaauaaguaaauugaauagcuuauuugaaaacaaaaacagcuuagcuaaggauaaauuaauguaugaagagagaacaaaugauaaaauacuaguuugaauagcauuaauuuggauuauacaugggauaaauuuaaaauaaaucuacuuuuuaucgugccaugaaauguuuuuggaggucacuuuaucugaggccaguuaguauucguagaaggaccuaaaaccaaagguacauauauugaccuuacuguguucaaauugagggaauuuguacauuuguaguguggaaaauauaauguacugaaaggaaaguuauaaauaucaaaaugagguaaauuacaguuuuaagauguucuuuuuauccauagugggaaaguuaaguccaaaauaaaaaaugauuaugauucuguuuuugaguucagaaguuguccacagacaaaaagcuagauuuuuaucaaggaagacaguugcuaagauucaggucccuagcauagugucuuucucgugaauguucaguaaacacuuacggccuucauuaauuaugauaguuaauuuuuaaaauguacuucuauuugguauguauguugccugcaugugugucugugcaccauauuugugucugguauuuacagaggcauuggauggauccccuggaacuggaauuacauucauuugugagaugccaugugggugcugggauuugaaaccaggucuucuaagaagaggcuggaaaaagaggcucuuaaccacuauaccaucucuccagccccaaauuaggauagucaauuuuuauugauaagaugcuggcucuaucuaaauacauaacaaugauuuuucuucucugcuuuagacuauccccauaaauacggcccacaggggggcugugcagaucacuccguuuuugaaaggaugaggaaguaccaaaugacuggaguagaggaaggagcccggguaaggauuucagcguucucuaaguuaagcagaaugcacuugggcaaguguuucuucauuucacacauauguucuaggaguugugaaacauuuauaccacuguugugaaauauucccauuuaaauaaaugaaaauuaacuauccuaauuuggggcuggagagaugcuauagugauaaagagccucuucuuucagccucuuccagaagaccugguuucgacuccaagaggccauccacacaauucagcaguaguaaagcgguggcugaucaccuguuuuaaaacugaaucuugaaucuuuagacaaaccaagaugauuauucacccuaaauaaaagcucagugcuuuggacauuuuaauuacacauugaucuuucccuuuuuccauuugauauuuaaaacuuuuucaucacaaacauucucugauagauuaccaugcucccaggucuuuacagcauuuaagugucuaagcaaaugcuagauaaacacuccaggggaaaacaggcuuuaagaauauguaaaacugcccaugguagugaacaccgugcuggaaucucaguacugggaggcugaagcaguaugaaagauaacaaauguuuucucagguucuuaaacuuucugugaauaguuaaaacuauauuugauuuuguuaacuuaaggauuauaugguuaucucuaaguuaacuucuuccucuaaaauauaagaauccagaaagacugaaaaaaaacccuaacauacaagauauaaguauuucaaauuccuaccaguauuauauauauuuuguuaauaucaaaguagacuuuaggcaagaaagcaacaauaaaauaaauauuuauaaaaagguuuaguucucucauguuguagcaauaaauugaaacuuauauaaagccgggccuggggcuguagcucacuugauagaugccuguauuccuagcacuugggaguacagguaagaagaucugaacuucaagauuguccuuagcuccacuuccaauuuaaggcuagccuugcuauuaugagaccuugucucuaaaauagaacaauacagcuaaaguugacuaacucaaaaggagcaguagaaagaccauaugacagauuuuaguccacuucuuagagaauaauuagacaaagaauaaagcccaauaaagauacagaaauucugaauuauauaauugauaaacuugaccgcuuaacuuauguuaauuccuuuacuugacaguuuuuuucacauuuaagaauaacuuaauuuaaacauuuuuacuccuuaucuggggauccaucccauaaucagcuuccaaacgcugacaccauugcauacacuagcaagauuuugcugaaaggacccagauauagcugucucuugugagacuaugcuggggccuagcaaacacagaaguggaugcucacagucagcuauuggauggaucacagggcucccaauggaggagcuagagaaaguacccaaggagcuaaagggaucugcaacccuauagguggaacaaaauaugaacuaaccaguaccccggagcucgugucucuagcugcauauguaucagaagacggccuagucggccaucaguggaaagagaggcccauuggucgugcaaacuuuauaugccucaguacaggggaacgccagggcccagaagugggaguugguaggugggggagugggugggggagcguaugggggacuuuugggauaccauuggaaauguaaaugaaauaaauaccuaaaaaaaauuuuuuuuuuacuaaaaaaaauauuuucauauuggagcauucagacuucccucccaaaguuaaaaaaaaaaaaaaagcuguauauacaacuuuaaguguagcuaagauuaacauguguaugaaguaacaugauuguaaagauaaacuauauaacacaaauuugggcccaugaaguauuuuucagucauuuucaagcugaacagauugguaccuagaaacaaccuaaaugaguauauagaggaaaauaguauuaaagacaugcuuccuccaaauguccugcuuaggacuguauugauucuccccucccccaugacugggaauugaauuuagggcucacucuugguuagagugcuagccaagcacucaacaacugagcuauauaacucgcccaguagaauucgggguuuuuuguuuguuuguuuguuuuuguuuuugaacuauaauaguauuugaaacuuuuauuuaaaauuguguauuuuuaugauauaguuucuguaauacauauagacuaaaaugacuauuauaggaaacaaauuaauguuuucauuaucacacuguuacaucuccucuugugaacauaauacagcauuuaaguuuguauaaauuaacagaauuaucaaggaagaaggaaaacauaaaaugcgaauguagauuuagaauugugacuuaaaacuuaaguucuaugugacugucaaguuaggcuuaacaugauguuuuugaugucuuaaacauuuugaauguuugaauucagcaguugugguaauucauuaaagaaauacuuucuguuaaauuuacuaagugaugacaaucuagugaaaaagaaacacaaugugguuccucuucaaaaacauauauucuaguuguugaugaguuagggacagaaauuaaacagaagauaauaaauguaagguugcauuguagaaggaagauaggugcauagcucugugaagugauaaaaugggugaauuaacagucucuauaucugaggaaagacacuaacuggauccagagagacagcauaagugacauacaaagaauggcgggaggcagacaggcugugugcuuuagaaucauagaaggcuucaguuuugcaaagauuacaguaugaaaaccaguucaaaguccagacaugguagguagcuuuaggugaaguggcagagccagagaaaauggcuggaggagauaaauuugcuaagacuaggucauagaugggaaaggaaagaugauauuaaauuauuaugcaugacgcuuuauauuuaaaugaauauauuuuauauaccuugaaaauguuuuuaaagauggaggaauuguuugaauaguaaguucccauguggaaaauauuuuauggacaaaguguuauuuauaaguaaauucuaaauauuauaaaauguaugcaacaugauguacauauuuauagguuuggugcaaacucccaaacaaagagacugggaauccuaacacacacacacacacacacacacacacacacacacacacacacacaaauaguaacaccuuaggaaauggaaaugcugaggaaucugaucucauacacuguguguguguguguguguguguguguguguguguguguguguguguguguguguguguguuuggauucccagucucuuuguuugggaguuugucauuggcuauaguagaguacaguuguccugcugagccauacaacacaagcgcauggcggcccuccacuccuagcuuuugguguccacuagccacuucucacacuuguaccuuucuuccuaacuucuaguggcccuuuuauacuaugagguauuuucuagugaccuuagaaaagcuuggggguauugcauagccaugugauuuaaaauuguuuaacauauguguucuuaacuguaaaacuguaauuguaaaacaagcuaauaaucagaaaugacuuugacguacaggcacauccagagaagcaugcugcuaguagugguccugagcuccugaggaaaaaacgcacaacucuggcugaaagaaauacuugucagcucuauauccagacagaucaccuguucuuuaaauacuauggaacacgagaagcugugauugcucagguacugaaaguuacucauuguguuacguguuuucuccuauuguuuuguauuauuguuucaguugugucauaggaaagucuguaaacuuaguguagaggagauggaaaguccaguuuagauuuuggauugccaaacagaagagagauaaaggaaacaauuuuaauuaaaaguugcuaguaacauuggaacuuaggcuuuuguucuuuguuuuguuuuguuuuggggaaaaaguguuuuggauuugggucuggugacaugcaugguaaacaaguaugaaacucaccuuuguaaacaguuccguuuuucauuuggauuuugcaagagaaaacaggaauuuucucuuagcuagaagucuauaauuucuguuuuguauuucauuguauuuacuuagcauuuuccaaguaaaauuauuauuuauaguuguccccaucuucccugcugagaacagguucuuuguggcccagaguggcuugugcucacuucauucugaggguguccuggaaguuaugguaauccuuccauuucagccuccugagugugcugggauuacagguuugcuguaccuguaugaaaaucuuuaugaaaauagaauauuuuaggguacccuuuaaaaugucuuuuuauguugaagauaccuagagaaaguuuauuaaauuuauuuuugacaaagaauuugagcaugagaagauagaagugcugugguauaaaugaugauuacguuuuggugguggggauugacaggguuuuaagaaaugugagaaauagaaaggaugcaauaagcuauaauuugagaauaauggaauaauggagagcaaugagcacaguuaaagacugggaagcaccuuuguagagagacaguauaaacacggguaauguuaauauccccacaguauuuuuuuuguuguuguuuuuuuuuuuuuuguuuuuuucgagacaggguuucucuauauagcccuggcuguccuggagcucacuuuguagaccaggcuggccucgaacucagaaauccgccugccucugccucccgagugcugggauuaaaggugugcgccaccgcgcccggcgucccacaguauuuuugaagagaaagugcucuagaacauucccuaaggagugggguaaccuuaagugacccuuucaggagaagucuccaucugaggagauaggaaaauuuagagggaaagauagaaaagaaaaagauaaaaaggaagggacuccaaguaaaguaggcaauguaaaccugccuggagacauaucugaauugccacagaugcacauggagcagaaacaguggggaaacugaaccaggcauuggaagcugcugaggccaggcaugcgaguucaggauggacccuucaacacuguuguccuacuccucggaguguuugucaguguggacugcuuuugaaaugcuacuucuugaccgucuucugugccuucucaauaaguuuugaaauggcacauacauauuuccaccuagaugguagccagggugcucuuuuguagauaaaguuggaagguugcauguagagugguuagagccgaugcuuaguugggagucagcuaaguaaacaaaugccgcuuguguucuuucacuaaguuuauuuccuuucagaauuuaaguagcuauuaccauauuuauuuuauauucagauuaucuuucccuccuguauacuucauuacaguaagccucuauuaauuuauagagaccuucucuauuucauuuauuaguuuaucucugaccccuaaaacagugcccaguuguagaaaguaaucaggauguuuggaauuugugucagugcagcaacagaaggacuauuguggaggaaggaaugcaugcccugagauugcuagaucccuguagaugguguuugagucuuaaggacucaaacuaaugcagacauuccaggcacuaaguccagcagcaugugaaaagcagagggagugggacucugcaggcugggcugaugaaggaguuuuaauaggacugaaauagggguacacuuucuaauugaugcauugguugauugauuagccagagccugggaaagacaagaguauccacucuguccuagcucacucaucuuuuccauucuguacaacauauggcauacauauuuuaaaauuuaaauguguagcauaaauaacucuugauguuacaaagagaaauugucuuuuucauauuucaguauugucccuaaaauguuuuguuuucuauuuuaauuacuagauauccagucauguuaaagcaauugauacaauuuaccagacuacagacuucuccggaauccguaacaucagcuucauggugaaacgcauaagaguaaggaacuuuaguagauccauuuuaaaaaguguuaagggggcuggaaagaugggcucaacaguuaaagcacucacacucuuccagaggacuuggguuugguuagcauucacaugguggcucacaacugucuguaacucguguuccagaggaucuaaugcccuuuucuguaccccccacccccacaugggcaauugcauacuugugacauauuuacauacaugaaagcaaaacacauaaaauaaaaauaaauaaaacuuaagguuacaaaaauuaguaaggaauaaguuuaaaaagaaagaaaauacuugcuuuuuacuucauccuuagaacggagagagacugaucucugaagcucauuggcugugcuugcuagcuaauuuuaugagccccagguuuagggagcauccgugucucaaaaaugaaguggagaucuuuagaggaagauaccuaguaccaaccucugaccucuauacaaacaugcauucacauguauauaccacaugagcauguauacauaccacuacaagaaucaaaucuacaaggccuuaauugagacuacaguagagguaaaacaguauuguuuuuugucugauaaacauugcuugccccccacccccauuacuaauuucuuaagguuugcuuugugcguguuguuuugggugugcccgacuuguuauucuagggcugaggaaaaauaaaggcaguguuuaaauaaaguuagacuuuggagaaacacuuauuguuauaaucuugaaacauuacagcuuagaaugucaucuaucagguuuuagaaguccuccaagaaagaaagcucuaaguuuggccauggaauccuuuuuuguuguaauaucauuucuaacucucagaacugcugaacagaaccacaggguacugguugcaguuucuugacauuguuguuauaauggcuguaacuaaaaacugaaccuagauuuuagcuauauuaaaaacagguaauaaauauuuaaguauaauugcuuuaaacuaaacuuacaaucucaguuaugaacuuugaagcugccauaguuuuuguugauguacacaucuucagagugccaaucauuuacuaaacucuccauucccuccaaagcuguaaaggucugguguugacuguucuucaguuugugaaggaggguccauggaggagaacaguagccaaguaucagaaaaaagaugugcaggaacuuagcuuaaacaguaagagaagugaagugaaaguagaaaucaaaauucuuguauacaucaagaaaacaguggaucaaguaguuaggguuaacuuaccugcuuucuaggcaagaaggaccagggaaaucuggcaaacucagccuugcauuucaaacuuauucuaccuauaagcuaaugaugagguuuuauguuuucauacuugugcccauucauagagcucccauaaagagcccugcucaggcaguugaguuugagaaaccggacaucauuuguuagaacuugcagaggugcagcgucuucucugcaugcuucuguucaggaaucugcagauccuugcugaggcauuuaauagcaucagcuccguucuuccugcccugcucuccuuuuguucuuuuugucuguguguuuaugcuuucuacaaucaguucagggcugugcucagggagaacaucucuggagcccaugagaauguuguccaggucugugggaggggcuggggagagaacaacuagaaguaaucauugacuucaguuauuguuuuggauuuuagaucaauacaaccucugaugaaaaagacccuacaaauccuuuccguuucccaaauauugguguggagaaguuccuggaguugaauucugagcagaaucaugaugacuacugccuggccuaugucuucacagaccgggauuuugaugaugguguucuuggucuggccuggguuggagcaccuucagguagauuguguaacaaugucuuaauacuuggaagaaaaggcaaguuugggggaagauuagguuuuacuaaauauaggagaaaacaaugccugugcagaaauuuaauucacacagccuggguuaagacuagauacauaacauaaagcaaauggcagaauagaugaagcagccuuuuauuuuaaaaggaauauaagaguugacccuguggcacacaccuacagucucagcucuuaugcugaaucaggaggcuugggaagguaaguucaaagccacccuggacuugggauuagggagacccuaucucaaguaacuaagcaaauaaguaaaaauuuaaaaagaaaagagaaguuugggaaguacccugauuuugggauuuccagaaguuaaccauuuugugggaagaaguaguaugugugacacuauaaaagggaaaccuaaguuuucccacaaaagcuaaaugcugcuaaauuccccugccugcuccuuggaauggggccugaaagucaacagcagaaacuguuuuugcuuugucaaaagggaaaacaacaacaacaaaccuaucuucuuuucuguucuguaaugagagaaagaaacucuggucaggagcagcagguagaaagaaagaaaacauaucuucauuugcuguccucgggucauuauuucaacagcagagauguacuaccuggaaggcaguccaggcagcagcacaagugccgcaugcagcuugcuggcaucauccaagcucaccauggggugggguccaacacugagaaggcugagaugggcuguccccuucccauuacaguggguuugaguacgcuguuggcaaauugagauuauucacugaaagacagguagaaaggaagucauauucuuuggaucugaguguggcuguggagugugaguuguguguaaacuuuggaguccuaagcagugauuucuccuucugaugccucauuucuacuuagaaauugaccuuucuuuaccugguauaaagcacguuuuucuuacuguuuaguuuauucuacgauuuauuauguauauuuuaucuuacauuucuugcuuuuuaaagaagccaacaguaaacaccuuauuuuuauuuccagugcuuuucuuucuuuucuuuuccgcccauguuguaaaaugcacuugauuccugugucucugagguacagaugucugucauggccuucuucucuuaccauaguguuguuuucaucuuguuugugcguaguccucuuuucauguuucuugcauugugaaaagguguucagcucuuccuucccaggauguuucagguuuuauaaauucucuuuccccucaaauagcuggauauuuuuucucacaagauuaaugauucccuuuuacuauuaauuaguauuauaaaagcuuggguauuucuuuggguuuccuuugcauauuuucuagauacucuuggguaagucaauggcucuccuccuguggagcauagcuagacgugcgugcguugccagaaccuuugagaaauguuaugguucauaggcuccaccuauguccuuugaaucagggacgcuuguuauucaucucagugucuuuguuuaaauaagcauugcugcucacuaaaaugagacugagaaccaccaaacuauuuaugucucuaaugcucccucaccaaauaccuccagagcaaacacagcaauuuccaaaugggagccugcuaccguuuuguauuuucauuuacagacuauuguucaucaaaaugucuguaauccuggcagaaucaugaguucaaggacagccuucacuacauaguaagagcuugucucuaaaacaaaggaguggggguagguggauucuucaggagcuugaaccacuuuguugaaaucuuuagaugccuucauguuuuuuacacauauaacugcuuaauuuccuuuuacauuccuuaauuuguuucuuuagaauacuuuuuagaguuaaagaguuaaaugaagcagaugcuauggagagucccuccucucagcuacuggcuuugaagaacacuguuugacugaauucuaggauauuuuguccugaaguuagaugauuuuaugaucaaauggggcugugggcuuagggacacucaguauuuaugucuagauuucgggauauuugaaacaucacuuugugauguugcucauuuuguuaacauggcacuggguagaguuucagguugaaaacaaugugacaugguuuuuuuuuugguuuuuuguuguuguuguuguuguuagauucuuuguaugaaugaaacaggacucuaccuuagccuaucaugagcaaaaagagaagauucaaccuuuauccuuauuuccaccuuuucuuuuucuuuacuucaggugugaaaugcacucugacuugacuguuaaauccccaacucugggccuuagaaggcuuuuuccaaaagcuguuucagagaguauaggccgagagauuagaggccagagugagggaaagaagucuacucucuuggcucaguugcuuuaauucaggguccugucuugaaauaacaccagcagcuuugucugaacagauuuugaguuugauauacacuuucuuuuauaaaggauguuacauacguaaucugcuugauuacuccaggguaauggcuccugcuucccaguagauauuauauuuuauugauugcuuuuccuucuuucuuaagagaagguggacaugggaacucuguugcacaauacguuccacuaaauuacuuugcaucagauaauuuguguuauaauuucuuuucucuccuugcuuugagacuccaucuuucugcuuguaagucuuaauuauguuugcuauuaucuuguucuuuuuagauaacacuucauagccaauuuauugaguuuauagucuuuaauauuucuuaaucuuucauuuuuauuugguuuaauuaaucuuuguuaauucucaucuuguuguauaauuugcccuaaguuuaauucauuaaauucugaaguuaucucacuauucuaaaauaugauagucgagauuuuuguuacauuaugguuaauuaucacagaauauguauguagauuauuagugguaguccuuuuugcugacccaguugaugcagggaaaucaaugaggguuacuuacacuuaauaguaaguuucuagucuuuaugucuuccuauuuuucaaauaaucucuuuuacuuuuguguuagaauuaggacaccauguauccuaguuucuucuuuguaugaauacauguguacuaggacaacucugucucuucuuuuucaguacuuuccucuaguugaauuuuuuuuuaaggugucuuugaucaagaaaacaguaucuaccuguugaacugaguuuaccuggagauuucuacuuaaaauuaugcuaugccuacaguggagccaucagaaaagagucugguucccauacaaagaucuacaggggguguggcucagugguagagcacaggcuuuagcauguacaaggccuaggguuugaucagcacaagggagaaagucaaaacaaaacucgggaaaacuauauacaguugccauuuugauuguuauuaccaugauuuuauaacaaaguaaauuuuauuuuguaccagagggcucacuguauacaggcugagcuuggauuuguguuaagcuuaggacuugguuguugcagguucccaugcauugguucuaagagagccaucaccuuccuucaguuucauuucacuugcugaacaucuuuaucaugcuucugcaauggaguucucuggcuuguucagauauguccugaccuguauuaacuggucucgguguuagucaguuaagugaacauagccgaggcuugcucagauuacugucacucuucucauuuacucacaagguuaguuucugugauaacugcaguaaaagcuuacaugucacugauauucugguauaucaaaacuaguugcaguauuuaaaacaauauuuauaaaauaaaauuuaguaaauuuucugugugauuuagcacuccuuaaacugaggaguuauuuaggagauuaagcaauauacacaucacagagauuauguuuaagaagaguauucucaaaccuacauaugaucuugcuaaguuagcuagacuuaaauacaucaauaugucagaaguuuuuaaugugccuauuuagucuuuuuucuuuuuaacuguuaagauguguauuggagucuucugugccuagaucaaauuugacaggacuuauuuugggucaguuucauaugacaagucuuuacugaggcaggauauuaauuuacuacuugcucaaagcuaacaugugguuguguaauuguuacagaguacuuacucauagauuuaauuuuuuaguuccuagagugauguaaccuucagaaaaagaacagaaaaaauauucauaaaucaaaaucuauuuucucuauuguuuuuuguucaggaaaggguguguauagaaaccacaugaaggccugugggcuaauucugcucuuggcuuaguauucauuuuccuuuuucacaaaguucaucaugauuucaucuugcuaaaucauaaaauuaauuaaaagaauugggagucuaaaaucaggaagauggcaaaugcagggagcugagcauaggcagacccucucaaauacaagacaaacacaggagaguucauucuugucaguguaggcauugacaagcuaguugaguugguuuucuuauuugucccuuauuaauuuuguguaacugcuguuggcuaugaaguauugucauuuugaucuugagcuccaaaguucuuuuaauaaaaagacaaauuacagaaugcuuacuaugcuuacuuuaauuccuuucaauuccuuuccuuuccuucccuucccuuccccuuccccuuccccucccccuuccccuuccccucccccucccccucccccucccccucccucuuccucuucuucuuccuccucuuccuuccuuccuucucucucucucucucucucucucucucucucucucucucucucucucucucucucucuuccagucuagucuuuaucccuuucccagucugcccuuugacuguucuuuaucccauaccuccuccuccaagaggauauccucaccccccacucccaucucaccagaccuccccacucccugaggccucaauaauuucuuuuaaaauuugaaaauuauuucagggcacaucaaaauuacaguucaguucuuuuguuuuguuuuaaguuccacagcugcugaagaguugugugaauagugcagugaacgccuggccgaccagauauccauauucuuccauauuugcuuuccugucccuuuuuuucuuccuaccuucucuccacccuucuuuuuccaugucuauuccuuaaauccaugucacgcagugucuugcugacaaaugagugauagagugcaucacagaacuaugagcacaugcugaaugccccucacucuuuguauaaauuucuuucagagaauguaaaauauugaggauauuuuaauguguauuuaauuuuuaaguuuccccuuuaaaaggugaagggauuuaaaaggugaagggauauaagcuuugguucaguguaaaugugaacucacccaaauuuaaaggaaauaaaaauguuuugcuauguuaauggcaggaaaaaauaacuuuuugaugcugaaaaauauguaaggauuguuuacuaaauccugggauuuuuuuucagggaccauuaauguuuuauuuuaaaugauuuuuaaaaucuuggacuaauugaaguauuugaaucaguuauguucauuuagucauuguauuuuaaauaaauauaaauguuuuagcuccauguaaugauuuuaauuacuguuuaccuauuuuuuauaggggaauagauaacuaauuuagucuuuuuuuauuauuauuuuaaaaucugaauuaggaagcucugggggaauaugugagaaaagcaaguuguauucagauggcaagaagaagucauugaacacaggcaucauuacuguucagaacuauggcucccaugugccucccaaagucucucauauuacguuugcucaugaaguuggacauaacuuuggaucuccagugaguacugccuaauuauuaaaaguuuaaaaagcaguuagcuugacuuuuaucuucagugguauuuugcaguacaauaauguacauaugaauguuuaguguuaauaugccaguacauagugaugcaauugauuauacugaaaguaagaagaguucugugaaagccagaauuuuauuuagcuccuuugugggaggguaguuuugagauacggucucauguagcauagacagucuugaguuccuaacccuccugucccugcuucccaaguucuaagugaauaucuguaugcuccaaccaugucuggcuuguuuaugcaggucaucugucuauauuugcugguuuagaaacaguuaccaucacauaauacacucaaauauauuuugaaugagucuccuuuuaguaauuucguaaauugugugauggcuuuuuggcuuuuguuucuauuaaaacaauauugugauuuacuugaauauauuucucuacuguauaaauagauugauauuuuauacuuuuuuauaauagguuucugacacaaagaagaaaaaauagcauagcaggccauguucucaucaccuagaacaggaguggcaagcacuucccgaagggcucucgugaacauuucuucuaggcuuugggggcuagcauuuguuuuaugcuccauguucuuuauuuuccaguucuuuaaaucuucaaauacggaaagcuauucuuagcuuaggcuuuguaauagcagcucauguguaauguagguucauuugcugaccccugagucaguugguaauuaucaagguuuuugcauuguuugcuuuuuguguuccuuucuuuuucuuuguuaagauguuuaaauuuacauuuuuuagaaaaaggcuuuauauguaaccacagugugauuauuacacuuauagcagcugucuuugguauucugcaauacuuagguccauucugaugauuuuacagugaucuaaauaaacaucaauucaacccagaaauaggaaauaguaaaagauuuucucugcuuuugguggagcuuaucaaguauguuucuuuugggaaaauucuacuugaaaauuguguaaauucauuuuacuugaauguuaucauuuguagacauggaaguuauuauuuuuuuaaggauaauuuguugguguugagaguauaggucaguauagaguacauaugcagcauacaugaggccuaggguuuaaucucuaguaccaaaauaaacuaauaaaaacauucaugaguuuguaguuuaaaaucuuaaaaggcacuucuaaauauuccagguuuuuaaaauguaucaccucagacuuuccuugucuaaguauccaucagaaacugagagguuguuuucaaaggaguucuuaaaguaccagagaugagcagagggcugaugcugaugguuaaguugcaauuucaagugcaaggagacacaccuucuucacaagcaccauacccuucuaguuccuuuucucugccucagggucuggcuuguuauuuauuuauuuauuuauuuauuugcuuuuggggaguauguagacuuggugacugggcuguucuagaacucucuauguagaucaggccuacucauggcaauccaacuguuucaacuuucugaaugcugaaguuaaaggcauguaccaccauaccugguuuguuuguuagcagucagaagccaagguuggcucuuccuccauugcacucccuccauuguuucauagucuucuuuuaaggcaggacagcucacugaaccuggagcccaccuuuuuagcuagucugacugguuggccuguaaaucccugagauuugucuaaaggccagcauacuaccuuguucaccuuugauguggauucuggggaaucuaaacucacaucuacagacuuggguggcaagcacuuuaacuugcugagccaguucuccccaguccccucacacucaucuuaaucuuuaucucacagccaacaauugcauuuaguaaauuaguauuauuguauauuuuauguauugcuuaauaaguaauuugguucucauuccuugucaacuuuguuaaccuuuuccuuuccuaauggacuacuuuuaaugaccuuacuaugcuuaaccagacucuuucuuugcauaugcuguuaauucuacaugguagauccugaauaaguauuuauugagugauuuaugguaagaugaacuggagccauaaacucccaaaccuguccacuuugacaucucucucugaaaucuuucuuucucccugcuuuccucuugcugugucucugugcuacaugauacuuucuccaaguggcuugcauuauucuuuauauucauuuuucuuuauaugaguacacuguagcugucuucagacacaccagaagagggcaucagaucccauugcaguugguucugagccaccaugugguugcugggaauugaacucaggaccucuaggaagagcacucagugcucuuaacgacuaagccaucucucccgcccuuauauucucuuuacuuaucccaaauauuuguugagcauucuuuccccaaaaagccacacccacuccaacaaggcuacacguaauagugccauucccuauuguccuauugaaggacauuuucuuucaaaccacuacauuccacacccuggcccuauaauuuuguagccauaucauagugcugaaauuaauuaaguccaacuuccaaagugcccauaguuuauuauaauaucagcacuuuuuaaaacuucaaacugucaucugagacucaugcagucuagcuguguaaaaccaaaaugaaaaugcagaucccaggcuuccaacacacaguggcacaggaucuauauuaccauucuaaacuggaggaaagagagcauaguaaggaaauacuggaccaaagcaagaugaaaacccagcugggcaaacuccagacuuuaucuccaugucugaugucaaagcauucuucagaacuccaacuccuuucaucuuuguugacugcaacacacuucuugcucuugggcugguuccguucccuguuagcagcuuaccuuggcagguaucccacagcucugguaucucuaacauuuugggcucuccaaagcaauccaggcuucaccuuuacagcuucacacaauggcuucucugggcuuccaugcaggaacaccccugacacacaccuggccuuaguggcuuuucuuaguugcagagggagauucuguaaccccuuuaaucuauccuugauuccaaagcugccaaguucuggugcuugcuggggcuggaacaugucguguguccccucccccuccccuaccccuguucaauuacaucuuauuaacuuacuguuuuugauaguuuccuucauugucuaaguuuggcugcccuggcucauugaccagacuggccuuaaacucagggaucugcuagcuucugcuucugaagugcugggauugaagguguggaccccuaaucuggcucugagcguuucuuuaauuucuuuucauaaguuggucucagcuggguggaaucuugcccugagcucuccuccuuuuauccauuuaacaucaugcuucucuuuaauauguuucucuccuuaaacacaggauuuagcuccauuucuucucccuguaccccuuuucuccuugaucuguauguuuuguauuuucccuuguucagcuugcuccuuuuaauuauacaucuucauaugaguuuuuucauuauacauuuccuuaagcgugaacacuaacaaccacaagacagagucaguacuaggcuguucugagauuuccucugccaaugcaauuaauccaaaacuuuacuguagccucaggcaaacuuuucagacaagagcagaaaauagcaacaauguuagccaaaauaucauaagaauagucucuaggccacauauuaaaauucuucuccucugaaacuucuugagccaggccaccacaguucaaaucacgaucagcaccacugucuuucaucuuccuacuagacugguccauuaagccccacuuaaaauguucauucaacugcuuuucuaauccaaagucccaaagucuacauuccuccaaacagaagcauggucaggccuaucaguaauauuccaauacuaacuucuguccuaggauuuuauugcugugaagagacaccaugaccauggaaauuuuuauaaaggaaaauauuuaguuggggcuggcuuacuguuucagagauuaaauuuauuaucaucauggugggacacauggcagcaugcaggcagacaugcuggagaaggagcugagaguucuauaucuugauccacagacagugaacugucuugagcuuggagaccucaaagcccaagugacauaccuacucuaacaaagcuauaccuccuaauauugccacuuccuaugggcuuaugagggccauuucuuucaaaccucuacagguuucaucauuuauggccuuuucauaauucaagucaaaguauauaugcugugucauuucucaccucucaaaucugaugaaucuccugcucuuaccuuaaaaucuuuuuuuaaguauuauuuuuauauguauggguguuuugucuguauauaugucuggguacaacauggaugccucaauccuuagaguagaaggugcagaacccuugggacuggaauuuauagauugugagcucaguguggguacugggaacuagcauagaucuucucagagaagcagcaaaugccuuugacugauaccauggaauauucuucagccauugaaaagcaggcucuucagugcuucuuauacugguaagcugagauauagauaauuauauauaccagaucccaaaguuuauauuaagaugugauacagccaauuauagucauaggaaauacaacaaaaugucaauaguugugggcuauagauuauaauuuauuuuuucauauguucuuaaaucuuuuucuuacuuuucugugaauauuuucucccuucuuucucucuuuguugccuucuucuuucuguuucuucuuuuuuuuuuuugauagguucucacuggauagccuaggcugaccucaaacuugugaucuuucugucucagccucuuuaaugcugggauugcagucuguuccaccaaaugcaucugauauuaugaacuuagaauacccaaaaaccuaacucuuuacgaacaaacaacuuggguacuuagcuuagaaaguaguuuuucuuaauuucuuuuuuaacuagaguuguaguauacucaugaaaccugaguccuuuuugacauccagucaggauaguccauuguguguaugugugucggagguguuuuuuuuuuuuuuauuccuuucuuugccaguuuuguuccuguaucugcuguagcaaauaauaagcauucuuuguuuaccguccauucuuccuuuuacggcuguuggugagaucuguuacaccauuccugagagauuaagacuaggcagguaggucacaauuagcuauuuuuaagaauguaacuccuugccaaguuagggacaauguuuauuccgucuguaucaguuuguauauuuuagcacuuccauguauaacaagcuacucauuagaaggcaauauucaaugccuucuaacauagcuacuguuucuuugaucacauuaacagccauucaguauuggaacuuuucuuucuguuucucaauuugaaugaugagauuguugcuaguaccauacuuaauaaaaaaccaaauuguaaggagcagaagcauaaagcaagguaauauacagagcaaguaguuuccagaggcugaaucuaggcucaggagaaaagcagggcaguaucaggaagaguaggaugugagacaucugaugaggaaauguaaaaucagagugacuugguauuauuguuuguucguaaagaguuagguuuuuggguauucaaacuaaggucaaguuaaauacaacugcuauucuaauguccaacauuuuuucccuuuagaauaaugaauaccuuaauuacuugaggacauuuugagguuucuuucggguguguguuguguguguauugaggguauuuugugugugguacaugcaccugaguauucaccuuuguauguacacacacagaugucagagaaggauguugaaugucuucuucuuacuuacucuugggacaauuagccuugagugaugcucucugaaccagaagcuuugggcucgacgagucaucuaaugagcucuugguaucugucucugaauucuagugaugagguuguugcaaaaaaagcacagucaugucuggcuuuaaauuuuuuucuuaaaauuguuauuacauuuuguguguguauguguguguguguucauguucauuuguaugccacagccugugaguggaggucagaggacaacuacuugcauuuggguccugggaucaaauugaaguugucaagcuuggugacaucuuguaccacugagccaucuuucugcuccugggccuggauuuauguggguccuggaguuuugaacagagguccacuugcauauacaucaaguguucuuccccaugaagccaucuaacaaacccuggcguuguuguuuuagugcauaugugcgaggaaagcaggugcuuccuuagcccagcuuugaaaguguuuuuccuuuaugaagauucagggagcucuugcuuuggucuuucuuaugccucugguaccuggauaaauuaccagaauccaaaccacgucugugcaggugcucauauacagaacucugucuccuguaaagcaauguuuugaucccaugccuuggguuuucuuagucuuauuuuaaaguaaaacuuguguuugacuccaaucagcauuuugcguggcugucuuuugcgccaacucacaaggaagugucacugccuugaguucuuacucugccuuccucagcacuggucuuggguuucauuuucacuucugccuuccugaaccaguuugaacauguacuuaccaugcauuuuaaugaaugugaauccauauuauuacggccacccauaaaagcuucuucuuaguaaucucuaugacgauguauguucaguucuagucccuaauuacaaagcucuaaguuuauguuuagacuuucaguuuuccucugugcugcaacaguggccccauagagcaaguguuuauccuaacucugauccuagacaguuguuagauucuucuucaaggaaaguaugugacuucuacuguucuucugaugagaaaguuccacauaagcaggugacugggcaauuuuacuuccuacuaauguaacaccauauucuguuuggcagcaugauucuggaacagaguguacuccaggagagucuaagaacuuaggacaaaaagaaaauggcaauuacaucauguaugcaagagcaacaucuggggacaaacuuaacaacaacaaauuuucacucugcagcauuagaaacauaagccaagugcuugagaagaagaggaacaacuguuuuguugguauguauauuuuccaacauuuuaauuaacuuuuucuucuacauuugugcaugugcacacaagccacagcagguauguggaggucagaggacaauuugauggagucaguucucccccuucaccaugugguucugacaacugaacgcagcuugucaagcuuggugguaagcaccuuuccccugagucaucuucccagcccaaaauauuuauagucaaaaaauauguaagaggccacucaguucccgccuguguuuuccaguuaacacuuugcaaaaaguauuugcuuuaucaaauacuuaggaauucauuugccccuuugaaaguaaguaucagauagcagaguguuuuacuucuaaacgcuuuuagcuuauaucucauuagcuagaguucaaucuuguuugagguucuuuucucuucccuccuccuucucucccuuccuuccuuucuuuaauaggugaacugcacaguuuuauauauauauaauuucauucauaauacauacaugccuugcugcaugugugacauuugcacuuacuguacaaugagcaauuccccaagccucuuauccucccuuucugcacugucuccucuuguuaguucccuuguuuccuagauaauuuugcuucugcuuucaugucauauaucugugcaugguuuuauggaucuguauaaacccuauaaacaagaagacaucaugauacuugucuuugugacauuggcuugauucauuuaaggugauuaucuccaguugcaucucuuuuccugcagacaacaaauaauuucauuccucaugucuaaaaccaacuccaucauguaucuacugcaugggugugguguugcacaccuuuaauccuaagaguugggaggcagaggcagguggaagguucugaugucaaggccagccuggucuauauagcaggcuccaggccagccagggccuacaguuuuuuuaauuacagguguuuuuguuuuuuuuuuguuuuuuuuuuuuuuuuuugcgggggugggggggguaauuguggauuugcacacagggcaguaguagguacucaguaccaucacccaguguccccauugguaauacugugcaggcugauagcaucacaagggccaugcugucaucagggcacacuccccacuccuugcuccuguuuuaucgggauguuuguuucuuuuaauauaauauaaauacauguguaguucuauaucccaccacuauagacaagauacagaacuguccaucaggacaaggguacugcugcuaugaacauaguagagcauguguccuuguuauauguuggaacaucuuuucgguauauguccaggagugguauagcuggguccucagguaguacuguguccaauuuucugaggaacugccagacugauuuccagagugguuguagcagcuugcaaucccaccaccaacaaaggaguguuccuuuuucuccacauccucaauuccuuuauaaaaucacuggugauuuguuagauaccuugggggagcuuuuugguuguucuugguauagcacacagucuuccuauauuuguguucugagugcuggauuauaggugugcacuauuaggcuggacucagauaaugguuuacagauguuuccuccuggccuguaguauauuucuuuauucuugucacagacagagucuuuggcuuuuucuuuuaaacuuuccccucacggguuagauugacauuacauugaugcuguuauucuauuauugucaucaaugguugcuuuucugucacuuacuucugucaguucuuaaguguucuauggacgguggaguuuucacaguaaacuuagaagcugauuauaaaagugaaugcacugaucuguuggucacuguuacgauguagguugugucagacacugcacacgcauuuuucucuagaauuauaugucacaugaauuauaaaguuacuagccauuuaaagucauuguuuuacuuaugaugguuguucuacuagaacaguccaaagacaucauauaaggucaguuagugggcuacaauuucagugacuguuaagauuuucuuuaaugaauuaagaaugaacuugauaaguguaaagccuaccuuccuggagugauuuucaaucaccugugccacagugagguuuuugugcuagguguguguucccuucauucaguaguuuauucaguucacauucuaaauccugauuggugcauuagaaacaaaagccuaaaauuuaagacccaagaaccccugcauuucaucuguuugaucauaucgggguauauacacaugggguacaagcaagucauaggcuccuuauaacuuaguuuugcuuacuagaaaugaaggcauuuguuucuuguaauucacgguaaaugauuguguauugaggugauuuugagaucuuacaaagagaauuccuggucugaauuuuuuuccuccaucauuuguuuuaguauugcuggggauugauuuaaaucuacucuucuaauuuuuuagcuucaggacuugagaaaguugaagaaacggcuaucacugggaagagaggccccuugguaucgcaaacuuuauaugccucaauacaggggaaugccagggccaagaagugggaguggguggguaggguagcagggcggagggaggguauagggaacuuucgggauagcauuugaaauguauauaaagaaaauaucuaacaacaacaaaaaaagaaaucugggggaaaaaaaagaaaguugaagaaauauauugaaauuauucaccaauauuuaggccagacuuucuaacucuaauuaucuaagaucuguccuuguuaggcugcuugggacuucagggaguauauuaauaauucauaccuauuucuuaaggugcuuggucucgcaauaaguagaauaauauucauuuaaaaguuauuauugacacuauugugaucacuuuuaaaaaaugaguuauaggauaaaauuauccaauauccuuaacaaauaaaugauguaaaaaauaaaaaacaaagugaaccuauucuauaguaaaauaacuuaaaugauaaaucaccuaaagcaauuaugguggaaggggugggguuaggagagccuuuuuuggaacuugauuuggugaccaauuauugaagauaguucaggaaauuugaacauggauuugugugguaauuucaaaaugcuacagaauaaaaagugguugcaaguaaguaagagaagaaaagcauucaugggaggugucuugcugugaaaagacaccaugaccaaggugacucuuacuaaaaacaguauuuaacuggaauuggguuacagguucagagguucaguccaaggcaggagcauggcagcauccaggaaggcauggugcaggaggagcugaggguuccacaucuucaucuaaaaggccacuaggagaaaaacuggcuucuagucagcuagaaugagggucuucaagcccaugcccacagugacacacuucuuccaacaaggccacacccacuccaacaaggccacaccuccaaacagugccacucauauucagaccaccacaggaggucauugugcuaauuuucuuacuauuuuuauguauguuugaaaacuucuguaacaagcuuuccucuuuucucuugguugagaaacacuaacuucguuugcauacauaugauacacauguguagucagcaaagcucaacuguaauguggccuaaacagcaaguuauuacuucuauaaagaacauagguaaggccagucuucucacgauguagaaacagggugacaugcugagguugcaauugcuguuuguagcacuucccauacuaaacgacaggucuccugauuuucagauucuguuuuuugccuuacuuacucguuaaaauuuccuuuuucuuuuugguaaaacucuaaagaguuugucaauuuuauguauuuaugugugugugguguuuugccugcaugcaugucugcauuauauguaagcuugauucccacagaugcuggaagauggugccagauccccuggaucuugaauuauagacaguuguaagcugcccugugggugcugggaaugaaaucagguccucaggaaggucaauaagugcucuuacauaaacugucaggcccccucuccagcccugagcuuugaaauuuugaaggaauuaaugugugcauauagcgcucaccguguccugugacuuuccucagaaucuggccagccuaucuguggaaacgggaugguggaacaaggggaagagugugacuguggcuacagugaccagugcaaagaugauugcugcuucgaugccaaccagccagaggggaagaaaugcaagcugaagccugggaagcagugcagguaccuaccuugccaaccugugaugccaacgucccugcaaggccacccacagcaguuaggacagaugaaaugcugauaucaagagagcuguauagccguggaaguuugccuugcuuuguuguauuguuauuuauuuguuuauuuggagugacagcauccuguuuugacauuuggaacaauuuauaauuuagugauuuggcuauugaaaaagagaaugugaacaggcugcuccaucaaaugcauguaucaucuaguuccuaacugugaaaacaugacuguauuacuuuaaacuauuuaggugaaguggggcguguaggcuucugugacuuaguaccauaucaucauuucacugucaaaugcagucaugauuucaggaaauagacuacagcuuacacaaacuuuuuaaaugguuagucagugaauccaaguucaauuuaguacagagagguguaaauugauuaauguguuauguagcugugggggaaaacacuaaaaaguuuucuaauccugaauuuaccucacaaaaggcagauuaacaauacugauuuuagcauuuuugacuguggaaaccauguacauaaucaucuucuuagacuugcuagacuguccaaagagaguagcuuguuacuaguaauaacugaaguuguaguccaguaaugaacuuaccacuuaagaggugacguucaugaugugaaaauauggcucauaucuagguguauaauaaauagcuagugauuuacuuuaucugauuauuuaacacuucuccuaguccgagucaaggacccugcuguacagcacagugugcauucaagucaaagucugaaaagugccgggaugauucugacugugcaaaggaagggauaugcaauggcuucacagcccuuugcccagcaucugaucccaagcccaacuuuacagacuguaacaggcacacacaagugugcauuaaugggguaagcaugugauuuaagauguuuuaaauuuuauugaacauccuuuuucagaauaaugauugccacccaucagguaacuauucugggguucccauucaguaagauccuaucuguuccccacaaaaccuggaguguauguaacacaauugccugguggcauauaguuagcuccugacucaccuuucauuuuugcaacuguguaucuuugguaugcacaagaguacaacuaggcauguggucuuaucugcacugcuuuuaaguuguauaaauuaauauuucaggagucugaauaaaagaacucaucuggucauuuucucagagugugaaaucuucugagcucccauggcuaaauguuacuuuguucugcaugaggaaaacuuauuuuuucucugcuuauagaggagccauaguaaccaacacaaauguggagcugccccuuccucugcuuuuaaguuuuuuguuuuuuucuucauugcuuuaaaaguuguacagcuuucuuucauuuacucucagaucuauauaugugguauuauugacgcugguguucaucuguggguuuguuuuguggugcugcggaucagacccagggccuugcaugugcuggcaagugcuugccauggaggcgcaaacccacaccuguuguuuguaacucccauugccacuuuauuauuugacaucaaaagcauauaccuaccuaauaccaugaacagucuugacuacacagagaugaaauaaaauuugccuuucccccagcaaugugcagguucuauuugugaaaaguaugacuuggaggagugcaccugugccagcucugauggcaaagaugauaaggaauuaugccauguuugcugcaugaagaaaaguaaggcuuuucaauaacuccuccuaaaaucaacuuccaaaaugguuuuuuuuucauccuuugggaaugagguuuauugggagaaaggccuuugagaccaugauggagccuugauguggagagcauaagaaagggacagcaguaucaaaaauagcuuagcagcuccuuaaagagaaagaagcuucccucuaaaaccuggagagaggggcuggagagauagcucagugguuaagagcccugacugcucuuccaaagguccugaguucaauuccuagcaaccacaugguggcucacaaccauuuguaaugggaucugaugcccucuucuggugugucugaaguguacucauuaaauaaauaaauaaauaaauaaauauuuuuuuaaaaaccuggagagaagccuguuauagcuuacagugggacacagaaaagacagagacagagaaagaccuagaaagagcgccaugacagugauggcagcggugggaugguaugggucagagaagauccuugccuuuaauuguuaaacaguuuagacagauacuuuccagcuaaaucaguucuuuugagaaaaauuuaaauguagcauugcacuauggucuuuacaauguugcuaaguaauacauuagaacagaucuugccagccuuagauaauaauucauguaaacauaccucaaugguuuuaaagccauugcaggcacuaagucaauuguuuguuuauauuuuaacauuuaagguaaaugaguaaugauguuacucugacaaaaaguauagaucugugaaacaugggaaagagcuuaaguagucuguuuuuuuccgagacugcccugccagguauucugaccucuguuuauguuuggcacuucuuuuuccaguggcuccaucaacuugugccaguacaggcucuuugcaguggagcaagcaguucaguggucggacuaucacucugcagccgggcucuccauguaaugacuucagaggcuacugugauguuuucaugcggugcagauuaguagaugcugauggcccucuagcuaggcugaaaaaagccauuuuuaguccacaacucuaugaaaacauugcugaguggauugugguaagucuagucuucauucauuaaaaaccucaaaauguuugaucuuaauuuuacuuggguagaggucaccaauauuggaggaugaacaccuugccuguuuauacuagaaucacuauauguauagucuuugaauguuuagauaucccuggcucuuauuuccuucuguagugaucggcauauccaccugaaaguauugaaaacuguguuaggugguaggagucguucugugucccucugcugcuuugcuuacauugucucuugcaggugacuucuggugguacguguugguguuuucacugggcuuuuugggaaaaugcuccuuguuuuucuuauuucucuguuguuucaguagaacagauagccagcuaugggucuuaccuugcucaagaguaaaaaugagaaagacauuuucugaaggcuuuuuuuccugcauuuguuguuguuuuucuucugaucuuucaguguaauuuuugggucuuagucuugucugugauagauguugaacaauguaagaucauaugaagagucaguuacagauucuuuaauggcuguacugcauacgugguccucaucuauuauauugaauuuuuaaguucacauuucucaaaacuguaaaaucacugacuugagggggcaacucaguuaguagagugcuugucuacuaugcaugagccucugaguuguuggaaccaguauucaugaaaugggguaugguagcacaugugguuauuccuagcauuuggaagguaaaggaggaagauugauguuaaggucuuccucacauaguaucuagcucauucuagccagucuggauuauguaagaagcugucucagaaacagagaaacagccagccagugauacuggagacccugucucaaaacaaaacaaaacaaaccuuugaaacauuguauuuccugugguuuucuuaaagaauugcugagauuagccuaaauguucaugcauuccaaguguaggagacuuacuuucaaguggcauguuuagggacauguuauaccuaaaaccaaguaguuugcuuuguaaauugauuuagaacucaaacucuuuccaaguuuuuuuuuuuuuuuaaaguagauuuaaugaaagauuccuuucugugaauuagcaaugagaaugcuuaucuuaaguucuggaaugauuaaucagacacuguaugugagugaggguuaacacaugccuuuuauuuuauaaugucaauguggguguauuauccucagcuagcacuauccacaaugccuggagugcagaccgagaugcuuuagugagcaucggccaggucaaacaagacaauaaaugcugaguuuguuuuacauuauuugucucaucugauuuugugcaguuuccuugcauaacaagguuuguuuuauauuaaugauaguuugaaucuugauguccuaucauuucuguggugauauauauauuguuaggcuauucugcuaugaggcuaugcaagaagugaaggacuuccuucacugucuuuuccagugcugccugguguccuuuugucucuguugauggugcucuaggacuccuuuucuccucaugcaguucuguggcgacugaagaaccuugagaacacuucgauauuuuauggguacuguuguugucauggagauaaucauggagauaaucaauauuuuauggauacuguuguugucauggagauaaucuuuuuugugugugugugugugugaaguguuguuuugacaaccauguuuagauuuuuccagaauaugcucugcugagucugucuggcgaggaggcauuaacuuuagugccugcuuguaguucuugagaagacugcgagaguguucaccauuaagucuguugagauccugggccauuaucaccuguuuaagugggauuugaggacaucaguaauucuuuuccaguuucugcuauaguugauauggucuuacuucucuuugcaucuuuugcacuggguuugaucuggcaaagaaccauuuuuuaccauuuuuggguuuuguuuuguuuuuuuauuuuuuugauuuaucauuaugugucuccuuucuuucauucucacugugcugugacuuuuuuuguuuuuguuuuugcuuuuuuuguuuguuuguuuuuuuguagcaugugcaauuuuaauauaggaaucguucaauagccuggucauuuacuuuaaaacaugucauuguucaucaacaaauacucucuuacuguauaauuuagugagaauguucucagcauaagaggaauaugcuaaauuucauuuuuuuccaauuuuuuauuagauauuuucuuuuuguuuguuuuuuucuuuguagaccaggcuggccucgaacucagaaauccaccuggcucugccucccgauugcugggauuaaaggcgugggccaccacgcccagcuuuuuuuuuuuuuaagauauuuucuucauuuacauuucaaauacuaucccaaaaguccucuauacccuccccccaccuccccaacccgugcugugacuuuuuauuuaaguuugccaaaaucuugugaugaugaagaugauggauccuuauaccccuuuucacuaugguguccaggucucuaaucccugggcuucaggagucucucuaccuucagccucugaguagcugagcucguacacacuccuuuauuuuuuuuugaggcaagucuuguaucauagcucuaaaucuggcucuauauggcccaagcugagcucuaaccaacagcaguccuauagcauccuccaaaaugaucccucccucccucccucccucccucccucucucucucucucucucucucucucucucucucucucucucucucucucucuugauaggguuuuucuguccuggaacucacucuguagaucaggcuggcuucgcucagaucuguuuucucucucccacccaagugccggaauuaaaggaguagagugugccacuuccuccuggcucacuuucucauuuuaaaaaucaguuucugucccuguauuuuguucuaacuuugugaauguagcuacuaagaaucugguuuguuuuuguuuuuuuuuuauuuugaguaggagauuuagggcaaugguucucaaguggaucacaaacuacaguugcucucagguuguuuguccagugccucugagaaaacugaggccagugagaucuagacaagucauggauugcauacgucuuuguagcuuuguuuucacaacaaucacaggagaauuuacucacggaaggauuauaagccuagauguccuuagaugucauuugguauacauuguccaagaacagcagcuauuagugucaucacagggccuagaccaaguaagucagagcucuuagaauugguccaaaguaucuccaugcccaugguggcuagaagagugcauggauccccuagagcuggaguuacagacagugugaacugccauggggucgccgauaauugaaguugguuucuuuuggaauugagagagaaggcugugaguucagaaacucacaguauaggauauggaagauaggcacauagaaguguauuucaguucuguguguuguuuucauagaaaacagcagguucuauuggagaagucuuaaauuuuuuaaauuuuuuuguuuuuuguuuuugauuuuguuuguuuuugguuuuuguuuguuuuccgcacacacauguggugcugggaacuuaccucagggccugaugugcuuuagacaaauuaucugcgacucagccacugaaaaguucucuuuaaaaagacauuacaacuugauucuuaagugcggcaguagcaaauauacaggaauguuucauggagaagaaagugcaugaaucuuccacaugaaaacuguuugaaaagucuuuugaaagcuuagugaauuuuagugauugacaaaauacuccauuuaaaagcaggccugcuccuugcccugcagccugucugcccaggaugaauuuuuugugugcucuuuagggucuaaguagagccgugcugcuuugcacacucaggcuucauuuccugcuuucuuuccccgcuccugugcuauccagcuuuaggacaaagaguuuaaaugaaaagggggcaaaauuaaacccuuuguuugcauaguuguagcacugauagcugaauggaagguguuaggagcacagauggcuggagacuaaguguuaaagaacacagaagcacuaaggauggagguagcugcucugacagcacuagaccucagccucaguggagcaggacuaccauugcccuuugcacuaaagaguugacugcaguacgguuccccugguauuaacuaacugggcuccaggacugcugagcuuccaacauugcucacaauugucuuuggacuguuuggacagacugacaacaguacccugccucuugauaaauagcaacuauguuacuugagagugaauaaaaauagaaaaauaaaagaaauccauagaaaacuucuauaacaaggaugauauaucauccugaggacaaagaagaaaggaacucugaaaauugcuuucuauagcaaauaaaagaauguuuuagaaaacuaacaaucuaagauaggauacaaggaauagauuaaagagcagauuguaaguaagcuccgggucuucaaaugaacauucagcagaauacaaaaguauaccugagcauccuuggaacagcuggaaaacagcagaaacugauauuuugucuuucuggacuuuuuacucauagaucauaaaccagcacaauaguugucuuaaaugacugugggggaaaagaguagauuguaaacccaugguuucuaagccaaauucagccccaucaacauguuuugugugguuugcacauugcuuuuagacaaucugaacaaguuugccagcauuuacaauagacuucauauagaaauucagauuuguaacuucuaaaaaacaaaucuuugggagggaagauugaguugcauugcacuuucuugccaagaggacauugcuacggugagcggaagagugacagacuagaaacuucugucacaggcuauagcauacaaaggaaauagaagaaaggugguugugggacucucucaugcauaccugcaacccaaggauggucagagacugacgagaagccacgugcaguguaaaccauucuaaguucauuuugaauucaaaacaaaaucacccucuuucuguuuucuguucccucucuuuucuuucauauuuuugggguggagguggggaaaggauugagacagaaucuccuguggcccagucuagccucaaagugaguauuaguugaggcuaaacuccugcuucuccugccuucaugucccuguugcuggaaucacagacauaccaccacaucuggccuccuccuccuccuuucauuacuuuuaauuuucacauccuggguauuucaguguucuguguaccauggauguaccugguaucugcagggcccagaagacaguuguuagaucccuuggcacuucaguuccagaugguuguaugaacuaccauguugauucugggaauugaaccuagauccuggaagagcagccaguguucuuaaacacugagcuaucucuccauugccuuuacacaaaaacaaacaaaccuaaaaguguggggcggguuugugugugugugguacgugcauacguacgcauguugaacaguuuguuccuaaagccuuugggugauucuaagcaagguaggaauccauccaagguguguacagcuguagaaccacagagauggcuggcuuacaggugagucuuaugugguuaggaggguguggggaagagcacacuguggcauggcaucccccaaguaauggaaggugagugccaugucagaguacaaguggagugagcggguucuacagugaguugccucucccauguagaaggcaaguuccaugucagagugcaaguagguuaaggaggggucuuccuaggaggagaaacacuacaaggaaccaggcuucaacagcaacaugggugguccgggacucagguauugaaagaacaagaugaaccuggaagcuuuugugucacaaaguaaguccuuaaagaacgagguggggagagugucaaaaaccccaugguaauggugguauuggguuauaacccauuguauagaguaggaaacgccaaaggaacaguaaguaaguaaaugauaauuuauggggaauggaauguauacauaguuccaaauuacaucuccauaaaauacucauugauucuacaaaggaaaaguauauuguugauuaagucuggugaauaauaucacaaucaagaaaucaagguuagcaucagagugaugaagucagagucauauccccuguguuaggacgugguaaaagaguacaagagcccuuuugugauacucccgaugcuuggucagaaucugaucauaugaaacaccagagaauucaaaguagguuguuacaauccuguauuaacaacugcccugaaaaugccaaguguccaaguuuuaaaggccagagggagcugugcuacccuccagaaugaaggucagcaguagggcccaacagcacauggugcugaagaugugaugagacgucuuugaugaacaaggucuauccaggaaaauacucuuauaucuuagauuuaauaagaauuugugcguauaugucugucuaucucuccaaccaucugucuguggucugcaugugcaugugcauaugugggaggccagaguuugaugcuggguaguguuuuccacuuuuguuguuguuauugagauagggccuuucacugaacuuguagauuucugauugacaaaacugcaagcccaagagauucucuugucucugcuccacagugcugggauuauagauauaugcuuuuacaucuggcuuuuuagugucaagggaucugagcuuggguccucauuuuggugacaagacaggcccuuuaccaauugagcccuauguuaugggacuuucauggggaauaguguggugcauaaagcuggguccgauuuuugaaaguucuuugcacugugcuuacaacuuuucauuauauuagcaauucuuucaagaggaaacaaaagguuuuuuuuuuuuuuaauaugagggaacuuacguaugcagaaaaagugacuugggguguuuugagauagcauguguuuuuauuuuaggaucuggguaaacaguacagaguuaguaaguuguguaaagccucagaugauagaggcguuuugaauguuuugcuagaaacaaugaguaguaauugcauaaguguuacaguaaucugcauuaaacccaguguggacauucagaaauugaaaauugugaauauuucauaugauggauguuaguaucugcugucuuaaaacaguuuaauucuguuccugucaggcucacuggugggcaguacugcuuaugggaauugcccugaucauguuaauggcuggauuuaucaagauuugcaguguucacacuccaaguaguaauccaaaguugccgccuccuaaaccacuuccagguaaggugcugagcgcugggugcugcugugagcagagccagagcugugggcagggaggacgcagccucaggaggcuuuaguuuaguaacugaguuuagagggcuguguuuuugauaaauugccugacaaaugauucacuggcuguguaauuguucgucaguccaaucuaguuauugacuaccauuguaaugcugaucuauccugagugccaagaaacauuugaccaacauuuugauuuuugguuggauccuccuuccuuguuuuugucucagucucuugccauaccuuguuuguguuacuguaguggaggugauuuuaaauuauuggccuuuguaucuaaauaguuaauggcucugauaccauuuguaaugucuguguucuugaaauaguuucugguaggaagcacauuuuccucugcaagaggcuuacugagaaauauaaguuugcauguagggagucuuagcuucagauguuaagaaccugucagauagucuccacccuucccucuggaggacacugccacuaggacaagucaacuuugagcauuugaagaagacagaaggggauggcuguuuuguugcaguuagucugaucaguuuccccuuccccucuccaagguguggcuagucauuacagguguggggaagacugccuaaggcaguggcagggaagccagggcugugugcuacuguguggccuccucaggagagccuugccucagagugguuucuucuacuuuguauuuccccucagcuguuccuugcauuuucccguguuaggacaagagugcccaggagucaugauggggguggaggaugucugauuugauauacuugcuuucuuaaguuuccuaagucagaacccaggcacuugugugaguugaacacauuuccaagagcuauaggacacuuuugaggcaugguugccaugguguccuucuucauuggagcagauaaugcacuuguguguugacaccucugaaaaugaucgucacuuguuaaaucuucauaaaagugcugacuuaaggacggcuuuaaagucuucaugauagacugugugaaugacuucccauccugcugugcagacaggccucaagagucugucagggcuccagucagagauucugcucucaaagcuaaaauaauucugacuggucagucuaauucuuuaaguacuugaaaugugccccaucuccacugagaugugcuguuaaauauuaaauauggaucagacuuaaagacaacauaaaauaguaaaauauuuuaguaauuuuuauauugaguacaugcuacaguugguauuuuuaacuugaauuggccuagauaaaauaaauauuaaaauuuauuuuuauuuuauuauggccaccagaaaacugaaaaguguuacgggguaccuauuucugcuggucagugccaaaaaauagcuuuucuuggugaaagagugcuucccuuuugaagauuaggagguggugcucagggagcuguuuugcuuucguugcaggcacuuuaaagaggaggagaccgccacagcccauucagcagcccccgcgucagaggccccgagagaguuaucaaaugggacacaugcgacgcuaaugcagcuuuugccuugguucuuccuagugccuacagugggaaaacuucacuccaaagagaaaccuguuaagucaucaucugcaaaugauacccuuacaguuaauaguugaagaaaaauggcaagagaucauguccucagaucagguggaauuacucaaaauuuaaagccugaaaauuccaauuuugggggugggggugggauggaaaaggaacccaauuuucuuaugaacagauauuuuuaaccuaauggcacaaagucuuagaauauuauuaugugccccauguucccuguucuucguugcugcauuuucuucacuugcagacagacuuggcucucgauaaacuuuuaucacaaauugaaauauauuuuuuucaacugccaaucaaggcugggaggcucgaccaccucaacauuggauacaucacuugccaauguacauaccuuguuauaugcagacauguauuucuuacguacacuguacuucucugugcaauuguaaacagaaauugcaauauggauguuucuuuguauuauaaauuuuuccgcucuuaaugaaaaauuacuguuuaauugacauacucaggauaacagagaaugguggugugcagugguccaggauucuguaaugcuuuaugcaggcaguuuugaaaugagaaucauuuucccuuuucuuaugguggaguugguucuuacauacauuuuuuuccuuguuacauggcugcugugagcaggagaggcugugcugaagaacgcagcugauggcuugcaaacuggacagcaacagcauuuggcuucagagucagcucuuuuuguagaugucugauuucugcuuaguauuuuauacuuucuaaaucaauuccauuuuuaaauugcuaggugaauuuuuucaugccuuggaauuauguuggaaaugauuaauuuucaucuguagccugcuuauuacuuuguguauuccauauacuucaagccugcuaauucuguuuuuauccaauaugaaaaagaaaaucagugucuucauugaaauacuuggacaguuaguucuucagcacugucacugaucacugguaaccacuagagaugggugauuugcucagcagguaguugaaauuguagauagguuuuucgacguuguuuuccccccaacauuuuagcaacaaugaagguagacagcacagugucccauuacaaacuucuuuuuuaagcagauaaaauauuggcuuuuuuaaagaaagagaaagcaaaagcauuuaauguauuaacaggcuuaucgcuaugcagaaaauggagggggcauuaaaaaauguaagcuugugacauauucauugcuucuguuuuccagcuacaucacuuaaauuagaagucagcagcagugaucuuccuggcuuuacauaggaggcaaucuagagaagguugacaagauuacuguguuuggcuuuuuuuuuuuuuuccuuuuuucuuaagagucuaagguuuacacaaucacucacaaugugacgcgagccagcaaggccaaaaccgcuagagaaacaaugggaucucuccuuguaaacuuguacaguacgcgggacuuuuuucaaaacagcuuuuuguacaugauuuagagacaaauuuuguacaugaaaccccagauagacuauaaauaauucuaacccaacaaguagguagcuguguaugacacugcuuuaaaucauucaaaugccuuuguuuuuggacugugcaaagguuggaaguggauuugcauuucuaaaauggugacuuuuauucugcaagaguucuuaguaacuucuugagugugguagacuuuggaacauguacauuuuuugcuuguaauguuauccugugguaggguuuugcccuauuuuauuuugagucuaaguuaaauguuuucugaagagauacaugcacugaacuguuuccacuacaaaucaagaugugguuaaaaaaugaaaggaccaggaccagugagaucuaauacuacugucaguuuaauguccacuguguuuuauacaguaucuuuuuuuuguuguucacuuuggaaauuuuuacuaaaaccugcaaaaaauaaaguauugugcaaagauguaagguuuuuugaaacuugaaaugcauuaauaaauagacuugaugaaaucaacuugaggucuaugcucuuuggacucagaaacaucagaaguagccaccaugcugaaugaaggacuauucagcagaaaggucucuccaugcaagugagggcaucacugcuacaguccagagccauggugcacaguugauugccauuaucacauguacacuguauguugaaaguuacucaacacaacggcuucucacuguuucuaagcaguguccaggacuuguccuagugaagagcugaagcuaacuggaaacuuguagucuucuuucuguguucucaaaguucugucugggugcuaagugcuuuuauuaaugucugauuuaucuggaugugguagugccuauccauaauuucaguacuguagaggcuaacguaggaggaucuggagagaaaagguaaaccuaggcuauaugcaagauuccuucccuaaacaauccugguaaagaaauuaccuagcaugcacguggaccuugucuucaauucauaacu

SEQ ID NO: 5180 - RNA, 8308 nt, Mus musculus
ugaagcagaaaagcaaggucaaagcuaaccugggcaucuuagugaaaccuugucucaaaaaucaggucaacugaugcuggugauguagcucagugguagagcacugcucagccuguguuaagcccuagguucaacccccagcuucacagaaaagaacaacauaaguucauuucuagaacagcucuggggacuggcaagauguaaugaacguccaagguguugcgcacaucaccaagcacugguuauauaaucauuucauaagauauccaacuguuuaaaagcuauagagcagccauaaaaugcauauugugguugagaugguugagauauaaaacauuuaacacaggaaauguuugcaaaacaugaagcaaacugauaauacauauaaaauggcuacacagaaagcagaucagaguacacucgacuauugacagacuaaguggucagcucaagggggacugacugcgacugcaugcuugaguguggucucuccuuuacagccuucuagaagcacuaguucauuccagauaaggaauauaaaacaauguguuuugaaaucaccuauuagcaguuuuaaaaccacagguuccauacuguucuuacagcaaccuuuucuucaugggagagauguggaaagugcugacagcuagaagcauccacuauggaaucaagcccuucccaguaugugucuaaucuaaauguguuuucaguccaacuucauguaugaacacugcuuuuaaagaacggaaacucaaacaaguaccaagaacacaucgccaugagcucggggagcugcucugauugguauuuuauuucuucuuuacaaguuccacguaauagacaaaggcuuuugauaacauacuguuaucuuugcucaaaacgaucauauaaucauuuuaaacaacacaaauguguacauacaugacugagguuucugcagccuauaaacaccucuuuggguuuaaaaaugaaaaaagcaauguacucacaagucaacuguaacucuuagaaaaacaucgguuuccuuaccaaacgugaacgcccuguacagggaccuaucaucgagacagcaaugaguucaagccaagggaggccaggagcagcuccccacaccagcucagaagacccucccccgcccagcaccucuucagcgcuccuuguccucauccuaggaagacagcagucaccccagagagacaggaucagccaaugcacuugcuguaacauuucugagugucuuccacaguguuucacauccagcaucucaggaacauguccaugcaggcacguggaccauucuuuacacuucauuucuugagcgagggaaccaggccuuccuaauucacuuuaggugccugggguaacaaaguauuucaccagaaaggguguaagcagcacuaucugauaagaguacagauaaggaaaaugcagcuaaagaaaacgugugcucuacucacacuaaaauaucagaccaaugcacaacauacugcaaaacuguaacacaauacggccaaauacaagguucacauauuaaacugugcaagcugugaagagcgucuucugaaagacaaacuggguucuuacuuuguagcuaccuuuguguaacuuaaaaaccugcugucccucaacaaggucugacgcuggucuugauacuuguuaggaaguucgaugagccaaugagagcucugcagccagcucucggggugucccagcccugucuucagcacucauccgaggacugggcaucagcuucgucccucacuucucgguaucucccugaagacuccccuucuggauuguagcucugcauuuuaauauucagucucucggccaguuucugugcugcgagcuuugccugcaucuccuuuaaaacaaacacaaaggccaaguuacacauccacagcuccccuuagauauguggcaggaccggaaauaaaggaacauuggcucccacugucucucuggcaacacaagcagcugacauuaguguccugucaagacauggggcaauguuuccgagagcugucagccugcugcaguucccagcugcaaucaaaacagcucaccuccacacaagacacugagaaaccagcuuggcacuacagcagccauuaauagacacacgaagugucgcguaugcagugaaccaccugccuuuguuagaaaucaccaauguggugcugacaucuuccacugacuuucuucucuagacuaaaucauguuuucuagauuugaaggacacaccaaaauggcacaaaaagagccaaaacauuaaugcugcaugcugaagucuuauagaaauuuauacuugaaaagguccacguaaauucagaugugcaguggacuuuuccacacacaagacuuuacuccaacugcuggcaggcuacacagcucaucugauucaccuucuguaccacccacacuucuguaccgcccauagcagguccuuccucucugcccacgauauauggguaggcauaauugguaucauaauuacuauucugucaaggcaacacaauucaagcugaggguugaaccuaaaaauguuucgagguuuuuuuuguuuuuuuuuuuaaaaagucguugggcugugguggcgcacaccuuuagucccagcacuugagaggcagaggcaggaggauuucuguggccagccuggucuacagagugaguuccaggacagucaaggcuacagagaaacccugucucgaaaaaggagggggaaaaaaaguccagagacaacucacaggucauuccucuggcacagcacuuggaucugaugcuaauuuuaguguacuaauguacugggaggaagaaacgcaacaggccauagagcuaucagucccagcaagcugaaugcuagggaaaagccaagguggagucagagauaguuugacuuugucagaugaaggcaccugauaaaguccagcugcacaggagaggggguacuguuuucccagaaacucaacucaguguuccaaucuaagauaacuaauccuuccaauucuccccacacuuacuucucccauccugcuaaucugagcacaaacuuuauuauagacagggucucaccaucuauaacucuggcuggccuagaacuugcuacauagacucccaacugcuacaauuaaagugcuaggacuaaaggucaauauacauuaaaaaaaaaaauucuaggcaaaacagugcuauauacaacugauuaagacccaaaguaggaggggccucuauucacagggaccaugaauuauggucucaagcuccuucucagcagcugguaacccagcacaaccucuugcccuucuguguuggccccugcucuguagauggacuggggggaacugucucuaugucucuacacaggacccugagugaggucuuaccaccaaggagccacacaugggagagaagcacaugcugucccaagcagcaguugccugauccccauaacuccaauucucuccccuggccuucugguaaaucacugagauuucuuguaguuccagcaaccuuguggcugaaaacuaguggcauaugucuaagagcuaauggccucagccaaccacaugucuagaauauaaucccucuauucagucaaaguaaauucugauuccuaaagcagcagucaacacacaggcaagaaaaacccaagacucuagaauuaccucauaauucugcuucugcucccucugcagggccagcgacucuucuauggaaagcagcugugcaggcaggugguggagcggaaggaggcgcgcugcugugauaucaucaagaugcugccuagcccuucgucgcugcucuucugaggaagcaggagacuggccccucugacaaugacuuggugagucacucuguuguguggguaaccugaaaaaaggaaaagcaggcuuaauccaugcacaagcacaauguuggucuuuaacgcagguaacccaggauucuacugcuucugcaagguuaacauaaagcaggcugcccauacuugcugcugaccguggguauauauacggauacaaaccugacuuucuaucuuccucucaccuuauauucauuucauucacucaaccuuccuaaugcugugacccuuuaauacaguuccuuguguuggggugaccccaacuagucauuuuuuuugcuacuuuguaacuguaacuuugcaacuguuauaugaaucauaauguaucggauaugcagaaugugauguacaccccugugaaagggauugagacucugcuagcacacucuuuccucacugugugcucaaaccuccacaagucaaugccacugcagugucuccugcagccucuccaggucucuucugugcacaggcugcucuuucucucaaacuuccuacuaauccugguaguccucgcugcucaucucucaccuucccuguuccuggccacacggcugugaccagaccaccuaacucuuucugacacuccuaguuuuuuaaugcaaccuccuagaagcgagacagacacagaagaugagaccccuucauccagaugccuucaccaaaggucacuuuccuagcuaaaaaauuaauguguuaugaccugguuucuaaauagaagaaaccauuuaaaguuaaaacaucaauagucaguggauuagguuuaagucucugcaacaacaaacacgaugugggucuucugacacuuucagcauuccuaagaaggaacacccacguucccucuuuugagucacccgggcucuauguaaagauguaaagaugggcaguuacccggcacuacuucccggcacuacuucccuacaaaugcaauucuuuucuccucaaaguuuuaguuguucuggugaucucagaaacauuacagcaaagcacucaaagcaagauucccagcccccaccccccaucuccccaaaucuaaguuuaguuuuauuuuuuagaaaaaaaaaaauccuuuuaaccuccuuucccugaaaaauugcuaucauuuaguuuaaaauuucuuccaaguuuguaaaccuugagugcucgagauuccaaucucuuuaaggaacagacucuuuacuucacugugucccacagcucuguugccuacuuauaaugagcacacaguuuuguuuuauuuuuuuucccauuagcuccugcaauugcuucucuuggcuuacacagcaacugagaggagagcugcacaccagcaaaugguacugaaagaagucaugguacaucugcccucccacucuguguuuauuaugaaauauugucuaagugucuugaaacacaagacuccccaucugcuauuuaaaacccuucuaaugacuugccuucaaaacuagcauuuuuuuuccaaaagcaguuuuccauucuagccccucuggucuacuuucacagacaguauggucaauccgacccacaugcuccucacaugacauccccucaacuaguaugacacuuugaacucuuuuucugagcuccacacacauucacucuuaugacaagccuguuccggugacacuuacacauuggucuuaaacuuaugaggagggggcacuggguuucuggcucgcauuucuagcacuuucauguaaugaggcuucuuaggagucucacucugcaguucuggaaaguucucagugcugguguuuucuucugaggguucacucuggucugcaauugugauuuuuugcaauuuagugaugaagagacugucgaugcugcuggagaucucuuccucuugacuugaaacagagugcugggggagaugcuccuuaacuucggaugagggcgcccgggcucggaugugggcagcugggcugcuguuuacuguguagccagccuccaaagucucuucauugccucugugagugagauguguaggucccuguguuucugagguugauuuagaugacuuaaugucuauugaggaacagucaggaucuaaugaugaaguaucaagcaucaggucagaacucugggccuugucuacaucggugucagcucuugugguugcuuuuugccuuagcuuacagucuacacuaacaggaugaaacaguucacuucucccucuaaccucuucacguucugaaauggcagcuuucaguuuggcaacugugucugagaucuuuuuaccuuugucgggcaauuugcaaaugaauuuucuguggaguggaaaaaaagaaaccagcacauacauauuacaggcauguuuuuaaacauggggaacacaguauuuaaaaggcaaaauggaaucaaagaaaagcuggcucuuaaaaguuuaaaaaaaauuuuuuuugauuuuuaaaaaaucuggcuuaagacaauaaccaaacacguaaaauuauucuaaccccucccccaagggagugcucugaaugggaaaugaaauucucucaggguggaaaguuucacaccugaccacaggaugaugagguguagucaaaacccaaacuaugagcagggcgugguggcgcacgccuuuaaucccagcacuugggaggcaaaggcaggcggauuuaugaguucgaggccagccuggucuacaaagugaauuccaggacagccagggcuacacagagaaacccugucuugaaccccucaacccgcccccccaagcuauaaggaacaugguauaaaauuaccuucaagccauguguaagaaacaacugaaacuuauauuuaaauuugggucuuaacucuacccauacauuccaagccuccuaaaaauauaaaauaauggucuuaagcacuuaggaaaacaugguuagccuguacaauaaauauaugauaaggaccaguggguuuuaagccauggucucugaaccccgaugaacugaggaaugccagagguuacauaaugggauaacaucacuaucuuacaaaggaagauggacuugcuuaugugguucuguguuugaaagaauucucaguugcuucuggcaaacugcuaauauuucuagacucagcauauauaaacaggaguucuuugagaugccaaauaacucuuaaagaguauaaaaauguuccaagaccagaagguuaauucacugcuaaaauuaacaacccaaucuugaaaagucaaaauaccuaccuguuucuaguaggaaccccuccugccaaauggucauuggcuccuuucccucagugacaaaaauucccuuucugguucuuuuccuugguuauauaacaaacaggagaagggggcuaaaccuuggguccucuauuuuuccugauacauuuauucccacguuuucaacaguauuaaugccucucugcaacugaguuccucucgguuuuuuucagccuucucucucuugugccuaauacucauuccucuggguuuuaaucgguuggcuuuuaauuaacuaaaugccugcaauuacucccucaacugaauacgcccaaaauaaaaaauuaaccuaaaauccaucccucucucccaauuuucccauuauucuuuguugcuccccagaaacuucaaccaccuguuaacuauuaauauauauuugucuccaaauuauuacaccaguucccccaaucccucgauugccuucaugguccauuuuucccuccuugcugaaaaaaaaaccucucagaaaauauccuuuuggcgucuuccuucaauccuguuccuaaacaaagcugccuuuaggcaaucagcuaucaucuucuccccacuacgcaugaaccaaacuuuccagcccgcucuccaaaucuaugguuggggaaagaguggggcuucagauagagagaaggaaaucccacacguuccgaucaagaggcuuugguaccggagcucguucaaagcuguagugcgaacaugaaaucgagcaggcgcggcugccgagugagggccgggcagcauggagccaugcccgcgcacaggacaggccuggcucgggaggccuggccacgcaaggucaccuucgcgcgccaggccgcggggcggggcgggagaccaaguccccggaucccgaucccugagagccuguucccugaucccgaucccccgcaaccgcgaccccagggccaccgcuuacucguugcgcaaaagucucuccuggcgccucaaccucucccgcagcuccgccgaacucugccgccccaaguccucgggagcugggggcucgaagccgcggggcagcgagaacauugcgcacgggcugcggcuggcgcggcgggcagggauccccggcggggcccacggcgggcgcuggcuccgcggccggcggcgacucuggagcgcgagcgggagucgccauuuucccggaagagcacggcuucuccgagccgaagggagcuuuauugaaaugccggaaacggacaggccaggacgagggg
